United States Patent 8,969,254 (OLIGONUCLEOTIDE ARRAY FOR TISSUE TYPING) - sequence listing, part 15

SEQ ID NO: 337217 - DNA, 24 bp, Artificial Sequence
  Description of Artificial Sequence: Synthetic oligonucleotide
cggggtccgagcaaccacagcaga

SEQ ID NO: 337218 - DNA, 24 bp, Artificial Sequence
  Description of Artificial Sequence: Synthetic oligonucleotide
ggggtccgagcaaccacagcagac

SEQ ID NO: 337219 - DNA, 24 bp, Artificial Sequence
  Description of Artificial Sequence: Synthetic oligonucleotide
gggtccgagcaaccacagcagacc

SEQ ID NO: 337220 - DNA, 24 bp, Artificial Sequence
  Description of Artificial Sequence: Synthetic oligonucleotide
ggtccgagcaaccacagcagaccg

SEQ ID NO: 337221 - DNA, 24 bp, Artificial Sequence
  Description of Artificial Sequence: Synthetic oligonucleotide
gtccgagcaaccacagcagaccgc

SEQ ID NO: 337222 - DNA, 24 bp, Artificial Sequence
  Description of Artificial Sequence: Synthetic oligonucleotide
tccgagcaaccacagcagaccgcc

SEQ ID NO: 337223 - DNA, 23 bp, Artificial Sequence
  Description of Artificial Sequence: Synthetic oligonucleotide
ccgagcaaccacagcagaccgcc

SEQ ID NO: 337224 - DNA, 25 bp, Artificial Sequence
  Description of Artificial Sequence: Synthetic oligonucleotide
cgagcaaccacagcagaccgccctt

SEQ ID NO: 337225 - DNA, 26 bp, Artificial Sequence
  Description of Artificial Sequence: Synthetic oligonucleotide
gagcaaccacagcagaccgcccttct

SEQ ID NO: 337226 - DNA, 27 bp, Artificial Sequence
  Description of Artificial Sequence: Synthetic oligonucleotide
agcaaccacagcagaccgcccttctca

SEQ ID NO: 337227 - DNA, 27 bp, Artificial Sequence
  Description of Artificial Sequence: Synthetic oligonucleotide
gcaaccacagcagaccgcccttctcat

SEQ ID NO: 337228 - DNA, 27 bp, Artificial Sequence
  Description of Artificial Sequence: Synthetic oligonucleotide
caaccacagcagaccgcccttctcatc

SEQ ID NO: 337229 - DNA, 27 bp, Artificial Sequence
  Description of Artificial Sequence: Synthetic oligonucleotide
aaccacagcagaccgcccttctcatcg

SEQ ID NO: 337230 - DNA, 26 bp, Artificial Sequence
  Description of Artificial Sequence: Synthetic oligonucleotide
accacagcagaccgcccttctcatcg

SEQ ID NO: 337231 - DNA, 25 bp, Artificial Sequence
  Description of Artificial Sequence: Synthetic oligonucleotide
ccacagcagaccgcccttctcatcg

SEQ ID NO: 337232 - DNA, 26 bp, Artificial Sequence
  Description of Artificial Sequence: Synthetic oligonucleotide
cacagcagaccgcccttctcatcgga

SEQ ID NO: 337233 - DNA, 26 bp, Artificial Sequence
  Description of Artificial Sequence: Synthetic oligonucleotide
acagcagaccgcccttctcatcggag

SEQ ID NO: 337234 - DNA, 25 bp, Artificial Sequence
  Description of Artificial Sequence: Synthetic oligonucleotide
cagcagaccgcccttctcatcggag

SEQ ID NO: 337235 - DNA, 26 bp, Artificial Sequence
  Description of Artificial Sequence: Synthetic oligonucleotide
agcagaccgcccttctcatcggaggt

SEQ ID NO: 337236 - DNA, 25 bp, Artificial Sequence
  Description of Artificial Sequence: Synthetic oligonucleotide
gcagaccgcccttctcatcggaggt

SEQ ID NO: 337237 - DNA, 25 bp, Artificial Sequence
  Description of Artificial Sequence: Synthetic oligonucleotide
cagaccgcccttctcatcggaggtg

SEQ ID NO: 337238 - DNA, 25 bp, Artificial Sequence
  Description of Artificial Sequence: Synthetic oligonucleotide
agaccgcccttctcatcggaggtgc

SEQ ID NO: 337239 - DNA, 24 bp, Artificial Sequence
  Description of Artificial Sequence: Synthetic oligonucleotide
gaccgcccttctcatcggaggtgc

SEQ ID NO: 337240 - DNA, 25 bp, Artificial Sequence
  Description of Artificial Sequence: Synthetic oligonucleotide
accgcccttctcatcggaggtgcca

SEQ ID NO: 337241 - DNA, 24 bp, Artificial Sequence
  Description of Artificial Sequence: Synthetic oligonucleotide
ccgcccttctcatcggaggtgcca

SEQ ID NO: 337242 - DNA, 24 bp, Artificial Sequence
  Description of Artificial Sequence: Synthetic oligonucleotide
cgcccttctcatcggaggtgccac

SEQ ID NO: 337243 - DNA, 24 bp, Artificial Sequence
  Description of Artificial Sequence: Synthetic oligonucleotide
gcccttctcatcggaggtgccacc

SEQ ID NO: 337244 - DNA, 24 bp, Artificial Sequence
  Description of Artificial Sequence: Synthetic oligonucleotide
cccttctcatcggaggtgccaccg

SEQ ID NO: 337245 - DNA, 25 bp, Artificial Sequence
  Description of Artificial Sequence: Synthetic oligonucleotide
ccttctcatcggaggtgccaccgga

SEQ ID NO: 337246 - DNA, 25 bp, Artificial Sequence
  Description of Artificial Sequence: Synthetic oligonucleotide
cttctcatcggaggtgccaccggag

SEQ ID NO: 337247 - DNA, 26 bp, Artificial Sequence
  Description of Artificial Sequence: Synthetic oligonucleotide
ttctcatcggaggtgccaccggagga

SEQ ID NO: 337248 - DNA, 25 bp, Artificial Sequence
  Description of Artificial Sequence: Synthetic oligonucleotide
tctcatcggaggtgccaccggagga

SEQ ID NO: 337249 - DNA, 24 bp, Artificial Sequence
  Description of Artificial Sequence: Synthetic oligonucleotide
ctcatcggaggtgccaccggagga

SEQ ID NO: 337250 - DNA, 24 bp, Artificial Sequence
  Description of Artificial Sequence: Synthetic oligonucleotide
tcatcggaggtgccaccggaggag

SEQ ID NO: 337251 - DNA, 23 bp, Artificial Sequence
  Description of Artificial Sequence: Synthetic oligonucleotide
catcggaggtgccaccggaggag

SEQ ID NO: 337252 - DNA, 23 bp, Artificial Sequence
  Description of Artificial Sequence: Synthetic oligonucleotide
atcggaggtgccaccggaggagg

SEQ ID NO: 337253 - DNA, 22 bp, Artificial Sequence
  Description of Artificial Sequence: Synthetic oligonucleotide
tcggaggtgccaccggaggagg

SEQ ID NO: 337254 - DNA, 21 bp, Artificial Sequence
  Description of Artificial Sequence: Synthetic oligonucleotide
cggaggtgccaccggaggagg

SEQ ID NO: 337255 - DNA, 22 bp, Artificial Sequence
  Description of Artificial Sequence: Synthetic oligonucleotide
ggaggtgccaccggaggaggca

SEQ ID NO: 337256 - DNA, 22 bp, Artificial Sequence
  Description of Artificial Sequence: Synthetic oligonucleotide
gaggtgccaccggaggaggcag

SEQ ID NO: 337257 - DNA, 22 bp, Artificial Sequence
  Description of Artificial Sequence: Synthetic oligonucleotide
aggtgccaccggaggaggcagg

SEQ ID NO: 337258 - DNA, 21 bp, Artificial Sequence
  Description of Artificial Sequence: Synthetic oligonucleotide
ggtgccaccggaggaggcagg

SEQ ID NO: 337259 - DNA, 21 bp, Artificial Sequence
  Description of Artificial Sequence: Synthetic oligonucleotide
gtgccaccggaggaggcaggg

SEQ ID NO: 337260 - DNA, 22 bp, Artificial Sequence
  Description of Artificial Sequence: Synthetic oligonucleotide
tgccaccggaggaggcaggggt

SEQ ID NO: 337261 - DNA, 21 bp, Artificial Sequence
  Description of Artificial Sequence: Synthetic oligonucleotide
gccaccggaggaggcaggggt

SEQ ID NO: 337262 - DNA, 21 bp, Artificial Sequence
  Description of Artificial Sequence: Synthetic oligonucleotide
ccaccggaggaggcaggggtg

SEQ ID NO: 337263 - DNA, 21 bp, Artificial Sequence
  Description of Artificial Sequence: Synthetic oligonucleotide
caccggaggaggcaggggtgg

SEQ ID NO: 337264 - DNA, 22 bp, Artificial Sequence
  Description of Artificial Sequence: Synthetic oligonucleotide
accggaggaggcaggggtggga

SEQ ID NO: 337265 - DNA, 21 bp, Artificial Sequence
  Description of Artificial Sequence: Synthetic oligonucleotide
ccggaggaggcaggggtggga

SEQ ID NO: 337266 - DNA, 21 bp, Artificial Sequence
  Description of Artificial Sequence: Synthetic oligonucleotide
cggaggaggcaggggtgggag

SEQ ID NO: 337267 - DNA, 21 bp, Artificial Sequence
  Description of Artificial Sequence: Synthetic oligonucleotide
ggaggaggcaggggtgggagc

SEQ ID NO: 337268 - DNA, 21 bp, Artificial Sequence
  Description of Artificial Sequence: Synthetic oligonucleotide
gaggaggcaggggtgggagcg

SEQ ID NO: 337269 - DNA, 21 bp, Artificial Sequence
  Description of Artificial Sequence: Synthetic oligonucleotide
aggaggcaggggtgggagcgg

SEQ ID NO: 337270 - DNA, 20 bp, Artificial Sequence
  Description of Artificial Sequence: Synthetic oligonucleotide
ggaggcaggggtgggagcgg

SEQ ID NO: 337271 - DNA, 20 bp, Artificial Sequence
  Description of Artificial Sequence: Synthetic oligonucleotide
gaggcaggggtgggagcggg

SEQ ID NO: 337272 - DNA, 20 bp, Artificial Sequence
  Description of Artificial Sequence: Synthetic oligonucleotide
aggcaggggtgggagcgggg

SEQ ID NO: 337273 - DNA, 20 bp, Artificial Sequence
  Description of Artificial Sequence: Synthetic oligonucleotide
ggcaggggtgggagcggggt

SEQ ID NO: 337274 - DNA, 20 bp, Artificial Sequence
  Description of Artificial Sequence: Synthetic oligonucleotide
gcaggggtgggagcgggggt

SEQ ID NO: 337275 - DNA, 21 bp, Artificial Sequence
  Description of Artificial Sequence: Synthetic oligonucleotide
caggggtgggagcgggggcat

SEQ ID NO: 337276 - DNA, 21 bp, Artificial Sequence
  Description of Artificial Sequence: Synthetic oligonucleotide
aggggtgggagcgggggcatc

SEQ ID NO: 337277 - DNA, 20 bp, Artificial Sequence
  Description of Artificial Sequence: Synthetic oligonucleotide
ggggtgggagcgggggcatc

SEQ ID NO: 337278 - DNA, 20 bp, Artificial Sequence
  Description of Artificial Sequence: Synthetic oligonucleotide
gggtgggagcgggggcatcg

SEQ ID NO: 337279 - DNA, 21 bp, Artificial Sequence
  Description of Artificial Sequence: Synthetic oligonucleotide
ggtgggagcgggggcatcgga

SEQ ID NO: 337280 - DNA, 22 bp, Artificial Sequence
  Description of Artificial Sequence: Synthetic oligonucleotide
gtgggagcgggggcatcggaga

SEQ ID NO: 337281 - DNA, 22 bp, Artificial Sequence
  Description of Artificial Sequence: Synthetic oligonucleotide
tgggagcgggggcatcggagac

SEQ ID NO: 337282 - DNA, 21 bp, Artificial Sequence
  Description of Artificial Sequence: Synthetic oligonucleotide
gggagcgggggcatcggagac

SEQ ID NO: 337283 - DNA, 22 bp, Artificial Sequence
  Description of Artificial Sequence: Synthetic oligonucleotide
ggagcgggggcatcggagacgt

SEQ ID NO: 337284 - DNA, 23 bp, Artificial Sequence
  Description of Artificial Sequence: Synthetic oligonucleotide
gagcgggggcatcggagacgtgt

SEQ ID NO: 337285 - DNA, 23 bp, Artificial Sequence
  Description of Artificial Sequence: Synthetic oligonucleotide
agcgggggcatcggagacgtgtg

SEQ ID NO: 337286 - DNA, 22 bp, Artificial Sequence
  Description of Artificial Sequence: Synthetic oligonucleotide
gcgggggcatcggagacgtgtg

SEQ ID NO: 337287 - DNA, 23 bp, Artificial Sequence
  Description of Artificial Sequence: Synthetic oligonucleotide
cgggggcatcggagacgtgtgct

SEQ ID NO: 337288 - DNA, 24 bp, Artificial Sequence
  Description of Artificial Sequence: Synthetic oligonucleotide
gggggcatcggagacgtgtgctga

SEQ ID NO: 337289 - DNA, 27 bp, Artificial Sequence
  Description of Artificial Sequence: Synthetic oligonucleotide
atggggtctgtgttccctcagtcgctg

SEQ ID NO: 337290 - DNA, 26 bp, Artificial Sequence
  Description of Artificial Sequence: Synthetic oligonucleotide
tggggtctgtgttccctcagtcgctg

SEQ ID NO: 337291 - DNA, 25 bp, Artificial Sequence
  Description of Artificial Sequence: Synthetic oligonucleotide
ggggtctgtgttccctcagtcgctg

SEQ ID NO: 337292 - DNA, 26 bp, Artificial Sequence
  Description of Artificial Sequence: Synthetic oligonucleotide
gggtctgtgttccctcagtcgctgct

SEQ ID NO: 337293 - DNA, 27 bp, Artificial Sequence
  Description of Artificial Sequence: Synthetic oligonucleotide
ggtctgtgttccctcagtcgctgctct

SEQ ID NO: 337294 - DNA, 34 bp, Artificial Sequence
  Description of Artificial Sequence: Synthetic oligonucleotide
gtctgtgttccctcagtcgctgctcttttttttg

SEQ ID NO: 337295 - DNA, 34 bp, Artificial Sequence
  Description of Artificial Sequence: Synthetic oligonucleotide
tctgtgttccctcagtcgctgctcttttttttgc

SEQ ID NO: 337296 - DNA, 33 bp, Artificial Sequence
  Description of Artificial Sequence: Synthetic oligonucleotide
ctgtgttccctcagtcgctgctcttttttttgc

SEQ ID NO: 337297 - DNA, 33 bp, Artificial Sequence
  Description of Artificial Sequence: Synthetic oligonucleotide
tgtgttccctcagtcgctgctcttttttttgcc

SEQ ID NO: 337298 - DNA, 32 bp, Artificial Sequence
  Description of Artificial Sequence: Synthetic oligonucleotide
gtgttccctcagtcgctgctcttttttttgcc

SEQ ID NO: 337299 - DNA, 32 bp, Artificial Sequence
  Description of Artificial Sequence: Synthetic oligonucleotide
tgttccctcagtcgctgctcttttttttgccg

SEQ ID NO: 337300 - DNA, 31 bp, Artificial Sequence
  Description of Artificial Sequence: Synthetic oligonucleotide
gttccctcagtcgctgctcttttttttgccg

SEQ ID NO: 337301 - DNA, 31 bp, Artificial Sequence
  Description of Artificial Sequence: Synthetic oligonucleotide
ttccctcagtcgctgctcttttttttgccgg

SEQ ID NO: 337302 - DNA, 30 bp, Artificial Sequence
  Description of Artificial Sequence: Synthetic oligonucleotide
tccctcagtcgctgctcttttttttgccgg

SEQ ID NO: 337303 - DNA, 29 bp, Artificial Sequence
  Description of Artificial Sequence: Synthetic oligonucleotide
ccctcagtcgctgctcttttttttgccgg

SEQ ID NO: 337304 - DNA, 29 bp, Artificial Sequence
  Description of Artificial Sequence: Synthetic oligonucleotide
cctcagtcgctgctcttttttttgccggc

SEQ ID NO: 337305 - DNA, 29 bp, Artificial Sequence
  Description of Artificial Sequence: Synthetic oligonucleotide
ctcagtcgctgctcttttttttgccggcc

SEQ ID NO: 337306 - DNA, 29 bp, Artificial Sequence
  Description of Artificial Sequence: Synthetic oligonucleotide
tcagtcgctgctcttttttttgccggccg

SEQ ID NO: 337307 - DNA, 28 bp, Artificial Sequence
  Description of Artificial Sequence: Synthetic oligonucleotide
cagtcgctgctcttttttttgccggccg

SEQ ID NO: 337308 - DNA, 28 bp, Artificial Sequence
  Description of Artificial Sequence: Synthetic oligonucleotide
agtcgctgctcttttttttgccggccgc

SEQ ID NO: 337309 - DNA, 27 bp, Artificial Sequence
  Description of Artificial Sequence: Synthetic oligonucleotide
gtcgctgctcttttttttgccggccgc

SEQ ID NO: 337310 - DNA, 27 bp, Artificial Sequence
  Description of Artificial Sequence: Synthetic oligonucleotide
tcgctgctcttttttttgccggccgcc

SEQ ID NO: 337311 - DNA, 27 bp, Artificial Sequence
  Description of Artificial Sequence: Synthetic oligonucleotide
cgctgctcttttttttgccggccgcct

SEQ ID NO: 337312 - DNA, 28 bp, Artificial Sequence
  Description of Artificial Sequence: Synthetic oligonucleotide
gctgctcttttttttgccggccgccttc

SEQ ID NO: 337313 - DNA, 28 bp, Artificial Sequence
  Description of Artificial Sequence: Synthetic oligonucleotide
ctgctcttttttttgccggccgccttcc

SEQ ID NO: 337314 - DNA, 28 bp, Artificial Sequence
  Description of Artificial Sequence: Synthetic oligonucleotide
tgctcttttttttgccggccgccttccc

SEQ ID NO: 337315 - DNA, 27 bp, Artificial Sequence
  Description of Artificial Sequence: Synthetic oligonucleotide
gctcttttttttgccggccgccttccc

SEQ ID NO: 337316 - DNA, 27 bp, Artificial Sequence
  Description of Artificial Sequence: Synthetic oligonucleotide
ctcttttttttgccggccgccttcccg

SEQ ID NO: 337317 - DNA, 27 bp, Artificial Sequence
  Description of Artificial Sequence: Synthetic oligonucleotide
tcttttttttgccggccgccttcccgg

SEQ ID NO: 337318 - DNA, 26 bp, Artificial Sequence
  Description of Artificial Sequence: Synthetic oligonucleotide
cttttttttgccggccgccttcccgg

SEQ ID NO: 337319 - DNA, 27 bp, Artificial Sequence
  Description of Artificial Sequence: Synthetic oligonucleotide
ttttttttgccggccgccttcccggga

SEQ ID NO: 337320 - DNA, 26 bp, Artificial Sequence
  Description of Artificial Sequence: Synthetic oligonucleotide
tttttttgccggccgccttcccggga

SEQ ID NO: 337321 - DNA, 25 bp, Artificial Sequence
  Description of Artificial Sequence: Synthetic oligonucleotide
ttttttgccggccgccttcccggga

SEQ ID NO: 337322 - DNA, 24 bp, Artificial Sequence
  Description of Artificial Sequence: Synthetic oligonucleotide
tttttgccggccgccttcccggga

SEQ ID NO: 337323 - DNA, 23 bp, Artificial Sequence
  Description of Artificial Sequence: Synthetic oligonucleotide
ttttgccggccgccttcccggga

SEQ ID NO: 337324 - DNA, 22 bp, Artificial Sequence
  Description of Artificial Sequence: Synthetic oligonucleotide
tttgccggccgccttcccggga

SEQ ID NO: 337325 - DNA, 21 bp, Artificial Sequence
  Description of Artificial Sequence: Synthetic oligonucleotide
ttgccggccgccttcccggga

SEQ ID NO: 337326 - DNA, 20 bp, Artificial Sequence
  Description of Artificial Sequence: Synthetic oligonucleotide
tgccggccgccttcccggga

SEQ ID NO: 337327 - DNA, 20 bp, Artificial Sequence
  Description of Artificial Sequence: Synthetic oligonucleotide
gccggccgccttcccgggat

SEQ ID NO: 337328 - DNA, 21 bp, Artificial Sequence
  Description of Artificial Sequence: Synthetic oligonucleotide
ccggccgccttcccgggagta

SEQ ID NO: 337329 - DNA, 21 bp, Artificial Sequence
  Description of Artificial Sequence: Synthetic oligonucleotide
cggccgccttcccgggagtag

SEQ ID NO: 337330 - DNA, 21 bp, Artificial Sequence
  Description of Artificial Sequence: Synthetic oligonucleotide
ggccgccttcccgggagtagg

SEQ ID NO: 337331 - DNA, 22 bp, Artificial Sequence
  Description of Artificial Sequence: Synthetic oligonucleotide
gccgccttcccgggagtaggga

SEQ ID NO: 337332 - DNA, 22 bp, Artificial Sequence
  Description of Artificial Sequence: Synthetic oligonucleotide
ccgccttcccgggagtagggag

SEQ ID NO: 337333 - DNA, 22 bp, Artificial Sequence
  Description of Artificial Sequence: Synthetic oligonucleotide
cgccttcccgggagtagggagc

SEQ ID NO: 337334 - DNA, 22 bp, Artificial Sequence
  Description of Artificial Sequence: Synthetic oligonucleotide
gccttcccgggagtagggagcg

SEQ ID NO: 337335 - DNA, 22 bp, Artificial Sequence
  Description of Artificial Sequence: Synthetic oligonucleotide
ccttcccgggagtagggagcgc

SEQ ID NO: 337336 - DNA, 22 bp, Artificial Sequence
  Description of Artificial Sequence: Synthetic oligonucleotide
cttcccgggagtagggagcgcg

SEQ ID NO: 337337 - DNA, 23 bp, Artificial Sequence
  Description of Artificial Sequence: Synthetic oligonucleotide
ttcccgggagtagggagcgcggt

SEQ ID NO: 337338 - DNA, 22 bp, Artificial Sequence
  Description of Artificial Sequence: Synthetic oligonucleotide
tcccgggagtagggagcgcggt

SEQ ID NO: 337339 - DNA, 21 bp, Artificial Sequence
  Description of Artificial Sequence: Synthetic oligonucleotide
cccgggagtagggagcgcggt

SEQ ID NO: 337340 - DNA, 21 bp, Artificial Sequence
  Description of Artificial Sequence: Synthetic oligonucleotide
ccgggagtagggagcgcggtg

SEQ ID NO: 337341 - DNA, 21 bp, Artificial Sequence
  Description of Artificial Sequence: Synthetic oligonucleotide
cgggagtagggagcgcggtgg

SEQ ID NO: 337342 - DNA, 22 bp, Artificial Sequence
  Description of Artificial Sequence: Synthetic oligonucleotide
gggagtagggagcgcggtggga

SEQ ID NO: 337343 - DNA, 22 bp, Artificial Sequence
  Description of Artificial Sequence: Synthetic oligonucleotide
ggagtagggagcgcggtgggac

SEQ ID NO: 337344 - DNA, 22 bp, Artificial Sequence
  Description of Artificial Sequence: Synthetic oligonucleotide
gagtagggagcgcggtgggacg

SEQ ID NO: 337345 - DNA, 22 bp, Artificial Sequence
  Description of Artificial Sequence: Synthetic oligonucleotide
agtagggagcgcggtgggacgc

SEQ ID NO: 337346 - DNA, 21 bp, Artificial Sequence
  Description of Artificial Sequence: Synthetic oligonucleotide
gtagggagcgcggtgggacgc

SEQ ID NO: 337347 - DNA, 21 bp, Artificial Sequence
  Description of Artificial Sequence: Synthetic oligonucleotide
tagggagcgcggtgggacgcc

SEQ ID NO: 337348 - DNA, 20 bp, Artificial Sequence
  Description of Artificial Sequence: Synthetic oligonucleotide
agggagcgcggtgggacgcc

SEQ ID NO: 337349 - DNA, 20 bp, Artificial Sequence
  Description of Artificial Sequence: Synthetic oligonucleotide
gggagcgcggtgggacgcct

SEQ ID NO: 337350 - DNA, 20 bp, Artificial Sequence
  Description of Artificial Sequence: Synthetic oligonucleotide
ggagcgcggtgggacgccct

SEQ ID NO: 337351 - DNA, 20 bp, Artificial Sequence
  Description of Artificial Sequence: Synthetic oligonucleotide
gagcgcggtgggacgcccga

SEQ ID NO: 337352 - DNA, 23 bp, Artificial Sequence
  Description of Artificial Sequence: Synthetic oligonucleotide
agcgcggtgggacgcccgactaa

SEQ ID NO: 337353 - DNA, 22 bp, Artificial Sequence
  Description of Artificial Sequence: Synthetic oligonucleotide
gcgcggtgggacgcccgactaa

SEQ ID NO: 337354 - DNA, 22 bp, Artificial Sequence
  Description of Artificial Sequence: Synthetic oligonucleotide
cgcggtgggacgcccgactaag

SEQ ID NO: 337355 - DNA, 22 bp, Artificial Sequence
  Description of Artificial Sequence: Synthetic oligonucleotide
gcggtgggacgcccgactaagc

SEQ ID NO: 337356 - DNA, 22 bp, Artificial Sequence
  Description of Artificial Sequence: Synthetic oligonucleotide
cggtgggacgcccgactaagcg

SEQ ID NO: 337357 - DNA, 22 bp, Artificial Sequence
  Description of Artificial Sequence: Synthetic oligonucleotide
ggtgggacgcccgactaagcgc

SEQ ID NO: 337358 - DNA, 22 bp, Artificial Sequence
  Description of Artificial Sequence: Synthetic oligonucleotide
gtgggacgcccgactaagcgcg

SEQ ID NO: 337359 - DNA, 22 bp, Artificial Sequence
  Description of Artificial Sequence: Synthetic oligonucleotide
tgggacgcccgactaagcgcgc

SEQ ID NO: 337360 - DNA, 21 bp, Artificial Sequence
  Description of Artificial Sequence: Synthetic oligonucleotide
gggacgcccgactaagcgcgc

SEQ ID NO: 337361 - DNA, 21 bp, Artificial Sequence
  Description of Artificial Sequence: Synthetic oligonucleotide
ggacgcccgactaagcgcgcg

SEQ ID NO: 337362 - DNA, 24 bp, Artificial Sequence
  Description of Artificial Sequence: Synthetic oligonucleotide
gacgcccgactaagcgcgcgcaaa

SEQ ID NO: 337363 - DNA, 24 bp, Artificial Sequence
  Description of Artificial Sequence: Synthetic oligonucleotide
acgcccgactaagcgcgcgcaaag

SEQ ID NO: 337364 - DNA, 23 bp, Artificial Sequence
  Description of Artificial Sequence: Synthetic oligonucleotide
cgcccgactaagcgcgcgcaaag

SEQ ID NO: 337365 - DNA, 23 bp, Artificial Sequence
  Description of Artificial Sequence: Synthetic oligonucleotide
gcccgactaagcgcgcgcaaagc

SEQ ID NO: 337366 - DNA, 23 bp, Artificial Sequence
  Description of Artificial Sequence: Synthetic oligonucleotide
cccgactaagcgcgcgcaaagcg

SEQ ID NO: 337367 - DNA, 23 bp, Artificial Sequence
  Description of Artificial Sequence: Synthetic oligonucleotide
ccgactaagcgcgcgcaaagcgc

SEQ ID NO: 337368 - DNA, 25 bp, Artificial Sequence
  Description of Artificial Sequence: Synthetic oligonucleotide
cgactaagcgcgcgcaaagcgccaa

SEQ ID NO: 337369 - DNA, 25 bp, Artificial Sequence
  Description of Artificial Sequence: Synthetic oligonucleotide
gactaagcgcgcgcaaagcgccaag

SEQ ID NO: 337370 - DNA, 25 bp, Artificial Sequence
  Description of Artificial Sequence: Synthetic oligonucleotide
actaagcgcgcgcaaagcgccaagg

SEQ ID NO: 337371 - DNA, 24 bp, Artificial Sequence
  Description of Artificial Sequence: Synthetic oligonucleotide
ctaagcgcgcgcaaagcgccaagg

SEQ ID NO: 337372 - DNA, 26 bp, Artificial Sequence
  Description of Artificial Sequence: Synthetic oligonucleotide
taagcgcgcgcaaagcgccaagggta

SEQ ID NO: 337373 - DNA, 25 bp, Artificial Sequence
  Description of Artificial Sequence: Synthetic oligonucleotide
aagcgcgcgcaaagcgccaagggta

SEQ ID NO: 337374 - DNA, 24 bp, Artificial Sequence
  Description of Artificial Sequence: Synthetic oligonucleotide
agcgcgcgcaaagcgccaagggta

SEQ ID NO: 337375 - DNA, 23 bp, Artificial Sequence
  Description of Artificial Sequence: Synthetic oligonucleotide
gcgcgcgcaaagcgccaagggta

SEQ ID NO: 337376 - DNA, 23 bp, Artificial Sequence
  Description of Artificial Sequence: Synthetic oligonucleotide
cgcgcgcaaagcgccaagggtac

SEQ ID NO: 337377 - DNA, 23 bp, Artificial Sequence
  Description of Artificial Sequence: Synthetic oligonucleotide
gcgcgcaaagcgccaagggtacc

SEQ ID NO: 337378 - DNA, 23 bp, Artificial Sequence
  Description of Artificial Sequence: Synthetic oligonucleotide
cgcgcaaagcgccaagggtaccc

SEQ ID NO: 337379 - DNA, 24 bp, Artificial Sequence
  Description of Artificial Sequence: Synthetic oligonucleotide
gcgcaaagcgccaagggtacccct

SEQ ID NO: 337380 - DNA, 25 bp, Artificial Sequence
  Description of Artificial Sequence: Synthetic oligonucleotide
cgcaaagcgccaagggtacccctct

SEQ ID NO: 337381 - DNA, 25 bp, Artificial Sequence
  Description of Artificial Sequence: Synthetic oligonucleotide
gcaaagcgccaagggtacccctctc

SEQ ID NO: 337382 - DNA, 25 bp, Artificial Sequence
  Description of Artificial Sequence: Synthetic oligonucleotide
caaagcgccaagggtacccctctcg

SEQ ID NO: 337383 - DNA, 25 bp, Artificial Sequence
  Description of Artificial Sequence: Synthetic oligonucleotide
aaagcgccaagggtacccctctcgc

SEQ ID NO: 337384 - DNA, 24 bp, Artificial Sequence
  Description of Artificial Sequence: Synthetic oligonucleotide
aagcgccaagggtacccctctcgc

SEQ ID NO: 337385 - DNA, 23 bp, Artificial Sequence
  Description of Artificial Sequence: Synthetic oligonucleotide
agcgccaagggtacccctctcgc

SEQ ID NO: 337386 - DNA, 22 bp, Artificial Sequence
  Description of Artificial Sequence: Synthetic oligonucleotide
gcgccaagggtacccctctcgc

SEQ ID NO: 337387 - DNA, 22 bp, Artificial Sequence
  Description of Artificial Sequence: Synthetic oligonucleotide
cgccaagggtacccctctcgcc

SEQ ID NO: 337388 - DNA, 22 bp, Artificial Sequence
  Description of Artificial Sequence: Synthetic oligonucleotide
gccaagggtacccctctcgccc

SEQ ID NO: 337389 - DNA, 22 bp, Artificial Sequence
  Description of Artificial Sequence: Synthetic oligonucleotide
ccaagggtacccctctcgcccc

SEQ ID NO: 337390 - DNA, 23 bp, Artificial Sequence
  Description of Artificial Sequence: Synthetic oligonucleotide
caagggtacccctctcgccccct

SEQ ID NO: 337391 - DNA, 23 bp, Artificial Sequence
  Description of Artificial Sequence: Synthetic oligonucleotide
aagggtacccctctcgccccctc

SEQ ID NO: 337392 - DNA, 22 bp, Artificial Sequence
  Description of Artificial Sequence: Synthetic oligonucleotide
agggtacccctctcgccccctc

SEQ ID NO: 337393 - DNA, 21 bp, Artificial Sequence
  Description of Artificial Sequence: Synthetic oligonucleotide
gggtacccctctcgccccctc

SEQ ID NO: 337394 - DNA, 21 bp, Artificial Sequence
  Description of Artificial Sequence: Synthetic oligonucleotide
ggtacccctctcgccccctcc

SEQ ID NO: 337395 - DNA, 21 bp, Artificial Sequence
  Description of Artificial Sequence: Synthetic oligonucleotide
gtacccctctcgccccctccg

SEQ ID NO: 337396 - DNA, 21 bp, Artificial Sequence
  Description of Artificial Sequence: Synthetic oligonucleotide
tacccctctcgccccctccgg

SEQ ID NO: 337397 - DNA, 20 bp, Artificial Sequence
  Description of Artificial Sequence: Synthetic oligonucleotide
acccctctcgccccctccgg

SEQ ID NO: 337398 - DNA, 20 bp, Artificial Sequence
  Description of Artificial Sequence: Synthetic oligonucleotide
cccctctcgccccctccggt

SEQ ID NO: 337399 - DNA, 20 bp, Artificial Sequence
  Description of Artificial Sequence: Synthetic oligonucleotide
ccctctcgccccctccgggt

SEQ ID NO: 337400 - DNA, 20 bp, Artificial Sequence
  Description of Artificial Sequence: Synthetic oligonucleotide
cctctcgccccctccgggtc

SEQ ID NO: 337401 - DNA, 21 bp, Artificial Sequence
  Description of Artificial Sequence: Synthetic oligonucleotide
ctctcgccccctccgggtcct

SEQ ID NO: 337402 - DNA, 22 bp, Artificial Sequence
  Description of Artificial Sequence: Synthetic oligonucleotide
tctcgccccctccgggtcctca

SEQ ID NO: 337403 - DNA, 21 bp, Artificial Sequence
  Description of Artificial Sequence: Synthetic oligonucleotide
ctcgccccctccgggtcctca

SEQ ID NO: 337404 - DNA, 22 bp, Artificial Sequence
  Description of Artificial Sequence: Synthetic oligonucleotide
tcgccccctccgggtcctcagt

SEQ ID NO: 337405 - DNA, 21 bp, Artificial Sequence
  Description of Artificial Sequence: Synthetic oligonucleotide
cgccccctccgggtcctcagt

SEQ ID NO: 337406 - DNA, 21 bp, Artificial Sequence
  Description of Artificial Sequence: Synthetic oligonucleotide
gccccctccgggtcctcagtg

SEQ ID NO: 337407 - DNA, 21 bp, Artificial Sequence
  Description of Artificial Sequence: Synthetic oligonucleotide
ccccctccgggtcctcagtgc

SEQ ID NO: 337408 - DNA, 21 bp, Artificial Sequence
  Description of Artificial Sequence: Synthetic oligonucleotide
cccctccgggtcctcagtgcg

SEQ ID NO: 337409 - DNA, 23 bp, Artificial Sequence
  Description of Artificial Sequence: Synthetic oligonucleotide
ccctccgggtcctcagtgcgctt

SEQ ID NO: 337410 - DNA, 24 bp, Artificial Sequence
  Description of Artificial Sequence: Synthetic oligonucleotide
cctccgggtcctcagtgcgcttct

SEQ ID NO: 337411 - DNA, 24 bp, Artificial Sequence
  Description of Artificial Sequence: Synthetic oligonucleotide
ctccgggtcctcagtgcgcttctg

SEQ ID NO: 337412 - DNA, 24 bp, Artificial Sequence
  Description of Artificial Sequence: Synthetic oligonucleotide
tccgggtcctcagtgcgcttctgg

SEQ ID NO: 337413 - DNA, 23 bp, Artificial Sequence
  Description of Artificial Sequence: Synthetic oligonucleotide
ccgggtcctcagtgcgcttctgg

SEQ ID NO: 337414 - DNA, 24 bp, Artificial Sequence
  Description of Artificial Sequence: Synthetic oligonucleotide
cgggtcctcagtgcgcttctgggt

SEQ ID NO: 337415 - DNA, 24 bp, Artificial Sequence
  Description of Artificial Sequence: Synthetic oligonucleotide
gggtcctcagtgcgcttctgggtc

SEQ ID NO: 337416 - DNA, 24 bp, Artificial Sequence
  Description of Artificial Sequence: Synthetic oligonucleotide
ggtcctcagtgcgcttctgggtcc

SEQ ID NO: 337417 - DNA, 24 bp, Artificial Sequence
  Description of Artificial Sequence: Synthetic oligonucleotide
gtcctcagtgcgcttctgggtccg

SEQ ID NO: 337418 - DNA, 26 bp, Artificial Sequence
  Description of Artificial Sequence: Synthetic oligonucleotide
tcctcagtgcgcttctgggtccgcat

SEQ ID NO: 337419 - DNA, 25 bp, Artificial Sequence
  Description of Artificial Sequence: Synthetic oligonucleotide
cctcagtgcgcttctgggtccgcat

SEQ ID NO: 337420 - DNA, 26 bp, Artificial Sequence
  Description of Artificial Sequence: Synthetic oligonucleotide
ctcagtgcgcttctgggtccgcatga

SEQ ID NO: 337421 - DNA, 26 bp, Artificial Sequence
  Description of Artificial Sequence: Synthetic oligonucleotide
tcagtgcgcttctgggtccgcatgag

SEQ ID NO: 337422 - DNA, 25 bp, Artificial Sequence
  Description of Artificial Sequence: Synthetic oligonucleotide
cagtgcgcttctgggtccgcatgag

SEQ ID NO: 337423 - DNA, 25 bp, Artificial Sequence
  Description of Artificial Sequence: Synthetic oligonucleotide
agtgcgcttctgggtccgcatgagc

SEQ ID NO: 337424 - DNA, 24 bp, Artificial Sequence
  Description of Artificial Sequence: Synthetic oligonucleotide
gtgcgcttctgggtccgcatgagc

SEQ ID NO: 337425 - DNA, 24 bp, Artificial Sequence
  Description of Artificial Sequence: Synthetic oligonucleotide
tgcgcttctgggtccgcatgagcg

SEQ ID NO: 337426 - DNA, 23 bp, Artificial Sequence
  Description of Artificial Sequence: Synthetic oligonucleotide
gcgcttctgggtccgcatgagcg

SEQ ID NO: 337427 - DNA, 23 bp, Artificial Sequence
  Description of Artificial Sequence: Synthetic oligonucleotide
cgcttctgggtccgcatgagcgc

SEQ ID NO: 337428 - DNA, 23 bp, Artificial Sequence
  Description of Artificial Sequence: Synthetic oligonucleotide
gcttctgggtccgcatgagcgcg

SEQ ID NO: 337429 - DNA, 24 bp, Artificial Sequence
  Description of Artificial Sequence: Synthetic oligonucleotide
cttctgggtccgcatgagcgcgga

SEQ ID NO: 337430 - DNA, 26 bp, Artificial Sequence
  Description of Artificial Sequence: Synthetic oligonucleotide
ttctgggtccgcatgagcgcggagtt

SEQ ID NO: 337431 - DNA, 25 bp, Artificial Sequence
  Description of Artificial Sequence: Synthetic oligonucleotide
tctgggtccgcatgagcgcggagtt

SEQ ID NO: 337432 - DNA, 24 bp, Artificial Sequence
  Description of Artificial Sequence: Synthetic oligonucleotide
ctgggtccgcatgagcgcggagtt

SEQ ID NO: 337433 - DNA, 24 bp, Artificial Sequence
  Description of Artificial Sequence: Synthetic oligonucleotide
tgggtccgcatgagcgcggagttc

SEQ ID NO: 337434 - DNA, 23 bp, Artificial Sequence
  Description of Artificial Sequence: Synthetic oligonucleotide
gggtccgcatgagcgcggagttc

SEQ ID NO: 337435 - DNA, 24 bp, Artificial Sequence
  Description of Artificial Sequence: Synthetic oligonucleotide
ggtccgcatgagcgcggagttcga

SEQ ID NO: 337436 - DNA, 24 bp, Artificial Sequence
  Description of Artificial Sequence: Synthetic oligonucleotide
gtccgcatgagcgcggagttcgag

SEQ ID NO: 337437 - DNA, 24 bp, Artificial Sequence
  Description of Artificial Sequence: Synthetic oligonucleotide
tccgcatgagcgcggagttcgagg

SEQ ID NO: 337438 - DNA, 23 bp, Artificial Sequence
  Description of Artificial Sequence: Synthetic oligonucleotide
ccgcatgagcgcggagttcgagg

SEQ ID NO: 337439 - DNA, 24 bp, Artificial Sequence
  Description of Artificial Sequence: Synthetic oligonucleotide
cgcatgagcgcggagttcgaggct

SEQ ID NO: 337440 - DNA, 25 bp, Artificial Sequence
  Description of Artificial Sequence: Synthetic oligonucleotide
gcatgagcgcggagttcgaggctgt

SEQ ID NO: 337441 - DNA, 25 bp, Artificial Sequence
  Description of Artificial Sequence: Synthetic oligonucleotide
catgagcgcggagttcgaggctgtg

SEQ ID NO: 337442 - DNA, 26 bp, Artificial Sequence
  Description of Artificial Sequence: Synthetic oligonucleotide
atgagcgcggagttcgaggctgtgca

SEQ ID NO: 337443 - DNA, 25 bp, Artificial Sequence
  Description of Artificial Sequence: Synthetic oligonucleotide
tgagcgcggagttcgaggctgtgca

SEQ ID NO: 337444 - DNA, 24 bp, Artificial Sequence
  Description of Artificial Sequence: Synthetic oligonucleotide
gagcgcggagttcgaggctgtgca

SEQ ID NO: 337445 - DNA, 24 bp, Artificial Sequence
  Description of Artificial Sequence: Synthetic oligonucleotide
agcgcggagttcgaggctgtgcac

SEQ ID NO: 337446 - DNA, 23 bp, Artificial Sequence
  Description of Artificial Sequence: Synthetic oligonucleotide
gcgcggagttcgaggctgtgcac

SEQ ID NO: 337447 - DNA, 23 bp, Artificial Sequence
  Description of Artificial Sequence: Synthetic oligonucleotide
cgcggagttcgaggctgtgcacc

SEQ ID NO: 337448 - DNA, 23 bp, Artificial Sequence
  Description of Artificial Sequence: Synthetic oligonucleotide
gcggagttcgaggctgtgcaccc

SEQ ID NO: 337449 - DNA, 23 bp, Artificial Sequence
  Description of Artificial Sequence: Synthetic oligonucleotide
cggagttcgaggctgtgcacccg

SEQ ID NO: 337450 - DNA, 23 bp, Artificial Sequence
  Description of Artificial Sequence: Synthetic oligonucleotide
ggagttcgaggctgtgcacccgg

SEQ ID NO: 337451 - DNA, 23 bp, Artificial Sequence
  Description of Artificial Sequence: Synthetic oligonucleotide
gagttcgaggctgtgcacccggg

SEQ ID NO: 337452 - DNA, 25 bp, Artificial Sequence
  Description of Artificial Sequence: Synthetic oligonucleotide
agttcgaggctgtgcacccggggaa

SEQ ID NO: 337453 - DNA, 24 bp, Artificial Sequence
  Description of Artificial Sequence: Synthetic oligonucleotide
gttcgaggctgtgcacccggggaa

SEQ ID NO: 337454 - DNA, 25 bp, Artificial Sequence
  Description of Artificial Sequence: Synthetic oligonucleotide
ttcgaggctgtgcacccggggaaga

SEQ ID NO: 337455 - DNA, 24 bp, Artificial Sequence
  Description of Artificial Sequence: Synthetic oligonucleotide
tcgaggctgtgcacccggggaaga

SEQ ID NO: 337456 - DNA, 23 bp, Artificial Sequence
  Description of Artificial Sequence: Synthetic oligonucleotide
cgaggctgtgcacccggggaaga

SEQ ID NO: 337457 - DNA, 24 bp, Artificial Sequence
  Description of Artificial Sequence: Synthetic oligonucleotide
gaggctgtgcacccggggaagaca

SEQ ID NO: 337458 - DNA, 25 bp, Artificial Sequence
  Description of Artificial Sequence: Synthetic oligonucleotide
aggctgtgcacccggggaagacagt

SEQ ID NO: 337459 - DNA, 24 bp, Artificial Sequence
  Description of Artificial Sequence: Synthetic oligonucleotide
ggctgtgcacccggggaagacagt

SEQ ID NO: 337460 - DNA, 24 bp, Artificial Sequence
  Description of Artificial Sequence: Synthetic oligonucleotide
gctgtgcacccggggaagacagtg

SEQ ID NO: 337461 - DNA, 25 bp, Artificial Sequence
  Description of Artificial Sequence: Synthetic oligonucleotide
ctgtgcacccggggaagacagtgca

SEQ ID NO: 337462 - DNA, 25 bp, Artificial Sequence
  Description of Artificial Sequence: Synthetic oligonucleotide
tgtgcacccggggaagacagtgcag

SEQ ID NO: 337463 - DNA, 24 bp, Artificial Sequence
  Description of Artificial Sequence: Synthetic oligonucleotide
gtgcacccggggaagacagtgcag

SEQ ID NO: 337464 - DNA, 25 bp, Artificial Sequence
  Description of Artificial Sequence: Synthetic oligonucleotide
tgcacccggggaagacagtgcagca

SEQ ID NO: 337465 - DNA, 24 bp, Artificial Sequence
  Description of Artificial Sequence: Synthetic oligonucleotide
gcacccggggaagacagtgcagca

SEQ ID NO: 337466 - DNA, 27 bp, Artificial Sequence
  Description of Artificial Sequence: Synthetic oligonucleotide
cacccggggaagacagtgcagcacaat

SEQ ID NO: 337467 - DNA, 28 bp, Artificial Sequence
  Description of Artificial Sequence: Synthetic oligonucleotide
acccggggaagacagtgcagcacaattg

SEQ ID NO: 337468 - DNA, 27 bp, Artificial Sequence
  Description of Artificial Sequence: Synthetic oligonucleotide
cccggggaagacagtgcagcacaattg

SEQ ID NO: 337469 - DNA, 27 bp, Artificial Sequence
  Description of Artificial Sequence: Synthetic oligonucleotide
ccggggaagacagtgcagcacaattgc

SEQ ID NO: 337470 - DNA, 28 bp, Artificial Sequence
  Description of Artificial Sequence: Synthetic oligonucleotide
cggggaagacagtgcagcacaattgcag

SEQ ID NO: 337471 - DNA, 28 bp, Artificial Sequence
  Description of Artificial Sequence: Synthetic oligonucleotide
ggggaagacagtgcagcacaattgcagg

SEQ ID NO: 337472 - DNA, 30 bp, Artificial Sequence
  Description of Artificial Sequence: Synthetic oligonucleotide
gggaagacagtgcagcacaattgcaggaac

SEQ ID NO: 337473 - DNA, 31 bp, Artificial Sequence
  Description of Artificial Sequence: Synthetic oligonucleotide
ggaagacagtgcagcacaattgcaggaacag

SEQ ID NO: 337474 - DNA, 31 bp, Artificial Sequence
  Description of Artificial Sequence: Synthetic oligonucleotide
gaagacagtgcagcacaattgcaggaacagc

SEQ ID NO: 337475 - DNA, 32 bp, Artificial Sequence
  Description of Artificial Sequence: Synthetic oligonucleotide
aagacagtgcagcacaattgcaggaacagctg

SEQ ID NO: 337476 - DNA, 31 bp, Artificial Sequence
  Description of Artificial Sequence: Synthetic oligonucleotide
agacagtgcagcacaattgcaggaacagctg

SEQ ID NO: 337477 - DNA, 30 bp, Artificial Sequence
  Description of Artificial Sequence: Synthetic oligonucleotide
gacagtgcagcacaattgcaggaacagctg

SEQ ID NO: 337478 - DNA, 31 bp, Artificial Sequence
  Description of Artificial Sequence: Synthetic oligonucleotide
acagtgcagcacaattgcaggaacagctgtg

SEQ ID NO: 337479 - DNA, 30 bp, Artificial Sequence
  Description of Artificial Sequence: Synthetic oligonucleotide
cagtgcagcacaattgcaggaacagctgtg

SEQ ID NO: 337480 - DNA, 30 bp, Artificial Sequence
  Description of Artificial Sequence: Synthetic oligonucleotide
agtgcagcacaattgcaggaacagctgtgc

SEQ ID NO: 337481 - DNA, 29 bp, Artificial Sequence
  Description of Artificial Sequence: Synthetic oligonucleotide
gtgcagcacaattgcaggaacagctgtgc

SEQ ID NO: 337482 - DNA, 29 bp, Artificial Sequence
  Description of Artificial Sequence: Synthetic oligonucleotide
tgcagcacaattgcaggaacagctgtgcc

SEQ ID NO: 337483 - DNA, 28 bp, Artificial Sequence
  Description of Artificial Sequence: Synthetic oligonucleotide
gcagcacaattgcaggaacagctgtgcc

SEQ ID NO: 337484 - DNA, 28 bp, Artificial Sequence
  Description of Artificial Sequence: Synthetic oligonucleotide
cagcacaattgcaggaacagctgtgccc

SEQ ID NO: 337485 - DNA, 29 bp, Artificial Sequence
  Description of Artificial Sequence: Synthetic oligonucleotide
agcacaattgcaggaacagctgtgcccag

SEQ ID NO: 337486 - DNA, 28 bp, Artificial Sequence
  Description of Artificial Sequence: Synthetic oligonucleotide
gcacaattgcaggaacagctgtgcccag

SEQ ID NO: 337487 - DNA, 28 bp, Artificial Sequence
  Description of Artificial Sequence: Synthetic oligonucleotide
cacaattgcaggaacagctgtgcccagc

SEQ ID NO: 337488 - DNA, 28 bp, Artificial Sequence
  Description of Artificial Sequence: Synthetic oligonucleotide
acaattgcaggaacagctgtgcccagcc

SEQ ID NO: 337489 - DNA, 27 bp, Artificial Sequence
  Description of Artificial Sequence: Synthetic oligonucleotide
caattgcaggaacagctgtgcccagcc

SEQ ID NO: 337490 - DNA, 27 bp, Artificial Sequence
  Description of Artificial Sequence: Synthetic oligonucleotide
aattgcaggaacagctgtgcccagccg

SEQ ID NO: 337491 - DNA, 26 bp, Artificial Sequence
  Description of Artificial Sequence: Synthetic oligonucleotide
attgcaggaacagctgtgcccagccg

SEQ ID NO: 337492 - DNA, 25 bp, Artificial Sequence
  Description of Artificial Sequence: Synthetic oligonucleotide
ttgcaggaacagctgtgcccagccg

SEQ ID NO: 337493 - DNA, 24 bp, Artificial Sequence
  Description of Artificial Sequence: Synthetic oligonucleotide
tgcaggaacagctgtgcccagccg

SEQ ID NO: 337494 - DNA, 23 bp, Artificial Sequence
  Description of Artificial Sequence: Synthetic oligonucleotide
gcaggaacagctgtgcccagccg

SEQ ID NO: 337495 - DNA, 24 bp, Artificial Sequence
  Description of Artificial Sequence: Synthetic oligonucleotide
caggaacagctgtgcccagccgct

SEQ ID NO: 337496 - DNA, 27 bp, Artificial Sequence
  Description of Artificial Sequence: Synthetic oligonucleotide
aggaacagctgtgcccagccgctgaat

SEQ ID NO: 337497 - DNA, 27 bp, Artificial Sequence
  Description of Artificial Sequence: Synthetic oligonucleotide
ggaacagctgtgcccagccgctgaatt

SEQ ID NO: 337498 - DNA, 27 bp, Artificial Sequence
  Description of Artificial Sequence: Synthetic oligonucleotide
gaacagctgtgcccagccgctgaattc

SEQ ID NO: 337499 - DNA, 27 bp, Artificial Sequence
  Description of Artificial Sequence: Synthetic oligonucleotide
aacagctgtgcccagccgctgaattcc

SEQ ID NO: 337500 - DNA, 27 bp, Artificial Sequence
  Description of Artificial Sequence: Synthetic oligonucleotide
acagctgtgcccagccgctgaattcca

SEQ ID NO: 337501 - DNA, 26 bp, Artificial Sequence
  Description of Artificial Sequence: Synthetic oligonucleotide
cagctgtgcccagccgctgaattcca

SEQ ID NO: 337502 - DNA, 26 bp, Artificial Sequence
  Description of Artificial Sequence: Synthetic oligonucleotide
agctgtgcccagccgctgaattccag

SEQ ID NO: 337503 - DNA, 25 bp, Artificial Sequence
  Description of Artificial Sequence: Synthetic oligonucleotide
gctgtgcccagccgctgaattccag

SEQ ID NO: 337504 - DNA, 25 bp, Artificial Sequence
  Description of Artificial Sequence: Synthetic oligonucleotide
ctgtgcccagccgctgaattccagg

SEQ ID NO: 337505 - DNA, 26 bp, Artificial Sequence
  Description of Artificial Sequence: Synthetic oligonucleotide
tgtgcccagccgctgaattccaggct

SEQ ID NO: 337506 - DNA, 25 bp, Artificial Sequence
  Description of Artificial Sequence: Synthetic oligonucleotide
gtgcccagccgctgaattccaggct

SEQ ID NO: 337507 - DNA, 25 bp, Artificial Sequence
  Description of Artificial Sequence: Synthetic oligonucleotide
tgcccagccgctgaattccaggctc

SEQ ID NO: 337508 - DNA, 24 bp, Artificial Sequence
  Description of Artificial Sequence: Synthetic oligonucleotide
gcccagccgctgaattccaggctc

SEQ ID NO: 337509 - DNA, 24 bp, Artificial Sequence
  Description of Artificial Sequence: Synthetic oligonucleotide
cccagccgctgaattccaggctcc

SEQ ID NO: 337510 - DNA, 24 bp, Artificial Sequence
  Description of Artificial Sequence: Synthetic oligonucleotide
ccagccgctgaattccaggctccg

SEQ ID NO: 337511 - DNA, 25 bp, Artificial Sequence
  Description of Artificial Sequence: Synthetic oligonucleotide
cagccgctgaattccaggctccgca

SEQ ID NO: 337512 - DNA, 25 bp, Artificial Sequence
  Description of Artificial Sequence: Synthetic oligonucleotide
agccgctgaattccaggctccgcac

SEQ ID NO: 337513 - DNA, 24 bp, Artificial Sequence
  Description of Artificial Sequence: Synthetic oligonucleotide
gccgctgaattccaggctccgcac

SEQ ID NO: 337514 - DNA, 24 bp, Artificial Sequence
  Description of Artificial Sequence: Synthetic oligonucleotide
ccgctgaattccaggctccgcacc

SEQ ID NO: 337515 - DNA, 24 bp, Artificial Sequence
  Description of Artificial Sequence: Synthetic oligonucleotide
cgctgaattccaggctccgcaccg

SEQ ID NO: 337516 - DNA, 24 bp, Artificial Sequence
  Description of Artificial Sequence: Synthetic oligonucleotide
gctgaattccaggctccgcaccgc

SEQ ID NO: 337517 - DNA, 24 bp, Artificial Sequence
  Description of Artificial Sequence: Synthetic oligonucleotide
ctgaattccaggctccgcaccgcg

SEQ ID NO: 337518 - DNA, 25 bp, Artificial Sequence
  Description of Artificial Sequence: Synthetic oligonucleotide
tgaattccaggctccgcaccgcgct

SEQ ID NO: 337519 - DNA, 24 bp, Artificial Sequence
  Description of Artificial Sequence: Synthetic oligonucleotide
gaattccaggctccgcaccgcgct

SEQ ID NO: 337520 - DNA, 24 bp, Artificial Sequence
  Description of Artificial Sequence: Synthetic oligonucleotide
aattccaggctccgcaccgcgctg

SEQ ID NO: 337521 - DNA, 23 bp, Artificial Sequence
  Description of Artificial Sequence: Synthetic oligonucleotide
attccaggctccgcaccgcgctg

SEQ ID NO: 337522 - DNA, 22 bp, Artificial Sequence
  Description of Artificial Sequence: Synthetic oligonucleotide
ttccaggctccgcaccgcgctg

SEQ ID NO: 337523 - DNA, 21 bp, Artificial Sequence
  Description of Artificial Sequence: Synthetic oligonucleotide
tccaggctccgcaccgcgctg

SEQ ID NO: 337524 - DNA, 20 bp, Artificial Sequence
  Description of Artificial Sequence: Synthetic oligonucleotide
ccaggctccgcaccgcgctg

SEQ ID NO: 337525 - DNA, 20 bp, Artificial Sequence
  Description of Artificial Sequence: Synthetic oligonucleotide
caggctccgcaccgcgctgc

SEQ ID NO: 337526 - DNA, 20 bp, Artificial Sequence
  Description of Artificial Sequence: Synthetic oligonucleotide
aggctccgcaccgcgctgcg

SEQ ID NO: 337527 - DNA, 20 bp, Artificial Sequence
  Description of Artificial Sequence: Synthetic oligonucleotide
ggctccgcaccgcgctgcgt

SEQ ID NO: 337528 - DNA, 20 bp, Artificial Sequence
  Description of Artificial Sequence: Synthetic oligonucleotide
gctccgcaccgcgctgcggt

SEQ ID NO: 337529 - DNA, 21 bp, Artificial Sequence
  Description of Artificial Sequence: Synthetic oligonucleotide
ctccgcaccgcgctgcggcta

SEQ ID NO: 337530 - DNA, 21 bp, Artificial Sequence
  Description of Artificial Sequence: Synthetic oligonucleotide
tccgcaccgcgctgcggctag

SEQ ID NO: 337531 - DNA, 20 bp, Artificial Sequence
  Description of Artificial Sequence: Synthetic oligonucleotide
ccgcaccgcgctgcggctag

SEQ ID NO: 337532 - DNA, 20 bp, Artificial Sequence
  Description of Artificial Sequence: Synthetic oligonucleotide
cgcaccgcgctgcggctagg

SEQ ID NO: 337533 - DNA, 22 bp, Artificial Sequence
  Description of Artificial Sequence: Synthetic oligonucleotide
gcaccgcgctgcggctaggcaa

SEQ ID NO: 337534 - DNA, 23 bp, Artificial Sequence
  Description of Artificial Sequence: Synthetic oligonucleotide
caccgcgctgcggctaggcaaga

SEQ ID NO: 337535 - DNA, 23 bp, Artificial Sequence
  Description of Artificial Sequence: Synthetic oligonucleotide
accgcgctgcggctaggcaagac

SEQ ID NO: 337536 - DNA, 22 bp, Artificial Sequence
  Description of Artificial Sequence: Synthetic oligonucleotide
ccgcgctgcggctaggcaagac

SEQ ID NO: 337537 - DNA, 22 bp, Artificial Sequence
  Description of Artificial Sequence: Synthetic oligonucleotide
cgcgctgcggctaggcaagacc

SEQ ID NO: 337538 - DNA, 23 bp, Artificial Sequence
  Description of Artificial Sequence: Synthetic oligonucleotide
gcgctgcggctaggcaagaccct

SEQ ID NO: 337539 - DNA, 24 bp, Artificial Sequence
  Description of Artificial Sequence: Synthetic oligonucleotide
cgctgcggctaggcaagaccctca

SEQ ID NO: 337540 - DNA, 25 bp, Artificial Sequence
  Description of Artificial Sequence: Synthetic oligonucleotide
gctgcggctaggcaagaccctcaga

SEQ ID NO: 337541 - DNA, 25 bp, Artificial Sequence
  Description of Artificial Sequence: Synthetic oligonucleotide
ctgcggctaggcaagaccctcagag

SEQ ID NO: 337542 - DNA, 25 bp, Artificial Sequence
  Description of Artificial Sequence: Synthetic oligonucleotide
tgcggctaggcaagaccctcagagg

SEQ ID NO: 337543 - DNA, 24 bp, Artificial Sequence
  Description of Artificial Sequence: Synthetic oligonucleotide
gcggctaggcaagaccctcagagg

SEQ ID NO: 337544 - DNA, 24 bp, Artificial Sequence
  Description of Artificial Sequence: Synthetic oligonucleotide
cggctaggcaagaccctcagaggg

SEQ ID NO: 337545 - DNA, 24 bp, Artificial Sequence
  Description of Artificial Sequence: Synthetic oligonucleotide
ggctaggcaagaccctcagagggg

SEQ ID NO: 337546 - DNA, 24 bp, Artificial Sequence
  Description of Artificial Sequence: Synthetic oligonucleotide
gctaggcaagaccctcagaggggc

SEQ ID NO: 337547 - DNA, 24 bp, Artificial Sequence
  Description of Artificial Sequence: Synthetic oligonucleotide
ctaggcaagaccctcagaggggcg

SEQ ID NO: 337548 - DNA, 24 bp, Artificial Sequence
  Description of Artificial Sequence: Synthetic oligonucleotide
taggcaagaccctcagaggggcgg

SEQ ID NO: 337549 - DNA, 23 bp, Artificial Sequence
  Description of Artificial Sequence: Synthetic oligonucleotide
aggcaagaccctcagaggggcgg

SEQ ID NO: 337550 - DNA, 22 bp, Artificial Sequence
  Description of Artificial Sequence: Synthetic oligonucleotide
ggcaagaccctcagaggggcgg

SEQ ID NO: 337551 - DNA, 24 bp, Artificial Sequence
  Description of Artificial Sequence: Synthetic oligonucleotide
gcaagaccctcagaggggcgggtt

SEQ ID NO: 337552 - DNA, 24 bp, Artificial Sequence
  Description of Artificial Sequence: Synthetic oligonucleotide
caagaccctcagaggggcgggttg

SEQ ID NO: 337553 - DNA, 24 bp, Artificial Sequence
  Description of Artificial Sequence: Synthetic oligonucleotide
aagaccctcagaggggcgggttgg

SEQ ID NO: 337554 - DNA, 23 bp, Artificial Sequence
  Description of Artificial Sequence: Synthetic oligonucleotide
agaccctcagaggggcgggttgg

SEQ ID NO: 337555 - DNA, 22 bp, Artificial Sequence
  Description of Artificial Sequence: Synthetic oligonucleotide
gaccctcagaggggcgggttgg

SEQ ID NO: 337556 - DNA, 23 bp, Artificial Sequence
  Description of Artificial Sequence: Synthetic oligonucleotide
accctcagaggggcgggttggga

SEQ ID NO: 337557 - DNA, 22 bp, Artificial Sequence
  Description of Artificial Sequence: Synthetic oligonucleotide
ccctcagaggggcgggttggga

SEQ ID NO: 337558 - DNA, 23 bp, Artificial Sequence
  Description of Artificial Sequence: Synthetic oligonucleotide
cctcagaggggcgggttgggagt

SEQ ID NO: 337559 - DNA, 26 bp, Artificial Sequence
  Description of Artificial Sequence: Synthetic oligonucleotide
ctcagaggggcgggttgggagtctta

SEQ ID NO: 337560 - DNA, 26 bp, Artificial Sequence
  Description of Artificial Sequence: Synthetic oligonucleotide
tcagaggggcgggttgggagtcttac

SEQ ID NO: 337561 - DNA, 25 bp, Artificial Sequence
  Description of Artificial Sequence: Synthetic oligonucleotide
cagaggggcgggttgggagtcttac

SEQ ID NO: 337562 - DNA, 26 bp, Artificial Sequence
  Description of Artificial Sequence: Synthetic oligonucleotide
agaggggcgggttgggagtcttacca

SEQ ID NO: 337563 - DNA, 25 bp, Artificial Sequence
  Description of Artificial Sequence: Synthetic oligonucleotide
gaggggcgggttgggagtcttacca

SEQ ID NO: 337564 - DNA, 25 bp, Artificial Sequence
  Description of Artificial Sequence: Synthetic oligonucleotide
aggggcgggttgggagtcttaccac

SEQ ID NO: 337565 - DNA, 24 bp, Artificial Sequence
  Description of Artificial Sequence: Synthetic oligonucleotide
ggggcgggttgggagtcttaccac

SEQ ID NO: 337566 - DNA, 25 bp, Artificial Sequence
  Description of Artificial Sequence: Synthetic oligonucleotide
gggcgggttgggagtcttaccacct

SEQ ID NO: 337567 - DNA, 25 bp, Artificial Sequence
  Description of Artificial Sequence: Synthetic oligonucleotide
ggcgggttgggagtcttaccacctg

SEQ ID NO: 337568 - DNA, 26 bp, Artificial Sequence
  Description of Artificial Sequence: Synthetic oligonucleotide
gcgggttgggagtcttaccacctgct

SEQ ID NO: 337569 - DNA, 26 bp, Artificial Sequence
  Description of Artificial Sequence: Synthetic oligonucleotide
cgggttgggagtcttaccacctgctc

SEQ ID NO: 337570 - DNA, 27 bp, Artificial Sequence
  Description of Artificial Sequence: Synthetic oligonucleotide
gggttgggagtcttaccacctgctcga

SEQ ID NO: 337571 - DNA, 27 bp, Artificial Sequence
  Description of Artificial Sequence: Synthetic oligonucleotide
ggttgggagtcttaccacctgctcgac

SEQ ID NO: 337572 - DNA, 27 bp, Artificial Sequence
  Description of Artificial Sequence: Synthetic oligonucleotide
gttgggagtcttaccacctgctcgacc

SEQ ID NO: 337573 - DNA, 28 bp, Artificial Sequence
  Description of Artificial Sequence: Synthetic oligonucleotide
ttgggagtcttaccacctgctcgacctg

SEQ ID NO: 337574 - DNA, 27 bp, Artificial Sequence
  Description of Artificial Sequence: Synthetic oligonucleotide
tgggagtcttaccacctgctcgacctg

SEQ ID NO: 337575 - DNA, 27 bp, Artificial Sequence
  Description of Artificial Sequence: Synthetic oligonucleotide
gggagtcttaccacctgctcgacctga

SEQ ID NO: 337576 - DNA, 27 bp, Artificial Sequence
  Description of Artificial Sequence: Synthetic oligonucleotide
ggagtcttaccacctgctcgacctgag

SEQ ID NO: 337577 - DNA, 27 bp, Artificial Sequence
  Description of Artificial Sequence: Synthetic oligonucleotide
gagtcttaccacctgctcgacctgagg

SEQ ID NO: 337578 - DNA, 27 bp, Artificial Sequence
  Description of Artificial Sequence: Synthetic oligonucleotide
agtcttaccacctgctcgacctgaggg

SEQ ID NO: 337579 - DNA, 26 bp, Artificial Sequence
  Description of Artificial Sequence: Synthetic oligonucleotide
gtcttaccacctgctcgacctgaggg

SEQ ID NO: 337580 - DNA, 26 bp, Artificial Sequence
  Description of Artificial Sequence: Synthetic oligonucleotide
tcttaccacctgctcgacctgagggc

SEQ ID NO: 337581 - DNA, 25 bp, Artificial Sequence
  Description of Artificial Sequence: Synthetic oligonucleotide
cttaccacctgctcgacctgagggc

SEQ ID NO: 337582 - DNA, 26 bp, Artificial Sequence
  Description of Artificial Sequence: Synthetic oligonucleotide
ttaccacctgctcgacctgagggcct

SEQ ID NO: 337583 - DNA, 25 bp, Artificial Sequence
  Description of Artificial Sequence: Synthetic oligonucleotide
taccacctgctcgacctgagggcct

SEQ ID NO: 337584 - DNA, 24 bp, Artificial Sequence
  Description of Artificial Sequence: Synthetic oligonucleotide
accacctgctcgacctgagggcct

SEQ ID NO: 337585 - DNA, 23 bp, Artificial Sequence
  Description of Artificial Sequence: Synthetic oligonucleotide
ccacctgctcgacctgagggcct

SEQ ID NO: 337586 - DNA, 23 bp, Artificial Sequence
  Description of Artificial Sequence: Synthetic oligonucleotide
cacctgctcgacctgagggcctc

SEQ ID NO: 337587 - DNA, 24 bp, Artificial Sequence
  Description of Artificial Sequence: Synthetic oligonucleotide
acctgctcgacctgagggcctcga

SEQ ID NO: 337588 - DNA, 23 bp, Artificial Sequence
  Description of Artificial Sequence: Synthetic oligonucleotide
cctgctcgacctgagggcctcga

SEQ ID NO: 337589 - DNA, 23 bp, Artificial Sequence
  Description of Artificial Sequence: Synthetic oligonucleotide
ctgctcgacctgagggcctcgag

SEQ ID NO: 337590 - DNA, 24 bp, Artificial Sequence
  Description of Artificial Sequence: Synthetic oligonucleotide
tgctcgacctgagggcctcgagct

SEQ ID NO: 337591 - DNA, 23 bp, Artificial Sequence
  Description of Artificial Sequence: Synthetic oligonucleotide
gctcgacctgagggcctcgagct

SEQ ID NO: 337592 - DNA, 23 bp, Artificial Sequence
  Description of Artificial Sequence: Synthetic oligonucleotide
ctcgacctgagggcctcgagctc

SEQ ID NO: 337593 - DNA, 23 bp, Artificial Sequence
  Description of Artificial Sequence: Synthetic oligonucleotide
tcgacctgagggcctcgagctcc

SEQ ID NO: 337594 - DNA, 22 bp, Artificial Sequence
  Description of Artificial Sequence: Synthetic oligonucleotide
cgacctgagggcctcgagctcc

SEQ ID NO: 337595 - DNA, 23 bp, Artificial Sequence
  Description of Artificial Sequence: Synthetic oligonucleotide
gacctgagggcctcgagctccct

SEQ ID NO: 337596 - DNA, 23 bp, Artificial Sequence
  Description of Artificial Sequence: Synthetic oligonucleotide
acctgagggcctcgagctccctg

SEQ ID NO: 337597 - DNA, 22 bp, Artificial Sequence
  Description of Artificial Sequence: Synthetic oligonucleotide
cctgagggcctcgagctccctg

SEQ ID NO: 337598 - DNA, 22 bp, Artificial Sequence
  Description of Artificial Sequence: Synthetic oligonucleotide
ctgagggcctcgagctccctgg

SEQ ID NO: 337599 - DNA, 22 bp, Artificial Sequence
  Description of Artificial Sequence: Synthetic oligonucleotide
tgagggcctcgagctccctggc

SEQ ID NO: 337600 - DNA, 21 bp, Artificial Sequence
  Description of Artificial Sequence: Synthetic oligonucleotide
gagggcctcgagctccctggc

SEQ ID NO: 337601 - DNA, 21 bp, Artificial Sequence
  Description of Artificial Sequence: Synthetic oligonucleotide
agggcctcgagctccctggcg

SEQ ID NO: 337602 - DNA, 20 bp, Artificial Sequence
  Description of Artificial Sequence: Synthetic oligonucleotide
gggcctcgagctccctggcg

SEQ ID NO: 337603 - DNA, 21 bp, Artificial Sequence
  Description of Artificial Sequence: Synthetic oligonucleotide
ggcctcgagctccctggcgca

SEQ ID NO: 337604 - DNA, 22 bp, Artificial Sequence
  Description of Artificial Sequence: Synthetic oligonucleotide
gcctcgagctccctggcgcact

SEQ ID NO: 337605 - DNA, 22 bp, Artificial Sequence
  Description of Artificial Sequence: Synthetic oligonucleotide
cctcgagctccctggcgcactg

SEQ ID NO: 337606 - DNA, 22 bp, Artificial Sequence
  Description of Artificial Sequence: Synthetic oligonucleotide
ctcgagctccctggcgcactgc

SEQ ID NO: 337607 - DNA, 23 bp, Artificial Sequence
  Description of Artificial Sequence: Synthetic oligonucleotide
tcgagctccctggcgcactgcgt

SEQ ID NO: 337608 - DNA, 22 bp, Artificial Sequence
  Description of Artificial Sequence: Synthetic oligonucleotide
cgagctccctggcgcactgcgt

SEQ ID NO: 337609 - DNA, 22 bp, Artificial Sequence
  Description of Artificial Sequence: Synthetic oligonucleotide
gagctccctggcgcactgcgtc

SEQ ID NO: 337610 - DNA, 23 bp, Artificial Sequence
  Description of Artificial Sequence: Synthetic oligonucleotide
agctccctggcgcactgcgtcgt

SEQ ID NO: 337611 - DNA, 22 bp, Artificial Sequence
  Description of Artificial Sequence: Synthetic oligonucleotide
gctccctggcgcactgcgtcgt

SEQ ID NO: 337612 - DNA, 23 bp, Artificial Sequence
  Description of Artificial Sequence: Synthetic oligonucleotide
ctccctggcgcactgcgtcgtga

SEQ ID NO: 337613 - DNA, 23 bp, Artificial Sequence
  Description of Artificial Sequence: Synthetic oligonucleotide
tccctggcgcactgcgtcgtgac

SEQ ID NO: 337614 - DNA, 22 bp, Artificial Sequence
  Description of Artificial Sequence: Synthetic oligonucleotide
ccctggcgcactgcgtcgtgac

SEQ ID NO: 337615 - DNA, 23 bp, Artificial Sequence
  Description of Artificial Sequence: Synthetic oligonucleotide
cctggcgcactgcgtcgtgacct

SEQ ID NO: 337616 - DNA, 23 bp, Artificial Sequence
  Description of Artificial Sequence: Synthetic oligonucleotide
ctggcgcactgcgtcgtgacctc

SEQ ID NO: 337617 - DNA, 23 bp, Artificial Sequence
  Description of Artificial Sequence: Synthetic oligonucleotide
tggcgcactgcgtcgtgacctcc

SEQ ID NO: 337618 - DNA, 22 bp, Artificial Sequence
  Description of Artificial Sequence: Synthetic oligonucleotide
ggcgcactgcgtcgtgacctcc

SEQ ID NO: 337619 - DNA, 22 bp, Artificial Sequence
  Description of Artificial Sequence: Synthetic oligonucleotide
gcgcactgcgtcgtgacctccg

SEQ ID NO: 337620 - DNA, 23 bp, Artificial Sequence
  Description of Artificial Sequence: Synthetic oligonucleotide
cgcactgcgtcgtgacctccgca

SEQ ID NO: 337621 - DNA, 23 bp, Artificial Sequence
  Description of Artificial Sequence: Synthetic oligonucleotide
gcactgcgtcgtgacctccgcag

SEQ ID NO: 337622 - DNA, 27 bp, Artificial Sequence
  Description of Artificial Sequence: Synthetic oligonucleotide
cactgcgtcgtgacctccgcaggaaat

SEQ ID NO: 337623 - DNA, 28 bp, Artificial Sequence
  Description of Artificial Sequence: Synthetic oligonucleotide
actgcgtcgtgacctccgcaggaaatac

SEQ ID NO: 337624 - DNA, 27 bp, Artificial Sequence
  Description of Artificial Sequence: Synthetic oligonucleotide
ctgcgtcgtgacctccgcaggaaatac

SEQ ID NO: 337625 - DNA, 28 bp, Artificial Sequence
  Description of Artificial Sequence: Synthetic oligonucleotide
tgcgtcgtgacctccgcaggaaatacac

SEQ ID NO: 337626 - DNA, 27 bp, Artificial Sequence
  Description of Artificial Sequence: Synthetic oligonucleotide
gcgtcgtgacctccgcaggaaatacac

SEQ ID NO: 337627 - DNA, 27 bp, Artificial Sequence
  Description of Artificial Sequence: Synthetic oligonucleotide
cgtcgtgacctccgcaggaaatacacg

SEQ ID NO: 337628 - DNA, 27 bp, Artificial Sequence
  Description of Artificial Sequence: Synthetic oligonucleotide
gtcgtgacctccgcaggaaatacacgc

SEQ ID NO: 337629 - DNA, 28 bp, Artificial Sequence
  Description of Artificial Sequence: Synthetic oligonucleotide
tcgtgacctccgcaggaaatacacgctg

SEQ ID NO: 337630 - DNA, 27 bp, Artificial Sequence
  Description of Artificial Sequence: Synthetic oligonucleotide
cgtgacctccgcaggaaatacacgctg

SEQ ID NO: 337631 - DNA, 27 bp, Artificial Sequence
  Description of Artificial Sequence: Synthetic oligonucleotide
gtgacctccgcaggaaatacacgctgg

SEQ ID NO: 337632 - DNA, 27 bp, Artificial Sequence
  Description of Artificial Sequence: Synthetic oligonucleotide
tgacctccgcaggaaatacacgctggc

SEQ ID NO: 337633 - DNA, 26 bp, Artificial Sequence
  Description of Artificial Sequence: Synthetic oligonucleotide
gacctccgcaggaaatacacgctggc

SEQ ID NO: 337634 - DNA, 26 bp, Artificial Sequence
  Description of Artificial Sequence: Synthetic oligonucleotide
acctccgcaggaaatacacgctggcc

SEQ ID NO: 337635 - DNA, 25 bp, Artificial Sequence
  Description of Artificial Sequence: Synthetic oligonucleotide
cctccgcaggaaatacacgctggcc

SEQ ID NO: 337636 - DNA, 26 bp, Artificial Sequence
  Description of Artificial Sequence: Synthetic oligonucleotide
ctccgcaggaaatacacgctggccca

SEQ ID NO: 337637 - DNA, 26 bp, Artificial Sequence
  Description of Artificial Sequence: Synthetic oligonucleotide
tccgcaggaaatacacgctggcccac

SEQ ID NO: 337638 - DNA, 25 bp, Artificial Sequence
  Description of Artificial Sequence: Synthetic oligonucleotide
ccgcaggaaatacacgctggcccac

SEQ ID NO: 337639 - DNA, 26 bp, Artificial Sequence
  Description of Artificial Sequence: Synthetic oligonucleotide
cgcaggaaatacacgctggcccacct

SEQ ID NO: 337640 - DNA, 26 bp, Artificial Sequence
  Description of Artificial Sequence: Synthetic oligonucleotide
gcaggaaatacacgctggcccacctc

SEQ ID NO: 337641 - DNA, 27 bp, Artificial Sequence
  Description of Artificial Sequence: Synthetic oligonucleotide
caggaaatacacgctggcccacctcca

SEQ ID NO: 337642 - DNA, 27 bp, Artificial Sequence
  Description of Artificial Sequence: Synthetic oligonucleotide
aggaaatacacgctggcccacctccac

SEQ ID NO: 337643 - DNA, 26 bp, Artificial Sequence
  Description of Artificial Sequence: Synthetic oligonucleotide
ggaaatacacgctggcccacctccac

SEQ ID NO: 337644 - DNA, 27 bp, Artificial Sequence
  Description of Artificial Sequence: Synthetic oligonucleotide
gaaatacacgctggcccacctccacga

SEQ ID NO: 337645 - DNA, 28 bp, Artificial Sequence
  Description of Artificial Sequence: Synthetic oligonucleotide
aaatacacgctggcccacctccacgatc

SEQ ID NO: 337646 - DNA, 27 bp, Artificial Sequence
  Description of Artificial Sequence: Synthetic oligonucleotide
aatacacgctggcccacctccacgatc

SEQ ID NO: 337647 - DNA, 27 bp, Artificial Sequence
  Description of Artificial Sequence: Synthetic oligonucleotide
atacacgctggcccacctccacgatca

SEQ ID NO: 337648 - DNA, 26 bp, Artificial Sequence
  Description of Artificial Sequence: Synthetic oligonucleotide
tacacgctggcccacctccacgatca

SEQ ID NO: 337649 - DNA, 25 bp, Artificial Sequence
  Description of Artificial Sequence: Synthetic oligonucleotide
acacgctggcccacctccacgatca

SEQ ID NO: 337650 - DNA, 24 bp, Artificial Sequence
  Description of Artificial Sequence: Synthetic oligonucleotide
cacgctggcccacctccacgatca

SEQ ID NO: 337651 - DNA, 24 bp, Artificial Sequence
  Description of Artificial Sequence: Synthetic oligonucleotide
acgctggcccacctccacgatcac

SEQ ID NO: 337652 - DNA, 23 bp, Artificial Sequence
  Description of Artificial Sequence: Synthetic oligonucleotide
cgctggcccacctccacgatcac

SEQ ID NO: 337653 - DNA, 23 bp, Artificial Sequence
  Description of Artificial Sequence: Synthetic oligonucleotide
gctggcccacctccacgatcacc

SEQ ID NO: 337654 - DNA, 23 bp, Artificial Sequence
  Description of Artificial Sequence: Synthetic oligonucleotide
ctggcccacctccacgatcaccg

SEQ ID NO: 337655 - DNA, 23 bp, Artificial Sequence
  Description of Artificial Sequence: Synthetic oligonucleotide
tggcccacctccacgatcaccgc

SEQ ID NO: 337656 - DNA, 22 bp, Artificial Sequence
  Description of Artificial Sequence: Synthetic oligonucleotide
ggcccacctccacgatcaccgc

SEQ ID NO: 337657 - DNA, 24 bp, Artificial Sequence
  Description of Artificial Sequence: Synthetic oligonucleotide
gcccacctccacgatcaccgcgta

SEQ ID NO: 337658 - DNA, 27 bp, Artificial Sequence
  Description of Artificial Sequence: Synthetic oligonucleotide
cccacctccacgatcaccgcgtacaaa

SEQ ID NO: 337659 - DNA, 27 bp, Artificial Sequence
  Description of Artificial Sequence: Synthetic oligonucleotide
ccacctccacgatcaccgcgtacaaac

SEQ ID NO: 337660 - DNA, 27 bp, Artificial Sequence
  Description of Artificial Sequence: Synthetic oligonucleotide
cacctccacgatcaccgcgtacaaacc

SEQ ID NO: 337661 - DNA, 27 bp, Artificial Sequence
  Description of Artificial Sequence: Synthetic oligonucleotide
acctccacgatcaccgcgtacaaaccg

SEQ ID NO: 337662 - DNA, 26 bp, Artificial Sequence
  Description of Artificial Sequence: Synthetic oligonucleotide
cctccacgatcaccgcgtacaaaccg

SEQ ID NO: 337663 - DNA, 26 bp, Artificial Sequence
  Description of Artificial Sequence: Synthetic oligonucleotide
ctccacgatcaccgcgtacaaaccgg

SEQ ID NO: 337664 - DNA, 26 bp, Artificial Sequence
  Description of Artificial Sequence: Synthetic oligonucleotide
tccacgatcaccgcgtacaaaccggc

SEQ ID NO: 337665 - DNA, 25 bp, Artificial Sequence
  Description of Artificial Sequence: Synthetic oligonucleotide
ccacgatcaccgcgtacaaaccggc

SEQ ID NO: 337666 - DNA, 25 bp, Artificial Sequence
  Description of Artificial Sequence: Synthetic oligonucleotide
cacgatcaccgcgtacaaaccggcc

SEQ ID NO: 337667 - DNA, 26 bp, Artificial Sequence
  Description of Artificial Sequence: Synthetic oligonucleotide
acgatcaccgcgtacaaaccggccca

SEQ ID NO: 337668 - DNA, 25 bp, Artificial Sequence
  Description of Artificial Sequence: Synthetic oligonucleotide
cgatcaccgcgtacaaaccggccca

SEQ ID NO: 337669 - DNA, 26 bp, Artificial Sequence
  Description of Artificial Sequence: Synthetic oligonucleotide
gatcaccgcgtacaaaccggcccaca

SEQ ID NO: 337670 - DNA, 26 bp, Artificial Sequence
  Description of Artificial Sequence: Synthetic oligonucleotide
atcaccgcgtacaaaccggcccacag

SEQ ID NO: 337671 - DNA, 25 bp, Artificial Sequence
  Description of Artificial Sequence: Synthetic oligonucleotide
tcaccgcgtacaaaccggcccacag

SEQ ID NO: 337672 - DNA, 24 bp, Artificial Sequence
  Description of Artificial Sequence: Synthetic oligonucleotide
caccgcgtacaaaccggcccacag

SEQ ID NO: 337673 - DNA, 24 bp, Artificial Sequence
  Description of Artificial Sequence: Synthetic oligonucleotide
accgcgtacaaaccggcccacagc

SEQ ID NO: 337674 - DNA, 23 bp, Artificial Sequence
  Description of Artificial Sequence: Synthetic oligonucleotide
ccgcgtacaaaccggcccacagc

SEQ ID NO: 337675 - DNA, 24 bp, Artificial Sequence
  Description of Artificial Sequence: Synthetic oligonucleotide
cgcgtacaaaccggcccacagcga

SEQ ID NO: 337676 - DNA, 27 bp, Artificial Sequence
  Description of Artificial Sequence: Synthetic oligonucleotide
gcgtacaaaccggcccacagcgagatt

SEQ ID NO: 337677 - DNA, 29 bp, Artificial Sequence
  Description of Artificial Sequence: Synthetic oligonucleotide
cgtacaaaccggcccacagcgagattttg

SEQ ID NO: 337678 - DNA, 29 bp, Artificial Sequence
  Description of Artificial Sequence: Synthetic oligonucleotide
gtacaaaccggcccacagcgagattttgg

SEQ ID NO: 337679 - DNA, 30 bp, Artificial Sequence
  Description of Artificial Sequence: Synthetic oligonucleotide
tacaaaccggcccacagcgagattttggac

SEQ ID NO: 337680 - DNA, 29 bp, Artificial Sequence
  Description of Artificial Sequence: Synthetic oligonucleotide
acaaaccggcccacagcgagattttggac

SEQ ID NO: 337681 - DNA, 28 bp, Artificial Sequence
  Description of Artificial Sequence: Synthetic oligonucleotide
caaaccggcccacagcgagattttggac

SEQ ID NO: 337682 - DNA, 28 bp, Artificial Sequence
  Description of Artificial Sequence: Synthetic oligonucleotide
aaaccggcccacagcgagattttggacc

SEQ ID NO: 337683 - DNA, 27 bp, Artificial Sequence
  Description of Artificial Sequence: Synthetic oligonucleotide
aaccggcccacagcgagattttggacc

SEQ ID NO: 337684 - DNA, 26 bp, Artificial Sequence
  Description of Artificial Sequence: Synthetic oligonucleotide
accggcccacagcgagattttggacc

SEQ ID NO: 337685 - DNA, 25 bp, Artificial Sequence
  Description of Artificial Sequence: Synthetic oligonucleotide
ccggcccacagcgagattttggacc

SEQ ID NO: 337686 - DNA, 26 bp, Artificial Sequence
  Description of Artificial Sequence: Synthetic oligonucleotide
cggcccacagcgagattttggaccct

SEQ ID NO: 337687 - DNA, 26 bp, Artificial Sequence
  Description of Artificial Sequence: Synthetic oligonucleotide
ggcccacagcgagattttggaccctc

SEQ ID NO: 337688 - DNA, 26 bp, Artificial Sequence
  Description of Artificial Sequence: Synthetic oligonucleotide
gcccacagcgagattttggaccctcc

SEQ ID NO: 337689 - DNA, 26 bp, Artificial Sequence
  Description of Artificial Sequence: Synthetic oligonucleotide
cccacagcgagattttggaccctccg

SEQ ID NO: 337690 - DNA, 27 bp, Artificial Sequence
  Description of Artificial Sequence: Synthetic oligonucleotide
ccacagcgagattttggaccctccggt

SEQ ID NO: 337691 - DNA, 27 bp, Artificial Sequence
  Description of Artificial Sequence: Synthetic oligonucleotide
cacagcgagattttggaccctccggtc

SEQ ID NO: 337692 - DNA, 32 bp, Artificial Sequence
  Description of Artificial Sequence: Synthetic oligonucleotide
acagcgagattttggaccctccggtcataaag

SEQ ID NO: 337693 - DNA, 31 bp, Artificial Sequence
  Description of Artificial Sequence: Synthetic oligonucleotide
cagcgagattttggaccctccggtcataaag

SEQ ID NO: 337694 - DNA, 31 bp, Artificial Sequence
  Description of Artificial Sequence: Synthetic oligonucleotide
agcgagattttggaccctccggtcataaagg

SEQ ID NO: 337695 - DNA, 30 bp, Artificial Sequence
  Description of Artificial Sequence: Synthetic oligonucleotide
gcgagattttggaccctccggtcataaagg

SEQ ID NO: 337696 - DNA, 30 bp, Artificial Sequence
  Description of Artificial Sequence: Synthetic oligonucleotide
cgagattttggaccctccggtcataaaggg

SEQ ID NO: 337697 - DNA, 30 bp, Artificial Sequence
  Description of Artificial Sequence: Synthetic oligonucleotide
gagattttggaccctccggtcataaagggc

SEQ ID NO: 337698 - DNA, 31 bp, Artificial Sequence
  Description of Artificial Sequence: Synthetic oligonucleotide
agattttggaccctccggtcataaagggcac

SEQ ID NO: 337699 - DNA, 30 bp, Artificial Sequence
  Description of Artificial Sequence: Synthetic oligonucleotide
gattttggaccctccggtcataaagggcac

SEQ ID NO: 337700 - DNA, 30 bp, Artificial Sequence
  Description of Artificial Sequence: Synthetic oligonucleotide
attttggaccctccggtcataaagggcacg

SEQ ID NO: 337701 - DNA, 29 bp, Artificial Sequence
  Description of Artificial Sequence: Synthetic oligonucleotide
ttttggaccctccggtcataaagggcacg

SEQ ID NO: 337702 - DNA, 28 bp, Artificial Sequence
  Description of Artificial Sequence: Synthetic oligonucleotide
tttggaccctccggtcataaagggcacg

SEQ ID NO: 337703 - DNA, 27 bp, Artificial Sequence
  Description of Artificial Sequence: Synthetic oligonucleotide
ttggaccctccggtcataaagggcacg

SEQ ID NO: 337704 - DNA, 27 bp, Artificial Sequence
  Description of Artificial Sequence: Synthetic oligonucleotide
tggaccctccggtcataaagggcacga

SEQ ID NO: 337705 - DNA, 27 bp, Artificial Sequence
  Description of Artificial Sequence: Synthetic oligonucleotide
ggaccctccggtcataaagggcacgaa

SEQ ID NO: 337706 - DNA, 30 bp, Artificial Sequence
  Description of Artificial Sequence: Synthetic oligonucleotide
gaccctccggtcataaagggcacgaaatac

SEQ ID NO: 337707 - DNA, 31 bp, Artificial Sequence
  Description of Artificial Sequence: Synthetic oligonucleotide
accctccggtcataaagggcacgaaatacac

SEQ ID NO: 337708 - DNA, 30 bp, Artificial Sequence
  Description of Artificial Sequence: Synthetic oligonucleotide
ccctccggtcataaagggcacgaaatacac

SEQ ID NO: 337709 - DNA, 33 bp, Artificial Sequence
  Description of Artificial Sequence: Synthetic oligonucleotide
cctccggtcataaagggcacgaaatacacattg

SEQ ID NO: 337710 - DNA, 33 bp, Artificial Sequence
  Description of Artificial Sequence: Synthetic oligonucleotide
ctccggtcataaagggcacgaaatacacattgc

SEQ ID NO: 337711 - DNA, 33 bp, Artificial Sequence
  Description of Artificial Sequence: Synthetic oligonucleotide
tccggtcataaagggcacgaaatacacattgcg

SEQ ID NO: 337712 - DNA, 32 bp, Artificial Sequence
  Description of Artificial Sequence: Synthetic oligonucleotide
ccggtcataaagggcacgaaatacacattgcg

SEQ ID NO: 337713 - DNA, 32 bp, Artificial Sequence
  Description of Artificial Sequence: Synthetic oligonucleotide
cggtcataaagggcacgaaatacacattgcgc

SEQ ID NO: 337714 - DNA, 33 bp, Artificial Sequence
  Description of Artificial Sequence: Synthetic oligonucleotide
ggtcataaagggcacgaaatacacattgcgctg

SEQ ID NO: 337715 - DNA, 33 bp, Artificial Sequence
  Description of Artificial Sequence: Synthetic oligonucleotide
gtcataaagggcacgaaatacacattgcgctgc

SEQ ID NO: 337716 - DNA, 33 bp, Artificial Sequence
  Description of Artificial Sequence: Synthetic oligonucleotide
tcataaagggcacgaaatacacattgcgctgcg

SEQ ID NO: 337717 - DNA, 32 bp, Artificial Sequence
  Description of Artificial Sequence: Synthetic oligonucleotide
cataaagggcacgaaatacacattgcgctgcg

SEQ ID NO: 337718 - DNA, 33 bp, Artificial Sequence
  Description of Artificial Sequence: Synthetic oligonucleotide
ataaagggcacgaaatacacattgcgctgcgac

SEQ ID NO: 337719 - DNA, 32 bp, Artificial Sequence
  Description of Artificial Sequence: Synthetic oligonucleotide
taaagggcacgaaatacacattgcgctgcgac

SEQ ID NO: 337720 - DNA, 31 bp, Artificial Sequence
  Description of Artificial Sequence: Synthetic oligonucleotide
aaagggcacgaaatacacattgcgctgcgac

SEQ ID NO: 337721 - DNA, 30 bp, Artificial Sequence
  Description of Artificial Sequence: Synthetic oligonucleotide
aagggcacgaaatacacattgcgctgcgac

SEQ ID NO: 337722 - DNA, 29 bp, Artificial Sequence
  Description of Artificial Sequence: Synthetic oligonucleotide
agggcacgaaatacacattgcgctgcgac

SEQ ID NO: 337723 - DNA, 28 bp, Artificial Sequence
  Description of Artificial Sequence: Synthetic oligonucleotide
gggcacgaaatacacattgcgctgcgac

SEQ ID NO: 337724 - DNA, 28 bp, Artificial Sequence
  Description of Artificial Sequence: Synthetic oligonucleotide
ggcacgaaatacacattgcgctgcgacg

SEQ ID NO: 337725 - DNA, 29 bp, Artificial Sequence
  Description of Artificial Sequence: Synthetic oligonucleotide
gcacgaaatacacattgcgctgcgacgtg

SEQ ID NO: 337726 - DNA, 30 bp, Artificial Sequence
  Description of Artificial Sequence: Synthetic oligonucleotide
cacgaaatacacattgcgctgcgacgtgac

SEQ ID NO: 337727 - DNA, 30 bp, Artificial Sequence
  Description of Artificial Sequence: Synthetic oligonucleotide
acgaaatacacattgcgctgcgacgtgacg

SEQ ID NO: 337728 - DNA, 29 bp, Artificial Sequence
  Description of Artificial Sequence: Synthetic oligonucleotide
cgaaatacacattgcgctgcgacgtgacg

SEQ ID NO: 337729 - DNA, 29 bp, Artificial Sequence
  Description of Artificial Sequence: Synthetic oligonucleotide
gaaatacacattgcgctgcgacgtgacgc

SEQ ID NO: 337730 - DNA, 30 bp, Artificial Sequence
  Description of Artificial Sequence: Synthetic oligonucleotide
aaatacacattgcgctgcgacgtgacgctg

SEQ ID NO: 337731 - DNA, 29 bp, Artificial Sequence
  Description of Artificial Sequence: Synthetic oligonucleotide
aatacacattgcgctgcgacgtgacgctg

SEQ ID NO: 337732 - DNA, 28 bp, Artificial Sequence
  Description of Artificial Sequence: Synthetic oligonucleotide
atacacattgcgctgcgacgtgacgctg

SEQ ID NO: 337733 - DNA, 27 bp, Artificial Sequence
  Description of Artificial Sequence: Synthetic oligonucleotide
tacacattgcgctgcgacgtgacgctg

SEQ ID NO: 337734 - DNA, 26 bp, Artificial Sequence
  Description of Artificial Sequence: Synthetic oligonucleotide
acacattgcgctgcgacgtgacgctg

SEQ ID NO: 337735 - DNA, 25 bp, Artificial Sequence
  Description of Artificial Sequence: Synthetic oligonucleotide
cacattgcgctgcgacgtgacgctg

SEQ ID NO: 337736 - DNA, 26 bp, Artificial Sequence
  Description of Artificial Sequence: Synthetic oligonucleotide
acattgcgctgcgacgtgacgctggt

SEQ ID NO: 337737 - DNA, 25 bp, Artificial Sequence
  Description of Artificial Sequence: Synthetic oligonucleotide
cattgcgctgcgacgtgacgctggt

SEQ ID NO: 337738 - DNA, 27 bp, Artificial Sequence
  Description of Artificial Sequence: Synthetic oligonucleotide
attgcgctgcgacgtgacgctggtgtt

SEQ ID NO: 337739 - DNA, 26 bp, Artificial Sequence
  Description of Artificial Sequence: Synthetic oligonucleotide
ttgcgctgcgacgtgacgctggtgtt

SEQ ID NO: 337740 - DNA, 25 bp, Artificial Sequence
  Description of Artificial Sequence: Synthetic oligonucleotide
tgcgctgcgacgtgacgctggtgtt

SEQ ID NO: 337741 - DNA, 24 bp, Artificial Sequence
  Description of Artificial Sequence: Synthetic oligonucleotide
gcgctgcgacgtgacgctggtgtt

SEQ ID NO: 337742 - DNA, 24 bp, Artificial Sequence
  Description of Artificial Sequence: Synthetic oligonucleotide
cgctgcgacgtgacgctggtgttc

SEQ ID NO: 337743 - DNA, 24 bp, Artificial Sequence
  Description of Artificial Sequence: Synthetic oligonucleotide
gctgcgacgtgacgctggtgttcc

SEQ ID NO: 337744 - DNA, 24 bp, Artificial Sequence
  Description of Artificial Sequence: Synthetic oligonucleotide
ctgcgacgtgacgctggtgttccc

SEQ ID NO: 337745 - DNA, 24 bp, Artificial Sequence
  Description of Artificial Sequence: Synthetic oligonucleotide
tgcgacgtgacgctggtgttcccc

SEQ ID NO: 337746 - DNA, 23 bp, Artificial Sequence
  Description of Artificial Sequence: Synthetic oligonucleotide
gcgacgtgacgctggtgttcccc

SEQ ID NO: 337747 - DNA, 24 bp, Artificial Sequence
  Description of Artificial Sequence: Synthetic oligonucleotide
cgacgtgacgctggtgttccccgt

SEQ ID NO: 337748 - DNA, 24 bp, Artificial Sequence
  Description of Artificial Sequence: Synthetic oligonucleotide
gacgtgacgctggtgttccccgtg

SEQ ID NO: 337749 - DNA, 24 bp, Artificial Sequence
  Description of Artificial Sequence: Synthetic oligonucleotide
acgtgacgctggtgttccccgtgg

SEQ ID NO: 337750 - DNA, 23 bp, Artificial Sequence
  Description of Artificial Sequence: Synthetic oligonucleotide
cgtgacgctggtgttccccgtgg

SEQ ID NO: 337751 - DNA, 23 bp, Artificial Sequence
  Description of Artificial Sequence: Synthetic oligonucleotide
gtgacgctggtgttccccgtggg

SEQ ID NO: 337752 - DNA, 25 bp, Artificial Sequence
  Description of Artificial Sequence: Synthetic oligonucleotide
tgacgctggtgttccccgtgggcta

SEQ ID NO: 337753 - DNA, 24 bp, Artificial Sequence
  Description of Artificial Sequence: Synthetic oligonucleotide
gacgctggtgttccccgtgggcta

SEQ ID NO: 337754 - DNA, 26 bp, Artificial Sequence
  Description of Artificial Sequence: Synthetic oligonucleotide
acgctggtgttccccgtgggctacat

SEQ ID NO: 337755 - DNA, 25 bp, Artificial Sequence
  Description of Artificial Sequence: Synthetic oligonucleotide
cgctggtgttccccgtgggctacat

SEQ ID NO: 337756 - DNA, 25 bp, Artificial Sequence
  Description of Artificial Sequence: Synthetic oligonucleotide
gctggtgttccccgtgggctacatg

SEQ ID NO: 337757 - DNA, 26 bp, Artificial Sequence
  Description of Artificial Sequence: Synthetic oligonucleotide
ctggtgttccccgtgggctacatggt

SEQ ID NO: 337758 - DNA, 26 bp, Artificial Sequence
  Description of Artificial Sequence: Synthetic oligonucleotide
tggtgttccccgtgggctacatggtg

SEQ ID NO: 337759 - DNA, 25 bp, Artificial Sequence
  Description of Artificial Sequence: Synthetic oligonucleotide
ggtgttccccgtgggctacatggtg

SEQ ID NO: 337760 - DNA, 26 bp, Artificial Sequence
  Description of Artificial Sequence: Synthetic oligonucleotide
gtgttccccgtgggctacatggtggt

SEQ ID NO: 337761 - DNA, 27 bp, Artificial Sequence
  Description of Artificial Sequence: Synthetic oligonucleotide
tgttccccgtgggctacatggtggtga

SEQ ID NO: 337762 - DNA, 26 bp, Artificial Sequence
  Description of Artificial Sequence: Synthetic oligonucleotide
gttccccgtgggctacatggtggtga

SEQ ID NO: 337763 - DNA, 26 bp, Artificial Sequence
  Description of Artificial Sequence: Synthetic oligonucleotide
ttccccgtgggctacatggtggtgag

SEQ ID NO: 337764 - DNA, 25 bp, Artificial Sequence
  Description of Artificial Sequence: Synthetic oligonucleotide
tccccgtgggctacatggtggtgag

SEQ ID NO: 337765 - DNA, 24 bp, Artificial Sequence
  Description of Artificial Sequence: Synthetic oligonucleotide
ccccgtgggctacatggtggtgag

SEQ ID NO: 337766 - DNA, 24 bp, Artificial Sequence
  Description of Artificial Sequence: Synthetic oligonucleotide
cccgtgggctacatggtggtgagc

SEQ ID NO: 337767 - DNA, 25 bp, Artificial Sequence
  Description of Artificial Sequence: Synthetic oligonucleotide
ccgtgggctacatggtggtgagcct

SEQ ID NO: 337768 - DNA, 26 bp, Artificial Sequence
  Description of Artificial Sequence: Synthetic oligonucleotide
cgtgggctacatggtggtgagcctga

SEQ ID NO: 337769 - DNA, 26 bp, Artificial Sequence
  Description of Artificial Sequence: Synthetic oligonucleotide
gtgggctacatggtggtgagcctgag

SEQ ID NO: 337770 - DNA, 26 bp, Artificial Sequence
  Description of Artificial Sequence: Synthetic oligonucleotide
tgggctacatggtggtgagcctgagg

SEQ ID NO: 337771 - DNA, 25 bp, Artificial Sequence
  Description of Artificial Sequence: Synthetic oligonucleotide
gggctacatggtggtgagcctgagg

SEQ ID NO: 337772 - DNA, 27 bp, Artificial Sequence
  Description of Artificial Sequence: Synthetic oligonucleotide
ggctacatggtggtgagcctgaggcaa

SEQ ID NO: 337773 - DNA, 27 bp, Artificial Sequence
  Description of Artificial Sequence: Synthetic oligonucleotide
gctacatggtggtgagcctgaggcaag

SEQ ID NO: 337774 - DNA, 27 bp, Artificial Sequence
  Description of Artificial Sequence: Synthetic oligonucleotide
ctacatggtggtgagcctgaggcaagg

SEQ ID NO: 337775 - DNA, 29 bp, Artificial Sequence
  Description of Artificial Sequence: Synthetic oligonucleotide
tacatggtggtgagcctgaggcaaggaag

SEQ ID NO: 337776 - DNA, 28 bp, Artificial Sequence
  Description of Artificial Sequence: Synthetic oligonucleotide
acatggtggtgagcctgaggcaaggaag

SEQ ID NO: 337777 - DNA, 27 bp, Artificial Sequence
  Description of Artificial Sequence: Synthetic oligonucleotide
catggtggtgagcctgaggcaaggaag

SEQ ID NO: 337778 - DNA, 27 bp, Artificial Sequence
  Description of Artificial Sequence: Synthetic oligonucleotide
atggtggtgagcctgaggcaaggaagc

SEQ ID NO: 337779 - DNA, 26 bp, Artificial Sequence
  Description of Artificial Sequence: Synthetic oligonucleotide
tggtggtgagcctgaggcaaggaagc

SEQ ID NO: 337780 - DNA, 25 bp, Artificial Sequence
  Description of Artificial Sequence: Synthetic oligonucleotide
ggtggtgagcctgaggcaaggaagc

SEQ ID NO: 337781 - DNA, 25 bp, Artificial Sequence
  Description of Artificial Sequence: Synthetic oligonucleotide
gtggtgagcctgaggcaaggaagcc

SEQ ID NO: 337782 - DNA, 25 bp, Artificial Sequence
  Description of Artificial Sequence: Synthetic oligonucleotide
tggtgagcctgaggcaaggaagccg

SEQ ID NO: 337783 - DNA, 24 bp, Artificial Sequence
  Description of Artificial Sequence: Synthetic oligonucleotide
ggtgagcctgaggcaaggaagccg

SEQ ID NO: 337784 - DNA, 24 bp, Artificial Sequence
  Description of Artificial Sequence: Synthetic oligonucleotide
gtgagcctgaggcaaggaagccgg

SEQ ID NO: 337785 - DNA, 25 bp, Artificial Sequence
  Description of Artificial Sequence: Synthetic oligonucleotide
tgagcctgaggcaaggaagccggct

SEQ ID NO: 337786 - DNA, 24 bp, Artificial Sequence
  Description of Artificial Sequence: Synthetic oligonucleotide
gagcctgaggcaaggaagccggct

SEQ ID NO: 337787 - DNA, 26 bp, Artificial Sequence
  Description of Artificial Sequence: Synthetic oligonucleotide
agcctgaggcaaggaagccggctcat

SEQ ID NO: 337788 - DNA, 25 bp, Artificial Sequence
  Description of Artificial Sequence: Synthetic oligonucleotide
gcctgaggcaaggaagccggctcat

SEQ ID NO: 337789 - DNA, 27 bp, Artificial Sequence
  Description of Artificial Sequence: Synthetic oligonucleotide
cctgaggcaaggaagccggctcatcta

SEQ ID NO: 337790 - DNA, 29 bp, Artificial Sequence
  Description of Artificial Sequence: Synthetic oligonucleotide
ctgaggcaaggaagccggctcatctattg

SEQ ID NO: 337791 - DNA, 29 bp, Artificial Sequence
  Description of Artificial Sequence: Synthetic oligonucleotide
tgaggcaaggaagccggctcatctattgc

SEQ ID NO: 337792 - DNA, 28 bp, Artificial Sequence
  Description of Artificial Sequence: Synthetic oligonucleotide
gaggcaaggaagccggctcatctattgc

SEQ ID NO: 337793 - DNA, 28 bp, Artificial Sequence
  Description of Artificial Sequence: Synthetic oligonucleotide
aggcaaggaagccggctcatctattgcg

SEQ ID NO: 337794 - DNA, 27 bp, Artificial Sequence
  Description of Artificial Sequence: Synthetic oligonucleotide
ggcaaggaagccggctcatctattgcg

SEQ ID NO: 337795 - DNA, 30 bp, Artificial Sequence
  Description of Artificial Sequence: Synthetic oligonucleotide
gcaaggaagccggctcatctattgcgaaag

SEQ ID NO: 337796 - DNA, 30 bp, Artificial Sequence
  Description of Artificial Sequence: Synthetic oligonucleotide
caaggaagccggctcatctattgcgaaagc

SEQ ID NO: 337797 - DNA, 30 bp, Artificial Sequence
  Description of Artificial Sequence: Synthetic oligonucleotide
aaggaagccggctcatctattgcgaaagcc

SEQ ID NO: 337798 - DNA, 29 bp, Artificial Sequence
  Description of Artificial Sequence: Synthetic oligonucleotide
aggaagccggctcatctattgcgaaagcc

SEQ ID NO: 337799 - DNA, 28 bp, Artificial Sequence
  Description of Artificial Sequence: Synthetic oligonucleotide
ggaagccggctcatctattgcgaaagcc

SEQ ID NO: 337800 - DNA, 29 bp, Artificial Sequence
  Description of Artificial Sequence: Synthetic oligonucleotide
gaagccggctcatctattgcgaaagcctc

SEQ ID NO: 337801 - DNA, 29 bp, Artificial Sequence
  Description of Artificial Sequence: Synthetic oligonucleotide
aagccggctcatctattgcgaaagcctcg

SEQ ID NO: 337802 - DNA, 28 bp, Artificial Sequence
  Description of Artificial Sequence: Synthetic oligonucleotide
agccggctcatctattgcgaaagcctcg

SEQ ID NO: 337803 - DNA, 27 bp, Artificial Sequence
  Description of Artificial Sequence: Synthetic oligonucleotide
gccggctcatctattgcgaaagcctcg

SEQ ID NO: 337804 - DNA, 28 bp, Artificial Sequence
  Description of Artificial Sequence: Synthetic oligonucleotide
ccggctcatctattgcgaaagcctcgag

SEQ ID NO: 337805 - DNA, 28 bp, Artificial Sequence
  Description of Artificial Sequence: Synthetic oligonucleotide
cggctcatctattgcgaaagcctcgagc

SEQ ID NO: 337806 - DNA, 28 bp, Artificial Sequence
  Description of Artificial Sequence: Synthetic oligonucleotide
ggctcatctattgcgaaagcctcgagcg

SEQ ID NO: 337807 - DNA, 28 bp, Artificial Sequence
  Description of Artificial Sequence: Synthetic oligonucleotide
gctcatctattgcgaaagcctcgagcgc

SEQ ID NO: 337808 - DNA, 30 bp, Artificial Sequence
  Description of Artificial Sequence: Synthetic oligonucleotide
ctcatctattgcgaaagcctcgagcgcttc

SEQ ID NO: 337809 - DNA, 31 bp, Artificial Sequence
  Description of Artificial Sequence: Synthetic oligonucleotide
tcatctattgcgaaagcctcgagcgcttctc

SEQ ID NO: 337810 - DNA, 30 bp, Artificial Sequence
  Description of Artificial Sequence: Synthetic oligonucleotide
catctattgcgaaagcctcgagcgcttctc

SEQ ID NO: 337811 - DNA, 30 bp, Artificial Sequence
  Description of Artificial Sequence: Synthetic oligonucleotide
atctattgcgaaagcctcgagcgcttctcc

SEQ ID NO: 337812 - DNA, 29 bp, Artificial Sequence
  Description of Artificial Sequence: Synthetic oligonucleotide
tctattgcgaaagcctcgagcgcttctcc

SEQ ID NO: 337813 - DNA, 28 bp, Artificial Sequence
  Description of Artificial Sequence: Synthetic oligonucleotide
ctattgcgaaagcctcgagcgcttctcc

SEQ ID NO: 337814 - DNA, 28 bp, Artificial Sequence
  Description of Artificial Sequence: Synthetic oligonucleotide
tattgcgaaagcctcgagcgcttctccg

SEQ ID NO: 337815 - DNA, 27 bp, Artificial Sequence
  Description of Artificial Sequence: Synthetic oligonucleotide
attgcgaaagcctcgagcgcttctccg

SEQ ID NO: 337816 - DNA, 26 bp, Artificial Sequence
  Description of Artificial Sequence: Synthetic oligonucleotide
ttgcgaaagcctcgagcgcttctccg

SEQ ID NO: 337817 - DNA, 25 bp, Artificial Sequence
  Description of Artificial Sequence: Synthetic oligonucleotide
tgcgaaagcctcgagcgcttctccg

SEQ ID NO: 337818 - DNA, 24 bp, Artificial Sequence
  Description of Artificial Sequence: Synthetic oligonucleotide
gcgaaagcctcgagcgcttctccg

SEQ ID NO: 337819 - DNA, 24 bp, Artificial Sequence
  Description of Artificial Sequence: Synthetic oligonucleotide
cgaaagcctcgagcgcttctccgg

SEQ ID NO: 337820 - DNA, 24 bp, Artificial Sequence
  Description of Artificial Sequence: Synthetic oligonucleotide
gaaagcctcgagcgcttctccggc

SEQ ID NO: 337821 - DNA, 25 bp, Artificial Sequence
  Description of Artificial Sequence: Synthetic oligonucleotide
aaagcctcgagcgcttctccggcct

SEQ ID NO: 337822 - DNA, 24 bp, Artificial Sequence
  Description of Artificial Sequence: Synthetic oligonucleotide
aagcctcgagcgcttctccggcct

SEQ ID NO: 337823 - DNA, 23 bp, Artificial Sequence
  Description of Artificial Sequence: Synthetic oligonucleotide
agcctcgagcgcttctccggcct

SEQ ID NO: 337824 - DNA, 22 bp, Artificial Sequence
  Description of Artificial Sequence: Synthetic oligonucleotide
gcctcgagcgcttctccggcct

SEQ ID NO: 337825 - DNA, 22 bp, Artificial Sequence
  Description of Artificial Sequence: Synthetic oligonucleotide
cctcgagcgcttctccggcctg

SEQ ID NO: 337826 - DNA, 24 bp, Artificial Sequence
  Description of Artificial Sequence: Synthetic oligonucleotide
ctcgagcgcttctccggcctggtt

SEQ ID NO: 337827 - DNA, 25 bp, Artificial Sequence
  Description of Artificial Sequence: Synthetic oligonucleotide
tcgagcgcttctccggcctggttct

SEQ ID NO: 337828 - DNA, 24 bp, Artificial Sequence
  Description of Artificial Sequence: Synthetic oligonucleotide
cgagcgcttctccggcctggttct

SEQ ID NO: 337829 - DNA, 24 bp, Artificial Sequence
  Description of Artificial Sequence: Synthetic oligonucleotide
gagcgcttctccggcctggttctg

SEQ ID NO: 337830 - DNA, 24 bp, Artificial Sequence
  Description of Artificial Sequence: Synthetic oligonucleotide
agcgcttctccggcctggttctgg

SEQ ID NO: 337831 - DNA, 23 bp, Artificial Sequence
  Description of Artificial Sequence: Synthetic oligonucleotide
gcgcttctccggcctggttctgg

SEQ ID NO: 337832 - DNA, 23 bp, Artificial Sequence
  Description of Artificial Sequence: Synthetic oligonucleotide
cgcttctccggcctggttctggc

SEQ ID NO: 337833 - DNA, 25 bp, Artificial Sequence
  Description of Artificial Sequence: Synthetic oligonucleotide
gcttctccggcctggttctggccaa

SEQ ID NO: 337834 - DNA, 25 bp, Artificial Sequence
  Description of Artificial Sequence: Synthetic oligonucleotide
cttctccggcctggttctggccaag

SEQ ID NO: 337835 - DNA, 26 bp, Artificial Sequence
  Description of Artificial Sequence: Synthetic oligonucleotide
ttctccggcctggttctggccaaggt

SEQ ID NO: 337836 - DNA, 25 bp, Artificial Sequence
  Description of Artificial Sequence: Synthetic oligonucleotide
tctccggcctggttctggccaaggt

SEQ ID NO: 337837 - DNA, 24 bp, Artificial Sequence
  Description of Artificial Sequence: Synthetic oligonucleotide
ctccggcctggttctggccaaggt

SEQ ID NO: 337838 - DNA, 25 bp, Artificial Sequence
  Description of Artificial Sequence: Synthetic oligonucleotide
tccggcctggttctggccaaggtga

SEQ ID NO: 337839 - DNA, 24 bp, Artificial Sequence
  Description of Artificial Sequence: Synthetic oligonucleotide
ccggcctggttctggccaaggtga

SEQ ID NO: 337840 - DNA, 24 bp, Artificial Sequence
  Description of Artificial Sequence: Synthetic oligonucleotide
cggcctggttctggccaaggtgac

SEQ ID NO: 337841 - DNA, 26 bp, Artificial Sequence
  Description of Artificial Sequence: Synthetic oligonucleotide
ggcctggttctggccaaggtgacctt

SEQ ID NO: 337842 - DNA, 27 bp, Artificial Sequence
  Description of Artificial Sequence: Synthetic oligonucleotide
gcctggttctggccaaggtgaccttgt

SEQ ID NO: 337843 - DNA, 27 bp, Artificial Sequence
  Description of Artificial Sequence: Synthetic oligonucleotide
cctggttctggccaaggtgaccttgtc

SEQ ID NO: 337844 - DNA, 27 bp, Artificial Sequence
  Description of Artificial Sequence: Synthetic oligonucleotide
ctggttctggccaaggtgaccttgtcc

SEQ ID NO: 337845 - DNA, 29 bp, Artificial Sequence
  Description of Artificial Sequence: Synthetic oligonucleotide
tggttctggccaaggtgaccttgtcctac

SEQ ID NO: 337846 - DNA, 28 bp, Artificial Sequence
  Description of Artificial Sequence: Synthetic oligonucleotide
ggttctggccaaggtgaccttgtcctac

SEQ ID NO: 337847 - DNA, 28 bp, Artificial Sequence
  Description of Artificial Sequence: Synthetic oligonucleotide
gttctggccaaggtgaccttgtcctacg

SEQ ID NO: 337848 - DNA, 29 bp, Artificial Sequence
  Description of Artificial Sequence: Synthetic oligonucleotide
ttctggccaaggtgaccttgtcctacgag

SEQ ID NO: 337849 - DNA, 28 bp, Artificial Sequence
  Description of Artificial Sequence: Synthetic oligonucleotide
tctggccaaggtgaccttgtcctacgag

SEQ ID NO: 337850 - DNA, 27 bp, Artificial Sequence
  Description of Artificial Sequence: Synthetic oligonucleotide
ctggccaaggtgaccttgtcctacgag

SEQ ID NO: 337851 - DNA, 30 bp, Artificial Sequence
  Description of Artificial Sequence: Synthetic oligonucleotide
tggccaaggtgaccttgtcctacgagtatg

SEQ ID NO: 337852 - DNA, 29 bp, Artificial Sequence
  Description of Artificial Sequence: Synthetic oligonucleotide
ggccaaggtgaccttgtcctacgagtatg

SEQ ID NO: 337853 - DNA, 29 bp, Artificial Sequence
  Description of Artificial Sequence: Synthetic oligonucleotide
gccaaggtgaccttgtcctacgagtatgc

SEQ ID NO: 337854 - DNA, 30 bp, Artificial Sequence
  Description of Artificial Sequence: Synthetic oligonucleotide
ccaaggtgaccttgtcctacgagtatgctg

SEQ ID NO: 337855 - DNA, 30 bp, Artificial Sequence
  Description of Artificial Sequence: Synthetic oligonucleotide
caaggtgaccttgtcctacgagtatgctgc

SEQ ID NO: 337856 - DNA, 31 bp, Artificial Sequence
  Description of Artificial Sequence: Synthetic oligonucleotide
aaggtgaccttgtcctacgagtatgctgctg

SEQ ID NO: 337857 - DNA, 30 bp, Artificial Sequence
  Description of Artificial Sequence: Synthetic oligonucleotide
aggtgaccttgtcctacgagtatgctgctg

SEQ ID NO: 337858 - DNA, 29 bp, Artificial Sequence
  Description of Artificial Sequence: Synthetic oligonucleotide
ggtgaccttgtcctacgagtatgctgctg

SEQ ID NO: 337859 - DNA, 29 bp, Artificial Sequence
  Description of Artificial Sequence: Synthetic oligonucleotide
gtgaccttgtcctacgagtatgctgctgg

SEQ ID NO: 337860 - DNA, 30 bp, Artificial Sequence
  Description of Artificial Sequence: Synthetic oligonucleotide
tgaccttgtcctacgagtatgctgctggtc

SEQ ID NO: 337861 - DNA, 29 bp, Artificial Sequence
  Description of Artificial Sequence: Synthetic oligonucleotide
gaccttgtcctacgagtatgctgctggtc

SEQ ID NO: 337862 - DNA, 29 bp, Artificial Sequence
  Description of Artificial Sequence: Synthetic oligonucleotide
accttgtcctacgagtatgctgctggtcc

SEQ ID NO: 337863 - DNA, 28 bp, Artificial Sequence
  Description of Artificial Sequence: Synthetic oligonucleotide
ccttgtcctacgagtatgctgctggtcc

SEQ ID NO: 337864 - DNA, 28 bp, Artificial Sequence
  Description of Artificial Sequence: Synthetic oligonucleotide
cttgtcctacgagtatgctgctggtccc

SEQ ID NO: 337865 - DNA, 28 bp, Artificial Sequence
  Description of Artificial Sequence: Synthetic oligonucleotide
ttgtcctacgagtatgctgctggtcccc

SEQ ID NO: 337866 - DNA, 27 bp, Artificial Sequence
  Description of Artificial Sequence: Synthetic oligonucleotide
tgtcctacgagtatgctgctggtcccc

SEQ ID NO: 337867 - DNA, 26 bp, Artificial Sequence
  Description of Artificial Sequence: Synthetic oligonucleotide
gtcctacgagtatgctgctggtcccc

SEQ ID NO: 337868 - DNA, 26 bp, Artificial Sequence
  Description of Artificial Sequence: Synthetic oligonucleotide
tcctacgagtatgctgctggtccccg

SEQ ID NO: 337869 - DNA, 25 bp, Artificial Sequence
  Description of Artificial Sequence: Synthetic oligonucleotide
cctacgagtatgctgctggtccccg

SEQ ID NO: 337870 - DNA, 25 bp, Artificial Sequence
  Description of Artificial Sequence: Synthetic oligonucleotide
ctacgagtatgctgctggtccccgc

SEQ ID NO: 337871 - DNA, 26 bp, Artificial Sequence
  Description of Artificial Sequence: Synthetic oligonucleotide
tacgagtatgctgctggtccccgcga

SEQ ID NO: 337872 - DNA, 25 bp, Artificial Sequence
  Description of Artificial Sequence: Synthetic oligonucleotide
acgagtatgctgctggtccccgcga

SEQ ID NO: 337873 - DNA, 24 bp, Artificial Sequence
  Description of Artificial Sequence: Synthetic oligonucleotide
cgagtatgctgctggtccccgcga

SEQ ID NO: 337874 - DNA, 26 bp, Artificial Sequence
  Description of Artificial Sequence: Synthetic oligonucleotide
gagtatgctgctggtccccgcgacat

SEQ ID NO: 337875 - DNA, 27 bp, Artificial Sequence
  Description of Artificial Sequence: Synthetic oligonucleotide
agtatgctgctggtccccgcgacatct

SEQ ID NO: 337876 - DNA, 26 bp, Artificial Sequence
  Description of Artificial Sequence: Synthetic oligonucleotide
gtatgctgctggtccccgcgacatct

SEQ ID NO: 337877 - DNA, 26 bp, Artificial Sequence
  Description of Artificial Sequence: Synthetic oligonucleotide
tatgctgctggtccccgcgacatctg

SEQ ID NO: 337878 - DNA, 25 bp, Artificial Sequence
  Description of Artificial Sequence: Synthetic oligonucleotide
atgctgctggtccccgcgacatctg

SEQ ID NO: 337879 - DNA, 24 bp, Artificial Sequence
  Description of Artificial Sequence: Synthetic oligonucleotide
tgctgctggtccccgcgacatctg

SEQ ID NO: 337880 - DNA, 23 bp, Artificial Sequence
  Description of Artificial Sequence: Synthetic oligonucleotide
gctgctggtccccgcgacatctg

SEQ ID NO: 337881 - DNA, 23 bp, Artificial Sequence
  Description of Artificial Sequence: Synthetic oligonucleotide
ctgctggtccccgcgacatctgg

SEQ ID NO: 337882 - DNA, 24 bp, Artificial Sequence
  Description of Artificial Sequence: Synthetic oligonucleotide
tgctggtccccgcgacatctggca

SEQ ID NO: 337883 - DNA, 23 bp, Artificial Sequence
  Description of Artificial Sequence: Synthetic oligonucleotide
gctggtccccgcgacatctggca

SEQ ID NO: 337884 - DNA, 23 bp, Artificial Sequence
  Description of Artificial Sequence: Synthetic oligonucleotide
ctggtccccgcgacatctggcag

SEQ ID NO: 337885 - DNA, 23 bp, Artificial Sequence
  Description of Artificial Sequence: Synthetic oligonucleotide
tggtccccgcgacatctggcagc

SEQ ID NO: 337886 - DNA, 22 bp, Artificial Sequence
  Description of Artificial Sequence: Synthetic oligonucleotide
ggtccccgcgacatctggcagc

SEQ ID NO: 337887 - DNA, 22 bp, Artificial Sequence
  Description of Artificial Sequence: Synthetic oligonucleotide
gtccccgcgacatctggcagcg

SEQ ID NO: 337888 - DNA, 22 bp, Artificial Sequence
  Description of Artificial Sequence: Synthetic oligonucleotide
tccccgcgacatctggcagcgc

SEQ ID NO: 337889 - DNA, 21 bp, Artificial Sequence
  Description of Artificial Sequence: Synthetic oligonucleotide
ccccgcgacatctggcagcgc

SEQ ID NO: 337890 - DNA, 22 bp, Artificial Sequence
  Description of Artificial Sequence: Synthetic oligonucleotide
cccgcgacatctggcagcgcgt

SEQ ID NO: 337891 - DNA, 24 bp, Artificial Sequence
  Description of Artificial Sequence: Synthetic oligonucleotide
ccgcgacatctggcagcgcgtgat

SEQ ID NO: 337892 - DNA, 25 bp, Artificial Sequence
  Description of Artificial Sequence: Synthetic oligonucleotide
cgcgacatctggcagcgcgtgatct

SEQ ID NO: 337893 - DNA, 25 bp, Artificial Sequence
  Description of Artificial Sequence: Synthetic oligonucleotide
gcgacatctggcagcgcgtgatctg

SEQ ID NO: 337894 - DNA, 25 bp, Artificial Sequence
  Description of Artificial Sequence: Synthetic oligonucleotide
cgacatctggcagcgcgtgatctgg

SEQ ID NO: 337895 - DNA, 26 bp, Artificial Sequence
  Description of Artificial Sequence: Synthetic oligonucleotide
gacatctggcagcgcgtgatctggca

SEQ ID NO: 337896 - DNA, 26 bp, Artificial Sequence
  Description of Artificial Sequence: Synthetic oligonucleotide
acatctggcagcgcgtgatctggcac

SEQ ID NO: 337897 - DNA, 25 bp, Artificial Sequence
  Description of Artificial Sequence: Synthetic oligonucleotide
catctggcagcgcgtgatctggcac

SEQ ID NO: 337898 - DNA, 25 bp, Artificial Sequence
  Description of Artificial Sequence: Synthetic oligonucleotide
atctggcagcgcgtgatctggcacg

SEQ ID NO: 337899 - DNA, 24 bp, Artificial Sequence
  Description of Artificial Sequence: Synthetic oligonucleotide
tctggcagcgcgtgatctggcacg

SEQ ID NO: 337900 - DNA, 23 bp, Artificial Sequence
  Description of Artificial Sequence: Synthetic oligonucleotide
ctggcagcgcgtgatctggcacg

SEQ ID NO: 337901 - DNA, 23 bp, Artificial Sequence
  Description of Artificial Sequence: Synthetic oligonucleotide
tggcagcgcgtgatctggcacgc

SEQ ID NO: 337902 - DNA, 22 bp, Artificial Sequence
  Description of Artificial Sequence: Synthetic oligonucleotide
ggcagcgcgtgatctggcacgc

SEQ ID NO: 337903 - DNA, 22 bp, Artificial Sequence
  Description of Artificial Sequence: Synthetic oligonucleotide
gcagcgcgtgatctggcacgcg

SEQ ID NO: 337904 - DNA, 22 bp, Artificial Sequence
  Description of Artificial Sequence: Synthetic oligonucleotide
cagcgcgtgatctggcacgcgc

SEQ ID NO: 337905 - DNA, 22 bp, Artificial Sequence
  Description of Artificial Sequence: Synthetic oligonucleotide
agcgcgtgatctggcacgcgcg

SEQ ID NO: 337906 - DNA, 21 bp, Artificial Sequence
  Description of Artificial Sequence: Synthetic oligonucleotide
gcgcgtgatctggcacgcgcg

SEQ ID NO: 337907 - DNA, 21 bp, Artificial Sequence
  Description of Artificial Sequence: Synthetic oligonucleotide
cgcgtgatctggcacgcgcgc

SEQ ID NO: 337908 - DNA, 22 bp, Artificial Sequence
  Description of Artificial Sequence: Synthetic oligonucleotide
gcgtgatctggcacgcgcgcgt

SEQ ID NO: 337909 - DNA, 25 bp, Artificial Sequence
  Description of Artificial Sequence: Synthetic oligonucleotide
cgtgatctggcacgcgcgcgtcaat

SEQ ID NO: 337910 - DNA, 26 bp, Artificial Sequence
  Description of Artificial Sequence: Synthetic oligonucleotide
gtgatctggcacgcgcgcgtcaatct

SEQ ID NO: 337911 - DNA, 26 bp, Artificial Sequence
  Description of Artificial Sequence: Synthetic oligonucleotide
tgatctggcacgcgcgcgtcaatctc

SEQ ID NO: 337912 - DNA, 25 bp, Artificial Sequence
  Description of Artificial Sequence: Synthetic oligonucleotide
gatctggcacgcgcgcgtcaatctc

SEQ ID NO: 337913 - DNA, 26 bp, Artificial Sequence
  Description of Artificial Sequence: Synthetic oligonucleotide
atctggcacgcgcgcgtcaatctcgt

SEQ ID NO: 337914 - DNA, 25 bp, Artificial Sequence
  Description of Artificial Sequence: Synthetic oligonucleotide
tctggcacgcgcgcgtcaatctcgt

SEQ ID NO: 337915 - DNA, 24 bp, Artificial Sequence
  Description of Artificial Sequence: Synthetic oligonucleotide
ctggcacgcgcgcgtcaatctcgt

SEQ ID NO: 337916 - DNA, 24 bp, Artificial Sequence
  Description of Artificial Sequence: Synthetic oligonucleotide
tggcacgcgcgcgtcaatctcgtc

SEQ ID NO: 337917 - DNA, 23 bp, Artificial Sequence
  Description of Artificial Sequence: Synthetic oligonucleotide
ggcacgcgcgcgtcaatctcgtc

SEQ ID NO: 337918 - DNA, 23 bp, Artificial Sequence
  Description of Artificial Sequence: Synthetic oligonucleotide
gcacgcgcgcgtcaatctcgtcg

SEQ ID NO: 337919 - DNA, 23 bp, Artificial Sequence
  Description of Artificial Sequence: Synthetic oligonucleotide
cacgcgcgcgtcaatctcgtcgg

SEQ ID NO: 337920 - DNA, 23 bp, Artificial Sequence
  Description of Artificial Sequence: Synthetic oligonucleotide
acgcgcgcgtcaatctcgtcggc

SEQ ID NO: 337921 - DNA, 22 bp, Artificial Sequence
  Description of Artificial Sequence: Synthetic oligonucleotide
cgcgcgcgtcaatctcgtcggc

SEQ ID NO: 337922 - DNA, 23 bp, Artificial Sequence
  Description of Artificial Sequence: Synthetic oligonucleotide
gcgcgcgtcaatctcgtcggcct

SEQ ID NO: 337923 - DNA, 23 bp, Artificial Sequence
  Description of Artificial Sequence: Synthetic oligonucleotide
cgcgcgtcaatctcgtcggcctg

SEQ ID NO: 337924 - DNA, 24 bp, Artificial Sequence
  Description of Artificial Sequence: Synthetic oligonucleotide
gcgcgtcaatctcgtcggcctggt

SEQ ID NO: 337925 - DNA, 24 bp, Artificial Sequence
  Description of Artificial Sequence: Synthetic oligonucleotide
cgcgtcaatctcgtcggcctggtc

SEQ ID NO: 337926 - DNA, 25 bp, Artificial Sequence
  Description of Artificial Sequence: Synthetic oligonucleotide
gcgtcaatctcgtcggcctggtcgt

SEQ ID NO: 337927 - DNA, 25 bp, Artificial Sequence
  Description of Artificial Sequence: Synthetic oligonucleotide
cgtcaatctcgtcggcctggtcgtc

SEQ ID NO: 337928 - DNA, 25 bp, Artificial Sequence
  Description of Artificial Sequence: Synthetic oligonucleotide
gtcaatctcgtcggcctggtcgtcc

SEQ ID NO: 337929 - DNA, 25 bp, Artificial Sequence
  Description of Artificial Sequence: Synthetic oligonucleotide
tcaatctcgtcggcctggtcgtccg

SEQ ID NO: 337930 - DNA, 24 bp, Artificial Sequence
  Description of Artificial Sequence: Synthetic oligonucleotide
caatctcgtcggcctggtcgtccg

SEQ ID NO: 337931 - DNA, 26 bp, Artificial Sequence
  Description of Artificial Sequence: Synthetic oligonucleotide
aatctcgtcggcctggtcgtccgcaa

SEQ ID NO: 337932 - DNA, 25 bp, Artificial Sequence
  Description of Artificial Sequence: Synthetic oligonucleotide
atctcgtcggcctggtcgtccgcaa

SEQ ID NO: 337933 - DNA, 24 bp, Artificial Sequence
  Description of Artificial Sequence: Synthetic oligonucleotide
tctcgtcggcctggtcgtccgcaa

SEQ ID NO: 337934 - DNA, 23 bp, Artificial Sequence
  Description of Artificial Sequence: Synthetic oligonucleotide
ctcgtcggcctggtcgtccgcaa

SEQ ID NO: 337935 - DNA, 24 bp, Artificial Sequence
  Description of Artificial Sequence: Synthetic oligonucleotide
tcgtcggcctggtcgtccgcaact

SEQ ID NO: 337936 - DNA, 23 bp, Artificial Sequence
  Description of Artificial Sequence: Synthetic oligonucleotide
cgtcggcctggtcgtccgcaact

SEQ ID NO: 337937 - DNA, 23 bp, Artificial Sequence
  Description of Artificial Sequence: Synthetic oligonucleotide
gtcggcctggtcgtccgcaactg

SEQ ID NO: 337938 - DNA, 24 bp, Artificial Sequence
  Description of Artificial Sequence: Synthetic oligonucleotide
tcggcctggtcgtccgcaactgct

SEQ ID NO: 337939 - DNA, 23 bp, Artificial Sequence
  Description of Artificial Sequence: Synthetic oligonucleotide
cggcctggtcgtccgcaactgct

SEQ ID NO: 337940 - DNA, 23 bp, Artificial Sequence
  Description of Artificial Sequence: Synthetic oligonucleotide
ggcctggtcgtccgcaactgctc

SEQ ID NO: 337941 - DNA, 23 bp, Artificial Sequence
  Description of Artificial Sequence: Synthetic oligonucleotide
gcctggtcgtccgcaactgctcg

SEQ ID NO: 337942 - DNA, 23 bp, Artificial Sequence
  Description of Artificial Sequence: Synthetic oligonucleotide
cctggtcgtccgcaactgctcgg

SEQ ID NO: 337943 - DNA, 24 bp, Artificial Sequence
  Description of Artificial Sequence: Synthetic oligonucleotide
ctggtcgtccgcaactgctcggca

SEQ ID NO: 337944 - DNA, 24 bp, Artificial Sequence
  Description of Artificial Sequence: Synthetic oligonucleotide
tggtcgtccgcaactgctcggcac

SEQ ID NO: 337945 - DNA, 23 bp, Artificial Sequence
  Description of Artificial Sequence: Synthetic oligonucleotide
ggtcgtccgcaactgctcggcac

SEQ ID NO: 337946 - DNA, 23 bp, Artificial Sequence
  Description of Artificial Sequence: Synthetic oligonucleotide
gtcgtccgcaactgctcggcacg

SEQ ID NO: 337947 - DNA, 27 bp, Artificial Sequence
  Description of Artificial Sequence: Synthetic oligonucleotide
tcgtccgcaactgctcggcacgcatta

SEQ ID NO: 337948 - DNA, 26 bp, Artificial Sequence
  Description of Artificial Sequence: Synthetic oligonucleotide
cgtccgcaactgctcggcacgcatta

SEQ ID NO: 337949 - DNA, 27 bp, Artificial Sequence
  Description of Artificial Sequence: Synthetic oligonucleotide
gtccgcaactgctcggcacgcattaca

SEQ ID NO: 337950 - DNA, 27 bp, Artificial Sequence
  Description of Artificial Sequence: Synthetic oligonucleotide
tccgcaactgctcggcacgcattacac

SEQ ID NO: 337951 - DNA, 27 bp, Artificial Sequence
  Description of Artificial Sequence: Synthetic oligonucleotide
ccgcaactgctcggcacgcattacact

SEQ ID NO: 337952 - DNA, 27 bp, Artificial Sequence
  Description of Artificial Sequence: Synthetic oligonucleotide
cgcaactgctcggcacgcattacactc

SEQ ID NO: 337953 - DNA, 29 bp, Artificial Sequence
  Description of Artificial Sequence: Synthetic oligonucleotide
gcaactgctcggcacgcattacactcatg

SEQ ID NO: 337954 - DNA, 29 bp, Artificial Sequence
  Description of Artificial Sequence: Synthetic oligonucleotide
caactgctcggcacgcattacactcatgc

SEQ ID NO: 337955 - DNA, 30 bp, Artificial Sequence
  Description of Artificial Sequence: Synthetic oligonucleotide
aactgctcggcacgcattacactcatgctc

SEQ ID NO: 337956 - DNA, 29 bp, Artificial Sequence
  Description of Artificial Sequence: Synthetic oligonucleotide
actgctcggcacgcattacactcatgctc

SEQ ID NO: 337957 - DNA, 28 bp, Artificial Sequence
  Description of Artificial Sequence: Synthetic oligonucleotide
ctgctcggcacgcattacactcatgctc

SEQ ID NO: 337958 - DNA, 28 bp, Artificial Sequence
  Description of Artificial Sequence: Synthetic oligonucleotide
tgctcggcacgcattacactcatgctcg

SEQ ID NO: 337959 - DNA, 27 bp, Artificial Sequence
  Description of Artificial Sequence: Synthetic oligonucleotide
gctcggcacgcattacactcatgctcg

SEQ ID NO: 337960 - DNA, 27 bp, Artificial Sequence
  Description of Artificial Sequence: Synthetic oligonucleotide
ctcggcacgcattacactcatgctcgc

SEQ ID NO: 337961 - DNA, 29 bp, Artificial Sequence
  Description of Artificial Sequence: Synthetic oligonucleotide
tcggcacgcattacactcatgctcgctag

SEQ ID NO: 337962 - DNA, 28 bp, Artificial Sequence
  Description of Artificial Sequence: Synthetic oligonucleotide
cggcacgcattacactcatgctcgctag

SEQ ID NO: 337963 - DNA, 28 bp, Artificial Sequence
  Description of Artificial Sequence: Synthetic oligonucleotide
ggcacgcattacactcatgctcgctagg

SEQ ID NO: 337964 - DNA, 29 bp, Artificial Sequence
  Description of Artificial Sequence: Synthetic oligonucleotide
gcacgcattacactcatgctcgctaggag

SEQ ID NO: 337965 - DNA, 29 bp, Artificial Sequence
  Description of Artificial Sequence: Synthetic oligonucleotide
cacgcattacactcatgctcgctaggagc

SEQ ID NO: 337966 - DNA, 29 bp, Artificial Sequence
  Description of Artificial Sequence: Synthetic oligonucleotide
acgcattacactcatgctcgctaggagcc

SEQ ID NO: 337967 - DNA, 28 bp, Artificial Sequence
  Description of Artificial Sequence: Synthetic oligonucleotide
cgcattacactcatgctcgctaggagcc

SEQ ID NO: 337968 - DNA, 28 bp, Artificial Sequence
  Description of Artificial Sequence: Synthetic oligonucleotide
gcattacactcatgctcgctaggagccc

SEQ ID NO: 337969 - DNA, 28 bp, Artificial Sequence
  Description of Artificial Sequence: Synthetic oligonucleotide
cattacactcatgctcgctaggagcccc

SEQ ID NO: 337970 - DNA, 28 bp, Artificial Sequence
  Description of Artificial Sequence: Synthetic oligonucleotide
attacactcatgctcgctaggagccccg

SEQ ID NO: 337971 - DNA, 27 bp, Artificial Sequence
  Description of Artificial Sequence: Synthetic oligonucleotide
ttacactcatgctcgctaggagccccg

SEQ ID NO: 337972 - DNA, 26 bp, Artificial Sequence
  Description of Artificial Sequence: Synthetic oligonucleotide
tacactcatgctcgctaggagccccg

SEQ ID NO: 337973 - DNA, 25 bp, Artificial Sequence
  Description of Artificial Sequence: Synthetic oligonucleotide
acactcatgctcgctaggagccccg

SEQ ID NO: 337974 - DNA, 24 bp, Artificial Sequence
  Description of Artificial Sequence: Synthetic oligonucleotide
cactcatgctcgctaggagccccg

SEQ ID NO: 337975 - DNA, 24 bp, Artificial Sequence
  Description of Artificial Sequence: Synthetic oligonucleotide
actcatgctcgctaggagccccgg

SEQ ID NO: 337976 - DNA, 23 bp, Artificial Sequence
  Description of Artificial Sequence: Synthetic oligonucleotide
ctcatgctcgctaggagccccgg

SEQ ID NO: 337977 - DNA, 23 bp, Artificial Sequence
  Description of Artificial Sequence: Synthetic oligonucleotide
tcatgctcgctaggagccccggg

SEQ ID NO: 337978 - DNA, 22 bp, Artificial Sequence
  Description of Artificial Sequence: Synthetic oligonucleotide
catgctcgctaggagccccggg

SEQ ID NO: 337979 - DNA, 22 bp, Artificial Sequence
  Description of Artificial Sequence: Synthetic oligonucleotide
atgctcgctaggagccccgggc

SEQ ID NO: 337980 - DNA, 21 bp, Artificial Sequence
  Description of Artificial Sequence: Synthetic oligonucleotide
tgctcgctaggagccccgggc

SEQ ID NO: 337981 - DNA, 20 bp, Artificial Sequence
  Description of Artificial Sequence: Synthetic oligonucleotide
gctcgctaggagccccgggc

SEQ ID NO: 337982 - DNA, 20 bp, Artificial Sequence
  Description of Artificial Sequence: Synthetic oligonucleotide
ctcgctaggagccccgggcc

SEQ ID NO: 337983 - DNA, 21 bp, Artificial Sequence
  Description of Artificial Sequence: Synthetic oligonucleotide
tcgctaggagccccgggccca

SEQ ID NO: 337984 - DNA, 20 bp, Artificial Sequence
  Description of Artificial Sequence: Synthetic oligonucleotide
cgctaggagccccgggccca

SEQ ID NO: 337985 - DNA, 21 bp, Artificial Sequence
  Description of Artificial Sequence: Synthetic oligonucleotide
gctaggagccccgggcccaca

SEQ ID NO: 337986 - DNA, 21 bp, Artificial Sequence
  Description of Artificial Sequence: Synthetic oligonucleotide
ctaggagccccgggcccacag

SEQ ID NO: 337987 - DNA, 24 bp, Artificial Sequence
  Description of Artificial Sequence: Synthetic oligonucleotide
taggagccccgggcccacagcatt

SEQ ID NO: 337988 - DNA, 23 bp, Artificial Sequence
  Description of Artificial Sequence: Synthetic oligonucleotide
aggagccccgggcccacagcatt

SEQ ID NO: 337989 - DNA, 22 bp, Artificial Sequence
  Description of Artificial Sequence: Synthetic oligonucleotide
ggagccccgggcccacagcatt

SEQ ID NO: 337990 - DNA, 22 bp, Artificial Sequence
  Description of Artificial Sequence: Synthetic oligonucleotide
gagccccgggcccacagcattg

SEQ ID NO: 337991 - DNA, 22 bp, Artificial Sequence
  Description of Artificial Sequence: Synthetic oligonucleotide
agccccgggcccacagcattgg

SEQ ID NO: 337992 - DNA, 21 bp, Artificial Sequence
  Description of Artificial Sequence: Synthetic oligonucleotide
gccccgggcccacagcattgg

SEQ ID NO: 337993 - DNA, 21 bp, Artificial Sequence
  Description of Artificial Sequence: Synthetic oligonucleotide
ccccgggcccacagcattggc

SEQ ID NO: 337994 - DNA, 22 bp, Artificial Sequence
  Description of Artificial Sequence: Synthetic oligonucleotide
cccgggcccacagcattggcct

SEQ ID NO: 337995 - DNA, 22 bp, Artificial Sequence
  Description of Artificial Sequence: Synthetic oligonucleotide
ccgggcccacagcattggcctc

SEQ ID NO: 337996 - DNA, 22 bp, Artificial Sequence
  Description of Artificial Sequence: Synthetic oligonucleotide
cgggcccacagcattggcctcc

SEQ ID NO: 337997 - DNA, 22 bp, Artificial Sequence
  Description of Artificial Sequence: Synthetic oligonucleotide
gggcccacagcattggcctccc

SEQ ID NO: 337998 - DNA, 24 bp, Artificial Sequence
  Description of Artificial Sequence: Synthetic oligonucleotide
ggcccacagcattggcctcccgtt

SEQ ID NO: 337999 - DNA, 24 bp, Artificial Sequence
  Description of Artificial Sequence: Synthetic oligonucleotide
gcccacagcattggcctcccgttc

SEQ ID NO: 338000 - DNA, 26 bp, Artificial Sequence
  Description of Artificial Sequence: Synthetic oligonucleotide
cccacagcattggcctcccgttccat

SEQ ID NO: 338001 - DNA, 26 bp, Artificial Sequence
  Description of Artificial Sequence: Synthetic oligonucleotide
ccacagcattggcctcccgttccatc

SEQ ID NO: 338002 - DNA, 26 bp, Artificial Sequence
  Description of Artificial Sequence: Synthetic oligonucleotide
cacagcattggcctcccgttccatcg

SEQ ID NO: 338003 - DNA, 27 bp, Artificial Sequence
  Description of Artificial Sequence: Synthetic oligonucleotide
acagcattggcctcccgttccatcggt

SEQ ID NO: 338004 - DNA, 26 bp, Artificial Sequence
  Description of Artificial Sequence: Synthetic oligonucleotide
cagcattggcctcccgttccatcggt

SEQ ID NO: 338005 - DNA, 26 bp, Artificial Sequence
  Description of Artificial Sequence: Synthetic oligonucleotide
agcattggcctcccgttccatcggtg

SEQ ID NO: 338006 - DNA, 25 bp, Artificial Sequence
  Description of Artificial Sequence: Synthetic oligonucleotide
gcattggcctcccgttccatcggtg

SEQ ID NO: 338007 - DNA, 25 bp, Artificial Sequence
  Description of Artificial Sequence: Synthetic oligonucleotide
cattggcctcccgttccatcggtgc

SEQ ID NO: 338008 - DNA, 25 bp, Artificial Sequence
  Description of Artificial Sequence: Synthetic oligonucleotide
attggcctcccgttccatcggtgcc

SEQ ID NO: 338009 - DNA, 24 bp, Artificial Sequence
  Description of Artificial Sequence: Synthetic oligonucleotide
ttggcctcccgttccatcggtgcc

SEQ ID NO: 338010 - DNA, 23 bp, Artificial Sequence
  Description of Artificial Sequence: Synthetic oligonucleotide
tggcctcccgttccatcggtgcc

SEQ ID NO: 338011 - DNA, 22 bp, Artificial Sequence
  Description of Artificial Sequence: Synthetic oligonucleotide
ggcctcccgttccatcggtgcc

SEQ ID NO: 338012 - DNA, 24 bp, Artificial Sequence
  Description of Artificial Sequence: Synthetic oligonucleotide
gcctcccgttccatcggtgccctt

SEQ ID NO: 338013 - DNA, 26 bp, Artificial Sequence
  Description of Artificial Sequence: Synthetic oligonucleotide
cctcccgttccatcggtgcccttgtt

SEQ ID NO: 338014 - DNA, 26 bp, Artificial Sequence
  Description of Artificial Sequence: Synthetic oligonucleotide
ctcccgttccatcggtgcccttgttg

SEQ ID NO: 338015 - DNA, 26 bp, Artificial Sequence
  Description of Artificial Sequence: Synthetic oligonucleotide
tcccgttccatcggtgcccttgttgg

SEQ ID NO: 338016 - DNA, 25 bp, Artificial Sequence
  Description of Artificial Sequence: Synthetic oligonucleotide
cccgttccatcggtgcccttgttgg

SEQ ID NO: 338017 - DNA, 27 bp, Artificial Sequence
  Description of Artificial Sequence: Synthetic oligonucleotide
ccgttccatcggtgcccttgttgggat

SEQ ID NO: 338018 - DNA, 27 bp, Artificial Sequence
  Description of Artificial Sequence: Synthetic oligonucleotide
cgttccatcggtgcccttgttgggatc

SEQ ID NO: 338019 - DNA, 27 bp, Artificial Sequence
  Description of Artificial Sequence: Synthetic oligonucleotide
gttccatcggtgcccttgttgggatcc

SEQ ID NO: 338020 - DNA, 28 bp, Artificial Sequence
  Description of Artificial Sequence: Synthetic oligonucleotide
ttccatcggtgcccttgttgggatcctc

SEQ ID NO: 338021 - DNA, 27 bp, Artificial Sequence
  Description of Artificial Sequence: Synthetic oligonucleotide
tccatcggtgcccttgttgggatcctc

SEQ ID NO: 338022 - DNA, 26 bp, Artificial Sequence
  Description of Artificial Sequence: Synthetic oligonucleotide
ccatcggtgcccttgttgggatcctc

SEQ ID NO: 338023 - DNA, 27 bp, Artificial Sequence
  Description of Artificial Sequence: Synthetic oligonucleotide
catcggtgcccttgttgggatcctcgt

SEQ ID NO: 338024 - DNA, 27 bp, Artificial Sequence
  Description of Artificial Sequence: Synthetic oligonucleotide
atcggtgcccttgttgggatcctcgtc

SEQ ID NO: 338025 - DNA, 27 bp, Artificial Sequence
  Description of Artificial Sequence: Synthetic oligonucleotide
tcggtgcccttgttgggatcctcgtca

SEQ ID NO: 338026 - DNA, 26 bp, Artificial Sequence
  Description of Artificial Sequence: Synthetic oligonucleotide
cggtgcccttgttgggatcctcgtca

SEQ ID NO: 338027 - DNA, 27 bp, Artificial Sequence
  Description of Artificial Sequence: Synthetic oligonucleotide
ggtgcccttgttgggatcctcgtcact

SEQ ID NO: 338028 - DNA, 27 bp, Artificial Sequence
  Description of Artificial Sequence: Synthetic oligonucleotide
gtgcccttgttgggatcctcgtcactg

SEQ ID NO: 338029 - DNA, 28 bp, Artificial Sequence
  Description of Artificial Sequence: Synthetic oligonucleotide
tgcccttgttgggatcctcgtcactgtg

SEQ ID NO: 338030 - DNA, 27 bp, Artificial Sequence
  Description of Artificial Sequence: Synthetic oligonucleotide
gcccttgttgggatcctcgtcactgtg

SEQ ID NO: 338031 - DNA, 27 bp, Artificial Sequence
  Description of Artificial Sequence: Synthetic oligonucleotide
cccttgttgggatcctcgtcactgtgg

SEQ ID NO: 338032 - DNA, 27 bp, Artificial Sequence
  Description of Artificial Sequence: Synthetic oligonucleotide
ccttgttgggatcctcgtcactgtggc

SEQ ID NO: 338033 - DNA, 27 bp, Artificial Sequence
  Description of Artificial Sequence: Synthetic oligonucleotide
cttgttgggatcctcgtcactgtggcc

SEQ ID NO: 338034 - DNA, 27 bp, Artificial Sequence
  Description of Artificial Sequence: Synthetic oligonucleotide
ttgttgggatcctcgtcactgtggccg

SEQ ID NO: 338035 - DNA, 26 bp, Artificial Sequence
  Description of Artificial Sequence: Synthetic oligonucleotide
tgttgggatcctcgtcactgtggccg

SEQ ID NO: 338036 - DNA, 25 bp, Artificial Sequence
  Description of Artificial Sequence: Synthetic oligonucleotide
gttgggatcctcgtcactgtggccg

SEQ ID NO: 338037 - DNA, 26 bp, Artificial Sequence
  Description of Artificial Sequence: Synthetic oligonucleotide
ttgggatcctcgtcactgtggccgct

SEQ ID NO: 338038 - DNA, 25 bp, Artificial Sequence
  Description of Artificial Sequence: Synthetic oligonucleotide
tgggatcctcgtcactgtggccgct

SEQ ID NO: 338039 - DNA, 24 bp, Artificial Sequence
  Description of Artificial Sequence: Synthetic oligonucleotide
gggatcctcgtcactgtggccgct

SEQ ID NO: 338040 - DNA, 24 bp, Artificial Sequence
  Description of Artificial Sequence: Synthetic oligonucleotide
ggatcctcgtcactgtggccgctg

SEQ ID NO: 338041 - DNA, 24 bp, Artificial Sequence
  Description of Artificial Sequence: Synthetic oligonucleotide
gatcctcgtcactgtggccgctgc

SEQ ID NO: 338042 - DNA, 26 bp, Artificial Sequence
  Description of Artificial Sequence: Synthetic oligonucleotide
atcctcgtcactgtggccgctgcgta

SEQ ID NO: 338043 - DNA, 25 bp, Artificial Sequence
  Description of Artificial Sequence: Synthetic oligonucleotide
tcctcgtcactgtggccgctgcgta

SEQ ID NO: 338044 - DNA, 24 bp, Artificial Sequence
  Description of Artificial Sequence: Synthetic oligonucleotide
cctcgtcactgtggccgctgcgta

SEQ ID NO: 338045 - DNA, 24 bp, Artificial Sequence
  Description of Artificial Sequence: Synthetic oligonucleotide
ctcgtcactgtggccgctgcgtag

SEQ ID NO: 338046 - DNA, 27 bp, Artificial Sequence
  Description of Artificial Sequence: Synthetic oligonucleotide
tcgtcactgtggccgctgcgtagctat

SEQ ID NO: 338047 - DNA, 26 bp, Artificial Sequence
  Description of Artificial Sequence: Synthetic oligonucleotide
cgtcactgtggccgctgcgtagctat

SEQ ID NO: 338048 - DNA, 26 bp, Artificial Sequence
  Description of Artificial Sequence: Synthetic oligonucleotide
gtcactgtggccgctgcgtagctatg

SEQ ID NO: 338049 - DNA, 27 bp, Artificial Sequence
  Description of Artificial Sequence: Synthetic oligonucleotide
tcactgtggccgctgcgtagctatgca

SEQ ID NO: 338050 - DNA, 27 bp, Artificial Sequence
  Description of Artificial Sequence: Synthetic oligonucleotide
cactgtggccgctgcgtagctatgcaa

SEQ ID NO: 338051 - DNA, 27 bp, Artificial Sequence
  Description of Artificial Sequence: Synthetic oligonucleotide
actgtggccgctgcgtagctatgcaag

SEQ ID NO: 338052 - DNA, 27 bp, Artificial Sequence
  Description of Artificial Sequence: Synthetic oligonucleotide
ctgtggccgctgcgtagctatgcaaga

SEQ ID NO: 338053 - DNA, 27 bp, Artificial Sequence
  Description of Artificial Sequence: Synthetic oligonucleotide
tgtggccgctgcgtagctatgcaagag

SEQ ID NO: 338054 - DNA, 26 bp, Artificial Sequence
  Description of Artificial Sequence: Synthetic oligonucleotide
gtggccgctgcgtagctatgcaagag

SEQ ID NO: 338055 - DNA, 26 bp, Artificial Sequence
  Description of Artificial Sequence: Synthetic oligonucleotide
tggccgctgcgtagctatgcaagagc

SEQ ID NO: 338056 - DNA, 25 bp, Artificial Sequence
  Description of Artificial Sequence: Synthetic oligonucleotide
ggccgctgcgtagctatgcaagagc

SEQ ID NO: 338057 - DNA, 27 bp, Artificial Sequence
  Description of Artificial Sequence: Synthetic oligonucleotide
gccgctgcgtagctatgcaagagccta

SEQ ID NO: 338058 - DNA, 27 bp, Artificial Sequence
  Description of Artificial Sequence: Synthetic oligonucleotide
ccgctgcgtagctatgcaagagcctag

SEQ ID NO: 338059 - DNA, 27 bp, Artificial Sequence
  Description of Artificial Sequence: Synthetic oligonucleotide
cgctgcgtagctatgcaagagcctagc

SEQ ID NO: 338060 - DNA, 30 bp, Artificial Sequence
  Description of Artificial Sequence: Synthetic oligonucleotide
gctgcgtagctatgcaagagcctagctaag

SEQ ID NO: 338061 - DNA, 32 bp, Artificial Sequence
  Description of Artificial Sequence: Synthetic oligonucleotide
ctgcgtagctatgcaagagcctagctaagaag

SEQ ID NO: 338062 - DNA, 33 bp, Artificial Sequence
  Description of Artificial Sequence: Synthetic oligonucleotide
tgcgtagctatgcaagagcctagctaagaagtc

SEQ ID NO: 338063 - DNA, 32 bp, Artificial Sequence
  Description of Artificial Sequence: Synthetic oligonucleotide
gcgtagctatgcaagagcctagctaagaagtc

SEQ ID NO: 338064 - DNA, 32 bp, Artificial Sequence
  Description of Artificial Sequence: Synthetic oligonucleotide
cgtagctatgcaagagcctagctaagaagtcc

SEQ ID NO: 338065 - DNA, 32 bp, Artificial Sequence
  Description of Artificial Sequence: Synthetic oligonucleotide
gtagctatgcaagagcctagctaagaagtccc

SEQ ID NO: 338066 - DNA, 33 bp, Artificial Sequence
  Description of Artificial Sequence: Synthetic oligonucleotide
tagctatgcaagagcctagctaagaagtcccac

SEQ ID NO: 338067 - DNA, 32 bp, Artificial Sequence
  Description of Artificial Sequence: Synthetic oligonucleotide
agctatgcaagagcctagctaagaagtcccac

SEQ ID NO: 338068 - DNA, 31 bp, Artificial Sequence
  Description of Artificial Sequence: Synthetic oligonucleotide
gctatgcaagagcctagctaagaagtcccac

SEQ ID NO: 338069 - DNA, 31 bp, Artificial Sequence
  Description of Artificial Sequence: Synthetic oligonucleotide
ctatgcaagagcctagctaagaagtcccacg

SEQ ID NO: 338070 - DNA, 31 bp, Artificial Sequence
  Description of Artificial Sequence: Synthetic oligonucleotide
tatgcaagagcctagctaagaagtcccacgc

SEQ ID NO: 338071 - DNA, 30 bp, Artificial Sequence
  Description of Artificial Sequence: Synthetic oligonucleotide
atgcaagagcctagctaagaagtcccacgc

SEQ ID NO: 338072 - DNA, 29 bp, Artificial Sequence
  Description of Artificial Sequence: Synthetic oligonucleotide
tgcaagagcctagctaagaagtcccacgc

SEQ ID NO: 338073 - DNA, 28 bp, Artificial Sequence
  Description of Artificial Sequence: Synthetic oligonucleotide
gcaagagcctagctaagaagtcccacgc

SEQ ID NO: 338074 - DNA, 28 bp, Artificial Sequence
  Description of Artificial Sequence: Synthetic oligonucleotide
caagagcctagctaagaagtcccacgcg

SEQ ID NO: 338075 - DNA, 20 bp, Artificial Sequence
  Description of Artificial Sequence: Synthetic oligonucleotide
atggcccgccgggctgcgca

SEQ ID NO: 338076 - DNA, 20 bp, Artificial Sequence
  Description of Artificial Sequence: Synthetic oligonucleotide
tggcccgccgggctgcgcat

SEQ ID NO: 338077 - DNA, 20 bp, Artificial Sequence
  Description of Artificial Sequence: Synthetic oligonucleotide
ggcccgccgggctgcgcatt

SEQ ID NO: 338078 - DNA, 20 bp, Artificial Sequence
  Description of Artificial Sequence: Synthetic oligonucleotide
gcccgccgggctgcgcagtt

SEQ ID NO: 338079 - DNA, 20 bp, Artificial Sequence
  Description of Artificial Sequence: Synthetic oligonucleotide
cccgccgggctgcgcaggtt

SEQ ID NO: 338080 - DNA, 20 bp, Artificial Sequence
  Description of Artificial Sequence: Synthetic oligonucleotide
ccgccgggctgcgcaggctt

SEQ ID NO: 338081 - DNA, 20 bp, Artificial Sequence
  Description of Artificial Sequence: Synthetic oligonucleotide
cgccgggctgcgcaggcgtt

SEQ ID NO: 338082 - DNA, 20 bp, Artificial Sequence
  Description of Artificial Sequence: Synthetic oligonucleotide
gccgggctgcgcaggcgctt

SEQ ID NO: 338083 - DNA, 20 bp, Artificial Sequence
  Description of Artificial Sequence: Synthetic oligonucleotide
ccgggctgcgcaggcgctgt

SEQ ID NO: 338084 - DNA, 20 bp, Artificial Sequence
  Description of Artificial Sequence: Synthetic oligonucleotide
cgggctgcgcaggcgctgct

SEQ ID NO: 338085 - DNA, 20 bp, Artificial Sequence
  Description of Artificial Sequence: Synthetic oligonucleotide
gggctgcgcaggcgctgctc

SEQ ID NO: 338086 - DNA, 21 bp, Artificial Sequence
  Description of Artificial Sequence: Synthetic oligonucleotide
ggctgcgcaggcgctgctcct

SEQ ID NO: 338087 - DNA, 23 bp, Artificial Sequence
  Description of Artificial Sequence: Synthetic oligonucleotide
gctgcgcaggcgctgctcctctt

SEQ ID NO: 338088 - DNA, 23 bp, Artificial Sequence
  Description of Artificial Sequence: Synthetic oligonucleotide
ctgcgcaggcgctgctcctcttc

SEQ ID NO: 338089 - DNA, 23 bp, Artificial Sequence
  Description of Artificial Sequence: Synthetic oligonucleotide
tgcgcaggcgctgctcctcttcg

SEQ ID NO: 338090 - DNA, 22 bp, Artificial Sequence
  Description of Artificial Sequence: Synthetic oligonucleotide
gcgcaggcgctgctcctcttcg

SEQ ID NO: 338091 - DNA, 22 bp, Artificial Sequence
  Description of Artificial Sequence: Synthetic oligonucleotide
cgcaggcgctgctcctcttcgg

SEQ ID NO: 338092 - DNA, 22 bp, Artificial Sequence
  Description of Artificial Sequence: Synthetic oligonucleotide
gcaggcgctgctcctcttcggc

SEQ ID NO: 338093 - DNA, 23 bp, Artificial Sequence
  Description of Artificial Sequence: Synthetic oligonucleotide
caggcgctgctcctcttcggcgt

SEQ ID NO: 338094 - DNA, 23 bp, Artificial Sequence
  Description of Artificial Sequence: Synthetic oligonucleotide
aggcgctgctcctcttcggcgtg

SEQ ID NO: 338095 - DNA, 22 bp, Artificial Sequence
  Description of Artificial Sequence: Synthetic oligonucleotide
ggcgctgctcctcttcggcgtg

SEQ ID NO: 338096 - DNA, 23 bp, Artificial Sequence
  Description of Artificial Sequence: Synthetic oligonucleotide
gcgctgctcctcttcggcgtgct

SEQ ID NO: 338097 - DNA, 23 bp, Artificial Sequence
  Description of Artificial Sequence: Synthetic oligonucleotide
cgctgctcctcttcggcgtgctg

SEQ ID NO: 338098 - DNA, 23 bp, Artificial Sequence
  Description of Artificial Sequence: Synthetic oligonucleotide
gctgctcctcttcggcgtgctgg

SEQ ID NO: 338099 - DNA, 24 bp, Artificial Sequence
  Description of Artificial Sequence: Synthetic oligonucleotide
ctgctcctcttcggcgtgctgggt

SEQ ID NO: 338100 - DNA, 26 bp, Artificial Sequence
  Description of Artificial Sequence: Synthetic oligonucleotide
tgctcctcttcggcgtgctgggtgat

SEQ ID NO: 338101 - DNA, 25 bp, Artificial Sequence
  Description of Artificial Sequence: Synthetic oligonucleotide
gctcctcttcggcgtgctgggtgat

SEQ ID NO: 338102 - DNA, 26 bp, Artificial Sequence
  Description of Artificial Sequence: Synthetic oligonucleotide
ctcctcttcggcgtgctgggtgatct

SEQ ID NO: 338103 - DNA, 26 bp, Artificial Sequence
  Description of Artificial Sequence: Synthetic oligonucleotide
tcctcttcggcgtgctgggtgatctg

SEQ ID NO: 338104 - DNA, 25 bp, Artificial Sequence
  Description of Artificial Sequence: Synthetic oligonucleotide
cctcttcggcgtgctgggtgatctg

SEQ ID NO: 338105 - DNA, 26 bp, Artificial Sequence
  Description of Artificial Sequence: Synthetic oligonucleotide
ctcttcggcgtgctgggtgatctggt

SEQ ID NO: 338106 - DNA, 26 bp, Artificial Sequence
  Description of Artificial Sequence: Synthetic oligonucleotide
tcttcggcgtgctgggtgatctggtc

SEQ ID NO: 338107 - DNA, 25 bp, Artificial Sequence
  Description of Artificial Sequence: Synthetic oligonucleotide
cttcggcgtgctgggtgatctggtc

SEQ ID NO: 338108 - DNA, 25 bp, Artificial Sequence
  Description of Artificial Sequence: Synthetic oligonucleotide
ttcggcgtgctgggtgatctggtcg

SEQ ID NO: 338109 - DNA, 24 bp, Artificial Sequence
  Description of Artificial Sequence: Synthetic oligonucleotide
tcggcgtgctgggtgatctggtcg

SEQ ID NO: 338110 - DNA, 23 bp, Artificial Sequence
  Description of Artificial Sequence: Synthetic oligonucleotide
cggcgtgctgggtgatctggtcg

SEQ ID NO: 338111 - DNA, 23 bp, Artificial Sequence
  Description of Artificial Sequence: Synthetic oligonucleotide
ggcgtgctgggtgatctggtcgc

SEQ ID NO: 338112 - DNA, 23 bp, Artificial Sequence
  Description of Artificial Sequence: Synthetic oligonucleotide
gcgtgctgggtgatctggtcgcg

SEQ ID NO: 338113 - DNA, 23 bp, Artificial Sequence
  Description of Artificial Sequence: Synthetic oligonucleotide
cgtgctgggtgatctggtcgcgg

SEQ ID NO: 338114 - DNA, 23 bp, Artificial Sequence
  Description of Artificial Sequence: Synthetic oligonucleotide
gtgctgggtgatctggtcgcggc

SEQ ID NO: 338115 - DNA, 23 bp, Artificial Sequence
  Description of Artificial Sequence: Synthetic oligonucleotide
tgctgggtgatctggtcgcggcc

SEQ ID NO: 338116 - DNA, 22 bp, Artificial Sequence
  Description of Artificial Sequence: Synthetic oligonucleotide
gctgggtgatctggtcgcggcc

SEQ ID NO: 338117 - DNA, 22 bp, Artificial Sequence
  Description of Artificial Sequence: Synthetic oligonucleotide
ctgggtgatctggtcgcggccc

SEQ ID NO: 338118 - DNA, 22 bp, Artificial Sequence
  Description of Artificial Sequence: Synthetic oligonucleotide
tgggtgatctggtcgcggcccc

SEQ ID NO: 338119 - DNA, 21 bp, Artificial Sequence
  Description of Artificial Sequence: Synthetic oligonucleotide
gggtgatctggtcgcggcccc

SEQ ID NO: 338120 - DNA, 21 bp, Artificial Sequence
  Description of Artificial Sequence: Synthetic oligonucleotide
ggtgatctggtcgcggccccg

SEQ ID NO: 338121 - DNA, 23 bp, Artificial Sequence
  Description of Artificial Sequence: Synthetic oligonucleotide
gtgatctggtcgcggccccggat

SEQ ID NO: 338122 - DNA, 23 bp, Artificial Sequence
  Description of Artificial Sequence: Synthetic oligonucleotide
tgatctggtcgcggccccggatc

SEQ ID NO: 338123 - DNA, 22 bp, Artificial Sequence
  Description of Artificial Sequence: Synthetic oligonucleotide
gatctggtcgcggccccggatc

SEQ ID NO: 338124 - DNA, 23 bp, Artificial Sequence
  Description of Artificial Sequence: Synthetic oligonucleotide
atctggtcgcggccccggatcgt

SEQ ID NO: 338125 - DNA, 22 bp, Artificial Sequence
  Description of Artificial Sequence: Synthetic oligonucleotide
tctggtcgcggccccggatcgt

SEQ ID NO: 338126 - DNA, 21 bp, Artificial Sequence
  Description of Artificial Sequence: Synthetic oligonucleotide
ctggtcgcggccccggatcgt

SEQ ID NO: 338127 - DNA, 21 bp, Artificial Sequence
  Description of Artificial Sequence: Synthetic oligonucleotide
tggtcgcggccccggatcgtg

SEQ ID NO: 338128 - DNA, 20 bp, Artificial Sequence
  Description of Artificial Sequence: Synthetic oligonucleotide
ggtcgcggccccggatcgtg

SEQ ID NO: 338129 - DNA, 23 bp, Artificial Sequence
  Description of Artificial Sequence: Synthetic oligonucleotide
gtcgcggccccggatcgtggttt

SEQ ID NO: 338130 - DNA, 23 bp, Artificial Sequence
  Description of Artificial Sequence: Synthetic oligonucleotide
tcgcggccccggatcgtggtttc

SEQ ID NO: 338131 - DNA, 22 bp, Artificial Sequence
  Description of Artificial Sequence: Synthetic oligonucleotide
cgcggccccggatcgtggtttc

SEQ ID NO: 338132 - DNA, 27 bp, Artificial Sequence
  Description of Artificial Sequence: Synthetic oligonucleotide
gcggccccggatcgtggtttcgtttta

SEQ ID NO: 338133 - DNA, 28 bp, Artificial Sequence
  Description of Artificial Sequence: Synthetic oligonucleotide
cggccccggatcgtggtttcgttttatc

SEQ ID NO: 338134 - DNA, 28 bp, Artificial Sequence
  Description of Artificial Sequence: Synthetic oligonucleotide
ggccccggatcgtggtttcgttttatcc

SEQ ID NO: 338135 - DNA, 28 bp, Artificial Sequence
  Description of Artificial Sequence: Synthetic oligonucleotide
gccccggatcgtggtttcgttttatccg

SEQ ID NO: 338136 - DNA, 30 bp, Artificial Sequence
  Description of Artificial Sequence: Synthetic oligonucleotide
ccccggatcgtggtttcgttttatccgaag

SEQ ID NO: 338137 - DNA, 30 bp, Artificial Sequence
  Description of Artificial Sequence: Synthetic oligonucleotide
cccggatcgtggtttcgttttatccgaagc

SEQ ID NO: 338138 - DNA, 30 bp, Artificial Sequence
  Description of Artificial Sequence: Synthetic oligonucleotide
ccggatcgtggtttcgttttatccgaagcc

SEQ ID NO: 338139 - DNA, 30 bp, Artificial Sequence
  Description of Artificial Sequence: Synthetic oligonucleotide
cggatcgtggtttcgttttatccgaagccc

SEQ ID NO: 338140 - DNA, 32 bp, Artificial Sequence
  Description of Artificial Sequence: Synthetic oligonucleotide
ggatcgtggtttcgttttatccgaagcccttc

SEQ ID NO: 338141 - DNA, 32 bp, Artificial Sequence
  Description of Artificial Sequence: Synthetic oligonucleotide
gatcgtggtttcgttttatccgaagcccttcc

SEQ ID NO: 338142 - DNA, 33 bp, Artificial Sequence
  Description of Artificial Sequence: Synthetic oligonucleotide
atcgtggtttcgttttatccgaagcccttcctc

SEQ ID NO: 338143 - DNA, 32 bp, Artificial Sequence
  Description of Artificial Sequence: Synthetic oligonucleotide
tcgtggtttcgttttatccgaagcccttcctc

SEQ ID NO: 338144 - DNA, 31 bp, Artificial Sequence
  Description of Artificial Sequence: Synthetic oligonucleotide
cgtggtttcgttttatccgaagcccttcctc

SEQ ID NO: 338145 - DNA, 32 bp, Artificial Sequence
  Description of Artificial Sequence: Synthetic oligonucleotide
gtggtttcgttttatccgaagcccttcctcac

SEQ ID NO: 338146 - DNA, 35 bp, Artificial Sequence
  Description of Artificial Sequence: Synthetic oligonucleotide
tggtttcgttttatccgaagcccttcctcacaatg

SEQ ID NO: 338147 - DNA, 34 bp, Artificial Sequence
  Description of Artificial Sequence: Synthetic oligonucleotide
ggtttcgttttatccgaagcccttcctcacaatg

SEQ ID NO: 338148 - DNA, 38 bp, Artificial Sequence
  Description of Artificial Sequence: Synthetic oligonucleotide
gtttcgttttatccgaagcccttcctcacaatgaaatc

SEQ ID NO: 338149 - DNA, 40 bp, Artificial Sequence
  Description of Artificial Sequence: Synthetic oligonucleotide
tttcgttttatccgaagcccttcctcacaatgaaatcaag

SEQ ID NO: 338150 - DNA, 39 bp, Artificial Sequence
  Description of Artificial Sequence: Synthetic oligonucleotide
ttcgttttatccgaagcccttcctcacaatgaaatcaag

SEQ ID NO: 338151 - DNA, 38 bp, Artificial Sequence
  Description of Artificial Sequence: Synthetic oligonucleotide
tcgttttatccgaagcccttcctcacaatgaaatcaag

SEQ ID NO: 338152 - DNA, 37 bp, Artificial Sequence
  Description of Artificial Sequence: Synthetic oligonucleotide
cgttttatccgaagcccttcctcacaatgaaatcaag

SEQ ID NO: 338153 - DNA, 40 bp, Artificial Sequence
  Description of Artificial Sequence: Synthetic oligonucleotide
gttttatccgaagcccttcctcacaatgaaatcaagaaac

SEQ ID NO: 338154 - DNA, 40 bp, Artificial Sequence
  Description of Artificial Sequence: Synthetic oligonucleotide
ttttatccgaagcccttcctcacaatgaaatcaagaaacc

SEQ ID NO: 338155 - DNA, 39 bp, Artificial Sequence
  Description of Artificial Sequence: Synthetic oligonucleotide
tttatccgaagcccttcctcacaatgaaatcaagaaacc

SEQ ID NO: 338156 - DNA, 38 bp, Artificial Sequence
  Description of Artificial Sequence: Synthetic oligonucleotide
ttatccgaagcccttcctcacaatgaaatcaagaaacc

SEQ ID NO: 338157 - DNA, 37 bp, Artificial Sequence
  Description of Artificial Sequence: Synthetic oligonucleotide
tatccgaagcccttcctcacaatgaaatcaagaaacc

SEQ ID NO: 338158 - DNA, 36 bp, Artificial Sequence
  Description of Artificial Sequence: Synthetic oligonucleotide
atccgaagcccttcctcacaatgaaatcaagaaacc

SEQ ID NO: 338159 - DNA, 35 bp, Artificial Sequence
  Description of Artificial Sequence: Synthetic oligonucleotide
tccgaagcccttcctcacaatgaaatcaagaaacc

SEQ ID NO: 338160 - DNA, 34 bp, Artificial Sequence
  Description of Artificial Sequence: Synthetic oligonucleotide
ccgaagcccttcctcacaatgaaatcaagaaacc

SEQ ID NO: 338161 - DNA, 34 bp, Artificial Sequence
  Description of Artificial Sequence: Synthetic oligonucleotide
cgaagcccttcctcacaatgaaatcaagaaaccg

SEQ ID NO: 338162 - DNA, 35 bp, Artificial Sequence
  Description of Artificial Sequence: Synthetic oligonucleotide
gaagcccttcctcacaatgaaatcaagaaaccgac

SEQ ID NO: 338163 - DNA, 36 bp, Artificial Sequence
  Description of Artificial Sequence: Synthetic oligonucleotide
aagcccttcctcacaatgaaatcaagaaaccgactg

SEQ ID NO: 338164 - DNA, 35 bp, Artificial Sequence
  Description of Artificial Sequence: Synthetic oligonucleotide
agcccttcctcacaatgaaatcaagaaaccgactg

SEQ ID NO: 338165 - DNA, 34 bp, Artificial Sequence
  Description of Artificial Sequence: Synthetic oligonucleotide
gcccttcctcacaatgaaatcaagaaaccgactg

SEQ ID NO: 338166 - DNA, 34 bp, Artificial Sequence
  Description of Artificial Sequence: Synthetic oligonucleotide
cccttcctcacaatgaaatcaagaaaccgactgc

SEQ ID NO: 338167 - DNA, 37 bp, Artificial Sequence
  Description of Artificial Sequence: Synthetic oligonucleotide
ccttcctcacaatgaaatcaagaaaccgactgcaatc

SEQ ID NO: 338168 - DNA, 37 bp, Artificial Sequence
  Description of Artificial Sequence: Synthetic oligonucleotide
cttcctcacaatgaaatcaagaaaccgactgcaatcg

SEQ ID NO: 338169 - DNA, 37 bp, Artificial Sequence
  Description of Artificial Sequence: Synthetic oligonucleotide
ttcctcacaatgaaatcaagaaaccgactgcaatcgc

SEQ ID NO: 338170 - DNA, 36 bp, Artificial Sequence
  Description of Artificial Sequence: Synthetic oligonucleotide
tcctcacaatgaaatcaagaaaccgactgcaatcgc

SEQ ID NO: 338171 - DNA, 35 bp, Artificial Sequence
  Description of Artificial Sequence: Synthetic oligonucleotide
cctcacaatgaaatcaagaaaccgactgcaatcgc

SEQ ID NO: 338172 - DNA, 35 bp, Artificial Sequence
  Description of Artificial Sequence: Synthetic oligonucleotide
ctcacaatgaaatcaagaaaccgactgcaatcgcc

SEQ ID NO: 338173 - DNA, 37 bp, Artificial Sequence
  Description of Artificial Sequence: Synthetic oligonucleotide
tcacaatgaaatcaagaaaccgactgcaatcgccaag

SEQ ID NO: 338174 - DNA, 36 bp, Artificial Sequence
  Description of Artificial Sequence: Synthetic oligonucleotide
cacaatgaaatcaagaaaccgactgcaatcgccaag

SEQ ID NO: 338175 - DNA, 39 bp, Artificial Sequence
  Description of Artificial Sequence: Synthetic oligonucleotide
acaatgaaatcaagaaaccgactgcaatcgccaagaaac

SEQ ID NO: 338176 - DNA, 38 bp, Artificial Sequence
  Description of Artificial Sequence: Synthetic oligonucleotide
caatgaaatcaagaaaccgactgcaatcgccaagaaac

SEQ ID NO: 338177 - DNA, 38 bp, Artificial Sequence
  Description of Artificial Sequence: Synthetic oligonucleotide
aatgaaatcaagaaaccgactgcaatcgccaagaaacg

SEQ ID NO: 338178 - DNA, 37 bp, Artificial Sequence
  Description of Artificial Sequence: Synthetic oligonucleotide
atgaaatcaagaaaccgactgcaatcgccaagaaacg

SEQ ID NO: 338179 - DNA, 36 bp, Artificial Sequence
  Description of Artificial Sequence: Synthetic oligonucleotide
tgaaatcaagaaaccgactgcaatcgccaagaaacg

SEQ ID NO: 338180 - DNA, 35 bp, Artificial Sequence
  Description of Artificial Sequence: Synthetic oligonucleotide
gaaatcaagaaaccgactgcaatcgccaagaaacg

SEQ ID NO: 338181 - DNA, 35 bp, Artificial Sequence
  Description of Artificial Sequence: Synthetic oligonucleotide
aaatcaagaaaccgactgcaatcgccaagaaacgc

SEQ ID NO: 338182 - DNA, 34 bp, Artificial Sequence
  Description of Artificial Sequence: Synthetic oligonucleotide
aatcaagaaaccgactgcaatcgccaagaaacgc

SEQ ID NO: 338183 - DNA, 33 bp, Artificial Sequence
  Description of Artificial Sequence: Synthetic oligonucleotide
atcaagaaaccgactgcaatcgccaagaaacgc

SEQ ID NO: 338184 - DNA, 32 bp, Artificial Sequence
  Description of Artificial Sequence: Synthetic oligonucleotide
tcaagaaaccgactgcaatcgccaagaaacgc

SEQ ID NO: 338185 - DNA, 31 bp, Artificial Sequence
  Description of Artificial Sequence: Synthetic oligonucleotide
caagaaaccgactgcaatcgccaagaaacgc

SEQ ID NO: 338186 - DNA, 32 bp, Artificial Sequence
  Description of Artificial Sequence: Synthetic oligonucleotide
aagaaaccgactgcaatcgccaagaaacgcag

SEQ ID NO: 338187 - DNA, 31 bp, Artificial Sequence
  Description of Artificial Sequence: Synthetic oligonucleotide
agaaaccgactgcaatcgccaagaaacgcag

SEQ ID NO: 338188 - DNA, 30 bp, Artificial Sequence
  Description of Artificial Sequence: Synthetic oligonucleotide
gaaaccgactgcaatcgccaagaaacgcag

SEQ ID NO: 338189 - DNA, 31 bp, Artificial Sequence
  Description of Artificial Sequence: Synthetic oligonucleotide
aaaccgactgcaatcgccaagaaacgcagtg

SEQ ID NO: 338190 - DNA, 30 bp, Artificial Sequence
  Description of Artificial Sequence: Synthetic oligonucleotide
aaccgactgcaatcgccaagaaacgcagtg

SEQ ID NO: 338191 - DNA, 29 bp, Artificial Sequence
  Description of Artificial Sequence: Synthetic oligonucleotide
accgactgcaatcgccaagaaacgcagtg

SEQ ID NO: 338192 - DNA, 28 bp, Artificial Sequence
  Description of Artificial Sequence: Synthetic oligonucleotide
ccgactgcaatcgccaagaaacgcagtg

SEQ ID NO: 338193 - DNA, 28 bp, Artificial Sequence
  Description of Artificial Sequence: Synthetic oligonucleotide
cgactgcaatcgccaagaaacgcagtgc

SEQ ID NO: 338194 - DNA, 29 bp, Artificial Sequence
  Description of Artificial Sequence: Synthetic oligonucleotide
gactgcaatcgccaagaaacgcagtgctg

SEQ ID NO: 338195 - DNA, 29 bp, Artificial Sequence
  Description of Artificial Sequence: Synthetic oligonucleotide
actgcaatcgccaagaaacgcagtgctgg

SEQ ID NO: 338196 - DNA, 28 bp, Artificial Sequence
  Description of Artificial Sequence: Synthetic oligonucleotide
ctgcaatcgccaagaaacgcagtgctgg

SEQ ID NO: 338197 - DNA, 28 bp, Artificial Sequence
  Description of Artificial Sequence: Synthetic oligonucleotide
tgcaatcgccaagaaacgcagtgctggc

SEQ ID NO: 338198 - DNA, 27 bp, Artificial Sequence
  Description of Artificial Sequence: Synthetic oligonucleotide
gcaatcgccaagaaacgcagtgctggc

SEQ ID NO: 338199 - DNA, 27 bp, Artificial Sequence
  Description of Artificial Sequence: Synthetic oligonucleotide
caatcgccaagaaacgcagtgctggcg

SEQ ID NO: 338200 - DNA, 29 bp, Artificial Sequence
  Description of Artificial Sequence: Synthetic oligonucleotide
aatcgccaagaaacgcagtgctggcgatg

SEQ ID NO: 338201 - DNA, 28 bp, Artificial Sequence
  Description of Artificial Sequence: Synthetic oligonucleotide
atcgccaagaaacgcagtgctggcgatg

SEQ ID NO: 338202 - DNA, 27 bp, Artificial Sequence
  Description of Artificial Sequence: Synthetic oligonucleotide
tcgccaagaaacgcagtgctggcgatg

SEQ ID NO: 338203 - DNA, 27 bp, Artificial Sequence
  Description of Artificial Sequence: Synthetic oligonucleotide
cgccaagaaacgcagtgctggcgatga

SEQ ID NO: 338204 - DNA, 27 bp, Artificial Sequence
  Description of Artificial Sequence: Synthetic oligonucleotide
gccaagaaacgcagtgctggcgatgac

SEQ ID NO: 338205 - DNA, 30 bp, Artificial Sequence
  Description of Artificial Sequence: Synthetic oligonucleotide
ccaagaaacgcagtgctggcgatgactttc

SEQ ID NO: 338206 - DNA, 31 bp, Artificial Sequence
  Description of Artificial Sequence: Synthetic oligonucleotide
caagaaacgcagtgctggcgatgactttcac

SEQ ID NO: 338207 - DNA, 34 bp, Artificial Sequence
  Description of Artificial Sequence: Synthetic oligonucleotide
aagaaacgcagtgctggcgatgactttcacttag

SEQ ID NO: 338208 - DNA, 33 bp, Artificial Sequence
  Description of Artificial Sequence: Synthetic oligonucleotide
agaaacgcagtgctggcgatgactttcacttag

SEQ ID NO: 338209 - DNA, 32 bp, Artificial Sequence
  Description of Artificial Sequence: Synthetic oligonucleotide
gaaacgcagtgctggcgatgactttcacttag

SEQ ID NO: 338210 - DNA, 32 bp, Artificial Sequence
  Description of Artificial Sequence: Synthetic oligonucleotide
aaacgcagtgctggcgatgactttcacttagg

SEQ ID NO: 338211 - DNA, 31 bp, Artificial Sequence
  Description of Artificial Sequence: Synthetic oligonucleotide
aacgcagtgctggcgatgactttcacttagg

SEQ ID NO: 338212 - DNA, 30 bp, Artificial Sequence
  Description of Artificial Sequence: Synthetic oligonucleotide
acgcagtgctggcgatgactttcacttagg

SEQ ID NO: 338213 - DNA, 29 bp, Artificial Sequence
  Description of Artificial Sequence: Synthetic oligonucleotide
cgcagtgctggcgatgactttcacttagg

SEQ ID NO: 338214 - DNA, 30 bp, Artificial Sequence
  Description of Artificial Sequence: Synthetic oligonucleotide
gcagtgctggcgatgactttcacttaggag

SEQ ID NO: 338215 - DNA, 32 bp, Artificial Sequence
  Description of Artificial Sequence: Synthetic oligonucleotide
cagtgctggcgatgactttcacttaggagttg

SEQ ID NO: 338216 - DNA, 32 bp, Artificial Sequence
  Description of Artificial Sequence: Synthetic oligonucleotide
agtgctggcgatgactttcacttaggagttgc

SEQ ID NO: 338217 - DNA, 31 bp, Artificial Sequence
  Description of Artificial Sequence: Synthetic oligonucleotide
gtgctggcgatgactttcacttaggagttgc

SEQ ID NO: 338218 - DNA, 32 bp, Artificial Sequence
  Description of Artificial Sequence: Synthetic oligonucleotide
tgctggcgatgactttcacttaggagttgctg

SEQ ID NO: 338219 - DNA, 31 bp, Artificial Sequence
  Description of Artificial Sequence: Synthetic oligonucleotide
gctggcgatgactttcacttaggagttgctg

SEQ ID NO: 338220 - DNA, 33 bp, Artificial Sequence
  Description of Artificial Sequence: Synthetic oligonucleotide
ctggcgatgactttcacttaggagttgctgttg

SEQ ID NO: 338221 - DNA, 35 bp, Artificial Sequence
  Description of Artificial Sequence: Synthetic oligonucleotide
tggcgatgactttcacttaggagttgctgttgtag

SEQ ID NO: 338222 - DNA, 34 bp, Artificial Sequence
  Description of Artificial Sequence: Synthetic oligonucleotide
ggcgatgactttcacttaggagttgctgttgtag

SEQ ID NO: 338223 - DNA, 36 bp, Artificial Sequence
  Description of Artificial Sequence: Synthetic oligonucleotide
gcgatgactttcacttaggagttgctgttgtagatg

SEQ ID NO: 338224 - DNA, 36 bp, Artificial Sequence
  Description of Artificial Sequence: Synthetic oligonucleotide
cgatgactttcacttaggagttgctgttgtagatgg

SEQ ID NO: 338225 - DNA, 37 bp, Artificial Sequence
  Description of Artificial Sequence: Synthetic oligonucleotide
gatgactttcacttaggagttgctgttgtagatggag

SEQ ID NO: 338226 - DNA, 42 bp, Artificial Sequence
  Description of Artificial Sequence: Synthetic oligonucleotide
atgactttcacttaggagttgctgttgtagatggagaatatg

SEQ ID NO: 338227 - DNA, 41 bp, Artificial Sequence
  Description of Artificial Sequence: Synthetic oligonucleotide
tgactttcacttaggagttgctgttgtagatggagaatatg

SEQ ID NO: 338228 - DNA, 40 bp, Artificial Sequence
  Description of Artificial Sequence: Synthetic oligonucleotide
gactttcacttaggagttgctgttgtagatggagaatatg

SEQ ID NO: 338229 - DNA, 41 bp, Artificial Sequence
  Description of Artificial Sequence: Synthetic oligonucleotide
actttcacttaggagttgctgttgtagatggagaatatgac

SEQ ID NO: 338230 - DNA, 40 bp, Artificial Sequence
  Description of Artificial Sequence: Synthetic oligonucleotide
ctttcacttaggagttgctgttgtagatggagaatatgac

SEQ ID NO: 338231 - DNA, 40 bp, Artificial Sequence
  Description of Artificial Sequence: Synthetic oligonucleotide
tttcacttaggagttgctgttgtagatggagaatatgacg

SEQ ID NO: 338232 - DNA, 39 bp, Artificial Sequence
  Description of Artificial Sequence: Synthetic oligonucleotide
ttcacttaggagttgctgttgtagatggagaatatgacg

SEQ ID NO: 338233 - DNA, 38 bp, Artificial Sequence
  Description of Artificial Sequence: Synthetic oligonucleotide
tcacttaggagttgctgttgtagatggagaatatgacg

SEQ ID NO: 338234 - DNA, 37 bp, Artificial Sequence
  Description of Artificial Sequence: Synthetic oligonucleotide
cacttaggagttgctgttgtagatggagaatatgacg

SEQ ID NO: 338235 - DNA, 38 bp, Artificial Sequence
  Description of Artificial Sequence: Synthetic oligonucleotide
acttaggagttgctgttgtagatggagaatatgacgac

SEQ ID NO: 338236 - DNA, 37 bp, Artificial Sequence
  Description of Artificial Sequence: Synthetic oligonucleotide
cttaggagttgctgttgtagatggagaatatgacgac

SEQ ID NO: 338237 - DNA, 37 bp, Artificial Sequence
  Description of Artificial Sequence: Synthetic oligonucleotide
ttaggagttgctgttgtagatggagaatatgacgacc

SEQ ID NO: 338238 - DNA, 36 bp, Artificial Sequence
  Description of Artificial Sequence: Synthetic oligonucleotide
taggagttgctgttgtagatggagaatatgacgacc

SEQ ID NO: 338239 - DNA, 35 bp, Artificial Sequence
  Description of Artificial Sequence: Synthetic oligonucleotide
aggagttgctgttgtagatggagaatatgacgacc

SEQ ID NO: 338240 - DNA, 34 bp, Artificial Sequence
  Description of Artificial Sequence: Synthetic oligonucleotide
ggagttgctgttgtagatggagaatatgacgacc

SEQ ID NO: 338241 - DNA, 34 bp, Artificial Sequence
  Description of Artificial Sequence: Synthetic oligonucleotide
gagttgctgttgtagatggagaatatgacgaccg

SEQ ID NO: 338242 - DNA, 35 bp, Artificial Sequence
  Description of Artificial Sequence: Synthetic oligonucleotide
agttgctgttgtagatggagaatatgacgaccgac

SEQ ID NO: 338243 - DNA, 34 bp, Artificial Sequence
  Description of Artificial Sequence: Synthetic oligonucleotide
gttgctgttgtagatggagaatatgacgaccgac

SEQ ID NO: 338244 - DNA, 34 bp, Artificial Sequence
  Description of Artificial Sequence: Synthetic oligonucleotide
ttgctgttgtagatggagaatatgacgaccgacg

SEQ ID NO: 338245 - DNA, 33 bp, Artificial Sequence
  Description of Artificial Sequence: Synthetic oligonucleotide
tgctgttgtagatggagaatatgacgaccgacg

SEQ ID NO: 338246 - DNA, 32 bp, Artificial Sequence
  Description of Artificial Sequence: Synthetic oligonucleotide
gctgttgtagatggagaatatgacgaccgacg

SEQ ID NO: 338247 - DNA, 33 bp, Artificial Sequence
  Description of Artificial Sequence: Synthetic oligonucleotide
ctgttgtagatggagaatatgacgaccgacgac

SEQ ID NO: 338248 - DNA, 33 bp, Artificial Sequence
  Description of Artificial Sequence: Synthetic oligonucleotide
tgttgtagatggagaatatgacgaccgacgacc

SEQ ID NO: 338249 - DNA, 32 bp, Artificial Sequence
  Description of Artificial Sequence: Synthetic oligonucleotide
gttgtagatggagaatatgacgaccgacgacc

SEQ ID NO: 338250 - DNA, 33 bp, Artificial Sequence
  Description of Artificial Sequence: Synthetic oligonucleotide
ttgtagatggagaatatgacgaccgacgaccac

SEQ ID NO: 338251 - DNA, 32 bp, Artificial Sequence
  Description of Artificial Sequence: Synthetic oligonucleotide
tgtagatggagaatatgacgaccgacgaccac

SEQ ID NO: 338252 - DNA, 31 bp, Artificial Sequence
  Description of Artificial Sequence: Synthetic oligonucleotide
gtagatggagaatatgacgaccgacgaccac

SEQ ID NO: 338253 - DNA, 31 bp, Artificial Sequence
  Description of Artificial Sequence: Synthetic oligonucleotide
tagatggagaatatgacgaccgacgaccacc

SEQ ID NO: 338254 - DNA, 30 bp, Artificial Sequence
  Description of Artificial Sequence: Synthetic oligonucleotide
agatggagaatatgacgaccgacgaccacc

SEQ ID NO: 338255 - DNA, 29 bp, Artificial Sequence
  Description of Artificial Sequence: Synthetic oligonucleotide
gatggagaatatgacgaccgacgaccacc

SEQ ID NO: 338256 - DNA, 29 bp, Artificial Sequence
  Description of Artificial Sequence: Synthetic oligonucleotide
atggagaatatgacgaccgacgaccaccc

SEQ ID NO: 338257 - DNA, 28 bp, Artificial Sequence
  Description of Artificial Sequence: Synthetic oligonucleotide
tggagaatatgacgaccgacgaccaccc

SEQ ID NO: 338258 - DNA, 27 bp, Artificial Sequence
  Description of Artificial Sequence: Synthetic oligonucleotide
ggagaatatgacgaccgacgaccaccc

SEQ ID NO: 338259 - DNA, 29 bp, Artificial Sequence
  Description of Artificial Sequence: Synthetic oligonucleotide
gagaatatgacgaccgacgaccacccaac

SEQ ID NO: 338260 - DNA, 29 bp, Artificial Sequence
  Description of Artificial Sequence: Synthetic oligonucleotide
agaatatgacgaccgacgaccacccaacc

SEQ ID NO: 338261 - DNA, 28 bp, Artificial Sequence
  Description of Artificial Sequence: Synthetic oligonucleotide
gaatatgacgaccgacgaccacccaacc

SEQ ID NO: 338262 - DNA, 28 bp, Artificial Sequence
  Description of Artificial Sequence: Synthetic oligonucleotide
aatatgacgaccgacgaccacccaaccc

SEQ ID NO: 338263 - DNA, 27 bp, Artificial Sequence
  Description of Artificial Sequence: Synthetic oligonucleotide
atatgacgaccgacgaccacccaaccc

SEQ ID NO: 338264 - DNA, 27 bp, Artificial Sequence
  Description of Artificial Sequence: Synthetic oligonucleotide
tatgacgaccgacgaccacccaaccca

SEQ ID NO: 338265 - DNA, 26 bp, Artificial Sequence
  Description of Artificial Sequence: Synthetic oligonucleotide
atgacgaccgacgaccacccaaccca

SEQ ID NO: 338266 - DNA, 25 bp, Artificial Sequence
  Description of Artificial Sequence: Synthetic oligonucleotide
tgacgaccgacgaccacccaaccca

SEQ ID NO: 338267 - DNA, 24 bp, Artificial Sequence
  Description of Artificial Sequence: Synthetic oligonucleotide
gacgaccgacgaccacccaaccca

SEQ ID NO: 338268 - DNA, 24 bp, Artificial Sequence
  Description of Artificial Sequence: Synthetic oligonucleotide
acgaccgacgaccacccaacccac

SEQ ID NO: 338269 - DNA, 23 bp, Artificial Sequence
  Description of Artificial Sequence: Synthetic oligonucleotide
cgaccgacgaccacccaacccac

SEQ ID NO: 338270 - DNA, 23 bp, Artificial Sequence
  Description of Artificial Sequence: Synthetic oligonucleotide
gaccgacgaccacccaacccacc

SEQ ID NO: 338271 - DNA, 26 bp, Artificial Sequence
  Description of Artificial Sequence: Synthetic oligonucleotide
accgacgaccacccaacccaccctaa

SEQ ID NO: 338272 - DNA, 25 bp, Artificial Sequence
  Description of Artificial Sequence: Synthetic oligonucleotide
ccgacgaccacccaacccaccctaa

SEQ ID NO: 338273 - DNA, 25 bp, Artificial Sequence
  Description of Artificial Sequence: Synthetic oligonucleotide
cgacgaccacccaacccaccctaac

SEQ ID NO: 338274 - DNA, 25 bp, Artificial Sequence
  Description of Artificial Sequence: Synthetic oligonucleotide
gacgaccacccaacccaccctaacc

SEQ ID NO: 338275 - DNA, 27 bp, Artificial Sequence
  Description of Artificial Sequence: Synthetic oligonucleotide
acgaccacccaacccaccctaaccgat

SEQ ID NO: 338276 - DNA, 26 bp, Artificial Sequence
  Description of Artificial Sequence: Synthetic oligonucleotide
cgaccacccaacccaccctaaccgat

SEQ ID NO: 338277 - DNA, 26 bp, Artificial Sequence
  Description of Artificial Sequence: Synthetic oligonucleotide
gaccacccaacccaccctaaccgatg

SEQ ID NO: 338278 - DNA, 26 bp, Artificial Sequence
  Description of Artificial Sequence: Synthetic oligonucleotide
accacccaacccaccctaaccgatgc

SEQ ID NO: 338279 - DNA, 25 bp, Artificial Sequence
  Description of Artificial Sequence: Synthetic oligonucleotide
ccacccaacccaccctaaccgatgc

SEQ ID NO: 338280 - DNA, 27 bp, Artificial Sequence
  Description of Artificial Sequence: Synthetic oligonucleotide
cacccaacccaccctaaccgatgcgaa

SEQ ID NO: 338281 - DNA, 29 bp, Artificial Sequence
  Description of Artificial Sequence: Synthetic oligonucleotide
acccaacccaccctaaccgatgcgaaatc

SEQ ID NO: 338282 - DNA, 28 bp, Artificial Sequence
  Description of Artificial Sequence: Synthetic oligonucleotide
cccaacccaccctaaccgatgcgaaatc

SEQ ID NO: 338283 - DNA, 28 bp, Artificial Sequence
  Description of Artificial Sequence: Synthetic oligonucleotide
ccaacccaccctaaccgatgcgaaatcc

SEQ ID NO: 338284 - DNA, 31 bp, Artificial Sequence
  Description of Artificial Sequence: Synthetic oligonucleotide
caacccaccctaaccgatgcgaaatccaaag

SEQ ID NO: 338285 - DNA, 31 bp, Artificial Sequence
  Description of Artificial Sequence: Synthetic oligonucleotide
aacccaccctaaccgatgcgaaatccaaagc

SEQ ID NO: 338286 - DNA, 30 bp, Artificial Sequence
  Description of Artificial Sequence: Synthetic oligonucleotide
acccaccctaaccgatgcgaaatccaaagc

SEQ ID NO: 338287 - DNA, 29 bp, Artificial Sequence
  Description of Artificial Sequence: Synthetic oligonucleotide
cccaccctaaccgatgcgaaatccaaagc

SEQ ID NO: 338288 - DNA, 29 bp, Artificial Sequence
  Description of Artificial Sequence: Synthetic oligonucleotide
ccaccctaaccgatgcgaaatccaaagcc

SEQ ID NO: 338289 - DNA, 29 bp, Artificial Sequence
  Description of Artificial Sequence: Synthetic oligonucleotide
caccctaaccgatgcgaaatccaaagccc

SEQ ID NO: 338290 - DNA, 31 bp, Artificial Sequence
  Description of Artificial Sequence: Synthetic oligonucleotide
accctaaccgatgcgaaatccaaagcccaac

SEQ ID NO: 338291 - DNA, 30 bp, Artificial Sequence
  Description of Artificial Sequence: Synthetic oligonucleotide
ccctaaccgatgcgaaatccaaagcccaac

SEQ ID NO: 338292 - DNA, 30 bp, Artificial Sequence
  Description of Artificial Sequence: Synthetic oligonucleotide
cctaaccgatgcgaaatccaaagcccaacc

SEQ ID NO: 338293 - DNA, 31 bp, Artificial Sequence
  Description of Artificial Sequence: Synthetic oligonucleotide
ctaaccgatgcgaaatccaaagcccaaccac

SEQ ID NO: 338294 - DNA, 31 bp, Artificial Sequence
  Description of Artificial Sequence: Synthetic oligonucleotide
taaccgatgcgaaatccaaagcccaaccacg

SEQ ID NO: 338295 - DNA, 30 bp, Artificial Sequence
  Description of Artificial Sequence: Synthetic oligonucleotide
aaccgatgcgaaatccaaagcccaaccacg

SEQ ID NO: 338296 - DNA, 29 bp, Artificial Sequence
  Description of Artificial Sequence: Synthetic oligonucleotide
accgatgcgaaatccaaagcccaaccacg

SEQ ID NO: 338297 - DNA, 28 bp, Artificial Sequence
  Description of Artificial Sequence: Synthetic oligonucleotide
ccgatgcgaaatccaaagcccaaccacg

SEQ ID NO: 338298 - DNA, 28 bp, Artificial Sequence
  Description of Artificial Sequence: Synthetic oligonucleotide
cgatgcgaaatccaaagcccaaccacgc

SEQ ID NO: 338299 - DNA, 30 bp, Artificial Sequence
  Description of Artificial Sequence: Synthetic oligonucleotide
gatgcgaaatccaaagcccaaccacgctag

SEQ ID NO: 338300 - DNA, 32 bp, Artificial Sequence
  Description of Artificial Sequence: Synthetic oligonucleotide
atgcgaaatccaaagcccaaccacgctagttc

SEQ ID NO: 338301 - DNA, 31 bp, Artificial Sequence
  Description of Artificial Sequence: Synthetic oligonucleotide
tgcgaaatccaaagcccaaccacgctagttc

SEQ ID NO: 338302 - DNA, 30 bp, Artificial Sequence
  Description of Artificial Sequence: Synthetic oligonucleotide
gcgaaatccaaagcccaaccacgctagttc

SEQ ID NO: 338303 - DNA, 30 bp, Artificial Sequence
  Description of Artificial Sequence: Synthetic oligonucleotide
cgaaatccaaagcccaaccacgctagttcc

SEQ ID NO: 338304 - DNA, 31 bp, Artificial Sequence
  Description of Artificial Sequence: Synthetic oligonucleotide
gaaatccaaagcccaaccacgctagttcctg

SEQ ID NO: 338305 - DNA, 31 bp, Artificial Sequence
  Description of Artificial Sequence: Synthetic oligonucleotide
aaatccaaagcccaaccacgctagttcctgc

SEQ ID NO: 338306 - DNA, 30 bp, Artificial Sequence
  Description of Artificial Sequence: Synthetic oligonucleotide
aatccaaagcccaaccacgctagttcctgc

SEQ ID NO: 338307 - DNA, 29 bp, Artificial Sequence
  Description of Artificial Sequence: Synthetic oligonucleotide
atccaaagcccaaccacgctagttcctgc

SEQ ID NO: 338308 - DNA, 28 bp, Artificial Sequence
  Description of Artificial Sequence: Synthetic oligonucleotide
tccaaagcccaaccacgctagttcctgc

SEQ ID NO: 338309 - DNA, 27 bp, Artificial Sequence
  Description of Artificial Sequence: Synthetic oligonucleotide
ccaaagcccaaccacgctagttcctgc

SEQ ID NO: 338310 - DNA, 27 bp, Artificial Sequence
  Description of Artificial Sequence: Synthetic oligonucleotide
caaagcccaaccacgctagttcctgcg

SEQ ID NO: 338311 - DNA, 27 bp, Artificial Sequence
  Description of Artificial Sequence: Synthetic oligonucleotide
aaagcccaaccacgctagttcctgcgg

SEQ ID NO: 338312 - DNA, 27 bp, Artificial Sequence
  Description of Artificial Sequence: Synthetic oligonucleotide
aagcccaaccacgctagttcctgcggt

SEQ ID NO: 338313 - DNA, 27 bp, Artificial Sequence
  Description of Artificial Sequence: Synthetic oligonucleotide
agcccaaccacgctagttcctgcggta

SEQ ID NO: 338314 - DNA, 26 bp, Artificial Sequence
  Description of Artificial Sequence: Synthetic oligonucleotide
gcccaaccacgctagttcctgcggta

SEQ ID NO: 338315 - DNA, 26 bp, Artificial Sequence
  Description of Artificial Sequence: Synthetic oligonucleotide
cccaaccacgctagttcctgcggtag

SEQ ID NO: 338316 - DNA, 27 bp, Artificial Sequence
  Description of Artificial Sequence: Synthetic oligonucleotide
ccaaccacgctagttcctgcggtagct

SEQ ID NO: 338317 - DNA, 30 bp, Artificial Sequence
  Description of Artificial Sequence: Synthetic oligonucleotide
caaccacgctagttcctgcggtagcttatc

SEQ ID NO: 338318 - DNA, 31 bp, Artificial Sequence
  Description of Artificial Sequence: Synthetic oligonucleotide
aaccacgctagttcctgcggtagcttatcag

SEQ ID NO: 338319 - DNA, 30 bp, Artificial Sequence
  Description of Artificial Sequence: Synthetic oligonucleotide
accacgctagttcctgcggtagcttatcag

SEQ ID NO: 338320 - DNA, 29 bp, Artificial Sequence
  Description of Artificial Sequence: Synthetic oligonucleotide
ccacgctagttcctgcggtagcttatcag

SEQ ID NO: 338321 - DNA, 31 bp, Artificial Sequence
  Description of Artificial Sequence: Synthetic oligonucleotide
cacgctagttcctgcggtagcttatcagatg

SEQ ID NO: 338322 - DNA, 31 bp, Artificial Sequence
  Description of Artificial Sequence: Synthetic oligonucleotide
acgctagttcctgcggtagcttatcagatgc

SEQ ID NO: 338323 - DNA, 30 bp, Artificial Sequence
  Description of Artificial Sequence: Synthetic oligonucleotide
cgctagttcctgcggtagcttatcagatgc

SEQ ID NO: 338324 - DNA, 31 bp, Artificial Sequence
  Description of Artificial Sequence: Synthetic oligonucleotide
gctagttcctgcggtagcttatcagatgctc

SEQ ID NO: 338325 - DNA, 32 bp, Artificial Sequence
  Description of Artificial Sequence: Synthetic oligonucleotide
ctagttcctgcggtagcttatcagatgctcac

SEQ ID NO: 338326 - DNA, 32 bp, Artificial Sequence
  Description of Artificial Sequence: Synthetic oligonucleotide
tagttcctgcggtagcttatcagatgctcacc

SEQ ID NO: 338327 - DNA, 31 bp, Artificial Sequence
  Description of Artificial Sequence: Synthetic oligonucleotide
agttcctgcggtagcttatcagatgctcacc

SEQ ID NO: 338328 - DNA, 30 bp, Artificial Sequence
  Description of Artificial Sequence: Synthetic oligonucleotide
gttcctgcggtagcttatcagatgctcacc

SEQ ID NO: 338329 - DNA, 32 bp, Artificial Sequence
  Description of Artificial Sequence: Synthetic oligonucleotide
ttcctgcggtagcttatcagatgctcaccttg

SEQ ID NO: 338330 - DNA, 31 bp, Artificial Sequence
  Description of Artificial Sequence: Synthetic oligonucleotide
tcctgcggtagcttatcagatgctcaccttg

SEQ ID NO: 338331 - DNA, 30 bp, Artificial Sequence
  Description of Artificial Sequence: Synthetic oligonucleotide
cctgcggtagcttatcagatgctcaccttg

SEQ ID NO: 338332 - DNA, 30 bp, Artificial Sequence
  Description of Artificial Sequence: Synthetic oligonucleotide
ctgcggtagcttatcagatgctcaccttgc

SEQ ID NO: 338333 - DNA, 30 bp, Artificial Sequence
  Description of Artificial Sequence: Synthetic oligonucleotide
tgcggtagcttatcagatgctcaccttgcg

SEQ ID NO: 338334 - DNA, 29 bp, Artificial Sequence
  Description of Artificial Sequence: Synthetic oligonucleotide
gcggtagcttatcagatgctcaccttgcg

SEQ ID NO: 338335 - DNA, 29 bp, Artificial Sequence
  Description of Artificial Sequence: Synthetic oligonucleotide
cggtagcttatcagatgctcaccttgcgg

SEQ ID NO: 338336 - DNA, 31 bp, Artificial Sequence
  Description of Artificial Sequence: Synthetic oligonucleotide
ggtagcttatcagatgctcaccttgcggttg

SEQ ID NO: 338337 - DNA, 31 bp, Artificial Sequence
  Description of Artificial Sequence: Synthetic oligonucleotide
gtagcttatcagatgctcaccttgcggttgg

SEQ ID NO: 338338 - DNA, 31 bp, Artificial Sequence
  Description of Artificial Sequence: Synthetic oligonucleotide
tagcttatcagatgctcaccttgcggttggc

SEQ ID NO: 338339 - DNA, 30 bp, Artificial Sequence
  Description of Artificial Sequence: Synthetic oligonucleotide
agcttatcagatgctcaccttgcggttggc

SEQ ID NO: 338340 - DNA, 29 bp, Artificial Sequence
  Description of Artificial Sequence: Synthetic oligonucleotide
gcttatcagatgctcaccttgcggttggc

SEQ ID NO: 338341 - DNA, 29 bp, Artificial Sequence
  Description of Artificial Sequence: Synthetic oligonucleotide
cttatcagatgctcaccttgcggttggcg

SEQ ID NO: 338342 - DNA, 32 bp, Artificial Sequence
  Description of Artificial Sequence: Synthetic oligonucleotide
ttatcagatgctcaccttgcggttggcgtttc

SEQ ID NO: 338343 - DNA, 31 bp, Artificial Sequence
  Description of Artificial Sequence: Synthetic oligonucleotide
tatcagatgctcaccttgcggttggcgtttc

SEQ ID NO: 338344 - DNA, 30 bp, Artificial Sequence
  Description of Artificial Sequence: Synthetic oligonucleotide
atcagatgctcaccttgcggttggcgtttc

SEQ ID NO: 338345 - DNA, 29 bp, Artificial Sequence
  Description of Artificial Sequence: Synthetic oligonucleotide
tcagatgctcaccttgcggttggcgtttc

SEQ ID NO: 338346 - DNA, 28 bp, Artificial Sequence
  Description of Artificial Sequence: Synthetic oligonucleotide
cagatgctcaccttgcggttggcgtttc

SEQ ID NO: 338347 - DNA, 29 bp, Artificial Sequence
  Description of Artificial Sequence: Synthetic oligonucleotide
agatgctcaccttgcggttggcgtttctg

SEQ ID NO: 338348 - DNA, 28 bp, Artificial Sequence
  Description of Artificial Sequence: Synthetic oligonucleotide
gatgctcaccttgcggttggcgtttctg

SEQ ID NO: 338349 - DNA, 28 bp, Artificial Sequence
  Description of Artificial Sequence: Synthetic oligonucleotide
atgctcaccttgcggttggcgtttctgg

SEQ ID NO: 338350 - DNA, 27 bp, Artificial Sequence
  Description of Artificial Sequence: Synthetic oligonucleotide
tgctcaccttgcggttggcgtttctgg

SEQ ID NO: 338351 - DNA, 27 bp, Artificial Sequence
  Description of Artificial Sequence: Synthetic oligonucleotide
gctcaccttgcggttggcgtttctggt

SEQ ID NO: 338352 - DNA, 27 bp, Artificial Sequence
  Description of Artificial Sequence: Synthetic oligonucleotide
ctcaccttgcggttggcgtttctggtg

SEQ ID NO: 338353 - DNA, 27 bp, Artificial Sequence
  Description of Artificial Sequence: Synthetic oligonucleotide
tcaccttgcggttggcgtttctggtgg

SEQ ID NO: 338354 - DNA, 27 bp, Artificial Sequence
  Description of Artificial Sequence: Synthetic oligonucleotide
caccttgcggttggcgtttctggtgga

SEQ ID NO: 338355 - DNA, 27 bp, Artificial Sequence
  Description of Artificial Sequence: Synthetic oligonucleotide
accttgcggttggcgtttctggtggag

SEQ ID NO: 338356 - DNA, 27 bp, Artificial Sequence
  Description of Artificial Sequence: Synthetic oligonucleotide
ccttgcggttggcgtttctggtggaga

SEQ ID NO: 338357 - DNA, 28 bp, Artificial Sequence
  Description of Artificial Sequence: Synthetic oligonucleotide
cttgcggttggcgtttctggtggagaac

SEQ ID NO: 338358 - DNA, 28 bp, Artificial Sequence
  Description of Artificial Sequence: Synthetic oligonucleotide
ttgcggttggcgtttctggtggagaacg

SEQ ID NO: 338359 - DNA, 27 bp, Artificial Sequence
  Description of Artificial Sequence: Synthetic oligonucleotide
tgcggttggcgtttctggtggagaacg

SEQ ID NO: 338360 - DNA, 27 bp, Artificial Sequence
  Description of Artificial Sequence: Synthetic oligonucleotide
gcggttggcgtttctggtggagaacga

SEQ ID NO: 338361 - DNA, 30 bp, Artificial Sequence
  Description of Artificial Sequence: Synthetic oligonucleotide
cggttggcgtttctggtggagaacgaaaag

SEQ ID NO: 338362 - DNA, 30 bp, Artificial Sequence
  Description of Artificial Sequence: Synthetic oligonucleotide
ggttggcgtttctggtggagaacgaaaagg

SEQ ID NO: 338363 - DNA, 31 bp, Artificial Sequence
  Description of Artificial Sequence: Synthetic oligonucleotide
gttggcgtttctggtggagaacgaaaaggag

SEQ ID NO: 338364 - DNA, 31 bp, Artificial Sequence
  Description of Artificial Sequence: Synthetic oligonucleotide
ttggcgtttctggtggagaacgaaaaggagc

SEQ ID NO: 338365 - DNA, 30 bp, Artificial Sequence
  Description of Artificial Sequence: Synthetic oligonucleotide
tggcgtttctggtggagaacgaaaaggagc

SEQ ID NO: 338366 - DNA, 29 bp, Artificial Sequence
  Description of Artificial Sequence: Synthetic oligonucleotide
ggcgtttctggtggagaacgaaaaggagc

SEQ ID NO: 338367 - DNA, 29 bp, Artificial Sequence
  Description of Artificial Sequence: Synthetic oligonucleotide
gcgtttctggtggagaacgaaaaggagcc

SEQ ID NO: 338368 - DNA, 30 bp, Artificial Sequence
  Description of Artificial Sequence: Synthetic oligonucleotide
cgtttctggtggagaacgaaaaggagccag

SEQ ID NO: 338369 - DNA, 31 bp, Artificial Sequence
  Description of Artificial Sequence: Synthetic oligonucleotide
gtttctggtggagaacgaaaaggagccagtg

SEQ ID NO: 338370 - DNA, 33 bp, Artificial Sequence
  Description of Artificial Sequence: Synthetic oligonucleotide
tttctggtggagaacgaaaaggagccagtgatg

SEQ ID NO: 338371 - DNA, 32 bp, Artificial Sequence
  Description of Artificial Sequence: Synthetic oligonucleotide
ttctggtggagaacgaaaaggagccagtgatg

SEQ ID NO: 338372 - DNA, 31 bp, Artificial Sequence
  Description of Artificial Sequence: Synthetic oligonucleotide
tctggtggagaacgaaaaggagccagtgatg

SEQ ID NO: 338373 - DNA, 30 bp, Artificial Sequence
  Description of Artificial Sequence: Synthetic oligonucleotide
ctggtggagaacgaaaaggagccagtgatg

SEQ ID NO: 338374 - DNA, 30 bp, Artificial Sequence
  Description of Artificial Sequence: Synthetic oligonucleotide
tggtggagaacgaaaaggagccagtgatgg

SEQ ID NO: 338375 - DNA, 29 bp, Artificial Sequence
  Description of Artificial Sequence: Synthetic oligonucleotide
ggtggagaacgaaaaggagccagtgatgg

SEQ ID NO: 338376 - DNA, 30 bp, Artificial Sequence
  Description of Artificial Sequence: Synthetic oligonucleotide
gtggagaacgaaaaggagccagtgatggag

SEQ ID NO: 338377 - DNA, 30 bp, Artificial Sequence
  Description of Artificial Sequence: Synthetic oligonucleotide
tggagaacgaaaaggagccagtgatggagg

SEQ ID NO: 338378 - DNA, 29 bp, Artificial Sequence
  Description of Artificial Sequence: Synthetic oligonucleotide
ggagaacgaaaaggagccagtgatggagg

SEQ ID NO: 338379 - DNA, 30 bp, Artificial Sequence
  Description of Artificial Sequence: Synthetic oligonucleotide
gagaacgaaaaggagccagtgatggaggag

SEQ ID NO: 338380 - DNA, 30 bp, Artificial Sequence
  Description of Artificial Sequence: Synthetic oligonucleotide
agaacgaaaaggagccagtgatggaggagg

SEQ ID NO: 338381 - DNA, 29 bp, Artificial Sequence
  Description of Artificial Sequence: Synthetic oligonucleotide
gaacgaaaaggagccagtgatggaggagg

SEQ ID NO: 338382 - DNA, 29 bp, Artificial Sequence
  Description of Artificial Sequence: Synthetic oligonucleotide
aacgaaaaggagccagtgatggaggaggc

SEQ ID NO: 338383 - DNA, 28 bp, Artificial Sequence
  Description of Artificial Sequence: Synthetic oligonucleotide
acgaaaaggagccagtgatggaggaggc

SEQ ID NO: 338384 - DNA, 27 bp, Artificial Sequence
  Description of Artificial Sequence: Synthetic oligonucleotide
cgaaaaggagccagtgatggaggaggc

SEQ ID NO: 338385 - DNA, 28 bp, Artificial Sequence
  Description of Artificial Sequence: Synthetic oligonucleotide
gaaaaggagccagtgatggaggaggcag

SEQ ID NO: 338386 - DNA, 28 bp, Artificial Sequence
  Description of Artificial Sequence: Synthetic oligonucleotide
aaaaggagccagtgatggaggaggcagc

SEQ ID NO: 338387 - DNA, 27 bp, Artificial Sequence
  Description of Artificial Sequence: Synthetic oligonucleotide
aaaggagccagtgatggaggaggcagc

SEQ ID NO: 338388 - DNA, 26 bp, Artificial Sequence
  Description of Artificial Sequence: Synthetic oligonucleotide
aaggagccagtgatggaggaggcagc

SEQ ID NO: 338389 - DNA, 25 bp, Artificial Sequence
  Description of Artificial Sequence: Synthetic oligonucleotide
aggagccagtgatggaggaggcagc

SEQ ID NO: 338390 - DNA, 24 bp, Artificial Sequence
  Description of Artificial Sequence: Synthetic oligonucleotide
ggagccagtgatggaggaggcagc

SEQ ID NO: 338391 - DNA, 25 bp, Artificial Sequence
  Description of Artificial Sequence: Synthetic oligonucleotide
gagccagtgatggaggaggcagcga

SEQ ID NO: 338392 - DNA, 26 bp, Artificial Sequence
  Description of Artificial Sequence: Synthetic oligonucleotide
agccagtgatggaggaggcagcgaca

SEQ ID NO: 338393 - DNA, 25 bp, Artificial Sequence
  Description of Artificial Sequence: Synthetic oligonucleotide
gccagtgatggaggaggcagcgaca

SEQ ID NO: 338394 - DNA, 25 bp, Artificial Sequence
  Description of Artificial Sequence: Synthetic oligonucleotide
ccagtgatggaggaggcagcgacag

SEQ ID NO: 338395 - DNA, 27 bp, Artificial Sequence
  Description of Artificial Sequence: Synthetic oligonucleotide
cagtgatggaggaggcagcgacaggaa

SEQ ID NO: 338396 - DNA, 28 bp, Artificial Sequence
  Description of Artificial Sequence: Synthetic oligonucleotide
agtgatggaggaggcagcgacaggaaag

SEQ ID NO: 338397 - DNA, 27 bp, Artificial Sequence
  Description of Artificial Sequence: Synthetic oligonucleotide
gtgatggaggaggcagcgacaggaaag

SEQ ID NO: 338398 - DNA, 29 bp, Artificial Sequence
  Description of Artificial Sequence: Synthetic oligonucleotide
tgatggaggaggcagcgacaggaaagtag

SEQ ID NO: 338399 - DNA, 28 bp, Artificial Sequence
  Description of Artificial Sequence: Synthetic oligonucleotide
gatggaggaggcagcgacaggaaagtag

SEQ ID NO: 338400 - DNA, 28 bp, Artificial Sequence
  Description of Artificial Sequence: Synthetic oligonucleotide
atggaggaggcagcgacaggaaagtagg

SEQ ID NO: 338401 - DNA, 27 bp, Artificial Sequence
  Description of Artificial Sequence: Synthetic oligonucleotide
tggaggaggcagcgacaggaaagtagg

SEQ ID NO: 338402 - DNA, 26 bp, Artificial Sequence
  Description of Artificial Sequence: Synthetic oligonucleotide
ggaggaggcagcgacaggaaagtagg

SEQ ID NO: 338403 - DNA, 26 bp, Artificial Sequence
  Description of Artificial Sequence: Synthetic oligonucleotide
gaggaggcagcgacaggaaagtaggg

SEQ ID NO: 338404 - DNA, 27 bp, Artificial Sequence
  Description of Artificial Sequence: Synthetic oligonucleotide
aggaggcagcgacaggaaagtagggga

SEQ ID NO: 338405 - DNA, 27 bp, Artificial Sequence
  Description of Artificial Sequence: Synthetic oligonucleotide
ggaggcagcgacaggaaagtaggggaa

SEQ ID NO: 338406 - DNA, 27 bp, Artificial Sequence
  Description of Artificial Sequence: Synthetic oligonucleotide
gaggcagcgacaggaaagtaggggaag

SEQ ID NO: 338407 - DNA, 28 bp, Artificial Sequence
  Description of Artificial Sequence: Synthetic oligonucleotide
aggcagcgacaggaaagtaggggaagac

SEQ ID NO: 338408 - DNA, 27 bp, Artificial Sequence
  Description of Artificial Sequence: Synthetic oligonucleotide
ggcagcgacaggaaagtaggggaagac

SEQ ID NO: 338409 - DNA, 27 bp, Artificial Sequence
  Description of Artificial Sequence: Synthetic oligonucleotide
gcagcgacaggaaagtaggggaagacg

SEQ ID NO: 338410 - DNA, 27 bp, Artificial Sequence
  Description of Artificial Sequence: Synthetic oligonucleotide
cagcgacaggaaagtaggggaagacgc

SEQ ID NO: 338411 - DNA, 27 bp, Artificial Sequence
  Description of Artificial Sequence: Synthetic oligonucleotide
agcgacaggaaagtaggggaagacgcc

SEQ ID NO: 338412 - DNA, 26 bp, Artificial Sequence
  Description of Artificial Sequence: Synthetic oligonucleotide
gcgacaggaaagtaggggaagacgcc

SEQ ID NO: 338413 - DNA, 27 bp, Artificial Sequence
  Description of Artificial Sequence: Synthetic oligonucleotide
cgacaggaaagtaggggaagacgccga

SEQ ID NO: 338414 - DNA, 27 bp, Artificial Sequence
  Description of Artificial Sequence: Synthetic oligonucleotide
gacaggaaagtaggggaagacgccgac

SEQ ID NO: 338415 - DNA, 27 bp, Artificial Sequence
  Description of Artificial Sequence: Synthetic oligonucleotide
acaggaaagtaggggaagacgccgacg

SEQ ID NO: 338416 - DNA, 26 bp, Artificial Sequence
  Description of Artificial Sequence: Synthetic oligonucleotide
caggaaagtaggggaagacgccgacg

SEQ ID NO: 338417 - DNA, 26 bp, Artificial Sequence
  Description of Artificial Sequence: Synthetic oligonucleotide
aggaaagtaggggaagacgccgacgc

SEQ ID NO: 338418 - DNA, 25 bp, Artificial Sequence
  Description of Artificial Sequence: Synthetic oligonucleotide
ggaaagtaggggaagacgccgacgc

SEQ ID NO: 338419 - DNA, 25 bp, Artificial Sequence
  Description of Artificial Sequence: Synthetic oligonucleotide
gaaagtaggggaagacgccgacgcc

SEQ ID NO: 338420 - DNA, 25 bp, Artificial Sequence
  Description of Artificial Sequence: Synthetic oligonucleotide
aaagtaggggaagacgccgacgccg

SEQ ID NO: 338421 - DNA, 24 bp, Artificial Sequence
  Description of Artificial Sequence: Synthetic oligonucleotide
aagtaggggaagacgccgacgccg

SEQ ID NO: 338422 - DNA, 23 bp, Artificial Sequence
  Description of Artificial Sequence: Synthetic oligonucleotide
agtaggggaagacgccgacgccg

SEQ ID NO: 338423 - DNA, 22 bp, Artificial Sequence
  Description of Artificial Sequence: Synthetic oligonucleotide
gtaggggaagacgccgacgccg

SEQ ID NO: 338424 - DNA, 23 bp, Artificial Sequence
  Description of Artificial Sequence: Synthetic oligonucleotide
taggggaagacgccgacgccgca

SEQ ID NO: 338425 - DNA, 22 bp, Artificial Sequence
  Description of Artificial Sequence: Synthetic oligonucleotide
aggggaagacgccgacgccgca

SEQ ID NO: 338426 - DNA, 21 bp, Artificial Sequence
  Description of Artificial Sequence: Synthetic oligonucleotide
ggggaagacgccgacgccgca

SEQ ID NO: 338427 - DNA, 21 bp, Artificial Sequence
  Description of Artificial Sequence: Synthetic oligonucleotide
gggaagacgccgacgccgcag

SEQ ID NO: 338428 - DNA, 21 bp, Artificial Sequence
  Description of Artificial Sequence: Synthetic oligonucleotide
ggaagacgccgacgccgcagg

SEQ ID NO: 338429 - DNA, 21 bp, Artificial Sequence
  Description of Artificial Sequence: Synthetic oligonucleotide
gaagacgccgacgccgcaggc

SEQ ID NO: 338430 - DNA, 22 bp, Artificial Sequence
  Description of Artificial Sequence: Synthetic oligonucleotide
aagacgccgacgccgcaggcgt

SEQ ID NO: 338431 - DNA, 21 bp, Artificial Sequence
  Description of Artificial Sequence: Synthetic oligonucleotide
agacgccgacgccgcaggcgt

SEQ ID NO: 338432 - DNA, 20 bp, Artificial Sequence
  Description of Artificial Sequence: Synthetic oligonucleotide
gacgccgacgccgcaggcgt

SEQ ID NO: 338433 - DNA, 22 bp, Artificial Sequence
  Description of Artificial Sequence: Synthetic oligonucleotide
acgccgacgccgcaggcgtgaa

SEQ ID NO: 338434 - DNA, 21 bp, Artificial Sequence
  Description of Artificial Sequence: Synthetic oligonucleotide
cgccgacgccgcaggcgtgaa

SEQ ID NO: 338435 - DNA, 21 bp, Artificial Sequence
  Description of Artificial Sequence: Synthetic oligonucleotide
gccgacgccgcaggcgtgaac

SEQ ID NO: 338436 - DNA, 21 bp, Artificial Sequence
  Description of Artificial Sequence: Synthetic oligonucleotide
ccgacgccgcaggcgtgaacc

SEQ ID NO: 338437 - DNA, 21 bp, Artificial Sequence
  Description of Artificial Sequence: Synthetic oligonucleotide
cgacgccgcaggcgtgaaccc

SEQ ID NO: 338438 - DNA, 21 bp, Artificial Sequence
  Description of Artificial Sequence: Synthetic oligonucleotide
gacgccgcaggcgtgaacccc

SEQ ID NO: 338439 - DNA, 21 bp, Artificial Sequence
  Description of Artificial Sequence: Synthetic oligonucleotide
acgccgcaggcgtgaaccccg

SEQ ID NO: 338440 - DNA, 20 bp, Artificial Sequence
  Description of Artificial Sequence: Synthetic oligonucleotide
cgccgcaggcgtgaaccccg

SEQ ID NO: 338441 - DNA, 20 bp, Artificial Sequence
  Description of Artificial Sequence: Synthetic oligonucleotide
gccgcaggcgtgaaccccgg

SEQ ID NO: 338442 - DNA, 23 bp, Artificial Sequence
  Description of Artificial Sequence: Synthetic oligonucleotide
ccgcaggcgtgaaccccgggata

SEQ ID NO: 338443 - DNA, 24 bp, Artificial Sequence
  Description of Artificial Sequence: Synthetic oligonucleotide
cgcaggcgtgaaccccgggatagt

SEQ ID NO: 338444 - DNA, 24 bp, Artificial Sequence
  Description of Artificial Sequence: Synthetic oligonucleotide
gcaggcgtgaaccccgggatagtg

SEQ ID NO: 338445 - DNA, 24 bp, Artificial Sequence
  Description of Artificial Sequence: Synthetic oligonucleotide
caggcgtgaaccccgggatagtgg

SEQ ID NO: 338446 - DNA, 24 bp, Artificial Sequence
  Description of Artificial Sequence: Synthetic oligonucleotide
aggcgtgaaccccgggatagtggg

SEQ ID NO: 338447 - DNA, 23 bp, Artificial Sequence
  Description of Artificial Sequence: Synthetic oligonucleotide
ggcgtgaaccccgggatagtggg

SEQ ID NO: 338448 - DNA, 23 bp, Artificial Sequence
  Description of Artificial Sequence: Synthetic oligonucleotide
gcgtgaaccccgggatagtgggg

SEQ ID NO: 338449 - DNA, 23 bp, Artificial Sequence
  Description of Artificial Sequence: Synthetic oligonucleotide
cgtgaaccccgggatagtggggg

SEQ ID NO: 338450 - DNA, 24 bp, Artificial Sequence
  Description of Artificial Sequence: Synthetic oligonucleotide
gtgaaccccgggatagtgggggct

SEQ ID NO: 338451 - DNA, 25 bp, Artificial Sequence
  Description of Artificial Sequence: Synthetic oligonucleotide
tgaaccccgggatagtgggggctct

SEQ ID NO: 338452 - DNA, 24 bp, Artificial Sequence
  Description of Artificial Sequence: Synthetic oligonucleotide
gaaccccgggatagtgggggctct

SEQ ID NO: 338453 - DNA, 24 bp, Artificial Sequence
  Description of Artificial Sequence: Synthetic oligonucleotide
aaccccgggatagtgggggctctc

SEQ ID NO: 338454 - DNA, 23 bp, Artificial Sequence
  Description of Artificial Sequence: Synthetic oligonucleotide
accccgggatagtgggggctctc

SEQ ID NO: 338455 - DNA, 22 bp, Artificial Sequence
  Description of Artificial Sequence: Synthetic oligonucleotide
ccccgggatagtgggggctctc

SEQ ID NO: 338456 - DNA, 23 bp, Artificial Sequence
  Description of Artificial Sequence: Synthetic oligonucleotide
cccgggatagtgggggctctcgt

SEQ ID NO: 338457 - DNA, 23 bp, Artificial Sequence
  Description of Artificial Sequence: Synthetic oligonucleotide
ccgggatagtgggggctctcgtg

SEQ ID NO: 338458 - DNA, 24 bp, Artificial Sequence
  Description of Artificial Sequence: Synthetic oligonucleotide
cgggatagtgggggctctcgtggt

SEQ ID NO: 338459 - DNA, 24 bp, Artificial Sequence
  Description of Artificial Sequence: Synthetic oligonucleotide
gggatagtgggggctctcgtggtc

SEQ ID NO: 338460 - DNA, 24 bp, Artificial Sequence
  Description of Artificial Sequence: Synthetic oligonucleotide
ggatagtgggggctctcgtggtcg

SEQ ID NO: 338461 - DNA, 24 bp, Artificial Sequence
  Description of Artificial Sequence: Synthetic oligonucleotide
gatagtgggggctctcgtggtcgg

SEQ ID NO: 338462 - DNA, 24 bp, Artificial Sequence
  Description of Artificial Sequence: Synthetic oligonucleotide
atagtgggggctctcgtggtcggc

SEQ ID NO: 338463 - DNA, 23 bp, Artificial Sequence
  Description of Artificial Sequence: Synthetic oligonucleotide
tagtgggggctctcgtggtcggc

SEQ ID NO: 338464 - DNA, 22 bp, Artificial Sequence
  Description of Artificial Sequence: Synthetic oligonucleotide
agtgggggctctcgtggtcggc

SEQ ID NO: 338465 - DNA, 21 bp, Artificial Sequence
  Description of Artificial Sequence: Synthetic oligonucleotide
gtgggggctctcgtggtcggc

SEQ ID NO: 338466 - DNA, 22 bp, Artificial Sequence
  Description of Artificial Sequence: Synthetic oligonucleotide
tgggggctctcgtggtcggcgt

SEQ ID NO: 338467 - DNA, 21 bp, Artificial Sequence
  Description of Artificial Sequence: Synthetic oligonucleotide
gggggctctcgtggtcggcgt

SEQ ID NO: 338468 - DNA, 21 bp, Artificial Sequence
  Description of Artificial Sequence: Synthetic oligonucleotide
ggggctctcgtggtcggcgtg

SEQ ID NO: 338469 - DNA, 21 bp, Artificial Sequence
  Description of Artificial Sequence: Synthetic oligonucleotide
gggctctcgtggtcggcgtgg

SEQ ID NO: 338470 - DNA, 22 bp, Artificial Sequence
  Description of Artificial Sequence: Synthetic oligonucleotide
ggctctcgtggtcggcgtggct

SEQ ID NO: 338471 - DNA, 22 bp, Artificial Sequence
  Description of Artificial Sequence: Synthetic oligonucleotide
gctctcgtggtcggcgtggctg

SEQ ID NO: 338472 - DNA, 23 bp, Artificial Sequence
  Description of Artificial Sequence: Synthetic oligonucleotide
ctctcgtggtcggcgtggctggt

SEQ ID NO: 338473 - DNA, 23 bp, Artificial Sequence
  Description of Artificial Sequence: Synthetic oligonucleotide
tctcgtggtcggcgtggctggtg

SEQ ID NO: 338474 - DNA, 22 bp, Artificial Sequence
  Description of Artificial Sequence: Synthetic oligonucleotide
ctcgtggtcggcgtggctggtg

SEQ ID NO: 338475 - DNA, 22 bp, Artificial Sequence
  Description of Artificial Sequence: Synthetic oligonucleotide
tcgtggtcggcgtggctggtgc

SEQ ID NO: 338476 - DNA, 21 bp, Artificial Sequence
  Description of Artificial Sequence: Synthetic oligonucleotide
cgtggtcggcgtggctggtgc

SEQ ID NO: 338477 - DNA, 23 bp, Artificial Sequence
  Description of Artificial Sequence: Synthetic oligonucleotide
gtggtcggcgtggctggtgccat

SEQ ID NO: 338478 - DNA, 24 bp, Artificial Sequence
  Description of Artificial Sequence: Synthetic oligonucleotide
tggtcggcgtggctggtgccatct

SEQ ID NO: 338479 - DNA, 23 bp, Artificial Sequence
  Description of Artificial Sequence: Synthetic oligonucleotide
ggtcggcgtggctggtgccatct

SEQ ID NO: 338480 - DNA, 25 bp, Artificial Sequence
  Description of Artificial Sequence: Synthetic oligonucleotide
gtcggcgtggctggtgccatctctt

SEQ ID NO: 338481 - DNA, 25 bp, Artificial Sequence
  Description of Artificial Sequence: Synthetic oligonucleotide
tcggcgtggctggtgccatctcttg

SEQ ID NO: 338482 - DNA, 24 bp, Artificial Sequence
  Description of Artificial Sequence: Synthetic oligonucleotide
cggcgtggctggtgccatctcttg

SEQ ID NO: 338483 - DNA, 26 bp, Artificial Sequence
  Description of Artificial Sequence: Synthetic oligonucleotide
ggcgtggctggtgccatctcttgctt

SEQ ID NO: 338484 - DNA, 27 bp, Artificial Sequence
  Description of Artificial Sequence: Synthetic oligonucleotide
gcgtggctggtgccatctcttgcttca

SEQ ID NO: 338485 - DNA, 29 bp, Artificial Sequence
  Description of Artificial Sequence: Synthetic oligonucleotide
cgtggctggtgccatctcttgcttcattg

SEQ ID NO: 338486 - DNA, 29 bp, Artificial Sequence
  Description of Artificial Sequence: Synthetic oligonucleotide
gtggctggtgccatctcttgcttcattgg

SEQ ID NO: 338487 - DNA, 32 bp, Artificial Sequence
  Description of Artificial Sequence: Synthetic oligonucleotide
tggctggtgccatctcttgcttcattggttac

SEQ ID NO: 338488 - DNA, 31 bp, Artificial Sequence
  Description of Artificial Sequence: Synthetic oligonucleotide
ggctggtgccatctcttgcttcattggttac

SEQ ID NO: 338489 - DNA, 31 bp, Artificial Sequence
  Description of Artificial Sequence: Synthetic oligonucleotide
gctggtgccatctcttgcttcattggttacc

SEQ ID NO: 338490 - DNA, 32 bp, Artificial Sequence
  Description of Artificial Sequence: Synthetic oligonucleotide
ctggtgccatctcttgcttcattggttaccag

SEQ ID NO: 338491 - DNA, 37 bp, Artificial Sequence
  Description of Artificial Sequence: Synthetic oligonucleotide
tggtgccatctcttgcttcattggttaccagaataag

SEQ ID NO: 338492 - DNA, 36 bp, Artificial Sequence
  Description of Artificial Sequence: Synthetic oligonucleotide
ggtgccatctcttgcttcattggttaccagaataag

SEQ ID NO: 338493 - DNA, 38 bp, Artificial Sequence
  Description of Artificial Sequence: Synthetic oligonucleotide
gtgccatctcttgcttcattggttaccagaataagaag

SEQ ID NO: 338494 - DNA, 38 bp, Artificial Sequence
  Description of Artificial Sequence: Synthetic oligonucleotide
tgccatctcttgcttcattggttaccagaataagaagc

SEQ ID NO: 338495 - DNA, 37 bp, Artificial Sequence
  Description of Artificial Sequence: Synthetic oligonucleotide
gccatctcttgcttcattggttaccagaataagaagc

SEQ ID NO: 338496 - DNA, 40 bp, Artificial Sequence
  Description of Artificial Sequence: Synthetic oligonucleotide
ccatctcttgcttcattggttaccagaataagaagctaag

SEQ ID NO: 338497 - DNA, 40 bp, Artificial Sequence
  Description of Artificial Sequence: Synthetic oligonucleotide
catctcttgcttcattggttaccagaataagaagctaagc

SEQ ID NO: 338498 - DNA, 42 bp, Artificial Sequence
  Description of Artificial Sequence: Synthetic oligonucleotide
atctcttgcttcattggttaccagaataagaagctaagcttc

SEQ ID NO: 338499 - DNA, 41 bp, Artificial Sequence
  Description of Artificial Sequence: Synthetic oligonucleotide
tctcttgcttcattggttaccagaataagaagctaagcttc

SEQ ID NO: 338500 - DNA, 40 bp, Artificial Sequence
  Description of Artificial Sequence: Synthetic oligonucleotide
ctcttgcttcattggttaccagaataagaagctaagcttc

SEQ ID NO: 338501 - DNA, 43 bp, Artificial Sequence
  Description of Artificial Sequence: Synthetic oligonucleotide
tcttgcttcattggttaccagaataagaagctaagcttcaaag

SEQ ID NO: 338502 - DNA, 42 bp, Artificial Sequence
  Description of Artificial Sequence: Synthetic oligonucleotide
cttgcttcattggttaccagaataagaagctaagcttcaaag

SEQ ID NO: 338503 - DNA, 47 bp, Artificial Sequence
  Description of Artificial Sequence: Synthetic oligonucleotide
ttgcttcattggttaccagaataagaagctaagcttcaaagtaaatg

SEQ ID NO: 338504 - DNA, 46 bp, Artificial Sequence
  Description of Artificial Sequence: Synthetic oligonucleotide
tgcttcattggttaccagaataagaagctaagcttcaaagtaaatg

SEQ ID NO: 338505 - DNA, 45 bp, Artificial Sequence
  Description of Artificial Sequence: Synthetic oligonucleotide
gcttcattggttaccagaataagaagctaagcttcaaagtaaatg

SEQ ID NO: 338506 - DNA, 45 bp, Artificial Sequence
  Description of Artificial Sequence: Synthetic oligonucleotide
cttcattggttaccagaataagaagctaagcttcaaagtaaatgc

SEQ ID NO: 338507 - DNA, 46 bp, Artificial Sequence
  Description of Artificial Sequence: Synthetic oligonucleotide
ttcattggttaccagaataagaagctaagcttcaaagtaaatgcag

SEQ ID NO: 338508 - DNA, 45 bp, Artificial Sequence
  Description of Artificial Sequence: Synthetic oligonucleotide
tcattggttaccagaataagaagctaagcttcaaagtaaatgcag

SEQ ID NO: 338509 - DNA, 44 bp, Artificial Sequence
  Description of Artificial Sequence: Synthetic oligonucleotide
cattggttaccagaataagaagctaagcttcaaagtaaatgcag

SEQ ID NO: 338510 - DNA, 46 bp, Artificial Sequence
  Description of Artificial Sequence: Synthetic oligonucleotide
attggttaccagaataagaagctaagcttcaaagtaaatgcagatc

SEQ ID NO: 338511 - DNA, 45 bp, Artificial Sequence
  Description of Artificial Sequence: Synthetic oligonucleotide
ttggttaccagaataagaagctaagcttcaaagtaaatgcagatc

SEQ ID NO: 338512 - DNA, 44 bp, Artificial Sequence
  Description of Artificial Sequence: Synthetic oligonucleotide
tggttaccagaataagaagctaagcttcaaagtaaatgcagatc

SEQ ID NO: 338513 - DNA, 43 bp, Artificial Sequence
  Description of Artificial Sequence: Synthetic oligonucleotide
ggttaccagaataagaagctaagcttcaaagtaaatgcagatc

SEQ ID NO: 338514 - DNA, 45 bp, Artificial Sequence
  Description of Artificial Sequence: Synthetic oligonucleotide
gttaccagaataagaagctaagcttcaaagtaaatgcagatcaag

SEQ ID NO: 338515 - DNA, 45 bp, Artificial Sequence
  Description of Artificial Sequence: Synthetic oligonucleotide
ttaccagaataagaagctaagcttcaaagtaaatgcagatcaagg

SEQ ID NO: 338516 - DNA, 44 bp, Artificial Sequence
  Description of Artificial Sequence: Synthetic oligonucleotide
taccagaataagaagctaagcttcaaagtaaatgcagatcaagg

SEQ ID NO: 338517 - DNA, 43 bp, Artificial Sequence
  Description of Artificial Sequence: Synthetic oligonucleotide
accagaataagaagctaagcttcaaagtaaatgcagatcaagg

SEQ ID NO: 338518 - DNA, 42 bp, Artificial Sequence
  Description of Artificial Sequence: Synthetic oligonucleotide
ccagaataagaagctaagcttcaaagtaaatgcagatcaagg

SEQ ID NO: 338519 - DNA, 42 bp, Artificial Sequence
  Description of Artificial Sequence: Synthetic oligonucleotide
cagaataagaagctaagcttcaaagtaaatgcagatcaaggg

SEQ ID NO: 338520 - DNA, 42 bp, Artificial Sequence
  Description of Artificial Sequence: Synthetic oligonucleotide
agaataagaagctaagcttcaaagtaaatgcagatcaagggg

SEQ ID NO: 338521 - DNA, 41 bp, Artificial Sequence
  Description of Artificial Sequence: Synthetic oligonucleotide
gaataagaagctaagcttcaaagtaaatgcagatcaagggg

SEQ ID NO: 338522 - DNA, 42 bp, Artificial Sequence
  Description of Artificial Sequence: Synthetic oligonucleotide
aataagaagctaagcttcaaagtaaatgcagatcaaggggag

SEQ ID NO: 338523 - DNA, 41 bp, Artificial Sequence
  Description of Artificial Sequence: Synthetic oligonucleotide
ataagaagctaagcttcaaagtaaatgcagatcaaggggag

SEQ ID NO: 338524 - DNA, 40 bp, Artificial Sequence
  Description of Artificial Sequence: Synthetic oligonucleotide
taagaagctaagcttcaaagtaaatgcagatcaaggggag

SEQ ID NO: 338525 - DNA, 39 bp, Artificial Sequence
  Description of Artificial Sequence: Synthetic oligonucleotide
aagaagctaagcttcaaagtaaatgcagatcaaggggag

SEQ ID NO: 338526 - DNA, 38 bp, Artificial Sequence
  Description of Artificial Sequence: Synthetic oligonucleotide
agaagctaagcttcaaagtaaatgcagatcaaggggag

SEQ ID NO: 338527 - DNA, 37 bp, Artificial Sequence
  Description of Artificial Sequence: Synthetic oligonucleotide
gaagctaagcttcaaagtaaatgcagatcaaggggag

SEQ ID NO: 338528 - DNA, 37 bp, Artificial Sequence
  Description of Artificial Sequence: Synthetic oligonucleotide
aagctaagcttcaaagtaaatgcagatcaaggggagc

SEQ ID NO: 338529 - DNA, 36 bp, Artificial Sequence
  Description of Artificial Sequence: Synthetic oligonucleotide
agctaagcttcaaagtaaatgcagatcaaggggagc

SEQ ID NO: 338530 - DNA, 35 bp, Artificial Sequence
  Description of Artificial Sequence: Synthetic oligonucleotide
gctaagcttcaaagtaaatgcagatcaaggggagc

SEQ ID NO: 338531 - DNA, 36 bp, Artificial Sequence
  Description of Artificial Sequence: Synthetic oligonucleotide
ctaagcttcaaagtaaatgcagatcaaggggagctg

SEQ ID NO: 338532 - DNA, 36 bp, Artificial Sequence
  Description of Artificial Sequence: Synthetic oligonucleotide
taagcttcaaagtaaatgcagatcaaggggagctgg

SEQ ID NO: 338533 - DNA, 35 bp, Artificial Sequence
  Description of Artificial Sequence: Synthetic oligonucleotide
aagcttcaaagtaaatgcagatcaaggggagctgg

SEQ ID NO: 338534 - DNA, 34 bp, Artificial Sequence
  Description of Artificial Sequence: Synthetic oligonucleotide
agcttcaaagtaaatgcagatcaaggggagctgg

SEQ ID NO: 338535 - DNA, 33 bp, Artificial Sequence
  Description of Artificial Sequence: Synthetic oligonucleotide
gcttcaaagtaaatgcagatcaaggggagctgg

SEQ ID NO: 338536 - DNA, 34 bp, Artificial Sequence
  Description of Artificial Sequence: Synthetic oligonucleotide
cttcaaagtaaatgcagatcaaggggagctggac

SEQ ID NO: 338537 - DNA, 36 bp, Artificial Sequence
  Description of Artificial Sequence: Synthetic oligonucleotide
ttcaaagtaaatgcagatcaaggggagctggacatg

SEQ ID NO: 338538 - DNA, 35 bp, Artificial Sequence
  Description of Artificial Sequence: Synthetic oligonucleotide
tcaaagtaaatgcagatcaaggggagctggacatg

SEQ ID NO: 338539 - DNA, 34 bp, Artificial Sequence
  Description of Artificial Sequence: Synthetic oligonucleotide
caaagtaaatgcagatcaaggggagctggacatg

SEQ ID NO: 338540 - DNA, 34 bp, Artificial Sequence
  Description of Artificial Sequence: Synthetic oligonucleotide
aaagtaaatgcagatcaaggggagctggacatgg

SEQ ID NO: 338541 - DNA, 33 bp, Artificial Sequence
  Description of Artificial Sequence: Synthetic oligonucleotide
aagtaaatgcagatcaaggggagctggacatgg

SEQ ID NO: 338542 - DNA, 32 bp, Artificial Sequence
  Description of Artificial Sequence: Synthetic oligonucleotide
agtaaatgcagatcaaggggagctggacatgg

SEQ ID NO: 338543 - DNA, 31 bp, Artificial Sequence
  Description of Artificial Sequence: Synthetic oligonucleotide
gtaaatgcagatcaaggggagctggacatgg

SEQ ID NO: 338544 - DNA, 32 bp, Artificial Sequence
  Description of Artificial Sequence: Synthetic oligonucleotide
taaatgcagatcaaggggagctggacatggtg

SEQ ID NO: 338545 - DNA, 31 bp, Artificial Sequence
  Description of Artificial Sequence: Synthetic oligonucleotide
aaatgcagatcaaggggagctggacatggtg

SEQ ID NO: 338546 - DNA, 30 bp, Artificial Sequence
  Description of Artificial Sequence: Synthetic oligonucleotide
aatgcagatcaaggggagctggacatggtg

SEQ ID NO: 338547 - DNA, 29 bp, Artificial Sequence
  Description of Artificial Sequence: Synthetic oligonucleotide
atgcagatcaaggggagctggacatggtg

SEQ ID NO: 338548 - DNA, 28 bp, Artificial Sequence
  Description of Artificial Sequence: Synthetic oligonucleotide
tgcagatcaaggggagctggacatggtg

SEQ ID NO: 338549 - DNA, 27 bp, Artificial Sequence
  Description of Artificial Sequence: Synthetic oligonucleotide
gcagatcaaggggagctggacatggtg

SEQ ID NO: 338550 - DNA, 28 bp, Artificial Sequence
  Description of Artificial Sequence: Synthetic oligonucleotide
cagatcaaggggagctggacatggtgag

SEQ ID NO: 338551 - DNA, 28 bp, Artificial Sequence
  Description of Artificial Sequence: Synthetic oligonucleotide
agatcaaggggagctggacatggtgagc

SEQ ID NO: 338552 - DNA, 27 bp, Artificial Sequence
  Description of Artificial Sequence: Synthetic oligonucleotide
gatcaaggggagctggacatggtgagc

SEQ ID NO: 338553 - DNA, 27 bp, Artificial Sequence
  Description of Artificial Sequence: Synthetic oligonucleotide
atcaaggggagctggacatggtgagcc

SEQ ID NO: 338554 - DNA, 27 bp, Artificial Sequence
  Description of Artificial Sequence: Synthetic oligonucleotide
tcaaggggagctggacatggtgagcca

SEQ ID NO: 338555 - DNA, 26 bp, Artificial Sequence
  Description of Artificial Sequence: Synthetic oligonucleotide
caaggggagctggacatggtgagcca

SEQ ID NO: 338556 - DNA, 26 bp, Artificial Sequence
  Description of Artificial Sequence: Synthetic oligonucleotide
aaggggagctggacatggtgagccac

SEQ ID NO: 338557 - DNA, 25 bp, Artificial Sequence
  Description of Artificial Sequence: Synthetic oligonucleotide
aggggagctggacatggtgagccac

SEQ ID NO: 338558 - DNA, 24 bp, Artificial Sequence
  Description of Artificial Sequence: Synthetic oligonucleotide
ggggagctggacatggtgagccac

SEQ ID NO: 338559 - DNA, 24 bp, Artificial Sequence
  Description of Artificial Sequence: Synthetic oligonucleotide
gggagctggacatggtgagccacc

SEQ ID NO: 338560 - DNA, 24 bp, Artificial Sequence
  Description of Artificial Sequence: Synthetic oligonucleotide
ggagctggacatggtgagccaccg

SEQ ID NO: 338561 - DNA, 27 bp, Artificial Sequence
  Description of Artificial Sequence: Synthetic oligonucleotide
gagctggacatggtgagccaccgcaat

SEQ ID NO: 338562 - DNA, 27 bp, Artificial Sequence
  Description of Artificial Sequence: Synthetic oligonucleotide
agctggacatggtgagccaccgcaatg

SEQ ID NO: 338563 - DNA, 26 bp, Artificial Sequence
  Description of Artificial Sequence: Synthetic oligonucleotide
gctggacatggtgagccaccgcaatg

SEQ ID NO: 338564 - DNA, 26 bp, Artificial Sequence
  Description of Artificial Sequence: Synthetic oligonucleotide
ctggacatggtgagccaccgcaatgc

SEQ ID NO: 338565 - DNA, 27 bp, Artificial Sequence
  Description of Artificial Sequence: Synthetic oligonucleotide
tggacatggtgagccaccgcaatgcca

SEQ ID NO: 338566 - DNA, 27 bp, Artificial Sequence
  Description of Artificial Sequence: Synthetic oligonucleotide
ggacatggtgagccaccgcaatgccaa

SEQ ID NO: 338567 - DNA, 27 bp, Artificial Sequence
  Description of Artificial Sequence: Synthetic oligonucleotide
gacatggtgagccaccgcaatgccaac

SEQ ID NO: 338568 - DNA, 27 bp, Artificial Sequence
  Description of Artificial Sequence: Synthetic oligonucleotide
acatggtgagccaccgcaatgccaacc

SEQ ID NO: 338569 - DNA, 26 bp, Artificial Sequence
  Description of Artificial Sequence: Synthetic oligonucleotide
catggtgagccaccgcaatgccaacc

SEQ ID NO: 338570 - DNA, 27 bp, Artificial Sequence
  Description of Artificial Sequence: Synthetic oligonucleotide
atggtgagccaccgcaatgccaaccca

SEQ ID NO: 338571 - DNA, 26 bp, Artificial Sequence
  Description of Artificial Sequence: Synthetic oligonucleotide
tggtgagccaccgcaatgccaaccca

SEQ ID NO: 338572 - DNA, 25 bp, Artificial Sequence
  Description of Artificial Sequence: Synthetic oligonucleotide
ggtgagccaccgcaatgccaaccca

SEQ ID NO: 338573 - DNA, 26 bp, Artificial Sequence
  Description of Artificial Sequence: Synthetic oligonucleotide
gtgagccaccgcaatgccaacccaga

SEQ ID NO: 338574 - DNA, 26 bp, Artificial Sequence
  Description of Artificial Sequence: Synthetic oligonucleotide
tgagccaccgcaatgccaacccagag

SEQ ID NO: 338575 - DNA, 25 bp, Artificial Sequence
  Description of Artificial Sequence: Synthetic oligonucleotide
gagccaccgcaatgccaacccagag

SEQ ID NO: 338576 - DNA, 25 bp, Artificial Sequence
  Description of Artificial Sequence: Synthetic oligonucleotide
agccaccgcaatgccaacccagagc

SEQ ID NO: 338577 - DNA, 24 bp, Artificial Sequence
  Description of Artificial Sequence: Synthetic oligonucleotide
gccaccgcaatgccaacccagagc

SEQ ID NO: 338578 - DNA, 25 bp, Artificial Sequence
  Description of Artificial Sequence: Synthetic oligonucleotide
ccaccgcaatgccaacccagagcca

SEQ ID NO: 338579 - DNA, 25 bp, Artificial Sequence
  Description of Artificial Sequence: Synthetic oligonucleotide
caccgcaatgccaacccagagccag

SEQ ID NO: 338580 - DNA, 26 bp, Artificial Sequence
  Description of Artificial Sequence: Synthetic oligonucleotide
accgcaatgccaacccagagccaggt

SEQ ID NO: 338581 - DNA, 25 bp, Artificial Sequence
  Description of Artificial Sequence: Synthetic oligonucleotide
ccgcaatgccaacccagagccaggt

SEQ ID NO: 338582 - DNA, 27 bp, Artificial Sequence
  Description of Artificial Sequence: Synthetic oligonucleotide
cgcaatgccaacccagagccaggtgtt

SEQ ID NO: 338583 - DNA, 27 bp, Artificial Sequence
  Description of Artificial Sequence: Synthetic oligonucleotide
gcaatgccaacccagagccaggtgttc

SEQ ID NO: 338584 - DNA, 28 bp, Artificial Sequence
  Description of Artificial Sequence: Synthetic oligonucleotide
caatgccaacccagagccaggtgttcag

SEQ ID NO: 338585 - DNA, 28 bp, Artificial Sequence
  Description of Artificial Sequence: Synthetic oligonucleotide
aatgccaacccagagccaggtgttcagc

SEQ ID NO: 338586 - DNA, 27 bp, Artificial Sequence
  Description of Artificial Sequence: Synthetic oligonucleotide
atgccaacccagagccaggtgttcagc

SEQ ID NO: 338587 - DNA, 26 bp, Artificial Sequence
  Description of Artificial Sequence: Synthetic oligonucleotide
tgccaacccagagccaggtgttcagc

SEQ ID NO: 338588 - DNA, 25 bp, Artificial Sequence
  Description of Artificial Sequence: Synthetic oligonucleotide
gccaacccagagccaggtgttcagc

SEQ ID NO: 338589 - DNA, 27 bp, Artificial Sequence
  Description of Artificial Sequence: Synthetic oligonucleotide
ccaacccagagccaggtgttcagcgaa

SEQ ID NO: 338590 - DNA, 27 bp, Artificial Sequence
  Description of Artificial Sequence: Synthetic oligonucleotide
caacccagagccaggtgttcagcgaac

SEQ ID NO: 338591 - DNA, 28 bp, Artificial Sequence
  Description of Artificial Sequence: Synthetic oligonucleotide
aacccagagccaggtgttcagcgaactc

SEQ ID NO: 338592 - DNA, 27 bp, Artificial Sequence
  Description of Artificial Sequence: Synthetic oligonucleotide
acccagagccaggtgttcagcgaactc

SEQ ID NO: 338593 - DNA, 27 bp, Artificial Sequence
  Description of Artificial Sequence: Synthetic oligonucleotide
cccagagccaggtgttcagcgaactct

SEQ ID NO: 338594 - DNA, 31 bp, Artificial Sequence
  Description of Artificial Sequence: Synthetic oligonucleotide
ccagagccaggtgttcagcgaactcttttac

SEQ ID NO: 338595 - DNA, 32 bp, Artificial Sequence
  Description of Artificial Sequence: Synthetic oligonucleotide
cagagccaggtgttcagcgaactcttttacag

SEQ ID NO: 338596 - DNA, 37 bp, Artificial Sequence
  Description of Artificial Sequence: Synthetic oligonucleotide
agagccaggtgttcagcgaactcttttacagaaatag

SEQ ID NO: 338597 - DNA, 24 bp, Artificial Sequence
  Description of Artificial Sequence: Synthetic oligonucleotide
atggcggctccgctgttcgagctg

SEQ ID NO: 338598 - DNA, 23 bp, Artificial Sequence
  Description of Artificial Sequence: Synthetic oligonucleotide
tggcggctccgctgttcgagctg

SEQ ID NO: 338599 - DNA, 22 bp, Artificial Sequence
  Description of Artificial Sequence: Synthetic oligonucleotide
ggcggctccgctgttcgagctg

SEQ ID NO: 338600 - DNA, 23 bp, Artificial Sequence
  Description of Artificial Sequence: Synthetic oligonucleotide
gcggctccgctgttcgagctgct

SEQ ID NO: 338601 - DNA, 23 bp, Artificial Sequence
  Description of Artificial Sequence: Synthetic oligonucleotide
cggctccgctgttcgagctgctg

SEQ ID NO: 338602 - DNA, 23 bp, Artificial Sequence
  Description of Artificial Sequence: Synthetic oligonucleotide
ggctccgctgttcgagctgctgg

SEQ ID NO: 338603 - DNA, 26 bp, Artificial Sequence
  Description of Artificial Sequence: Synthetic oligonucleotide
gctccgctgttcgagctgctgggttt

SEQ ID NO: 338604 - DNA, 26 bp, Artificial Sequence
  Description of Artificial Sequence: Synthetic oligonucleotide
ctccgctgttcgagctgctgggtttc

SEQ ID NO: 338605 - DNA, 26 bp, Artificial Sequence
  Description of Artificial Sequence: Synthetic oligonucleotide
tccgctgttcgagctgctgggtttcg

SEQ ID NO: 338606 - DNA, 25 bp, Artificial Sequence
  Description of Artificial Sequence: Synthetic oligonucleotide
ccgctgttcgagctgctgggtttcg

SEQ ID NO: 338607 - DNA, 25 bp, Artificial Sequence
  Description of Artificial Sequence: Synthetic oligonucleotide
cgctgttcgagctgctgggtttcgc

SEQ ID NO: 338608 - DNA, 25 bp, Artificial Sequence
  Description of Artificial Sequence: Synthetic oligonucleotide
gctgttcgagctgctgggtttcgcg

SEQ ID NO: 338609 - DNA, 26 bp, Artificial Sequence
  Description of Artificial Sequence: Synthetic oligonucleotide
ctgttcgagctgctgggtttcgcgct

SEQ ID NO: 338610 - DNA, 26 bp, Artificial Sequence
  Description of Artificial Sequence: Synthetic oligonucleotide
tgttcgagctgctgggtttcgcgctg

SEQ ID NO: 338611 - DNA, 25 bp, Artificial Sequence
  Description of Artificial Sequence: Synthetic oligonucleotide
gttcgagctgctgggtttcgcgctg

SEQ ID NO: 338612 - DNA, 26 bp, Artificial Sequence
  Description of Artificial Sequence: Synthetic oligonucleotide
ttcgagctgctgggtttcgcgctggt

SEQ ID NO: 338613 - DNA, 25 bp, Artificial Sequence
  Description of Artificial Sequence: Synthetic oligonucleotide
tcgagctgctgggtttcgcgctggt

SEQ ID NO: 338614 - DNA, 24 bp, Artificial Sequence
  Description of Artificial Sequence: Synthetic oligonucleotide
cgagctgctgggtttcgcgctggt

SEQ ID NO: 338615 - DNA, 24 bp, Artificial Sequence
  Description of Artificial Sequence: Synthetic oligonucleotide
gagctgctgggtttcgcgctggtg

SEQ ID NO: 338616 - DNA, 24 bp, Artificial Sequence
  Description of Artificial Sequence: Synthetic oligonucleotide
agctgctgggtttcgcgctggtgg

SEQ ID NO: 338617 - DNA, 23 bp, Artificial Sequence
  Description of Artificial Sequence: Synthetic oligonucleotide
gctgctgggtttcgcgctggtgg

SEQ ID NO: 338618 - DNA, 23 bp, Artificial Sequence
  Description of Artificial Sequence: Synthetic oligonucleotide
ctgctgggtttcgcgctggtggg

SEQ ID NO: 338619 - DNA, 24 bp, Artificial Sequence
  Description of Artificial Sequence: Synthetic oligonucleotide
tgctgggtttcgcgctggtgggca

SEQ ID NO: 338620 - DNA, 23 bp, Artificial Sequence
  Description of Artificial Sequence: Synthetic oligonucleotide
gctgggtttcgcgctggtgggca

SEQ ID NO: 338621 - DNA, 23 bp, Artificial Sequence
  Description of Artificial Sequence: Synthetic oligonucleotide
ctgggtttcgcgctggtgggcac

SEQ ID NO: 338622 - DNA, 23 bp, Artificial Sequence
  Description of Artificial Sequence: Synthetic oligonucleotide
tgggtttcgcgctggtgggcacc

SEQ ID NO: 338623 - DNA, 22 bp, Artificial Sequence
  Description of Artificial Sequence: Synthetic oligonucleotide
gggtttcgcgctggtgggcacc

SEQ ID NO: 338624 - DNA, 23 bp, Artificial Sequence
  Description of Artificial Sequence: Synthetic oligonucleotide
ggtttcgcgctggtgggcaccct

SEQ ID NO: 338625 - DNA, 23 bp, Artificial Sequence
  Description of Artificial Sequence: Synthetic oligonucleotide
gtttcgcgctggtgggcaccctc

SEQ ID NO: 338626 - DNA, 23 bp, Artificial Sequence
  Description of Artificial Sequence: Synthetic oligonucleotide
tttcgcgctggtgggcaccctcg

SEQ ID NO: 338627 - DNA, 22 bp, Artificial Sequence
  Description of Artificial Sequence: Synthetic oligonucleotide
ttcgcgctggtgggcaccctcg

SEQ ID NO: 338628 - DNA, 21 bp, Artificial Sequence
  Description of Artificial Sequence: Synthetic oligonucleotide
tcgcgctggtgggcaccctcg

SEQ ID NO: 338629 - DNA, 20 bp, Artificial Sequence
  Description of Artificial Sequence: Synthetic oligonucleotide
cgcgctggtgggcaccctcg

SEQ ID NO: 338630 - DNA, 21 bp, Artificial Sequence
  Description of Artificial Sequence: Synthetic oligonucleotide
gcgctggtgggcaccctcgga

SEQ ID NO: 338631 - DNA, 21 bp, Artificial Sequence
  Description of Artificial Sequence: Synthetic oligonucleotide
cgctggtgggcaccctcggag

SEQ ID NO: 338632 - DNA, 21 bp, Artificial Sequence
  Description of Artificial Sequence: Synthetic oligonucleotide
gctggtgggcaccctcggagc

SEQ ID NO: 338633 - DNA, 22 bp, Artificial Sequence
  Description of Artificial Sequence: Synthetic oligonucleotide
ctggtgggcaccctcggagcct

SEQ ID NO: 338634 - DNA, 22 bp, Artificial Sequence
  Description of Artificial Sequence: Synthetic oligonucleotide
tggtgggcaccctcggagcctc

SEQ ID NO: 338635 - DNA, 21 bp, Artificial Sequence
  Description of Artificial Sequence: Synthetic oligonucleotide
ggtgggcaccctcggagcctc

SEQ ID NO: 338636 - DNA, 21 bp, Artificial Sequence
  Description of Artificial Sequence: Synthetic oligonucleotide
gtgggcaccctcggagcctcg

SEQ ID NO: 338637 - DNA, 21 bp, Artificial Sequence
  Description of Artificial Sequence: Synthetic oligonucleotide
tgggcaccctcggagcctcgg

SEQ ID NO: 338638 - DNA, 20 bp, Artificial Sequence
  Description of Artificial Sequence: Synthetic oligonucleotide
gggcaccctcggagcctcgg

SEQ ID NO: 338639 - DNA, 20 bp, Artificial Sequence
  Description of Artificial Sequence: Synthetic oligonucleotide
ggcaccctcggagcctcggg

SEQ ID NO: 338640 - DNA, 20 bp, Artificial Sequence
  Description of Artificial Sequence: Synthetic oligonucleotide
gcaccctcggagcctcgggg

SEQ ID NO: 338641 - DNA, 20 bp, Artificial Sequence
  Description of Artificial Sequence: Synthetic oligonucleotide
caccctcggagcctcggggg

SEQ ID NO: 338642 - DNA, 21 bp, Artificial Sequence
  Description of Artificial Sequence: Synthetic oligonucleotide
accctcggagcctcgggggct

SEQ ID NO: 338643 - DNA, 20 bp, Artificial Sequence
  Description of Artificial Sequence: Synthetic oligonucleotide
ccctcggagcctcgggggct

SEQ ID NO: 338644 - DNA, 20 bp, Artificial Sequence
  Description of Artificial Sequence: Synthetic oligonucleotide
cctcggagcctcgggggctg

SEQ ID NO: 338645 - DNA, 20 bp, Artificial Sequence
  Description of Artificial Sequence: Synthetic oligonucleotide
ctcggagcctcgggggctgc

SEQ ID NO: 338646 - DNA, 20 bp, Artificial Sequence
  Description of Artificial Sequence: Synthetic oligonucleotide
tcggagcctcgggggctgcc

SEQ ID NO: 338647 - DNA, 20 bp, Artificial Sequence
  Description of Artificial Sequence: Synthetic oligonucleotide
cggagcctcgggggctgcct

SEQ ID NO: 338648 - DNA, 20 bp, Artificial Sequence
  Description of Artificial Sequence: Synthetic oligonucleotide
ggagcctcgggggctgccct

SEQ ID NO: 338649 - DNA, 20 bp, Artificial Sequence
  Description of Artificial Sequence: Synthetic oligonucleotide
gagcctcgggggctgcccgt

SEQ ID NO: 338650 - DNA, 21 bp, Artificial Sequence
  Description of Artificial Sequence: Synthetic oligonucleotide
agcctcgggggctgcccgctt

SEQ ID NO: 338651 - DNA, 20 bp, Artificial Sequence
  Description of Artificial Sequence: Synthetic oligonucleotide
gcctcgggggctgcccgctt

SEQ ID NO: 338652 - DNA, 20 bp, Artificial Sequence
  Description of Artificial Sequence: Synthetic oligonucleotide
cctcgggggctgcccgcttc

SEQ ID NO: 338653 - DNA, 21 bp, Artificial Sequence
  Description of Artificial Sequence: Synthetic oligonucleotide
ctcgggggctgcccgcttcgt

SEQ ID NO: 338654 - DNA, 21 bp, Artificial Sequence
  Description of Artificial Sequence: Synthetic oligonucleotide
tcgggggctgcccgcttcgtc

SEQ ID NO: 338655 - DNA, 20 bp, Artificial Sequence
  Description of Artificial Sequence: Synthetic oligonucleotide
cgggggctgcccgcttcgtc

SEQ ID NO: 338656 - DNA, 21 bp, Artificial Sequence
  Description of Artificial Sequence: Synthetic oligonucleotide
gggggctgcccgcttcgtcct

SEQ ID NO: 338657 - DNA, 21 bp, Artificial Sequence
  Description of Artificial Sequence: Synthetic oligonucleotide
ggggctgcccgcttcgtcctg

SEQ ID NO: 338658 - DNA, 21 bp, Artificial Sequence
  Description of Artificial Sequence: Synthetic oligonucleotide
gggctgcccgcttcgtcctgg

SEQ ID NO: 338659 - DNA, 21 bp, Artificial Sequence
  Description of Artificial Sequence: Synthetic oligonucleotide
ggctgcccgcttcgtcctggc

SEQ ID NO: 338660 - DNA, 21 bp, Artificial Sequence
  Description of Artificial Sequence: Synthetic oligonucleotide
gctgcccgcttcgtcctggcg

SEQ ID NO: 338661 - DNA, 21 bp, Artificial Sequence
  Description of Artificial Sequence: Synthetic oligonucleotide
ctgcccgcttcgtcctggcgc

SEQ ID NO: 338662 - DNA, 21 bp, Artificial Sequence
  Description of Artificial Sequence: Synthetic oligonucleotide
tgcccgcttcgtcctggcgcc

SEQ ID NO: 338663 - DNA, 20 bp, Artificial Sequence
  Description of Artificial Sequence: Synthetic oligonucleotide
gcccgcttcgtcctggcgcc

SEQ ID NO: 338664 - DNA, 20 bp, Artificial Sequence
  Description of Artificial Sequence: Synthetic oligonucleotide
cccgcttcgtcctggcgccg

SEQ ID NO: 338665 - DNA, 21 bp, Artificial Sequence
  Description of Artificial Sequence: Synthetic oligonucleotide
ccgcttcgtcctggcgccgct

SEQ ID NO: 338666 - DNA, 22 bp, Artificial Sequence
  Description of Artificial Sequence: Synthetic oligonucleotide
cgcttcgtcctggcgccgctct

SEQ ID NO: 338667 - DNA, 22 bp, Artificial Sequence
  Description of Artificial Sequence: Synthetic oligonucleotide
gcttcgtcctggcgccgctctc

SEQ ID NO: 338668 - DNA, 22 bp, Artificial Sequence
  Description of Artificial Sequence: Synthetic oligonucleotide
cttcgtcctggcgccgctctcc

SEQ ID NO: 338669 - DNA, 23 bp, Artificial Sequence
  Description of Artificial Sequence: Synthetic oligonucleotide
ttcgtcctggcgccgctctccca

SEQ ID NO: 338670 - DNA, 22 bp, Artificial Sequence
  Description of Artificial Sequence: Synthetic oligonucleotide
tcgtcctggcgccgctctccca

SEQ ID NO: 338671 - DNA, 21 bp, Artificial Sequence
  Description of Artificial Sequence: Synthetic oligonucleotide
cgtcctggcgccgctctccca

SEQ ID NO: 338672 - DNA, 21 bp, Artificial Sequence
  Description of Artificial Sequence: Synthetic oligonucleotide
gtcctggcgccgctctcccag

SEQ ID NO: 338673 - DNA, 22 bp, Artificial Sequence
  Description of Artificial Sequence: Synthetic oligonucleotide
tcctggcgccgctctcccagca

SEQ ID NO: 338674 - DNA, 21 bp, Artificial Sequence
  Description of Artificial Sequence: Synthetic oligonucleotide
cctggcgccgctctcccagca

SEQ ID NO: 338675 - DNA, 22 bp, Artificial Sequence
  Description of Artificial Sequence: Synthetic oligonucleotide
ctggcgccgctctcccagcagt

SEQ ID NO: 338676 - DNA, 22 bp, Artificial Sequence
  Description of Artificial Sequence: Synthetic oligonucleotide
tggcgccgctctcccagcagtg

SEQ ID NO: 338677 - DNA, 21 bp, Artificial Sequence
  Description of Artificial Sequence: Synthetic oligonucleotide
ggcgccgctctcccagcagtg

SEQ ID NO: 338678 - DNA, 22 bp, Artificial Sequence
  Description of Artificial Sequence: Synthetic oligonucleotide
gcgccgctctcccagcagtggt

SEQ ID NO: 338679 - DNA, 22 bp, Artificial Sequence
  Description of Artificial Sequence: Synthetic oligonucleotide
cgccgctctcccagcagtggtg

SEQ ID NO: 338680 - DNA, 22 bp, Artificial Sequence
  Description of Artificial Sequence: Synthetic oligonucleotide
gccgctctcccagcagtggtgg

SEQ ID NO: 338681 - DNA, 23 bp, Artificial Sequence
  Description of Artificial Sequence: Synthetic oligonucleotide
ccgctctcccagcagtggtgggt

SEQ ID NO: 338682 - DNA, 23 bp, Artificial Sequence
  Description of Artificial Sequence: Synthetic oligonucleotide
cgctctcccagcagtggtgggtg

SEQ ID NO: 338683 - DNA, 23 bp, Artificial Sequence
  Description of Artificial Sequence: Synthetic oligonucleotide
gctctcccagcagtggtgggtgg

SEQ ID NO: 338684 - DNA, 23 bp, Artificial Sequence
  Description of Artificial Sequence: Synthetic oligonucleotide
ctctcccagcagtggtgggtggc

SEQ ID NO: 338685 - DNA, 23 bp, Artificial Sequence
  Description of Artificial Sequence: Synthetic oligonucleotide
tctcccagcagtggtgggtggcg

SEQ ID NO: 338686 - DNA, 22 bp, Artificial Sequence
  Description of Artificial Sequence: Synthetic oligonucleotide
ctcccagcagtggtgggtggcg

SEQ ID NO: 338687 - DNA, 22 bp, Artificial Sequence
  Description of Artificial Sequence: Synthetic oligonucleotide
tcccagcagtggtgggtggcgg

SEQ ID NO: 338688 - DNA, 21 bp, Artificial Sequence
  Description of Artificial Sequence: Synthetic oligonucleotide
cccagcagtggtgggtggcgg

SEQ ID NO: 338689 - DNA, 21 bp, Artificial Sequence
  Description of Artificial Sequence: Synthetic oligonucleotide
ccagcagtggtgggtggcggg

SEQ ID NO: 338690 - DNA, 22 bp, Artificial Sequence
  Description of Artificial Sequence: Synthetic oligonucleotide
cagcagtggtgggtggcgggca

SEQ ID NO: 338691 - DNA, 23 bp, Artificial Sequence
  Description of Artificial Sequence: Synthetic oligonucleotide
agcagtggtgggtggcgggcagt

SEQ ID NO: 338692 - DNA, 22 bp, Artificial Sequence
  Description of Artificial Sequence: Synthetic oligonucleotide
gcagtggtgggtggcgggcagt

SEQ ID NO: 338693 - DNA, 23 bp, Artificial Sequence
  Description of Artificial Sequence: Synthetic oligonucleotide
cagtggtgggtggcgggcagtgt

SEQ ID NO: 338694 - DNA, 23 bp, Artificial Sequence
  Description of Artificial Sequence: Synthetic oligonucleotide
agtggtgggtggcgggcagtgtc

SEQ ID NO: 338695 - DNA, 22 bp, Artificial Sequence
  Description of Artificial Sequence: Synthetic oligonucleotide
gtggtgggtggcgggcagtgtc

SEQ ID NO: 338696 - DNA, 23 bp, Artificial Sequence
  Description of Artificial Sequence: Synthetic oligonucleotide
tggtgggtggcgggcagtgtcga

SEQ ID NO: 338697 - DNA, 22 bp, Artificial Sequence
  Description of Artificial Sequence: Synthetic oligonucleotide
ggtgggtggcgggcagtgtcga

SEQ ID NO: 338698 - DNA, 22 bp, Artificial Sequence
  Description of Artificial Sequence: Synthetic oligonucleotide
gtgggtggcgggcagtgtcgag

SEQ ID NO: 338699 - DNA, 23 bp, Artificial Sequence
  Description of Artificial Sequence: Synthetic oligonucleotide
tgggtggcgggcagtgtcgagct

SEQ ID NO: 338700 - DNA, 22 bp, Artificial Sequence
  Description of Artificial Sequence: Synthetic oligonucleotide
gggtggcgggcagtgtcgagct

SEQ ID NO: 338701 - DNA, 22 bp, Artificial Sequence
  Description of Artificial Sequence: Synthetic oligonucleotide
ggtggcgggcagtgtcgagctg

SEQ ID NO: 338702 - DNA, 23 bp, Artificial Sequence
  Description of Artificial Sequence: Synthetic oligonucleotide
gtggcgggcagtgtcgagctgca

SEQ ID NO: 338703 - DNA, 24 bp, Artificial Sequence
  Description of Artificial Sequence: Synthetic oligonucleotide
tggcgggcagtgtcgagctgcaca

SEQ ID NO: 338704 - DNA, 23 bp, Artificial Sequence
  Description of Artificial Sequence: Synthetic oligonucleotide
ggcgggcagtgtcgagctgcaca

SEQ ID NO: 338705 - DNA, 23 bp, Artificial Sequence
  Description of Artificial Sequence: Synthetic oligonucleotide
gcgggcagtgtcgagctgcacag

SEQ ID NO: 338706 - DNA, 23 bp, Artificial Sequence
  Description of Artificial Sequence: Synthetic oligonucleotide
cgggcagtgtcgagctgcacagc

SEQ ID NO: 338707 - DNA, 24 bp, Artificial Sequence
  Description of Artificial Sequence: Synthetic oligonucleotide
gggcagtgtcgagctgcacagcga

SEQ ID NO: 338708 - DNA, 24 bp, Artificial Sequence
  Description of Artificial Sequence: Synthetic oligonucleotide
ggcagtgtcgagctgcacagcgag

SEQ ID NO: 338709 - DNA, 24 bp, Artificial Sequence
  Description of Artificial Sequence: Synthetic oligonucleotide
gcagtgtcgagctgcacagcgagg

SEQ ID NO: 338710 - DNA, 24 bp, Artificial Sequence
  Description of Artificial Sequence: Synthetic oligonucleotide
cagtgtcgagctgcacagcgaggc

SEQ ID NO: 338711 - DNA, 24 bp, Artificial Sequence
  Description of Artificial Sequence: Synthetic oligonucleotide
agtgtcgagctgcacagcgaggcc

SEQ ID NO: 338712 - DNA, 23 bp, Artificial Sequence
  Description of Artificial Sequence: Synthetic oligonucleotide
gtgtcgagctgcacagcgaggcc

SEQ ID NO: 338713 - DNA, 24 bp, Artificial Sequence
  Description of Artificial Sequence: Synthetic oligonucleotide
tgtcgagctgcacagcgaggccga

SEQ ID NO: 338714 - DNA, 23 bp, Artificial Sequence
  Description of Artificial Sequence: Synthetic oligonucleotide
gtcgagctgcacagcgaggccga

SEQ ID NO: 338715 - DNA, 23 bp, Artificial Sequence
  Description of Artificial Sequence: Synthetic oligonucleotide
tcgagctgcacagcgaggccgag

SEQ ID NO: 338716 - DNA, 22 bp, Artificial Sequence
  Description of Artificial Sequence: Synthetic oligonucleotide
cgagctgcacagcgaggccgag

SEQ ID NO: 338717 - DNA, 22 bp, Artificial Sequence
  Description of Artificial Sequence: Synthetic oligonucleotide
gagctgcacagcgaggccgagg

SEQ ID NO: 338718 - DNA, 22 bp, Artificial Sequence
  Description of Artificial Sequence: Synthetic oligonucleotide
agctgcacagcgaggccgaggg

SEQ ID NO: 338719 - DNA, 21 bp, Artificial Sequence
  Description of Artificial Sequence: Synthetic oligonucleotide
gctgcacagcgaggccgaggg

SEQ ID NO: 338720 - DNA, 22 bp, Artificial Sequence
  Description of Artificial Sequence: Synthetic oligonucleotide
ctgcacagcgaggccgagggca

SEQ ID NO: 338721 - DNA, 22 bp, Artificial Sequence
  Description of Artificial Sequence: Synthetic oligonucleotide
tgcacagcgaggccgagggcag

SEQ ID NO: 338722 - DNA, 21 bp, Artificial Sequence
  Description of Artificial Sequence: Synthetic oligonucleotide
gcacagcgaggccgagggcag

SEQ ID NO: 338723 - DNA, 21 bp, Artificial Sequence
  Description of Artificial Sequence: Synthetic oligonucleotide
cacagcgaggccgagggcagc

SEQ ID NO: 338724 - DNA, 21 bp, Artificial Sequence
  Description of Artificial Sequence: Synthetic oligonucleotide
acagcgaggccgagggcagcc

SEQ ID NO: 338725 - DNA, 20 bp, Artificial Sequence
  Description of Artificial Sequence: Synthetic oligonucleotide
cagcgaggccgagggcagcc

SEQ ID NO: 338726 - DNA, 20 bp, Artificial Sequence
  Description of Artificial Sequence: Synthetic oligonucleotide
agcgaggccgagggcagccc

SEQ ID NO: 338727 - DNA, 20 bp, Artificial Sequence
  Description of Artificial Sequence: Synthetic oligonucleotide
gcgaggccgagggcagccct

SEQ ID NO: 338728 - DNA, 20 bp, Artificial Sequence
  Description of Artificial Sequence: Synthetic oligonucleotide
cgaggccgagggcagcccct

SEQ ID NO: 338729 - DNA, 20 bp, Artificial Sequence
  Description of Artificial Sequence: Synthetic oligonucleotide
gaggccgagggcagccccgt

SEQ ID NO: 338730 - DNA, 20 bp, Artificial Sequence
  Description of Artificial Sequence: Synthetic oligonucleotide
aggccgagggcagccccgtg

SEQ ID NO: 338731 - DNA, 20 bp, Artificial Sequence
  Description of Artificial Sequence: Synthetic oligonucleotide
ggccgagggcagccccgtgt

SEQ ID NO: 338732 - DNA, 20 bp, Artificial Sequence
  Description of Artificial Sequence: Synthetic oligonucleotide
gccgagggcagccccgtgct

SEQ ID NO: 338733 - DNA, 20 bp, Artificial Sequence
  Description of Artificial Sequence: Synthetic oligonucleotide
ccgagggcagccccgtgcct

SEQ ID NO: 338734 - DNA, 20 bp, Artificial Sequence
  Description of Artificial Sequence: Synthetic oligonucleotide
cgagggcagccccgtgccct

SEQ ID NO: 338735 - DNA, 20 bp, Artificial Sequence
  Description of Artificial Sequence: Synthetic oligonucleotide
gagggcagccccgtgcccga

SEQ ID NO: 338736 - DNA, 22 bp, Artificial Sequence
  Description of Artificial Sequence: Synthetic oligonucleotide
agggcagccccgtgcccgagtt

SEQ ID NO: 338737 - DNA, 21 bp, Artificial Sequence
  Description of Artificial Sequence: Synthetic oligonucleotide
gggcagccccgtgcccgagtt

SEQ ID NO: 338738 - DNA, 21 bp, Artificial Sequence
  Description of Artificial Sequence: Synthetic oligonucleotide
ggcagccccgtgcccgagttc

SEQ ID NO: 338739 - DNA, 22 bp, Artificial Sequence
  Description of Artificial Sequence: Synthetic oligonucleotide
gcagccccgtgcccgagttcca

SEQ ID NO: 338740 - DNA, 23 bp, Artificial Sequence
  Description of Artificial Sequence: Synthetic oligonucleotide
cagccccgtgcccgagttccagt

SEQ ID NO: 338741 - DNA, 23 bp, Artificial Sequence
  Description of Artificial Sequence: Synthetic oligonucleotide
agccccgtgcccgagttccagtg

SEQ ID NO: 338742 - DNA, 22 bp, Artificial Sequence
  Description of Artificial Sequence: Synthetic oligonucleotide
gccccgtgcccgagttccagtg

SEQ ID NO: 338743 - DNA, 23 bp, Artificial Sequence
  Description of Artificial Sequence: Synthetic oligonucleotide
ccccgtgcccgagttccagtggt

SEQ ID NO: 338744 - DNA, 23 bp, Artificial Sequence
  Description of Artificial Sequence: Synthetic oligonucleotide
cccgtgcccgagttccagtggtc

SEQ ID NO: 338745 - DNA, 26 bp, Artificial Sequence
  Description of Artificial Sequence: Synthetic oligonucleotide
ccgtgcccgagttccagtggtcgttt

SEQ ID NO: 338746 - DNA, 27 bp, Artificial Sequence
  Description of Artificial Sequence: Synthetic oligonucleotide
cgtgcccgagttccagtggtcgtttga

SEQ ID NO: 338747 - DNA, 28 bp, Artificial Sequence
  Description of Artificial Sequence: Synthetic oligonucleotide
gtgcccgagttccagtggtcgtttgaag

SEQ ID NO: 338748 - DNA, 28 bp, Artificial Sequence
  Description of Artificial Sequence: Synthetic oligonucleotide
tgcccgagttccagtggtcgtttgaagg

SEQ ID NO: 338749 - DNA, 27 bp, Artificial Sequence
  Description of Artificial Sequence: Synthetic oligonucleotide
gcccgagttccagtggtcgtttgaagg

SEQ ID NO: 338750 - DNA, 27 bp, Artificial Sequence
  Description of Artificial Sequence: Synthetic oligonucleotide
cccgagttccagtggtcgtttgaaggc

SEQ ID NO: 338751 - DNA, 27 bp, Artificial Sequence
  Description of Artificial Sequence: Synthetic oligonucleotide
ccgagttccagtggtcgtttgaaggcc

SEQ ID NO: 338752 - DNA, 28 bp, Artificial Sequence
  Description of Artificial Sequence: Synthetic oligonucleotide
cgagttccagtggtcgtttgaaggccag

SEQ ID NO: 338753 - DNA, 28 bp, Artificial Sequence
  Description of Artificial Sequence: Synthetic oligonucleotide
gagttccagtggtcgtttgaaggccagg

SEQ ID NO: 338754 - DNA, 28 bp, Artificial Sequence
  Description of Artificial Sequence: Synthetic oligonucleotide
agttccagtggtcgtttgaaggccaggg

SEQ ID NO: 338755 - DNA, 27 bp, Artificial Sequence
  Description of Artificial Sequence: Synthetic oligonucleotide
gttccagtggtcgtttgaaggccaggg

SEQ ID NO: 338756 - DNA, 28 bp, Artificial Sequence
  Description of Artificial Sequence: Synthetic oligonucleotide
ttccagtggtcgtttgaaggccagggtc

SEQ ID NO: 338757 - DNA, 27 bp, Artificial Sequence
  Description of Artificial Sequence: Synthetic oligonucleotide
tccagtggtcgtttgaaggccagggtc

SEQ ID NO: 338758 - DNA, 26 bp, Artificial Sequence
  Description of Artificial Sequence: Synthetic oligonucleotide
ccagtggtcgtttgaaggccagggtc

SEQ ID NO: 338759 - DNA, 26 bp, Artificial Sequence
  Description of Artificial Sequence: Synthetic oligonucleotide
cagtggtcgtttgaaggccagggtcc

SEQ ID NO: 338760 - DNA, 27 bp, Artificial Sequence
  Description of Artificial Sequence: Synthetic oligonucleotide
agtggtcgtttgaaggccagggtccct

SEQ ID NO: 338761 - DNA, 27 bp, Artificial Sequence
  Description of Artificial Sequence: Synthetic oligonucleotide
gtggtcgtttgaaggccagggtcccta

SEQ ID NO: 338762 - DNA, 27 bp, Artificial Sequence
  Description of Artificial Sequence: Synthetic oligonucleotide
tggtcgtttgaaggccagggtccctac

SEQ ID NO: 338763 - DNA, 26 bp, Artificial Sequence
  Description of Artificial Sequence: Synthetic oligonucleotide
ggtcgtttgaaggccagggtccctac

SEQ ID NO: 338764 - DNA, 27 bp, Artificial Sequence
  Description of Artificial Sequence: Synthetic oligonucleotide
gtcgtttgaaggccagggtccctacga

SEQ ID NO: 338765 - DNA, 27 bp, Artificial Sequence
  Description of Artificial Sequence: Synthetic oligonucleotide
tcgtttgaaggccagggtccctacgac

SEQ ID NO: 338766 - DNA, 27 bp, Artificial Sequence
  Description of Artificial Sequence: Synthetic oligonucleotide
cgtttgaaggccagggtccctacgaca

SEQ ID NO: 338767 - DNA, 27 bp, Artificial Sequence
  Description of Artificial Sequence: Synthetic oligonucleotide
gtttgaaggccagggtccctacgacac

SEQ ID NO: 338768 - DNA, 27 bp, Artificial Sequence
  Description of Artificial Sequence: Synthetic oligonucleotide
tttgaaggccagggtccctacgacacc

SEQ ID NO: 338769 - DNA, 27 bp, Artificial Sequence
  Description of Artificial Sequence: Synthetic oligonucleotide
ttgaaggccagggtccctacgacacct

SEQ ID NO: 338770 - DNA, 26 bp, Artificial Sequence
  Description of Artificial Sequence: Synthetic oligonucleotide
tgaaggccagggtccctacgacacct

SEQ ID NO: 338771 - DNA, 25 bp, Artificial Sequence
  Description of Artificial Sequence: Synthetic oligonucleotide
gaaggccagggtccctacgacacct

SEQ ID NO: 338772 - DNA, 25 bp, Artificial Sequence
  Description of Artificial Sequence: Synthetic oligonucleotide
aaggccagggtccctacgacacctc

SEQ ID NO: 338773 - DNA, 24 bp, Artificial Sequence
  Description of Artificial Sequence: Synthetic oligonucleotide
aggccagggtccctacgacacctc

SEQ ID NO: 338774 - DNA, 23 bp, Artificial Sequence
  Description of Artificial Sequence: Synthetic oligonucleotide
ggccagggtccctacgacacctc

SEQ ID NO: 338775 - DNA, 24 bp, Artificial Sequence
  Description of Artificial Sequence: Synthetic oligonucleotide
gccagggtccctacgacacctcct

SEQ ID NO: 338776 - DNA, 24 bp, Artificial Sequence
  Description of Artificial Sequence: Synthetic oligonucleotide
ccagggtccctacgacacctcctc

SEQ ID NO: 338777 - DNA, 24 bp, Artificial Sequence
  Description of Artificial Sequence: Synthetic oligonucleotide
cagggtccctacgacacctcctcc

SEQ ID NO: 338778 - DNA, 25 bp, Artificial Sequence
  Description of Artificial Sequence: Synthetic oligonucleotide
agggtccctacgacacctcctccca

SEQ ID NO: 338779 - DNA, 24 bp, Artificial Sequence
  Description of Artificial Sequence: Synthetic oligonucleotide
gggtccctacgacacctcctccca

SEQ ID NO: 338780 - DNA, 24 bp, Artificial Sequence
  Description of Artificial Sequence: Synthetic oligonucleotide
ggtccctacgacacctcctcccag

SEQ ID NO: 338781 - DNA, 25 bp, Artificial Sequence
  Description of Artificial Sequence: Synthetic oligonucleotide
gtccctacgacacctcctcccagct

SEQ ID NO: 338782 - DNA, 26 bp, Artificial Sequence
  Description of Artificial Sequence: Synthetic oligonucleotide
tccctacgacacctcctcccagctgt

SEQ ID NO: 338783 - DNA, 25 bp, Artificial Sequence
  Description of Artificial Sequence: Synthetic oligonucleotide
ccctacgacacctcctcccagctgt

SEQ ID NO: 338784 - DNA, 25 bp, Artificial Sequence
  Description of Artificial Sequence: Synthetic oligonucleotide
cctacgacacctcctcccagctgtg

SEQ ID NO: 338785 - DNA, 25 bp, Artificial Sequence
  Description of Artificial Sequence: Synthetic oligonucleotide
ctacgacacctcctcccagctgtgg

SEQ ID NO: 338786 - DNA, 26 bp, Artificial Sequence
  Description of Artificial Sequence: Synthetic oligonucleotide
tacgacacctcctcccagctgtggga

SEQ ID NO: 338787 - DNA, 25 bp, Artificial Sequence
  Description of Artificial Sequence: Synthetic oligonucleotide
acgacacctcctcccagctgtggga

SEQ ID NO: 338788 - DNA, 24 bp, Artificial Sequence
  Description of Artificial Sequence: Synthetic oligonucleotide
cgacacctcctcccagctgtggga

SEQ ID NO: 338789 - DNA, 24 bp, Artificial Sequence
  Description of Artificial Sequence: Synthetic oligonucleotide
gacacctcctcccagctgtgggac

SEQ ID NO: 338790 - DNA, 24 bp, Artificial Sequence
  Description of Artificial Sequence: Synthetic oligonucleotide
acacctcctcccagctgtgggacg

SEQ ID NO: 338791 - DNA, 23 bp, Artificial Sequence
  Description of Artificial Sequence: Synthetic oligonucleotide
cacctcctcccagctgtgggacg

SEQ ID NO: 338792 - DNA, 23 bp, Artificial Sequence
  Description of Artificial Sequence: Synthetic oligonucleotide
acctcctcccagctgtgggacgg

SEQ ID NO: 338793 - DNA, 22 bp, Artificial Sequence
  Description of Artificial Sequence: Synthetic oligonucleotide
cctcctcccagctgtgggacgg

SEQ ID NO: 338794 - DNA, 22 bp, Artificial Sequence
  Description of Artificial Sequence: Synthetic oligonucleotide
ctcctcccagctgtgggacggc

SEQ ID NO: 338795 - DNA, 22 bp, Artificial Sequence
  Description of Artificial Sequence: Synthetic oligonucleotide
tcctcccagctgtgggacggcc

SEQ ID NO: 338796 - DNA, 21 bp, Artificial Sequence
  Description of Artificial Sequence: Synthetic oligonucleotide
cctcccagctgtgggacggcc

SEQ ID NO: 338797 - DNA, 21 bp, Artificial Sequence
  Description of Artificial Sequence: Synthetic oligonucleotide
ctcccagctgtgggacggccc

SEQ ID NO: 338798 - DNA, 21 bp, Artificial Sequence
  Description of Artificial Sequence: Synthetic oligonucleotide
tcccagctgtgggacggcccc

SEQ ID NO: 338799 - DNA, 20 bp, Artificial Sequence
  Description of Artificial Sequence: Synthetic oligonucleotide
cccagctgtgggacggcccc

SEQ ID NO: 338800 - DNA, 20 bp, Artificial Sequence
  Description of Artificial Sequence: Synthetic oligonucleotide
ccagctgtgggacggccccc

SEQ ID NO: 338801 - DNA, 20 bp, Artificial Sequence
  Description of Artificial Sequence: Synthetic oligonucleotide
cagctgtgggacggcccccg

SEQ ID NO: 338802 - DNA, 20 bp, Artificial Sequence
  Description of Artificial Sequence: Synthetic oligonucleotide
agctgtgggacggcccccgg

SEQ ID NO: 338803 - DNA, 20 bp, Artificial Sequence
  Description of Artificial Sequence: Synthetic oligonucleotide
gctgtgggacggcccccggt

SEQ ID NO: 338804 - DNA, 20 bp, Artificial Sequence
  Description of Artificial Sequence: Synthetic oligonucleotide
ctgtgggacggcccccggct

SEQ ID NO: 338805 - DNA, 20 bp, Artificial Sequence
  Description of Artificial Sequence: Synthetic oligonucleotide
tgtgggacggcccccggctg

SEQ ID NO: 338806 - DNA, 20 bp, Artificial Sequence
  Description of Artificial Sequence: Synthetic oligonucleotide
gtgggacggcccccggctgt

SEQ ID NO: 338807 - DNA, 20 bp, Artificial Sequence
  Description of Artificial Sequence: Synthetic oligonucleotide
tgggacggcccccggctggt

SEQ ID NO: 338808 - DNA, 20 bp, Artificial Sequence
  Description of Artificial Sequence: Synthetic oligonucleotide
gggacggcccccggctggtt

SEQ ID NO: 338809 - DNA, 20 bp, Artificial Sequence
  Description of Artificial Sequence: Synthetic oligonucleotide
ggacggcccccggctggtct

SEQ ID NO: 338810 - DNA, 20 bp, Artificial Sequence
  Description of Artificial Sequence: Synthetic oligonucleotide
gacggcccccggctggtcct

SEQ ID NO: 338811 - DNA, 20 bp, Artificial Sequence
  Description of Artificial Sequence: Synthetic oligonucleotide
acggcccccggctggtccgt

SEQ ID NO: 338812 - DNA, 20 bp, Artificial Sequence
  Description of Artificial Sequence: Synthetic oligonucleotide
cggcccccggctggtccgtt

SEQ ID NO: 338813 - DNA, 20 bp, Artificial Sequence
  Description of Artificial Sequence: Synthetic oligonucleotide
ggcccccggctggtccgctt

SEQ ID NO: 338814 - DNA, 20 bp, Artificial Sequence
  Description of Artificial Sequence: Synthetic oligonucleotide
gcccccggctggtccgcgtt

SEQ ID NO: 338815 - DNA, 20 bp, Artificial Sequence
  Description of Artificial Sequence: Synthetic oligonucleotide
cccccggctggtccgcgtct

SEQ ID NO: 338816 - DNA, 20 bp, Artificial Sequence
  Description of Artificial Sequence: Synthetic oligonucleotide
ccccggctggtccgcgtcca

SEQ ID NO: 338817 - DNA, 22 bp, Artificial Sequence
  Description of Artificial Sequence: Synthetic oligonucleotide
cccggctggtccgcgtccagat

SEQ ID NO: 338818 - DNA, 22 bp, Artificial Sequence
  Description of Artificial Sequence: Synthetic oligonucleotide
ccggctggtccgcgtccagatc

SEQ ID NO: 338819 - DNA, 23 bp, Artificial Sequence
  Description of Artificial Sequence: Synthetic oligonucleotide
cggctggtccgcgtccagatcca

SEQ ID NO: 338820 - DNA, 23 bp, Artificial Sequence
  Description of Artificial Sequence: Synthetic oligonucleotide
ggctggtccgcgtccagatccac

SEQ ID NO: 338821 - DNA, 23 bp, Artificial Sequence
  Description of Artificial Sequence: Synthetic oligonucleotide
gctggtccgcgtccagatccacg

SEQ ID NO: 338822 - DNA, 23 bp, Artificial Sequence
  Description of Artificial Sequence: Synthetic oligonucleotide
ctggtccgcgtccagatccacgc

SEQ ID NO: 338823 - DNA, 24 bp, Artificial Sequence
  Description of Artificial Sequence: Synthetic oligonucleotide
tggtccgcgtccagatccacgcct

SEQ ID NO: 338824 - DNA, 23 bp, Artificial Sequence
  Description of Artificial Sequence: Synthetic oligonucleotide
ggtccgcgtccagatccacgcct

SEQ ID NO: 338825 - DNA, 23 bp, Artificial Sequence
  Description of Artificial Sequence: Synthetic oligonucleotide
gtccgcgtccagatccacgcctc

SEQ ID NO: 338826 - DNA, 25 bp, Artificial Sequence
  Description of Artificial Sequence: Synthetic oligonucleotide
tccgcgtccagatccacgcctccta

SEQ ID NO: 338827 - DNA, 24 bp, Artificial Sequence
  Description of Artificial Sequence: Synthetic oligonucleotide
ccgcgtccagatccacgcctccta

SEQ ID NO: 338828 - DNA, 24 bp, Artificial Sequence
  Description of Artificial Sequence: Synthetic oligonucleotide
cgcgtccagatccacgcctcctac

SEQ ID NO: 338829 - DNA, 25 bp, Artificial Sequence
  Description of Artificial Sequence: Synthetic oligonucleotide
gcgtccagatccacgcctcctacca

SEQ ID NO: 338830 - DNA, 25 bp, Artificial Sequence
  Description of Artificial Sequence: Synthetic oligonucleotide
cgtccagatccacgcctcctaccac

SEQ ID NO: 338831 - DNA, 26 bp, Artificial Sequence
  Description of Artificial Sequence: Synthetic oligonucleotide
gtccagatccacgcctcctaccacct

SEQ ID NO: 338832 - DNA, 26 bp, Artificial Sequence
  Description of Artificial Sequence: Synthetic oligonucleotide
tccagatccacgcctcctaccacctg

SEQ ID NO: 338833 - DNA, 25 bp, Artificial Sequence
  Description of Artificial Sequence: Synthetic oligonucleotide
ccagatccacgcctcctaccacctg

SEQ ID NO: 338834 - DNA, 26 bp, Artificial Sequence
  Description of Artificial Sequence: Synthetic oligonucleotide
cagatccacgcctcctaccacctgca

SEQ ID NO: 338835 - DNA, 26 bp, Artificial Sequence
  Description of Artificial Sequence: Synthetic oligonucleotide
agatccacgcctcctaccacctgcac

SEQ ID NO: 338836 - DNA, 25 bp, Artificial Sequence
  Description of Artificial Sequence: Synthetic oligonucleotide
gatccacgcctcctaccacctgcac

SEQ ID NO: 338837 - DNA, 25 bp, Artificial Sequence
  Description of Artificial Sequence: Synthetic oligonucleotide
atccacgcctcctaccacctgcacg

SEQ ID NO: 338838 - DNA, 24 bp, Artificial Sequence
  Description of Artificial Sequence: Synthetic oligonucleotide
tccacgcctcctaccacctgcacg

SEQ ID NO: 338839 - DNA, 23 bp, Artificial Sequence
  Description of Artificial Sequence: Synthetic oligonucleotide
ccacgcctcctaccacctgcacg

SEQ ID NO: 338840 - DNA, 23 bp, Artificial Sequence
  Description of Artificial Sequence: Synthetic oligonucleotide
cacgcctcctaccacctgcacgc

SEQ ID NO: 338841 - DNA, 23 bp, Artificial Sequence
  Description of Artificial Sequence: Synthetic oligonucleotide
acgcctcctaccacctgcacgcg

SEQ ID NO: 338842 - DNA, 22 bp, Artificial Sequence
  Description of Artificial Sequence: Synthetic oligonucleotide
cgcctcctaccacctgcacgcg

SEQ ID NO: 338843 - DNA, 22 bp, Artificial Sequence
  Description of Artificial Sequence: Synthetic oligonucleotide
gcctcctaccacctgcacgcgg

SEQ ID NO: 338844 - DNA, 22 bp, Artificial Sequence
  Description of Artificial Sequence: Synthetic oligonucleotide
cctcctaccacctgcacgcggc

SEQ ID NO: 338845 - DNA, 23 bp, Artificial Sequence
  Description of Artificial Sequence: Synthetic oligonucleotide
ctcctaccacctgcacgcggcga

SEQ ID NO: 338846 - DNA, 23 bp, Artificial Sequence
  Description of Artificial Sequence: Synthetic oligonucleotide
tcctaccacctgcacgcggcgag

SEQ ID NO: 338847 - DNA, 22 bp, Artificial Sequence
  Description of Artificial Sequence: Synthetic oligonucleotide
cctaccacctgcacgcggcgag

SEQ ID NO: 338848 - DNA, 23 bp, Artificial Sequence
  Description of Artificial Sequence: Synthetic oligonucleotide
ctaccacctgcacgcggcgagca

SEQ ID NO: 338849 - DNA, 23 bp, Artificial Sequence
  Description of Artificial Sequence: Synthetic oligonucleotide
taccacctgcacgcggcgagcac

SEQ ID NO: 338850 - DNA, 22 bp, Artificial Sequence
  Description of Artificial Sequence: Synthetic oligonucleotide
accacctgcacgcggcgagcac

SEQ ID NO: 338851 - DNA, 21 bp, Artificial Sequence
  Description of Artificial Sequence: Synthetic oligonucleotide
ccacctgcacgcggcgagcac

SEQ ID NO: 338852 - DNA, 23 bp, Artificial Sequence
  Description of Artificial Sequence: Synthetic oligonucleotide
cacctgcacgcggcgagcaccat

SEQ ID NO: 338853 - DNA, 24 bp, Artificial Sequence
  Description of Artificial Sequence: Synthetic oligonucleotide
acctgcacgcggcgagcaccatca

SEQ ID NO: 338854 - DNA, 23 bp, Artificial Sequence
  Description of Artificial Sequence: Synthetic oligonucleotide
cctgcacgcggcgagcaccatca

SEQ ID NO: 338855 - DNA, 23 bp, Artificial Sequence
  Description of Artificial Sequence: Synthetic oligonucleotide
ctgcacgcggcgagcaccatcac

SEQ ID NO: 338856 - DNA, 25 bp, Artificial Sequence
  Description of Artificial Sequence: Synthetic oligonucleotide
tgcacgcggcgagcaccatcaccat

SEQ ID NO: 338857 - DNA, 24 bp, Artificial Sequence
  Description of Artificial Sequence: Synthetic oligonucleotide
gcacgcggcgagcaccatcaccat

SEQ ID NO: 338858 - DNA, 24 bp, Artificial Sequence
  Description of Artificial Sequence: Synthetic oligonucleotide
cacgcggcgagcaccatcaccatc

SEQ ID NO: 338859 - DNA, 25 bp, Artificial Sequence
  Description of Artificial Sequence: Synthetic oligonucleotide
acgcggcgagcaccatcaccatcga

SEQ ID NO: 338860 - DNA, 24 bp, Artificial Sequence
  Description of Artificial Sequence: Synthetic oligonucleotide
cgcggcgagcaccatcaccatcga

SEQ ID NO: 338861 - DNA, 25 bp, Artificial Sequence
  Description of Artificial Sequence: Synthetic oligonucleotide
gcggcgagcaccatcaccatcgaca

SEQ ID NO: 338862 - DNA, 25 bp, Artificial Sequence
  Description of Artificial Sequence: Synthetic oligonucleotide
cggcgagcaccatcaccatcgacag

SEQ ID NO: 338863 - DNA, 25 bp, Artificial Sequence
  Description of Artificial Sequence: Synthetic oligonucleotide
ggcgagcaccatcaccatcgacagg

SEQ ID NO: 338864 - DNA, 26 bp, Artificial Sequence
  Description of Artificial Sequence: Synthetic oligonucleotide
gcgagcaccatcaccatcgacaggct

SEQ ID NO: 338865 - DNA, 26 bp, Artificial Sequence
  Description of Artificial Sequence: Synthetic oligonucleotide
cgagcaccatcaccatcgacaggctc

SEQ ID NO: 338866 - DNA, 27 bp, Artificial Sequence
  Description of Artificial Sequence: Synthetic oligonucleotide
gagcaccatcaccatcgacaggctcgt

SEQ ID NO: 338867 - DNA, 27 bp, Artificial Sequence
  Description of Artificial Sequence: Synthetic oligonucleotide
agcaccatcaccatcgacaggctcgtg

SEQ ID NO: 338868 - DNA, 26 bp, Artificial Sequence
  Description of Artificial Sequence: Synthetic oligonucleotide
gcaccatcaccatcgacaggctcgtg

SEQ ID NO: 338869 - DNA, 27 bp, Artificial Sequence
  Description of Artificial Sequence: Synthetic oligonucleotide
caccatcaccatcgacaggctcgtgga

SEQ ID NO: 338870 - DNA, 27 bp, Artificial Sequence
  Description of Artificial Sequence: Synthetic oligonucleotide
accatcaccatcgacaggctcgtggac

SEQ ID NO: 338871 - DNA, 26 bp, Artificial Sequence
  Description of Artificial Sequence: Synthetic oligonucleotide
ccatcaccatcgacaggctcgtggac

SEQ ID NO: 338872 - DNA, 27 bp, Artificial Sequence
  Description of Artificial Sequence: Synthetic oligonucleotide
catcaccatcgacaggctcgtggacga

SEQ ID NO: 338873 - DNA, 27 bp, Artificial Sequence
  Description of Artificial Sequence: Synthetic oligonucleotide
atcaccatcgacaggctcgtggacgag

SEQ ID NO: 338874 - DNA, 26 bp, Artificial Sequence
  Description of Artificial Sequence: Synthetic oligonucleotide
tcaccatcgacaggctcgtggacgag

SEQ ID NO: 338875 - DNA, 25 bp, Artificial Sequence
  Description of Artificial Sequence: Synthetic oligonucleotide
caccatcgacaggctcgtggacgag

SEQ ID NO: 338876 - DNA, 26 bp, Artificial Sequence
  Description of Artificial Sequence: Synthetic oligonucleotide
accatcgacaggctcgtggacgagga

SEQ ID NO: 338877 - DNA, 25 bp, Artificial Sequence
  Description of Artificial Sequence: Synthetic oligonucleotide
ccatcgacaggctcgtggacgagga

SEQ ID NO: 338878 - DNA, 26 bp, Artificial Sequence
  Description of Artificial Sequence: Synthetic oligonucleotide
catcgacaggctcgtggacgaggaca

SEQ ID NO: 338879 - DNA, 26 bp, Artificial Sequence
  Description of Artificial Sequence: Synthetic oligonucleotide
atcgacaggctcgtggacgaggacac

SEQ ID NO: 338880 - DNA, 25 bp, Artificial Sequence
  Description of Artificial Sequence: Synthetic oligonucleotide
tcgacaggctcgtggacgaggacac

SEQ ID NO: 338881 - DNA, 24 bp, Artificial Sequence
  Description of Artificial Sequence: Synthetic oligonucleotide
cgacaggctcgtggacgaggacac

SEQ ID NO: 338882 - DNA, 24 bp, Artificial Sequence
  Description of Artificial Sequence: Synthetic oligonucleotide
gacaggctcgtggacgaggacacg

SEQ ID NO: 338883 - DNA, 24 bp, Artificial Sequence
  Description of Artificial Sequence: Synthetic oligonucleotide
acaggctcgtggacgaggacacgc

SEQ ID NO: 338884 - DNA, 23 bp, Artificial Sequence
  Description of Artificial Sequence: Synthetic oligonucleotide
caggctcgtggacgaggacacgc

SEQ ID NO: 338885 - DNA, 23 bp, Artificial Sequence
  Description of Artificial Sequence: Synthetic oligonucleotide
aggctcgtggacgaggacacgcg

SEQ ID NO: 338886 - DNA, 22 bp, Artificial Sequence
  Description of Artificial Sequence: Synthetic oligonucleotide
ggctcgtggacgaggacacgcg

SEQ ID NO: 338887 - DNA, 23 bp, Artificial Sequence
  Description of Artificial Sequence: Synthetic oligonucleotide
gctcgtggacgaggacacgcgca

SEQ ID NO: 338888 - DNA, 26 bp, Artificial Sequence
  Description of Artificial Sequence: Synthetic oligonucleotide
ctcgtggacgaggacacgcgcactta

SEQ ID NO: 338889 - DNA, 26 bp, Artificial Sequence
  Description of Artificial Sequence: Synthetic oligonucleotide
tcgtggacgaggacacgcgcacttac

SEQ ID NO: 338890 - DNA, 25 bp, Artificial Sequence
  Description of Artificial Sequence: Synthetic oligonucleotide
cgtggacgaggacacgcgcacttac

SEQ ID NO: 338891 - DNA, 26 bp, Artificial Sequence
  Description of Artificial Sequence: Synthetic oligonucleotide
gtggacgaggacacgcgcacttacgt

SEQ ID NO: 338892 - DNA, 27 bp, Artificial Sequence
  Description of Artificial Sequence: Synthetic oligonucleotide
tggacgaggacacgcgcacttacgtgt

SEQ ID NO: 338893 - DNA, 26 bp, Artificial Sequence
  Description of Artificial Sequence: Synthetic oligonucleotide
ggacgaggacacgcgcacttacgtgt

SEQ ID NO: 338894 - DNA, 26 bp, Artificial Sequence
  Description of Artificial Sequence: Synthetic oligonucleotide
gacgaggacacgcgcacttacgtgtg

SEQ ID NO: 338895 - DNA, 26 bp, Artificial Sequence
  Description of Artificial Sequence: Synthetic oligonucleotide
acgaggacacgcgcacttacgtgtgc

SEQ ID NO: 338896 - DNA, 25 bp, Artificial Sequence
  Description of Artificial Sequence: Synthetic oligonucleotide
cgaggacacgcgcacttacgtgtgc

SEQ ID NO: 338897 - DNA, 25 bp, Artificial Sequence
  Description of Artificial Sequence: Synthetic oligonucleotide
gaggacacgcgcacttacgtgtgcc

SEQ ID NO: 338898 - DNA, 25 bp, Artificial Sequence
  Description of Artificial Sequence: Synthetic oligonucleotide
aggacacgcgcacttacgtgtgccg

SEQ ID NO: 338899 - DNA, 24 bp, Artificial Sequence
  Description of Artificial Sequence: Synthetic oligonucleotide
ggacacgcgcacttacgtgtgccg

SEQ ID NO: 338900 - DNA, 24 bp, Artificial Sequence
  Description of Artificial Sequence: Synthetic oligonucleotide
gacacgcgcacttacgtgtgccgg

SEQ ID NO: 338901 - DNA, 24 bp, Artificial Sequence
  Description of Artificial Sequence: Synthetic oligonucleotide
acacgcgcacttacgtgtgccggg

SEQ ID NO: 338902 - DNA, 23 bp, Artificial Sequence
  Description of Artificial Sequence: Synthetic oligonucleotide
cacgcgcacttacgtgtgccggg

SEQ ID NO: 338903 - DNA, 23 bp, Artificial Sequence
  Description of Artificial Sequence: Synthetic oligonucleotide
acgcgcacttacgtgtgccgggc

SEQ ID NO: 338904 - DNA, 22 bp, Artificial Sequence
  Description of Artificial Sequence: Synthetic oligonucleotide
cgcgcacttacgtgtgccgggc

SEQ ID NO: 338905 - DNA, 23 bp, Artificial Sequence
  Description of Artificial Sequence: Synthetic oligonucleotide
gcgcacttacgtgtgccgggcga

SEQ ID NO: 338906 - DNA, 23 bp, Artificial Sequence
  Description of Artificial Sequence: Synthetic oligonucleotide
cgcacttacgtgtgccgggcgag

SEQ ID NO: 338907 - DNA, 25 bp, Artificial Sequence
  Description of Artificial Sequence: Synthetic oligonucleotide
gcacttacgtgtgccgggcgagcaa

SEQ ID NO: 338908 - DNA, 25 bp, Artificial Sequence
  Description of Artificial Sequence: Synthetic oligonucleotide
cacttacgtgtgccgggcgagcaac

SEQ ID NO: 338909 - DNA, 26 bp, Artificial Sequence
  Description of Artificial Sequence: Synthetic oligonucleotide
acttacgtgtgccgggcgagcaacga

SEQ ID NO: 338910 - DNA, 25 bp, Artificial Sequence
  Description of Artificial Sequence: Synthetic oligonucleotide
cttacgtgtgccgggcgagcaacga

SEQ ID NO: 338911 - DNA, 25 bp, Artificial Sequence
  Description of Artificial Sequence: Synthetic oligonucleotide
ttacgtgtgccgggcgagcaacgac

SEQ ID NO: 338912 - DNA, 24 bp, Artificial Sequence
  Description of Artificial Sequence: Synthetic oligonucleotide
tacgtgtgccgggcgagcaacgac

SEQ ID NO: 338913 - DNA, 23 bp, Artificial Sequence
  Description of Artificial Sequence: Synthetic oligonucleotide
acgtgtgccgggcgagcaacgac

SEQ ID NO: 338914 - DNA, 22 bp, Artificial Sequence
  Description of Artificial Sequence: Synthetic oligonucleotide
cgtgtgccgggcgagcaacgac

SEQ ID NO: 338915 - DNA, 22 bp, Artificial Sequence
  Description of Artificial Sequence: Synthetic oligonucleotide
gtgtgccgggcgagcaacgacg

SEQ ID NO: 338916 - DNA, 22 bp, Artificial Sequence
  Description of Artificial Sequence: Synthetic oligonucleotide
tgtgccgggcgagcaacgacgc

SEQ ID NO: 338917 - DNA, 21 bp, Artificial Sequence
  Description of Artificial Sequence: Synthetic oligonucleotide
gtgccgggcgagcaacgacgc

SEQ ID NO: 338918 - DNA, 21 bp, Artificial Sequence
  Description of Artificial Sequence: Synthetic oligonucleotide
tgccgggcgagcaacgacgcg

SEQ ID NO: 338919 - DNA, 20 bp, Artificial Sequence
  Description of Artificial Sequence: Synthetic oligonucleotide
gccgggcgagcaacgacgcg

SEQ ID NO: 338920 - DNA, 22 bp, Artificial Sequence
  Description of Artificial Sequence: Synthetic oligonucleotide
ccgggcgagcaacgacgcggat

SEQ ID NO: 338921 - DNA, 22 bp, Artificial Sequence
  Description of Artificial Sequence: Synthetic oligonucleotide
cgggcgagcaacgacgcggatc

SEQ ID NO: 338922 - DNA, 22 bp, Artificial Sequence
  Description of Artificial Sequence: Synthetic oligonucleotide
gggcgagcaacgacgcggatcg

SEQ ID NO: 338923 - DNA, 24 bp, Artificial Sequence
  Description of Artificial Sequence: Synthetic oligonucleotide
ggcgagcaacgacgcggatcgcat

SEQ ID NO: 338924 - DNA, 24 bp, Artificial Sequence
  Description of Artificial Sequence: Synthetic oligonucleotide
gcgagcaacgacgcggatcgcatc

SEQ ID NO: 338925 - DNA, 25 bp, Artificial Sequence
  Description of Artificial Sequence: Synthetic oligonucleotide
cgagcaacgacgcggatcgcatcca

SEQ ID NO: 338926 - DNA, 25 bp, Artificial Sequence
  Description of Artificial Sequence: Synthetic oligonucleotide
gagcaacgacgcggatcgcatccac

SEQ ID NO: 338927 - DNA, 26 bp, Artificial Sequence
  Description of Artificial Sequence: Synthetic oligonucleotide
agcaacgacgcggatcgcatccacct

SEQ ID NO: 338928 - DNA, 25 bp, Artificial Sequence
  Description of Artificial Sequence: Synthetic oligonucleotide
gcaacgacgcggatcgcatccacct

SEQ ID NO: 338929 - DNA, 26 bp, Artificial Sequence
  Description of Artificial Sequence: Synthetic oligonucleotide
caacgacgcggatcgcatccacctga

SEQ ID NO: 338930 - DNA, 26 bp, Artificial Sequence
  Description of Artificial Sequence: Synthetic oligonucleotide
aacgacgcggatcgcatccacctgac

SEQ ID NO: 338931 - DNA, 25 bp, Artificial Sequence
  Description of Artificial Sequence: Synthetic oligonucleotide
acgacgcggatcgcatccacctgac

SEQ ID NO: 338932 - DNA, 24 bp, Artificial Sequence
  Description of Artificial Sequence: Synthetic oligonucleotide
cgacgcggatcgcatccacctgac

SEQ ID NO: 338933 - DNA, 24 bp, Artificial Sequence
  Description of Artificial Sequence: Synthetic oligonucleotide
gacgcggatcgcatccacctgacg

SEQ ID NO: 338934 - DNA, 24 bp, Artificial Sequence
  Description of Artificial Sequence: Synthetic oligonucleotide
acgcggatcgcatccacctgacgc

SEQ ID NO: 338935 - DNA, 23 bp, Artificial Sequence
  Description of Artificial Sequence: Synthetic oligonucleotide
cgcggatcgcatccacctgacgc

SEQ ID NO: 338936 - DNA, 23 bp, Artificial Sequence
  Description of Artificial Sequence: Synthetic oligonucleotide
gcggatcgcatccacctgacgcg

SEQ ID NO: 338937 - DNA, 23 bp, Artificial Sequence
  Description of Artificial Sequence: Synthetic oligonucleotide
cggatcgcatccacctgacgcgg

SEQ ID NO: 338938 - DNA, 23 bp, Artificial Sequence
  Description of Artificial Sequence: Synthetic oligonucleotide
ggatcgcatccacctgacgcggg

SEQ ID NO: 338939 - DNA, 23 bp, Artificial Sequence
  Description of Artificial Sequence: Synthetic oligonucleotide
gatcgcatccacctgacgcgggc

SEQ ID NO: 338940 - DNA, 23 bp, Artificial Sequence
  Description of Artificial Sequence: Synthetic oligonucleotide
atcgcatccacctgacgcgggcg

SEQ ID NO: 338941 - DNA, 22 bp, Artificial Sequence
  Description of Artificial Sequence: Synthetic oligonucleotide
tcgcatccacctgacgcgggcg

SEQ ID NO: 338942 - DNA, 21 bp, Artificial Sequence
  Description of Artificial Sequence: Synthetic oligonucleotide
cgcatccacctgacgcgggcg

SEQ ID NO: 338943 - DNA, 21 bp, Artificial Sequence
  Description of Artificial Sequence: Synthetic oligonucleotide
gcatccacctgacgcgggcgc

SEQ ID NO: 338944 - DNA, 21 bp, Artificial Sequence
  Description of Artificial Sequence: Synthetic oligonucleotide
catccacctgacgcgggcgcc

SEQ ID NO: 338945 - DNA, 22 bp, Artificial Sequence
  Description of Artificial Sequence: Synthetic oligonucleotide
atccacctgacgcgggcgccct

SEQ ID NO: 338946 - DNA, 21 bp, Artificial Sequence
  Description of Artificial Sequence: Synthetic oligonucleotide
tccacctgacgcgggcgccct

SEQ ID NO: 338947 - DNA, 20 bp, Artificial Sequence
  Description of Artificial Sequence: Synthetic oligonucleotide
ccacctgacgcgggcgccct

SEQ ID NO: 338948 - DNA, 20 bp, Artificial Sequence
  Description of Artificial Sequence: Synthetic oligonucleotide
cacctgacgcgggcgccctg

SEQ ID NO: 338949 - DNA, 20 bp, Artificial Sequence
  Description of Artificial Sequence: Synthetic oligonucleotide
acctgacgcgggcgccctgg

SEQ ID NO: 338950 - DNA, 20 bp, Artificial Sequence
  Description of Artificial Sequence: Synthetic oligonucleotide
cctgacgcgggcgccctggt

SEQ ID NO: 338951 - DNA, 20 bp, Artificial Sequence
  Description of Artificial Sequence: Synthetic oligonucleotide
ctgacgcgggcgccctgggt

SEQ ID NO: 338952 - DNA, 22 bp, Artificial Sequence
  Description of Artificial Sequence: Synthetic oligonucleotide
tgacgcgggcgccctgggtcaa

SEQ ID NO: 338953 - DNA, 21 bp, Artificial Sequence
  Description of Artificial Sequence: Synthetic oligonucleotide
gacgcgggcgccctgggtcaa

SEQ ID NO: 338954 - DNA, 22 bp, Artificial Sequence
  Description of Artificial Sequence: Synthetic oligonucleotide
acgcgggcgccctgggtcaagt

SEQ ID NO: 338955 - DNA, 21 bp, Artificial Sequence
  Description of Artificial Sequence: Synthetic oligonucleotide
cgcgggcgccctgggtcaagt

SEQ ID NO: 338956 - DNA, 21 bp, Artificial Sequence
  Description of Artificial Sequence: Synthetic oligonucleotide
gcgggcgccctgggtcaagtc

SEQ ID NO: 338957 - DNA, 21 bp, Artificial Sequence
  Description of Artificial Sequence: Synthetic oligonucleotide
cgggcgccctgggtcaagtcg

SEQ ID NO: 338958 - DNA, 22 bp, Artificial Sequence
  Description of Artificial Sequence: Synthetic oligonucleotide
gggcgccctgggtcaagtcggt

SEQ ID NO: 338959 - DNA, 22 bp, Artificial Sequence
  Description of Artificial Sequence: Synthetic oligonucleotide
ggcgccctgggtcaagtcggtc

SEQ ID NO: 338960 - DNA, 22 bp, Artificial Sequence
  Description of Artificial Sequence: Synthetic oligonucleotide
gcgccctgggtcaagtcggtcc

SEQ ID NO: 338961 - DNA, 22 bp, Artificial Sequence
  Description of Artificial Sequence: Synthetic oligonucleotide
cgccctgggtcaagtcggtccg

SEQ ID NO: 338962 - DNA, 22 bp, Artificial Sequence
  Description of Artificial Sequence: Synthetic oligonucleotide
gccctgggtcaagtcggtccgc

SEQ ID NO: 338963 - DNA, 22 bp, Artificial Sequence
  Description of Artificial Sequence: Synthetic oligonucleotide
ccctgggtcaagtcggtccgcg

SEQ ID NO: 338964 - DNA, 22 bp, Artificial Sequence
  Description of Artificial Sequence: Synthetic oligonucleotide
cctgggtcaagtcggtccgcgc

SEQ ID NO: 338965 - DNA, 22 bp, Artificial Sequence
  Description of Artificial Sequence: Synthetic oligonucleotide
ctgggtcaagtcggtccgcgcg

SEQ ID NO: 338966 - DNA, 23 bp, Artificial Sequence
  Description of Artificial Sequence: Synthetic oligonucleotide
tgggtcaagtcggtccgcgcgca

SEQ ID NO: 338967 - DNA, 22 bp, Artificial Sequence
  Description of Artificial Sequence: Synthetic oligonucleotide
gggtcaagtcggtccgcgcgca

SEQ ID NO: 338968 - DNA, 22 bp, Artificial Sequence
  Description of Artificial Sequence: Synthetic oligonucleotide
ggtcaagtcggtccgcgcgcag

SEQ ID NO: 338969 - DNA, 22 bp, Artificial Sequence
  Description of Artificial Sequence: Synthetic oligonucleotide
gtcaagtcggtccgcgcgcagg

SEQ ID NO: 338970 - DNA, 23 bp, Artificial Sequence
  Description of Artificial Sequence: Synthetic oligonucleotide
tcaagtcggtccgcgcgcaggca

SEQ ID NO: 338971 - DNA, 22 bp, Artificial Sequence
  Description of Artificial Sequence: Synthetic oligonucleotide
caagtcggtccgcgcgcaggca

SEQ ID NO: 338972 - DNA, 23 bp, Artificial Sequence
  Description of Artificial Sequence: Synthetic oligonucleotide
aagtcggtccgcgcgcaggcagt

SEQ ID NO: 338973 - DNA, 22 bp, Artificial Sequence
  Description of Artificial Sequence: Synthetic oligonucleotide
agtcggtccgcgcgcaggcagt

SEQ ID NO: 338974 - DNA, 21 bp, Artificial Sequence
  Description of Artificial Sequence: Synthetic oligonucleotide
gtcggtccgcgcgcaggcagt

SEQ ID NO: 338975 - DNA, 21 bp, Artificial Sequence
  Description of Artificial Sequence: Synthetic oligonucleotide
tcggtccgcgcgcaggcagtc

SEQ ID NO: 338976 - DNA, 20 bp, Artificial Sequence
  Description of Artificial Sequence: Synthetic oligonucleotide
cggtccgcgcgcaggcagtc

SEQ ID NO: 338977 - DNA, 21 bp, Artificial Sequence
  Description of Artificial Sequence: Synthetic oligonucleotide
ggtccgcgcgcaggcagtcct

SEQ ID NO: 338978 - DNA, 21 bp, Artificial Sequence
  Description of Artificial Sequence: Synthetic oligonucleotide
gtccgcgcgcaggcagtcctg

SEQ ID NO: 338979 - DNA, 23 bp, Artificial Sequence
  Description of Artificial Sequence: Synthetic oligonucleotide
tccgcgcgcaggcagtcctgcta

SEQ ID NO: 338980 - DNA, 22 bp, Artificial Sequence
  Description of Artificial Sequence: Synthetic oligonucleotide
ccgcgcgcaggcagtcctgcta

SEQ ID NO: 338981 - DNA, 23 bp, Artificial Sequence
  Description of Artificial Sequence: Synthetic oligonucleotide
cgcgcgcaggcagtcctgctagt

SEQ ID NO: 338982 - DNA, 23 bp, Artificial Sequence
  Description of Artificial Sequence: Synthetic oligonucleotide
gcgcgcaggcagtcctgctagtc

SEQ ID NO: 338983 - DNA, 24 bp, Artificial Sequence
  Description of Artificial Sequence: Synthetic oligonucleotide
cgcgcaggcagtcctgctagtcca

SEQ ID NO: 338984 - DNA, 24 bp, Artificial Sequence
  Description of Artificial Sequence: Synthetic oligonucleotide
gcgcaggcagtcctgctagtccag

SEQ ID NO: 338985 - DNA, 26 bp, Artificial Sequence
  Description of Artificial Sequence: Synthetic oligonucleotide
cgcaggcagtcctgctagtccaggaa

SEQ ID NO: 338986 - DNA, 26 bp, Artificial Sequence
  Description of Artificial Sequence: Synthetic oligonucleotide
gcaggcagtcctgctagtccaggaac

SEQ ID NO: 338987 - DNA, 26 bp, Artificial Sequence
  Description of Artificial Sequence: Synthetic oligonucleotide
caggcagtcctgctagtccaggaacc

SEQ ID NO: 338988 - DNA, 26 bp, Artificial Sequence
  Description of Artificial Sequence: Synthetic oligonucleotide
aggcagtcctgctagtccaggaaccc

SEQ ID NO: 338989 - DNA, 25 bp, Artificial Sequence
  Description of Artificial Sequence: Synthetic oligonucleotide
ggcagtcctgctagtccaggaaccc

SEQ ID NO: 338990 - DNA, 25 bp, Artificial Sequence
  Description of Artificial Sequence: Synthetic oligonucleotide
gcagtcctgctagtccaggaacccg

SEQ ID NO: 338991 - DNA, 25 bp, Artificial Sequence
  Description of Artificial Sequence: Synthetic oligonucleotide
cagtcctgctagtccaggaacccgg

SEQ ID NO: 338992 - DNA, 26 bp, Artificial Sequence
  Description of Artificial Sequence: Synthetic oligonucleotide
agtcctgctagtccaggaacccggga

SEQ ID NO: 338993 - DNA, 25 bp, Artificial Sequence
  Description of Artificial Sequence: Synthetic oligonucleotide
gtcctgctagtccaggaacccggga

SEQ ID NO: 338994 - DNA, 26 bp, Artificial Sequence
  Description of Artificial Sequence: Synthetic oligonucleotide
tcctgctagtccaggaacccgggaca

SEQ ID NO: 338995 - DNA, 25 bp, Artificial Sequence
  Description of Artificial Sequence: Synthetic oligonucleotide
cctgctagtccaggaacccgggaca

SEQ ID NO: 338996 - DNA, 26 bp, Artificial Sequence
  Description of Artificial Sequence: Synthetic oligonucleotide
ctgctagtccaggaacccgggacagt

SEQ ID NO: 338997 - DNA, 27 bp, Artificial Sequence
  Description of Artificial Sequence: Synthetic oligonucleotide
tgctagtccaggaacccgggacagtct

SEQ ID NO: 338998 - DNA, 27 bp, Artificial Sequence
  Description of Artificial Sequence: Synthetic oligonucleotide
gctagtccaggaacccgggacagtctt

SEQ ID NO: 338999 - DNA, 27 bp, Artificial Sequence
  Description of Artificial Sequence: Synthetic oligonucleotide
ctagtccaggaacccgggacagtcttc

SEQ ID NO: 339000 - DNA, 28 bp, Artificial Sequence
  Description of Artificial Sequence: Synthetic oligonucleotide
tagtccaggaacccgggacagtcttctc

SEQ ID NO: 339001 - DNA, 27 bp, Artificial Sequence
  Description of Artificial Sequence: Synthetic oligonucleotide
agtccaggaacccgggacagtcttctc

SEQ ID NO: 339002 - DNA, 27 bp, Artificial Sequence
  Description of Artificial Sequence: Synthetic oligonucleotide
gtccaggaacccgggacagtcttctct

SEQ ID NO: 339003 - DNA, 28 bp, Artificial Sequence
  Description of Artificial Sequence: Synthetic oligonucleotide
tccaggaacccgggacagtcttctctac

SEQ ID NO: 339004 - DNA, 27 bp, Artificial Sequence
  Description of Artificial Sequence: Synthetic oligonucleotide
ccaggaacccgggacagtcttctctac

SEQ ID NO: 339005 - DNA, 27 bp, Artificial Sequence
  Description of Artificial Sequence: Synthetic oligonucleotide
caggaacccgggacagtcttctctacc

SEQ ID NO: 339006 - DNA, 27 bp, Artificial Sequence
  Description of Artificial Sequence: Synthetic oligonucleotide
aggaacccgggacagtcttctctaccg

SEQ ID NO: 339007 - DNA, 27 bp, Artificial Sequence
  Description of Artificial Sequence: Synthetic oligonucleotide
ggaacccgggacagtcttctctaccgt

SEQ ID NO: 339008 - DNA, 28 bp, Artificial Sequence
  Description of Artificial Sequence: Synthetic oligonucleotide
gaacccgggacagtcttctctaccgtag

SEQ ID NO: 339009 - DNA, 30 bp, Artificial Sequence
  Description of Artificial Sequence: Synthetic oligonucleotide
aacccgggacagtcttctctaccgtagtag

SEQ ID NO: 339010 - DNA, 29 bp, Artificial Sequence
  Description of Artificial Sequence: Synthetic oligonucleotide
acccgggacagtcttctctaccgtagtag

SEQ ID NO: 339011 - DNA, 28 bp, Artificial Sequence
  Description of Artificial Sequence: Synthetic oligonucleotide
cccgggacagtcttctctaccgtagtag

SEQ ID NO: 339012 - DNA, 29 bp, Artificial Sequence
  Description of Artificial Sequence: Synthetic oligonucleotide
ccgggacagtcttctctaccgtagtagac

SEQ ID NO: 339013 - DNA, 29 bp, Artificial Sequence
  Description of Artificial Sequence: Synthetic oligonucleotide
cgggacagtcttctctaccgtagtagacc

SEQ ID NO: 339014 - DNA, 31 bp, Artificial Sequence
  Description of Artificial Sequence: Synthetic oligonucleotide
gggacagtcttctctaccgtagtagaccttg

SEQ ID NO: 339015 - DNA, 31 bp, Artificial Sequence
  Description of Artificial Sequence: Synthetic oligonucleotide
ggacagtcttctctaccgtagtagaccttgg

SEQ ID NO: 339016 - DNA, 31 bp, Artificial Sequence
  Description of Artificial Sequence: Synthetic oligonucleotide
gacagtcttctctaccgtagtagaccttggg

SEQ ID NO: 339017 - DNA, 32 bp, Artificial Sequence
  Description of Artificial Sequence: Synthetic oligonucleotide
acagtcttctctaccgtagtagaccttgggtc

SEQ ID NO: 339018 - DNA, 31 bp, Artificial Sequence
  Description of Artificial Sequence: Synthetic oligonucleotide
cagtcttctctaccgtagtagaccttgggtc

SEQ ID NO: 339019 - DNA, 31 bp, Artificial Sequence
  Description of Artificial Sequence: Synthetic oligonucleotide
agtcttctctaccgtagtagaccttgggtcc

SEQ ID NO: 339020 - DNA, 30 bp, Artificial Sequence
  Description of Artificial Sequence: Synthetic oligonucleotide
gtcttctctaccgtagtagaccttgggtcc

SEQ ID NO: 339021 - DNA, 32 bp, Artificial Sequence
  Description of Artificial Sequence: Synthetic oligonucleotide
tcttctctaccgtagtagaccttgggtccaag

SEQ ID NO: 339022 - DNA, 31 bp, Artificial Sequence
  Description of Artificial Sequence: Synthetic oligonucleotide
cttctctaccgtagtagaccttgggtccaag

SEQ ID NO: 339023 - DNA, 34 bp, Artificial Sequence
  Description of Artificial Sequence: Synthetic oligonucleotide
ttctctaccgtagtagaccttgggtccaagatag

SEQ ID NO: 339024 - DNA, 33 bp, Artificial Sequence
  Description of Artificial Sequence: Synthetic oligonucleotide
tctctaccgtagtagaccttgggtccaagatag

SEQ ID NO: 339025 - DNA, 32 bp, Artificial Sequence
  Description of Artificial Sequence: Synthetic oligonucleotide
ctctaccgtagtagaccttgggtccaagatag

SEQ ID NO: 339026 - DNA, 33 bp, Artificial Sequence
  Description of Artificial Sequence: Synthetic oligonucleotide
tctaccgtagtagaccttgggtccaagatagtc

SEQ ID NO: 339027 - DNA, 32 bp, Artificial Sequence
  Description of Artificial Sequence: Synthetic oligonucleotide
ctaccgtagtagaccttgggtccaagatagtc

SEQ ID NO: 339028 - DNA, 32 bp, Artificial Sequence
  Description of Artificial Sequence: Synthetic oligonucleotide
taccgtagtagaccttgggtccaagatagtcc

SEQ ID NO: 339029 - DNA, 31 bp, Artificial Sequence
  Description of Artificial Sequence: Synthetic oligonucleotide
accgtagtagaccttgggtccaagatagtcc

SEQ ID NO: 339030 - DNA, 30 bp, Artificial Sequence
  Description of Artificial Sequence: Synthetic oligonucleotide
ccgtagtagaccttgggtccaagatagtcc

SEQ ID NO: 339031 - DNA, 31 bp, Artificial Sequence
  Description of Artificial Sequence: Synthetic oligonucleotide
cgtagtagaccttgggtccaagatagtcctc

SEQ ID NO: 339032 - DNA, 32 bp, Artificial Sequence
  Description of Artificial Sequence: Synthetic oligonucleotide
gtagtagaccttgggtccaagatagtcctcac

SEQ ID NO: 339033 - DNA, 32 bp, Artificial Sequence
  Description of Artificial Sequence: Synthetic oligonucleotide
tagtagaccttgggtccaagatagtcctcacc

SEQ ID NO: 339034 - DNA, 31 bp, Artificial Sequence
  Description of Artificial Sequence: Synthetic oligonucleotide
agtagaccttgggtccaagatagtcctcacc

SEQ ID NO: 339035 - DNA, 30 bp, Artificial Sequence
  Description of Artificial Sequence: Synthetic oligonucleotide
gtagaccttgggtccaagatagtcctcacc

SEQ ID NO: 339036 - DNA, 31 bp, Artificial Sequence
  Description of Artificial Sequence: Synthetic oligonucleotide
tagaccttgggtccaagatagtcctcacctc

SEQ ID NO: 339037 - DNA, 30 bp, Artificial Sequence
  Description of Artificial Sequence: Synthetic oligonucleotide
agaccttgggtccaagatagtcctcacctc

SEQ ID NO: 339038 - DNA, 29 bp, Artificial Sequence
  Description of Artificial Sequence: Synthetic oligonucleotide
gaccttgggtccaagatagtcctcacctc

SEQ ID NO: 339039 - DNA, 29 bp, Artificial Sequence
  Description of Artificial Sequence: Synthetic oligonucleotide
accttgggtccaagatagtcctcacctcc

SEQ ID NO: 339040 - DNA, 28 bp, Artificial Sequence
  Description of Artificial Sequence: Synthetic oligonucleotide
ccttgggtccaagatagtcctcacctcc

SEQ ID NO: 339041 - DNA, 29 bp, Artificial Sequence
  Description of Artificial Sequence: Synthetic oligonucleotide
cttgggtccaagatagtcctcacctcctc

SEQ ID NO: 339042 - DNA, 29 bp, Artificial Sequence
  Description of Artificial Sequence: Synthetic oligonucleotide
ttgggtccaagatagtcctcacctcctcc

SEQ ID NO: 339043 - DNA, 28 bp, Artificial Sequence
  Description of Artificial Sequence: Synthetic oligonucleotide
tgggtccaagatagtcctcacctcctcc

SEQ ID NO: 339044 - DNA, 27 bp, Artificial Sequence
  Description of Artificial Sequence: Synthetic oligonucleotide
gggtccaagatagtcctcacctcctcc

SEQ ID NO: 339045 - DNA, 29 bp, Artificial Sequence
  Description of Artificial Sequence: Synthetic oligonucleotide
ggtccaagatagtcctcacctcctccttg

SEQ ID NO: 339046 - DNA, 32 bp, Artificial Sequence
  Description of Artificial Sequence: Synthetic oligonucleotide
gtccaagatagtcctcacctcctccttgaaag

SEQ ID NO: 339047 - DNA, 33 bp, Artificial Sequence
  Description of Artificial Sequence: Synthetic oligonucleotide
tccaagatagtcctcacctcctccttgaaagac

SEQ ID NO: 339048 - DNA, 32 bp, Artificial Sequence
  Description of Artificial Sequence: Synthetic oligonucleotide
ccaagatagtcctcacctcctccttgaaagac

SEQ ID NO: 339049 - DNA, 33 bp, Artificial Sequence
  Description of Artificial Sequence: Synthetic oligonucleotide
caagatagtcctcacctcctccttgaaagacag

SEQ ID NO: 339050 - DNA, 33 bp, Artificial Sequence
  Description of Artificial Sequence: Synthetic oligonucleotide
aagatagtcctcacctcctccttgaaagacagc

SEQ ID NO: 339051 - DNA, 32 bp, Artificial Sequence
  Description of Artificial Sequence: Synthetic oligonucleotide
agatagtcctcacctcctccttgaaagacagc

SEQ ID NO: 339052 - DNA, 31 bp, Artificial Sequence
  Description of Artificial Sequence: Synthetic oligonucleotide
gatagtcctcacctcctccttgaaagacagc

SEQ ID NO: 339053 - DNA, 31 bp, Artificial Sequence
  Description of Artificial Sequence: Synthetic oligonucleotide
atagtcctcacctcctccttgaaagacagcg

SEQ ID NO: 339054 - DNA, 30 bp, Artificial Sequence
  Description of Artificial Sequence: Synthetic oligonucleotide
tagtcctcacctcctccttgaaagacagcg

SEQ ID NO: 339055 - DNA, 29 bp, Artificial Sequence
  Description of Artificial Sequence: Synthetic oligonucleotide
agtcctcacctcctccttgaaagacagcg

SEQ ID NO: 339056 - DNA, 28 bp, Artificial Sequence
  Description of Artificial Sequence: Synthetic oligonucleotide
gtcctcacctcctccttgaaagacagcg

SEQ ID NO: 339057 - DNA, 28 bp, Artificial Sequence
  Description of Artificial Sequence: Synthetic oligonucleotide
tcctcacctcctccttgaaagacagcgc

SEQ ID NO: 339058 - DNA, 27 bp, Artificial Sequence
  Description of Artificial Sequence: Synthetic oligonucleotide
cctcacctcctccttgaaagacagcgc

SEQ ID NO: 339059 - DNA, 27 bp, Artificial Sequence
  Description of Artificial Sequence: Synthetic oligonucleotide
ctcacctcctccttgaaagacagcgcc

SEQ ID NO: 339060 - DNA, 28 bp, Artificial Sequence
  Description of Artificial Sequence: Synthetic oligonucleotide
tcacctcctccttgaaagacagcgcctc

SEQ ID NO: 339061 - DNA, 27 bp, Artificial Sequence
  Description of Artificial Sequence: Synthetic oligonucleotide
cacctcctccttgaaagacagcgcctc

SEQ ID NO: 339062 - DNA, 28 bp, Artificial Sequence
  Description of Artificial Sequence: Synthetic oligonucleotide
acctcctccttgaaagacagcgcctcag

SEQ ID NO: 339063 - DNA, 27 bp, Artificial Sequence
  Description of Artificial Sequence: Synthetic oligonucleotide
cctcctccttgaaagacagcgcctcag

SEQ ID NO: 339064 - DNA, 28 bp, Artificial Sequence
  Description of Artificial Sequence: Synthetic oligonucleotide
ctcctccttgaaagacagcgcctcagag

SEQ ID NO: 339065 - DNA, 28 bp, Artificial Sequence
  Description of Artificial Sequence: Synthetic oligonucleotide
tcctccttgaaagacagcgcctcagagg

SEQ ID NO: 339066 - DNA, 27 bp, Artificial Sequence
  Description of Artificial Sequence: Synthetic oligonucleotide
cctccttgaaagacagcgcctcagagg

SEQ ID NO: 339067 - DNA, 28 bp, Artificial Sequence
  Description of Artificial Sequence: Synthetic oligonucleotide
ctccttgaaagacagcgcctcagaggtc

SEQ ID NO: 339068 - DNA, 29 bp, Artificial Sequence
  Description of Artificial Sequence: Synthetic oligonucleotide
tccttgaaagacagcgcctcagaggtcag

SEQ ID NO: 339069 - DNA, 28 bp, Artificial Sequence
  Description of Artificial Sequence: Synthetic oligonucleotide
ccttgaaagacagcgcctcagaggtcag

SEQ ID NO: 339070 - DNA, 29 bp, Artificial Sequence
  Description of Artificial Sequence: Synthetic oligonucleotide
cttgaaagacagcgcctcagaggtcagag

SEQ ID NO: 339071 - DNA, 29 bp, Artificial Sequence
  Description of Artificial Sequence: Synthetic oligonucleotide
ttgaaagacagcgcctcagaggtcagagg

SEQ ID NO: 339072 - DNA, 28 bp, Artificial Sequence
  Description of Artificial Sequence: Synthetic oligonucleotide
tgaaagacagcgcctcagaggtcagagg

SEQ ID NO: 339073 - DNA, 27 bp, Artificial Sequence
  Description of Artificial Sequence: Synthetic oligonucleotide
gaaagacagcgcctcagaggtcagagg

SEQ ID NO: 339074 - DNA, 27 bp, Artificial Sequence
  Description of Artificial Sequence: Synthetic oligonucleotide
aaagacagcgcctcagaggtcagaggg

SEQ ID NO: 339075 - DNA, 26 bp, Artificial Sequence
  Description of Artificial Sequence: Synthetic oligonucleotide
aagacagcgcctcagaggtcagaggg

SEQ ID NO: 339076 - DNA, 25 bp, Artificial Sequence
  Description of Artificial Sequence: Synthetic oligonucleotide
agacagcgcctcagaggtcagaggg

SEQ ID NO: 339077 - DNA, 24 bp, Artificial Sequence
  Description of Artificial Sequence: Synthetic oligonucleotide
gacagcgcctcagaggtcagaggg

SEQ ID NO: 339078 - DNA, 25 bp, Artificial Sequence
  Description of Artificial Sequence: Synthetic oligonucleotide
acagcgcctcagaggtcagagggca

SEQ ID NO: 339079 - DNA, 24 bp, Artificial Sequence
  Description of Artificial Sequence: Synthetic oligonucleotide
cagcgcctcagaggtcagagggca

SEQ ID NO: 339080 - DNA, 24 bp, Artificial Sequence
  Description of Artificial Sequence: Synthetic oligonucleotide
agcgcctcagaggtcagagggcac

SEQ ID NO: 339081 - DNA, 23 bp, Artificial Sequence
  Description of Artificial Sequence: Synthetic oligonucleotide
gcgcctcagaggtcagagggcac

SEQ ID NO: 339082 - DNA, 23 bp, Artificial Sequence
  Description of Artificial Sequence: Synthetic oligonucleotide
cgcctcagaggtcagagggcacc

SEQ ID NO: 339083 - DNA, 23 bp, Artificial Sequence
  Description of Artificial Sequence: Synthetic oligonucleotide
gcctcagaggtcagagggcaccg

SEQ ID NO: 339084 - DNA, 24 bp, Artificial Sequence
  Description of Artificial Sequence: Synthetic oligonucleotide
cctcagaggtcagagggcaccggt

SEQ ID NO: 339085 - DNA, 24 bp, Artificial Sequence
  Description of Artificial Sequence: Synthetic oligonucleotide
ctcagaggtcagagggcaccggtg

SEQ ID NO: 339086 - DNA, 24 bp, Artificial Sequence
  Description of Artificial Sequence: Synthetic oligonucleotide
tcagaggtcagagggcaccggtgg

SEQ ID NO: 339087 - DNA, 23 bp, Artificial Sequence
  Description of Artificial Sequence: Synthetic oligonucleotide
cagaggtcagagggcaccggtgg

SEQ ID NO: 339088 - DNA, 24 bp, Artificial Sequence
  Description of Artificial Sequence: Synthetic oligonucleotide
agaggtcagagggcaccggtggct

SEQ ID NO: 339089 - DNA, 23 bp, Artificial Sequence
  Description of Artificial Sequence: Synthetic oligonucleotide
gaggtcagagggcaccggtggct

SEQ ID NO: 339090 - DNA, 25 bp, Artificial Sequence
  Description of Artificial Sequence: Synthetic oligonucleotide
aggtcagagggcaccggtggctgaa

SEQ ID NO: 339091 - DNA, 24 bp, Artificial Sequence
  Description of Artificial Sequence: Synthetic oligonucleotide
ggtcagagggcaccggtggctgaa

SEQ ID NO: 339092 - DNA, 24 bp, Artificial Sequence
  Description of Artificial Sequence: Synthetic oligonucleotide
gtcagagggcaccggtggctgaag

SEQ ID NO: 339093 - DNA, 24 bp, Artificial Sequence
  Description of Artificial Sequence: Synthetic oligonucleotide
tcagagggcaccggtggctgaagc

SEQ ID NO: 339094 - DNA, 23 bp, Artificial Sequence
  Description of Artificial Sequence: Synthetic oligonucleotide
cagagggcaccggtggctgaagc

SEQ ID NO: 339095 - DNA, 23 bp, Artificial Sequence
  Description of Artificial Sequence: Synthetic oligonucleotide
agagggcaccggtggctgaagcg

SEQ ID NO: 339096 - DNA, 22 bp, Artificial Sequence
  Description of Artificial Sequence: Synthetic oligonucleotide
gagggcaccggtggctgaagcg

SEQ ID NO: 339097 - DNA, 22 bp, Artificial Sequence
  Description of Artificial Sequence: Synthetic oligonucleotide
agggcaccggtggctgaagcgg

SEQ ID NO: 339098 - DNA, 21 bp, Artificial Sequence
  Description of Artificial Sequence: Synthetic oligonucleotide
gggcaccggtggctgaagcgg

SEQ ID NO: 339099 - DNA, 21 bp, Artificial Sequence
  Description of Artificial Sequence: Synthetic oligonucleotide
ggcaccggtggctgaagcggg

SEQ ID NO: 339100 - DNA, 21 bp, Artificial Sequence
  Description of Artificial Sequence: Synthetic oligonucleotide
gcaccggtggctgaagcgggg

SEQ ID NO: 339101 - DNA, 21 bp, Artificial Sequence
  Description of Artificial Sequence: Synthetic oligonucleotide
caccggtggctgaagcggggc

SEQ ID NO: 339102 - DNA, 22 bp, Artificial Sequence
  Description of Artificial Sequence: Synthetic oligonucleotide
accggtggctgaagcggggcgt

SEQ ID NO: 339103 - DNA, 21 bp, Artificial Sequence
  Description of Artificial Sequence: Synthetic oligonucleotide
ccggtggctgaagcggggcgt

SEQ ID NO: 339104 - DNA, 21 bp, Artificial Sequence
  Description of Artificial Sequence: Synthetic oligonucleotide
cggtggctgaagcggggcgtg

SEQ ID NO: 339105 - DNA, 22 bp, Artificial Sequence
  Description of Artificial Sequence: Synthetic oligonucleotide
ggtggctgaagcggggcgtgga

SEQ ID NO: 339106 - DNA, 22 bp, Artificial Sequence
  Description of Artificial Sequence: Synthetic oligonucleotide
gtggctgaagcggggcgtggag

SEQ ID NO: 339107 - DNA, 23 bp, Artificial Sequence
  Description of Artificial Sequence: Synthetic oligonucleotide
tggctgaagcggggcgtggagct

SEQ ID NO: 339108 - DNA, 22 bp, Artificial Sequence
  Description of Artificial Sequence: Synthetic oligonucleotide
ggctgaagcggggcgtggagct

SEQ ID NO: 339109 - DNA, 24 bp, Artificial Sequence
  Description of Artificial Sequence: Synthetic oligonucleotide
gctgaagcggggcgtggagctgaa

SEQ ID NO: 339110 - DNA, 24 bp, Artificial Sequence
  Description of Artificial Sequence: Synthetic oligonucleotide
ctgaagcggggcgtggagctgaag

SEQ ID NO: 339111 - DNA, 25 bp, Artificial Sequence
  Description of Artificial Sequence: Synthetic oligonucleotide
tgaagcggggcgtggagctgaagga

SEQ ID NO: 339112 - DNA, 24 bp, Artificial Sequence
  Description of Artificial Sequence: Synthetic oligonucleotide
gaagcggggcgtggagctgaagga

SEQ ID NO: 339113 - DNA, 24 bp, Artificial Sequence
  Description of Artificial Sequence: Synthetic oligonucleotide
aagcggggcgtggagctgaaggac

SEQ ID NO: 339114 - DNA, 23 bp, Artificial Sequence
  Description of Artificial Sequence: Synthetic oligonucleotide
agcggggcgtggagctgaaggac

SEQ ID NO: 339115 - DNA, 22 bp, Artificial Sequence
  Description of Artificial Sequence: Synthetic oligonucleotide
gcggggcgtggagctgaaggac

SEQ ID NO: 339116 - DNA, 23 bp, Artificial Sequence
  Description of Artificial Sequence: Synthetic oligonucleotide
cggggcgtggagctgaaggacga

SEQ ID NO: 339117 - DNA, 23 bp, Artificial Sequence
  Description of Artificial Sequence: Synthetic oligonucleotide
ggggcgtggagctgaaggacgac

SEQ ID NO: 339118 - DNA, 23 bp, Artificial Sequence
  Description of Artificial Sequence: Synthetic oligonucleotide
gggcgtggagctgaaggacgacg

SEQ ID NO: 339119 - DNA, 23 bp, Artificial Sequence
  Description of Artificial Sequence: Synthetic oligonucleotide
ggcgtggagctgaaggacgacgc

SEQ ID NO: 339120 - DNA, 23 bp, Artificial Sequence
  Description of Artificial Sequence: Synthetic oligonucleotide
gcgtggagctgaaggacgacgcg

SEQ ID NO: 339121 - DNA, 24 bp, Artificial Sequence
  Description of Artificial Sequence: Synthetic oligonucleotide
cgtggagctgaaggacgacgcgct

SEQ ID NO: 339122 - DNA, 24 bp, Artificial Sequence
  Description of Artificial Sequence: Synthetic oligonucleotide
gtggagctgaaggacgacgcgctg

SEQ ID NO: 339123 - DNA, 24 bp, Artificial Sequence
  Description of Artificial Sequence: Synthetic oligonucleotide
tggagctgaaggacgacgcgctgg

SEQ ID NO: 339124 - DNA, 23 bp, Artificial Sequence
  Description of Artificial Sequence: Synthetic oligonucleotide
ggagctgaaggacgacgcgctgg

SEQ ID NO: 339125 - DNA, 23 bp, Artificial Sequence
  Description of Artificial Sequence: Synthetic oligonucleotide
gagctgaaggacgacgcgctggc

SEQ ID NO: 339126 - DNA, 23 bp, Artificial Sequence
  Description of Artificial Sequence: Synthetic oligonucleotide
agctgaaggacgacgcgctggcc

SEQ ID NO: 339127 - DNA, 22 bp, Artificial Sequence
  Description of Artificial Sequence: Synthetic oligonucleotide
gctgaaggacgacgcgctggcc

SEQ ID NO: 339128 - DNA, 22 bp, Artificial Sequence
  Description of Artificial Sequence: Synthetic oligonucleotide
ctgaaggacgacgcgctggccg

SEQ ID NO: 339129 - DNA, 22 bp, Artificial Sequence
  Description of Artificial Sequence: Synthetic oligonucleotide
tgaaggacgacgcgctggccgg

SEQ ID NO: 339130 - DNA, 21 bp, Artificial Sequence
  Description of Artificial Sequence: Synthetic oligonucleotide
gaaggacgacgcgctggccgg

SEQ ID NO: 339131 - DNA, 21 bp, Artificial Sequence
  Description of Artificial Sequence: Synthetic oligonucleotide
aaggacgacgcgctggccggc

SEQ ID NO: 339132 - DNA, 20 bp, Artificial Sequence
  Description of Artificial Sequence: Synthetic oligonucleotide
aggacgacgcgctggccggc

SEQ ID NO: 339133 - DNA, 20 bp, Artificial Sequence
  Description of Artificial Sequence: Synthetic oligonucleotide
ggacgacgcgctggccggct

SEQ ID NO: 339134 - DNA, 20 bp, Artificial Sequence
  Description of Artificial Sequence: Synthetic oligonucleotide
gacgacgcgctggccggcca

SEQ ID NO: 339135 - DNA, 24 bp, Artificial Sequence
  Description of Artificial Sequence: Synthetic oligonucleotide
acgacgcgctggccggccagataa

SEQ ID NO: 339136 - DNA, 23 bp, Artificial Sequence
  Description of Artificial Sequence: Synthetic oligonucleotide
cgacgcgctggccggccagataa

SEQ ID NO: 339137 - DNA, 23 bp, Artificial Sequence
  Description of Artificial Sequence: Synthetic oligonucleotide
gacgcgctggccggccagataac

SEQ ID NO: 339138 - DNA, 23 bp, Artificial Sequence
  Description of Artificial Sequence: Synthetic oligonucleotide
acgcgctggccggccagataacg

SEQ ID NO: 339139 - DNA, 22 bp, Artificial Sequence
  Description of Artificial Sequence: Synthetic oligonucleotide
cgcgctggccggccagataacg

SEQ ID NO: 339140 - DNA, 23 bp, Artificial Sequence
  Description of Artificial Sequence: Synthetic oligonucleotide
gcgctggccggccagataacgga

SEQ ID NO: 339141 - DNA, 25 bp, Artificial Sequence
  Description of Artificial Sequence: Synthetic oligonucleotide
cgctggccggccagataacggagtt

SEQ ID NO: 339142 - DNA, 27 bp, Artificial Sequence
  Description of Artificial Sequence: Synthetic oligonucleotide
gctggccggccagataacggagttgaa

SEQ ID NO: 339143 - DNA, 27 bp, Artificial Sequence
  Description of Artificial Sequence: Synthetic oligonucleotide
ctggccggccagataacggagttgaag

SEQ ID NO: 339144 - DNA, 27 bp, Artificial Sequence
  Description of Artificial Sequence: Synthetic oligonucleotide
tggccggccagataacggagttgaagg

SEQ ID NO: 339145 - DNA, 27 bp, Artificial Sequence
  Description of Artificial Sequence: Synthetic oligonucleotide
ggccggccagataacggagttgaaggt

SEQ ID NO: 339146 - DNA, 27 bp, Artificial Sequence
  Description of Artificial Sequence: Synthetic oligonucleotide
gccggccagataacggagttgaaggtg

SEQ ID NO: 339147 - DNA, 27 bp, Artificial Sequence
  Description of Artificial Sequence: Synthetic oligonucleotide
ccggccagataacggagttgaaggtgg

SEQ ID NO: 339148 - DNA, 28 bp, Artificial Sequence
  Description of Artificial Sequence: Synthetic oligonucleotide
cggccagataacggagttgaaggtggac

SEQ ID NO: 339149 - DNA, 29 bp, Artificial Sequence
  Description of Artificial Sequence: Synthetic oligonucleotide
ggccagataacggagttgaaggtggacac

SEQ ID NO: 339150 - DNA, 29 bp, Artificial Sequence
  Description of Artificial Sequence: Synthetic oligonucleotide
gccagataacggagttgaaggtggacacc

SEQ ID NO: 339151 - DNA, 29 bp, Artificial Sequence
  Description of Artificial Sequence: Synthetic oligonucleotide
ccagataacggagttgaaggtggacaccg

SEQ ID NO: 339152 - DNA, 30 bp, Artificial Sequence
  Description of Artificial Sequence: Synthetic oligonucleotide
cagataacggagttgaaggtggacaccgac

SEQ ID NO: 339153 - DNA, 30 bp, Artificial Sequence
  Description of Artificial Sequence: Synthetic oligonucleotide
agataacggagttgaaggtggacaccgacg

SEQ ID NO: 339154 - DNA, 29 bp, Artificial Sequence
  Description of Artificial Sequence: Synthetic oligonucleotide
gataacggagttgaaggtggacaccgacg

SEQ ID NO: 339155 - DNA, 30 bp, Artificial Sequence
  Description of Artificial Sequence: Synthetic oligonucleotide
ataacggagttgaaggtggacaccgacgac

SEQ ID NO: 339156 - DNA, 29 bp, Artificial Sequence
  Description of Artificial Sequence: Synthetic oligonucleotide
taacggagttgaaggtggacaccgacgac

SEQ ID NO: 339157 - DNA, 28 bp, Artificial Sequence
  Description of Artificial Sequence: Synthetic oligonucleotide
aacggagttgaaggtggacaccgacgac

SEQ ID NO: 339158 - DNA, 27 bp, Artificial Sequence
  Description of Artificial Sequence: Synthetic oligonucleotide
acggagttgaaggtggacaccgacgac

SEQ ID NO: 339159 - DNA, 26 bp, Artificial Sequence
  Description of Artificial Sequence: Synthetic oligonucleotide
cggagttgaaggtggacaccgacgac

SEQ ID NO: 339160 - DNA, 27 bp, Artificial Sequence
  Description of Artificial Sequence: Synthetic oligonucleotide
ggagttgaaggtggacaccgacgacct

SEQ ID NO: 339161 - DNA, 27 bp, Artificial Sequence
  Description of Artificial Sequence: Synthetic oligonucleotide
gagttgaaggtggacaccgacgacctg

SEQ ID NO: 339162 - DNA, 28 bp, Artificial Sequence
  Description of Artificial Sequence: Synthetic oligonucleotide
agttgaaggtggacaccgacgacctgtg

SEQ ID NO: 339163 - DNA, 27 bp, Artificial Sequence
  Description of Artificial Sequence: Synthetic oligonucleotide
gttgaaggtggacaccgacgacctgtg

SEQ ID NO: 339164 - DNA, 27 bp, Artificial Sequence
  Description of Artificial Sequence: Synthetic oligonucleotide
ttgaaggtggacaccgacgacctgtgg

SEQ ID NO: 339165 - DNA, 26 bp, Artificial Sequence
  Description of Artificial Sequence: Synthetic oligonucleotide
tgaaggtggacaccgacgacctgtgg

SEQ ID NO: 339166 - DNA, 25 bp, Artificial Sequence
  Description of Artificial Sequence: Synthetic oligonucleotide
gaaggtggacaccgacgacctgtgg

SEQ ID NO: 339167 - DNA, 25 bp, Artificial Sequence
  Description of Artificial Sequence: Synthetic oligonucleotide
aaggtggacaccgacgacctgtggg

SEQ ID NO: 339168 - DNA, 24 bp, Artificial Sequence
  Description of Artificial Sequence: Synthetic oligonucleotide
aggtggacaccgacgacctgtggg

SEQ ID NO: 339169 - DNA, 23 bp, Artificial Sequence
  Description of Artificial Sequence: Synthetic oligonucleotide
ggtggacaccgacgacctgtggg

SEQ ID NO: 339170 - DNA, 24 bp, Artificial Sequence
  Description of Artificial Sequence: Synthetic oligonucleotide
gtggacaccgacgacctgtgggga

SEQ ID NO: 339171 - DNA, 25 bp, Artificial Sequence
  Description of Artificial Sequence: Synthetic oligonucleotide
tggacaccgacgacctgtggggaga

SEQ ID NO: 339172 - DNA, 24 bp, Artificial Sequence
  Description of Artificial Sequence: Synthetic oligonucleotide
ggacaccgacgacctgtggggaga

SEQ ID NO: 339173 - DNA, 26 bp, Artificial Sequence
  Description of Artificial Sequence: Synthetic oligonucleotide
gacaccgacgacctgtggggagacta

SEQ ID NO: 339174 - DNA, 27 bp, Artificial Sequence
  Description of Artificial Sequence: Synthetic oligonucleotide
acaccgacgacctgtggggagactact

SEQ ID NO: 339175 - DNA, 26 bp, Artificial Sequence
  Description of Artificial Sequence: Synthetic oligonucleotide
caccgacgacctgtggggagactact

SEQ ID NO: 339176 - DNA, 26 bp, Artificial Sequence
  Description of Artificial Sequence: Synthetic oligonucleotide
accgacgacctgtggggagactactc

SEQ ID NO: 339177 - DNA, 25 bp, Artificial Sequence
  Description of Artificial Sequence: Synthetic oligonucleotide
ccgacgacctgtggggagactactc

SEQ ID NO: 339178 - DNA, 26 bp, Artificial Sequence
  Description of Artificial Sequence: Synthetic oligonucleotide
cgacgacctgtggggagactactcct

SEQ ID NO: 339179 - DNA, 26 bp, Artificial Sequence
  Description of Artificial Sequence: Synthetic oligonucleotide
gacgacctgtggggagactactcctg

SEQ ID NO: 339180 - DNA, 26 bp, Artificial Sequence
  Description of Artificial Sequence: Synthetic oligonucleotide
acgacctgtggggagactactcctgc

SEQ ID NO: 339181 - DNA, 25 bp, Artificial Sequence
  Description of Artificial Sequence: Synthetic oligonucleotide
cgacctgtggggagactactcctgc

SEQ ID NO: 339182 - DNA, 26 bp, Artificial Sequence
  Description of Artificial Sequence: Synthetic oligonucleotide
gacctgtggggagactactcctgcct

SEQ ID NO: 339183 - DNA, 27 bp, Artificial Sequence
  Description of Artificial Sequence: Synthetic oligonucleotide
acctgtggggagactactcctgcctct

SEQ ID NO: 339184 - DNA, 27 bp, Artificial Sequence
  Description of Artificial Sequence: Synthetic oligonucleotide
cctgtggggagactactcctgcctctt

SEQ ID NO: 339185 - DNA, 27 bp, Artificial Sequence
  Description of Artificial Sequence: Synthetic oligonucleotide
ctgtggggagactactcctgcctcttc

SEQ ID NO: 339186 - DNA, 27 bp, Artificial Sequence
  Description of Artificial Sequence: Synthetic oligonucleotide
tgtggggagactactcctgcctcttcc

SEQ ID NO: 339187 - DNA, 27 bp, Artificial Sequence
  Description of Artificial Sequence: Synthetic oligonucleotide
gtggggagactactcctgcctcttcct

SEQ ID NO: 339188 - DNA, 27 bp, Artificial Sequence
  Description of Artificial Sequence: Synthetic oligonucleotide
tggggagactactcctgcctcttcctc

SEQ ID NO: 339189 - DNA, 26 bp, Artificial Sequence
  Description of Artificial Sequence: Synthetic oligonucleotide
ggggagactactcctgcctcttcctc

SEQ ID NO: 339190 - DNA, 26 bp, Artificial Sequence
  Description of Artificial Sequence: Synthetic oligonucleotide
gggagactactcctgcctcttcctcc

SEQ ID NO: 339191 - DNA, 26 bp, Artificial Sequence
  Description of Artificial Sequence: Synthetic oligonucleotide
ggagactactcctgcctcttcctccg

SEQ ID NO: 339192 - DNA, 26 bp, Artificial Sequence
  Description of Artificial Sequence: Synthetic oligonucleotide
gagactactcctgcctcttcctccgc

SEQ ID NO: 339193 - DNA, 27 bp, Artificial Sequence
  Description of Artificial Sequence: Synthetic oligonucleotide
agactactcctgcctcttcctccgcga

SEQ ID NO: 339194 - DNA, 26 bp, Artificial Sequence
  Description of Artificial Sequence: Synthetic oligonucleotide
gactactcctgcctcttcctccgcga

SEQ ID NO: 339195 - DNA, 26 bp, Artificial Sequence
  Description of Artificial Sequence: Synthetic oligonucleotide
actactcctgcctcttcctccgcgag

SEQ ID NO: 339196 - DNA, 25 bp, Artificial Sequence
  Description of Artificial Sequence: Synthetic oligonucleotide
ctactcctgcctcttcctccgcgag

SEQ ID NO: 339197 - DNA, 25 bp, Artificial Sequence
  Description of Artificial Sequence: Synthetic oligonucleotide
tactcctgcctcttcctccgcgagc

SEQ ID NO: 339198 - DNA, 24 bp, Artificial Sequence
  Description of Artificial Sequence: Synthetic oligonucleotide
actcctgcctcttcctccgcgagc

SEQ ID NO: 339199 - DNA, 23 bp, Artificial Sequence
  Description of Artificial Sequence: Synthetic oligonucleotide
ctcctgcctcttcctccgcgagc

SEQ ID NO: 339200 - DNA, 23 bp, Artificial Sequence
  Description of Artificial Sequence: Synthetic oligonucleotide
tcctgcctcttcctccgcgagcc

SEQ ID NO: 339201 - DNA, 22 bp, Artificial Sequence
  Description of Artificial Sequence: Synthetic oligonucleotide
cctgcctcttcctccgcgagcc

SEQ ID NO: 339202 - DNA, 24 bp, Artificial Sequence
  Description of Artificial Sequence: Synthetic oligonucleotide
ctgcctcttcctccgcgagcccat

SEQ ID NO: 339203 - DNA, 24 bp, Artificial Sequence
  Description of Artificial Sequence: Synthetic oligonucleotide
tgcctcttcctccgcgagcccatc

SEQ ID NO: 339204 - DNA, 23 bp, Artificial Sequence
  Description of Artificial Sequence: Synthetic oligonucleotide
gcctcttcctccgcgagcccatc

SEQ ID NO: 339205 - DNA, 23 bp, Artificial Sequence
  Description of Artificial Sequence: Synthetic oligonucleotide
cctcttcctccgcgagcccatcg

SEQ ID NO: 339206 - DNA, 23 bp, Artificial Sequence
  Description of Artificial Sequence: Synthetic oligonucleotide
ctcttcctccgcgagcccatcgg

SEQ ID NO: 339207 - DNA, 24 bp, Artificial Sequence
  Description of Artificial Sequence: Synthetic oligonucleotide
tcttcctccgcgagcccatcggca

SEQ ID NO: 339208 - DNA, 23 bp, Artificial Sequence
  Description of Artificial Sequence: Synthetic oligonucleotide
cttcctccgcgagcccatcggca

SEQ ID NO: 339209 - DNA, 23 bp, Artificial Sequence
  Description of Artificial Sequence: Synthetic oligonucleotide
ttcctccgcgagcccatcggcac

SEQ ID NO: 339210 - DNA, 22 bp, Artificial Sequence
  Description of Artificial Sequence: Synthetic oligonucleotide
tcctccgcgagcccatcggcac

SEQ ID NO: 339211 - DNA, 21 bp, Artificial Sequence
  Description of Artificial Sequence: Synthetic oligonucleotide
cctccgcgagcccatcggcac

SEQ ID NO: 339212 - DNA, 21 bp, Artificial Sequence
  Description of Artificial Sequence: Synthetic oligonucleotide
ctccgcgagcccatcggcacg

SEQ ID NO: 339213 - DNA, 21 bp, Artificial Sequence
  Description of Artificial Sequence: Synthetic oligonucleotide
tccgcgagcccatcggcacgg

SEQ ID NO: 339214 - DNA, 20 bp, Artificial Sequence
  Description of Artificial Sequence: Synthetic oligonucleotide
ccgcgagcccatcggcacgg

SEQ ID NO: 339215 - DNA, 20 bp, Artificial Sequence
  Description of Artificial Sequence: Synthetic oligonucleotide
cgcgagcccatcggcacggc

SEQ ID NO: 339216 - DNA, 22 bp, Artificial Sequence
  Description of Artificial Sequence: Synthetic oligonucleotide
gcgagcccatcggcacggccta

SEQ ID NO: 339217 - DNA, 24 bp, Artificial Sequence
  Description of Artificial Sequence: Synthetic oligonucleotide
cgagcccatcggcacggcctacat

SEQ ID NO: 339218 - DNA, 24 bp, Artificial Sequence
  Description of Artificial Sequence: Synthetic oligonucleotide
gagcccatcggcacggcctacatc

SEQ ID NO: 339219 - DNA, 25 bp, Artificial Sequence
  Description of Artificial Sequence: Synthetic oligonucleotide
agcccatcggcacggcctacatcca

SEQ ID NO: 339220 - DNA, 24 bp, Artificial Sequence
  Description of Artificial Sequence: Synthetic oligonucleotide
gcccatcggcacggcctacatcca

SEQ ID NO: 339221 - DNA, 24 bp, Artificial Sequence
  Description of Artificial Sequence: Synthetic oligonucleotide
cccatcggcacggcctacatccag

SEQ ID NO: 339222 - DNA, 25 bp, Artificial Sequence
  Description of Artificial Sequence: Synthetic oligonucleotide
ccatcggcacggcctacatccagca

SEQ ID NO: 339223 - DNA, 25 bp, Artificial Sequence
  Description of Artificial Sequence: Synthetic oligonucleotide
catcggcacggcctacatccagcac

SEQ ID NO: 339224 - DNA, 26 bp, Artificial Sequence
  Description of Artificial Sequence: Synthetic oligonucleotide
atcggcacggcctacatccagcacca

SEQ ID NO: 339225 - DNA, 25 bp, Artificial Sequence
  Description of Artificial Sequence: Synthetic oligonucleotide
tcggcacggcctacatccagcacca

SEQ ID NO: 339226 - DNA, 24 bp, Artificial Sequence
  Description of Artificial Sequence: Synthetic oligonucleotide
cggcacggcctacatccagcacca

SEQ ID NO: 339227 - DNA, 24 bp, Artificial Sequence
  Description of Artificial Sequence: Synthetic oligonucleotide
ggcacggcctacatccagcaccac

SEQ ID NO: 339228 - DNA, 24 bp, Artificial Sequence
  Description of Artificial Sequence: Synthetic oligonucleotide
gcacggcctacatccagcaccacg

SEQ ID NO: 339229 - DNA, 24 bp, Artificial Sequence
  Description of Artificial Sequence: Synthetic oligonucleotide
cacggcctacatccagcaccacgg

SEQ ID NO: 339230 - DNA, 24 bp, Artificial Sequence
  Description of Artificial Sequence: Synthetic oligonucleotide
acggcctacatccagcaccacggg

SEQ ID NO: 339231 - DNA, 23 bp, Artificial Sequence
  Description of Artificial Sequence: Synthetic oligonucleotide
cggcctacatccagcaccacggg

SEQ ID NO: 339232 - DNA, 23 bp, Artificial Sequence
  Description of Artificial Sequence: Synthetic oligonucleotide
ggcctacatccagcaccacgggc

SEQ ID NO: 339233 - DNA, 24 bp, Artificial Sequence
  Description of Artificial Sequence: Synthetic oligonucleotide
gcctacatccagcaccacgggcca

SEQ ID NO: 339234 - DNA, 24 bp, Artificial Sequence
  Description of Artificial Sequence: Synthetic oligonucleotide
cctacatccagcaccacgggccac

SEQ ID NO: 339235 - DNA, 24 bp, Artificial Sequence
  Description of Artificial Sequence: Synthetic oligonucleotide
ctacatccagcaccacgggccacc

SEQ ID NO: 339236 - DNA, 25 bp, Artificial Sequence
  Description of Artificial Sequence: Synthetic oligonucleotide
tacatccagcaccacgggccaccca

SEQ ID NO: 339237 - DNA, 24 bp, Artificial Sequence
  Description of Artificial Sequence: Synthetic oligonucleotide
acatccagcaccacgggccaccca

SEQ ID NO: 339238 - DNA, 23 bp, Artificial Sequence
  Description of Artificial Sequence: Synthetic oligonucleotide
catccagcaccacgggccaccca

SEQ ID NO: 339239 - DNA, 24 bp, Artificial Sequence
  Description of Artificial Sequence: Synthetic oligonucleotide
atccagcaccacgggccacccaga

SEQ ID NO: 339240 - DNA, 23 bp, Artificial Sequence
  Description of Artificial Sequence: Synthetic oligonucleotide
tccagcaccacgggccacccaga

SEQ ID NO: 339241 - DNA, 22 bp, Artificial Sequence
  Description of Artificial Sequence: Synthetic oligonucleotide
ccagcaccacgggccacccaga

SEQ ID NO: 339242 - DNA, 23 bp, Artificial Sequence
  Description of Artificial Sequence: Synthetic oligonucleotide
cagcaccacgggccacccagagt

SEQ ID NO: 339243 - DNA, 25 bp, Artificial Sequence
  Description of Artificial Sequence: Synthetic oligonucleotide
agcaccacgggccacccagagtgta

SEQ ID NO: 339244 - DNA, 24 bp, Artificial Sequence
  Description of Artificial Sequence: Synthetic oligonucleotide
gcaccacgggccacccagagtgta

SEQ ID NO: 339245 - DNA, 24 bp, Artificial Sequence
  Description of Artificial Sequence: Synthetic oligonucleotide
caccacgggccacccagagtgtag

SEQ ID NO: 339246 - DNA, 24 bp, Artificial Sequence
  Description of Artificial Sequence: Synthetic oligonucleotide
accacgggccacccagagtgtagg

SEQ ID NO: 339247 - DNA, 23 bp, Artificial Sequence
  Description of Artificial Sequence: Synthetic oligonucleotide
ccacgggccacccagagtgtagg

SEQ ID NO: 339248 - DNA, 24 bp, Artificial Sequence
  Description of Artificial Sequence: Synthetic oligonucleotide
cacgggccacccagagtgtaggct

SEQ ID NO: 339249 - DNA, 25 bp, Artificial Sequence
  Description of Artificial Sequence: Synthetic oligonucleotide
acgggccacccagagtgtaggctgt

SEQ ID NO: 339250 - DNA, 24 bp, Artificial Sequence
  Description of Artificial Sequence: Synthetic oligonucleotide
cgggccacccagagtgtaggctgt

SEQ ID NO: 339251 - DNA, 26 bp, Artificial Sequence
  Description of Artificial Sequence: Synthetic oligonucleotide
gggccacccagagtgtaggctgtgat

SEQ ID NO: 339252 - DNA, 27 bp, Artificial Sequence
  Description of Artificial Sequence: Synthetic oligonucleotide
ggccacccagagtgtaggctgtgatgt

SEQ ID NO: 339253 - DNA, 27 bp, Artificial Sequence
  Description of Artificial Sequence: Synthetic oligonucleotide
gccacccagagtgtaggctgtgatgtc

SEQ ID NO: 339254 - DNA, 27 bp, Artificial Sequence
  Description of Artificial Sequence: Synthetic oligonucleotide
ccacccagagtgtaggctgtgatgtcg

SEQ ID NO: 339255 - DNA, 28 bp, Artificial Sequence
  Description of Artificial Sequence: Synthetic oligonucleotide
cacccagagtgtaggctgtgatgtcgtc

SEQ ID NO: 339256 - DNA, 29 bp, Artificial Sequence
  Description of Artificial Sequence: Synthetic oligonucleotide
acccagagtgtaggctgtgatgtcgtcag

SEQ ID NO: 339257 - DNA, 28 bp, Artificial Sequence
  Description of Artificial Sequence: Synthetic oligonucleotide
cccagagtgtaggctgtgatgtcgtcag

SEQ ID NO: 339258 - DNA, 30 bp, Artificial Sequence
  Description of Artificial Sequence: Synthetic oligonucleotide
ccagagtgtaggctgtgatgtcgtcagatc

SEQ ID NO: 339259 - DNA, 31 bp, Artificial Sequence
  Description of Artificial Sequence: Synthetic oligonucleotide
cagagtgtaggctgtgatgtcgtcagatcac

SEQ ID NO: 339260 - DNA, 33 bp, Artificial Sequence
  Description of Artificial Sequence: Synthetic oligonucleotide
agagtgtaggctgtgatgtcgtcagatcacatc

SEQ ID NO: 339261 - DNA, 32 bp, Artificial Sequence
  Description of Artificial Sequence: Synthetic oligonucleotide
gagtgtaggctgtgatgtcgtcagatcacatc

SEQ ID NO: 339262 - DNA, 34 bp, Artificial Sequence
  Description of Artificial Sequence: Synthetic oligonucleotide
agtgtaggctgtgatgtcgtcagatcacatcaac

SEQ ID NO: 339263 - DNA, 33 bp, Artificial Sequence
  Description of Artificial Sequence: Synthetic oligonucleotide
gtgtaggctgtgatgtcgtcagatcacatcaac

SEQ ID NO: 339264 - DNA, 33 bp, Artificial Sequence
  Description of Artificial Sequence: Synthetic oligonucleotide
tgtaggctgtgatgtcgtcagatcacatcaacc

SEQ ID NO: 339265 - DNA, 32 bp, Artificial Sequence
  Description of Artificial Sequence: Synthetic oligonucleotide
gtaggctgtgatgtcgtcagatcacatcaacc

SEQ ID NO: 339266 - DNA, 33 bp, Artificial Sequence
  Description of Artificial Sequence: Synthetic oligonucleotide
taggctgtgatgtcgtcagatcacatcaaccag

SEQ ID NO: 339267 - DNA, 32 bp, Artificial Sequence
  Description of Artificial Sequence: Synthetic oligonucleotide
aggctgtgatgtcgtcagatcacatcaaccag

SEQ ID NO: 339268 - DNA, 31 bp, Artificial Sequence
  Description of Artificial Sequence: Synthetic oligonucleotide
ggctgtgatgtcgtcagatcacatcaaccag

SEQ ID NO: 339269 - DNA, 31 bp, Artificial Sequence
  Description of Artificial Sequence: Synthetic oligonucleotide
gctgtgatgtcgtcagatcacatcaaccagg

SEQ ID NO: 339270 - DNA, 31 bp, Artificial Sequence
  Description of Artificial Sequence: Synthetic oligonucleotide
ctgtgatgtcgtcagatcacatcaaccaggg

SEQ ID NO: 339271 - DNA, 31 bp, Artificial Sequence
  Description of Artificial Sequence: Synthetic oligonucleotide
tgtgatgtcgtcagatcacatcaaccagggg

SEQ ID NO: 339272 - DNA, 30 bp, Artificial Sequence
  Description of Artificial Sequence: Synthetic oligonucleotide
gtgatgtcgtcagatcacatcaaccagggg

SEQ ID NO: 339273 - DNA, 30 bp, Artificial Sequence
  Description of Artificial Sequence: Synthetic oligonucleotide
tgatgtcgtcagatcacatcaaccaggggg

SEQ ID NO: 339274 - DNA, 29 bp, Artificial Sequence
  Description of Artificial Sequence: Synthetic oligonucleotide
gatgtcgtcagatcacatcaaccaggggg

SEQ ID NO: 339275 - DNA, 30 bp, Artificial Sequence
  Description of Artificial Sequence: Synthetic oligonucleotide
atgtcgtcagatcacatcaaccagggggag

SEQ ID NO: 339276 - DNA, 29 bp, Artificial Sequence
  Description of Artificial Sequence: Synthetic oligonucleotide
tgtcgtcagatcacatcaaccagggggag

SEQ ID NO: 339277 - DNA, 28 bp, Artificial Sequence
  Description of Artificial Sequence: Synthetic oligonucleotide
gtcgtcagatcacatcaaccagggggag

SEQ ID NO: 339278 - DNA, 29 bp, Artificial Sequence
  Description of Artificial Sequence: Synthetic oligonucleotide
tcgtcagatcacatcaaccagggggagag

SEQ ID NO: 339279 - DNA, 28 bp, Artificial Sequence
  Description of Artificial Sequence: Synthetic oligonucleotide
cgtcagatcacatcaaccagggggagag

SEQ ID NO: 339280 - DNA, 28 bp, Artificial Sequence
  Description of Artificial Sequence: Synthetic oligonucleotide
gtcagatcacatcaaccagggggagagg

SEQ ID NO: 339281 - DNA, 28 bp, Artificial Sequence
  Description of Artificial Sequence: Synthetic oligonucleotide
tcagatcacatcaaccagggggagaggg

SEQ ID NO: 339282 - DNA, 27 bp, Artificial Sequence
  Description of Artificial Sequence: Synthetic oligonucleotide
cagatcacatcaaccagggggagaggg

SEQ ID NO: 339283 - DNA, 27 bp, Artificial Sequence
  Description of Artificial Sequence: Synthetic oligonucleotide
agatcacatcaaccagggggagagggc

SEQ ID NO: 339284 - DNA, 26 bp, Artificial Sequence
  Description of Artificial Sequence: Synthetic oligonucleotide
gatcacatcaaccagggggagagggc

SEQ ID NO: 339285 - DNA, 27 bp, Artificial Sequence
  Description of Artificial Sequence: Synthetic oligonucleotide
atcacatcaaccagggggagagggcca

SEQ ID NO: 339286 - DNA, 27 bp, Artificial Sequence
  Description of Artificial Sequence: Synthetic oligonucleotide
tcacatcaaccagggggagagggccat

SEQ ID NO: 339287 - DNA, 26 bp, Artificial Sequence
  Description of Artificial Sequence: Synthetic oligonucleotide
cacatcaaccagggggagagggccat

SEQ ID NO: 339288 - DNA, 26 bp, Artificial Sequence
  Description of Artificial Sequence: Synthetic oligonucleotide
acatcaaccagggggagagggccatg

SEQ ID NO: 339289 - DNA, 25 bp, Artificial Sequence
  Description of Artificial Sequence: Synthetic oligonucleotide
catcaaccagggggagagggccatg

SEQ ID NO: 339290 - DNA, 26 bp, Artificial Sequence
  Description of Artificial Sequence: Synthetic oligonucleotide
atcaaccagggggagagggccatgct

SEQ ID NO: 339291 - DNA, 25 bp, Artificial Sequence
  Description of Artificial Sequence: Synthetic oligonucleotide
tcaaccagggggagagggccatgct

SEQ ID NO: 339292 - DNA, 24 bp, Artificial Sequence
  Description of Artificial Sequence: Synthetic oligonucleotide
caaccagggggagagggccatgct

SEQ ID NO: 339293 - DNA, 24 bp, Artificial Sequence
  Description of Artificial Sequence: Synthetic oligonucleotide
aaccagggggagagggccatgctc

SEQ ID NO: 339294 - DNA, 23 bp, Artificial Sequence
  Description of Artificial Sequence: Synthetic oligonucleotide
accagggggagagggccatgctc

SEQ ID NO: 339295 - DNA, 22 bp, Artificial Sequence
  Description of Artificial Sequence: Synthetic oligonucleotide
ccagggggagagggccatgctc

SEQ ID NO: 339296 - DNA, 23 bp, Artificial Sequence
  Description of Artificial Sequence: Synthetic oligonucleotide
cagggggagagggccatgctcgt

SEQ ID NO: 339297 - DNA, 24 bp, Artificial Sequence
  Description of Artificial Sequence: Synthetic oligonucleotide
agggggagagggccatgctcgtct

SEQ ID NO: 339298 - DNA, 23 bp, Artificial Sequence
  Description of Artificial Sequence: Synthetic oligonucleotide
gggggagagggccatgctcgtct

SEQ ID NO: 339299 - DNA, 23 bp, Artificial Sequence
  Description of Artificial Sequence: Synthetic oligonucleotide
ggggagagggccatgctcgtctg

SEQ ID NO: 339300 - DNA, 25 bp, Artificial Sequence
  Description of Artificial Sequence: Synthetic oligonucleotide
gggagagggccatgctcgtctgcaa

SEQ ID NO: 339301 - DNA, 26 bp, Artificial Sequence
  Description of Artificial Sequence: Synthetic oligonucleotide
ggagagggccatgctcgtctgcaaga

SEQ ID NO: 339302 - DNA, 27 bp, Artificial Sequence
  Description of Artificial Sequence: Synthetic oligonucleotide
gagagggccatgctcgtctgcaagaca

SEQ ID NO: 339303 - DNA, 27 bp, Artificial Sequence
  Description of Artificial Sequence: Synthetic oligonucleotide
agagggccatgctcgtctgcaagacag

SEQ ID NO: 339304 - DNA, 27 bp, Artificial Sequence
  Description of Artificial Sequence: Synthetic oligonucleotide
gagggccatgctcgtctgcaagacaga

SEQ ID NO: 339305 - DNA, 27 bp, Artificial Sequence
  Description of Artificial Sequence: Synthetic oligonucleotide
agggccatgctcgtctgcaagacagag

SEQ ID NO: 339306 - DNA, 27 bp, Artificial Sequence
  Description of Artificial Sequence: Synthetic oligonucleotide
gggccatgctcgtctgcaagacagagt

SEQ ID NO: 339307 - DNA, 27 bp, Artificial Sequence
  Description of Artificial Sequence: Synthetic oligonucleotide
ggccatgctcgtctgcaagacagagtc

SEQ ID NO: 339308 - DNA, 27 bp, Artificial Sequence
  Description of Artificial Sequence: Synthetic oligonucleotide
gccatgctcgtctgcaagacagagtcc

SEQ ID NO: 339309 - DNA, 27 bp, Artificial Sequence
  Description of Artificial Sequence: Synthetic oligonucleotide
ccatgctcgtctgcaagacagagtccg

SEQ ID NO: 339310 - DNA, 28 bp, Artificial Sequence
  Description of Artificial Sequence: Synthetic oligonucleotide
catgctcgtctgcaagacagagtccgag

SEQ ID NO: 339311 - DNA, 28 bp, Artificial Sequence
  Description of Artificial Sequence: Synthetic oligonucleotide
atgctcgtctgcaagacagagtccgagc

SEQ ID NO: 339312 - DNA, 27 bp, Artificial Sequence
  Description of Artificial Sequence: Synthetic oligonucleotide
tgctcgtctgcaagacagagtccgagc

SEQ ID NO: 339313 - DNA, 26 bp, Artificial Sequence
  Description of Artificial Sequence: Synthetic oligonucleotide
gctcgtctgcaagacagagtccgagc

SEQ ID NO: 339314 - DNA, 27 bp, Artificial Sequence
  Description of Artificial Sequence: Synthetic oligonucleotide
ctcgtctgcaagacagagtccgagcca

SEQ ID NO: 339315 - DNA, 27 bp, Artificial Sequence
  Description of Artificial Sequence: Synthetic oligonucleotide
tcgtctgcaagacagagtccgagccac

SEQ ID NO: 339316 - DNA, 26 bp, Artificial Sequence
  Description of Artificial Sequence: Synthetic oligonucleotide
cgtctgcaagacagagtccgagccac

SEQ ID NO: 339317 - DNA, 27 bp, Artificial Sequence
  Description of Artificial Sequence: Synthetic oligonucleotide
gtctgcaagacagagtccgagccacct

SEQ ID NO: 339318 - DNA, 27 bp, Artificial Sequence
  Description of Artificial Sequence: Synthetic oligonucleotide
tctgcaagacagagtccgagccacctg

SEQ ID NO: 339319 - DNA, 27 bp, Artificial Sequence
  Description of Artificial Sequence: Synthetic oligonucleotide
ctgcaagacagagtccgagccacctgt

SEQ ID NO: 339320 - DNA, 27 bp, Artificial Sequence
  Description of Artificial Sequence: Synthetic oligonucleotide
tgcaagacagagtccgagccacctgtg

SEQ ID NO: 339321 - DNA, 27 bp, Artificial Sequence
  Description of Artificial Sequence: Synthetic oligonucleotide
gcaagacagagtccgagccacctgtga

SEQ ID NO: 339322 - DNA, 27 bp, Artificial Sequence
  Description of Artificial Sequence: Synthetic oligonucleotide
caagacagagtccgagccacctgtgac

SEQ ID NO: 339323 - DNA, 28 bp, Artificial Sequence
  Description of Artificial Sequence: Synthetic oligonucleotide
aagacagagtccgagccacctgtgactg

SEQ ID NO: 339324 - DNA, 27 bp, Artificial Sequence
  Description of Artificial Sequence: Synthetic oligonucleotide
agacagagtccgagccacctgtgactg

SEQ ID NO: 339325 - DNA, 27 bp, Artificial Sequence
  Description of Artificial Sequence: Synthetic oligonucleotide
gacagagtccgagccacctgtgactga

SEQ ID NO: 339326 - DNA, 27 bp, Artificial Sequence
  Description of Artificial Sequence: Synthetic oligonucleotide
acagagtccgagccacctgtgactgac

SEQ ID NO: 339327 - DNA, 27 bp, Artificial Sequence
  Description of Artificial Sequence: Synthetic oligonucleotide
cagagtccgagccacctgtgactgact

SEQ ID NO: 339328 - DNA, 27 bp, Artificial Sequence
  Description of Artificial Sequence: Synthetic oligonucleotide
agagtccgagccacctgtgactgactg

SEQ ID NO: 339329 - DNA, 26 bp, Artificial Sequence
  Description of Artificial Sequence: Synthetic oligonucleotide
gagtccgagccacctgtgactgactg

SEQ ID NO: 339330 - DNA, 26 bp, Artificial Sequence
  Description of Artificial Sequence: Synthetic oligonucleotide
agtccgagccacctgtgactgactgg

SEQ ID NO: 339331 - DNA, 25 bp, Artificial Sequence
  Description of Artificial Sequence: Synthetic oligonucleotide
gtccgagccacctgtgactgactgg

SEQ ID NO: 339332 - DNA, 25 bp, Artificial Sequence
  Description of Artificial Sequence: Synthetic oligonucleotide
tccgagccacctgtgactgactggc

SEQ ID NO: 339333 - DNA, 24 bp, Artificial Sequence
  Description of Artificial Sequence: Synthetic oligonucleotide
ccgagccacctgtgactgactggc

SEQ ID NO: 339334 - DNA, 24 bp, Artificial Sequence
  Description of Artificial Sequence: Synthetic oligonucleotide
cgagccacctgtgactgactggcc

SEQ ID NO: 339335 - DNA, 25 bp, Artificial Sequence
  Description of Artificial Sequence: Synthetic oligonucleotide
gagccacctgtgactgactggccct

SEQ ID NO: 339336 - DNA, 25 bp, Artificial Sequence
  Description of Artificial Sequence: Synthetic oligonucleotide
agccacctgtgactgactggccctg

SEQ ID NO: 339337 - DNA, 24 bp, Artificial Sequence
  Description of Artificial Sequence: Synthetic oligonucleotide
gccacctgtgactgactggccctg

SEQ ID NO: 339338 - DNA, 26 bp, Artificial Sequence
  Description of Artificial Sequence: Synthetic oligonucleotide
ccacctgtgactgactggccctggta

SEQ ID NO: 339339 - DNA, 27 bp, Artificial Sequence
  Description of Artificial Sequence: Synthetic oligonucleotide
cacctgtgactgactggccctggtaca

SEQ ID NO: 339340 - DNA, 28 bp, Artificial Sequence
  Description of Artificial Sequence: Synthetic oligonucleotide
acctgtgactgactggccctggtacatg

SEQ ID NO: 339341 - DNA, 27 bp, Artificial Sequence
  Description of Artificial Sequence: Synthetic oligonucleotide
cctgtgactgactggccctggtacatg

SEQ ID NO: 339342 - DNA, 29 bp, Artificial Sequence
  Description of Artificial Sequence: Synthetic oligonucleotide
ctgtgactgactggccctggtacatgatc

SEQ ID NO: 339343 - DNA, 30 bp, Artificial Sequence
  Description of Artificial Sequence: Synthetic oligonucleotide
tgtgactgactggccctggtacatgatcac

SEQ ID NO: 339344 - DNA, 29 bp, Artificial Sequence
  Description of Artificial Sequence: Synthetic oligonucleotide
gtgactgactggccctggtacatgatcac

SEQ ID NO: 339345 - DNA, 30 bp, Artificial Sequence
  Description of Artificial Sequence: Synthetic oligonucleotide
tgactgactggccctggtacatgatcactg

SEQ ID NO: 339346 - DNA, 29 bp, Artificial Sequence
  Description of Artificial Sequence: Synthetic oligonucleotide
gactgactggccctggtacatgatcactg

SEQ ID NO: 339347 - DNA, 30 bp, Artificial Sequence
  Description of Artificial Sequence: Synthetic oligonucleotide
actgactggccctggtacatgatcactgag

SEQ ID NO: 339348 - DNA, 29 bp, Artificial Sequence
  Description of Artificial Sequence: Synthetic oligonucleotide
ctgactggccctggtacatgatcactgag

SEQ ID NO: 339349 - DNA, 30 bp, Artificial Sequence
  Description of Artificial Sequence: Synthetic oligonucleotide
tgactggccctggtacatgatcactgagtc

SEQ ID NO: 339350 - DNA, 29 bp, Artificial Sequence
  Description of Artificial Sequence: Synthetic oligonucleotide
gactggccctggtacatgatcactgagtc

SEQ ID NO: 339351 - DNA, 30 bp, Artificial Sequence
  Description of Artificial Sequence: Synthetic oligonucleotide
actggccctggtacatgatcactgagtctg

SEQ ID NO: 339352 - DNA, 29 bp, Artificial Sequence
  Description of Artificial Sequence: Synthetic oligonucleotide
ctggccctggtacatgatcactgagtctg

SEQ ID NO: 339353 - DNA, 30 bp, Artificial Sequence
  Description of Artificial Sequence: Synthetic oligonucleotide
tggccctggtacatgatcactgagtctgag

SEQ ID NO: 339354 - DNA, 29 bp, Artificial Sequence
  Description of Artificial Sequence: Synthetic oligonucleotide
ggccctggtacatgatcactgagtctgag

SEQ ID NO: 339355 - DNA, 29 bp, Artificial Sequence
  Description of Artificial Sequence: Synthetic oligonucleotide
gccctggtacatgatcactgagtctgagg

SEQ ID NO: 339356 - DNA, 30 bp, Artificial Sequence
  Description of Artificial Sequence: Synthetic oligonucleotide
ccctggtacatgatcactgagtctgaggac

SEQ ID NO: 339357 - DNA, 32 bp, Artificial Sequence
  Description of Artificial Sequence: Synthetic oligonucleotide
cctggtacatgatcactgagtctgaggactag

SEQ ID NO: 339358 - DNA, 32 bp, Artificial Sequence
  Description of Artificial Sequence: Synthetic oligonucleotide
ctggtacatgatcactgagtctgaggactagg

SEQ ID NO: 339359 - DNA, 32 bp, Artificial Sequence
  Description of Artificial Sequence: Synthetic oligonucleotide
tggtacatgatcactgagtctgaggactaggc

SEQ ID NO: 339360 - DNA, 31 bp, Artificial Sequence
  Description of Artificial Sequence: Synthetic oligonucleotide
ggtacatgatcactgagtctgaggactaggc

SEQ ID NO: 339361 - DNA, 31 bp, Artificial Sequence
  Description of Artificial Sequence: Synthetic oligonucleotide
gtacatgatcactgagtctgaggactaggcc

SEQ ID NO: 339362 - DNA, 31 bp, Artificial Sequence
  Description of Artificial Sequence: Synthetic oligonucleotide
tacatgatcactgagtctgaggactaggccc

SEQ ID NO: 339363 - DNA, 30 bp, Artificial Sequence
  Description of Artificial Sequence: Synthetic oligonucleotide
acatgatcactgagtctgaggactaggccc

SEQ ID NO: 339364 - DNA, 29 bp, Artificial Sequence
  Description of Artificial Sequence: Synthetic oligonucleotide
catgatcactgagtctgaggactaggccc

SEQ ID NO: 339365 - DNA, 30 bp, Artificial Sequence
  Description of Artificial Sequence: Synthetic oligonucleotide
atgatcactgagtctgaggactaggccctc

SEQ ID NO: 339366 - DNA, 29 bp, Artificial Sequence
  Description of Artificial Sequence: Synthetic oligonucleotide
tgatcactgagtctgaggactaggccctc

SEQ ID NO: 339367 - DNA, 28 bp, Artificial Sequence
  Description of Artificial Sequence: Synthetic oligonucleotide
gatcactgagtctgaggactaggccctc

SEQ ID NO: 339368 - DNA, 30 bp, Artificial Sequence
  Description of Artificial Sequence: Synthetic oligonucleotide
atcactgagtctgaggactaggccctcaag

SEQ ID NO: 339369 - DNA, 29 bp, Artificial Sequence
  Description of Artificial Sequence: Synthetic oligonucleotide
tcactgagtctgaggactaggccctcaag

SEQ ID NO: 339370 - DNA, 28 bp, Artificial Sequence
  Description of Artificial Sequence: Synthetic oligonucleotide
cactgagtctgaggactaggccctcaag

SEQ ID NO: 339371 - DNA, 30 bp, Artificial Sequence
  Description of Artificial Sequence: Synthetic oligonucleotide
actgagtctgaggactaggccctcaagaac

SEQ ID NO: 339372 - DNA, 29 bp, Artificial Sequence
  Description of Artificial Sequence: Synthetic oligonucleotide
ctgagtctgaggactaggccctcaagaac

SEQ ID NO: 339373 - DNA, 29 bp, Artificial Sequence
  Description of Artificial Sequence: Synthetic oligonucleotide
tgagtctgaggactaggccctcaagaacg

SEQ ID NO: 339374 - DNA, 28 bp, Artificial Sequence
  Description of Artificial Sequence: Synthetic oligonucleotide
gagtctgaggactaggccctcaagaacg

SEQ ID NO: 339375 - DNA, 28 bp, Artificial Sequence
  Description of Artificial Sequence: Synthetic oligonucleotide
agtctgaggactaggccctcaagaacgg

SEQ ID NO: 339376 - DNA, 27 bp, Artificial Sequence
  Description of Artificial Sequence: Synthetic oligonucleotide
gtctgaggactaggccctcaagaacgg

SEQ ID NO: 339377 - DNA, 27 bp, Artificial Sequence
  Description of Artificial Sequence: Synthetic oligonucleotide
tctgaggactaggccctcaagaacggc

SEQ ID NO: 339378 - DNA, 27 bp, Artificial Sequence
  Description of Artificial Sequence: Synthetic oligonucleotide
ctgaggactaggccctcaagaacggct

SEQ ID NO: 339379 - DNA, 27 bp, Artificial Sequence
  Description of Artificial Sequence: Synthetic oligonucleotide
tgaggactaggccctcaagaacggctc

SEQ ID NO: 339380 - DNA, 26 bp, Artificial Sequence
  Description of Artificial Sequence: Synthetic oligonucleotide
gaggactaggccctcaagaacggctc

SEQ ID NO: 339381 - DNA, 26 bp, Artificial Sequence
  Description of Artificial Sequence: Synthetic oligonucleotide
aggactaggccctcaagaacggctcg

SEQ ID NO: 339382 - DNA, 25 bp, Artificial Sequence
  Description of Artificial Sequence: Synthetic oligonucleotide
ggactaggccctcaagaacggctcg

SEQ ID NO: 339383 - DNA, 26 bp, Artificial Sequence
  Description of Artificial Sequence: Synthetic oligonucleotide
gactaggccctcaagaacggctcgga

SEQ ID NO: 339384 - DNA, 27 bp, Artificial Sequence
  Description of Artificial Sequence: Synthetic oligonucleotide
actaggccctcaagaacggctcggaga

SEQ ID NO: 339385 - DNA, 26 bp, Artificial Sequence
  Description of Artificial Sequence: Synthetic oligonucleotide
ctaggccctcaagaacggctcggaga

SEQ ID NO: 339386 - DNA, 26 bp, Artificial Sequence
  Description of Artificial Sequence: Synthetic oligonucleotide
taggccctcaagaacggctcggagag

SEQ ID NO: 339387 - DNA, 25 bp, Artificial Sequence
  Description of Artificial Sequence: Synthetic oligonucleotide
aggccctcaagaacggctcggagag

SEQ ID NO: 339388 - DNA, 24 bp, Artificial Sequence
  Description of Artificial Sequence: Synthetic oligonucleotide
ggccctcaagaacggctcggagag

SEQ ID NO: 339389 - DNA, 25 bp, Artificial Sequence
  Description of Artificial Sequence: Synthetic oligonucleotide
gccctcaagaacggctcggagagca

SEQ ID NO: 339390 - DNA, 25 bp, Artificial Sequence
  Description of Artificial Sequence: Synthetic oligonucleotide
ccctcaagaacggctcggagagcag

SEQ ID NO: 339391 - DNA, 27 bp, Artificial Sequence
  Description of Artificial Sequence: Synthetic oligonucleotide
cctcaagaacggctcggagagcaggat

SEQ ID NO: 339392 - DNA, 27 bp, Artificial Sequence
  Description of Artificial Sequence: Synthetic oligonucleotide
ctcaagaacggctcggagagcaggatc

SEQ ID NO: 339393 - DNA, 29 bp, Artificial Sequence
  Description of Artificial Sequence: Synthetic oligonucleotide
tcaagaacggctcggagagcaggatcttc

SEQ ID NO: 339394 - DNA, 28 bp, Artificial Sequence
  Description of Artificial Sequence: Synthetic oligonucleotide
caagaacggctcggagagcaggatcttc

SEQ ID NO: 339395 - DNA, 28 bp, Artificial Sequence
  Description of Artificial Sequence: Synthetic oligonucleotide
aagaacggctcggagagcaggatcttcg

SEQ ID NO: 339396 - DNA, 27 bp, Artificial Sequence
  Description of Artificial Sequence: Synthetic oligonucleotide
agaacggctcggagagcaggatcttcg

SEQ ID NO: 339397 - DNA, 27 bp, Artificial Sequence
  Description of Artificial Sequence: Synthetic oligonucleotide
gaacggctcggagagcaggatcttcgt

SEQ ID NO: 339398 - DNA, 27 bp, Artificial Sequence
  Description of Artificial Sequence: Synthetic oligonucleotide
aacggctcggagagcaggatcttcgtg

SEQ ID NO: 339399 - DNA, 27 bp, Artificial Sequence
  Description of Artificial Sequence: Synthetic oligonucleotide
acggctcggagagcaggatcttcgtga

SEQ ID NO: 339400 - DNA, 26 bp, Artificial Sequence
  Description of Artificial Sequence: Synthetic oligonucleotide
cggctcggagagcaggatcttcgtga

SEQ ID NO: 339401 - DNA, 27 bp, Artificial Sequence
  Description of Artificial Sequence: Synthetic oligonucleotide
ggctcggagagcaggatcttcgtgact

SEQ ID NO: 339402 - DNA, 28 bp, Artificial Sequence
  Description of Artificial Sequence: Synthetic oligonucleotide
gctcggagagcaggatcttcgtgacttc

SEQ ID NO: 339403 - DNA, 28 bp, Artificial Sequence
  Description of Artificial Sequence: Synthetic oligonucleotide
ctcggagagcaggatcttcgtgacttcc

SEQ ID NO: 339404 - DNA, 29 bp, Artificial Sequence
  Description of Artificial Sequence: Synthetic oligonucleotide
tcggagagcaggatcttcgtgacttcctc

SEQ ID NO: 339405 - DNA, 28 bp, Artificial Sequence
  Description of Artificial Sequence: Synthetic oligonucleotide
cggagagcaggatcttcgtgacttcctc

SEQ ID NO: 339406 - DNA, 28 bp, Artificial Sequence
  Description of Artificial Sequence: Synthetic oligonucleotide
ggagagcaggatcttcgtgacttcctcg

SEQ ID NO: 339407 - DNA, 28 bp, Artificial Sequence
  Description of Artificial Sequence: Synthetic oligonucleotide
gagagcaggatcttcgtgacttcctcgc

SEQ ID NO: 339408 - DNA, 29 bp, Artificial Sequence
  Description of Artificial Sequence: Synthetic oligonucleotide
agagcaggatcttcgtgacttcctcgcac

SEQ ID NO: 339409 - DNA, 28 bp, Artificial Sequence
  Description of Artificial Sequence: Synthetic oligonucleotide
gagcaggatcttcgtgacttcctcgcac

SEQ ID NO: 339410 - DNA, 28 bp, Artificial Sequence
  Description of Artificial Sequence: Synthetic oligonucleotide
agcaggatcttcgtgacttcctcgcacg

SEQ ID NO: 339411 - DNA, 27 bp, Artificial Sequence
  Description of Artificial Sequence: Synthetic oligonucleotide
gcaggatcttcgtgacttcctcgcacg

SEQ ID NO: 339412 - DNA, 27 bp, Artificial Sequence
  Description of Artificial Sequence: Synthetic oligonucleotide
caggatcttcgtgacttcctcgcacgg

SEQ ID NO: 339413 - DNA, 27 bp, Artificial Sequence
  Description of Artificial Sequence: Synthetic oligonucleotide
aggatcttcgtgacttcctcgcacggc

SEQ ID NO: 339414 - DNA, 26 bp, Artificial Sequence
  Description of Artificial Sequence: Synthetic oligonucleotide
ggatcttcgtgacttcctcgcacggc

SEQ ID NO: 339415 - DNA, 26 bp, Artificial Sequence
  Description of Artificial Sequence: Synthetic oligonucleotide
gatcttcgtgacttcctcgcacggcc

SEQ ID NO: 339416 - DNA, 26 bp, Artificial Sequence
  Description of Artificial Sequence: Synthetic oligonucleotide
atcttcgtgacttcctcgcacggccg

SEQ ID NO: 339417 - DNA, 25 bp, Artificial Sequence
  Description of Artificial Sequence: Synthetic oligonucleotide
tcttcgtgacttcctcgcacggccg

SEQ ID NO: 339418 - DNA, 24 bp, Artificial Sequence
  Description of Artificial Sequence: Synthetic oligonucleotide
cttcgtgacttcctcgcacggccg

SEQ ID NO: 339419 - DNA, 25 bp, Artificial Sequence
  Description of Artificial Sequence: Synthetic oligonucleotide
ttcgtgacttcctcgcacggccggt

SEQ ID NO: 339420 - DNA, 24 bp, Artificial Sequence
  Description of Artificial Sequence: Synthetic oligonucleotide
tcgtgacttcctcgcacggccggt

SEQ ID NO: 339421 - DNA, 23 bp, Artificial Sequence
  Description of Artificial Sequence: Synthetic oligonucleotide
cgtgacttcctcgcacggccggt

SEQ ID NO: 339422 - DNA, 24 bp, Artificial Sequence
  Description of Artificial Sequence: Synthetic oligonucleotide
gtgacttcctcgcacggccggtca

SEQ ID NO: 339423 - DNA, 25 bp, Artificial Sequence
  Description of Artificial Sequence: Synthetic oligonucleotide
tgacttcctcgcacggccggtcaca

SEQ ID NO: 339424 - DNA, 24 bp, Artificial Sequence
  Description of Artificial Sequence: Synthetic oligonucleotide
gacttcctcgcacggccggtcaca

SEQ ID NO: 339425 - DNA, 24 bp, Artificial Sequence
  Description of Artificial Sequence: Synthetic oligonucleotide
acttcctcgcacggccggtcacag

SEQ ID NO: 339426 - DNA, 23 bp, Artificial Sequence
  Description of Artificial Sequence: Synthetic oligonucleotide
cttcctcgcacggccggtcacag

SEQ ID NO: 339427 - DNA, 25 bp, Artificial Sequence
  Description of Artificial Sequence: Synthetic oligonucleotide
ttcctcgcacggccggtcacagcta

SEQ ID NO: 339428 - DNA, 24 bp, Artificial Sequence
  Description of Artificial Sequence: Synthetic oligonucleotide
tcctcgcacggccggtcacagcta

SEQ ID NO: 339429 - DNA, 23 bp, Artificial Sequence
  Description of Artificial Sequence: Synthetic oligonucleotide
cctcgcacggccggtcacagcta

SEQ ID NO: 339430 - DNA, 24 bp, Artificial Sequence
  Description of Artificial Sequence: Synthetic oligonucleotide
ctcgcacggccggtcacagctaca

SEQ ID NO: 339431 - DNA, 27 bp, Artificial Sequence
  Description of Artificial Sequence: Synthetic oligonucleotide
tcgcacggccggtcacagctacacaat

SEQ ID NO: 339432 - DNA, 26 bp, Artificial Sequence
  Description of Artificial Sequence: Synthetic oligonucleotide
cgcacggccggtcacagctacacaat

SEQ ID NO: 339433 - DNA, 27 bp, Artificial Sequence
  Description of Artificial Sequence: Synthetic oligonucleotide
gcacggccggtcacagctacacaatga

SEQ ID NO: 339434 - DNA, 27 bp, Artificial Sequence
  Description of Artificial Sequence: Synthetic oligonucleotide
cacggccggtcacagctacacaatgag

SEQ ID NO: 339435 - DNA, 29 bp, Artificial Sequence
  Description of Artificial Sequence: Synthetic oligonucleotide
acggccggtcacagctacacaatgagaac

SEQ ID NO: 339436 - DNA, 28 bp, Artificial Sequence
  Description of Artificial Sequence: Synthetic oligonucleotide
cggccggtcacagctacacaatgagaac

SEQ ID NO: 339437 - DNA, 28 bp, Artificial Sequence
  Description of Artificial Sequence: Synthetic oligonucleotide
ggccggtcacagctacacaatgagaacc

SEQ ID NO: 339438 - DNA, 29 bp, Artificial Sequence
  Description of Artificial Sequence: Synthetic oligonucleotide
gccggtcacagctacacaatgagaacctc

SEQ ID NO: 339439 - DNA, 31 bp, Artificial Sequence
  Description of Artificial Sequence: Synthetic oligonucleotide
ccggtcacagctacacaatgagaacctcaac

SEQ ID NO: 339440 - DNA, 33 bp, Artificial Sequence
  Description of Artificial Sequence: Synthetic oligonucleotide
cggtcacagctacacaatgagaacctcaacatg

SEQ ID NO: 339441 - DNA, 33 bp, Artificial Sequence
  Description of Artificial Sequence: Synthetic oligonucleotide
ggtcacagctacacaatgagaacctcaacatgg

SEQ ID NO: 339442 - DNA, 34 bp, Artificial Sequence
  Description of Artificial Sequence: Synthetic oligonucleotide
gtcacagctacacaatgagaacctcaacatggag

SEQ ID NO: 339443 - DNA, 34 bp, Artificial Sequence
  Description of Artificial Sequence: Synthetic oligonucleotide
tcacagctacacaatgagaacctcaacatggagc

SEQ ID NO: 339444 - DNA, 33 bp, Artificial Sequence
  Description of Artificial Sequence: Synthetic oligonucleotide
cacagctacacaatgagaacctcaacatggagc

SEQ ID NO: 339445 - DNA, 33 bp, Artificial Sequence
  Description of Artificial Sequence: Synthetic oligonucleotide
acagctacacaatgagaacctcaacatggagcc

SEQ ID NO: 339446 - DNA, 32 bp, Artificial Sequence
  Description of Artificial Sequence: Synthetic oligonucleotide
cagctacacaatgagaacctcaacatggagcc

SEQ ID NO: 339447 - DNA, 32 bp, Artificial Sequence
  Description of Artificial Sequence: Synthetic oligonucleotide
agctacacaatgagaacctcaacatggagccc

SEQ ID NO: 339448 - DNA, 31 bp, Artificial Sequence
  Description of Artificial Sequence: Synthetic oligonucleotide
gctacacaatgagaacctcaacatggagccc

SEQ ID NO: 339449 - DNA, 31 bp, Artificial Sequence
  Description of Artificial Sequence: Synthetic oligonucleotide
ctacacaatgagaacctcaacatggagcccg

SEQ ID NO: 339450 - DNA, 32 bp, Artificial Sequence
  Description of Artificial Sequence: Synthetic oligonucleotide
tacacaatgagaacctcaacatggagcccgac

SEQ ID NO: 339451 - DNA, 31 bp, Artificial Sequence
  Description of Artificial Sequence: Synthetic oligonucleotide
acacaatgagaacctcaacatggagcccgac

SEQ ID NO: 339452 - DNA, 30 bp, Artificial Sequence
  Description of Artificial Sequence: Synthetic oligonucleotide
cacaatgagaacctcaacatggagcccgac

SEQ ID NO: 339453 - DNA, 30 bp, Artificial Sequence
  Description of Artificial Sequence: Synthetic oligonucleotide
acaatgagaacctcaacatggagcccgacc

SEQ ID NO: 339454 - DNA, 29 bp, Artificial Sequence
  Description of Artificial Sequence: Synthetic oligonucleotide
caatgagaacctcaacatggagcccgacc

SEQ ID NO: 339455 - DNA, 29 bp, Artificial Sequence
  Description of Artificial Sequence: Synthetic oligonucleotide
aatgagaacctcaacatggagcccgaccc

SEQ ID NO: 339456 - DNA, 28 bp, Artificial Sequence
  Description of Artificial Sequence: Synthetic oligonucleotide
atgagaacctcaacatggagcccgaccc

SEQ ID NO: 339457 - DNA, 27 bp, Artificial Sequence
  Description of Artificial Sequence: Synthetic oligonucleotide
tgagaacctcaacatggagcccgaccc

SEQ ID NO: 339458 - DNA, 26 bp, Artificial Sequence
  Description of Artificial Sequence: Synthetic oligonucleotide
gagaacctcaacatggagcccgaccc

SEQ ID NO: 339459 - DNA, 26 bp, Artificial Sequence
  Description of Artificial Sequence: Synthetic oligonucleotide
agaacctcaacatggagcccgacccc

SEQ ID NO: 339460 - DNA, 25 bp, Artificial Sequence
  Description of Artificial Sequence: Synthetic oligonucleotide
gaacctcaacatggagcccgacccc

SEQ ID NO: 339461 - DNA, 25 bp, Artificial Sequence
  Description of Artificial Sequence: Synthetic oligonucleotide
aacctcaacatggagcccgaccccg

SEQ ID NO: 339462 - DNA, 24 bp, Artificial Sequence
  Description of Artificial Sequence: Synthetic oligonucleotide
acctcaacatggagcccgaccccg

SEQ ID NO: 339463 - DNA, 23 bp, Artificial Sequence
  Description of Artificial Sequence: Synthetic oligonucleotide
cctcaacatggagcccgaccccg

SEQ ID NO: 339464 - DNA, 23 bp, Artificial Sequence
  Description of Artificial Sequence: Synthetic oligonucleotide
ctcaacatggagcccgaccccgc

SEQ ID NO: 339465 - DNA, 23 bp, Artificial Sequence
  Description of Artificial Sequence: Synthetic oligonucleotide
tcaacatggagcccgaccccgcc

SEQ ID NO: 339466 - DNA, 22 bp, Artificial Sequence
  Description of Artificial Sequence: Synthetic oligonucleotide
caacatggagcccgaccccgcc

SEQ ID NO: 339467 - DNA, 23 bp, Artificial Sequence
  Description of Artificial Sequence: Synthetic oligonucleotide
aacatggagcccgaccccgccca

SEQ ID NO: 339468 - DNA, 22 bp, Artificial Sequence
  Description of Artificial Sequence: Synthetic oligonucleotide
acatggagcccgaccccgccca

SEQ ID NO: 339469 - DNA, 21 bp, Artificial Sequence
  Description of Artificial Sequence: Synthetic oligonucleotide
catggagcccgaccccgccca

SEQ ID NO: 339470 - DNA, 23 bp, Artificial Sequence
  Description of Artificial Sequence: Synthetic oligonucleotide
atggagcccgaccccgcccagta

SEQ ID NO: 339471 - DNA, 22 bp, Artificial Sequence
  Description of Artificial Sequence: Synthetic oligonucleotide
tggagcccgaccccgcccagta

SEQ ID NO: 339472 - DNA, 21 bp, Artificial Sequence
  Description of Artificial Sequence: Synthetic oligonucleotide
ggagcccgaccccgcccagta

SEQ ID NO: 339473 - DNA, 21 bp, Artificial Sequence
  Description of Artificial Sequence: Synthetic oligonucleotide
gagcccgaccccgcccagtac

SEQ ID NO: 339474 - DNA, 21 bp, Artificial Sequence
  Description of Artificial Sequence: Synthetic oligonucleotide
agcccgaccccgcccagtacc

SEQ ID NO: 339475 - DNA, 20 bp, Artificial Sequence
  Description of Artificial Sequence: Synthetic oligonucleotide
gcccgaccccgcccagtacc

SEQ ID NO: 339476 - DNA, 20 bp, Artificial Sequence
  Description of Artificial Sequence: Synthetic oligonucleotide
cccgaccccgcccagtaccg

SEQ ID NO: 339477 - DNA, 21 bp, Artificial Sequence
  Description of Artificial Sequence: Synthetic oligonucleotide
ccgaccccgcccagtaccgct

SEQ ID NO: 339478 - DNA, 21 bp, Artificial Sequence
  Description of Artificial Sequence: Synthetic oligonucleotide
cgaccccgcccagtaccgctg

SEQ ID NO: 339479 - DNA, 23 bp, Artificial Sequence
  Description of Artificial Sequence: Synthetic oligonucleotide
gaccccgcccagtaccgctgcaa

SEQ ID NO: 339480 - DNA, 23 bp, Artificial Sequence
  Description of Artificial Sequence: Synthetic oligonucleotide
accccgcccagtaccgctgcaac

SEQ ID NO: 339481 - DNA, 22 bp, Artificial Sequence
  Description of Artificial Sequence: Synthetic oligonucleotide
ccccgcccagtaccgctgcaac

SEQ ID NO: 339482 - DNA, 22 bp, Artificial Sequence
  Description of Artificial Sequence: Synthetic oligonucleotide
cccgcccagtaccgctgcaacg

SEQ ID NO: 339483 - DNA, 22 bp, Artificial Sequence
  Description of Artificial Sequence: Synthetic oligonucleotide
ccgcccagtaccgctgcaacgg

SEQ ID NO: 339484 - DNA, 23 bp, Artificial Sequence
  Description of Artificial Sequence: Synthetic oligonucleotide
cgcccagtaccgctgcaacggct

SEQ ID NO: 339485 - DNA, 23 bp, Artificial Sequence
  Description of Artificial Sequence: Synthetic oligonucleotide
gcccagtaccgctgcaacggctc

SEQ ID NO: 339486 - DNA, 24 bp, Artificial Sequence
  Description of Artificial Sequence: Synthetic oligonucleotide
cccagtaccgctgcaacggctcca

SEQ ID NO: 339487 - DNA, 24 bp, Artificial Sequence
  Description of Artificial Sequence: Synthetic oligonucleotide
ccagtaccgctgcaacggctccag

SEQ ID NO: 339488 - DNA, 25 bp, Artificial Sequence
  Description of Artificial Sequence: Synthetic oligonucleotide
cagtaccgctgcaacggctccagct

SEQ ID NO: 339489 - DNA, 25 bp, Artificial Sequence
  Description of Artificial Sequence: Synthetic oligonucleotide
agtaccgctgcaacggctccagctc

SEQ ID NO: 339490 - DNA, 24 bp, Artificial Sequence
  Description of Artificial Sequence: Synthetic oligonucleotide
gtaccgctgcaacggctccagctc

SEQ ID NO: 339491 - DNA, 26 bp, Artificial Sequence
  Description of Artificial Sequence: Synthetic oligonucleotide
taccgctgcaacggctccagctccat

SEQ ID NO: 339492 - DNA, 25 bp, Artificial Sequence
  Description of Artificial Sequence: Synthetic oligonucleotide
accgctgcaacggctccagctccat

SEQ ID NO: 339493 - DNA, 24 bp, Artificial Sequence
  Description of Artificial Sequence: Synthetic oligonucleotide
ccgctgcaacggctccagctccat

SEQ ID NO: 339494 - DNA, 24 bp, Artificial Sequence
  Description of Artificial Sequence: Synthetic oligonucleotide
cgctgcaacggctccagctccatg

SEQ ID NO: 339495 - DNA, 24 bp, Artificial Sequence
  Description of Artificial Sequence: Synthetic oligonucleotide
gctgcaacggctccagctccatgg

SEQ ID NO: 339496 - DNA, 24 bp, Artificial Sequence
  Description of Artificial Sequence: Synthetic oligonucleotide
ctgcaacggctccagctccatggg

SEQ ID NO: 339497 - DNA, 25 bp, Artificial Sequence
  Description of Artificial Sequence: Synthetic oligonucleotide
tgcaacggctccagctccatgggct

SEQ ID NO: 339498 - DNA, 24 bp, Artificial Sequence
  Description of Artificial Sequence: Synthetic oligonucleotide
gcaacggctccagctccatgggct

SEQ ID NO: 339499 - DNA, 24 bp, Artificial Sequence
  Description of Artificial Sequence: Synthetic oligonucleotide
caacggctccagctccatgggctc

SEQ ID NO: 339500 - DNA, 24 bp, Artificial Sequence
  Description of Artificial Sequence: Synthetic oligonucleotide
aacggctccagctccatgggctcc

SEQ ID NO: 339501 - DNA, 23 bp, Artificial Sequence
  Description of Artificial Sequence: Synthetic oligonucleotide
acggctccagctccatgggctcc

SEQ ID NO: 339502 - DNA, 22 bp, Artificial Sequence
  Description of Artificial Sequence: Synthetic oligonucleotide
cggctccagctccatgggctcc

SEQ ID NO: 339503 - DNA, 23 bp, Artificial Sequence
  Description of Artificial Sequence: Synthetic oligonucleotide
ggctccagctccatgggctccga

SEQ ID NO: 339504 - DNA, 23 bp, Artificial Sequence
  Description of Artificial Sequence: Synthetic oligonucleotide
gctccagctccatgggctccgag

SEQ ID NO: 339505 - DNA, 24 bp, Artificial Sequence
  Description of Artificial Sequence: Synthetic oligonucleotide
ctccagctccatgggctccgagca

SEQ ID NO: 339506 - DNA, 24 bp, Artificial Sequence
  Description of Artificial Sequence: Synthetic oligonucleotide
tccagctccatgggctccgagcag

SEQ ID NO: 339507 - DNA, 23 bp, Artificial Sequence
  Description of Artificial Sequence: Synthetic oligonucleotide
ccagctccatgggctccgagcag

SEQ ID NO: 339508 - DNA, 23 bp, Artificial Sequence
  Description of Artificial Sequence: Synthetic oligonucleotide
cagctccatgggctccgagcagg

SEQ ID NO: 339509 - DNA, 23 bp, Artificial Sequence
  Description of Artificial Sequence: Synthetic oligonucleotide
agctccatgggctccgagcaggc

SEQ ID NO: 339510 - DNA, 22 bp, Artificial Sequence
  Description of Artificial Sequence: Synthetic oligonucleotide
gctccatgggctccgagcaggc

SEQ ID NO: 339511 - DNA, 24 bp, Artificial Sequence
  Description of Artificial Sequence: Synthetic oligonucleotide
ctccatgggctccgagcaggccat

SEQ ID NO: 339512 - DNA, 26 bp, Artificial Sequence
  Description of Artificial Sequence: Synthetic oligonucleotide
tccatgggctccgagcaggccatctt

SEQ ID NO: 339513 - DNA, 25 bp, Artificial Sequence
  Description of Artificial Sequence: Synthetic oligonucleotide
ccatgggctccgagcaggccatctt

SEQ ID NO: 339514 - DNA, 26 bp, Artificial Sequence
  Description of Artificial Sequence: Synthetic oligonucleotide
catgggctccgagcaggccatcttca

SEQ ID NO: 339515 - DNA, 26 bp, Artificial Sequence
  Description of Artificial Sequence: Synthetic oligonucleotide
atgggctccgagcaggccatcttcac

SEQ ID NO: 339516 - DNA, 25 bp, Artificial Sequence
  Description of Artificial Sequence: Synthetic oligonucleotide
tgggctccgagcaggccatcttcac

SEQ ID NO: 339517 - DNA, 24 bp, Artificial Sequence
  Description of Artificial Sequence: Synthetic oligonucleotide
gggctccgagcaggccatcttcac

SEQ ID NO: 339518 - DNA, 24 bp, Artificial Sequence
  Description of Artificial Sequence: Synthetic oligonucleotide
ggctccgagcaggccatcttcacg

SEQ ID NO: 339519 - DNA, 25 bp, Artificial Sequence
  Description of Artificial Sequence: Synthetic oligonucleotide
gctccgagcaggccatcttcacgct

SEQ ID NO: 339520 - DNA, 25 bp, Artificial Sequence
  Description of Artificial Sequence: Synthetic oligonucleotide
ctccgagcaggccatcttcacgctc

SEQ ID NO: 339521 - DNA, 25 bp, Artificial Sequence
  Description of Artificial Sequence: Synthetic oligonucleotide
tccgagcaggccatcttcacgctcc

SEQ ID NO: 339522 - DNA, 24 bp, Artificial Sequence
  Description of Artificial Sequence: Synthetic oligonucleotide
ccgagcaggccatcttcacgctcc

SEQ ID NO: 339523 - DNA, 24 bp, Artificial Sequence
  Description of Artificial Sequence: Synthetic oligonucleotide
cgagcaggccatcttcacgctccc

SEQ ID NO: 339524 - DNA, 24 bp, Artificial Sequence
  Description of Artificial Sequence: Synthetic oligonucleotide
gagcaggccatcttcacgctcccc

SEQ ID NO: 339525 - DNA, 25 bp, Artificial Sequence
  Description of Artificial Sequence: Synthetic oligonucleotide
agcaggccatcttcacgctccccgt

SEQ ID NO: 339526 - DNA, 24 bp, Artificial Sequence
  Description of Artificial Sequence: Synthetic oligonucleotide
gcaggccatcttcacgctccccgt

SEQ ID NO: 339527 - DNA, 24 bp, Artificial Sequence
  Description of Artificial Sequence: Synthetic oligonucleotide
caggccatcttcacgctccccgtg

SEQ ID NO: 339528 - DNA, 24 bp, Artificial Sequence
  Description of Artificial Sequence: Synthetic oligonucleotide
aggccatcttcacgctccccgtgc

SEQ ID NO: 339529 - DNA, 23 bp, Artificial Sequence
  Description of Artificial Sequence: Synthetic oligonucleotide
ggccatcttcacgctccccgtgc

SEQ ID NO: 339530 - DNA, 23 bp, Artificial Sequence
  Description of Artificial Sequence: Synthetic oligonucleotide
gccatcttcacgctccccgtgcg

SEQ ID NO: 339531 - DNA, 24 bp, Artificial Sequence
  Description of Artificial Sequence: Synthetic oligonucleotide
ccatcttcacgctccccgtgcgca

SEQ ID NO: 339532 - DNA, 24 bp, Artificial Sequence
  Description of Artificial Sequence: Synthetic oligonucleotide
catcttcacgctccccgtgcgcag

SEQ ID NO: 339533 - DNA, 24 bp, Artificial Sequence
  Description of Artificial Sequence: Synthetic oligonucleotide
atcttcacgctccccgtgcgcagg

SEQ ID NO: 339534 - DNA, 23 bp, Artificial Sequence
  Description of Artificial Sequence: Synthetic oligonucleotide
tcttcacgctccccgtgcgcagg

SEQ ID NO: 339535 - DNA, 22 bp, Artificial Sequence
  Description of Artificial Sequence: Synthetic oligonucleotide
cttcacgctccccgtgcgcagg

SEQ ID NO: 339536 - DNA, 23 bp, Artificial Sequence
  Description of Artificial Sequence: Synthetic oligonucleotide
ttcacgctccccgtgcgcaggca

SEQ ID NO: 339537 - DNA, 22 bp, Artificial Sequence
  Description of Artificial Sequence: Synthetic oligonucleotide
tcacgctccccgtgcgcaggca

SEQ ID NO: 339538 - DNA, 21 bp, Artificial Sequence
  Description of Artificial Sequence: Synthetic oligonucleotide
cacgctccccgtgcgcaggca

SEQ ID NO: 339539 - DNA, 21 bp, Artificial Sequence
  Description of Artificial Sequence: Synthetic oligonucleotide
acgctccccgtgcgcaggcac

SEQ ID NO: 339540 - DNA, 20 bp, Artificial Sequence
  Description of Artificial Sequence: Synthetic oligonucleotide
cgctccccgtgcgcaggcac

SEQ ID NO: 339541 - DNA, 21 bp, Artificial Sequence
  Description of Artificial Sequence: Synthetic oligonucleotide
gctccccgtgcgcaggcacct

SEQ ID NO: 339542 - DNA, 21 bp, Artificial Sequence
  Description of Artificial Sequence: Synthetic oligonucleotide
ctccccgtgcgcaggcacctg

SEQ ID NO: 339543 - DNA, 21 bp, Artificial Sequence
  Description of Artificial Sequence: Synthetic oligonucleotide
tccccgtgcgcaggcacctgg

SEQ ID NO: 339544 - DNA, 20 bp, Artificial Sequence
  Description of Artificial Sequence: Synthetic oligonucleotide
ccccgtgcgcaggcacctgg

SEQ ID NO: 339545 - DNA, 20 bp, Artificial Sequence
  Description of Artificial Sequence: Synthetic oligonucleotide
cccgtgcgcaggcacctggc

SEQ ID NO: 339546 - DNA, 20 bp, Artificial Sequence
  Description of Artificial Sequence: Synthetic oligonucleotide
ccgtgcgcaggcacctggcc

SEQ ID NO: 339547 - DNA, 20 bp, Artificial Sequence
  Description of Artificial Sequence: Synthetic oligonucleotide
cgtgcgcaggcacctggccc

SEQ ID NO: 339548 - DNA, 20 bp, Artificial Sequence
  Description of Artificial Sequence: Synthetic oligonucleotide
gtgcgcaggcacctggcccc

SEQ ID NO: 339549 - DNA, 20 bp, Artificial Sequence
  Description of Artificial Sequence: Synthetic oligonucleotide
tgcgcaggcacctggccccc

SEQ ID NO: 339550 - DNA, 20 bp, Artificial Sequence
  Description of Artificial Sequence: Synthetic oligonucleotide
gcgcaggcacctggccccct

SEQ ID NO: 339551 - DNA, 20 bp, Artificial Sequence
  Description of Artificial Sequence: Synthetic oligonucleotide
cgcaggcacctggcccccct

SEQ ID NO: 339552 - DNA, 21 bp, Artificial Sequence
  Description of Artificial Sequence: Synthetic oligonucleotide
gcaggcacctggcccccctct

SEQ ID NO: 339553 - DNA, 21 bp, Artificial Sequence
  Description of Artificial Sequence: Synthetic oligonucleotide
caggcacctggcccccctctg

SEQ ID NO: 339554 - DNA, 21 bp, Artificial Sequence
  Description of Artificial Sequence: Synthetic oligonucleotide
aggcacctggcccccctctgg

SEQ ID NO: 339555 - DNA, 20 bp, Artificial Sequence
  Description of Artificial Sequence: Synthetic oligonucleotide
ggcacctggcccccctctgg

SEQ ID NO: 339556 - DNA, 20 bp, Artificial Sequence
  Description of Artificial Sequence: Synthetic oligonucleotide
gcacctggcccccctctggc

SEQ ID NO: 339557 - DNA, 20 bp, Artificial Sequence
  Description of Artificial Sequence: Synthetic oligonucleotide
cacctggcccccctctggcg

SEQ ID NO: 339558 - DNA, 22 bp, Artificial Sequence
  Description of Artificial Sequence: Synthetic oligonucleotide
acctggcccccctctggcgctt

SEQ ID NO: 339559 - DNA, 21 bp, Artificial Sequence
  Description of Artificial Sequence: Synthetic oligonucleotide
cctggcccccctctggcgctt

SEQ ID NO: 339560 - DNA, 21 bp, Artificial Sequence
  Description of Artificial Sequence: Synthetic oligonucleotide
ctggcccccctctggcgcttc

SEQ ID NO: 339561 - DNA, 22 bp, Artificial Sequence
  Description of Artificial Sequence: Synthetic oligonucleotide
tggcccccctctggcgcttcct

SEQ ID NO: 339562 - DNA, 21 bp, Artificial Sequence
  Description of Artificial Sequence: Synthetic oligonucleotide
ggcccccctctggcgcttcct

SEQ ID NO: 339563 - DNA, 21 bp, Artificial Sequence
  Description of Artificial Sequence: Synthetic oligonucleotide
gcccccctctggcgcttcctg

SEQ ID NO: 339564 - DNA, 21 bp, Artificial Sequence
  Description of Artificial Sequence: Synthetic oligonucleotide
cccccctctggcgcttcctgg

SEQ ID NO: 339565 - DNA, 21 bp, Artificial Sequence
  Description of Artificial Sequence: Synthetic oligonucleotide
ccccctctggcgcttcctggg

SEQ ID NO: 339566 - DNA, 23 bp, Artificial Sequence
  Description of Artificial Sequence: Synthetic oligonucleotide
cccctctggcgcttcctggggat

SEQ ID NO: 339567 - DNA, 23 bp, Artificial Sequence
  Description of Artificial Sequence: Synthetic oligonucleotide
ccctctggcgcttcctggggatc

SEQ ID NO: 339568 - DNA, 24 bp, Artificial Sequence
  Description of Artificial Sequence: Synthetic oligonucleotide
cctctggcgcttcctggggatcgt

SEQ ID NO: 339569 - DNA, 24 bp, Artificial Sequence
  Description of Artificial Sequence: Synthetic oligonucleotide
ctctggcgcttcctggggatcgtg

SEQ ID NO: 339570 - DNA, 24 bp, Artificial Sequence
  Description of Artificial Sequence: Synthetic oligonucleotide
tctggcgcttcctggggatcgtgg

SEQ ID NO: 339571 - DNA, 23 bp, Artificial Sequence
  Description of Artificial Sequence: Synthetic oligonucleotide
ctggcgcttcctggggatcgtgg

SEQ ID NO: 339572 - DNA, 24 bp, Artificial Sequence
  Description of Artificial Sequence: Synthetic oligonucleotide
tggcgcttcctggggatcgtggct

SEQ ID NO: 339573 - DNA, 23 bp, Artificial Sequence
  Description of Artificial Sequence: Synthetic oligonucleotide
ggcgcttcctggggatcgtggct

SEQ ID NO: 339574 - DNA, 24 bp, Artificial Sequence
  Description of Artificial Sequence: Synthetic oligonucleotide
gcgcttcctggggatcgtggctca

SEQ ID NO: 339575 - DNA, 24 bp, Artificial Sequence
  Description of Artificial Sequence: Synthetic oligonucleotide
cgcttcctggggatcgtggctcag

SEQ ID NO: 339576 - DNA, 25 bp, Artificial Sequence
  Description of Artificial Sequence: Synthetic oligonucleotide
gcttcctggggatcgtggctcaggt

SEQ ID NO: 339577 - DNA, 25 bp, Artificial Sequence
  Description of Artificial Sequence: Synthetic oligonucleotide
cttcctggggatcgtggctcaggtg

SEQ ID NO: 339578 - DNA, 26 bp, Artificial Sequence
  Description of Artificial Sequence: Synthetic oligonucleotide
ttcctggggatcgtggctcaggtgct

SEQ ID NO: 339579 - DNA, 25 bp, Artificial Sequence
  Description of Artificial Sequence: Synthetic oligonucleotide
tcctggggatcgtggctcaggtgct

SEQ ID NO: 339580 - DNA, 24 bp, Artificial Sequence
  Description of Artificial Sequence: Synthetic oligonucleotide
cctggggatcgtggctcaggtgct

SEQ ID NO: 339581 - DNA, 24 bp, Artificial Sequence
  Description of Artificial Sequence: Synthetic oligonucleotide
ctggggatcgtggctcaggtgctg

SEQ ID NO: 339582 - DNA, 25 bp, Artificial Sequence
  Description of Artificial Sequence: Synthetic oligonucleotide
tggggatcgtggctcaggtgctgga

SEQ ID NO: 339583 - DNA, 24 bp, Artificial Sequence
  Description of Artificial Sequence: Synthetic oligonucleotide
ggggatcgtggctcaggtgctgga

SEQ ID NO: 339584 - DNA, 24 bp, Artificial Sequence
  Description of Artificial Sequence: Synthetic oligonucleotide
gggatcgtggctcaggtgctggag

SEQ ID NO: 339585 - DNA, 25 bp, Artificial Sequence
  Description of Artificial Sequence: Synthetic oligonucleotide
ggatcgtggctcaggtgctggagct

SEQ ID NO: 339586 - DNA, 25 bp, Artificial Sequence
  Description of Artificial Sequence: Synthetic oligonucleotide
gatcgtggctcaggtgctggagctg

SEQ ID NO: 339587 - DNA, 26 bp, Artificial Sequence
  Description of Artificial Sequence: Synthetic oligonucleotide
atcgtggctcaggtgctggagctggt

SEQ ID NO: 339588 - DNA, 25 bp, Artificial Sequence
  Description of Artificial Sequence: Synthetic oligonucleotide
tcgtggctcaggtgctggagctggt

SEQ ID NO: 339589 - DNA, 24 bp, Artificial Sequence
  Description of Artificial Sequence: Synthetic oligonucleotide
cgtggctcaggtgctggagctggt

SEQ ID NO: 339590 - DNA, 25 bp, Artificial Sequence
  Description of Artificial Sequence: Synthetic oligonucleotide
gtggctcaggtgctggagctggtca

SEQ ID NO: 339591 - DNA, 25 bp, Artificial Sequence
  Description of Artificial Sequence: Synthetic oligonucleotide
tggctcaggtgctggagctggtcac

SEQ ID NO: 339592 - DNA, 24 bp, Artificial Sequence
  Description of Artificial Sequence: Synthetic oligonucleotide
ggctcaggtgctggagctggtcac

SEQ ID NO: 339593 - DNA, 26 bp, Artificial Sequence
  Description of Artificial Sequence: Synthetic oligonucleotide
gctcaggtgctggagctggtcacgat

SEQ ID NO: 339594 - DNA, 27 bp, Artificial Sequence
  Description of Artificial Sequence: Synthetic oligonucleotide
ctcaggtgctggagctggtcacgatca

SEQ ID NO: 339595 - DNA, 28 bp, Artificial Sequence
  Description of Artificial Sequence: Synthetic oligonucleotide
tcaggtgctggagctggtcacgatcatc

SEQ ID NO: 339596 - DNA, 27 bp, Artificial Sequence
  Description of Artificial Sequence: Synthetic oligonucleotide
caggtgctggagctggtcacgatcatc

SEQ ID NO: 339597 - DNA, 29 bp, Artificial Sequence
  Description of Artificial Sequence: Synthetic oligonucleotide
aggtgctggagctggtcacgatcatcttc

SEQ ID NO: 339598 - DNA, 28 bp, Artificial Sequence
  Description of Artificial Sequence: Synthetic oligonucleotide
ggtgctggagctggtcacgatcatcttc

SEQ ID NO: 339599 - DNA, 30 bp, Artificial Sequence
  Description of Artificial Sequence: Synthetic oligonucleotide
gtgctggagctggtcacgatcatcttcttc

SEQ ID NO: 339600 - DNA, 32 bp, Artificial Sequence
  Description of Artificial Sequence: Synthetic oligonucleotide
tgctggagctggtcacgatcatcttcttctac

SEQ ID NO: 339601 - DNA, 31 bp, Artificial Sequence
  Description of Artificial Sequence: Synthetic oligonucleotide
gctggagctggtcacgatcatcttcttctac

SEQ ID NO: 339602 - DNA, 31 bp, Artificial Sequence
  Description of Artificial Sequence: Synthetic oligonucleotide
ctggagctggtcacgatcatcttcttctacg

SEQ ID NO: 339603 - DNA, 32 bp, Artificial Sequence
  Description of Artificial Sequence: Synthetic oligonucleotide
tggagctggtcacgatcatcttcttctacgag

SEQ ID NO: 339604 - DNA, 31 bp, Artificial Sequence
  Description of Artificial Sequence: Synthetic oligonucleotide
ggagctggtcacgatcatcttcttctacgag

SEQ ID NO: 339605 - DNA, 33 bp, Artificial Sequence
  Description of Artificial Sequence: Synthetic oligonucleotide
gagctggtcacgatcatcttcttctacgagatg

SEQ ID NO: 339606 - DNA, 33 bp, Artificial Sequence
  Description of Artificial Sequence: Synthetic oligonucleotide
agctggtcacgatcatcttcttctacgagatgc

SEQ ID NO: 339607 - DNA, 32 bp, Artificial Sequence
  Description of Artificial Sequence: Synthetic oligonucleotide
gctggtcacgatcatcttcttctacgagatgc

SEQ ID NO: 339608 - DNA, 32 bp, Artificial Sequence
  Description of Artificial Sequence: Synthetic oligonucleotide
ctggtcacgatcatcttcttctacgagatgcg

SEQ ID NO: 339609 - DNA, 32 bp, Artificial Sequence
  Description of Artificial Sequence: Synthetic oligonucleotide
tggtcacgatcatcttcttctacgagatgcgc

SEQ ID NO: 339610 - DNA, 31 bp, Artificial Sequence
  Description of Artificial Sequence: Synthetic oligonucleotide
ggtcacgatcatcttcttctacgagatgcgc

SEQ ID NO: 339611 - DNA, 31 bp, Artificial Sequence
  Description of Artificial Sequence: Synthetic oligonucleotide
gtcacgatcatcttcttctacgagatgcgcc

SEQ ID NO: 339612 - DNA, 31 bp, Artificial Sequence
  Description of Artificial Sequence: Synthetic oligonucleotide
tcacgatcatcttcttctacgagatgcgccg

SEQ ID NO: 339613 - DNA, 30 bp, Artificial Sequence
  Description of Artificial Sequence: Synthetic oligonucleotide
cacgatcatcttcttctacgagatgcgccg

SEQ ID NO: 339614 - DNA, 30 bp, Artificial Sequence
  Description of Artificial Sequence: Synthetic oligonucleotide
acgatcatcttcttctacgagatgcgccgg

SEQ ID NO: 339615 - DNA, 29 bp, Artificial Sequence
  Description of Artificial Sequence: Synthetic oligonucleotide
cgatcatcttcttctacgagatgcgccgg

SEQ ID NO: 339616 - DNA, 31 bp, Artificial Sequence
  Description of Artificial Sequence: Synthetic oligonucleotide
gatcatcttcttctacgagatgcgccggaac

SEQ ID NO: 339617 - DNA, 31 bp, Artificial Sequence
  Description of Artificial Sequence: Synthetic oligonucleotide
atcatcttcttctacgagatgcgccggaacc

SEQ ID NO: 339618 - DNA, 30 bp, Artificial Sequence
  Description of Artificial Sequence: Synthetic oligonucleotide
tcatcttcttctacgagatgcgccggaacc

SEQ ID NO: 339619 - DNA, 29 bp, Artificial Sequence
  Description of Artificial Sequence: Synthetic oligonucleotide
catcttcttctacgagatgcgccggaacc

SEQ ID NO: 339620 - DNA, 29 bp, Artificial Sequence
  Description of Artificial Sequence: Synthetic oligonucleotide
atcttcttctacgagatgcgccggaaccc

SEQ ID NO: 339621 - DNA, 28 bp, Artificial Sequence
  Description of Artificial Sequence: Synthetic oligonucleotide
tcttcttctacgagatgcgccggaaccc

SEQ ID NO: 339622 - DNA, 27 bp, Artificial Sequence
  Description of Artificial Sequence: Synthetic oligonucleotide
cttcttctacgagatgcgccggaaccc

SEQ ID NO: 339623 - DNA, 27 bp, Artificial Sequence
  Description of Artificial Sequence: Synthetic oligonucleotide
ttcttctacgagatgcgccggaacccc

SEQ ID NO: 339624 - DNA, 26 bp, Artificial Sequence
  Description of Artificial Sequence: Synthetic oligonucleotide
tcttctacgagatgcgccggaacccc

SEQ ID NO: 339625 - DNA, 25 bp, Artificial Sequence
  Description of Artificial Sequence: Synthetic oligonucleotide
cttctacgagatgcgccggaacccc

SEQ ID NO: 339626 - DNA, 26 bp, Artificial Sequence
  Description of Artificial Sequence: Synthetic oligonucleotide
ttctacgagatgcgccggaaccccga

SEQ ID NO: 339627 - DNA, 25 bp, Artificial Sequence
  Description of Artificial Sequence: Synthetic oligonucleotide
tctacgagatgcgccggaaccccga

SEQ ID NO: 339628 - DNA, 24 bp, Artificial Sequence
  Description of Artificial Sequence: Synthetic oligonucleotide
ctacgagatgcgccggaaccccga

SEQ ID NO: 339629 - DNA, 24 bp, Artificial Sequence
  Description of Artificial Sequence: Synthetic oligonucleotide
tacgagatgcgccggaaccccgag

SEQ ID NO: 339630 - DNA, 23 bp, Artificial Sequence
  Description of Artificial Sequence: Synthetic oligonucleotide
acgagatgcgccggaaccccgag

SEQ ID NO: 339631 - DNA, 22 bp, Artificial Sequence
  Description of Artificial Sequence: Synthetic oligonucleotide
cgagatgcgccggaaccccgag

SEQ ID NO: 339632 - DNA, 23 bp, Artificial Sequence
  Description of Artificial Sequence: Synthetic oligonucleotide
gagatgcgccggaaccccgagga

SEQ ID NO: 339633 - DNA, 23 bp, Artificial Sequence
  Description of Artificial Sequence: Synthetic oligonucleotide
agatgcgccggaaccccgaggac

SEQ ID NO: 339634 - DNA, 22 bp, Artificial Sequence
  Description of Artificial Sequence: Synthetic oligonucleotide
gatgcgccggaaccccgaggac

SEQ ID NO: 339635 - DNA, 23 bp, Artificial Sequence
  Description of Artificial Sequence: Synthetic oligonucleotide
atgcgccggaaccccgaggacct

SEQ ID NO: 339636 - DNA, 22 bp, Artificial Sequence
  Description of Artificial Sequence: Synthetic oligonucleotide
tgcgccggaaccccgaggacct

SEQ ID NO: 339637 - DNA, 21 bp, Artificial Sequence
  Description of Artificial Sequence: Synthetic oligonucleotide
gcgccggaaccccgaggacct

SEQ ID NO: 339638 - DNA, 21 bp, Artificial Sequence
  Description of Artificial Sequence: Synthetic oligonucleotide
cgccggaaccccgaggacctc

SEQ ID NO: 339639 - DNA, 22 bp, Artificial Sequence
  Description of Artificial Sequence: Synthetic oligonucleotide
gccggaaccccgaggacctcct

SEQ ID NO: 339640 - DNA, 22 bp, Artificial Sequence
  Description of Artificial Sequence: Synthetic oligonucleotide
ccggaaccccgaggacctcctg

SEQ ID NO: 339641 - DNA, 24 bp, Artificial Sequence
  Description of Artificial Sequence: Synthetic oligonucleotide
cggaaccccgaggacctcctggat

SEQ ID NO: 339642 - DNA, 26 bp, Artificial Sequence
  Description of Artificial Sequence: Synthetic oligonucleotide
ggaaccccgaggacctcctggatgtt

SEQ ID NO: 339643 - DNA, 27 bp, Artificial Sequence
  Description of Artificial Sequence: Synthetic oligonucleotide
gaaccccgaggacctcctggatgttga

SEQ ID NO: 339644 - DNA, 27 bp, Artificial Sequence
  Description of Artificial Sequence: Synthetic oligonucleotide
aaccccgaggacctcctggatgttgac

SEQ ID NO: 339645 - DNA, 26 bp, Artificial Sequence
  Description of Artificial Sequence: Synthetic oligonucleotide
accccgaggacctcctggatgttgac

SEQ ID NO: 339646 - DNA, 25 bp, Artificial Sequence
  Description of Artificial Sequence: Synthetic oligonucleotide
ccccgaggacctcctggatgttgac

SEQ ID NO: 339647 - DNA, 26 bp, Artificial Sequence
  Description of Artificial Sequence: Synthetic oligonucleotide
cccgaggacctcctggatgttgacga

SEQ ID NO: 339648 - DNA, 26 bp, Artificial Sequence
  Description of Artificial Sequence: Synthetic oligonucleotide
ccgaggacctcctggatgttgacgac

SEQ ID NO: 339649 - DNA, 26 bp, Artificial Sequence
  Description of Artificial Sequence: Synthetic oligonucleotide
cgaggacctcctggatgttgacgacg

SEQ ID NO: 339650 - DNA, 26 bp, Artificial Sequence
  Description of Artificial Sequence: Synthetic oligonucleotide
gaggacctcctggatgttgacgacgc

SEQ ID NO: 339651 - DNA, 26 bp, Artificial Sequence
  Description of Artificial Sequence: Synthetic oligonucleotide
aggacctcctggatgttgacgacgcg

SEQ ID NO: 339652 - DNA, 25 bp, Artificial Sequence
  Description of Artificial Sequence: Synthetic oligonucleotide
ggacctcctggatgttgacgacgcg

SEQ ID NO: 339653 - DNA, 25 bp, Artificial Sequence
  Description of Artificial Sequence: Synthetic oligonucleotide
gacctcctggatgttgacgacgcgg

SEQ ID NO: 339654 - DNA, 25 bp, Artificial Sequence
  Description of Artificial Sequence: Synthetic oligonucleotide
acctcctggatgttgacgacgcggg

SEQ ID NO: 339655 - DNA, 24 bp, Artificial Sequence
  Description of Artificial Sequence: Synthetic oligonucleotide
cctcctggatgttgacgacgcggg

SEQ ID NO: 339656 - DNA, 25 bp, Artificial Sequence
  Description of Artificial Sequence: Synthetic oligonucleotide
ctcctggatgttgacgacgcgggct

SEQ ID NO: 339657 - DNA, 26 bp, Artificial Sequence
  Description of Artificial Sequence: Synthetic oligonucleotide
tcctggatgttgacgacgcgggctct

SEQ ID NO: 339658 - DNA, 25 bp, Artificial Sequence
  Description of Artificial Sequence: Synthetic oligonucleotide
cctggatgttgacgacgcgggctct

SEQ ID NO: 339659 - DNA, 25 bp, Artificial Sequence
  Description of Artificial Sequence: Synthetic oligonucleotide
ctggatgttgacgacgcgggctctg

SEQ ID NO: 339660 - DNA, 26 bp, Artificial Sequence
  Description of Artificial Sequence: Synthetic oligonucleotide
tggatgttgacgacgcgggctctgca

SEQ ID NO: 339661 - DNA, 25 bp, Artificial Sequence
  Description of Artificial Sequence: Synthetic oligonucleotide
ggatgttgacgacgcgggctctgca

SEQ ID NO: 339662 - DNA, 25 bp, Artificial Sequence
  Description of Artificial Sequence: Synthetic oligonucleotide
gatgttgacgacgcgggctctgcag

SEQ ID NO: 339663 - DNA, 25 bp, Artificial Sequence
  Description of Artificial Sequence: Synthetic oligonucleotide
atgttgacgacgcgggctctgcagc

SEQ ID NO: 339664 - DNA, 24 bp, Artificial Sequence
  Description of Artificial Sequence: Synthetic oligonucleotide
tgttgacgacgcgggctctgcagc

SEQ ID NO: 339665 - DNA, 23 bp, Artificial Sequence
  Description of Artificial Sequence: Synthetic oligonucleotide
gttgacgacgcgggctctgcagc

SEQ ID NO: 339666 - DNA, 23 bp, Artificial Sequence
  Description of Artificial Sequence: Synthetic oligonucleotide
ttgacgacgcgggctctgcagcc

SEQ ID NO: 339667 - DNA, 22 bp, Artificial Sequence
  Description of Artificial Sequence: Synthetic oligonucleotide
tgacgacgcgggctctgcagcc

SEQ ID NO: 339668 - DNA, 21 bp, Artificial Sequence
  Description of Artificial Sequence: Synthetic oligonucleotide
gacgacgcgggctctgcagcc

SEQ ID NO: 339669 - DNA, 22 bp, Artificial Sequence
  Description of Artificial Sequence: Synthetic oligonucleotide
acgacgcgggctctgcagccct

SEQ ID NO: 339670 - DNA, 21 bp, Artificial Sequence
  Description of Artificial Sequence: Synthetic oligonucleotide
cgacgcgggctctgcagccct

SEQ ID NO: 339671 - DNA, 23 bp, Artificial Sequence
  Description of Artificial Sequence: Synthetic oligonucleotide
gacgcgggctctgcagccctgaa

SEQ ID NO: 339672 - DNA, 24 bp, Artificial Sequence
  Description of Artificial Sequence: Synthetic oligonucleotide
acgcgggctctgcagccctgaaga

SEQ ID NO: 339673 - DNA, 23 bp, Artificial Sequence
  Description of Artificial Sequence: Synthetic oligonucleotide
cgcgggctctgcagccctgaaga

SEQ ID NO: 339674 - DNA, 23 bp, Artificial Sequence
  Description of Artificial Sequence: Synthetic oligonucleotide
gcgggctctgcagccctgaagac

SEQ ID NO: 339675 - DNA, 24 bp, Artificial Sequence
  Description of Artificial Sequence: Synthetic oligonucleotide
cgggctctgcagccctgaagacca

SEQ ID NO: 339676 - DNA, 24 bp, Artificial Sequence
  Description of Artificial Sequence: Synthetic oligonucleotide
gggctctgcagccctgaagaccag

SEQ ID NO: 339677 - DNA, 24 bp, Artificial Sequence
  Description of Artificial Sequence: Synthetic oligonucleotide
ggctctgcagccctgaagaccagc

SEQ ID NO: 339678 - DNA, 24 bp, Artificial Sequence
  Description of Artificial Sequence: Synthetic oligonucleotide
gctctgcagccctgaagaccagcg

SEQ ID NO: 339679 - DNA, 24 bp, Artificial Sequence
  Description of Artificial Sequence: Synthetic oligonucleotide
ctctgcagccctgaagaccagcgg

SEQ ID NO: 339680 - DNA, 24 bp, Artificial Sequence
  Description of Artificial Sequence: Synthetic oligonucleotide
tctgcagccctgaagaccagcggg

SEQ ID NO: 339681 - DNA, 23 bp, Artificial Sequence
  Description of Artificial Sequence: Synthetic oligonucleotide
ctgcagccctgaagaccagcggg

SEQ ID NO: 339682 - DNA, 24 bp, Artificial Sequence
  Description of Artificial Sequence: Synthetic oligonucleotide
tgcagccctgaagaccagcgggca

SEQ ID NO: 339683 - DNA, 23 bp, Artificial Sequence
  Description of Artificial Sequence: Synthetic oligonucleotide
gcagccctgaagaccagcgggca

SEQ ID NO: 339684 - DNA, 23 bp, Artificial Sequence
  Description of Artificial Sequence: Synthetic oligonucleotide
cagccctgaagaccagcgggcac

SEQ ID NO: 339685 - DNA, 24 bp, Artificial Sequence
  Description of Artificial Sequence: Synthetic oligonucleotide
agccctgaagaccagcgggcacca

SEQ ID NO: 339686 - DNA, 23 bp, Artificial Sequence
  Description of Artificial Sequence: Synthetic oligonucleotide
gccctgaagaccagcgggcacca

SEQ ID NO: 339687 - DNA, 23 bp, Artificial Sequence
  Description of Artificial Sequence: Synthetic oligonucleotide
ccctgaagaccagcgggcaccac

SEQ ID NO: 339688 - DNA, 24 bp, Artificial Sequence
  Description of Artificial Sequence: Synthetic oligonucleotide
cctgaagaccagcgggcaccacca

SEQ ID NO: 339689 - DNA, 27 bp, Artificial Sequence
  Description of Artificial Sequence: Synthetic oligonucleotide
ctgaagaccagcgggcaccaccagaat

SEQ ID NO: 339690 - DNA, 27 bp, Artificial Sequence
  Description of Artificial Sequence: Synthetic oligonucleotide
tgaagaccagcgggcaccaccagaatc

SEQ ID NO: 339691 - DNA, 27 bp, Artificial Sequence
  Description of Artificial Sequence: Synthetic oligonucleotide
gaagaccagcgggcaccaccagaatca

SEQ ID NO: 339692 - DNA, 27 bp, Artificial Sequence
  Description of Artificial Sequence: Synthetic oligonucleotide
aagaccagcgggcaccaccagaatcac

SEQ ID NO: 339693 - DNA, 27 bp, Artificial Sequence
  Description of Artificial Sequence: Synthetic oligonucleotide
agaccagcgggcaccaccagaatcaca

SEQ ID NO: 339694 - DNA, 27 bp, Artificial Sequence
  Description of Artificial Sequence: Synthetic oligonucleotide
gaccagcgggcaccaccagaatcacaa

SEQ ID NO: 339695 - DNA, 28 bp, Artificial Sequence
  Description of Artificial Sequence: Synthetic oligonucleotide
accagcgggcaccaccagaatcacaaag

SEQ ID NO: 339696 - DNA, 27 bp, Artificial Sequence
  Description of Artificial Sequence: Synthetic oligonucleotide
ccagcgggcaccaccagaatcacaaag

SEQ ID NO: 339697 - DNA, 27 bp, Artificial Sequence
  Description of Artificial Sequence: Synthetic oligonucleotide
cagcgggcaccaccagaatcacaaagg

SEQ ID NO: 339698 - DNA, 27 bp, Artificial Sequence
  Description of Artificial Sequence: Synthetic oligonucleotide
agcgggcaccaccagaatcacaaaggc

SEQ ID NO: 339699 - DNA, 27 bp, Artificial Sequence
  Description of Artificial Sequence: Synthetic oligonucleotide
gcgggcaccaccagaatcacaaaggca

SEQ ID NO: 339700 - DNA, 28 bp, Artificial Sequence
  Description of Artificial Sequence: Synthetic oligonucleotide
cgggcaccaccagaatcacaaaggcatg

SEQ ID NO: 339701 - DNA, 30 bp, Artificial Sequence
  Description of Artificial Sequence: Synthetic oligonucleotide
gggcaccaccagaatcacaaaggcatgaac

SEQ ID NO: 339702 - DNA, 30 bp, Artificial Sequence
  Description of Artificial Sequence: Synthetic oligonucleotide
ggcaccaccagaatcacaaaggcatgaacg

SEQ ID NO: 339703 - DNA, 31 bp, Artificial Sequence
  Description of Artificial Sequence: Synthetic oligonucleotide
gcaccaccagaatcacaaaggcatgaacgtc

SEQ ID NO: 339704 - DNA, 31 bp, Artificial Sequence
  Description of Artificial Sequence: Synthetic oligonucleotide
caccaccagaatcacaaaggcatgaacgtcc

SEQ ID NO: 339705 - DNA, 31 bp, Artificial Sequence
  Description of Artificial Sequence: Synthetic oligonucleotide
accaccagaatcacaaaggcatgaacgtccg

SEQ ID NO: 339706 - DNA, 30 bp, Artificial Sequence
  Description of Artificial Sequence: Synthetic oligonucleotide
ccaccagaatcacaaaggcatgaacgtccg

SEQ ID NO: 339707 - DNA, 30 bp, Artificial Sequence
  Description of Artificial Sequence: Synthetic oligonucleotide
caccagaatcacaaaggcatgaacgtccgg

SEQ ID NO: 339708 - DNA, 30 bp, Artificial Sequence
  Description of Artificial Sequence: Synthetic oligonucleotide
accagaatcacaaaggcatgaacgtccggc

SEQ ID NO: 339709 - DNA, 29 bp, Artificial Sequence
  Description of Artificial Sequence: Synthetic oligonucleotide
ccagaatcacaaaggcatgaacgtccggc

SEQ ID NO: 339710 - DNA, 30 bp, Artificial Sequence
  Description of Artificial Sequence: Synthetic oligonucleotide
cagaatcacaaaggcatgaacgtccggcag

SEQ ID NO: 339711 - DNA, 31 bp, Artificial Sequence
  Description of Artificial Sequence: Synthetic oligonucleotide
agaatcacaaaggcatgaacgtccggcagag

SEQ ID NO: 339712 - DNA, 30 bp, Artificial Sequence
  Description of Artificial Sequence: Synthetic oligonucleotide
gaatcacaaaggcatgaacgtccggcagag

SEQ ID NO: 339713 - DNA, 30 bp, Artificial Sequence
  Description of Artificial Sequence: Synthetic oligonucleotide
aatcacaaaggcatgaacgtccggcagagg

SEQ ID NO: 339714 - DNA, 29 bp, Artificial Sequence
  Description of Artificial Sequence: Synthetic oligonucleotide
atcacaaaggcatgaacgtccggcagagg

SEQ ID NO: 339715 - DNA, 28 bp, Artificial Sequence
  Description of Artificial Sequence: Synthetic oligonucleotide
tcacaaaggcatgaacgtccggcagagg

SEQ ID NO: 339716 - DNA, 27 bp, Artificial Sequence
  Description of Artificial Sequence: Synthetic oligonucleotide
cacaaaggcatgaacgtccggcagagg

SEQ ID NO: 339717 - DNA, 29 bp, Artificial Sequence
  Description of Artificial Sequence: Synthetic oligonucleotide
acaaaggcatgaacgtccggcagaggaac

SEQ ID NO: 339718 - DNA, 28 bp, Artificial Sequence
  Description of Artificial Sequence: Synthetic oligonucleotide
caaaggcatgaacgtccggcagaggaac

SEQ ID NO: 339719 - DNA, 29 bp, Artificial Sequence
  Description of Artificial Sequence: Synthetic oligonucleotide
aaaggcatgaacgtccggcagaggaacac

SEQ ID NO: 339720 - DNA, 28 bp, Artificial Sequence
  Description of Artificial Sequence: Synthetic oligonucleotide
aaggcatgaacgtccggcagaggaacac

SEQ ID NO: 339721 - DNA, 27 bp, Artificial Sequence
  Description of Artificial Sequence: Synthetic oligonucleotide
aggcatgaacgtccggcagaggaacac

SEQ ID NO: 339722 - DNA, 27 bp, Artificial Sequence
  Description of Artificial Sequence: Synthetic oligonucleotide
ggcatgaacgtccggcagaggaacact

SEQ ID NO: 339723 - DNA, 28 bp, Artificial Sequence
  Description of Artificial Sequence: Synthetic oligonucleotide
gcatgaacgtccggcagaggaacacttc

SEQ ID NO: 339724 - DNA, 28 bp, Artificial Sequence
  Description of Artificial Sequence: Synthetic oligonucleotide
catgaacgtccggcagaggaacacttcc

SEQ ID NO: 339725 - DNA, 29 bp, Artificial Sequence
  Description of Artificial Sequence: Synthetic oligonucleotide
atgaacgtccggcagaggaacacttcctg

SEQ ID NO: 339726 - DNA, 28 bp, Artificial Sequence
  Description of Artificial Sequence: Synthetic oligonucleotide
tgaacgtccggcagaggaacacttcctg

SEQ ID NO: 339727 - DNA, 27 bp, Artificial Sequence
  Description of Artificial Sequence: Synthetic oligonucleotide
gaacgtccggcagaggaacacttcctg

SEQ ID NO: 339728 - DNA, 27 bp, Artificial Sequence
  Description of Artificial Sequence: Synthetic oligonucleotide
atggagagcaggtggggacatccctgt

SEQ ID NO: 339729 - DNA, 26 bp, Artificial Sequence
  Description of Artificial Sequence: Synthetic oligonucleotide
tggagagcaggtggggacatccctgt

SEQ ID NO: 339730 - DNA, 25 bp, Artificial Sequence
  Description of Artificial Sequence: Synthetic oligonucleotide
ggagagcaggtggggacatccctgt

SEQ ID NO: 339731 - DNA, 27 bp, Artificial Sequence
  Description of Artificial Sequence: Synthetic oligonucleotide
gagagcaggtggggacatccctgtcta

SEQ ID NO: 339732 - DNA, 27 bp, Artificial Sequence
  Description of Artificial Sequence: Synthetic oligonucleotide
agagcaggtggggacatccctgtctag

SEQ ID NO: 339733 - DNA, 26 bp, Artificial Sequence
  Description of Artificial Sequence: Synthetic oligonucleotide
gagcaggtggggacatccctgtctag

SEQ ID NO: 339734 - DNA, 26 bp, Artificial Sequence
  Description of Artificial Sequence: Synthetic oligonucleotide
agcaggtggggacatccctgtctagc

SEQ ID NO: 339735 - DNA, 25 bp, Artificial Sequence
  Description of Artificial Sequence: Synthetic oligonucleotide
gcaggtggggacatccctgtctagc

SEQ ID NO: 339736 - DNA, 27 bp, Artificial Sequence
  Description of Artificial Sequence: Synthetic oligonucleotide
caggtggggacatccctgtctagcgtt

SEQ ID NO: 339737 - DNA, 27 bp, Artificial Sequence
  Description of Artificial Sequence: Synthetic oligonucleotide
aggtggggacatccctgtctagcgttc

SEQ ID NO: 339738 - DNA, 26 bp, Artificial Sequence
  Description of Artificial Sequence: Synthetic oligonucleotide
ggtggggacatccctgtctagcgttc

SEQ ID NO: 339739 - DNA, 27 bp, Artificial Sequence
  Description of Artificial Sequence: Synthetic oligonucleotide
gtggggacatccctgtctagcgttcct

SEQ ID NO: 339740 - DNA, 27 bp, Artificial Sequence
  Description of Artificial Sequence: Synthetic oligonucleotide
tggggacatccctgtctagcgttcctg

SEQ ID NO: 339741 - DNA, 27 bp, Artificial Sequence
  Description of Artificial Sequence: Synthetic oligonucleotide
ggggacatccctgtctagcgttcctga

SEQ ID NO: 339742 - DNA, 27 bp, Artificial Sequence
  Description of Artificial Sequence: Synthetic oligonucleotide
gggacatccctgtctagcgttcctgag

SEQ ID NO: 339743 - DNA, 31 bp, Artificial Sequence
  Description of Artificial Sequence: Synthetic oligonucleotide
ggacatccctgtctagcgttcctgagttttc

SEQ ID NO: 339744 - DNA, 35 bp, Artificial Sequence
  Description of Artificial Sequence: Synthetic oligonucleotide
gacatccctgtctagcgttcctgagttttctaaag

SEQ ID NO: 339745 - DNA, 35 bp, Artificial Sequence
  Description of Artificial Sequence: Synthetic oligonucleotide
acatccctgtctagcgttcctgagttttctaaagc

SEQ ID NO: 339746 - DNA, 34 bp, Artificial Sequence
  Description of Artificial Sequence: Synthetic oligonucleotide
catccctgtctagcgttcctgagttttctaaagc

SEQ ID NO: 339747 - DNA, 35 bp, Artificial Sequence
  Description of Artificial Sequence: Synthetic oligonucleotide
atccctgtctagcgttcctgagttttctaaagcac

SEQ ID NO: 339748 - DNA, 34 bp, Artificial Sequence
  Description of Artificial Sequence: Synthetic oligonucleotide
tccctgtctagcgttcctgagttttctaaagcac

SEQ ID NO: 339749 - DNA, 33 bp, Artificial Sequence
  Description of Artificial Sequence: Synthetic oligonucleotide
ccctgtctagcgttcctgagttttctaaagcac

SEQ ID NO: 339750 - DNA, 33 bp, Artificial Sequence
  Description of Artificial Sequence: Synthetic oligonucleotide
cctgtctagcgttcctgagttttctaaagcacg

SEQ ID NO: 339751 - DNA, 33 bp, Artificial Sequence
  Description of Artificial Sequence: Synthetic oligonucleotide
ctgtctagcgttcctgagttttctaaagcacgc

SEQ ID NO: 339752 - DNA, 33 bp, Artificial Sequence
  Description of Artificial Sequence: Synthetic oligonucleotide
tgtctagcgttcctgagttttctaaagcacgcc

SEQ ID NO: 339753 - DNA, 32 bp, Artificial Sequence
  Description of Artificial Sequence: Synthetic oligonucleotide
gtctagcgttcctgagttttctaaagcacgcc

SEQ ID NO: 339754 - DNA, 32 bp, Artificial Sequence
  Description of Artificial Sequence: Synthetic oligonucleotide
tctagcgttcctgagttttctaaagcacgccc

SEQ ID NO: 339755 - DNA, 31 bp, Artificial Sequence
  Description of Artificial Sequence: Synthetic oligonucleotide
ctagcgttcctgagttttctaaagcacgccc

SEQ ID NO: 339756 - DNA, 31 bp, Artificial Sequence
  Description of Artificial Sequence: Synthetic oligonucleotide
tagcgttcctgagttttctaaagcacgcccg

SEQ ID NO: 339757 - DNA, 30 bp, Artificial Sequence
  Description of Artificial Sequence: Synthetic oligonucleotide
agcgttcctgagttttctaaagcacgcccg

SEQ ID NO: 339758 - DNA, 29 bp, Artificial Sequence
  Description of Artificial Sequence: Synthetic oligonucleotide
gcgttcctgagttttctaaagcacgcccg

SEQ ID NO: 339759 - DNA, 30 bp, Artificial Sequence
  Description of Artificial Sequence: Synthetic oligonucleotide
cgttcctgagttttctaaagcacgcccgtg

SEQ ID NO: 339760 - DNA, 30 bp, Artificial Sequence
  Description of Artificial Sequence: Synthetic oligonucleotide
gttcctgagttttctaaagcacgcccgtgg

SEQ ID NO: 339761 - DNA, 31 bp, Artificial Sequence
  Description of Artificial Sequence: Synthetic oligonucleotide
ttcctgagttttctaaagcacgcccgtggtc

SEQ ID NO: 339762 - DNA, 30 bp, Artificial Sequence
  Description of Artificial Sequence: Synthetic oligonucleotide
tcctgagttttctaaagcacgcccgtggtc

SEQ ID NO: 339763 - DNA, 29 bp, Artificial Sequence
  Description of Artificial Sequence: Synthetic oligonucleotide
cctgagttttctaaagcacgcccgtggtc

SEQ ID NO: 339764 - DNA, 32 bp, Artificial Sequence
  Description of Artificial Sequence: Synthetic oligonucleotide
ctgagttttctaaagcacgcccgtggtcaaag

SEQ ID NO: 339765 - DNA, 33 bp, Artificial Sequence
  Description of Artificial Sequence: Synthetic oligonucleotide
tgagttttctaaagcacgcccgtggtcaaagac

SEQ ID NO: 339766 - DNA, 32 bp, Artificial Sequence
  Description of Artificial Sequence: Synthetic oligonucleotide
gagttttctaaagcacgcccgtggtcaaagac

SEQ ID NO: 339767 - DNA, 33 bp, Artificial Sequence
  Description of Artificial Sequence: Synthetic oligonucleotide
agttttctaaagcacgcccgtggtcaaagacac

SEQ ID NO: 339768 - DNA, 32 bp, Artificial Sequence
  Description of Artificial Sequence: Synthetic oligonucleotide
gttttctaaagcacgcccgtggtcaaagacac

SEQ ID NO: 339769 - DNA, 35 bp, Artificial Sequence
  Description of Artificial Sequence: Synthetic oligonucleotide
ttttctaaagcacgcccgtggtcaaagacactttg

SEQ ID NO: 339770 - DNA, 34 bp, Artificial Sequence
  Description of Artificial Sequence: Synthetic oligonucleotide
tttctaaagcacgcccgtggtcaaagacactttg

SEQ ID NO: 339771 - DNA, 33 bp, Artificial Sequence
  Description of Artificial Sequence: Synthetic oligonucleotide
ttctaaagcacgcccgtggtcaaagacactttg

SEQ ID NO: 339772 - DNA, 32 bp, Artificial Sequence
  Description of Artificial Sequence: Synthetic oligonucleotide
tctaaagcacgcccgtggtcaaagacactttg

SEQ ID NO: 339773 - DNA, 31 bp, Artificial Sequence
  Description of Artificial Sequence: Synthetic oligonucleotide
ctaaagcacgcccgtggtcaaagacactttg

SEQ ID NO: 339774 - DNA, 35 bp, Artificial Sequence
  Description of Artificial Sequence: Synthetic oligonucleotide
taaagcacgcccgtggtcaaagacactttgattag

SEQ ID NO: 339775 - DNA, 34 bp, Artificial Sequence
  Description of Artificial Sequence: Synthetic oligonucleotide
aaagcacgcccgtggtcaaagacactttgattag

SEQ ID NO: 339776 - DNA, 33 bp, Artificial Sequence
  Description of Artificial Sequence: Synthetic oligonucleotide
aagcacgcccgtggtcaaagacactttgattag

SEQ ID NO: 339777 - DNA, 32 bp, Artificial Sequence
  Description of Artificial Sequence: Synthetic oligonucleotide
agcacgcccgtggtcaaagacactttgattag

SEQ ID NO: 339778 - DNA, 31 bp, Artificial Sequence
  Description of Artificial Sequence: Synthetic oligonucleotide
gcacgcccgtggtcaaagacactttgattag

SEQ ID NO: 339779 - DNA, 31 bp, Artificial Sequence
  Description of Artificial Sequence: Synthetic oligonucleotide
cacgcccgtggtcaaagacactttgattagg

SEQ ID NO: 339780 - DNA, 31 bp, Artificial Sequence
  Description of Artificial Sequence: Synthetic oligonucleotide
acgcccgtggtcaaagacactttgattaggc

SEQ ID NO: 339781 - DNA, 30 bp, Artificial Sequence
  Description of Artificial Sequence: Synthetic oligonucleotide
cgcccgtggtcaaagacactttgattaggc

SEQ ID NO: 339782 - DNA, 31 bp, Artificial Sequence
  Description of Artificial Sequence: Synthetic oligonucleotide
gcccgtggtcaaagacactttgattaggcag

SEQ ID NO: 339783 - DNA, 33 bp, Artificial Sequence
  Description of Artificial Sequence: Synthetic oligonucleotide
cccgtggtcaaagacactttgattaggcagatg

SEQ ID NO: 339784 - DNA, 33 bp, Artificial Sequence
  Description of Artificial Sequence: Synthetic oligonucleotide
ccgtggtcaaagacactttgattaggcagatgc

SEQ ID NO: 339785 - DNA, 33 bp, Artificial Sequence
  Description of Artificial Sequence: Synthetic oligonucleotide
cgtggtcaaagacactttgattaggcagatgcg

SEQ ID NO: 339786 - DNA, 33 bp, Artificial Sequence
  Description of Artificial Sequence: Synthetic oligonucleotide
gtggtcaaagacactttgattaggcagatgcgc

SEQ ID NO: 339787 - DNA, 35 bp, Artificial Sequence
  Description of Artificial Sequence: Synthetic oligonucleotide
tggtcaaagacactttgattaggcagatgcgcttg

SEQ ID NO: 339788 - DNA, 34 bp, Artificial Sequence
  Description of Artificial Sequence: Synthetic oligonucleotide
ggtcaaagacactttgattaggcagatgcgcttg

SEQ ID NO: 339789 - DNA, 36 bp, Artificial Sequence
  Description of Artificial Sequence: Synthetic oligonucleotide
gtcaaagacactttgattaggcagatgcgcttgatg

SEQ ID NO: 339790 - DNA, 37 bp, Artificial Sequence
  Description of Artificial Sequence: Synthetic oligonucleotide
tcaaagacactttgattaggcagatgcgcttgatgac

SEQ ID NO: 339791 - DNA, 36 bp, Artificial Sequence
  Description of Artificial Sequence: Synthetic oligonucleotide
caaagacactttgattaggcagatgcgcttgatgac

SEQ ID NO: 339792 - DNA, 36 bp, Artificial Sequence
  Description of Artificial Sequence: Synthetic oligonucleotide
aaagacactttgattaggcagatgcgcttgatgacg

SEQ ID NO: 339793 - DNA, 35 bp, Artificial Sequence
  Description of Artificial Sequence: Synthetic oligonucleotide
aagacactttgattaggcagatgcgcttgatgacg

SEQ ID NO: 339794 - DNA, 34 bp, Artificial Sequence
  Description of Artificial Sequence: Synthetic oligonucleotide
agacactttgattaggcagatgcgcttgatgacg

SEQ ID NO: 339795 - DNA, 33 bp, Artificial Sequence
  Description of Artificial Sequence: Synthetic oligonucleotide
gacactttgattaggcagatgcgcttgatgacg

SEQ ID NO: 339796 - DNA, 33 bp, Artificial Sequence
  Description of Artificial Sequence: Synthetic oligonucleotide
acactttgattaggcagatgcgcttgatgacgc

SEQ ID NO: 339797 - DNA, 32 bp, Artificial Sequence
  Description of Artificial Sequence: Synthetic oligonucleotide
cactttgattaggcagatgcgcttgatgacgc

SEQ ID NO: 339798 - DNA, 33 bp, Artificial Sequence
  Description of Artificial Sequence: Synthetic oligonucleotide
actttgattaggcagatgcgcttgatgacgctg

SEQ ID NO: 339799 - DNA, 32 bp, Artificial Sequence
  Description of Artificial Sequence: Synthetic oligonucleotide
ctttgattaggcagatgcgcttgatgacgctg

SEQ ID NO: 339800 - DNA, 34 bp, Artificial Sequence
  Description of Artificial Sequence: Synthetic oligonucleotide
tttgattaggcagatgcgcttgatgacgctgaac

SEQ ID NO: 339801 - DNA, 33 bp, Artificial Sequence
  Description of Artificial Sequence: Synthetic oligonucleotide
ttgattaggcagatgcgcttgatgacgctgaac

SEQ ID NO: 339802 - DNA, 32 bp, Artificial Sequence
  Description of Artificial Sequence: Synthetic oligonucleotide
tgattaggcagatgcgcttgatgacgctgaac

SEQ ID NO: 339803 - DNA, 31 bp, Artificial Sequence
  Description of Artificial Sequence: Synthetic oligonucleotide
gattaggcagatgcgcttgatgacgctgaac

SEQ ID NO: 339804 - DNA, 31 bp, Artificial Sequence
  Description of Artificial Sequence: Synthetic oligonucleotide
attaggcagatgcgcttgatgacgctgaacc

SEQ ID NO: 339805 - DNA, 30 bp, Artificial Sequence
  Description of Artificial Sequence: Synthetic oligonucleotide
ttaggcagatgcgcttgatgacgctgaacc

SEQ ID NO: 339806 - DNA, 29 bp, Artificial Sequence
  Description of Artificial Sequence: Synthetic oligonucleotide
taggcagatgcgcttgatgacgctgaacc

SEQ ID NO: 339807 - DNA, 28 bp, Artificial Sequence
  Description of Artificial Sequence: Synthetic oligonucleotide
aggcagatgcgcttgatgacgctgaacc

SEQ ID NO: 339808 - DNA, 27 bp, Artificial Sequence
  Description of Artificial Sequence: Synthetic oligonucleotide
ggcagatgcgcttgatgacgctgaacc

SEQ ID NO: 339809 - DNA, 27 bp, Artificial Sequence
  Description of Artificial Sequence: Synthetic oligonucleotide
gcagatgcgcttgatgacgctgaaccc

SEQ ID NO: 339810 - DNA, 28 bp, Artificial Sequence
  Description of Artificial Sequence: Synthetic oligonucleotide
cagatgcgcttgatgacgctgaacccag

SEQ ID NO: 339811 - DNA, 28 bp, Artificial Sequence
  Description of Artificial Sequence: Synthetic oligonucleotide
agatgcgcttgatgacgctgaacccagc

SEQ ID NO: 339812 - DNA, 27 bp, Artificial Sequence
  Description of Artificial Sequence: Synthetic oligonucleotide
gatgcgcttgatgacgctgaacccagc

SEQ ID NO: 339813 - DNA, 29 bp, Artificial Sequence
  Description of Artificial Sequence: Synthetic oligonucleotide
atgcgcttgatgacgctgaacccagcaag

SEQ ID NO: 339814 - DNA, 28 bp, Artificial Sequence
  Description of Artificial Sequence: Synthetic oligonucleotide
tgcgcttgatgacgctgaacccagcaag

SEQ ID NO: 339815 - DNA, 27 bp, Artificial Sequence
  Description of Artificial Sequence: Synthetic oligonucleotide
gcgcttgatgacgctgaacccagcaag

SEQ ID NO: 339816 - DNA, 29 bp, Artificial Sequence
  Description of Artificial Sequence: Synthetic oligonucleotide
cgcttgatgacgctgaacccagcaagaag

SEQ ID NO: 339817 - DNA, 29 bp, Artificial Sequence
  Description of Artificial Sequence: Synthetic oligonucleotide
gcttgatgacgctgaacccagcaagaagc

SEQ ID NO: 339818 - DNA, 29 bp, Artificial Sequence
  Description of Artificial Sequence: Synthetic oligonucleotide
cttgatgacgctgaacccagcaagaagcc

SEQ ID NO: 339819 - DNA, 32 bp, Artificial Sequence
  Description of Artificial Sequence: Synthetic oligonucleotide
ttgatgacgctgaacccagcaagaagcctaac

SEQ ID NO: 339820 - DNA, 31 bp, Artificial Sequence
  Description of Artificial Sequence: Synthetic oligonucleotide
tgatgacgctgaacccagcaagaagcctaac

SEQ ID NO: 339821 - DNA, 30 bp, Artificial Sequence
  Description of Artificial Sequence: Synthetic oligonucleotide
gatgacgctgaacccagcaagaagcctaac

SEQ ID NO: 339822 - DNA, 31 bp, Artificial Sequence
  Description of Artificial Sequence: Synthetic oligonucleotide
atgacgctgaacccagcaagaagcctaactc

SEQ ID NO: 339823 - DNA, 30 bp, Artificial Sequence
  Description of Artificial Sequence: Synthetic oligonucleotide
tgacgctgaacccagcaagaagcctaactc

SEQ ID NO: 339824 - DNA, 29 bp, Artificial Sequence
  Description of Artificial Sequence: Synthetic oligonucleotide
gacgctgaacccagcaagaagcctaactc

SEQ ID NO: 339825 - DNA, 30 bp, Artificial Sequence
  Description of Artificial Sequence: Synthetic oligonucleotide
acgctgaacccagcaagaagcctaactcag

SEQ ID NO: 339826 - DNA, 29 bp, Artificial Sequence
  Description of Artificial Sequence: Synthetic oligonucleotide
cgctgaacccagcaagaagcctaactcag

SEQ ID NO: 339827 - DNA, 33 bp, Artificial Sequence
  Description of Artificial Sequence: Synthetic oligonucleotide
gctgaacccagcaagaagcctaactcagatttc

SEQ ID NO: 339828 - DNA, 35 bp, Artificial Sequence
  Description of Artificial Sequence: Synthetic oligonucleotide
ctgaacccagcaagaagcctaactcagatttctac

SEQ ID NO: 339829 - DNA, 35 bp, Artificial Sequence
  Description of Artificial Sequence: Synthetic oligonucleotide
tgaacccagcaagaagcctaactcagatttctacc

SEQ ID NO: 339830 - DNA, 34 bp, Artificial Sequence
  Description of Artificial Sequence: Synthetic oligonucleotide
gaacccagcaagaagcctaactcagatttctacc

SEQ ID NO: 339831 - DNA, 34 bp, Artificial Sequence
  Description of Artificial Sequence: Synthetic oligonucleotide
aacccagcaagaagcctaactcagatttctaccc

SEQ ID NO: 339832 - DNA, 33 bp, Artificial Sequence
  Description of Artificial Sequence: Synthetic oligonucleotide
acccagcaagaagcctaactcagatttctaccc

SEQ ID NO: 339833 - DNA, 32 bp, Artificial Sequence
  Description of Artificial Sequence: Synthetic oligonucleotide
cccagcaagaagcctaactcagatttctaccc

SEQ ID NO: 339834 - DNA, 35 bp, Artificial Sequence
  Description of Artificial Sequence: Synthetic oligonucleotide
ccagcaagaagcctaactcagatttctacccaatg

SEQ ID NO: 339835 - DNA, 35 bp, Artificial Sequence
  Description of Artificial Sequence: Synthetic oligonucleotide
cagcaagaagcctaactcagatttctacccaatgc

SEQ ID NO: 339836 - DNA, 35 bp, Artificial Sequence
  Description of Artificial Sequence: Synthetic oligonucleotide
agcaagaagcctaactcagatttctacccaatgcc

SEQ ID NO: 339837 - DNA, 34 bp, Artificial Sequence
  Description of Artificial Sequence: Synthetic oligonucleotide
gcaagaagcctaactcagatttctacccaatgcc

SEQ ID NO: 339838 - DNA, 38 bp, Artificial Sequence
  Description of Artificial Sequence: Synthetic oligonucleotide
caagaagcctaactcagatttctacccaatgccaaaac

SEQ ID NO: 339839 - DNA, 38 bp, Artificial Sequence
  Description of Artificial Sequence: Synthetic oligonucleotide
aagaagcctaactcagatttctacccaatgccaaaacc

SEQ ID NO: 339840 - DNA, 37 bp, Artificial Sequence
  Description of Artificial Sequence: Synthetic oligonucleotide
agaagcctaactcagatttctacccaatgccaaaacc

SEQ ID NO: 339841 - DNA, 36 bp, Artificial Sequence
  Description of Artificial Sequence: Synthetic oligonucleotide
gaagcctaactcagatttctacccaatgccaaaacc

SEQ ID NO: 339842 - DNA, 37 bp, Artificial Sequence
  Description of Artificial Sequence: Synthetic oligonucleotide
aagcctaactcagatttctacccaatgccaaaacctc

SEQ ID NO: 339843 - DNA, 36 bp, Artificial Sequence
  Description of Artificial Sequence: Synthetic oligonucleotide
agcctaactcagatttctacccaatgccaaaacctc

SEQ ID NO: 339844 - DNA, 35 bp, Artificial Sequence
  Description of Artificial Sequence: Synthetic oligonucleotide
gcctaactcagatttctacccaatgccaaaacctc

SEQ ID NO: 339845 - DNA, 35 bp, Artificial Sequence
  Description of Artificial Sequence: Synthetic oligonucleotide
cctaactcagatttctacccaatgccaaaacctcc

SEQ ID NO: 339846 - DNA, 38 bp, Artificial Sequence
  Description of Artificial Sequence: Synthetic oligonucleotide
ctaactcagatttctacccaatgccaaaacctccttac

SEQ ID NO: 339847 - DNA, 40 bp, Artificial Sequence
  Description of Artificial Sequence: Synthetic oligonucleotide
taactcagatttctacccaatgccaaaacctccttactac

SEQ ID NO: 339848 - DNA, 39 bp, Artificial Sequence
  Description of Artificial Sequence: Synthetic oligonucleotide
aactcagatttctacccaatgccaaaacctccttactac

SEQ ID NO: 339849 - DNA, 38 bp, Artificial Sequence
  Description of Artificial Sequence: Synthetic oligonucleotide
actcagatttctacccaatgccaaaacctccttactac

SEQ ID NO: 339850 - DNA, 37 bp, Artificial Sequence
  Description of Artificial Sequence: Synthetic oligonucleotide
ctcagatttctacccaatgccaaaacctccttactac

SEQ ID NO: 339851 - DNA, 37 bp, Artificial Sequence
  Description of Artificial Sequence: Synthetic oligonucleotide
tcagatttctacccaatgccaaaacctccttactacg

SEQ ID NO: 339852 - DNA, 36 bp, Artificial Sequence
  Description of Artificial Sequence: Synthetic oligonucleotide
cagatttctacccaatgccaaaacctccttactacg

SEQ ID NO: 339853 - DNA, 36 bp, Artificial Sequence
  Description of Artificial Sequence: Synthetic oligonucleotide
agatttctacccaatgccaaaacctccttactacgc

SEQ ID NO: 339854 - DNA, 35 bp, Artificial Sequence
  Description of Artificial Sequence: Synthetic oligonucleotide
gatttctacccaatgccaaaacctccttactacgc

SEQ ID NO: 339855 - DNA, 36 bp, Artificial Sequence
  Description of Artificial Sequence: Synthetic oligonucleotide
atttctacccaatgccaaaacctccttactacgcac

SEQ ID NO: 339856 - DNA, 35 bp, Artificial Sequence
  Description of Artificial Sequence: Synthetic oligonucleotide
tttctacccaatgccaaaacctccttactacgcac

SEQ ID NO: 339857 - DNA, 34 bp, Artificial Sequence
  Description of Artificial Sequence: Synthetic oligonucleotide
ttctacccaatgccaaaacctccttactacgcac

SEQ ID NO: 339858 - DNA, 33 bp, Artificial Sequence
  Description of Artificial Sequence: Synthetic oligonucleotide
tctacccaatgccaaaacctccttactacgcac

SEQ ID NO: 339859 - DNA, 32 bp, Artificial Sequence
  Description of Artificial Sequence: Synthetic oligonucleotide
ctacccaatgccaaaacctccttactacgcac

SEQ ID NO: 339860 - DNA, 33 bp, Artificial Sequence
  Description of Artificial Sequence: Synthetic oligonucleotide
tacccaatgccaaaacctccttactacgcacag

SEQ ID NO: 339861 - DNA, 32 bp, Artificial Sequence
  Description of Artificial Sequence: Synthetic oligonucleotide
acccaatgccaaaacctccttactacgcacag

SEQ ID NO: 339862 - DNA, 31 bp, Artificial Sequence
  Description of Artificial Sequence: Synthetic oligonucleotide
cccaatgccaaaacctccttactacgcacag

SEQ ID NO: 339863 - DNA, 31 bp, Artificial Sequence
  Description of Artificial Sequence: Synthetic oligonucleotide
ccaatgccaaaacctccttactacgcacagc

SEQ ID NO: 339864 - DNA, 31 bp, Artificial Sequence
  Description of Artificial Sequence: Synthetic oligonucleotide
caatgccaaaacctccttactacgcacagcc

SEQ ID NO: 339865 - DNA, 31 bp, Artificial Sequence
  Description of Artificial Sequence: Synthetic oligonucleotide
aatgccaaaacctccttactacgcacagccc

SEQ ID NO: 339866 - DNA, 30 bp, Artificial Sequence
  Description of Artificial Sequence: Synthetic oligonucleotide
atgccaaaacctccttactacgcacagccc

SEQ ID NO: 339867 - DNA, 29 bp, Artificial Sequence
  Description of Artificial Sequence: Synthetic oligonucleotide
tgccaaaacctccttactacgcacagccc

SEQ ID NO: 339868 - DNA, 28 bp, Artificial Sequence
  Description of Artificial Sequence: Synthetic oligonucleotide
gccaaaacctccttactacgcacagccc

SEQ ID NO: 339869 - DNA, 28 bp, Artificial Sequence
  Description of Artificial Sequence: Synthetic oligonucleotide
ccaaaacctccttactacgcacagcccg

SEQ ID NO: 339870 - DNA, 29 bp, Artificial Sequence
  Description of Artificial Sequence: Synthetic oligonucleotide
caaaacctccttactacgcacagcccgtg

SEQ ID NO: 339871 - DNA, 32 bp, Artificial Sequence
  Description of Artificial Sequence: Synthetic oligonucleotide
aaaacctccttactacgcacagcccgtgaatc

SEQ ID NO: 339872 - DNA, 31 bp, Artificial Sequence
  Description of Artificial Sequence: Synthetic oligonucleotide
aaacctccttactacgcacagcccgtgaatc

SEQ ID NO: 339873 - DNA, 30 bp, Artificial Sequence
  Description of Artificial Sequence: Synthetic oligonucleotide
aacctccttactacgcacagcccgtgaatc

SEQ ID NO: 339874 - DNA, 29 bp, Artificial Sequence
  Description of Artificial Sequence: Synthetic oligonucleotide
acctccttactacgcacagcccgtgaatc

SEQ ID NO: 339875 - DNA, 28 bp, Artificial Sequence
  Description of Artificial Sequence: Synthetic oligonucleotide
cctccttactacgcacagcccgtgaatc

SEQ ID NO: 339876 - DNA, 28 bp, Artificial Sequence
  Description of Artificial Sequence: Synthetic oligonucleotide
ctccttactacgcacagcccgtgaatcc

SEQ ID NO: 339877 - DNA, 28 bp, Artificial Sequence
  Description of Artificial Sequence: Synthetic oligonucleotide
tccttactacgcacagcccgtgaatccc

SEQ ID NO: 339878 - DNA, 27 bp, Artificial Sequence
  Description of Artificial Sequence: Synthetic oligonucleotide
ccttactacgcacagcccgtgaatccc

SEQ ID NO: 339879 - DNA, 27 bp, Artificial Sequence
  Description of Artificial Sequence: Synthetic oligonucleotide
cttactacgcacagcccgtgaatcccg

SEQ ID NO: 339880 - DNA, 28 bp, Artificial Sequence
  Description of Artificial Sequence: Synthetic oligonucleotide
ttactacgcacagcccgtgaatcccgag

SEQ ID NO: 339881 - DNA, 27 bp, Artificial Sequence
  Description of Artificial Sequence: Synthetic oligonucleotide
tactacgcacagcccgtgaatcccgag

SEQ ID NO: 339882 - DNA, 27 bp, Artificial Sequence
  Description of Artificial Sequence: Synthetic oligonucleotide
actacgcacagcccgtgaatcccgaga

SEQ ID NO: 339883 - DNA, 26 bp, Artificial Sequence
  Description of Artificial Sequence: Synthetic oligonucleotide
ctacgcacagcccgtgaatcccgaga

SEQ ID NO: 339884 - DNA, 26 bp, Artificial Sequence
  Description of Artificial Sequence: Synthetic oligonucleotide
tacgcacagcccgtgaatcccgagag

SEQ ID NO: 339885 - DNA, 25 bp, Artificial Sequence
  Description of Artificial Sequence: Synthetic oligonucleotide
acgcacagcccgtgaatcccgagag

SEQ ID NO: 339886 - DNA, 24 bp, Artificial Sequence
  Description of Artificial Sequence: Synthetic oligonucleotide
cgcacagcccgtgaatcccgagag

SEQ ID NO: 339887 - DNA, 24 bp, Artificial Sequence
  Description of Artificial Sequence: Synthetic oligonucleotide
gcacagcccgtgaatcccgagagc

SEQ ID NO: 339888 - DNA, 24 bp, Artificial Sequence
  Description of Artificial Sequence: Synthetic oligonucleotide
cacagcccgtgaatcccgagagcg

SEQ ID NO: 339889 - DNA, 25 bp, Artificial Sequence
  Description of Artificial Sequence: Synthetic oligonucleotide
acagcccgtgaatcccgagagcggt

SEQ ID NO: 339890 - DNA, 24 bp, Artificial Sequence
  Description of Artificial Sequence: Synthetic oligonucleotide
cagcccgtgaatcccgagagcggt

SEQ ID NO: 339891 - DNA, 24 bp, Artificial Sequence
  Description of Artificial Sequence: Synthetic oligonucleotide
agcccgtgaatcccgagagcggtg

SEQ ID NO: 339892 - DNA, 23 bp, Artificial Sequence
  Description of Artificial Sequence: Synthetic oligonucleotide
gcccgtgaatcccgagagcggtg

SEQ ID NO: 339893 - DNA, 27 bp, Artificial Sequence
  Description of Artificial Sequence: Synthetic oligonucleotide
cccgtgaatcccgagagcggtggatat

SEQ ID NO: 339894 - DNA, 29 bp, Artificial Sequence
  Description of Artificial Sequence: Synthetic oligonucleotide
ccgtgaatcccgagagcggtggatatatc

SEQ ID NO: 339895 - DNA, 31 bp, Artificial Sequence
  Description of Artificial Sequence: Synthetic oligonucleotide
cgtgaatcccgagagcggtggatatatctac

SEQ ID NO: 339896 - DNA, 31 bp, Artificial Sequence
  Description of Artificial Sequence: Synthetic oligonucleotide
gtgaatcccgagagcggtggatatatctacc

SEQ ID NO: 339897 - DNA, 31 bp, Artificial Sequence
  Description of Artificial Sequence: Synthetic oligonucleotide
tgaatcccgagagcggtggatatatctaccg

SEQ ID NO: 339898 - DNA, 30 bp, Artificial Sequence
  Description of Artificial Sequence: Synthetic oligonucleotide
gaatcccgagagcggtggatatatctaccg

SEQ ID NO: 339899 - DNA, 32 bp, Artificial Sequence
  Description of Artificial Sequence: Synthetic oligonucleotide
aatcccgagagcggtggatatatctaccgaag

SEQ ID NO: 339900 - DNA, 31 bp, Artificial Sequence
  Description of Artificial Sequence: Synthetic oligonucleotide
atcccgagagcggtggatatatctaccgaag

SEQ ID NO: 339901 - DNA, 30 bp, Artificial Sequence
  Description of Artificial Sequence: Synthetic oligonucleotide
tcccgagagcggtggatatatctaccgaag

SEQ ID NO: 339902 - DNA, 29 bp, Artificial Sequence
  Description of Artificial Sequence: Synthetic oligonucleotide
cccgagagcggtggatatatctaccgaag

SEQ ID NO: 339903 - DNA, 29 bp, Artificial Sequence
  Description of Artificial Sequence: Synthetic oligonucleotide
ccgagagcggtggatatatctaccgaagg

SEQ ID NO: 339904 - DNA, 29 bp, Artificial Sequence
  Description of Artificial Sequence: Synthetic oligonucleotide
cgagagcggtggatatatctaccgaaggc

SEQ ID NO: 339905 - DNA, 29 bp, Artificial Sequence
  Description of Artificial Sequence: Synthetic oligonucleotide
gagagcggtggatatatctaccgaaggcc

SEQ ID NO: 339906 - DNA, 32 bp, Artificial Sequence
  Description of Artificial Sequence: Synthetic oligonucleotide
agagcggtggatatatctaccgaaggccaaac

SEQ ID NO: 339907 - DNA, 31 bp, Artificial Sequence
  Description of Artificial Sequence: Synthetic oligonucleotide
gagcggtggatatatctaccgaaggccaaac

SEQ ID NO: 339908 - DNA, 31 bp, Artificial Sequence
  Description of Artificial Sequence: Synthetic oligonucleotide
agcggtggatatatctaccgaaggccaaacc

SEQ ID NO: 339909 - DNA, 30 bp, Artificial Sequence
  Description of Artificial Sequence: Synthetic oligonucleotide
gcggtggatatatctaccgaaggccaaacc

SEQ ID NO: 339910 - DNA, 30 bp, Artificial Sequence
  Description of Artificial Sequence: Synthetic oligonucleotide
cggtggatatatctaccgaaggccaaaccc

SEQ ID NO: 339911 - DNA, 31 bp, Artificial Sequence
  Description of Artificial Sequence: Synthetic oligonucleotide
ggtggatatatctaccgaaggccaaacccac

SEQ ID NO: 339912 - DNA, 31 bp, Artificial Sequence
  Description of Artificial Sequence: Synthetic oligonucleotide
gtggatatatctaccgaaggccaaacccacg

SEQ ID NO: 339913 - DNA, 31 bp, Artificial Sequence
  Description of Artificial Sequence: Synthetic oligonucleotide
tggatatatctaccgaaggccaaacccacgc

SEQ ID NO: 339914 - DNA, 30 bp, Artificial Sequence
  Description of Artificial Sequence: Synthetic oligonucleotide
ggatatatctaccgaaggccaaacccacgc

SEQ ID NO: 339915 - DNA, 30 bp, Artificial Sequence
  Description of Artificial Sequence: Synthetic oligonucleotide
gatatatctaccgaaggccaaacccacgcc

SEQ ID NO: 339916 - DNA, 30 bp, Artificial Sequence
  Description of Artificial Sequence: Synthetic oligonucleotide
atatatctaccgaaggccaaacccacgccc

SEQ ID NO: 339917 - DNA, 29 bp, Artificial Sequence
  Description of Artificial Sequence: Synthetic oligonucleotide
tatatctaccgaaggccaaacccacgccc

SEQ ID NO: 339918 - DNA, 28 bp, Artificial Sequence
  Description of Artificial Sequence: Synthetic oligonucleotide
atatctaccgaaggccaaacccacgccc

SEQ ID NO: 339919 - DNA, 27 bp, Artificial Sequence
  Description of Artificial Sequence: Synthetic oligonucleotide
tatctaccgaaggccaaacccacgccc

SEQ ID NO: 339920 - DNA, 27 bp, Artificial Sequence
  Description of Artificial Sequence: Synthetic oligonucleotide
atctaccgaaggccaaacccacgccct

SEQ ID NO: 339921 - DNA, 26 bp, Artificial Sequence
  Description of Artificial Sequence: Synthetic oligonucleotide
tctaccgaaggccaaacccacgccct

SEQ ID NO: 339922 - DNA, 25 bp, Artificial Sequence
  Description of Artificial Sequence: Synthetic oligonucleotide
ctaccgaaggccaaacccacgccct

SEQ ID NO: 339923 - DNA, 27 bp, Artificial Sequence
  Description of Artificial Sequence: Synthetic oligonucleotide
taccgaaggccaaacccacgccctgaa

SEQ ID NO: 339924 - DNA, 26 bp, Artificial Sequence
  Description of Artificial Sequence: Synthetic oligonucleotide
accgaaggccaaacccacgccctgaa

SEQ ID NO: 339925 - DNA, 25 bp, Artificial Sequence
  Description of Artificial Sequence: Synthetic oligonucleotide
ccgaaggccaaacccacgccctgaa

SEQ ID NO: 339926 - DNA, 25 bp, Artificial Sequence
  Description of Artificial Sequence: Synthetic oligonucleotide
cgaaggccaaacccacgccctgaac

SEQ ID NO: 339927 - DNA, 25 bp, Artificial Sequence
  Description of Artificial Sequence: Synthetic oligonucleotide
gaaggccaaacccacgccctgaacc

SEQ ID NO: 339928 - DNA, 25 bp, Artificial Sequence
  Description of Artificial Sequence: Synthetic oligonucleotide
aaggccaaacccacgccctgaaccc

SEQ ID NO: 339929 - DNA, 24 bp, Artificial Sequence
  Description of Artificial Sequence: Synthetic oligonucleotide
aggccaaacccacgccctgaaccc

SEQ ID NO: 339930 - DNA, 23 bp, Artificial Sequence
  Description of Artificial Sequence: Synthetic oligonucleotide
ggccaaacccacgccctgaaccc

SEQ ID NO: 339931 - DNA, 24 bp, Artificial Sequence
  Description of Artificial Sequence: Synthetic oligonucleotide
gccaaacccacgccctgaacccca

SEQ ID NO: 339932 - DNA, 24 bp, Artificial Sequence
  Description of Artificial Sequence: Synthetic oligonucleotide
ccaaacccacgccctgaaccccag

SEQ ID NO: 339933 - DNA, 24 bp, Artificial Sequence
  Description of Artificial Sequence: Synthetic oligonucleotide
caaacccacgccctgaaccccagc

SEQ ID NO: 339934 - DNA, 25 bp, Artificial Sequence
  Description of Artificial Sequence: Synthetic oligonucleotide
aaacccacgccctgaaccccagcgt

SEQ ID NO: 339935 - DNA, 24 bp, Artificial Sequence
  Description of Artificial Sequence: Synthetic oligonucleotide
aacccacgccctgaaccccagcgt

SEQ ID NO: 339936 - DNA, 23 bp, Artificial Sequence
  Description of Artificial Sequence: Synthetic oligonucleotide
acccacgccctgaaccccagcgt

SEQ ID NO: 339937 - DNA, 22 bp, Artificial Sequence
  Description of Artificial Sequence: Synthetic oligonucleotide
cccacgccctgaaccccagcgt

SEQ ID NO: 339938 - DNA, 22 bp, Artificial Sequence
  Description of Artificial Sequence: Synthetic oligonucleotide
ccacgccctgaaccccagcgtg

SEQ ID NO: 339939 - DNA, 22 bp, Artificial Sequence
  Description of Artificial Sequence: Synthetic oligonucleotide
cacgccctgaaccccagcgtgg

SEQ ID NO: 339940 - DNA, 26 bp, Artificial Sequence
  Description of Artificial Sequence: Synthetic oligonucleotide
acgccctgaaccccagcgtggcaatt

SEQ ID NO: 339941 - DNA, 25 bp, Artificial Sequence
  Description of Artificial Sequence: Synthetic oligonucleotide
cgccctgaaccccagcgtggcaatt

SEQ ID NO: 339942 - DNA, 25 bp, Artificial Sequence
  Description of Artificial Sequence: Synthetic oligonucleotide
gccctgaaccccagcgtggcaattc

SEQ ID NO: 339943 - DNA, 25 bp, Artificial Sequence
  Description of Artificial Sequence: Synthetic oligonucleotide
ccctgaaccccagcgtggcaattcg

SEQ ID NO: 339944 - DNA, 25 bp, Artificial Sequence
  Description of Artificial Sequence: Synthetic oligonucleotide
cctgaaccccagcgtggcaattcgg

SEQ ID NO: 339945 - DNA, 25 bp, Artificial Sequence
  Description of Artificial Sequence: Synthetic oligonucleotide
ctgaaccccagcgtggcaattcggg

SEQ ID NO: 339946 - DNA, 27 bp, Artificial Sequence
  Description of Artificial Sequence: Synthetic oligonucleotide
tgaaccccagcgtggcaattcgggcaa

SEQ ID NO: 339947 - DNA, 26 bp, Artificial Sequence
  Description of Artificial Sequence: Synthetic oligonucleotide
gaaccccagcgtggcaattcgggcaa

SEQ ID NO: 339948 - DNA, 27 bp, Artificial Sequence
  Description of Artificial Sequence: Synthetic oligonucleotide
aaccccagcgtggcaattcgggcaaca

SEQ ID NO: 339949 - DNA, 26 bp, Artificial Sequence
  Description of Artificial Sequence: Synthetic oligonucleotide
accccagcgtggcaattcgggcaaca

SEQ ID NO: 339950 - DNA, 25 bp, Artificial Sequence
  Description of Artificial Sequence: Synthetic oligonucleotide
ccccagcgtggcaattcgggcaaca

SEQ ID NO: 339951 - DNA, 26 bp, Artificial Sequence
  Description of Artificial Sequence: Synthetic oligonucleotide
cccagcgtggcaattcgggcaacagt

SEQ ID NO: 339952 - DNA, 26 bp, Artificial Sequence
  Description of Artificial Sequence: Synthetic oligonucleotide
ccagcgtggcaattcgggcaacagtc

SEQ ID NO: 339953 - DNA, 27 bp, Artificial Sequence
  Description of Artificial Sequence: Synthetic oligonucleotide
cagcgtggcaattcgggcaacagtcga

SEQ ID NO: 339954 - DNA, 27 bp, Artificial Sequence
  Description of Artificial Sequence: Synthetic oligonucleotide
agcgtggcaattcgggcaacagtcgag

SEQ ID NO: 339955 - DNA, 26 bp, Artificial Sequence
  Description of Artificial Sequence: Synthetic oligonucleotide
gcgtggcaattcgggcaacagtcgag

SEQ ID NO: 339956 - DNA, 27 bp, Artificial Sequence
  Description of Artificial Sequence: Synthetic oligonucleotide
cgtggcaattcgggcaacagtcgaggt

SEQ ID NO: 339957 - DNA, 29 bp, Artificial Sequence
  Description of Artificial Sequence: Synthetic oligonucleotide
gtggcaattcgggcaacagtcgaggttac

SEQ ID NO: 339958 - DNA, 31 bp, Artificial Sequence
  Description of Artificial Sequence: Synthetic oligonucleotide
tggcaattcgggcaacagtcgaggttactac

SEQ ID NO: 339959 - DNA, 30 bp, Artificial Sequence
  Description of Artificial Sequence: Synthetic oligonucleotide
ggcaattcgggcaacagtcgaggttactac

SEQ ID NO: 339960 - DNA, 33 bp, Artificial Sequence
  Description of Artificial Sequence: Synthetic oligonucleotide
gcaattcgggcaacagtcgaggttactacaatg

SEQ ID NO: 339961 - DNA, 35 bp, Artificial Sequence
  Description of Artificial Sequence: Synthetic oligonucleotide
caattcgggcaacagtcgaggttactacaatgatg

SEQ ID NO: 339962 - DNA, 36 bp, Artificial Sequence
  Description of Artificial Sequence: Synthetic oligonucleotide
aattcgggcaacagtcgaggttactacaatgatgtc

SEQ ID NO: 339963 - DNA, 35 bp, Artificial Sequence
  Description of Artificial Sequence: Synthetic oligonucleotide
attcgggcaacagtcgaggttactacaatgatgtc

SEQ ID NO: 339964 - DNA, 34 bp, Artificial Sequence
  Description of Artificial Sequence: Synthetic oligonucleotide
ttcgggcaacagtcgaggttactacaatgatgtc

SEQ ID NO: 339965 - DNA, 33 bp, Artificial Sequence
  Description of Artificial Sequence: Synthetic oligonucleotide
tcgggcaacagtcgaggttactacaatgatgtc

SEQ ID NO: 339966 - DNA, 32 bp, Artificial Sequence
  Description of Artificial Sequence: Synthetic oligonucleotide
cgggcaacagtcgaggttactacaatgatgtc

SEQ ID NO: 339967 - DNA, 32 bp, Artificial Sequence
  Description of Artificial Sequence: Synthetic oligonucleotide
gggcaacagtcgaggttactacaatgatgtcg

SEQ ID NO: 339968 - DNA, 33 bp, Artificial Sequence
  Description of Artificial Sequence: Synthetic oligonucleotide
ggcaacagtcgaggttactacaatgatgtcgac

SEQ ID NO: 339969 - DNA, 33 bp, Artificial Sequence
  Description of Artificial Sequence: Synthetic oligonucleotide
gcaacagtcgaggttactacaatgatgtcgacc

SEQ ID NO: 339970 - DNA, 33 bp, Artificial Sequence
  Description of Artificial Sequence: Synthetic oligonucleotide
caacagtcgaggttactacaatgatgtcgaccg

SEQ ID NO: 339971 - DNA, 34 bp, Artificial Sequence
  Description of Artificial Sequence: Synthetic oligonucleotide
aacagtcgaggttactacaatgatgtcgaccgtg

SEQ ID NO: 339972 - DNA, 33 bp, Artificial Sequence
  Description of Artificial Sequence: Synthetic oligonucleotide
acagtcgaggttactacaatgatgtcgaccgtg

SEQ ID NO: 339973 - DNA, 32 bp, Artificial Sequence
  Description of Artificial Sequence: Synthetic oligonucleotide
cagtcgaggttactacaatgatgtcgaccgtg

SEQ ID NO: 339974 - DNA, 34 bp, Artificial Sequence
  Description of Artificial Sequence: Synthetic oligonucleotide
agtcgaggttactacaatgatgtcgaccgtgatc

SEQ ID NO: 339975 - DNA, 33 bp, Artificial Sequence
  Description of Artificial Sequence: Synthetic oligonucleotide
gtcgaggttactacaatgatgtcgaccgtgatc

SEQ ID NO: 339976 - DNA, 34 bp, Artificial Sequence
  Description of Artificial Sequence: Synthetic oligonucleotide
tcgaggttactacaatgatgtcgaccgtgatcac

SEQ ID NO: 339977 - DNA, 33 bp, Artificial Sequence
  Description of Artificial Sequence: Synthetic oligonucleotide
cgaggttactacaatgatgtcgaccgtgatcac

SEQ ID NO: 339978 - DNA, 33 bp, Artificial Sequence
  Description of Artificial Sequence: Synthetic oligonucleotide
gaggttactacaatgatgtcgaccgtgatcacg

SEQ ID NO: 339979 - DNA, 33 bp, Artificial Sequence
  Description of Artificial Sequence: Synthetic oligonucleotide
aggttactacaatgatgtcgaccgtgatcacgg

SEQ ID NO: 339980 - DNA, 32 bp, Artificial Sequence
  Description of Artificial Sequence: Synthetic oligonucleotide
ggttactacaatgatgtcgaccgtgatcacgg

SEQ ID NO: 339981 - DNA, 33 bp, Artificial Sequence
  Description of Artificial Sequence: Synthetic oligonucleotide
gttactacaatgatgtcgaccgtgatcacggac

SEQ ID NO: 339982 - DNA, 33 bp, Artificial Sequence
  Description of Artificial Sequence: Synthetic oligonucleotide
ttactacaatgatgtcgaccgtgatcacggacg

SEQ ID NO: 339983 - DNA, 32 bp, Artificial Sequence
  Description of Artificial Sequence: Synthetic oligonucleotide
tactacaatgatgtcgaccgtgatcacggacg

SEQ ID NO: 339984 - DNA, 31 bp, Artificial Sequence
  Description of Artificial Sequence: Synthetic oligonucleotide
actacaatgatgtcgaccgtgatcacggacg

SEQ ID NO: 339985 - DNA, 30 bp, Artificial Sequence
  Description of Artificial Sequence: Synthetic oligonucleotide
ctacaatgatgtcgaccgtgatcacggacg

SEQ ID NO: 339986 - DNA, 30 bp, Artificial Sequence
  Description of Artificial Sequence: Synthetic oligonucleotide
tacaatgatgtcgaccgtgatcacggacgc

SEQ ID NO: 339987 - DNA, 29 bp, Artificial Sequence
  Description of Artificial Sequence: Synthetic oligonucleotide
acaatgatgtcgaccgtgatcacggacgc

SEQ ID NO: 339988 - DNA, 28 bp, Artificial Sequence
  Description of Artificial Sequence: Synthetic oligonucleotide
caatgatgtcgaccgtgatcacggacgc

SEQ ID NO: 339989 - DNA, 30 bp, Artificial Sequence
  Description of Artificial Sequence: Synthetic oligonucleotide
aatgatgtcgaccgtgatcacggacgcttc

SEQ ID NO: 339990 - DNA, 29 bp, Artificial Sequence
  Description of Artificial Sequence: Synthetic oligonucleotide
atgatgtcgaccgtgatcacggacgcttc

SEQ ID NO: 339991 - DNA, 28 bp, Artificial Sequence
  Description of Artificial Sequence: Synthetic oligonucleotide
tgatgtcgaccgtgatcacggacgcttc

SEQ ID NO: 339992 - DNA, 27 bp, Artificial Sequence
  Description of Artificial Sequence: Synthetic oligonucleotide
gatgtcgaccgtgatcacggacgcttc

SEQ ID NO: 339993 - DNA, 27 bp, Artificial Sequence
  Description of Artificial Sequence: Synthetic oligonucleotide
atgtcgaccgtgatcacggacgcttcc

SEQ ID NO: 339994 - DNA, 26 bp, Artificial Sequence
  Description of Artificial Sequence: Synthetic oligonucleotide
tgtcgaccgtgatcacggacgcttcc

SEQ ID NO: 339995 - DNA, 25 bp, Artificial Sequence
  Description of Artificial Sequence: Synthetic oligonucleotide
gtcgaccgtgatcacggacgcttcc

SEQ ID NO: 339996 - DNA, 25 bp, Artificial Sequence
  Description of Artificial Sequence: Synthetic oligonucleotide
tcgaccgtgatcacggacgcttccc

SEQ ID NO: 339997 - DNA, 24 bp, Artificial Sequence
  Description of Artificial Sequence: Synthetic oligonucleotide
cgaccgtgatcacggacgcttccc

SEQ ID NO: 339998 - DNA, 24 bp, Artificial Sequence
  Description of Artificial Sequence: Synthetic oligonucleotide
gaccgtgatcacggacgcttcccg

SEQ ID NO: 339999 - DNA, 24 bp, Artificial Sequence
  Description of Artificial Sequence: Synthetic oligonucleotide
accgtgatcacggacgcttcccgc

SEQ ID NO: 340000 - DNA, 23 bp, Artificial Sequence
  Description of Artificial Sequence: Synthetic oligonucleotide
ccgtgatcacggacgcttcccgc

SEQ ID NO: 340001 - DNA, 23 bp, Artificial Sequence
  Description of Artificial Sequence: Synthetic oligonucleotide
cgtgatcacggacgcttcccgcc

SEQ ID NO: 340002 - DNA, 24 bp, Artificial Sequence
  Description of Artificial Sequence: Synthetic oligonucleotide
gtgatcacggacgcttcccgccca

SEQ ID NO: 340003 - DNA, 24 bp, Artificial Sequence
  Description of Artificial Sequence: Synthetic oligonucleotide
tgatcacggacgcttcccgcccag

SEQ ID NO: 340004 - DNA, 23 bp, Artificial Sequence
  Description of Artificial Sequence: Synthetic oligonucleotide
gatcacggacgcttcccgcccag

SEQ ID NO: 340005 - DNA, 23 bp, Artificial Sequence
  Description of Artificial Sequence: Synthetic oligonucleotide
atcacggacgcttcccgcccagc

SEQ ID NO: 340006 - DNA, 22 bp, Artificial Sequence
  Description of Artificial Sequence: Synthetic oligonucleotide
tcacggacgcttcccgcccagc

SEQ ID NO: 340007 - DNA, 21 bp, Artificial Sequence
  Description of Artificial Sequence: Synthetic oligonucleotide
cacggacgcttcccgcccagc

SEQ ID NO: 340008 - DNA, 21 bp, Artificial Sequence
  Description of Artificial Sequence: Synthetic oligonucleotide
acggacgcttcccgcccagcc

SEQ ID NO: 340009 - DNA, 20 bp, Artificial Sequence
  Description of Artificial Sequence: Synthetic oligonucleotide
cggacgcttcccgcccagcc

SEQ ID NO: 340010 - DNA, 20 bp, Artificial Sequence
  Description of Artificial Sequence: Synthetic oligonucleotide
ggacgcttcccgcccagccc

SEQ ID NO: 340011 - DNA, 21 bp, Artificial Sequence
  Description of Artificial Sequence: Synthetic oligonucleotide
gacgcttcccgcccagcccca

SEQ ID NO: 340012 - DNA, 21 bp, Artificial Sequence
  Description of Artificial Sequence: Synthetic oligonucleotide
acgcttcccgcccagccccag

SEQ ID NO: 340013 - DNA, 20 bp, Artificial Sequence
  Description of Artificial Sequence: Synthetic oligonucleotide
cgcttcccgcccagccccag

SEQ ID NO: 340014 - DNA, 20 bp, Artificial Sequence
  Description of Artificial Sequence: Synthetic oligonucleotide
gcttcccgcccagccccagg

SEQ ID NO: 340015 - DNA, 20 bp, Artificial Sequence
  Description of Artificial Sequence: Synthetic oligonucleotide
cttcccgcccagccccaggc

SEQ ID NO: 340016 - DNA, 21 bp, Artificial Sequence
  Description of Artificial Sequence: Synthetic oligonucleotide
ttcccgcccagccccaggcca

SEQ ID NO: 340017 - DNA, 20 bp, Artificial Sequence
  Description of Artificial Sequence: Synthetic oligonucleotide
tcccgcccagccccaggcca

SEQ ID NO: 340018 - DNA, 20 bp, Artificial Sequence
  Description of Artificial Sequence: Synthetic oligonucleotide
cccgcccagccccaggccat

SEQ ID NO: 340019 - DNA, 20 bp, Artificial Sequence
  Description of Artificial Sequence: Synthetic oligonucleotide
ccgcccagccccaggccagt

SEQ ID NO: 340020 - DNA, 20 bp, Artificial Sequence
  Description of Artificial Sequence: Synthetic oligonucleotide
cgcccagccccaggccaggt

SEQ ID NO: 340021 - DNA, 20 bp, Artificial Sequence
  Description of Artificial Sequence: Synthetic oligonucleotide
gcccagccccaggccagggt

SEQ ID NO: 340022 - DNA, 20 bp, Artificial Sequence
  Description of Artificial Sequence: Synthetic oligonucleotide
cccagccccaggccagggct

SEQ ID NO: 340023 - DNA, 20 bp, Artificial Sequence
  Description of Artificial Sequence: Synthetic oligonucleotide
ccagccccaggccagggcct

SEQ ID NO: 340024 - DNA, 20 bp, Artificial Sequence
  Description of Artificial Sequence: Synthetic oligonucleotide
cagccccaggccagggccgt

SEQ ID NO: 340025 - DNA, 20 bp, Artificial Sequence
  Description of Artificial Sequence: Synthetic oligonucleotide
agccccaggccagggccgct

SEQ ID NO: 340026 - DNA, 20 bp, Artificial Sequence
  Description of Artificial Sequence: Synthetic oligonucleotide
gccccaggccagggccgctt

SEQ ID NO: 340027 - DNA, 20 bp, Artificial Sequence
  Description of Artificial Sequence: Synthetic oligonucleotide
ccccaggccagggccgcctt

SEQ ID NO: 340028 - DNA, 20 bp, Artificial Sequence
  Description of Artificial Sequence: Synthetic oligonucleotide
cccaggccagggccgcctgt

SEQ ID NO: 340029 - DNA, 20 bp, Artificial Sequence
  Description of Artificial Sequence: Synthetic oligonucleotide
ccaggccagggccgcctgga

SEQ ID NO: 340030 - DNA, 20 bp, Artificial Sequence
  Description of Artificial Sequence: Synthetic oligonucleotide
caggccagggccgcctggag

SEQ ID NO: 340031 - DNA, 21 bp, Artificial Sequence
  Description of Artificial Sequence: Synthetic oligonucleotide
aggccagggccgcctggagga

SEQ ID NO: 340032 - DNA, 20 bp, Artificial Sequence
  Description of Artificial Sequence: Synthetic oligonucleotide
ggccagggccgcctggagga

SEQ ID NO: 340033 - DNA, 20 bp, Artificial Sequence
  Description of Artificial Sequence: Synthetic oligonucleotide
gccagggccgcctggaggag

SEQ ID NO: 340034 - DNA, 21 bp, Artificial Sequence
  Description of Artificial Sequence: Synthetic oligonucleotide
ccagggccgcctggaggaggt

SEQ ID NO: 340035 - DNA, 21 bp, Artificial Sequence
  Description of Artificial Sequence: Synthetic oligonucleotide
cagggccgcctggaggaggtg

SEQ ID NO: 340036 - DNA, 21 bp, Artificial Sequence
  Description of Artificial Sequence: Synthetic oligonucleotide
agggccgcctggaggaggtgg

SEQ ID NO: 340037 - DNA, 20 bp, Artificial Sequence
  Description of Artificial Sequence: Synthetic oligonucleotide
gggccgcctggaggaggtgg

SEQ ID NO: 340038 - DNA, 20 bp, Artificial Sequence
  Description of Artificial Sequence: Synthetic oligonucleotide
ggccgcctggaggaggtggg

SEQ ID NO: 340039 - DNA, 20 bp, Artificial Sequence
  Description of Artificial Sequence: Synthetic oligonucleotide
gccgcctggaggaggtgggg

SEQ ID NO: 340040 - DNA, 20 bp, Artificial Sequence
  Description of Artificial Sequence: Synthetic oligonucleotide
ccgcctggaggaggtggggg

SEQ ID NO: 340041 - DNA, 20 bp, Artificial Sequence
  Description of Artificial Sequence: Synthetic oligonucleotide
cgcctggaggaggtgggggc

SEQ ID NO: 340042 - DNA, 20 bp, Artificial Sequence
  Description of Artificial Sequence: Synthetic oligonucleotide
gcctggaggaggtgggggcg

SEQ ID NO: 340043 - DNA, 21 bp, Artificial Sequence
  Description of Artificial Sequence: Synthetic oligonucleotide
cctggaggaggtgggggcggt

SEQ ID NO: 340044 - DNA, 21 bp, Artificial Sequence
  Description of Artificial Sequence: Synthetic oligonucleotide
ctggaggaggtgggggcggtg

SEQ ID NO: 340045 - DNA, 21 bp, Artificial Sequence
  Description of Artificial Sequence: Synthetic oligonucleotide
tggaggaggtgggggcggtgg

SEQ ID NO: 340046 - DNA, 20 bp, Artificial Sequence
  Description of Artificial Sequence: Synthetic oligonucleotide
ggaggaggtgggggcggtgg

SEQ ID NO: 340047 - DNA, 22 bp, Artificial Sequence
  Description of Artificial Sequence: Synthetic oligonucleotide
gaggaggtgggggcggtggcaa

SEQ ID NO: 340048 - DNA, 23 bp, Artificial Sequence
  Description of Artificial Sequence: Synthetic oligonucleotide
aggaggtgggggcggtggcaact

SEQ ID NO: 340049 - DNA, 22 bp, Artificial Sequence
  Description of Artificial Sequence: Synthetic oligonucleotide
ggaggtgggggcggtggcaact

SEQ ID NO: 340050 - DNA, 22 bp, Artificial Sequence
  Description of Artificial Sequence: Synthetic oligonucleotide
gaggtgggggcggtggcaactc

SEQ ID NO: 340051 - DNA, 23 bp, Artificial Sequence
  Description of Artificial Sequence: Synthetic oligonucleotide
aggtgggggcggtggcaactcca

SEQ ID NO: 340052 - DNA, 22 bp, Artificial Sequence
  Description of Artificial Sequence: Synthetic oligonucleotide
ggtgggggcggtggcaactcca

SEQ ID NO: 340053 - DNA, 26 bp, Artificial Sequence
  Description of Artificial Sequence: Synthetic oligonucleotide
gtgggggcggtggcaactccagtttt

SEQ ID NO: 340054 - DNA, 26 bp, Artificial Sequence
  Description of Artificial Sequence: Synthetic oligonucleotide
tgggggcggtggcaactccagttttg

SEQ ID NO: 340055 - DNA, 25 bp, Artificial Sequence
  Description of Artificial Sequence: Synthetic oligonucleotide
gggggcggtggcaactccagttttg

SEQ ID NO: 340056 - DNA, 25 bp, Artificial Sequence
  Description of Artificial Sequence: Synthetic oligonucleotide
ggggcggtggcaactccagttttgg

SEQ ID NO: 340057 - DNA, 27 bp, Artificial Sequence
  Description of Artificial Sequence: Synthetic oligonucleotide
gggcggtggcaactccagttttggcaa

SEQ ID NO: 340058 - DNA, 27 bp, Artificial Sequence
  Description of Artificial Sequence: Synthetic oligonucleotide
ggcggtggcaactccagttttggcaac

SEQ ID NO: 340059 - DNA, 28 bp, Artificial Sequence
  Description of Artificial Sequence: Synthetic oligonucleotide
gcggtggcaactccagttttggcaactc

SEQ ID NO: 340060 - DNA, 28 bp, Artificial Sequence
  Description of Artificial Sequence: Synthetic oligonucleotide
cggtggcaactccagttttggcaactcg

SEQ ID NO: 340061 - DNA, 28 bp, Artificial Sequence
  Description of Artificial Sequence: Synthetic oligonucleotide
ggtggcaactccagttttggcaactcgg

SEQ ID NO: 340062 - DNA, 29 bp, Artificial Sequence
  Description of Artificial Sequence: Synthetic oligonucleotide
gtggcaactccagttttggcaactcggac

SEQ ID NO: 340063 - DNA, 31 bp, Artificial Sequence
  Description of Artificial Sequence: Synthetic oligonucleotide
tggcaactccagttttggcaactcggacaac

SEQ ID NO: 340064 - DNA, 30 bp, Artificial Sequence
  Description of Artificial Sequence: Synthetic oligonucleotide
ggcaactccagttttggcaactcggacaac

SEQ ID NO: 340065 - DNA, 31 bp, Artificial Sequence
  Description of Artificial Sequence: Synthetic oligonucleotide
gcaactccagttttggcaactcggacaacac

SEQ ID NO: 340066 - DNA, 31 bp, Artificial Sequence
  Description of Artificial Sequence: Synthetic oligonucleotide
caactccagttttggcaactcggacaacacg

SEQ ID NO: 340067 - DNA, 31 bp, Artificial Sequence
  Description of Artificial Sequence: Synthetic oligonucleotide
aactccagttttggcaactcggacaacacgg

SEQ ID NO: 340068 - DNA, 30 bp, Artificial Sequence
  Description of Artificial Sequence: Synthetic oligonucleotide
actccagttttggcaactcggacaacacgg

SEQ ID NO: 340069 - DNA, 29 bp, Artificial Sequence
  Description of Artificial Sequence: Synthetic oligonucleotide
ctccagttttggcaactcggacaacacgg

SEQ ID NO: 340070 - DNA, 30 bp, Artificial Sequence
  Description of Artificial Sequence: Synthetic oligonucleotide
tccagttttggcaactcggacaacacggac

SEQ ID NO: 340071 - DNA, 29 bp, Artificial Sequence
  Description of Artificial Sequence: Synthetic oligonucleotide
ccagttttggcaactcggacaacacggac

SEQ ID NO: 340072 - DNA, 29 bp, Artificial Sequence
  Description of Artificial Sequence: Synthetic oligonucleotide
cagttttggcaactcggacaacacggacg

SEQ ID NO: 340073 - DNA, 30 bp, Artificial Sequence
  Description of Artificial Sequence: Synthetic oligonucleotide
agttttggcaactcggacaacacggacgac

SEQ ID NO: 340074 - DNA, 29 bp, Artificial Sequence
  Description of Artificial Sequence: Synthetic oligonucleotide
gttttggcaactcggacaacacggacgac

SEQ ID NO: 340075 - DNA, 30 bp, Artificial Sequence
  Description of Artificial Sequence: Synthetic oligonucleotide
ttttggcaactcggacaacacggacgacag

SEQ ID NO: 340076 - DNA, 29 bp, Artificial Sequence
  Description of Artificial Sequence: Synthetic oligonucleotide
tttggcaactcggacaacacggacgacag

SEQ ID NO: 340077 - DNA, 28 bp, Artificial Sequence
  Description of Artificial Sequence: Synthetic oligonucleotide
ttggcaactcggacaacacggacgacag

SEQ ID NO: 340078 - DNA, 27 bp, Artificial Sequence
  Description of Artificial Sequence: Synthetic oligonucleotide
tggcaactcggacaacacggacgacag

SEQ ID NO: 340079 - DNA, 26 bp, Artificial Sequence
  Description of Artificial Sequence: Synthetic oligonucleotide
ggcaactcggacaacacggacgacag

SEQ ID NO: 340080 - DNA, 27 bp, Artificial Sequence
  Description of Artificial Sequence: Synthetic oligonucleotide
gcaactcggacaacacggacgacaggt

SEQ ID NO: 340081 - DNA, 27 bp, Artificial Sequence
  Description of Artificial Sequence: Synthetic oligonucleotide
caactcggacaacacggacgacaggtc

SEQ ID NO: 340082 - DNA, 27 bp, Artificial Sequence
  Description of Artificial Sequence: Synthetic oligonucleotide
aactcggacaacacggacgacaggtcg

SEQ ID NO: 340083 - DNA, 27 bp, Artificial Sequence
  Description of Artificial Sequence: Synthetic oligonucleotide
actcggacaacacggacgacaggtcga

SEQ ID NO: 340084 - DNA, 26 bp, Artificial Sequence
  Description of Artificial Sequence: Synthetic oligonucleotide
ctcggacaacacggacgacaggtcga

SEQ ID NO: 340085 - DNA, 27 bp, Artificial Sequence
  Description of Artificial Sequence: Synthetic oligonucleotide
tcggacaacacggacgacaggtcgaga

SEQ ID NO: 340086 - DNA, 27 bp, Artificial Sequence
  Description of Artificial Sequence: Synthetic oligonucleotide
cggacaacacggacgacaggtcgagat

SEQ ID NO: 340087 - DNA, 27 bp, Artificial Sequence
  Description of Artificial Sequence: Synthetic oligonucleotide
ggacaacacggacgacaggtcgagatc

SEQ ID NO: 340088 - DNA, 28 bp, Artificial Sequence
  Description of Artificial Sequence: Synthetic oligonucleotide
gacaacacggacgacaggtcgagatcac

SEQ ID NO: 340089 - DNA, 28 bp, Artificial Sequence
  Description of Artificial Sequence: Synthetic oligonucleotide
acaacacggacgacaggtcgagatcacc

SEQ ID NO: 340090 - DNA, 27 bp, Artificial Sequence
  Description of Artificial Sequence: Synthetic oligonucleotide
caacacggacgacaggtcgagatcacc

SEQ ID NO: 340091 - DNA, 30 bp, Artificial Sequence
  Description of Artificial Sequence: Synthetic oligonucleotide
aacacggacgacaggtcgagatcacctttc

SEQ ID NO: 340092 - DNA, 29 bp, Artificial Sequence
  Description of Artificial Sequence: Synthetic oligonucleotide
acacggacgacaggtcgagatcacctttc

SEQ ID NO: 340093 - DNA, 28 bp, Artificial Sequence
  Description of Artificial Sequence: Synthetic oligonucleotide
cacggacgacaggtcgagatcacctttc

SEQ ID NO: 340094 - DNA, 30 bp, Artificial Sequence
  Description of Artificial Sequence: Synthetic oligonucleotide
acggacgacaggtcgagatcacctttcaac

SEQ ID NO: 340095 - DNA, 29 bp, Artificial Sequence
  Description of Artificial Sequence: Synthetic oligonucleotide
cggacgacaggtcgagatcacctttcaac

SEQ ID NO: 340096 - DNA, 29 bp, Artificial Sequence
  Description of Artificial Sequence: Synthetic oligonucleotide
ggacgacaggtcgagatcacctttcaacg

SEQ ID NO: 340097 - DNA, 32 bp, Artificial Sequence
  Description of Artificial Sequence: Synthetic oligonucleotide
gacgacaggtcgagatcacctttcaacgtaag

SEQ ID NO: 340098 - DNA, 32 bp, Artificial Sequence
  Description of Artificial Sequence: Synthetic oligonucleotide
acgacaggtcgagatcacctttcaacgtaagg

SEQ ID NO: 340099 - DNA, 31 bp, Artificial Sequence
  Description of Artificial Sequence: Synthetic oligonucleotide
cgacaggtcgagatcacctttcaacgtaagg

SEQ ID NO: 340100 - DNA, 31 bp, Artificial Sequence
  Description of Artificial Sequence: Synthetic oligonucleotide
gacaggtcgagatcacctttcaacgtaaggc

SEQ ID NO: 340101 - DNA, 34 bp, Artificial Sequence
  Description of Artificial Sequence: Synthetic oligonucleotide
acaggtcgagatcacctttcaacgtaaggcaatc

SEQ ID NO: 340102 - DNA, 33 bp, Artificial Sequence
  Description of Artificial Sequence: Synthetic oligonucleotide
caggtcgagatcacctttcaacgtaaggcaatc

SEQ ID NO: 340103 - DNA, 33 bp, Artificial Sequence
  Description of Artificial Sequence: Synthetic oligonucleotide
aggtcgagatcacctttcaacgtaaggcaatcc

SEQ ID NO: 340104 - DNA, 32 bp, Artificial Sequence
  Description of Artificial Sequence: Synthetic oligonucleotide
ggtcgagatcacctttcaacgtaaggcaatcc

SEQ ID NO: 340105 - DNA, 33 bp, Artificial Sequence
  Description of Artificial Sequence: Synthetic oligonucleotide
gtcgagatcacctttcaacgtaaggcaatccac

SEQ ID NO: 340106 - DNA, 33 bp, Artificial Sequence
  Description of Artificial Sequence: Synthetic oligonucleotide
tcgagatcacctttcaacgtaaggcaatccacc

SEQ ID NO: 340107 - DNA, 32 bp, Artificial Sequence
  Description of Artificial Sequence: Synthetic oligonucleotide
cgagatcacctttcaacgtaaggcaatccacc

SEQ ID NO: 340108 - DNA, 37 bp, Artificial Sequence
  Description of Artificial Sequence: Synthetic oligonucleotide
gagatcacctttcaacgtaaggcaatccaccaatatg

SEQ ID NO: 340109 - DNA, 37 bp, Artificial Sequence
  Description of Artificial Sequence: Synthetic oligonucleotide
agatcacctttcaacgtaaggcaatccaccaatatgg

SEQ ID NO: 340110 - DNA, 36 bp, Artificial Sequence
  Description of Artificial Sequence: Synthetic oligonucleotide
gatcacctttcaacgtaaggcaatccaccaatatgg

SEQ ID NO: 340111 - DNA, 38 bp, Artificial Sequence
  Description of Artificial Sequence: Synthetic oligonucleotide
atcacctttcaacgtaaggcaatccaccaatatggttg

SEQ ID NO: 340112 - DNA, 37 bp, Artificial Sequence
  Description of Artificial Sequence: Synthetic oligonucleotide
tcacctttcaacgtaaggcaatccaccaatatggttg

SEQ ID NO: 340113 - DNA, 36 bp, Artificial Sequence
  Description of Artificial Sequence: Synthetic oligonucleotide
cacctttcaacgtaaggcaatccaccaatatggttg

SEQ ID NO: 340114 - DNA, 36 bp, Artificial Sequence
  Description of Artificial Sequence: Synthetic oligonucleotide
acctttcaacgtaaggcaatccaccaatatggttgc

SEQ ID NO: 340115 - DNA, 35 bp, Artificial Sequence
  Description of Artificial Sequence: Synthetic oligonucleotide
cctttcaacgtaaggcaatccaccaatatggttgc

SEQ ID NO: 340116 - DNA, 41 bp, Artificial Sequence
  Description of Artificial Sequence: Synthetic oligonucleotide
ctttcaacgtaaggcaatccaccaatatggttgcaaaaatc

SEQ ID NO: 340117 - DNA, 41 bp, Artificial Sequence
  Description of Artificial Sequence: Synthetic oligonucleotide
tttcaacgtaaggcaatccaccaatatggttgcaaaaatcc

SEQ ID NO: 340118 - DNA, 40 bp, Artificial Sequence
  Description of Artificial Sequence: Synthetic oligonucleotide
ttcaacgtaaggcaatccaccaatatggttgcaaaaatcc

SEQ ID NO: 340119 - DNA, 39 bp, Artificial Sequence
  Description of Artificial Sequence: Synthetic oligonucleotide
tcaacgtaaggcaatccaccaatatggttgcaaaaatcc

SEQ ID NO: 340120 - DNA, 38 bp, Artificial Sequence
  Description of Artificial Sequence: Synthetic oligonucleotide
caacgtaaggcaatccaccaatatggttgcaaaaatcc

SEQ ID NO: 340121 - DNA, 39 bp, Artificial Sequence
  Description of Artificial Sequence: Synthetic oligonucleotide
aacgtaaggcaatccaccaatatggttgcaaaaatcctg

SEQ ID NO: 340122 - DNA, 38 bp, Artificial Sequence
  Description of Artificial Sequence: Synthetic oligonucleotide
acgtaaggcaatccaccaatatggttgcaaaaatcctg

SEQ ID NO: 340123 - DNA, 37 bp, Artificial Sequence
  Description of Artificial Sequence: Synthetic oligonucleotide
cgtaaggcaatccaccaatatggttgcaaaaatcctg

SEQ ID NO: 340124 - DNA, 38 bp, Artificial Sequence
  Description of Artificial Sequence: Synthetic oligonucleotide
gtaaggcaatccaccaatatggttgcaaaaatcctgtc

SEQ ID NO: 340125 - DNA, 39 bp, Artificial Sequence
  Description of Artificial Sequence: Synthetic oligonucleotide
taaggcaatccaccaatatggttgcaaaaatcctgtctc

SEQ ID NO: 340126 - DNA, 38 bp, Artificial Sequence
  Description of Artificial Sequence: Synthetic oligonucleotide
aaggcaatccaccaatatggttgcaaaaatcctgtctc

SEQ ID NO: 340127 - DNA, 37 bp, Artificial Sequence
  Description of Artificial Sequence: Synthetic oligonucleotide
aggcaatccaccaatatggttgcaaaaatcctgtctc

SEQ ID NO: 340128 - DNA, 36 bp, Artificial Sequence
  Description of Artificial Sequence: Synthetic oligonucleotide
ggcaatccaccaatatggttgcaaaaatcctgtctc

SEQ ID NO: 340129 - DNA, 36 bp, Artificial Sequence
  Description of Artificial Sequence: Synthetic oligonucleotide
gcaatccaccaatatggttgcaaaaatcctgtctcc

SEQ ID NO: 340130 - DNA, 36 bp, Artificial Sequence
  Description of Artificial Sequence: Synthetic oligonucleotide
caatccaccaatatggttgcaaaaatcctgtctccc

SEQ ID NO: 340131 - DNA, 38 bp, Artificial Sequence
  Description of Artificial Sequence: Synthetic oligonucleotide
aatccaccaatatggttgcaaaaatcctgtctcccaac

SEQ ID NO: 340132 - DNA, 37 bp, Artificial Sequence
  Description of Artificial Sequence: Synthetic oligonucleotide
atccaccaatatggttgcaaaaatcctgtctcccaac

SEQ ID NO: 340133 - DNA, 36 bp, Artificial Sequence
  Description of Artificial Sequence: Synthetic oligonucleotide
tccaccaatatggttgcaaaaatcctgtctcccaac

SEQ ID NO: 340134 - DNA, 35 bp, Artificial Sequence
  Description of Artificial Sequence: Synthetic oligonucleotide
ccaccaatatggttgcaaaaatcctgtctcccaac

SEQ ID NO: 340135 - DNA, 35 bp, Artificial Sequence
  Description of Artificial Sequence: Synthetic oligonucleotide
caccaatatggttgcaaaaatcctgtctcccaacg

SEQ ID NO: 340136 - DNA, 38 bp, Artificial Sequence
  Description of Artificial Sequence: Synthetic oligonucleotide
accaatatggttgcaaaaatcctgtctcccaacgtatc

SEQ ID NO: 340137 - DNA, 37 bp, Artificial Sequence
  Description of Artificial Sequence: Synthetic oligonucleotide
ccaatatggttgcaaaaatcctgtctcccaacgtatc

SEQ ID NO: 340138 - DNA, 37 bp, Artificial Sequence
  Description of Artificial Sequence: Synthetic oligonucleotide
caatatggttgcaaaaatcctgtctcccaacgtatcc

SEQ ID NO: 340139 - DNA, 37 bp, Artificial Sequence
  Description of Artificial Sequence: Synthetic oligonucleotide
aatatggttgcaaaaatcctgtctcccaacgtatccg

SEQ ID NO: 340140 - DNA, 36 bp, Artificial Sequence
  Description of Artificial Sequence: Synthetic oligonucleotide
atatggttgcaaaaatcctgtctcccaacgtatccg

SEQ ID NO: 340141 - DNA, 35 bp, Artificial Sequence
  Description of Artificial Sequence: Synthetic oligonucleotide
tatggttgcaaaaatcctgtctcccaacgtatccg

SEQ ID NO: 340142 - DNA, 34 bp, Artificial Sequence
  Description of Artificial Sequence: Synthetic oligonucleotide
atggttgcaaaaatcctgtctcccaacgtatccg

SEQ ID NO: 340143 - DNA, 33 bp, Artificial Sequence
  Description of Artificial Sequence: Synthetic oligonucleotide
tggttgcaaaaatcctgtctcccaacgtatccg

SEQ ID NO: 340144 - DNA, 32 bp, Artificial Sequence
  Description of Artificial Sequence: Synthetic oligonucleotide
ggttgcaaaaatcctgtctcccaacgtatccg

SEQ ID NO: 340145 - DNA, 33 bp, Artificial Sequence
  Description of Artificial Sequence: Synthetic oligonucleotide
gttgcaaaaatcctgtctcccaacgtatccgtc

SEQ ID NO: 340146 - DNA, 33 bp, Artificial Sequence
  Description of Artificial Sequence: Synthetic oligonucleotide
ttgcaaaaatcctgtctcccaacgtatccgtcg

SEQ ID NO: 340147 - DNA, 32 bp, Artificial Sequence
  Description of Artificial Sequence: Synthetic oligonucleotide
tgcaaaaatcctgtctcccaacgtatccgtcg

SEQ ID NO: 340148 - DNA, 31 bp, Artificial Sequence
  Description of Artificial Sequence: Synthetic oligonucleotide
gcaaaaatcctgtctcccaacgtatccgtcg

SEQ ID NO: 340149 - DNA, 32 bp, Artificial Sequence
  Description of Artificial Sequence: Synthetic oligonucleotide
caaaaatcctgtctcccaacgtatccgtcgtg

SEQ ID NO: 340150 - DNA, 32 bp, Artificial Sequence
  Description of Artificial Sequence: Synthetic oligonucleotide
aaaaatcctgtctcccaacgtatccgtcgtgg

SEQ ID NO: 340151 - DNA, 31 bp, Artificial Sequence
  Description of Artificial Sequence: Synthetic oligonucleotide
aaaatcctgtctcccaacgtatccgtcgtgg

SEQ ID NO: 340152 - DNA, 30 bp, Artificial Sequence
  Description of Artificial Sequence: Synthetic oligonucleotide
aaatcctgtctcccaacgtatccgtcgtgg

SEQ ID NO: 340153 - DNA, 29 bp, Artificial Sequence
  Description of Artificial Sequence: Synthetic oligonucleotide
aatcctgtctcccaacgtatccgtcgtgg

SEQ ID NO: 340154 - DNA, 28 bp, Artificial Sequence
  Description of Artificial Sequence: Synthetic oligonucleotide
atcctgtctcccaacgtatccgtcgtgg

SEQ ID NO: 340155 - DNA, 27 bp, Artificial Sequence
  Description of Artificial Sequence: Synthetic oligonucleotide
tcctgtctcccaacgtatccgtcgtgg

SEQ ID NO: 340156 - DNA, 27 bp, Artificial Sequence
  Description of Artificial Sequence: Synthetic oligonucleotide
cctgtctcccaacgtatccgtcgtggt

SEQ ID NO: 340157 - DNA, 27 bp, Artificial Sequence
  Description of Artificial Sequence: Synthetic oligonucleotide
ctgtctcccaacgtatccgtcgtggtg

SEQ ID NO: 340158 - DNA, 27 bp, Artificial Sequence
  Description of Artificial Sequence: Synthetic oligonucleotide
tgtctcccaacgtatccgtcgtggtgg

SEQ ID NO: 340159 - DNA, 27 bp, Artificial Sequence
  Description of Artificial Sequence: Synthetic oligonucleotide
gtctcccaacgtatccgtcgtggtggt

SEQ ID NO: 340160 - DNA, 27 bp, Artificial Sequence
  Description of Artificial Sequence: Synthetic oligonucleotide
tctcccaacgtatccgtcgtggtggtg

SEQ ID NO: 340161 - DNA, 27 bp, Artificial Sequence
  Description of Artificial Sequence: Synthetic oligonucleotide
ctcccaacgtatccgtcgtggtggtgt

SEQ ID NO: 340162 - DNA, 27 bp, Artificial Sequence
  Description of Artificial Sequence: Synthetic oligonucleotide
tcccaacgtatccgtcgtggtggtgtc

SEQ ID NO: 340163 - DNA, 27 bp, Artificial Sequence
  Description of Artificial Sequence: Synthetic oligonucleotide
cccaacgtatccgtcgtggtggtgtca

SEQ ID NO: 340164 - DNA, 27 bp, Artificial Sequence
  Description of Artificial Sequence: Synthetic oligonucleotide
ccaacgtatccgtcgtggtggtgtcac

SEQ ID NO: 340165 - DNA, 28 bp, Artificial Sequence
  Description of Artificial Sequence: Synthetic oligonucleotide
caacgtatccgtcgtggtggtgtcactg

SEQ ID NO: 340166 - DNA, 28 bp, Artificial Sequence
  Description of Artificial Sequence: Synthetic oligonucleotide
aacgtatccgtcgtggtggtgtcactgc

SEQ ID NO: 340167 - DNA, 27 bp, Artificial Sequence
  Description of Artificial Sequence: Synthetic oligonucleotide
acgtatccgtcgtggtggtgtcactgc

SEQ ID NO: 340168 - DNA, 27 bp, Artificial Sequence
  Description of Artificial Sequence: Synthetic oligonucleotide
cgtatccgtcgtggtggtgtcactgct

SEQ ID NO: 340169 - DNA, 27 bp, Artificial Sequence
  Description of Artificial Sequence: Synthetic oligonucleotide
gtatccgtcgtggtggtgtcactgctg

SEQ ID NO: 340170 - DNA, 27 bp, Artificial Sequence
  Description of Artificial Sequence: Synthetic oligonucleotide
tatccgtcgtggtggtgtcactgctgg

SEQ ID NO: 340171 - DNA, 26 bp, Artificial Sequence
  Description of Artificial Sequence: Synthetic oligonucleotide
atccgtcgtggtggtgtcactgctgg

SEQ ID NO: 340172 - DNA, 25 bp, Artificial Sequence
  Description of Artificial Sequence: Synthetic oligonucleotide
tccgtcgtggtggtgtcactgctgg

SEQ ID NO: 340173 - DNA, 24 bp, Artificial Sequence
  Description of Artificial Sequence: Synthetic oligonucleotide
ccgtcgtggtggtgtcactgctgg

SEQ ID NO: 340174 - DNA, 25 bp, Artificial Sequence
  Description of Artificial Sequence: Synthetic oligonucleotide
cgtcgtggtggtgtcactgctggca

SEQ ID NO: 340175 - DNA, 25 bp, Artificial Sequence
  Description of Artificial Sequence: Synthetic oligonucleotide
gtcgtggtggtgtcactgctggcag

SEQ ID NO: 340176 - DNA, 26 bp, Artificial Sequence
  Description of Artificial Sequence: Synthetic oligonucleotide
tcgtggtggtgtcactgctggcagca

SEQ ID NO: 340177 - DNA, 25 bp, Artificial Sequence
  Description of Artificial Sequence: Synthetic oligonucleotide
cgtggtggtgtcactgctggcagca

SEQ ID NO: 340178 - DNA, 25 bp, Artificial Sequence
  Description of Artificial Sequence: Synthetic oligonucleotide
gtggtggtgtcactgctggcagcag

SEQ ID NO: 340179 - DNA, 26 bp, Artificial Sequence
  Description of Artificial Sequence: Synthetic oligonucleotide
tggtggtgtcactgctggcagcagca

SEQ ID NO: 340180 - DNA, 25 bp, Artificial Sequence
  Description of Artificial Sequence: Synthetic oligonucleotide
ggtggtgtcactgctggcagcagca

SEQ ID NO: 340181 - DNA, 25 bp, Artificial Sequence
  Description of Artificial Sequence: Synthetic oligonucleotide
gtggtgtcactgctggcagcagcag

SEQ ID NO: 340182 - DNA, 25 bp, Artificial Sequence
  Description of Artificial Sequence: Synthetic oligonucleotide
tggtgtcactgctggcagcagcagc

SEQ ID NO: 340183 - DNA, 24 bp, Artificial Sequence
  Description of Artificial Sequence: Synthetic oligonucleotide
ggtgtcactgctggcagcagcagc

SEQ ID NO: 340184 - DNA, 25 bp, Artificial Sequence
  Description of Artificial Sequence: Synthetic oligonucleotide
gtgtcactgctggcagcagcagcga

SEQ ID NO: 340185 - DNA, 27 bp, Artificial Sequence
  Description of Artificial Sequence: Synthetic oligonucleotide
tgtcactgctggcagcagcagcgagtt

SEQ ID NO: 340186 - DNA, 27 bp, Artificial Sequence
  Description of Artificial Sequence: Synthetic oligonucleotide
gtcactgctggcagcagcagcgagtta

SEQ ID NO: 340187 - DNA, 30 bp, Artificial Sequence
  Description of Artificial Sequence: Synthetic oligonucleotide
tcactgctggcagcagcagcgagttatttc

SEQ ID NO: 340188 - DNA, 29 bp, Artificial Sequence
  Description of Artificial Sequence: Synthetic oligonucleotide
cactgctggcagcagcagcgagttatttc

SEQ ID NO: 340189 - DNA, 32 bp, Artificial Sequence
  Description of Artificial Sequence: Synthetic oligonucleotide
actgctggcagcagcagcgagttatttctaac

SEQ ID NO: 340190 - DNA, 31 bp, Artificial Sequence
  Description of Artificial Sequence: Synthetic oligonucleotide
ctgctggcagcagcagcgagttatttctaac

SEQ ID NO: 340191 - DNA, 35 bp, Artificial Sequence
  Description of Artificial Sequence: Synthetic oligonucleotide
tgctggcagcagcagcgagttatttctaactaaac

SEQ ID NO: 340192 - DNA, 34 bp, Artificial Sequence
  Description of Artificial Sequence: Synthetic oligonucleotide
gctggcagcagcagcgagttatttctaactaaac

SEQ ID NO: 340193 - DNA, 38 bp, Artificial Sequence
  Description of Artificial Sequence: Synthetic oligonucleotide
ctggcagcagcagcgagttatttctaactaaacattag

SEQ ID NO: 340194 - DNA, 38 bp, Artificial Sequence
  Description of Artificial Sequence: Synthetic oligonucleotide
tggcagcagcagcgagttatttctaactaaacattagg

SEQ ID NO: 340195 - DNA, 37 bp, Artificial Sequence
  Description of Artificial Sequence: Synthetic oligonucleotide
ggcagcagcagcgagttatttctaactaaacattagg

SEQ ID NO: 340196 - DNA, 38 bp, Artificial Sequence
  Description of Artificial Sequence: Synthetic oligonucleotide
gcagcagcagcgagttatttctaactaaacattaggag

SEQ ID NO: 340197 - DNA, 43 bp, Artificial Sequence
  Description of Artificial Sequence: Synthetic oligonucleotide
cagcagcagcgagttatttctaactaaacattaggagaaaatg

SEQ ID NO: 340198 - DNA, 46 bp, Artificial Sequence
  Description of Artificial Sequence: Synthetic oligonucleotide
agcagcagcgagttatttctaactaaacattaggagaaaatgtttc

SEQ ID NO: 340199 - DNA, 45 bp, Artificial Sequence
  Description of Artificial Sequence: Synthetic oligonucleotide
gcagcagcgagttatttctaactaaacattaggagaaaatgtttc

SEQ ID NO: 340200 - DNA, 46 bp, Artificial Sequence
  Description of Artificial Sequence: Synthetic oligonucleotide
cagcagcgagttatttctaactaaacattaggagaaaatgtttcag

SEQ ID NO: 340201 - DNA, 46 bp, Artificial Sequence
  Description of Artificial Sequence: Synthetic oligonucleotide
agcagcgagttatttctaactaaacattaggagaaaatgtttcagg

SEQ ID NO: 340202 - DNA, 45 bp, Artificial Sequence
  Description of Artificial Sequence: Synthetic oligonucleotide
gcagcgagttatttctaactaaacattaggagaaaatgtttcagg

SEQ ID NO: 340203 - DNA, 46 bp, Artificial Sequence
  Description of Artificial Sequence: Synthetic oligonucleotide
cagcgagttatttctaactaaacattaggagaaaatgtttcaggtc

SEQ ID NO: 340204 - DNA, 46 bp, Artificial Sequence
  Description of Artificial Sequence: Synthetic oligonucleotide
agcgagttatttctaactaaacattaggagaaaatgtttcaggtcc

SEQ ID NO: 340205 - DNA, 45 bp, Artificial Sequence
  Description of Artificial Sequence: Synthetic oligonucleotide
gcgagttatttctaactaaacattaggagaaaatgtttcaggtcc

SEQ ID NO: 340206 - DNA, 45 bp, Artificial Sequence
  Description of Artificial Sequence: Synthetic oligonucleotide
cgagttatttctaactaaacattaggagaaaatgtttcaggtccc

SEQ ID NO: 340207 - DNA, 47 bp, Artificial Sequence
  Description of Artificial Sequence: Synthetic oligonucleotide
gagttatttctaactaaacattaggagaaaatgtttcaggtcccatg

SEQ ID NO: 340208 - DNA, 49 bp, Artificial Sequence
  Description of Artificial Sequence: Synthetic oligonucleotide
agttatttctaactaaacattaggagaaaatgtttcaggtcccatgaac

SEQ ID NO: 340209 - DNA, 48 bp, Artificial Sequence
  Description of Artificial Sequence: Synthetic oligonucleotide
gttatttctaactaaacattaggagaaaatgtttcaggtcccatgaac

SEQ ID NO: 340210 - DNA, 48 bp, Artificial Sequence
  Description of Artificial Sequence: Synthetic oligonucleotide
ttatttctaactaaacattaggagaaaatgtttcaggtcccatgaacg

SEQ ID NO: 340211 - DNA, 47 bp, Artificial Sequence
  Description of Artificial Sequence: Synthetic oligonucleotide
tatttctaactaaacattaggagaaaatgtttcaggtcccatgaacg

SEQ ID NO: 340212 - DNA, 46 bp, Artificial Sequence
  Description of Artificial Sequence: Synthetic oligonucleotide
atttctaactaaacattaggagaaaatgtttcaggtcccatgaacg

SEQ ID NO: 340213 - DNA, 45 bp, Artificial Sequence
  Description of Artificial Sequence: Synthetic oligonucleotide
tttctaactaaacattaggagaaaatgtttcaggtcccatgaacg

SEQ ID NO: 340214 - DNA, 44 bp, Artificial Sequence
  Description of Artificial Sequence: Synthetic oligonucleotide
ttctaactaaacattaggagaaaatgtttcaggtcccatgaacg

SEQ ID NO: 340215 - DNA, 43 bp, Artificial Sequence
  Description of Artificial Sequence: Synthetic oligonucleotide
tctaactaaacattaggagaaaatgtttcaggtcccatgaacg

SEQ ID NO: 340216 - DNA, 42 bp, Artificial Sequence
  Description of Artificial Sequence: Synthetic oligonucleotide
ctaactaaacattaggagaaaatgtttcaggtcccatgaacg

SEQ ID NO: 340217 - DNA, 43 bp, Artificial Sequence
  Description of Artificial Sequence: Synthetic oligonucleotide
taactaaacattaggagaaaatgtttcaggtcccatgaacgag

SEQ ID NO: 340218 - DNA, 42 bp, Artificial Sequence
  Description of Artificial Sequence: Synthetic oligonucleotide
aactaaacattaggagaaaatgtttcaggtcccatgaacgag

SEQ ID NO: 340219 - DNA, 41 bp, Artificial Sequence
  Description of Artificial Sequence: Synthetic oligonucleotide
actaaacattaggagaaaatgtttcaggtcccatgaacgag

SEQ ID NO: 340220 - DNA, 40 bp, Artificial Sequence
  Description of Artificial Sequence: Synthetic oligonucleotide
ctaaacattaggagaaaatgtttcaggtcccatgaacgag

SEQ ID NO: 340221 - DNA, 45 bp, Artificial Sequence
  Description of Artificial Sequence: Synthetic oligonucleotide
taaacattaggagaaaatgtttcaggtcccatgaacgagaaaatg

SEQ ID NO: 340222 - DNA, 44 bp, Artificial Sequence
  Description of Artificial Sequence: Synthetic oligonucleotide
aaacattaggagaaaatgtttcaggtcccatgaacgagaaaatg

SEQ ID NO: 340223 - DNA, 43 bp, Artificial Sequence
  Description of Artificial Sequence: Synthetic oligonucleotide
aacattaggagaaaatgtttcaggtcccatgaacgagaaaatg

SEQ ID NO: 340224 - DNA, 42 bp, Artificial Sequence
  Description of Artificial Sequence: Synthetic oligonucleotide
acattaggagaaaatgtttcaggtcccatgaacgagaaaatg

SEQ ID NO: 340225 - DNA, 41 bp, Artificial Sequence
  Description of Artificial Sequence: Synthetic oligonucleotide
cattaggagaaaatgtttcaggtcccatgaacgagaaaatg

SEQ ID NO: 340226 - DNA, 42 bp, Artificial Sequence
  Description of Artificial Sequence: Synthetic oligonucleotide
attaggagaaaatgtttcaggtcccatgaacgagaaaatgtg

SEQ ID NO: 340227 - DNA, 41 bp, Artificial Sequence
  Description of Artificial Sequence: Synthetic oligonucleotide
ttaggagaaaatgtttcaggtcccatgaacgagaaaatgtg

SEQ ID NO: 340228 - DNA, 40 bp, Artificial Sequence
  Description of Artificial Sequence: Synthetic oligonucleotide
taggagaaaatgtttcaggtcccatgaacgagaaaatgtg

SEQ ID NO: 340229 - DNA, 39 bp, Artificial Sequence
  Description of Artificial Sequence: Synthetic oligonucleotide
aggagaaaatgtttcaggtcccatgaacgagaaaatgtg

SEQ ID NO: 340230 - DNA, 38 bp, Artificial Sequence
  Description of Artificial Sequence: Synthetic oligonucleotide
ggagaaaatgtttcaggtcccatgaacgagaaaatgtg

SEQ ID NO: 340231 - DNA, 39 bp, Artificial Sequence
  Description of Artificial Sequence: Synthetic oligonucleotide
gagaaaatgtttcaggtcccatgaacgagaaaatgtgtg

SEQ ID NO: 340232 - DNA, 35 bp, Artificial Sequence
  Description of Artificial Sequence: Synthetic oligonucleotide
atgggtgagatcaacgagatgaagacaacttgtgg

SEQ ID NO: 340233 - DNA, 34 bp, Artificial Sequence
  Description of Artificial Sequence: Synthetic oligonucleotide
tgggtgagatcaacgagatgaagacaacttgtgg

SEQ ID NO: 340234 - DNA, 33 bp, Artificial Sequence
  Description of Artificial Sequence: Synthetic oligonucleotide
gggtgagatcaacgagatgaagacaacttgtgg

SEQ ID NO: 340235 - DNA, 33 bp, Artificial Sequence
  Description of Artificial Sequence: Synthetic oligonucleotide
ggtgagatcaacgagatgaagacaacttgtggc

SEQ ID NO: 340236 - DNA, 34 bp, Artificial Sequence
  Description of Artificial Sequence: Synthetic oligonucleotide
gtgagatcaacgagatgaagacaacttgtggcac

SEQ ID NO: 340237 - DNA, 34 bp, Artificial Sequence
  Description of Artificial Sequence: Synthetic oligonucleotide
tgagatcaacgagatgaagacaacttgtggcacc

SEQ ID NO: 340238 - DNA, 33 bp, Artificial Sequence
  Description of Artificial Sequence: Synthetic oligonucleotide
gagatcaacgagatgaagacaacttgtggcacc

SEQ ID NO: 340239 - DNA, 33 bp, Artificial Sequence
  Description of Artificial Sequence: Synthetic oligonucleotide
agatcaacgagatgaagacaacttgtggcaccc

SEQ ID NO: 340240 - DNA, 32 bp, Artificial Sequence
  Description of Artificial Sequence: Synthetic oligonucleotide
gatcaacgagatgaagacaacttgtggcaccc

SEQ ID NO: 340241 - DNA, 35 bp, Artificial Sequence
  Description of Artificial Sequence: Synthetic oligonucleotide
atcaacgagatgaagacaacttgtggcaccctttg

SEQ ID NO: 340242 - DNA, 34 bp, Artificial Sequence
  Description of Artificial Sequence: Synthetic oligonucleotide
tcaacgagatgaagacaacttgtggcaccctttg

SEQ ID NO: 340243 - DNA, 33 bp, Artificial Sequence
  Description of Artificial Sequence: Synthetic oligonucleotide
caacgagatgaagacaacttgtggcaccctttg

SEQ ID NO: 340244 - DNA, 33 bp, Artificial Sequence
  Description of Artificial Sequence: Synthetic oligonucleotide
aacgagatgaagacaacttgtggcaccctttgc

SEQ ID NO: 340245 - DNA, 32 bp, Artificial Sequence
  Description of Artificial Sequence: Synthetic oligonucleotide
acgagatgaagacaacttgtggcaccctttgc

SEQ ID NO: 340246 - DNA, 31 bp, Artificial Sequence
  Description of Artificial Sequence: Synthetic oligonucleotide
cgagatgaagacaacttgtggcaccctttgc

SEQ ID NO: 340247 - DNA, 31 bp, Artificial Sequence
  Description of Artificial Sequence: Synthetic oligonucleotide
gagatgaagacaacttgtggcaccctttgcc

SEQ ID NO: 340248 - DNA, 32 bp, Artificial Sequence
  Description of Artificial Sequence: Synthetic oligonucleotide
agatgaagacaacttgtggcaccctttgcctc

SEQ ID NO: 340249 - DNA, 31 bp, Artificial Sequence
  Description of Artificial Sequence: Synthetic oligonucleotide
gatgaagacaacttgtggcaccctttgcctc

SEQ ID NO: 340250 - DNA, 33 bp, Artificial Sequence
  Description of Artificial Sequence: Synthetic oligonucleotide
atgaagacaacttgtggcaccctttgcctcatg

SEQ ID NO: 340251 - DNA, 32 bp, Artificial Sequence
  Description of Artificial Sequence: Synthetic oligonucleotide
tgaagacaacttgtggcaccctttgcctcatg

SEQ ID NO: 340252 - DNA, 31 bp, Artificial Sequence
  Description of Artificial Sequence: Synthetic oligonucleotide
gaagacaacttgtggcaccctttgcctcatg

SEQ ID NO: 340253 - DNA, 33 bp, Artificial Sequence
  Description of Artificial Sequence: Synthetic oligonucleotide
aagacaacttgtggcaccctttgcctcatgtac

SEQ ID NO: 340254 - DNA, 32 bp, Artificial Sequence
  Description of Artificial Sequence: Synthetic oligonucleotide
agacaacttgtggcaccctttgcctcatgtac

SEQ ID NO: 340255 - DNA, 31 bp, Artificial Sequence
  Description of Artificial Sequence: Synthetic oligonucleotide
gacaacttgtggcaccctttgcctcatgtac

SEQ ID NO: 340256 - DNA, 31 bp, Artificial Sequence
  Description of Artificial Sequence: Synthetic oligonucleotide
acaacttgtggcaccctttgcctcatgtacc

SEQ ID NO: 340257 - DNA, 30 bp, Artificial Sequence
  Description of Artificial Sequence: Synthetic oligonucleotide
caacttgtggcaccctttgcctcatgtacc

SEQ ID NO: 340258 - DNA, 31 bp, Artificial Sequence
  Description of Artificial Sequence: Synthetic oligonucleotide
aacttgtggcaccctttgcctcatgtacctg

SEQ ID NO: 340259 - DNA, 30 bp, Artificial Sequence
  Description of Artificial Sequence: Synthetic oligonucleotide
acttgtggcaccctttgcctcatgtacctg

SEQ ID NO: 340260 - DNA, 29 bp, Artificial Sequence
  Description of Artificial Sequence: Synthetic oligonucleotide
cttgtggcaccctttgcctcatgtacctg

SEQ ID NO: 340261 - DNA, 29 bp, Artificial Sequence
  Description of Artificial Sequence: Synthetic oligonucleotide
ttgtggcaccctttgcctcatgtacctgc

SEQ ID NO: 340262 - DNA, 28 bp, Artificial Sequence
  Description of Artificial Sequence: Synthetic oligonucleotide
tgtggcaccctttgcctcatgtacctgc

SEQ ID NO: 340263 - DNA, 27 bp, Artificial Sequence
  Description of Artificial Sequence: Synthetic oligonucleotide
gtggcaccctttgcctcatgtacctgc

SEQ ID NO: 340264 - DNA, 28 bp, Artificial Sequence
  Description of Artificial Sequence: Synthetic oligonucleotide
tggcaccctttgcctcatgtacctgctc

SEQ ID NO: 340265 - DNA, 27 bp, Artificial Sequence
  Description of Artificial Sequence: Synthetic oligonucleotide
ggcaccctttgcctcatgtacctgctc

SEQ ID NO: 340266 - DNA, 31 bp, Artificial Sequence
  Description of Artificial Sequence: Synthetic oligonucleotide
gcaccctttgcctcatgtacctgctctttac

SEQ ID NO: 340267 - DNA, 31 bp, Artificial Sequence
  Description of Artificial Sequence: Synthetic oligonucleotide
caccctttgcctcatgtacctgctctttacc

SEQ ID NO: 340268 - DNA, 33 bp, Artificial Sequence
  Description of Artificial Sequence: Synthetic oligonucleotide
accctttgcctcatgtacctgctctttacctac

SEQ ID NO: 340269 - DNA, 32 bp, Artificial Sequence
  Description of Artificial Sequence: Synthetic oligonucleotide
ccctttgcctcatgtacctgctctttacctac

SEQ ID NO: 340270 - DNA, 36 bp, Artificial Sequence
  Description of Artificial Sequence: Synthetic oligonucleotide
cctttgcctcatgtacctgctctttacctactattg

SEQ ID NO: 340271 - DNA, 36 bp, Artificial Sequence
  Description of Artificial Sequence: Synthetic oligonucleotide
ctttgcctcatgtacctgctctttacctactattgc

SEQ ID NO: 340272 - DNA, 37 bp, Artificial Sequence
  Description of Artificial Sequence: Synthetic oligonucleotide
tttgcctcatgtacctgctctttacctactattgctg

SEQ ID NO: 340273 - DNA, 36 bp, Artificial Sequence
  Description of Artificial Sequence: Synthetic oligonucleotide
ttgcctcatgtacctgctctttacctactattgctg

SEQ ID NO: 340274 - DNA, 35 bp, Artificial Sequence
  Description of Artificial Sequence: Synthetic oligonucleotide
tgcctcatgtacctgctctttacctactattgctg

SEQ ID NO: 340275 - DNA, 34 bp, Artificial Sequence
  Description of Artificial Sequence: Synthetic oligonucleotide
gcctcatgtacctgctctttacctactattgctg

SEQ ID NO: 340276 - DNA, 34 bp, Artificial Sequence
  Description of Artificial Sequence: Synthetic oligonucleotide
cctcatgtacctgctctttacctactattgctgc

SEQ ID NO: 340277 - DNA, 36 bp, Artificial Sequence
  Description of Artificial Sequence: Synthetic oligonucleotide
ctcatgtacctgctctttacctactattgctgctac

SEQ ID NO: 340278 - DNA, 37 bp, Artificial Sequence
  Description of Artificial Sequence: Synthetic oligonucleotide
tcatgtacctgctctttacctactattgctgctactg

SEQ ID NO: 340279 - DNA, 36 bp, Artificial Sequence
  Description of Artificial Sequence: Synthetic oligonucleotide
catgtacctgctctttacctactattgctgctactg

SEQ ID NO: 340280 - DNA, 36 bp, Artificial Sequence
  Description of Artificial Sequence: Synthetic oligonucleotide
atgtacctgctctttacctactattgctgctactgg

SEQ ID NO: 340281 - DNA, 35 bp, Artificial Sequence
  Description of Artificial Sequence: Synthetic oligonucleotide
tgtacctgctctttacctactattgctgctactgg

SEQ ID NO: 340282 - DNA, 34 bp, Artificial Sequence
  Description of Artificial Sequence: Synthetic oligonucleotide
gtacctgctctttacctactattgctgctactgg

SEQ ID NO: 340283 - DNA, 34 bp, Artificial Sequence
  Description of Artificial Sequence: Synthetic oligonucleotide
tacctgctctttacctactattgctgctactggc

SEQ ID NO: 340284 - DNA, 33 bp, Artificial Sequence
  Description of Artificial Sequence: Synthetic oligonucleotide
acctgctctttacctactattgctgctactggc

SEQ ID NO: 340285 - DNA, 32 bp, Artificial Sequence
  Description of Artificial Sequence: Synthetic oligonucleotide
cctgctctttacctactattgctgctactggc

SEQ ID NO: 340286 - DNA, 33 bp, Artificial Sequence
  Description of Artificial Sequence: Synthetic oligonucleotide
ctgctctttacctactattgctgctactggctg

SEQ ID NO: 340287 - DNA, 33 bp, Artificial Sequence
  Description of Artificial Sequence: Synthetic oligonucleotide
tgctctttacctactattgctgctactggctgg

SEQ ID NO: 340288 - DNA, 32 bp, Artificial Sequence
  Description of Artificial Sequence: Synthetic oligonucleotide
gctctttacctactattgctgctactggctgg

SEQ ID NO: 340289 - DNA, 32 bp, Artificial Sequence
  Description of Artificial Sequence: Synthetic oligonucleotide
ctctttacctactattgctgctactggctggc

SEQ ID NO: 340290 - DNA, 33 bp, Artificial Sequence
  Description of Artificial Sequence: Synthetic oligonucleotide
tctttacctactattgctgctactggctggcag

SEQ ID NO: 340291 - DNA, 32 bp, Artificial Sequence
  Description of Artificial Sequence: Synthetic oligonucleotide
ctttacctactattgctgctactggctggcag

SEQ ID NO: 340292 - DNA, 32 bp, Artificial Sequence
  Description of Artificial Sequence: Synthetic oligonucleotide
tttacctactattgctgctactggctggcagg

SEQ ID NO: 340293 - DNA, 31 bp, Artificial Sequence
  Description of Artificial Sequence: Synthetic oligonucleotide
ttacctactattgctgctactggctggcagg

SEQ ID NO: 340294 - DNA, 30 bp, Artificial Sequence
  Description of Artificial Sequence: Synthetic oligonucleotide
tacctactattgctgctactggctggcagg

SEQ ID NO: 340295 - DNA, 29 bp, Artificial Sequence
  Description of Artificial Sequence: Synthetic oligonucleotide
acctactattgctgctactggctggcagg

SEQ ID NO: 340296 - DNA, 28 bp, Artificial Sequence
  Description of Artificial Sequence: Synthetic oligonucleotide
cctactattgctgctactggctggcagg

SEQ ID NO: 340297 - DNA, 28 bp, Artificial Sequence
  Description of Artificial Sequence: Synthetic oligonucleotide
ctactattgctgctactggctggcaggc

SEQ ID NO: 340298 - DNA, 28 bp, Artificial Sequence
  Description of Artificial Sequence: Synthetic oligonucleotide
tactattgctgctactggctggcaggcc

SEQ ID NO: 340299 - DNA, 27 bp, Artificial Sequence
  Description of Artificial Sequence: Synthetic oligonucleotide
actattgctgctactggctggcaggcc

SEQ ID NO: 340300 - DNA, 27 bp, Artificial Sequence
  Description of Artificial Sequence: Synthetic oligonucleotide
ctattgctgctactggctggcaggcct

SEQ ID NO: 340301 - DNA, 27 bp, Artificial Sequence
  Description of Artificial Sequence: Synthetic oligonucleotide
tattgctgctactggctggcaggcctg

SEQ ID NO: 340302 - DNA, 26 bp, Artificial Sequence
  Description of Artificial Sequence: Synthetic oligonucleotide
attgctgctactggctggcaggcctg

SEQ ID NO: 340303 - DNA, 25 bp, Artificial Sequence
  Description of Artificial Sequence: Synthetic oligonucleotide
ttgctgctactggctggcaggcctg

SEQ ID NO: 340304 - DNA, 24 bp, Artificial Sequence
  Description of Artificial Sequence: Synthetic oligonucleotide
tgctgctactggctggcaggcctg

SEQ ID NO: 340305 - DNA, 23 bp, Artificial Sequence
  Description of Artificial Sequence: Synthetic oligonucleotide
gctgctactggctggcaggcctg

SEQ ID NO: 340306 - DNA, 23 bp, Artificial Sequence
  Description of Artificial Sequence: Synthetic oligonucleotide
ctgctactggctggcaggcctgg

SEQ ID NO: 340307 - DNA, 24 bp, Artificial Sequence
  Description of Artificial Sequence: Synthetic oligonucleotide
tgctactggctggcaggcctggct

SEQ ID NO: 340308 - DNA, 23 bp, Artificial Sequence
  Description of Artificial Sequence: Synthetic oligonucleotide
gctactggctggcaggcctggct

SEQ ID NO: 340309 - DNA, 24 bp, Artificial Sequence
  Description of Artificial Sequence: Synthetic oligonucleotide
ctactggctggcaggcctggctct

SEQ ID NO: 340310 - DNA, 26 bp, Artificial Sequence
  Description of Artificial Sequence: Synthetic oligonucleotide
tactggctggcaggcctggctctcat

SEQ ID NO: 340311 - DNA, 25 bp, Artificial Sequence
  Description of Artificial Sequence: Synthetic oligonucleotide
actggctggcaggcctggctctcat

SEQ ID NO: 340312 - DNA, 24 bp, Artificial Sequence
  Description of Artificial Sequence: Synthetic oligonucleotide
ctggctggcaggcctggctctcat

SEQ ID NO: 340313 - DNA, 24 bp, Artificial Sequence
  Description of Artificial Sequence: Synthetic oligonucleotide
tggctggcaggcctggctctcatg

SEQ ID NO: 340314 - DNA, 23 bp, Artificial Sequence
  Description of Artificial Sequence: Synthetic oligonucleotide
ggctggcaggcctggctctcatg

SEQ ID NO: 340315 - DNA, 23 bp, Artificial Sequence
  Description of Artificial Sequence: Synthetic oligonucleotide
gctggcaggcctggctctcatgg

SEQ ID NO: 340316 - DNA, 24 bp, Artificial Sequence
  Description of Artificial Sequence: Synthetic oligonucleotide
ctggcaggcctggctctcatggca

SEQ ID NO: 340317 - DNA, 25 bp, Artificial Sequence
  Description of Artificial Sequence: Synthetic oligonucleotide
tggcaggcctggctctcatggcaga

SEQ ID NO: 340318 - DNA, 24 bp, Artificial Sequence
  Description of Artificial Sequence: Synthetic oligonucleotide
ggcaggcctggctctcatggcaga

SEQ ID NO: 340319 - DNA, 24 bp, Artificial Sequence
  Description of Artificial Sequence: Synthetic oligonucleotide
gcaggcctggctctcatggcagag

SEQ ID NO: 340320 - DNA, 24 bp, Artificial Sequence
  Description of Artificial Sequence: Synthetic oligonucleotide
caggcctggctctcatggcagagg

SEQ ID NO: 340321 - DNA, 24 bp, Artificial Sequence
  Description of Artificial Sequence: Synthetic oligonucleotide
aggcctggctctcatggcagaggg

SEQ ID NO: 340322 - DNA, 23 bp, Artificial Sequence
  Description of Artificial Sequence: Synthetic oligonucleotide
ggcctggctctcatggcagaggg

SEQ ID NO: 340323 - DNA, 25 bp, Artificial Sequence
  Description of Artificial Sequence: Synthetic oligonucleotide
gcctggctctcatggcagagggcat

SEQ ID NO: 340324 - DNA, 26 bp, Artificial Sequence
  Description of Artificial Sequence: Synthetic oligonucleotide
cctggctctcatggcagagggcatct

SEQ ID NO: 340325 - DNA, 26 bp, Artificial Sequence
  Description of Artificial Sequence: Synthetic oligonucleotide
ctggctctcatggcagagggcatctg

SEQ ID NO: 340326 - DNA, 27 bp, Artificial Sequence
  Description of Artificial Sequence: Synthetic oligonucleotide
tggctctcatggcagagggcatctgca

SEQ ID NO: 340327 - DNA, 26 bp, Artificial Sequence
  Description of Artificial Sequence: Synthetic oligonucleotide
ggctctcatggcagagggcatctgca

SEQ ID NO: 340328 - DNA, 26 bp, Artificial Sequence
  Description of Artificial Sequence: Synthetic oligonucleotide
gctctcatggcagagggcatctgcac

SEQ ID NO: 340329 - DNA, 26 bp, Artificial Sequence
  Description of Artificial Sequence: Synthetic oligonucleotide
ctctcatggcagagggcatctgcacg

SEQ ID NO: 340330 - DNA, 27 bp, Artificial Sequence
  Description of Artificial Sequence: Synthetic oligonucleotide
tctcatggcagagggcatctgcacgct

SEQ ID NO: 340331 - DNA, 26 bp, Artificial Sequence
  Description of Artificial Sequence: Synthetic oligonucleotide
ctcatggcagagggcatctgcacgct

SEQ ID NO: 340332 - DNA, 26 bp, Artificial Sequence
  Description of Artificial Sequence: Synthetic oligonucleotide
tcatggcagagggcatctgcacgctg

SEQ ID NO: 340333 - DNA, 25 bp, Artificial Sequence
  Description of Artificial Sequence: Synthetic oligonucleotide
catggcagagggcatctgcacgctg

SEQ ID NO: 340334 - DNA, 25 bp, Artificial Sequence
  Description of Artificial Sequence: Synthetic oligonucleotide
atggcagagggcatctgcacgctgg

SEQ ID NO: 340335 - DNA, 24 bp, Artificial Sequence
  Description of Artificial Sequence: Synthetic oligonucleotide
tggcagagggcatctgcacgctgg

SEQ ID NO: 340336 - DNA, 23 bp, Artificial Sequence
  Description of Artificial Sequence: Synthetic oligonucleotide
ggcagagggcatctgcacgctgg

SEQ ID NO: 340337 - DNA, 23 bp, Artificial Sequence
  Description of Artificial Sequence: Synthetic oligonucleotide
gcagagggcatctgcacgctggc

SEQ ID NO: 340338 - DNA, 23 bp, Artificial Sequence
  Description of Artificial Sequence: Synthetic oligonucleotide
cagagggcatctgcacgctggcc

SEQ ID NO: 340339 - DNA, 24 bp, Artificial Sequence
  Description of Artificial Sequence: Synthetic oligonucleotide
agagggcatctgcacgctggccgt

SEQ ID NO: 340340 - DNA, 23 bp, Artificial Sequence
  Description of Artificial Sequence: Synthetic oligonucleotide
gagggcatctgcacgctggccgt

SEQ ID NO: 340341 - DNA, 25 bp, Artificial Sequence
  Description of Artificial Sequence: Synthetic oligonucleotide
agggcatctgcacgctggccgtcaa

SEQ ID NO: 340342 - DNA, 24 bp, Artificial Sequence
  Description of Artificial Sequence: Synthetic oligonucleotide
gggcatctgcacgctggccgtcaa

SEQ ID NO: 340343 - DNA, 25 bp, Artificial Sequence
  Description of Artificial Sequence: Synthetic oligonucleotide
ggcatctgcacgctggccgtcaaga

SEQ ID NO: 340344 - DNA, 26 bp, Artificial Sequence
  Description of Artificial Sequence: Synthetic oligonucleotide
gcatctgcacgctggccgtcaagagt

SEQ ID NO: 340345 - DNA, 27 bp, Artificial Sequence
  Description of Artificial Sequence: Synthetic oligonucleotide
catctgcacgctggccgtcaagagtgt

SEQ ID NO: 340346 - DNA, 27 bp, Artificial Sequence
  Description of Artificial Sequence: Synthetic oligonucleotide
atctgcacgctggccgtcaagagtgtc

SEQ ID NO: 340347 - DNA, 27 bp, Artificial Sequence
  Description of Artificial Sequence: Synthetic oligonucleotide
tctgcacgctggccgtcaagagtgtct

SEQ ID NO: 340348 - DNA, 27 bp, Artificial Sequence
  Description of Artificial Sequence: Synthetic oligonucleotide
ctgcacgctggccgtcaagagtgtcta

SEQ ID NO: 340349 - DNA, 27 bp, Artificial Sequence
  Description of Artificial Sequence: Synthetic oligonucleotide
tgcacgctggccgtcaagagtgtctac

SEQ ID NO: 340350 - DNA, 27 bp, Artificial Sequence
  Description of Artificial Sequence: Synthetic oligonucleotide
gcacgctggccgtcaagagtgtctaca

SEQ ID NO: 340351 - DNA, 28 bp, Artificial Sequence
  Description of Artificial Sequence: Synthetic oligonucleotide
cacgctggccgtcaagagtgtctacatc

SEQ ID NO: 340352 - DNA, 29 bp, Artificial Sequence
  Description of Artificial Sequence: Synthetic oligonucleotide
acgctggccgtcaagagtgtctacatcag

SEQ ID NO: 340353 - DNA, 28 bp, Artificial Sequence
  Description of Artificial Sequence: Synthetic oligonucleotide
cgctggccgtcaagagtgtctacatcag

SEQ ID NO: 340354 - DNA, 28 bp, Artificial Sequence
  Description of Artificial Sequence: Synthetic oligonucleotide
gctggccgtcaagagtgtctacatcagg

SEQ ID NO: 340355 - DNA, 28 bp, Artificial Sequence
  Description of Artificial Sequence: Synthetic oligonucleotide
ctggccgtcaagagtgtctacatcaggc

SEQ ID NO: 340356 - DNA, 29 bp, Artificial Sequence
  Description of Artificial Sequence: Synthetic oligonucleotide
tggccgtcaagagtgtctacatcaggctg

SEQ ID NO: 340357 - DNA, 28 bp, Artificial Sequence
  Description of Artificial Sequence: Synthetic oligonucleotide
ggccgtcaagagtgtctacatcaggctg

SEQ ID NO: 340358 - DNA, 28 bp, Artificial Sequence
  Description of Artificial Sequence: Synthetic oligonucleotide
gccgtcaagagtgtctacatcaggctgc

SEQ ID NO: 340359 - DNA, 29 bp, Artificial Sequence
  Description of Artificial Sequence: Synthetic oligonucleotide
ccgtcaagagtgtctacatcaggctgctg

SEQ ID NO: 340360 - DNA, 29 bp, Artificial Sequence
  Description of Artificial Sequence: Synthetic oligonucleotide
cgtcaagagtgtctacatcaggctgctgg

SEQ ID NO: 340361 - DNA, 29 bp, Artificial Sequence
  Description of Artificial Sequence: Synthetic oligonucleotide
gtcaagagtgtctacatcaggctgctggc

SEQ ID NO: 340362 - DNA, 29 bp, Artificial Sequence
  Description of Artificial Sequence: Synthetic oligonucleotide
tcaagagtgtctacatcaggctgctggcc

SEQ ID NO: 340363 - DNA, 28 bp, Artificial Sequence
  Description of Artificial Sequence: Synthetic oligonucleotide
caagagtgtctacatcaggctgctggcc

SEQ ID NO: 340364 - DNA, 29 bp, Artificial Sequence
  Description of Artificial Sequence: Synthetic oligonucleotide
aagagtgtctacatcaggctgctggccac

SEQ ID NO: 340365 - DNA, 28 bp, Artificial Sequence
  Description of Artificial Sequence: Synthetic oligonucleotide
agagtgtctacatcaggctgctggccac

SEQ ID NO: 340366 - DNA, 27 bp, Artificial Sequence
  Description of Artificial Sequence: Synthetic oligonucleotide
gagtgtctacatcaggctgctggccac

SEQ ID NO: 340367 - DNA, 28 bp, Artificial Sequence
  Description of Artificial Sequence: Synthetic oligonucleotide
agtgtctacatcaggctgctggccacag

SEQ ID NO: 340368 - DNA, 27 bp, Artificial Sequence
  Description of Artificial Sequence: Synthetic oligonucleotide
gtgtctacatcaggctgctggccacag

SEQ ID NO: 340369 - DNA, 27 bp, Artificial Sequence
  Description of Artificial Sequence: Synthetic oligonucleotide
tgtctacatcaggctgctggccacagg

SEQ ID NO: 340370 - DNA, 26 bp, Artificial Sequence
  Description of Artificial Sequence: Synthetic oligonucleotide
gtctacatcaggctgctggccacagg

SEQ ID NO: 340371 - DNA, 27 bp, Artificial Sequence
  Description of Artificial Sequence: Synthetic oligonucleotide
tctacatcaggctgctggccacaggca

SEQ ID NO: 340372 - DNA, 26 bp, Artificial Sequence
  Description of Artificial Sequence: Synthetic oligonucleotide
ctacatcaggctgctggccacaggca

SEQ ID NO: 340373 - DNA, 26 bp, Artificial Sequence
  Description of Artificial Sequence: Synthetic oligonucleotide
tacatcaggctgctggccacaggcac

SEQ ID NO: 340374 - DNA, 25 bp, Artificial Sequence
  Description of Artificial Sequence: Synthetic oligonucleotide
acatcaggctgctggccacaggcac

SEQ ID NO: 340375 - DNA, 24 bp, Artificial Sequence
  Description of Artificial Sequence: Synthetic oligonucleotide
catcaggctgctggccacaggcac

SEQ ID NO: 340376 - DNA, 26 bp, Artificial Sequence
  Description of Artificial Sequence: Synthetic oligonucleotide
atcaggctgctggccacaggcacctt

SEQ ID NO: 340377 - DNA, 25 bp, Artificial Sequence
  Description of Artificial Sequence: Synthetic oligonucleotide
tcaggctgctggccacaggcacctt

SEQ ID NO: 340378 - DNA, 24 bp, Artificial Sequence
  Description of Artificial Sequence: Synthetic oligonucleotide
caggctgctggccacaggcacctt

SEQ ID NO: 340379 - DNA, 24 bp, Artificial Sequence
  Description of Artificial Sequence: Synthetic oligonucleotide
aggctgctggccacaggcaccttc

SEQ ID NO: 340380 - DNA, 23 bp, Artificial Sequence
  Description of Artificial Sequence: Synthetic oligonucleotide
ggctgctggccacaggcaccttc

SEQ ID NO: 340381 - DNA, 24 bp, Artificial Sequence
  Description of Artificial Sequence: Synthetic oligonucleotide
gctgctggccacaggcaccttcct

SEQ ID NO: 340382 - DNA, 24 bp, Artificial Sequence
  Description of Artificial Sequence: Synthetic oligonucleotide
ctgctggccacaggcaccttcctg

SEQ ID NO: 340383 - DNA, 24 bp, Artificial Sequence
  Description of Artificial Sequence: Synthetic oligonucleotide
tgctggccacaggcaccttcctgg

SEQ ID NO: 340384 - DNA, 23 bp, Artificial Sequence
  Description of Artificial Sequence: Synthetic oligonucleotide
gctggccacaggcaccttcctgg

SEQ ID NO: 340385 - DNA, 23 bp, Artificial Sequence
  Description of Artificial Sequence: Synthetic oligonucleotide
ctggccacaggcaccttcctggc

SEQ ID NO: 340386 - DNA, 24 bp, Artificial Sequence
  Description of Artificial Sequence: Synthetic oligonucleotide
tggccacaggcaccttcctggcca

SEQ ID NO: 340387 - DNA, 23 bp, Artificial Sequence
  Description of Artificial Sequence: Synthetic oligonucleotide
ggccacaggcaccttcctggcca

SEQ ID NO: 340388 - DNA, 24 bp, Artificial Sequence
  Description of Artificial Sequence: Synthetic oligonucleotide
gccacaggcaccttcctggccact

SEQ ID NO: 340389 - DNA, 24 bp, Artificial Sequence
  Description of Artificial Sequence: Synthetic oligonucleotide
ccacaggcaccttcctggccactg

SEQ ID NO: 340390 - DNA, 24 bp, Artificial Sequence
  Description of Artificial Sequence: Synthetic oligonucleotide
cacaggcaccttcctggccactgc

SEQ ID NO: 340391 - DNA, 26 bp, Artificial Sequence
  Description of Artificial Sequence: Synthetic oligonucleotide
acaggcaccttcctggccactgccta

SEQ ID NO: 340392 - DNA, 25 bp, Artificial Sequence
  Description of Artificial Sequence: Synthetic oligonucleotide
caggcaccttcctggccactgccta

SEQ ID NO: 340393 - DNA, 27 bp, Artificial Sequence
  Description of Artificial Sequence: Synthetic oligonucleotide
aggcaccttcctggccactgcctacat

SEQ ID NO: 340394 - DNA, 26 bp, Artificial Sequence
  Description of Artificial Sequence: Synthetic oligonucleotide
ggcaccttcctggccactgcctacat

SEQ ID NO: 340395 - DNA, 26 bp, Artificial Sequence
  Description of Artificial Sequence: Synthetic oligonucleotide
gcaccttcctggccactgcctacatc

SEQ ID NO: 340396 - DNA, 27 bp, Artificial Sequence
  Description of Artificial Sequence: Synthetic oligonucleotide
caccttcctggccactgcctacatcgt

SEQ ID NO: 340397 - DNA, 27 bp, Artificial Sequence
  Description of Artificial Sequence: Synthetic oligonucleotide
accttcctggccactgcctacatcgtg

SEQ ID NO: 340398 - DNA, 26 bp, Artificial Sequence
  Description of Artificial Sequence: Synthetic oligonucleotide
ccttcctggccactgcctacatcgtg

SEQ ID NO: 340399 - DNA, 27 bp, Artificial Sequence
  Description of Artificial Sequence: Synthetic oligonucleotide
cttcctggccactgcctacatcgtggt

SEQ ID NO: 340400 - DNA, 27 bp, Artificial Sequence
  Description of Artificial Sequence: Synthetic oligonucleotide
ttcctggccactgcctacatcgtggtg

SEQ ID NO: 340401 - DNA, 26 bp, Artificial Sequence
  Description of Artificial Sequence: Synthetic oligonucleotide
tcctggccactgcctacatcgtggtg

SEQ ID NO: 340402 - DNA, 25 bp, Artificial Sequence
  Description of Artificial Sequence: Synthetic oligonucleotide
cctggccactgcctacatcgtggtg

SEQ ID NO: 340403 - DNA, 26 bp, Artificial Sequence
  Description of Artificial Sequence: Synthetic oligonucleotide
ctggccactgcctacatcgtggtggt

SEQ ID NO: 340404 - DNA, 26 bp, Artificial Sequence
  Description of Artificial Sequence: Synthetic oligonucleotide
tggccactgcctacatcgtggtggtg

SEQ ID NO: 340405 - DNA, 25 bp, Artificial Sequence
  Description of Artificial Sequence: Synthetic oligonucleotide
ggccactgcctacatcgtggtggtg

SEQ ID NO: 340406 - DNA, 25 bp, Artificial Sequence
  Description of Artificial Sequence: Synthetic oligonucleotide
gccactgcctacatcgtggtggtgg

SEQ ID NO: 340407 - DNA, 25 bp, Artificial Sequence
  Description of Artificial Sequence: Synthetic oligonucleotide
ccactgcctacatcgtggtggtggg

SEQ ID NO: 340408 - DNA, 25 bp, Artificial Sequence
  Description of Artificial Sequence: Synthetic oligonucleotide
cactgcctacatcgtggtggtgggg

SEQ ID NO: 340409 - DNA, 25 bp, Artificial Sequence
  Description of Artificial Sequence: Synthetic oligonucleotide
actgcctacatcgtggtggtggggg

SEQ ID NO: 340410 - DNA, 24 bp, Artificial Sequence
  Description of Artificial Sequence: Synthetic oligonucleotide
ctgcctacatcgtggtggtggggg

SEQ ID NO: 340411 - DNA, 24 bp, Artificial Sequence
  Description of Artificial Sequence: Synthetic oligonucleotide
tgcctacatcgtggtggtgggggg

SEQ ID NO: 340412 - DNA, 23 bp, Artificial Sequence
  Description of Artificial Sequence: Synthetic oligonucleotide
gcctacatcgtggtggtgggggg

SEQ ID NO: 340413 - DNA, 24 bp, Artificial Sequence
  Description of Artificial Sequence: Synthetic oligonucleotide
cctacatcgtggtggtggggggca

SEQ ID NO: 340414 - DNA, 25 bp, Artificial Sequence
  Description of Artificial Sequence: Synthetic oligonucleotide
ctacatcgtggtggtggggggcact

SEQ ID NO: 340415 - DNA, 26 bp, Artificial Sequence
  Description of Artificial Sequence: Synthetic oligonucleotide
tacatcgtggtggtggggggcactgt

SEQ ID NO: 340416 - DNA, 25 bp, Artificial Sequence
  Description of Artificial Sequence: Synthetic oligonucleotide
acatcgtggtggtggggggcactgt

SEQ ID NO: 340417 - DNA, 24 bp, Artificial Sequence
  Description of Artificial Sequence: Synthetic oligonucleotide
catcgtggtggtggggggcactgt

SEQ ID NO: 340418 - DNA, 24 bp, Artificial Sequence
  Description of Artificial Sequence: Synthetic oligonucleotide
atcgtggtggtggggggcactgtg

SEQ ID NO: 340419 - DNA, 23 bp, Artificial Sequence
  Description of Artificial Sequence: Synthetic oligonucleotide
tcgtggtggtggggggcactgtg

SEQ ID NO: 340420 - DNA, 22 bp, Artificial Sequence
  Description of Artificial Sequence: Synthetic oligonucleotide
cgtggtggtggggggcactgtg

SEQ ID NO: 340421 - DNA, 23 bp, Artificial Sequence
  Description of Artificial Sequence: Synthetic oligonucleotide
gtggtggtggggggcactgtggt

SEQ ID NO: 340422 - DNA, 25 bp, Artificial Sequence
  Description of Artificial Sequence: Synthetic oligonucleotide
tggtggtggggggcactgtggtcat

SEQ ID NO: 340423 - DNA, 24 bp, Artificial Sequence
  Description of Artificial Sequence: Synthetic oligonucleotide
ggtggtggggggcactgtggtcat

SEQ ID NO: 340424 - DNA, 24 bp, Artificial Sequence
  Description of Artificial Sequence: Synthetic oligonucleotide
gtggtggggggcactgtggtcatg

SEQ ID NO: 340425 - DNA, 25 bp, Artificial Sequence
  Description of Artificial Sequence: Synthetic oligonucleotide
tggtggggggcactgtggtcatggt

SEQ ID NO: 340426 - DNA, 24 bp, Artificial Sequence
  Description of Artificial Sequence: Synthetic oligonucleotide
ggtggggggcactgtggtcatggt

SEQ ID NO: 340427 - DNA, 25 bp, Artificial Sequence
  Description of Artificial Sequence: Synthetic oligonucleotide
gtggggggcactgtggtcatggtgt

SEQ ID NO: 340428 - DNA, 26 bp, Artificial Sequence
  Description of Artificial Sequence: Synthetic oligonucleotide
tggggggcactgtggtcatggtgtct

SEQ ID NO: 340429 - DNA, 25 bp, Artificial Sequence
  Description of Artificial Sequence: Synthetic oligonucleotide
ggggggcactgtggtcatggtgtct

SEQ ID NO: 340430 - DNA, 25 bp, Artificial Sequence
  Description of Artificial Sequence: Synthetic oligonucleotide
gggggcactgtggtcatggtgtctg

SEQ ID NO: 340431 - DNA, 25 bp, Artificial Sequence
  Description of Artificial Sequence: Synthetic oligonucleotide
ggggcactgtggtcatggtgtctgg

SEQ ID NO: 340432 - DNA, 25 bp, Artificial Sequence
  Description of Artificial Sequence: Synthetic oligonucleotide
gggcactgtggtcatggtgtctggg

SEQ ID NO: 340433 - DNA, 26 bp, Artificial Sequence
  Description of Artificial Sequence: Synthetic oligonucleotide
ggcactgtggtcatggtgtctggggt

SEQ ID NO: 340434 - DNA, 27 bp, Artificial Sequence
  Description of Artificial Sequence: Synthetic oligonucleotide
gcactgtggtcatggtgtctggggtct

SEQ ID NO: 340435 - DNA, 28 bp, Artificial Sequence
  Description of Artificial Sequence: Synthetic oligonucleotide
cactgtggtcatggtgtctggggtctag

SEQ ID NO: 340436 - DNA, 28 bp, Artificial Sequence
  Description of Artificial Sequence: Synthetic oligonucleotide
actgtggtcatggtgtctggggtctagg

SEQ ID NO: 340437 - DNA, 27 bp, Artificial Sequence
  Description of Artificial Sequence: Synthetic oligonucleotide
ctgtggtcatggtgtctggggtctagg

SEQ ID NO: 340438 - DNA, 27 bp, Artificial Sequence
  Description of Artificial Sequence: Synthetic oligonucleotide
tgtggtcatggtgtctggggtctaggg

SEQ ID NO: 340439 - DNA, 26 bp, Artificial Sequence
  Description of Artificial Sequence: Synthetic oligonucleotide
gtggtcatggtgtctggggtctaggg

SEQ ID NO: 340440 - DNA, 27 bp, Artificial Sequence
  Description of Artificial Sequence: Synthetic oligonucleotide
tggtcatggtgtctggggtctagggct

SEQ ID NO: 340441 - DNA, 26 bp, Artificial Sequence
  Description of Artificial Sequence: Synthetic oligonucleotide
ggtcatggtgtctggggtctagggct

SEQ ID NO: 340442 - DNA, 26 bp, Artificial Sequence
  Description of Artificial Sequence: Synthetic oligonucleotide
gtcatggtgtctggggtctagggctg

SEQ ID NO: 340443 - DNA, 27 bp, Artificial Sequence
  Description of Artificial Sequence: Synthetic oligonucleotide
tcatggtgtctggggtctagggctgct

SEQ ID NO: 340444 - DNA, 26 bp, Artificial Sequence
  Description of Artificial Sequence: Synthetic oligonucleotide
catggtgtctggggtctagggctgct

SEQ ID NO: 340445 - DNA, 26 bp, Artificial Sequence
  Description of Artificial Sequence: Synthetic oligonucleotide
atggtgtctggggtctagggctgctg

SEQ ID NO: 340446 - DNA, 25 bp, Artificial Sequence
  Description of Artificial Sequence: Synthetic oligonucleotide
tggtgtctggggtctagggctgctg

SEQ ID NO: 340447 - DNA, 24 bp, Artificial Sequence
  Description of Artificial Sequence: Synthetic oligonucleotide
ggtgtctggggtctagggctgctg

SEQ ID NO: 340448 - DNA, 24 bp, Artificial Sequence
  Description of Artificial Sequence: Synthetic oligonucleotide
gtgtctggggtctagggctgctgg

SEQ ID NO: 340449 - DNA, 24 bp, Artificial Sequence
  Description of Artificial Sequence: Synthetic oligonucleotide
tgtctggggtctagggctgctggg

SEQ ID NO: 340450 - DNA, 23 bp, Artificial Sequence
  Description of Artificial Sequence: Synthetic oligonucleotide
gtctggggtctagggctgctggg

SEQ ID NO: 340451 - DNA, 23 bp, Artificial Sequence
  Description of Artificial Sequence: Synthetic oligonucleotide
tctggggtctagggctgctgggc

SEQ ID NO: 340452 - DNA, 22 bp, Artificial Sequence
  Description of Artificial Sequence: Synthetic oligonucleotide
ctggggtctagggctgctgggc

SEQ ID NO: 340453 - DNA, 23 bp, Artificial Sequence
  Description of Artificial Sequence: Synthetic oligonucleotide
tggggtctagggctgctgggcca

SEQ ID NO: 340454 - DNA, 22 bp, Artificial Sequence
  Description of Artificial Sequence: Synthetic oligonucleotide
ggggtctagggctgctgggcca

SEQ ID NO: 340455 - DNA, 22 bp, Artificial Sequence
  Description of Artificial Sequence: Synthetic oligonucleotide
gggtctagggctgctgggccac

SEQ ID NO: 340456 - DNA, 24 bp, Artificial Sequence
  Description of Artificial Sequence: Synthetic oligonucleotide
ggtctagggctgctgggccacctt

SEQ ID NO: 340457 - DNA, 26 bp, Artificial Sequence
  Description of Artificial Sequence: Synthetic oligonucleotide
gtctagggctgctgggccaccttcta

SEQ ID NO: 340458 - DNA, 26 bp, Artificial Sequence
  Description of Artificial Sequence: Synthetic oligonucleotide
tctagggctgctgggccaccttctag

SEQ ID NO: 340459 - DNA, 25 bp, Artificial Sequence
  Description of Artificial Sequence: Synthetic oligonucleotide
ctagggctgctgggccaccttctag

SEQ ID NO: 340460 - DNA, 26 bp, Artificial Sequence
  Description of Artificial Sequence: Synthetic oligonucleotide
tagggctgctgggccaccttctagga

SEQ ID NO: 340461 - DNA, 25 bp, Artificial Sequence
  Description of Artificial Sequence: Synthetic oligonucleotide
agggctgctgggccaccttctagga

SEQ ID NO: 340462 - DNA, 24 bp, Artificial Sequence
  Description of Artificial Sequence: Synthetic oligonucleotide
gggctgctgggccaccttctagga

SEQ ID NO: 340463 - DNA, 24 bp, Artificial Sequence
  Description of Artificial Sequence: Synthetic oligonucleotide
ggctgctgggccaccttctaggag

SEQ ID NO: 340464 - DNA, 24 bp, Artificial Sequence
  Description of Artificial Sequence: Synthetic oligonucleotide
gctgctgggccaccttctaggagc

SEQ ID NO: 340465 - DNA, 25 bp, Artificial Sequence
  Description of Artificial Sequence: Synthetic oligonucleotide
ctgctgggccaccttctaggagcgt

SEQ ID NO: 340466 - DNA, 25 bp, Artificial Sequence
  Description of Artificial Sequence: Synthetic oligonucleotide
tgctgggccaccttctaggagcgtc

SEQ ID NO: 340467 - DNA, 24 bp, Artificial Sequence
  Description of Artificial Sequence: Synthetic oligonucleotide
gctgggccaccttctaggagcgtc

SEQ ID NO: 340468 - DNA, 24 bp, Artificial Sequence
  Description of Artificial Sequence: Synthetic oligonucleotide
ctgggccaccttctaggagcgtcc

SEQ ID NO: 340469 - DNA, 26 bp, Artificial Sequence
  Description of Artificial Sequence: Synthetic oligonucleotide
tgggccaccttctaggagcgtccgaa

SEQ ID NO: 340470 - DNA, 25 bp, Artificial Sequence
  Description of Artificial Sequence: Synthetic oligonucleotide
gggccaccttctaggagcgtccgaa

SEQ ID NO: 340471 - DNA, 25 bp, Artificial Sequence
  Description of Artificial Sequence: Synthetic oligonucleotide
ggccaccttctaggagcgtccgaac

SEQ ID NO: 340472 - DNA, 26 bp, Artificial Sequence
  Description of Artificial Sequence: Synthetic oligonucleotide
gccaccttctaggagcgtccgaacct

SEQ ID NO: 340473 - DNA, 26 bp, Artificial Sequence
  Description of Artificial Sequence: Synthetic oligonucleotide
ccaccttctaggagcgtccgaacctg

SEQ ID NO: 340474 - DNA, 27 bp, Artificial Sequence
  Description of Artificial Sequence: Synthetic oligonucleotide
caccttctaggagcgtccgaacctgct

SEQ ID NO: 340475 - DNA, 27 bp, Artificial Sequence
  Description of Artificial Sequence: Synthetic oligonucleotide
accttctaggagcgtccgaacctgctc

SEQ ID NO: 340476 - DNA, 26 bp, Artificial Sequence
  Description of Artificial Sequence: Synthetic oligonucleotide
ccttctaggagcgtccgaacctgctc

SEQ ID NO: 340477 - DNA, 26 bp, Artificial Sequence
  Description of Artificial Sequence: Synthetic oligonucleotide
cttctaggagcgtccgaacctgctcc

SEQ ID NO: 340478 - DNA, 26 bp, Artificial Sequence
  Description of Artificial Sequence: Synthetic oligonucleotide
ttctaggagcgtccgaacctgctccg

SEQ ID NO: 340479 - DNA, 25 bp, Artificial Sequence
  Description of Artificial Sequence: Synthetic oligonucleotide
tctaggagcgtccgaacctgctccg

SEQ ID NO: 340480 - DNA, 24 bp, Artificial Sequence
  Description of Artificial Sequence: Synthetic oligonucleotide
ctaggagcgtccgaacctgctccg

SEQ ID NO: 340481 - DNA, 24 bp, Artificial Sequence
  Description of Artificial Sequence: Synthetic oligonucleotide
taggagcgtccgaacctgctccgc

SEQ ID NO: 340482 - DNA, 23 bp, Artificial Sequence
  Description of Artificial Sequence: Synthetic oligonucleotide
aggagcgtccgaacctgctccgc

SEQ ID NO: 340483 - DNA, 22 bp, Artificial Sequence
  Description of Artificial Sequence: Synthetic oligonucleotide
ggagcgtccgaacctgctccgc

SEQ ID NO: 340484 - DNA, 23 bp, Artificial Sequence
  Description of Artificial Sequence: Synthetic oligonucleotide
gagcgtccgaacctgctccgcct

SEQ ID NO: 340485 - DNA, 25 bp, Artificial Sequence
  Description of Artificial Sequence: Synthetic oligonucleotide
agcgtccgaacctgctccgcctgta

SEQ ID NO: 340486 - DNA, 24 bp, Artificial Sequence
  Description of Artificial Sequence: Synthetic oligonucleotide
gcgtccgaacctgctccgcctgta

SEQ ID NO: 340487 - DNA, 26 bp, Artificial Sequence
  Description of Artificial Sequence: Synthetic oligonucleotide
cgtccgaacctgctccgcctgtacat

SEQ ID NO: 340488 - DNA, 27 bp, Artificial Sequence
  Description of Artificial Sequence: Synthetic oligonucleotide
gtccgaacctgctccgcctgtacatca

SEQ ID NO: 340489 - DNA, 28 bp, Artificial Sequence
  Description of Artificial Sequence: Synthetic oligonucleotide
tccgaacctgctccgcctgtacatcatc

SEQ ID NO: 340490 - DNA, 27 bp, Artificial Sequence
  Description of Artificial Sequence: Synthetic oligonucleotide
ccgaacctgctccgcctgtacatcatc

SEQ ID NO: 340491 - DNA, 27 bp, Artificial Sequence
  Description of Artificial Sequence: Synthetic oligonucleotide
cgaacctgctccgcctgtacatcatcc

SEQ ID NO: 340492 - DNA, 28 bp, Artificial Sequence
  Description of Artificial Sequence: Synthetic oligonucleotide
gaacctgctccgcctgtacatcatcctg

SEQ ID NO: 340493 - DNA, 28 bp, Artificial Sequence
  Description of Artificial Sequence: Synthetic oligonucleotide
aacctgctccgcctgtacatcatcctgc

SEQ ID NO: 340494 - DNA, 27 bp, Artificial Sequence
  Description of Artificial Sequence: Synthetic oligonucleotide
acctgctccgcctgtacatcatcctgc

SEQ ID NO: 340495 - DNA, 27 bp, Artificial Sequence
  Description of Artificial Sequence: Synthetic oligonucleotide
cctgctccgcctgtacatcatcctgca

SEQ ID NO: 340496 - DNA, 27 bp, Artificial Sequence
  Description of Artificial Sequence: Synthetic oligonucleotide
ctgctccgcctgtacatcatcctgcac

SEQ ID NO: 340497 - DNA, 27 bp, Artificial Sequence
  Description of Artificial Sequence: Synthetic oligonucleotide
tgctccgcctgtacatcatcctgcacc

SEQ ID NO: 340498 - DNA, 27 bp, Artificial Sequence
  Description of Artificial Sequence: Synthetic oligonucleotide
gctccgcctgtacatcatcctgcacct

SEQ ID NO: 340499 - DNA, 27 bp, Artificial Sequence
  Description of Artificial Sequence: Synthetic oligonucleotide
ctccgcctgtacatcatcctgcacctc

SEQ ID NO: 340500 - DNA, 29 bp, Artificial Sequence
  Description of Artificial Sequence: Synthetic oligonucleotide
tccgcctgtacatcatcctgcacctcatc

SEQ ID NO: 340501 - DNA, 28 bp, Artificial Sequence
  Description of Artificial Sequence: Synthetic oligonucleotide
ccgcctgtacatcatcctgcacctcatc

SEQ ID NO: 340502 - DNA, 30 bp, Artificial Sequence
  Description of Artificial Sequence: Synthetic oligonucleotide
cgcctgtacatcatcctgcacctcatcatg

SEQ ID NO: 340503 - DNA, 33 bp, Artificial Sequence
  Description of Artificial Sequence: Synthetic oligonucleotide
gcctgtacatcatcctgcacctcatcatgtttc

SEQ ID NO: 340504 - DNA, 34 bp, Artificial Sequence
  Description of Artificial Sequence: Synthetic oligonucleotide
cctgtacatcatcctgcacctcatcatgtttctg

SEQ ID NO: 340505 - DNA, 34 bp, Artificial Sequence
  Description of Artificial Sequence: Synthetic oligonucleotide
ctgtacatcatcctgcacctcatcatgtttctgc

SEQ ID NO: 340506 - DNA, 35 bp, Artificial Sequence
  Description of Artificial Sequence: Synthetic oligonucleotide
tgtacatcatcctgcacctcatcatgtttctgctg

SEQ ID NO: 340507 - DNA, 34 bp, Artificial Sequence
  Description of Artificial Sequence: Synthetic oligonucleotide
gtacatcatcctgcacctcatcatgtttctgctg

SEQ ID NO: 340508 - DNA, 34 bp, Artificial Sequence
  Description of Artificial Sequence: Synthetic oligonucleotide
tacatcatcctgcacctcatcatgtttctgctgc

SEQ ID NO: 340509 - DNA, 33 bp, Artificial Sequence
  Description of Artificial Sequence: Synthetic oligonucleotide
acatcatcctgcacctcatcatgtttctgctgc

SEQ ID NO: 340510 - DNA, 32 bp, Artificial Sequence
  Description of Artificial Sequence: Synthetic oligonucleotide
catcatcctgcacctcatcatgtttctgctgc

SEQ ID NO: 340511 - DNA, 33 bp, Artificial Sequence
  Description of Artificial Sequence: Synthetic oligonucleotide
atcatcctgcacctcatcatgtttctgctgcag

SEQ ID NO: 340512 - DNA, 32 bp, Artificial Sequence
  Description of Artificial Sequence: Synthetic oligonucleotide
tcatcctgcacctcatcatgtttctgctgcag

SEQ ID NO: 340513 - DNA, 31 bp, Artificial Sequence
  Description of Artificial Sequence: Synthetic oligonucleotide
catcctgcacctcatcatgtttctgctgcag

SEQ ID NO: 340514 - DNA, 33 bp, Artificial Sequence
  Description of Artificial Sequence: Synthetic oligonucleotide
atcctgcacctcatcatgtttctgctgcagatc

SEQ ID NO: 340515 - DNA, 32 bp, Artificial Sequence
  Description of Artificial Sequence: Synthetic oligonucleotide
tcctgcacctcatcatgtttctgctgcagatc

SEQ ID NO: 340516 - DNA, 31 bp, Artificial Sequence
  Description of Artificial Sequence: Synthetic oligonucleotide
cctgcacctcatcatgtttctgctgcagatc

SEQ ID NO: 340517 - DNA, 33 bp, Artificial Sequence
  Description of Artificial Sequence: Synthetic oligonucleotide
ctgcacctcatcatgtttctgctgcagatcatc

SEQ ID NO: 340518 - DNA, 33 bp, Artificial Sequence
  Description of Artificial Sequence: Synthetic oligonucleotide
tgcacctcatcatgtttctgctgcagatcatcg

SEQ ID NO: 340519 - DNA, 32 bp, Artificial Sequence
  Description of Artificial Sequence: Synthetic oligonucleotide
gcacctcatcatgtttctgctgcagatcatcg

SEQ ID NO: 340520 - DNA, 32 bp, Artificial Sequence
  Description of Artificial Sequence: Synthetic oligonucleotide
cacctcatcatgtttctgctgcagatcatcgg

SEQ ID NO: 340521 - DNA, 33 bp, Artificial Sequence
  Description of Artificial Sequence: Synthetic oligonucleotide
acctcatcatgtttctgctgcagatcatcggtg

SEQ ID NO: 340522 - DNA, 32 bp, Artificial Sequence
  Description of Artificial Sequence: Synthetic oligonucleotide
cctcatcatgtttctgctgcagatcatcggtg

SEQ ID NO: 340523 - DNA, 32 bp, Artificial Sequence
  Description of Artificial Sequence: Synthetic oligonucleotide
ctcatcatgtttctgctgcagatcatcggtgg

SEQ ID NO: 340524 - DNA, 35 bp, Artificial Sequence
  Description of Artificial Sequence: Synthetic oligonucleotide
tcatcatgtttctgctgcagatcatcggtggtatc

SEQ ID NO: 340525 - DNA, 34 bp, Artificial Sequence
  Description of Artificial Sequence: Synthetic oligonucleotide
catcatgtttctgctgcagatcatcggtggtatc

SEQ ID NO: 340526 - DNA, 34 bp, Artificial Sequence
  Description of Artificial Sequence: Synthetic oligonucleotide
atcatgtttctgctgcagatcatcggtggtatcc

SEQ ID NO: 340527 - DNA, 33 bp, Artificial Sequence
  Description of Artificial Sequence: Synthetic oligonucleotide
tcatgtttctgctgcagatcatcggtggtatcc

SEQ ID NO: 340528 - DNA, 32 bp, Artificial Sequence
  Description of Artificial Sequence: Synthetic oligonucleotide
catgtttctgctgcagatcatcggtggtatcc

SEQ ID NO: 340529 - DNA, 33 bp, Artificial Sequence
  Description of Artificial Sequence: Synthetic oligonucleotide
atgtttctgctgcagatcatcggtggtatcctg

SEQ ID NO: 340530 - DNA, 32 bp, Artificial Sequence
  Description of Artificial Sequence: Synthetic oligonucleotide
tgtttctgctgcagatcatcggtggtatcctg

SEQ ID NO: 340531 - DNA, 31 bp, Artificial Sequence
  Description of Artificial Sequence: Synthetic oligonucleotide
gtttctgctgcagatcatcggtggtatcctg

SEQ ID NO: 340532 - DNA, 31 bp, Artificial Sequence
  Description of Artificial Sequence: Synthetic oligonucleotide
tttctgctgcagatcatcggtggtatcctgg

SEQ ID NO: 340533 - DNA, 30 bp, Artificial Sequence
  Description of Artificial Sequence: Synthetic oligonucleotide
ttctgctgcagatcatcggtggtatcctgg

SEQ ID NO: 340534 - DNA, 29 bp, Artificial Sequence
  Description of Artificial Sequence: Synthetic oligonucleotide
tctgctgcagatcatcggtggtatcctgg

SEQ ID NO: 340535 - DNA, 28 bp, Artificial Sequence
  Description of Artificial Sequence: Synthetic oligonucleotide
ctgctgcagatcatcggtggtatcctgg

SEQ ID NO: 340536 - DNA, 28 bp, Artificial Sequence
  Description of Artificial Sequence: Synthetic oligonucleotide
tgctgcagatcatcggtggtatcctggc

SEQ ID NO: 340537 - DNA, 27 bp, Artificial Sequence
  Description of Artificial Sequence: Synthetic oligonucleotide
gctgcagatcatcggtggtatcctggc

SEQ ID NO: 340538 - DNA, 27 bp, Artificial Sequence
  Description of Artificial Sequence: Synthetic oligonucleotide
ctgcagatcatcggtggtatcctggcc

SEQ ID NO: 340539 - DNA, 29 bp, Artificial Sequence
  Description of Artificial Sequence: Synthetic oligonucleotide
tgcagatcatcggtggtatcctggcctac

SEQ ID NO: 340540 - DNA, 28 bp, Artificial Sequence
  Description of Artificial Sequence: Synthetic oligonucleotide
gcagatcatcggtggtatcctggcctac

SEQ ID NO: 340541 - DNA, 28 bp, Artificial Sequence
  Description of Artificial Sequence: Synthetic oligonucleotide
cagatcatcggtggtatcctggcctacg

SEQ ID NO: 340542 - DNA, 28 bp, Artificial Sequence
  Description of Artificial Sequence: Synthetic oligonucleotide
agatcatcggtggtatcctggcctacgc

SEQ ID NO: 340543 - DNA, 27 bp, Artificial Sequence
  Description of Artificial Sequence: Synthetic oligonucleotide
gatcatcggtggtatcctggcctacgc

SEQ ID NO: 340544 - DNA, 27 bp, Artificial Sequence
  Description of Artificial Sequence: Synthetic oligonucleotide
atcatcggtggtatcctggcctacgcc

SEQ ID NO: 340545 - DNA, 27 bp, Artificial Sequence
  Description of Artificial Sequence: Synthetic oligonucleotide
tcatcggtggtatcctggcctacgcca

SEQ ID NO: 340546 - DNA, 27 bp, Artificial Sequence
  Description of Artificial Sequence: Synthetic oligonucleotide
catcggtggtatcctggcctacgccaa

SEQ ID NO: 340547 - DNA, 27 bp, Artificial Sequence
  Description of Artificial Sequence: Synthetic oligonucleotide
atcggtggtatcctggcctacgccaac

SEQ ID NO: 340548 - DNA, 27 bp, Artificial Sequence
  Description of Artificial Sequence: Synthetic oligonucleotide
tcggtggtatcctggcctacgccaact

SEQ ID NO: 340549 - DNA, 27 bp, Artificial Sequence
  Description of Artificial Sequence: Synthetic oligonucleotide
cggtggtatcctggcctacgccaacta

SEQ ID NO: 340550 - DNA, 27 bp, Artificial Sequence
  Description of Artificial Sequence: Synthetic oligonucleotide
ggtggtatcctggcctacgccaactac

SEQ ID NO: 340551 - DNA, 27 bp, Artificial Sequence
  Description of Artificial Sequence: Synthetic oligonucleotide
gtggtatcctggcctacgccaactacc

SEQ ID NO: 340552 - DNA, 28 bp, Artificial Sequence
  Description of Artificial Sequence: Synthetic oligonucleotide
tggtatcctggcctacgccaactaccag

SEQ ID NO: 340553 - DNA, 27 bp, Artificial Sequence
  Description of Artificial Sequence: Synthetic oligonucleotide
ggtatcctggcctacgccaactaccag

SEQ ID NO: 340554 - DNA, 27 bp, Artificial Sequence
  Description of Artificial Sequence: Synthetic oligonucleotide
gtatcctggcctacgccaactaccagc

SEQ ID NO: 340555 - DNA, 28 bp, Artificial Sequence
  Description of Artificial Sequence: Synthetic oligonucleotide
tatcctggcctacgccaactaccagctg

SEQ ID NO: 340556 - DNA, 27 bp, Artificial Sequence
  Description of Artificial Sequence: Synthetic oligonucleotide
atcctggcctacgccaactaccagctg

SEQ ID NO: 340557 - DNA, 26 bp, Artificial Sequence
  Description of Artificial Sequence: Synthetic oligonucleotide
tcctggcctacgccaactaccagctg

SEQ ID NO: 340558 - DNA, 25 bp, Artificial Sequence
  Description of Artificial Sequence: Synthetic oligonucleotide
cctggcctacgccaactaccagctg

SEQ ID NO: 340559 - DNA, 26 bp, Artificial Sequence
  Description of Artificial Sequence: Synthetic oligonucleotide
ctggcctacgccaactaccagctgct

SEQ ID NO: 340560 - DNA, 27 bp, Artificial Sequence
  Description of Artificial Sequence: Synthetic oligonucleotide
tggcctacgccaactaccagctgctga

SEQ ID NO: 340561 - DNA, 27 bp, Artificial Sequence
  Description of Artificial Sequence: Synthetic oligonucleotide
ggcctacgccaactaccagctgctgaa

SEQ ID NO: 340562 - DNA, 27 bp, Artificial Sequence
  Description of Artificial Sequence: Synthetic oligonucleotide
gcctacgccaactaccagctgctgaac

SEQ ID NO: 340563 - DNA, 28 bp, Artificial Sequence
  Description of Artificial Sequence: Synthetic oligonucleotide
cctacgccaactaccagctgctgaacac

SEQ ID NO: 340564 - DNA, 28 bp, Artificial Sequence
  Description of Artificial Sequence: Synthetic oligonucleotide
ctacgccaactaccagctgctgaacacc

SEQ ID NO: 340565 - DNA, 28 bp, Artificial Sequence
  Description of Artificial Sequence: Synthetic oligonucleotide
tacgccaactaccagctgctgaacaccg

SEQ ID NO: 340566 - DNA, 27 bp, Artificial Sequence
  Description of Artificial Sequence: Synthetic oligonucleotide
acgccaactaccagctgctgaacaccg

SEQ ID NO: 340567 - DNA, 27 bp, Artificial Sequence
  Description of Artificial Sequence: Synthetic oligonucleotide
cgccaactaccagctgctgaacaccga

SEQ ID NO: 340568 - DNA, 27 bp, Artificial Sequence
  Description of Artificial Sequence: Synthetic oligonucleotide
gccaactaccagctgctgaacaccgag

SEQ ID NO: 340569 - DNA, 27 bp, Artificial Sequence
  Description of Artificial Sequence: Synthetic oligonucleotide
ccaactaccagctgctgaacaccgagc

SEQ ID NO: 340570 - DNA, 28 bp, Artificial Sequence
  Description of Artificial Sequence: Synthetic oligonucleotide
caactaccagctgctgaacaccgagctc

SEQ ID NO: 340571 - DNA, 30 bp, Artificial Sequence
  Description of Artificial Sequence: Synthetic oligonucleotide
aactaccagctgctgaacaccgagctcaag

SEQ ID NO: 340572 - DNA, 29 bp, Artificial Sequence
  Description of Artificial Sequence: Synthetic oligonucleotide
actaccagctgctgaacaccgagctcaag

SEQ ID NO: 340573 - DNA, 28 bp, Artificial Sequence
  Description of Artificial Sequence: Synthetic oligonucleotide
ctaccagctgctgaacaccgagctcaag

SEQ ID NO: 340574 - DNA, 28 bp, Artificial Sequence
  Description of Artificial Sequence: Synthetic oligonucleotide
taccagctgctgaacaccgagctcaagc

SEQ ID NO: 340575 - DNA, 27 bp, Artificial Sequence
  Description of Artificial Sequence: Synthetic oligonucleotide
accagctgctgaacaccgagctcaagc

SEQ ID NO: 340576 - DNA, 27 bp, Artificial Sequence
  Description of Artificial Sequence: Synthetic oligonucleotide
ccagctgctgaacaccgagctcaagca

SEQ ID NO: 340577 - DNA, 27 bp, Artificial Sequence
  Description of Artificial Sequence: Synthetic oligonucleotide
cagctgctgaacaccgagctcaagcag

SEQ ID NO: 340578 - DNA, 29 bp, Artificial Sequence
  Description of Artificial Sequence: Synthetic oligonucleotide
agctgctgaacaccgagctcaagcagaac

SEQ ID NO: 340579 - DNA, 28 bp, Artificial Sequence
  Description of Artificial Sequence: Synthetic oligonucleotide
gctgctgaacaccgagctcaagcagaac

SEQ ID NO: 340580 - DNA, 28 bp, Artificial Sequence
  Description of Artificial Sequence: Synthetic oligonucleotide
ctgctgaacaccgagctcaagcagaacc

SEQ ID NO: 340581 - DNA, 29 bp, Artificial Sequence
  Description of Artificial Sequence: Synthetic oligonucleotide
tgctgaacaccgagctcaagcagaacctg

SEQ ID NO: 340582 - DNA, 28 bp, Artificial Sequence
  Description of Artificial Sequence: Synthetic oligonucleotide
gctgaacaccgagctcaagcagaacctg

SEQ ID NO: 340583 - DNA, 30 bp, Artificial Sequence
  Description of Artificial Sequence: Synthetic oligonucleotide
ctgaacaccgagctcaagcagaacctgatg

SEQ ID NO: 340584 - DNA, 30 bp, Artificial Sequence
  Description of Artificial Sequence: Synthetic oligonucleotide
tgaacaccgagctcaagcagaacctgatgg

SEQ ID NO: 340585 - DNA, 29 bp, Artificial Sequence
  Description of Artificial Sequence: Synthetic oligonucleotide
gaacaccgagctcaagcagaacctgatgg

SEQ ID NO: 340586 - DNA, 30 bp, Artificial Sequence
  Description of Artificial Sequence: Synthetic oligonucleotide
aacaccgagctcaagcagaacctgatggac

SEQ ID NO: 340587 - DNA, 29 bp, Artificial Sequence
  Description of Artificial Sequence: Synthetic oligonucleotide
acaccgagctcaagcagaacctgatggac

SEQ ID NO: 340588 - DNA, 28 bp, Artificial Sequence
  Description of Artificial Sequence: Synthetic oligonucleotide
caccgagctcaagcagaacctgatggac

SEQ ID NO: 340589 - DNA, 29 bp, Artificial Sequence
  Description of Artificial Sequence: Synthetic oligonucleotide
accgagctcaagcagaacctgatggacac

SEQ ID NO: 340590 - DNA, 28 bp, Artificial Sequence
  Description of Artificial Sequence: Synthetic oligonucleotide
ccgagctcaagcagaacctgatggacac

SEQ ID NO: 340591 - DNA, 28 bp, Artificial Sequence
  Description of Artificial Sequence: Synthetic oligonucleotide
cgagctcaagcagaacctgatggacacc

SEQ ID NO: 340592 - DNA, 30 bp, Artificial Sequence
  Description of Artificial Sequence: Synthetic oligonucleotide
gagctcaagcagaacctgatggacaccatc

SEQ ID NO: 340593 - DNA, 31 bp, Artificial Sequence
  Description of Artificial Sequence: Synthetic oligonucleotide
agctcaagcagaacctgatggacaccatcac

SEQ ID NO: 340594 - DNA, 30 bp, Artificial Sequence
  Description of Artificial Sequence: Synthetic oligonucleotide
gctcaagcagaacctgatggacaccatcac

SEQ ID NO: 340595 - DNA, 30 bp, Artificial Sequence
  Description of Artificial Sequence: Synthetic oligonucleotide
ctcaagcagaacctgatggacaccatcacc

SEQ ID NO: 340596 - DNA, 32 bp, Artificial Sequence
  Description of Artificial Sequence: Synthetic oligonucleotide
tcaagcagaacctgatggacaccatcaccaag

SEQ ID NO: 340597 - DNA, 31 bp, Artificial Sequence
  Description of Artificial Sequence: Synthetic oligonucleotide
caagcagaacctgatggacaccatcaccaag

SEQ ID NO: 340598 - DNA, 31 bp, Artificial Sequence
  Description of Artificial Sequence: Synthetic oligonucleotide
aagcagaacctgatggacaccatcaccaagc

SEQ ID NO: 340599 - DNA, 30 bp, Artificial Sequence
  Description of Artificial Sequence: Synthetic oligonucleotide
agcagaacctgatggacaccatcaccaagc

SEQ ID NO: 340600 - DNA, 29 bp, Artificial Sequence
  Description of Artificial Sequence: Synthetic oligonucleotide
gcagaacctgatggacaccatcaccaagc

SEQ ID NO: 340601 - DNA, 29 bp, Artificial Sequence
  Description of Artificial Sequence: Synthetic oligonucleotide
cagaacctgatggacaccatcaccaagcg

SEQ ID NO: 340602 - DNA, 29 bp, Artificial Sequence
  Description of Artificial Sequence: Synthetic oligonucleotide
agaacctgatggacaccatcaccaagcgc

SEQ ID NO: 340603 - DNA, 28 bp, Artificial Sequence
  Description of Artificial Sequence: Synthetic oligonucleotide
gaacctgatggacaccatcaccaagcgc

SEQ ID NO: 340604 - DNA, 30 bp, Artificial Sequence
  Description of Artificial Sequence: Synthetic oligonucleotide
aacctgatggacaccatcaccaagcgcaac

SEQ ID NO: 340605 - DNA, 29 bp, Artificial Sequence
  Description of Artificial Sequence: Synthetic oligonucleotide
acctgatggacaccatcaccaagcgcaac

SEQ ID NO: 340606 - DNA, 28 bp, Artificial Sequence
  Description of Artificial Sequence: Synthetic oligonucleotide
cctgatggacaccatcaccaagcgcaac

SEQ ID NO: 340607 - DNA, 28 bp, Artificial Sequence
  Description of Artificial Sequence: Synthetic oligonucleotide
ctgatggacaccatcaccaagcgcaacc

SEQ ID NO: 340608 - DNA, 29 bp, Artificial Sequence
  Description of Artificial Sequence: Synthetic oligonucleotide
tgatggacaccatcaccaagcgcaaccac

SEQ ID NO: 340609 - DNA, 28 bp, Artificial Sequence
  Description of Artificial Sequence: Synthetic oligonucleotide
gatggacaccatcaccaagcgcaaccac

SEQ ID NO: 340610 - DNA, 28 bp, Artificial Sequence
  Description of Artificial Sequence: Synthetic oligonucleotide
atggacaccatcaccaagcgcaaccacc

SEQ ID NO: 340611 - DNA, 27 bp, Artificial Sequence
  Description of Artificial Sequence: Synthetic oligonucleotide
tggacaccatcaccaagcgcaaccacc

SEQ ID NO: 340612 - DNA, 27 bp, Artificial Sequence
  Description of Artificial Sequence: Synthetic oligonucleotide
ggacaccatcaccaagcgcaaccacca

SEQ ID NO: 340613 - DNA, 27 bp, Artificial Sequence
  Description of Artificial Sequence: Synthetic oligonucleotide
gacaccatcaccaagcgcaaccaccag

SEQ ID NO: 340614 - DNA, 27 bp, Artificial Sequence
  Description of Artificial Sequence: Synthetic oligonucleotide
acaccatcaccaagcgcaaccaccagc

SEQ ID NO: 340615 - DNA, 26 bp, Artificial Sequence
  Description of Artificial Sequence: Synthetic oligonucleotide
caccatcaccaagcgcaaccaccagc

SEQ ID NO: 340616 - DNA, 26 bp, Artificial Sequence
  Description of Artificial Sequence: Synthetic oligonucleotide
accatcaccaagcgcaaccaccagcg

SEQ ID NO: 340617 - DNA, 25 bp, Artificial Sequence
  Description of Artificial Sequence: Synthetic oligonucleotide
ccatcaccaagcgcaaccaccagcg

SEQ ID NO: 340618 - DNA, 25 bp, Artificial Sequence
  Description of Artificial Sequence: Synthetic oligonucleotide
catcaccaagcgcaaccaccagcgg

SEQ ID NO: 340619 - DNA, 25 bp, Artificial Sequence
  Description of Artificial Sequence: Synthetic oligonucleotide
atcaccaagcgcaaccaccagcggg

SEQ ID NO: 340620 - DNA, 24 bp, Artificial Sequence
  Description of Artificial Sequence: Synthetic oligonucleotide
tcaccaagcgcaaccaccagcggg

SEQ ID NO: 340621 - DNA, 23 bp, Artificial Sequence
  Description of Artificial Sequence: Synthetic oligonucleotide
caccaagcgcaaccaccagcggg

SEQ ID NO: 340622 - DNA, 23 bp, Artificial Sequence
  Description of Artificial Sequence: Synthetic oligonucleotide
accaagcgcaaccaccagcgggg

SEQ ID NO: 340623 - DNA, 22 bp, Artificial Sequence
  Description of Artificial Sequence: Synthetic oligonucleotide
ccaagcgcaaccaccagcgggg

SEQ ID NO: 340624 - DNA, 22 bp, Artificial Sequence
  Description of Artificial Sequence: Synthetic oligonucleotide
caagcgcaaccaccagcggggc

SEQ ID NO: 340625 - DNA, 24 bp, Artificial Sequence
  Description of Artificial Sequence: Synthetic oligonucleotide
aagcgcaaccaccagcggggccat

SEQ ID NO: 340626 - DNA, 23 bp, Artificial Sequence
  Description of Artificial Sequence: Synthetic oligonucleotide
agcgcaaccaccagcggggccat

SEQ ID NO: 340627 - DNA, 22 bp, Artificial Sequence
  Description of Artificial Sequence: Synthetic oligonucleotide
gcgcaaccaccagcggggccat

SEQ ID NO: 340628 - DNA, 23 bp, Artificial Sequence
  Description of Artificial Sequence: Synthetic oligonucleotide
cgcaaccaccagcggggccatga

SEQ ID NO: 340629 - DNA, 23 bp, Artificial Sequence
  Description of Artificial Sequence: Synthetic oligonucleotide
gcaaccaccagcggggccatgac

SEQ ID NO: 340630 - DNA, 23 bp, Artificial Sequence
  Description of Artificial Sequence: Synthetic oligonucleotide
caaccaccagcggggccatgacg

SEQ ID NO: 340631 - DNA, 24 bp, Artificial Sequence
  Description of Artificial Sequence: Synthetic oligonucleotide
aaccaccagcggggccatgacgct

SEQ ID NO: 340632 - DNA, 23 bp, Artificial Sequence
  Description of Artificial Sequence: Synthetic oligonucleotide
accaccagcggggccatgacgct

SEQ ID NO: 340633 - DNA, 22 bp, Artificial Sequence
  Description of Artificial Sequence: Synthetic oligonucleotide
ccaccagcggggccatgacgct

SEQ ID NO: 340634 - DNA, 23 bp, Artificial Sequence
  Description of Artificial Sequence: Synthetic oligonucleotide
caccagcggggccatgacgctgt

SEQ ID NO: 340635 - DNA, 24 bp, Artificial Sequence
  Description of Artificial Sequence: Synthetic oligonucleotide
accagcggggccatgacgctgtga

SEQ ID NO: 340636 - DNA, 23 bp, Artificial Sequence
  Description of Artificial Sequence: Synthetic oligonucleotide
ccagcggggccatgacgctgtga

SEQ ID NO: 340637 - DNA, 23 bp, Artificial Sequence
  Description of Artificial Sequence: Synthetic oligonucleotide
cagcggggccatgacgctgtgac

SEQ ID NO: 340638 - DNA, 24 bp, Artificial Sequence
  Description of Artificial Sequence: Synthetic oligonucleotide
agcggggccatgacgctgtgacct

SEQ ID NO: 340639 - DNA, 23 bp, Artificial Sequence
  Description of Artificial Sequence: Synthetic oligonucleotide
gcggggccatgacgctgtgacct

SEQ ID NO: 340640 - DNA, 23 bp, Artificial Sequence
  Description of Artificial Sequence: Synthetic oligonucleotide
cggggccatgacgctgtgacctg

SEQ ID NO: 340641 - DNA, 23 bp, Artificial Sequence
  Description of Artificial Sequence: Synthetic oligonucleotide
ggggccatgacgctgtgacctgc

SEQ ID NO: 340642 - DNA, 23 bp, Artificial Sequence
  Description of Artificial Sequence: Synthetic oligonucleotide
gggccatgacgctgtgacctgcg

SEQ ID NO: 340643 - DNA, 24 bp, Artificial Sequence
  Description of Artificial Sequence: Synthetic oligonucleotide
ggccatgacgctgtgacctgcgct

SEQ ID NO: 340644 - DNA, 25 bp, Artificial Sequence
  Description of Artificial Sequence: Synthetic oligonucleotide
gccatgacgctgtgacctgcgctgt

SEQ ID NO: 340645 - DNA, 25 bp, Artificial Sequence
  Description of Artificial Sequence: Synthetic oligonucleotide
ccatgacgctgtgacctgcgctgtg

SEQ ID NO: 340646 - DNA, 26 bp, Artificial Sequence
  Description of Artificial Sequence: Synthetic oligonucleotide
catgacgctgtgacctgcgctgtggt

SEQ ID NO: 340647 - DNA, 26 bp, Artificial Sequence
  Description of Artificial Sequence: Synthetic oligonucleotide
atgacgctgtgacctgcgctgtggtc

SEQ ID NO: 340648 - DNA, 25 bp, Artificial Sequence
  Description of Artificial Sequence: Synthetic oligonucleotide
tgacgctgtgacctgcgctgtggtc

SEQ ID NO: 340649 - DNA, 24 bp, Artificial Sequence
  Description of Artificial Sequence: Synthetic oligonucleotide
gacgctgtgacctgcgctgtggtc

SEQ ID NO: 340650 - DNA, 25 bp, Artificial Sequence
  Description of Artificial Sequence: Synthetic oligonucleotide
acgctgtgacctgcgctgtggtcca

SEQ ID NO: 340651 - DNA, 24 bp, Artificial Sequence
  Description of Artificial Sequence: Synthetic oligonucleotide
cgctgtgacctgcgctgtggtcca

SEQ ID NO: 340652 - DNA, 24 bp, Artificial Sequence
  Description of Artificial Sequence: Synthetic oligonucleotide
gctgtgacctgcgctgtggtccag

SEQ ID NO: 340653 - DNA, 25 bp, Artificial Sequence
  Description of Artificial Sequence: Synthetic oligonucleotide
ctgtgacctgcgctgtggtccagct

SEQ ID NO: 340654 - DNA, 25 bp, Artificial Sequence
  Description of Artificial Sequence: Synthetic oligonucleotide
tgtgacctgcgctgtggtccagctg

SEQ ID NO: 340655 - DNA, 24 bp, Artificial Sequence
  Description of Artificial Sequence: Synthetic oligonucleotide
gtgacctgcgctgtggtccagctg

SEQ ID NO: 340656 - DNA, 25 bp, Artificial Sequence
  Description of Artificial Sequence: Synthetic oligonucleotide
tgacctgcgctgtggtccagctgca

SEQ ID NO: 340657 - DNA, 24 bp, Artificial Sequence
  Description of Artificial Sequence: Synthetic oligonucleotide
gacctgcgctgtggtccagctgca

SEQ ID NO: 340658 - DNA, 24 bp, Artificial Sequence
  Description of Artificial Sequence: Synthetic oligonucleotide
acctgcgctgtggtccagctgcac

SEQ ID NO: 340659 - DNA, 23 bp, Artificial Sequence
  Description of Artificial Sequence: Synthetic oligonucleotide
cctgcgctgtggtccagctgcac

SEQ ID NO: 340660 - DNA, 24 bp, Artificial Sequence
  Description of Artificial Sequence: Synthetic oligonucleotide
ctgcgctgtggtccagctgcacca

SEQ ID NO: 340661 - DNA, 24 bp, Artificial Sequence
  Description of Artificial Sequence: Synthetic oligonucleotide
tgcgctgtggtccagctgcaccag

SEQ ID NO: 340662 - DNA, 23 bp, Artificial Sequence
  Description of Artificial Sequence: Synthetic oligonucleotide
gcgctgtggtccagctgcaccag

SEQ ID NO: 340663 - DNA, 24 bp, Artificial Sequence
  Description of Artificial Sequence: Synthetic oligonucleotide
cgctgtggtccagctgcaccagga

SEQ ID NO: 340664 - DNA, 26 bp, Artificial Sequence
  Description of Artificial Sequence: Synthetic oligonucleotide
gctgtggtccagctgcaccaggagtt

SEQ ID NO: 340665 - DNA, 26 bp, Artificial Sequence
  Description of Artificial Sequence: Synthetic oligonucleotide
ctgtggtccagctgcaccaggagttc

SEQ ID NO: 340666 - DNA, 27 bp, Artificial Sequence
  Description of Artificial Sequence: Synthetic oligonucleotide
tgtggtccagctgcaccaggagttcga

SEQ ID NO: 340667 - DNA, 26 bp, Artificial Sequence
  Description of Artificial Sequence: Synthetic oligonucleotide
gtggtccagctgcaccaggagttcga

SEQ ID NO: 340668 - DNA, 27 bp, Artificial Sequence
  Description of Artificial Sequence: Synthetic oligonucleotide
tggtccagctgcaccaggagttcgact

SEQ ID NO: 340669 - DNA, 26 bp, Artificial Sequence
  Description of Artificial Sequence: Synthetic oligonucleotide
ggtccagctgcaccaggagttcgact

SEQ ID NO: 340670 - DNA, 26 bp, Artificial Sequence
  Description of Artificial Sequence: Synthetic oligonucleotide
gtccagctgcaccaggagttcgactg

SEQ ID NO: 340671 - DNA, 27 bp, Artificial Sequence
  Description of Artificial Sequence: Synthetic oligonucleotide
tccagctgcaccaggagttcgactgct

SEQ ID NO: 340672 - DNA, 26 bp, Artificial Sequence
  Description of Artificial Sequence: Synthetic oligonucleotide
ccagctgcaccaggagttcgactgct

SEQ ID NO: 340673 - DNA, 27 bp, Artificial Sequence
  Description of Artificial Sequence: Synthetic oligonucleotide
cagctgcaccaggagttcgactgctgt

SEQ ID NO: 340674 - DNA, 27 bp, Artificial Sequence
  Description of Artificial Sequence: Synthetic oligonucleotide
agctgcaccaggagttcgactgctgtg

SEQ ID NO: 340675 - DNA, 26 bp, Artificial Sequence
  Description of Artificial Sequence: Synthetic oligonucleotide
gctgcaccaggagttcgactgctgtg

SEQ ID NO: 340676 - DNA, 26 bp, Artificial Sequence
  Description of Artificial Sequence: Synthetic oligonucleotide
ctgcaccaggagttcgactgctgtgc

SEQ ID NO: 340677 - DNA, 27 bp, Artificial Sequence
  Description of Artificial Sequence: Synthetic oligonucleotide
tgcaccaggagttcgactgctgtgcca

SEQ ID NO: 340678 - DNA, 26 bp, Artificial Sequence
  Description of Artificial Sequence: Synthetic oligonucleotide
gcaccaggagttcgactgctgtgcca

SEQ ID NO: 340679 - DNA, 26 bp, Artificial Sequence
  Description of Artificial Sequence: Synthetic oligonucleotide
caccaggagttcgactgctgtgccag

SEQ ID NO: 340680 - DNA, 27 bp, Artificial Sequence
  Description of Artificial Sequence: Synthetic oligonucleotide
accaggagttcgactgctgtgccagca

SEQ ID NO: 340681 - DNA, 27 bp, Artificial Sequence
  Description of Artificial Sequence: Synthetic oligonucleotide
ccaggagttcgactgctgtgccagcaa

SEQ ID NO: 340682 - DNA, 27 bp, Artificial Sequence
  Description of Artificial Sequence: Synthetic oligonucleotide
caggagttcgactgctgtgccagcaac

SEQ ID NO: 340683 - DNA, 29 bp, Artificial Sequence
  Description of Artificial Sequence: Synthetic oligonucleotide
aggagttcgactgctgtgccagcaacaag

SEQ ID NO: 340684 - DNA, 28 bp, Artificial Sequence
  Description of Artificial Sequence: Synthetic oligonucleotide
ggagttcgactgctgtgccagcaacaag

SEQ ID NO: 340685 - DNA, 29 bp, Artificial Sequence
  Description of Artificial Sequence: Synthetic oligonucleotide
gagttcgactgctgtgccagcaacaagtc

SEQ ID NO: 340686 - DNA, 30 bp, Artificial Sequence
  Description of Artificial Sequence: Synthetic oligonucleotide
agttcgactgctgtgccagcaacaagtcac

SEQ ID NO: 340687 - DNA, 29 bp, Artificial Sequence
  Description of Artificial Sequence: Synthetic oligonucleotide
gttcgactgctgtgccagcaacaagtcac

SEQ ID NO: 340688 - DNA, 30 bp, Artificial Sequence
  Description of Artificial Sequence: Synthetic oligonucleotide
ttcgactgctgtgccagcaacaagtcacag

SEQ ID NO: 340689 - DNA, 29 bp, Artificial Sequence
  Description of Artificial Sequence: Synthetic oligonucleotide
tcgactgctgtgccagcaacaagtcacag

SEQ ID NO: 340690 - DNA, 28 bp, Artificial Sequence
  Description of Artificial Sequence: Synthetic oligonucleotide
cgactgctgtgccagcaacaagtcacag

SEQ ID NO: 340691 - DNA, 28 bp, Artificial Sequence
  Description of Artificial Sequence: Synthetic oligonucleotide
gactgctgtgccagcaacaagtcacagg

SEQ ID NO: 340692 - DNA, 29 bp, Artificial Sequence
  Description of Artificial Sequence: Synthetic oligonucleotide
actgctgtgccagcaacaagtcacaggac

SEQ ID NO: 340693 - DNA, 28 bp, Artificial Sequence
  Description of Artificial Sequence: Synthetic oligonucleotide
ctgctgtgccagcaacaagtcacaggac

SEQ ID NO: 340694 - DNA, 29 bp, Artificial Sequence
  Description of Artificial Sequence: Synthetic oligonucleotide
tgctgtgccagcaacaagtcacaggacag

SEQ ID NO: 340695 - DNA, 28 bp, Artificial Sequence
  Description of Artificial Sequence: Synthetic oligonucleotide
gctgtgccagcaacaagtcacaggacag

SEQ ID NO: 340696 - DNA, 28 bp, Artificial Sequence
  Description of Artificial Sequence: Synthetic oligonucleotide
ctgtgccagcaacaagtcacaggacagg

SEQ ID NO: 340697 - DNA, 28 bp, Artificial Sequence
  Description of Artificial Sequence: Synthetic oligonucleotide
tgtgccagcaacaagtcacaggacaggc

SEQ ID NO: 340698 - DNA, 27 bp, Artificial Sequence
  Description of Artificial Sequence: Synthetic oligonucleotide
gtgccagcaacaagtcacaggacaggc

SEQ ID NO: 340699 - DNA, 27 bp, Artificial Sequence
  Description of Artificial Sequence: Synthetic oligonucleotide
tgccagcaacaagtcacaggacaggcg

SEQ ID NO: 340700 - DNA, 27 bp, Artificial Sequence
  Description of Artificial Sequence: Synthetic oligonucleotide
gccagcaacaagtcacaggacaggcga

SEQ ID NO: 340701 - DNA, 27 bp, Artificial Sequence
  Description of Artificial Sequence: Synthetic oligonucleotide
ccagcaacaagtcacaggacaggcgag

SEQ ID NO: 340702 - DNA, 28 bp, Artificial Sequence
  Description of Artificial Sequence: Synthetic oligonucleotide
cagcaacaagtcacaggacaggcgagac

SEQ ID NO: 340703 - DNA, 29 bp, Artificial Sequence
  Description of Artificial Sequence: Synthetic oligonucleotide
agcaacaagtcacaggacaggcgagacac

SEQ ID NO: 340704 - DNA, 28 bp, Artificial Sequence
  Description of Artificial Sequence: Synthetic oligonucleotide
gcaacaagtcacaggacaggcgagacac

SEQ ID NO: 340705 - DNA, 29 bp, Artificial Sequence
  Description of Artificial Sequence: Synthetic oligonucleotide
caacaagtcacaggacaggcgagacactg

SEQ ID NO: 340706 - DNA, 30 bp, Artificial Sequence
  Description of Artificial Sequence: Synthetic oligonucleotide
aacaagtcacaggacaggcgagacactgag

SEQ ID NO: 340707 - DNA, 29 bp, Artificial Sequence
  Description of Artificial Sequence: Synthetic oligonucleotide
acaagtcacaggacaggcgagacactgag

SEQ ID NO: 340708 - DNA, 28 bp, Artificial Sequence
  Description of Artificial Sequence: Synthetic oligonucleotide
caagtcacaggacaggcgagacactgag

SEQ ID NO: 340709 - DNA, 29 bp, Artificial Sequence
  Description of Artificial Sequence: Synthetic oligonucleotide
aagtcacaggacaggcgagacactgagtg

SEQ ID NO: 340710 - DNA, 28 bp, Artificial Sequence
  Description of Artificial Sequence: Synthetic oligonucleotide
agtcacaggacaggcgagacactgagtg

SEQ ID NO: 340711 - DNA, 27 bp, Artificial Sequence
  Description of Artificial Sequence: Synthetic oligonucleotide
gtcacaggacaggcgagacactgagtg

SEQ ID NO: 340712 - DNA, 27 bp, Artificial Sequence
  Description of Artificial Sequence: Synthetic oligonucleotide
tcacaggacaggcgagacactgagtgg

SEQ ID NO: 340713 - DNA, 27 bp, Artificial Sequence
  Description of Artificial Sequence: Synthetic oligonucleotide
cacaggacaggcgagacactgagtgga

SEQ ID NO: 340714 - DNA, 28 bp, Artificial Sequence
  Description of Artificial Sequence: Synthetic oligonucleotide
acaggacaggcgagacactgagtggatg

SEQ ID NO: 340715 - DNA, 27 bp, Artificial Sequence
  Description of Artificial Sequence: Synthetic oligonucleotide
caggacaggcgagacactgagtggatg

SEQ ID NO: 340716 - DNA, 27 bp, Artificial Sequence
  Description of Artificial Sequence: Synthetic oligonucleotide
aggacaggcgagacactgagtggatgc

SEQ ID NO: 340717 - DNA, 26 bp, Artificial Sequence
  Description of Artificial Sequence: Synthetic oligonucleotide
ggacaggcgagacactgagtggatgc

SEQ ID NO: 340718 - DNA, 26 bp, Artificial Sequence
  Description of Artificial Sequence: Synthetic oligonucleotide
gacaggcgagacactgagtggatgcg

SEQ ID NO: 340719 - DNA, 27 bp, Artificial Sequence
  Description of Artificial Sequence: Synthetic oligonucleotide
acaggcgagacactgagtggatgcgct

SEQ ID NO: 340720 - DNA, 26 bp, Artificial Sequence
  Description of Artificial Sequence: Synthetic oligonucleotide
caggcgagacactgagtggatgcgct

SEQ ID NO: 340721 - DNA, 27 bp, Artificial Sequence
  Description of Artificial Sequence: Synthetic oligonucleotide
aggcgagacactgagtggatgcgctca

SEQ ID NO: 340722 - DNA, 26 bp, Artificial Sequence
  Description of Artificial Sequence: Synthetic oligonucleotide
ggcgagacactgagtggatgcgctca

SEQ ID NO: 340723 - DNA, 27 bp, Artificial Sequence
  Description of Artificial Sequence: Synthetic oligonucleotide
gcgagacactgagtggatgcgctcaca

SEQ ID NO: 340724 - DNA, 27 bp, Artificial Sequence
  Description of Artificial Sequence: Synthetic oligonucleotide
cgagacactgagtggatgcgctcacag

SEQ ID NO: 340725 - DNA, 27 bp, Artificial Sequence
  Description of Artificial Sequence: Synthetic oligonucleotide
gagacactgagtggatgcgctcacagc

SEQ ID NO: 340726 - DNA, 28 bp, Artificial Sequence
  Description of Artificial Sequence: Synthetic oligonucleotide
agacactgagtggatgcgctcacagcag

SEQ ID NO: 340727 - DNA, 27 bp, Artificial Sequence
  Description of Artificial Sequence: Synthetic oligonucleotide
gacactgagtggatgcgctcacagcag

SEQ ID NO: 340728 - DNA, 27 bp, Artificial Sequence
  Description of Artificial Sequence: Synthetic oligonucleotide
acactgagtggatgcgctcacagcagg

SEQ ID NO: 340729 - DNA, 26 bp, Artificial Sequence
  Description of Artificial Sequence: Synthetic oligonucleotide
cactgagtggatgcgctcacagcagg

SEQ ID NO: 340730 - DNA, 26 bp, Artificial Sequence
  Description of Artificial Sequence: Synthetic oligonucleotide
actgagtggatgcgctcacagcaggc

SEQ ID NO: 340731 - DNA, 25 bp, Artificial Sequence
  Description of Artificial Sequence: Synthetic oligonucleotide
ctgagtggatgcgctcacagcaggc

SEQ ID NO: 340732 - DNA, 25 bp, Artificial Sequence
  Description of Artificial Sequence: Synthetic oligonucleotide
tgagtggatgcgctcacagcaggcc

SEQ ID NO: 340733 - DNA, 24 bp, Artificial Sequence
  Description of Artificial Sequence: Synthetic oligonucleotide
gagtggatgcgctcacagcaggcc

SEQ ID NO: 340734 - DNA, 24 bp, Artificial Sequence
  Description of Artificial Sequence: Synthetic oligonucleotide
agtggatgcgctcacagcaggccg

SEQ ID NO: 340735 - DNA, 23 bp, Artificial Sequence
  Description of Artificial Sequence: Synthetic oligonucleotide
gtggatgcgctcacagcaggccg

SEQ ID NO: 340736 - DNA, 24 bp, Artificial Sequence
  Description of Artificial Sequence: Synthetic oligonucleotide
tggatgcgctcacagcaggccggt

SEQ ID NO: 340737 - DNA, 23 bp, Artificial Sequence
  Description of Artificial Sequence: Synthetic oligonucleotide
ggatgcgctcacagcaggccggt

SEQ ID NO: 340738 - DNA, 23 bp, Artificial Sequence
  Description of Artificial Sequence: Synthetic oligonucleotide
gatgcgctcacagcaggccggtg

SEQ ID NO: 340739 - DNA, 23 bp, Artificial Sequence
  Description of Artificial Sequence: Synthetic oligonucleotide
atgcgctcacagcaggccggtgc

SEQ ID NO: 340740 - DNA, 22 bp, Artificial Sequence
  Description of Artificial Sequence: Synthetic oligonucleotide
tgcgctcacagcaggccggtgc

SEQ ID NO: 340741 - DNA, 21 bp, Artificial Sequence
  Description of Artificial Sequence: Synthetic oligonucleotide
gcgctcacagcaggccggtgc

SEQ ID NO: 340742 - DNA, 21 bp, Artificial Sequence
  Description of Artificial Sequence: Synthetic oligonucleotide
cgctcacagcaggccggtgcc

SEQ ID NO: 340743 - DNA, 21 bp, Artificial Sequence
  Description of Artificial Sequence: Synthetic oligonucleotide
gctcacagcaggccggtgccc

SEQ ID NO: 340744 - DNA, 22 bp, Artificial Sequence
  Description of Artificial Sequence: Synthetic oligonucleotide
ctcacagcaggccggtgcccgt

SEQ ID NO: 340745 - DNA, 23 bp, Artificial Sequence
  Description of Artificial Sequence: Synthetic oligonucleotide
tcacagcaggccggtgcccgtgt

SEQ ID NO: 340746 - DNA, 22 bp, Artificial Sequence
  Description of Artificial Sequence: Synthetic oligonucleotide
cacagcaggccggtgcccgtgt

SEQ ID NO: 340747 - DNA, 22 bp, Artificial Sequence
  Description of Artificial Sequence: Synthetic oligonucleotide
acagcaggccggtgcccgtgtg

SEQ ID NO: 340748 - DNA, 21 bp, Artificial Sequence
  Description of Artificial Sequence: Synthetic oligonucleotide
cagcaggccggtgcccgtgtg

SEQ ID NO: 340749 - DNA, 22 bp, Artificial Sequence
  Description of Artificial Sequence: Synthetic oligonucleotide
agcaggccggtgcccgtgtggt

SEQ ID NO: 340750 - DNA, 21 bp, Artificial Sequence
  Description of Artificial Sequence: Synthetic oligonucleotide
gcaggccggtgcccgtgtggt

SEQ ID NO: 340751 - DNA, 21 bp, Artificial Sequence
  Description of Artificial Sequence: Synthetic oligonucleotide
caggccggtgcccgtgtggtg

SEQ ID NO: 340752 - DNA, 21 bp, Artificial Sequence
  Description of Artificial Sequence: Synthetic oligonucleotide
aggccggtgcccgtgtggtgc

SEQ ID NO: 340753 - DNA, 20 bp, Artificial Sequence
  Description of Artificial Sequence: Synthetic oligonucleotide
ggccggtgcccgtgtggtgc

SEQ ID NO: 340754 - DNA, 21 bp, Artificial Sequence
  Description of Artificial Sequence: Synthetic oligonucleotide
gccggtgcccgtgtggtgcca

SEQ ID NO: 340755 - DNA, 22 bp, Artificial Sequence
  Description of Artificial Sequence: Synthetic oligonucleotide
ccggtgcccgtgtggtgccaga

SEQ ID NO: 340756 - DNA, 23 bp, Artificial Sequence
  Description of Artificial Sequence: Synthetic oligonucleotide
cggtgcccgtgtggtgccagaca

SEQ ID NO: 340757 - DNA, 23 bp, Artificial Sequence
  Description of Artificial Sequence: Synthetic oligonucleotide
ggtgcccgtgtggtgccagacag

SEQ ID NO: 340758 - DNA, 24 bp, Artificial Sequence
  Description of Artificial Sequence: Synthetic oligonucleotide
gtgcccgtgtggtgccagacagca

SEQ ID NO: 340759 - DNA, 24 bp, Artificial Sequence
  Description of Artificial Sequence: Synthetic oligonucleotide
tgcccgtgtggtgccagacagcag

SEQ ID NO: 340760 - DNA, 23 bp, Artificial Sequence
  Description of Artificial Sequence: Synthetic oligonucleotide
gcccgtgtggtgccagacagcag

SEQ ID NO: 340761 - DNA, 24 bp, Artificial Sequence
  Description of Artificial Sequence: Synthetic oligonucleotide
cccgtgtggtgccagacagcagct

SEQ ID NO: 340762 - DNA, 24 bp, Artificial Sequence
  Description of Artificial Sequence: Synthetic oligonucleotide
ccgtgtggtgccagacagcagctg

SEQ ID NO: 340763 - DNA, 26 bp, Artificial Sequence
  Description of Artificial Sequence: Synthetic oligonucleotide
cgtgtggtgccagacagcagctgcaa

SEQ ID NO: 340764 - DNA, 27 bp, Artificial Sequence
  Description of Artificial Sequence: Synthetic oligonucleotide
gtgtggtgccagacagcagctgcaaga

SEQ ID NO: 340765 - DNA, 27 bp, Artificial Sequence
  Description of Artificial Sequence: Synthetic oligonucleotide
tgtggtgccagacagcagctgcaagag

SEQ ID NO: 340766 - DNA, 26 bp, Artificial Sequence
  Description of Artificial Sequence: Synthetic oligonucleotide
gtggtgccagacagcagctgcaagag

SEQ ID NO: 340767 - DNA, 26 bp, Artificial Sequence
  Description of Artificial Sequence: Synthetic oligonucleotide
tggtgccagacagcagctgcaagagg

SEQ ID NO: 340768 - DNA, 25 bp, Artificial Sequence
  Description of Artificial Sequence: Synthetic oligonucleotide
ggtgccagacagcagctgcaagagg

SEQ ID NO: 340769 - DNA, 26 bp, Artificial Sequence
  Description of Artificial Sequence: Synthetic oligonucleotide
gtgccagacagcagctgcaagagggt

SEQ ID NO: 340770 - DNA, 26 bp, Artificial Sequence
  Description of Artificial Sequence: Synthetic oligonucleotide
tgccagacagcagctgcaagagggtg

SEQ ID NO: 340771 - DNA, 25 bp, Artificial Sequence
  Description of Artificial Sequence: Synthetic oligonucleotide
gccagacagcagctgcaagagggtg

SEQ ID NO: 340772 - DNA, 26 bp, Artificial Sequence
  Description of Artificial Sequence: Synthetic oligonucleotide
ccagacagcagctgcaagagggtggt

SEQ ID NO: 340773 - DNA, 26 bp, Artificial Sequence
  Description of Artificial Sequence: Synthetic oligonucleotide
cagacagcagctgcaagagggtggtg

SEQ ID NO: 340774 - DNA, 26 bp, Artificial Sequence
  Description of Artificial Sequence: Synthetic oligonucleotide
agacagcagctgcaagagggtggtgg

SEQ ID NO: 340775 - DNA, 25 bp, Artificial Sequence
  Description of Artificial Sequence: Synthetic oligonucleotide
gacagcagctgcaagagggtggtgg

SEQ ID NO: 340776 - DNA, 26 bp, Artificial Sequence
  Description of Artificial Sequence: Synthetic oligonucleotide
acagcagctgcaagagggtggtggca

SEQ ID NO: 340777 - DNA, 25 bp, Artificial Sequence
  Description of Artificial Sequence: Synthetic oligonucleotide
cagcagctgcaagagggtggtggca

SEQ ID NO: 340778 - DNA, 27 bp, Artificial Sequence
  Description of Artificial Sequence: Synthetic oligonucleotide
agcagctgcaagagggtggtggcactt

SEQ ID NO: 340779 - DNA, 27 bp, Artificial Sequence
  Description of Artificial Sequence: Synthetic oligonucleotide
gcagctgcaagagggtggtggcacttt

SEQ ID NO: 340780 - DNA, 27 bp, Artificial Sequence
  Description of Artificial Sequence: Synthetic oligonucleotide
cagctgcaagagggtggtggcactttg

SEQ ID NO: 340781 - DNA, 28 bp, Artificial Sequence
  Description of Artificial Sequence: Synthetic oligonucleotide
agctgcaagagggtggtggcactttgtg

SEQ ID NO: 340782 - DNA, 27 bp, Artificial Sequence
  Description of Artificial Sequence: Synthetic oligonucleotide
gctgcaagagggtggtggcactttgtg

SEQ ID NO: 340783 - DNA, 27 bp, Artificial Sequence
  Description of Artificial Sequence: Synthetic oligonucleotide
ctgcaagagggtggtggcactttgtgg

SEQ ID NO: 340784 - DNA, 27 bp, Artificial Sequence
  Description of Artificial Sequence: Synthetic oligonucleotide
tgcaagagggtggtggcactttgtggg

SEQ ID NO: 340785 - DNA, 26 bp, Artificial Sequence
  Description of Artificial Sequence: Synthetic oligonucleotide
gcaagagggtggtggcactttgtggg

SEQ ID NO: 340786 - DNA, 27 bp, Artificial Sequence
  Description of Artificial Sequence: Synthetic oligonucleotide
caagagggtggtggcactttgtgggga

SEQ ID NO: 340787 - DNA, 27 bp, Artificial Sequence
  Description of Artificial Sequence: Synthetic oligonucleotide
aagagggtggtggcactttgtggggag

SEQ ID NO: 340788 - DNA, 26 bp, Artificial Sequence
  Description of Artificial Sequence: Synthetic oligonucleotide
agagggtggtggcactttgtggggag

SEQ ID NO: 340789 - DNA, 25 bp, Artificial Sequence
  Description of Artificial Sequence: Synthetic oligonucleotide
gagggtggtggcactttgtggggag

SEQ ID NO: 340790 - DNA, 25 bp, Artificial Sequence
  Description of Artificial Sequence: Synthetic oligonucleotide
agggtggtggcactttgtggggagc

SEQ ID NO: 340791 - DNA, 24 bp, Artificial Sequence
  Description of Artificial Sequence: Synthetic oligonucleotide
gggtggtggcactttgtggggagc

SEQ ID NO: 340792 - DNA, 25 bp, Artificial Sequence
  Description of Artificial Sequence: Synthetic oligonucleotide
ggtggtggcactttgtggggagcga

SEQ ID NO: 340793 - DNA, 26 bp, Artificial Sequence
  Description of Artificial Sequence: Synthetic oligonucleotide
gtggtggcactttgtggggagcgaga

SEQ ID NO: 340794 - DNA, 26 bp, Artificial Sequence
  Description of Artificial Sequence: Synthetic oligonucleotide
tggtggcactttgtggggagcgagac

SEQ ID NO: 340795 - DNA, 25 bp, Artificial Sequence
  Description of Artificial Sequence: Synthetic oligonucleotide
ggtggcactttgtggggagcgagac

SEQ ID NO: 340796 - DNA, 27 bp, Artificial Sequence
  Description of Artificial Sequence: Synthetic oligonucleotide
gtggcactttgtggggagcgagacctt

SEQ ID NO: 340797 - DNA, 27 bp, Artificial Sequence
  Description of Artificial Sequence: Synthetic oligonucleotide
tggcactttgtggggagcgagaccttg

SEQ ID NO: 340798 - DNA, 26 bp, Artificial Sequence
  Description of Artificial Sequence: Synthetic oligonucleotide
ggcactttgtggggagcgagaccttg

SEQ ID NO: 340799 - DNA, 26 bp, Artificial Sequence
  Description of Artificial Sequence: Synthetic oligonucleotide
gcactttgtggggagcgagaccttgc

SEQ ID NO: 340800 - DNA, 27 bp, Artificial Sequence
  Description of Artificial Sequence: Synthetic oligonucleotide
cactttgtggggagcgagaccttgcct

SEQ ID NO: 340801 - DNA, 27 bp, Artificial Sequence
  Description of Artificial Sequence: Synthetic oligonucleotide
actttgtggggagcgagaccttgcctc

SEQ ID NO: 340802 - DNA, 26 bp, Artificial Sequence
  Description of Artificial Sequence: Synthetic oligonucleotide
ctttgtggggagcgagaccttgcctc

SEQ ID NO: 340803 - DNA, 27 bp, Artificial Sequence
  Description of Artificial Sequence: Synthetic oligonucleotide
tttgtggggagcgagaccttgcctcca

SEQ ID NO: 340804 - DNA, 27 bp, Artificial Sequence
  Description of Artificial Sequence: Synthetic oligonucleotide
ttgtggggagcgagaccttgcctccaa

SEQ ID NO: 340805 - DNA, 26 bp, Artificial Sequence
  Description of Artificial Sequence: Synthetic oligonucleotide
tgtggggagcgagaccttgcctccaa

SEQ ID NO: 340806 - DNA, 25 bp, Artificial Sequence
  Description of Artificial Sequence: Synthetic oligonucleotide
gtggggagcgagaccttgcctccaa

SEQ ID NO: 340807 - DNA, 27 bp, Artificial Sequence
  Description of Artificial Sequence: Synthetic oligonucleotide
tggggagcgagaccttgcctccaagat

SEQ ID NO: 340808 - DNA, 26 bp, Artificial Sequence
  Description of Artificial Sequence: Synthetic oligonucleotide
ggggagcgagaccttgcctccaagat

SEQ ID NO: 340809 - DNA, 27 bp, Artificial Sequence
  Description of Artificial Sequence: Synthetic oligonucleotide
gggagcgagaccttgcctccaagatct

SEQ ID NO: 340810 - DNA, 28 bp, Artificial Sequence
  Description of Artificial Sequence: Synthetic oligonucleotide
ggagcgagaccttgcctccaagatctac

SEQ ID NO: 340811 - DNA, 30 bp, Artificial Sequence
  Description of Artificial Sequence: Synthetic oligonucleotide
gagcgagaccttgcctccaagatctacaag

SEQ ID NO: 340812 - DNA, 30 bp, Artificial Sequence
  Description of Artificial Sequence: Synthetic oligonucleotide
agcgagaccttgcctccaagatctacaagc

SEQ ID NO: 340813 - DNA, 29 bp, Artificial Sequence
  Description of Artificial Sequence: Synthetic oligonucleotide
gcgagaccttgcctccaagatctacaagc

SEQ ID NO: 340814 - DNA, 30 bp, Artificial Sequence
  Description of Artificial Sequence: Synthetic oligonucleotide
cgagaccttgcctccaagatctacaagctg

SEQ ID NO: 340815 - DNA, 30 bp, Artificial Sequence
  Description of Artificial Sequence: Synthetic oligonucleotide
gagaccttgcctccaagatctacaagctgg

SEQ ID NO: 340816 - DNA, 31 bp, Artificial Sequence
  Description of Artificial Sequence: Synthetic oligonucleotide
agaccttgcctccaagatctacaagctggag

SEQ ID NO: 340817 - DNA, 30 bp, Artificial Sequence
  Description of Artificial Sequence: Synthetic oligonucleotide
gaccttgcctccaagatctacaagctggag

SEQ ID NO: 340818 - DNA, 30 bp, Artificial Sequence
  Description of Artificial Sequence: Synthetic oligonucleotide
accttgcctccaagatctacaagctggagg

SEQ ID NO: 340819 - DNA, 29 bp, Artificial Sequence
  Description of Artificial Sequence: Synthetic oligonucleotide
ccttgcctccaagatctacaagctggagg

SEQ ID NO: 340820 - DNA, 29 bp, Artificial Sequence
  Description of Artificial Sequence: Synthetic oligonucleotide
cttgcctccaagatctacaagctggaggg

SEQ ID NO: 340821 - DNA, 29 bp, Artificial Sequence
  Description of Artificial Sequence: Synthetic oligonucleotide
ttgcctccaagatctacaagctggagggc

SEQ ID NO: 340822 - DNA, 28 bp, Artificial Sequence
  Description of Artificial Sequence: Synthetic oligonucleotide
tgcctccaagatctacaagctggagggc

SEQ ID NO: 340823 - DNA, 27 bp, Artificial Sequence
  Description of Artificial Sequence: Synthetic oligonucleotide
gcctccaagatctacaagctggagggc

SEQ ID NO: 340824 - DNA, 27 bp, Artificial Sequence
  Description of Artificial Sequence: Synthetic oligonucleotide
cctccaagatctacaagctggagggcg

SEQ ID NO: 340825 - DNA, 27 bp, Artificial Sequence
  Description of Artificial Sequence: Synthetic oligonucleotide
ctccaagatctacaagctggagggcgc

SEQ ID NO: 340826 - DNA, 27 bp, Artificial Sequence
  Description of Artificial Sequence: Synthetic oligonucleotide
tccaagatctacaagctggagggcgcc

SEQ ID NO: 340827 - DNA, 27 bp, Artificial Sequence
  Description of Artificial Sequence: Synthetic oligonucleotide
ccaagatctacaagctggagggcgcct

SEQ ID NO: 340828 - DNA, 27 bp, Artificial Sequence
  Description of Artificial Sequence: Synthetic oligonucleotide
caagatctacaagctggagggcgcctg

SEQ ID NO: 340829 - DNA, 27 bp, Artificial Sequence
  Description of Artificial Sequence: Synthetic oligonucleotide
aagatctacaagctggagggcgcctgc

SEQ ID NO: 340830 - DNA, 27 bp, Artificial Sequence
  Description of Artificial Sequence: Synthetic oligonucleotide
agatctacaagctggagggcgcctgca

SEQ ID NO: 340831 - DNA, 27 bp, Artificial Sequence
  Description of Artificial Sequence: Synthetic oligonucleotide
gatctacaagctggagggcgcctgcat

SEQ ID NO: 340832 - DNA, 27 bp, Artificial Sequence
  Description of Artificial Sequence: Synthetic oligonucleotide
atctacaagctggagggcgcctgcatc

SEQ ID NO: 340833 - DNA, 27 bp, Artificial Sequence
  Description of Artificial Sequence: Synthetic oligonucleotide
tctacaagctggagggcgcctgcatca

SEQ ID NO: 340834 - DNA, 26 bp, Artificial Sequence
  Description of Artificial Sequence: Synthetic oligonucleotide
ctacaagctggagggcgcctgcatca

SEQ ID NO: 340835 - DNA, 26 bp, Artificial Sequence
  Description of Artificial Sequence: Synthetic oligonucleotide
tacaagctggagggcgcctgcatcac

SEQ ID NO: 340836 - DNA, 25 bp, Artificial Sequence
  Description of Artificial Sequence: Synthetic oligonucleotide
acaagctggagggcgcctgcatcac

SEQ ID NO: 340837 - DNA, 24 bp, Artificial Sequence
  Description of Artificial Sequence: Synthetic oligonucleotide
caagctggagggcgcctgcatcac

SEQ ID NO: 340838 - DNA, 26 bp, Artificial Sequence
  Description of Artificial Sequence: Synthetic oligonucleotide
aagctggagggcgcctgcatcacgaa

SEQ ID NO: 340839 - DNA, 25 bp, Artificial Sequence
  Description of Artificial Sequence: Synthetic oligonucleotide
agctggagggcgcctgcatcacgaa

SEQ ID NO: 340840 - DNA, 24 bp, Artificial Sequence
  Description of Artificial Sequence: Synthetic oligonucleotide
gctggagggcgcctgcatcacgaa

SEQ ID NO: 340841 - DNA, 26 bp, Artificial Sequence
  Description of Artificial Sequence: Synthetic oligonucleotide
ctggagggcgcctgcatcacgaagtt

SEQ ID NO: 340842 - DNA, 26 bp, Artificial Sequence
  Description of Artificial Sequence: Synthetic oligonucleotide
tggagggcgcctgcatcacgaagttg

SEQ ID NO: 340843 - DNA, 25 bp, Artificial Sequence
  Description of Artificial Sequence: Synthetic oligonucleotide
ggagggcgcctgcatcacgaagttg

SEQ ID NO: 340844 - DNA, 26 bp, Artificial Sequence
  Description of Artificial Sequence: Synthetic oligonucleotide
gagggcgcctgcatcacgaagttgga

SEQ ID NO: 340845 - DNA, 27 bp, Artificial Sequence
  Description of Artificial Sequence: Synthetic oligonucleotide
agggcgcctgcatcacgaagttggagt

SEQ ID NO: 340846 - DNA, 26 bp, Artificial Sequence
  Description of Artificial Sequence: Synthetic oligonucleotide
gggcgcctgcatcacgaagttggagt

SEQ ID NO: 340847 - DNA, 26 bp, Artificial Sequence
  Description of Artificial Sequence: Synthetic oligonucleotide
ggcgcctgcatcacgaagttggagtc

SEQ ID NO: 340848 - DNA, 27 bp, Artificial Sequence
  Description of Artificial Sequence: Synthetic oligonucleotide
gcgcctgcatcacgaagttggagtcct

SEQ ID NO: 340849 - DNA, 28 bp, Artificial Sequence
  Description of Artificial Sequence: Synthetic oligonucleotide
cgcctgcatcacgaagttggagtccttc

SEQ ID NO: 340850 - DNA, 30 bp, Artificial Sequence
  Description of Artificial Sequence: Synthetic oligonucleotide
gcctgcatcacgaagttggagtccttcatc

SEQ ID NO: 340851 - DNA, 30 bp, Artificial Sequence
  Description of Artificial Sequence: Synthetic oligonucleotide
cctgcatcacgaagttggagtccttcatcc

SEQ ID NO: 340852 - DNA, 31 bp, Artificial Sequence
  Description of Artificial Sequence: Synthetic oligonucleotide
ctgcatcacgaagttggagtccttcatcctg

SEQ ID NO: 340853 - DNA, 31 bp, Artificial Sequence
  Description of Artificial Sequence: Synthetic oligonucleotide
tgcatcacgaagttggagtccttcatcctgg

SEQ ID NO: 340854 - DNA, 30 bp, Artificial Sequence
  Description of Artificial Sequence: Synthetic oligonucleotide
gcatcacgaagttggagtccttcatcctgg

SEQ ID NO: 340855 - DNA, 31 bp, Artificial Sequence
  Description of Artificial Sequence: Synthetic oligonucleotide
catcacgaagttggagtccttcatcctggag

SEQ ID NO: 340856 - DNA, 31 bp, Artificial Sequence
  Description of Artificial Sequence: Synthetic oligonucleotide
atcacgaagttggagtccttcatcctggagc

SEQ ID NO: 340857 - DNA, 30 bp, Artificial Sequence
  Description of Artificial Sequence: Synthetic oligonucleotide
tcacgaagttggagtccttcatcctggagc

SEQ ID NO: 340858 - DNA, 29 bp, Artificial Sequence
  Description of Artificial Sequence: Synthetic oligonucleotide
cacgaagttggagtccttcatcctggagc

SEQ ID NO: 340859 - DNA, 30 bp, Artificial Sequence
  Description of Artificial Sequence: Synthetic oligonucleotide
acgaagttggagtccttcatcctggagcac

SEQ ID NO: 340860 - DNA, 29 bp, Artificial Sequence
  Description of Artificial Sequence: Synthetic oligonucleotide
cgaagttggagtccttcatcctggagcac

SEQ ID NO: 340861 - DNA, 29 bp, Artificial Sequence
  Description of Artificial Sequence: Synthetic oligonucleotide
gaagttggagtccttcatcctggagcacc

SEQ ID NO: 340862 - DNA, 30 bp, Artificial Sequence
  Description of Artificial Sequence: Synthetic oligonucleotide
aagttggagtccttcatcctggagcacctc

SEQ ID NO: 340863 - DNA, 29 bp, Artificial Sequence
  Description of Artificial Sequence: Synthetic oligonucleotide
agttggagtccttcatcctggagcacctc

SEQ ID NO: 340864 - DNA, 28 bp, Artificial Sequence
  Description of Artificial Sequence: Synthetic oligonucleotide
gttggagtccttcatcctggagcacctc

SEQ ID NO: 340865 - DNA, 29 bp, Artificial Sequence
  Description of Artificial Sequence: Synthetic oligonucleotide
ttggagtccttcatcctggagcacctcag

SEQ ID NO: 340866 - DNA, 28 bp, Artificial Sequence
  Description of Artificial Sequence: Synthetic oligonucleotide
tggagtccttcatcctggagcacctcag

SEQ ID NO: 340867 - DNA, 27 bp, Artificial Sequence
  Description of Artificial Sequence: Synthetic oligonucleotide
ggagtccttcatcctggagcacctcag

SEQ ID NO: 340868 - DNA, 27 bp, Artificial Sequence
  Description of Artificial Sequence: Synthetic oligonucleotide
gagtccttcatcctggagcacctcagg

SEQ ID NO: 340869 - DNA, 27 bp, Artificial Sequence
  Description of Artificial Sequence: Synthetic oligonucleotide
agtccttcatcctggagcacctcaggg

SEQ ID NO: 340870 - DNA, 27 bp, Artificial Sequence
  Description of Artificial Sequence: Synthetic oligonucleotide
gtccttcatcctggagcacctcagggt

SEQ ID NO: 340871 - DNA, 27 bp, Artificial Sequence
  Description of Artificial Sequence: Synthetic oligonucleotide
tccttcatcctggagcacctcagggtc

SEQ ID NO: 340872 - DNA, 27 bp, Artificial Sequence
  Description of Artificial Sequence: Synthetic oligonucleotide
ccttcatcctggagcacctcagggtca

SEQ ID NO: 340873 - DNA, 29 bp, Artificial Sequence
  Description of Artificial Sequence: Synthetic oligonucleotide
cttcatcctggagcacctcagggtcattc

SEQ ID NO: 340874 - DNA, 29 bp, Artificial Sequence
  Description of Artificial Sequence: Synthetic oligonucleotide
ttcatcctggagcacctcagggtcattcg

SEQ ID NO: 340875 - DNA, 28 bp, Artificial Sequence
  Description of Artificial Sequence: Synthetic oligonucleotide
tcatcctggagcacctcagggtcattcg

SEQ ID NO: 340876 - DNA, 27 bp, Artificial Sequence
  Description of Artificial Sequence: Synthetic oligonucleotide
catcctggagcacctcagggtcattcg

SEQ ID NO: 340877 - DNA, 27 bp, Artificial Sequence
  Description of Artificial Sequence: Synthetic oligonucleotide
atcctggagcacctcagggtcattcgg

SEQ ID NO: 340878 - DNA, 26 bp, Artificial Sequence
  Description of Artificial Sequence: Synthetic oligonucleotide
tcctggagcacctcagggtcattcgg

SEQ ID NO: 340879 - DNA, 25 bp, Artificial Sequence
  Description of Artificial Sequence: Synthetic oligonucleotide
cctggagcacctcagggtcattcgg

SEQ ID NO: 340880 - DNA, 25 bp, Artificial Sequence
  Description of Artificial Sequence: Synthetic oligonucleotide
ctggagcacctcagggtcattcggg

SEQ ID NO: 340881 - DNA, 26 bp, Artificial Sequence
  Description of Artificial Sequence: Synthetic oligonucleotide
tggagcacctcagggtcattcgggct

SEQ ID NO: 340882 - DNA, 25 bp, Artificial Sequence
  Description of Artificial Sequence: Synthetic oligonucleotide
ggagcacctcagggtcattcgggct

SEQ ID NO: 340883 - DNA, 26 bp, Artificial Sequence
  Description of Artificial Sequence: Synthetic oligonucleotide
gagcacctcagggtcattcgggctgt

SEQ ID NO: 340884 - DNA, 26 bp, Artificial Sequence
  Description of Artificial Sequence: Synthetic oligonucleotide
agcacctcagggtcattcgggctgtg

SEQ ID NO: 340885 - DNA, 25 bp, Artificial Sequence
  Description of Artificial Sequence: Synthetic oligonucleotide
gcacctcagggtcattcgggctgtg

SEQ ID NO: 340886 - DNA, 25 bp, Artificial Sequence
  Description of Artificial Sequence: Synthetic oligonucleotide
cacctcagggtcattcgggctgtgg

SEQ ID NO: 340887 - DNA, 25 bp, Artificial Sequence
  Description of Artificial Sequence: Synthetic oligonucleotide
acctcagggtcattcgggctgtggc

SEQ ID NO: 340888 - DNA, 24 bp, Artificial Sequence
  Description of Artificial Sequence: Synthetic oligonucleotide
cctcagggtcattcgggctgtggc

SEQ ID NO: 340889 - DNA, 26 bp, Artificial Sequence
  Description of Artificial Sequence: Synthetic oligonucleotide
ctcagggtcattcgggctgtggcgat

SEQ ID NO: 340890 - DNA, 26 bp, Artificial Sequence
  Description of Artificial Sequence: Synthetic oligonucleotide
tcagggtcattcgggctgtggcgatc

SEQ ID NO: 340891 - DNA, 25 bp, Artificial Sequence
  Description of Artificial Sequence: Synthetic oligonucleotide
cagggtcattcgggctgtggcgatc

SEQ ID NO: 340892 - DNA, 25 bp, Artificial Sequence
  Description of Artificial Sequence: Synthetic oligonucleotide
agggtcattcgggctgtggcgatcg

SEQ ID NO: 340893 - DNA, 24 bp, Artificial Sequence
  Description of Artificial Sequence: Synthetic oligonucleotide
gggtcattcgggctgtggcgatcg

SEQ ID NO: 340894 - DNA, 24 bp, Artificial Sequence
  Description of Artificial Sequence: Synthetic oligonucleotide
ggtcattcgggctgtggcgatcgg

SEQ ID NO: 340895 - DNA, 27 bp, Artificial Sequence
  Description of Artificial Sequence: Synthetic oligonucleotide
gtcattcgggctgtggcgatcggcata

SEQ ID NO: 340896 - DNA, 27 bp, Artificial Sequence
  Description of Artificial Sequence: Synthetic oligonucleotide
tcattcgggctgtggcgatcggcatag

SEQ ID NO: 340897 - DNA, 26 bp, Artificial Sequence
  Description of Artificial Sequence: Synthetic oligonucleotide
cattcgggctgtggcgatcggcatag

SEQ ID NO: 340898 - DNA, 26 bp, Artificial Sequence
  Description of Artificial Sequence: Synthetic oligonucleotide
attcgggctgtggcgatcggcatagc

SEQ ID NO: 340899 - DNA, 25 bp, Artificial Sequence
  Description of Artificial Sequence: Synthetic oligonucleotide
ttcgggctgtggcgatcggcatagc

SEQ ID NO: 340900 - DNA, 24 bp, Artificial Sequence
  Description of Artificial Sequence: Synthetic oligonucleotide
tcgggctgtggcgatcggcatagc

SEQ ID NO: 340901 - DNA, 23 bp, Artificial Sequence
  Description of Artificial Sequence: Synthetic oligonucleotide
cgggctgtggcgatcggcatagc

SEQ ID NO: 340902 - DNA, 24 bp, Artificial Sequence
  Description of Artificial Sequence: Synthetic oligonucleotide
gggctgtggcgatcggcatagcct

SEQ ID NO: 340903 - DNA, 25 bp, Artificial Sequence
  Description of Artificial Sequence: Synthetic oligonucleotide
ggctgtggcgatcggcatagcctgt

SEQ ID NO: 340904 - DNA, 26 bp, Artificial Sequence
  Description of Artificial Sequence: Synthetic oligonucleotide
gctgtggcgatcggcatagcctgtgt

SEQ ID NO: 340905 - DNA, 26 bp, Artificial Sequence
  Description of Artificial Sequence: Synthetic oligonucleotide
ctgtggcgatcggcatagcctgtgtg

SEQ ID NO: 340906 - DNA, 27 bp, Artificial Sequence
  Description of Artificial Sequence: Synthetic oligonucleotide
tgtggcgatcggcatagcctgtgtgga

SEQ ID NO: 340907 - DNA, 26 bp, Artificial Sequence
  Description of Artificial Sequence: Synthetic oligonucleotide
gtggcgatcggcatagcctgtgtgga

SEQ ID NO: 340908 - DNA, 26 bp, Artificial Sequence
  Description of Artificial Sequence: Synthetic oligonucleotide
tggcgatcggcatagcctgtgtggag

SEQ ID NO: 340909 - DNA, 25 bp, Artificial Sequence
  Description of Artificial Sequence: Synthetic oligonucleotide
ggcgatcggcatagcctgtgtggag

SEQ ID NO: 340910 - DNA, 26 bp, Artificial Sequence
  Description of Artificial Sequence: Synthetic oligonucleotide
gcgatcggcatagcctgtgtggaggt

SEQ ID NO: 340911 - DNA, 27 bp, Artificial Sequence
  Description of Artificial Sequence: Synthetic oligonucleotide
cgatcggcatagcctgtgtggaggtct

SEQ ID NO: 340912 - DNA, 29 bp, Artificial Sequence
  Description of Artificial Sequence: Synthetic oligonucleotide
gatcggcatagcctgtgtggaggtctttg

SEQ ID NO: 340913 - DNA, 29 bp, Artificial Sequence
  Description of Artificial Sequence: Synthetic oligonucleotide
atcggcatagcctgtgtggaggtctttgc

SEQ ID NO: 340914 - DNA, 28 bp, Artificial Sequence
  Description of Artificial Sequence: Synthetic oligonucleotide
tcggcatagcctgtgtggaggtctttgc

SEQ ID NO: 340915 - DNA, 27 bp, Artificial Sequence
  Description of Artificial Sequence: Synthetic oligonucleotide
cggcatagcctgtgtggaggtctttgc

SEQ ID NO: 340916 - DNA, 27 bp, Artificial Sequence
  Description of Artificial Sequence: Synthetic oligonucleotide
ggcatagcctgtgtggaggtctttgcc

SEQ ID NO: 340917 - DNA, 29 bp, Artificial Sequence
  Description of Artificial Sequence: Synthetic oligonucleotide
gcatagcctgtgtggaggtctttgccatg

SEQ ID NO: 340918 - DNA, 31 bp, Artificial Sequence
  Description of Artificial Sequence: Synthetic oligonucleotide
catagcctgtgtggaggtctttgccatgatc

SEQ ID NO: 340919 - DNA, 33 bp, Artificial Sequence
  Description of Artificial Sequence: Synthetic oligonucleotide
atagcctgtgtggaggtctttgccatgatcttg

SEQ ID NO: 340920 - DNA, 32 bp, Artificial Sequence
  Description of Artificial Sequence: Synthetic oligonucleotide
tagcctgtgtggaggtctttgccatgatcttg

SEQ ID NO: 340921 - DNA, 31 bp, Artificial Sequence
  Description of Artificial Sequence: Synthetic oligonucleotide
agcctgtgtggaggtctttgccatgatcttg

SEQ ID NO: 340922 - DNA, 30 bp, Artificial Sequence
  Description of Artificial Sequence: Synthetic oligonucleotide
gcctgtgtggaggtctttgccatgatcttg

SEQ ID NO: 340923 - DNA, 31 bp, Artificial Sequence
  Description of Artificial Sequence: Synthetic oligonucleotide
cctgtgtggaggtctttgccatgatcttgac

SEQ ID NO: 340924 - DNA, 31 bp, Artificial Sequence
  Description of Artificial Sequence: Synthetic oligonucleotide
ctgtgtggaggtctttgccatgatcttgacg

SEQ ID NO: 340925 - DNA, 32 bp, Artificial Sequence
  Description of Artificial Sequence: Synthetic oligonucleotide
tgtgtggaggtctttgccatgatcttgacgtg

SEQ ID NO: 340926 - DNA, 31 bp, Artificial Sequence
  Description of Artificial Sequence: Synthetic oligonucleotide
gtgtggaggtctttgccatgatcttgacgtg

SEQ ID NO: 340927 - DNA, 31 bp, Artificial Sequence
  Description of Artificial Sequence: Synthetic oligonucleotide
tgtggaggtctttgccatgatcttgacgtgc

SEQ ID NO: 340928 - DNA, 30 bp, Artificial Sequence
  Description of Artificial Sequence: Synthetic oligonucleotide
gtggaggtctttgccatgatcttgacgtgc

SEQ ID NO: 340929 - DNA, 31 bp, Artificial Sequence
  Description of Artificial Sequence: Synthetic oligonucleotide
tggaggtctttgccatgatcttgacgtgctg

SEQ ID NO: 340930 - DNA, 30 bp, Artificial Sequence
  Description of Artificial Sequence: Synthetic oligonucleotide
ggaggtctttgccatgatcttgacgtgctg

SEQ ID NO: 340931 - DNA, 30 bp, Artificial Sequence
  Description of Artificial Sequence: Synthetic oligonucleotide
gaggtctttgccatgatcttgacgtgctgc

SEQ ID NO: 340932 - DNA, 30 bp, Artificial Sequence
  Description of Artificial Sequence: Synthetic oligonucleotide
aggtctttgccatgatcttgacgtgctgcg

SEQ ID NO: 340933 - DNA, 29 bp, Artificial Sequence
  Description of Artificial Sequence: Synthetic oligonucleotide
ggtctttgccatgatcttgacgtgctgcg

SEQ ID NO: 340934 - DNA, 30 bp, Artificial Sequence
  Description of Artificial Sequence: Synthetic oligonucleotide
gtctttgccatgatcttgacgtgctgcgtg

SEQ ID NO: 340935 - DNA, 32 bp, Artificial Sequence
  Description of Artificial Sequence: Synthetic oligonucleotide
tctttgccatgatcttgacgtgctgcgtgtac

SEQ ID NO: 340936 - DNA, 31 bp, Artificial Sequence
  Description of Artificial Sequence: Synthetic oligonucleotide
ctttgccatgatcttgacgtgctgcgtgtac

SEQ ID NO: 340937 - DNA, 32 bp, Artificial Sequence
  Description of Artificial Sequence: Synthetic oligonucleotide
tttgccatgatcttgacgtgctgcgtgtacag

SEQ ID NO: 340938 - DNA, 31 bp, Artificial Sequence
  Description of Artificial Sequence: Synthetic oligonucleotide
ttgccatgatcttgacgtgctgcgtgtacag

SEQ ID NO: 340939 - DNA, 30 bp, Artificial Sequence
  Description of Artificial Sequence: Synthetic oligonucleotide
tgccatgatcttgacgtgctgcgtgtacag

SEQ ID NO: 340940 - DNA, 29 bp, Artificial Sequence
  Description of Artificial Sequence: Synthetic oligonucleotide
gccatgatcttgacgtgctgcgtgtacag

SEQ ID NO: 340941 - DNA, 29 bp, Artificial Sequence
  Description of Artificial Sequence: Synthetic oligonucleotide
ccatgatcttgacgtgctgcgtgtacagg

SEQ ID NO: 340942 - DNA, 30 bp, Artificial Sequence
  Description of Artificial Sequence: Synthetic oligonucleotide
catgatcttgacgtgctgcgtgtacaggac

SEQ ID NO: 340943 - DNA, 31 bp, Artificial Sequence
  Description of Artificial Sequence: Synthetic oligonucleotide
atgatcttgacgtgctgcgtgtacaggactc

SEQ ID NO: 340944 - DNA, 30 bp, Artificial Sequence
  Description of Artificial Sequence: Synthetic oligonucleotide
tgatcttgacgtgctgcgtgtacaggactc

SEQ ID NO: 340945 - DNA, 29 bp, Artificial Sequence
  Description of Artificial Sequence: Synthetic oligonucleotide
gatcttgacgtgctgcgtgtacaggactc

SEQ ID NO: 340946 - DNA, 30 bp, Artificial Sequence
  Description of Artificial Sequence: Synthetic oligonucleotide
atcttgacgtgctgcgtgtacaggactctc

SEQ ID NO: 340947 - DNA, 29 bp, Artificial Sequence
  Description of Artificial Sequence: Synthetic oligonucleotide
tcttgacgtgctgcgtgtacaggactctc

SEQ ID NO: 340948 - DNA, 28 bp, Artificial Sequence
  Description of Artificial Sequence: Synthetic oligonucleotide
cttgacgtgctgcgtgtacaggactctc

SEQ ID NO: 340949 - DNA, 30 bp, Artificial Sequence
  Description of Artificial Sequence: Synthetic oligonucleotide
ttgacgtgctgcgtgtacaggactctcaag

SEQ ID NO: 340950 - DNA, 29 bp, Artificial Sequence
  Description of Artificial Sequence: Synthetic oligonucleotide
tgacgtgctgcgtgtacaggactctcaag

SEQ ID NO: 340951 - DNA, 28 bp, Artificial Sequence
  Description of Artificial Sequence: Synthetic oligonucleotide
gacgtgctgcgtgtacaggactctcaag

SEQ ID NO: 340952 - DNA, 28 bp, Artificial Sequence
  Description of Artificial Sequence: Synthetic oligonucleotide
acgtgctgcgtgtacaggactctcaagc

SEQ ID NO: 340953 - DNA, 27 bp, Artificial Sequence
  Description of Artificial Sequence: Synthetic oligonucleotide
cgtgctgcgtgtacaggactctcaagc

SEQ ID NO: 340954 - DNA, 28 bp, Artificial Sequence
  Description of Artificial Sequence: Synthetic oligonucleotide
gtgctgcgtgtacaggactctcaagctc

SEQ ID NO: 340955 - DNA, 28 bp, Artificial Sequence
  Description of Artificial Sequence: Synthetic oligonucleotide
tgctgcgtgtacaggactctcaagctcg

SEQ ID NO: 340956 - DNA, 27 bp, Artificial Sequence
  Description of Artificial Sequence: Synthetic oligonucleotide
gctgcgtgtacaggactctcaagctcg

SEQ ID NO: 340957 - DNA, 28 bp, Artificial Sequence
  Description of Artificial Sequence: Synthetic oligonucleotide
ctgcgtgtacaggactctcaagctcgag

SEQ ID NO: 340958 - DNA, 28 bp, Artificial Sequence
  Description of Artificial Sequence: Synthetic oligonucleotide
tgcgtgtacaggactctcaagctcgagc

SEQ ID NO: 340959 - DNA, 27 bp, Artificial Sequence
  Description of Artificial Sequence: Synthetic oligonucleotide
gcgtgtacaggactctcaagctcgagc

SEQ ID NO: 340960 - DNA, 28 bp, Artificial Sequence
  Description of Artificial Sequence: Synthetic oligonucleotide
cgtgtacaggactctcaagctcgagcac

SEQ ID NO: 340961 - DNA, 30 bp, Artificial Sequence
  Description of Artificial Sequence: Synthetic oligonucleotide
gtgtacaggactctcaagctcgagcactac

SEQ ID NO: 340962 - DNA, 31 bp, Artificial Sequence
  Description of Artificial Sequence: Synthetic oligonucleotide
tgtacaggactctcaagctcgagcactacag

SEQ ID NO: 340963 - DNA, 30 bp, Artificial Sequence
  Description of Artificial Sequence: Synthetic oligonucleotide
gtacaggactctcaagctcgagcactacag

SEQ ID NO: 340964 - DNA, 26 bp, Artificial Sequence
  Description of Artificial Sequence: Synthetic oligonucleotide
atgaggctggtctgggggcagatctg

SEQ ID NO: 340965 - DNA, 25 bp, Artificial Sequence
  Description of Artificial Sequence: Synthetic oligonucleotide
tgaggctggtctgggggcagatctg

SEQ ID NO: 340966 - DNA, 24 bp, Artificial Sequence
  Description of Artificial Sequence: Synthetic oligonucleotide
gaggctggtctgggggcagatctg

SEQ ID NO: 340967 - DNA, 24 bp, Artificial Sequence
  Description of Artificial Sequence: Synthetic oligonucleotide
aggctggtctgggggcagatctgg

SEQ ID NO: 340968 - DNA, 23 bp, Artificial Sequence
  Description of Artificial Sequence: Synthetic oligonucleotide
ggctggtctgggggcagatctgg

SEQ ID NO: 340969 - DNA, 23 bp, Artificial Sequence
  Description of Artificial Sequence: Synthetic oligonucleotide
gctggtctgggggcagatctggg

SEQ ID NO: 340970 - DNA, 25 bp, Artificial Sequence
  Description of Artificial Sequence: Synthetic oligonucleotide
ctggtctgggggcagatctgggctt

SEQ ID NO: 340971 - DNA, 25 bp, Artificial Sequence
  Description of Artificial Sequence: Synthetic oligonucleotide
tggtctgggggcagatctgggcttc

SEQ ID NO: 340972 - DNA, 24 bp, Artificial Sequence
  Description of Artificial Sequence: Synthetic oligonucleotide
ggtctgggggcagatctgggcttc

SEQ ID NO: 340973 - DNA, 25 bp, Artificial Sequence
  Description of Artificial Sequence: Synthetic oligonucleotide
gtctgggggcagatctgggcttcca

SEQ ID NO: 340974 - DNA, 25 bp, Artificial Sequence
  Description of Artificial Sequence: Synthetic oligonucleotide
tctgggggcagatctgggcttccag

SEQ ID NO: 340975 - DNA, 24 bp, Artificial Sequence
  Description of Artificial Sequence: Synthetic oligonucleotide
ctgggggcagatctgggcttccag

SEQ ID NO: 340976 - DNA, 26 bp, Artificial Sequence
  Description of Artificial Sequence: Synthetic oligonucleotide
tgggggcagatctgggcttccagctt

SEQ ID NO: 340977 - DNA, 25 bp, Artificial Sequence
  Description of Artificial Sequence: Synthetic oligonucleotide
gggggcagatctgggcttccagctt

SEQ ID NO: 340978 - DNA, 27 bp, Artificial Sequence
  Description of Artificial Sequence: Synthetic oligonucleotide
ggggcagatctgggcttccagcttcat

SEQ ID NO: 340979 - DNA, 27 bp, Artificial Sequence
  Description of Artificial Sequence: Synthetic oligonucleotide
gggcagatctgggcttccagcttcatc

SEQ ID NO: 340980 - DNA, 28 bp, Artificial Sequence
  Description of Artificial Sequence: Synthetic oligonucleotide
ggcagatctgggcttccagcttcatcac

SEQ ID NO: 340981 - DNA, 28 bp, Artificial Sequence
  Description of Artificial Sequence: Synthetic oligonucleotide
gcagatctgggcttccagcttcatcacc

SEQ ID NO: 340982 - DNA, 32 bp, Artificial Sequence
  Description of Artificial Sequence: Synthetic oligonucleotide
cagatctgggcttccagcttcatcaccttatg

SEQ ID NO: 340983 - DNA, 33 bp, Artificial Sequence
  Description of Artificial Sequence: Synthetic oligonucleotide
agatctgggcttccagcttcatcaccttatgtc

SEQ ID NO: 340984 - DNA, 32 bp, Artificial Sequence
  Description of Artificial Sequence: Synthetic oligonucleotide
gatctgggcttccagcttcatcaccttatgtc

SEQ ID NO: 340985 - DNA, 33 bp, Artificial Sequence
  Description of Artificial Sequence: Synthetic oligonucleotide
atctgggcttccagcttcatcaccttatgtctg

SEQ ID NO: 340986 - DNA, 32 bp, Artificial Sequence
  Description of Artificial Sequence: Synthetic oligonucleotide
tctgggcttccagcttcatcaccttatgtctg

SEQ ID NO: 340987 - DNA, 31 bp, Artificial Sequence
  Description of Artificial Sequence: Synthetic oligonucleotide
ctgggcttccagcttcatcaccttatgtctg

SEQ ID NO: 340988 - DNA, 31 bp, Artificial Sequence
  Description of Artificial Sequence: Synthetic oligonucleotide
tgggcttccagcttcatcaccttatgtctgc

SEQ ID NO: 340989 - DNA, 30 bp, Artificial Sequence
  Description of Artificial Sequence: Synthetic oligonucleotide
gggcttccagcttcatcaccttatgtctgc

SEQ ID NO: 340990 - DNA, 31 bp, Artificial Sequence
  Description of Artificial Sequence: Synthetic oligonucleotide
ggcttccagcttcatcaccttatgtctgcag

SEQ ID NO: 340991 - DNA, 33 bp, Artificial Sequence
  Description of Artificial Sequence: Synthetic oligonucleotide
gcttccagcttcatcaccttatgtctgcagaac

SEQ ID NO: 340992 - DNA, 33 bp, Artificial Sequence
  Description of Artificial Sequence: Synthetic oligonucleotide
cttccagcttcatcaccttatgtctgcagaacc

SEQ ID NO: 340993 - DNA, 33 bp, Artificial Sequence
  Description of Artificial Sequence: Synthetic oligonucleotide
ttccagcttcatcaccttatgtctgcagaaccc

SEQ ID NO: 340994 - DNA, 32 bp, Artificial Sequence
  Description of Artificial Sequence: Synthetic oligonucleotide
tccagcttcatcaccttatgtctgcagaaccc

SEQ ID NO: 340995 - DNA, 31 bp, Artificial Sequence
  Description of Artificial Sequence: Synthetic oligonucleotide
ccagcttcatcaccttatgtctgcagaaccc

SEQ ID NO: 340996 - DNA, 31 bp, Artificial Sequence
  Description of Artificial Sequence: Synthetic oligonucleotide
cagcttcatcaccttatgtctgcagaacccc

SEQ ID NO: 340997 - DNA, 32 bp, Artificial Sequence
  Description of Artificial Sequence: Synthetic oligonucleotide
agcttcatcaccttatgtctgcagaaccccag

SEQ ID NO: 340998 - DNA, 31 bp, Artificial Sequence
  Description of Artificial Sequence: Synthetic oligonucleotide
gcttcatcaccttatgtctgcagaaccccag

SEQ ID NO: 340999 - DNA, 31 bp, Artificial Sequence
  Description of Artificial Sequence: Synthetic oligonucleotide
cttcatcaccttatgtctgcagaaccccagg

SEQ ID NO: 341000 - DNA, 33 bp, Artificial Sequence
  Description of Artificial Sequence: Synthetic oligonucleotide
ttcatcaccttatgtctgcagaaccccaggttg

SEQ ID NO: 341001 - DNA, 32 bp, Artificial Sequence
  Description of Artificial Sequence: Synthetic oligonucleotide
tcatcaccttatgtctgcagaaccccaggttg

SEQ ID NO: 341002 - DNA, 31 bp, Artificial Sequence
  Description of Artificial Sequence: Synthetic oligonucleotide
catcaccttatgtctgcagaaccccaggttg

SEQ ID NO: 341003 - DNA, 31 bp, Artificial Sequence
  Description of Artificial Sequence: Synthetic oligonucleotide
atcaccttatgtctgcagaaccccaggttgg

SEQ ID NO: 341004 - DNA, 30 bp, Artificial Sequence
  Description of Artificial Sequence: Synthetic oligonucleotide
tcaccttatgtctgcagaaccccaggttgg

SEQ ID NO: 341005 - DNA, 29 bp, Artificial Sequence
  Description of Artificial Sequence: Synthetic oligonucleotide
caccttatgtctgcagaaccccaggttgg

SEQ ID NO: 341006 - DNA, 30 bp, Artificial Sequence
  Description of Artificial Sequence: Synthetic oligonucleotide
accttatgtctgcagaaccccaggttggtc

SEQ ID NO: 341007 - DNA, 29 bp, Artificial Sequence
  Description of Artificial Sequence: Synthetic oligonucleotide
ccttatgtctgcagaaccccaggttggtc

SEQ ID NO: 341008 - DNA, 31 bp, Artificial Sequence
  Description of Artificial Sequence: Synthetic oligonucleotide
cttatgtctgcagaaccccaggttggtcttg

SEQ ID NO: 341009 - DNA, 33 bp, Artificial Sequence
  Description of Artificial Sequence: Synthetic oligonucleotide
ttatgtctgcagaaccccaggttggtcttgttc

SEQ ID NO: 341010 - DNA, 32 bp, Artificial Sequence
  Description of Artificial Sequence: Synthetic oligonucleotide
tatgtctgcagaaccccaggttggtcttgttc

SEQ ID NO: 341011 - DNA, 31 bp, Artificial Sequence
  Description of Artificial Sequence: Synthetic oligonucleotide
atgtctgcagaaccccaggttggtcttgttc

SEQ ID NO: 341012 - DNA, 30 bp, Artificial Sequence
  Description of Artificial Sequence: Synthetic oligonucleotide
tgtctgcagaaccccaggttggtcttgttc

SEQ ID NO: 341013 - DNA, 29 bp, Artificial Sequence
  Description of Artificial Sequence: Synthetic oligonucleotide
gtctgcagaaccccaggttggtcttgttc

SEQ ID NO: 341014 - DNA, 30 bp, Artificial Sequence
  Description of Artificial Sequence: Synthetic oligonucleotide
tctgcagaaccccaggttggtcttgttctg

SEQ ID NO: 341015 - DNA, 29 bp, Artificial Sequence
  Description of Artificial Sequence: Synthetic oligonucleotide
ctgcagaaccccaggttggtcttgttctg

SEQ ID NO: 341016 - DNA, 30 bp, Artificial Sequence
  Description of Artificial Sequence: Synthetic oligonucleotide
tgcagaaccccaggttggtcttgttctgtc

SEQ ID NO: 341017 - DNA, 29 bp, Artificial Sequence
  Description of Artificial Sequence: Synthetic oligonucleotide
gcagaaccccaggttggtcttgttctgtc

SEQ ID NO: 341018 - DNA, 29 bp, Artificial Sequence
  Description of Artificial Sequence: Synthetic oligonucleotide
cagaaccccaggttggtcttgttctgtcc

SEQ ID NO: 341019 - DNA, 31 bp, Artificial Sequence
  Description of Artificial Sequence: Synthetic oligonucleotide
agaaccccaggttggtcttgttctgtccttc

SEQ ID NO: 341020 - DNA, 30 bp, Artificial Sequence
  Description of Artificial Sequence: Synthetic oligonucleotide
gaaccccaggttggtcttgttctgtccttc

SEQ ID NO: 341021 - DNA, 31 bp, Artificial Sequence
  Description of Artificial Sequence: Synthetic oligonucleotide
aaccccaggttggtcttgttctgtccttctg

SEQ ID NO: 341022 - DNA, 30 bp, Artificial Sequence
  Description of Artificial Sequence: Synthetic oligonucleotide
accccaggttggtcttgttctgtccttctg

SEQ ID NO: 341023 - DNA, 29 bp, Artificial Sequence
  Description of Artificial Sequence: Synthetic oligonucleotide
ccccaggttggtcttgttctgtccttctg

SEQ ID NO: 341024 - DNA, 30 bp, Artificial Sequence
  Description of Artificial Sequence: Synthetic oligonucleotide
cccaggttggtcttgttctgtccttctgtc

SEQ ID NO: 341025 - DNA, 30 bp, Artificial Sequence
  Description of Artificial Sequence: Synthetic oligonucleotide
ccaggttggtcttgttctgtccttctgtcg

SEQ ID NO: 341026 - DNA, 32 bp, Artificial Sequence
  Description of Artificial Sequence: Synthetic oligonucleotide
caggttggtcttgttctgtccttctgtcgttc

SEQ ID NO: 341027 - DNA, 34 bp, Artificial Sequence
  Description of Artificial Sequence: Synthetic oligonucleotide
aggttggtcttgttctgtccttctgtcgttcatc

SEQ ID NO: 341028 - DNA, 33 bp, Artificial Sequence
  Description of Artificial Sequence: Synthetic oligonucleotide
ggttggtcttgttctgtccttctgtcgttcatc

SEQ ID NO: 341029 - DNA, 34 bp, Artificial Sequence
  Description of Artificial Sequence: Synthetic oligonucleotide
gttggtcttgttctgtccttctgtcgttcatctg

SEQ ID NO: 341030 - DNA, 34 bp, Artificial Sequence
  Description of Artificial Sequence: Synthetic oligonucleotide
ttggtcttgttctgtccttctgtcgttcatctgc

SEQ ID NO: 341031 - DNA, 33 bp, Artificial Sequence
  Description of Artificial Sequence: Synthetic oligonucleotide
tggtcttgttctgtccttctgtcgttcatctgc

SEQ ID NO: 341032 - DNA, 32 bp, Artificial Sequence
  Description of Artificial Sequence: Synthetic oligonucleotide
ggtcttgttctgtccttctgtcgttcatctgc

SEQ ID NO: 341033 - DNA, 32 bp, Artificial Sequence
  Description of Artificial Sequence: Synthetic oligonucleotide
gtcttgttctgtccttctgtcgttcatctgcg

SEQ ID NO: 341034 - DNA, 32 bp, Artificial Sequence
  Description of Artificial Sequence: Synthetic oligonucleotide
tcttgttctgtccttctgtcgttcatctgcgg

SEQ ID NO: 341035 - DNA, 31 bp, Artificial Sequence
  Description of Artificial Sequence: Synthetic oligonucleotide
cttgttctgtccttctgtcgttcatctgcgg

SEQ ID NO: 341036 - DNA, 31 bp, Artificial Sequence
  Description of Artificial Sequence: Synthetic oligonucleotide
ttgttctgtccttctgtcgttcatctgcggg

SEQ ID NO: 341037 - DNA, 30 bp, Artificial Sequence
  Description of Artificial Sequence: Synthetic oligonucleotide
tgttctgtccttctgtcgttcatctgcggg

SEQ ID NO: 341038 - DNA, 29 bp, Artificial Sequence
  Description of Artificial Sequence: Synthetic oligonucleotide
gttctgtccttctgtcgttcatctgcggg

SEQ ID NO: 341039 - DNA, 30 bp, Artificial Sequence
  Description of Artificial Sequence: Synthetic oligonucleotide
ttctgtccttctgtcgttcatctgcgggtc

SEQ ID NO: 341040 - DNA, 29 bp, Artificial Sequence
  Description of Artificial Sequence: Synthetic oligonucleotide
tctgtccttctgtcgttcatctgcgggtc

SEQ ID NO: 341041 - DNA, 28 bp, Artificial Sequence
  Description of Artificial Sequence: Synthetic oligonucleotide
ctgtccttctgtcgttcatctgcgggtc

SEQ ID NO: 341042 - DNA, 28 bp, Artificial Sequence
  Description of Artificial Sequence: Synthetic oligonucleotide
tgtccttctgtcgttcatctgcgggtcc

SEQ ID NO: 341043 - DNA, 27 bp, Artificial Sequence
  Description of Artificial Sequence: Synthetic oligonucleotide
gtccttctgtcgttcatctgcgggtcc

SEQ ID NO: 341044 - DNA, 27 bp, Artificial Sequence
  Description of Artificial Sequence: Synthetic oligonucleotide
tccttctgtcgttcatctgcgggtccc

SEQ ID NO: 341045 - DNA, 26 bp, Artificial Sequence
  Description of Artificial Sequence: Synthetic oligonucleotide
ccttctgtcgttcatctgcgggtccc

SEQ ID NO: 341046 - DNA, 26 bp, Artificial Sequence
  Description of Artificial Sequence: Synthetic oligonucleotide
cttctgtcgttcatctgcgggtcccc

SEQ ID NO: 341047 - DNA, 27 bp, Artificial Sequence
  Description of Artificial Sequence: Synthetic oligonucleotide
ttctgtcgttcatctgcgggtccccca

SEQ ID NO: 341048 - DNA, 27 bp, Artificial Sequence
  Description of Artificial Sequence: Synthetic oligonucleotide
tctgtcgttcatctgcgggtcccccaa

SEQ ID NO: 341049 - DNA, 27 bp, Artificial Sequence
  Description of Artificial Sequence: Synthetic oligonucleotide
ctgtcgttcatctgcgggtcccccaat

SEQ ID NO: 341050 - DNA, 27 bp, Artificial Sequence
  Description of Artificial Sequence: Synthetic oligonucleotide
tgtcgttcatctgcgggtcccccaatc

SEQ ID NO: 341051 - DNA, 26 bp, Artificial Sequence
  Description of Artificial Sequence: Synthetic oligonucleotide
gtcgttcatctgcgggtcccccaatc

SEQ ID NO: 341052 - DNA, 26 bp, Artificial Sequence
  Description of Artificial Sequence: Synthetic oligonucleotide
tcgttcatctgcgggtcccccaatcg

SEQ ID NO: 341053 - DNA, 25 bp, Artificial Sequence
  Description of Artificial Sequence: Synthetic oligonucleotide
cgttcatctgcgggtcccccaatcg

SEQ ID NO: 341054 - DNA, 26 bp, Artificial Sequence
  Description of Artificial Sequence: Synthetic oligonucleotide
gttcatctgcgggtcccccaatcggt

SEQ ID NO: 341055 - DNA, 26 bp, Artificial Sequence
  Description of Artificial Sequence: Synthetic oligonucleotide
ttcatctgcgggtcccccaatcggtg

SEQ ID NO: 341056 - DNA, 25 bp, Artificial Sequence
  Description of Artificial Sequence: Synthetic oligonucleotide
tcatctgcgggtcccccaatcggtg

SEQ ID NO: 341057 - DNA, 24 bp, Artificial Sequence
  Description of Artificial Sequence: Synthetic oligonucleotide
catctgcgggtcccccaatcggtg

SEQ ID NO: 341058 - DNA, 24 bp, Artificial Sequence
  Description of Artificial Sequence: Synthetic oligonucleotide
atctgcgggtcccccaatcggtgg

SEQ ID NO: 341059 - DNA, 23 bp, Artificial Sequence
  Description of Artificial Sequence: Synthetic oligonucleotide
tctgcgggtcccccaatcggtgg

SEQ ID NO: 341060 - DNA, 22 bp, Artificial Sequence
  Description of Artificial Sequence: Synthetic oligonucleotide
ctgcgggtcccccaatcggtgg

SEQ ID NO: 341061 - DNA, 22 bp, Artificial Sequence
  Description of Artificial Sequence: Synthetic oligonucleotide
tgcgggtcccccaatcggtggg

SEQ ID NO: 341062 - DNA, 21 bp, Artificial Sequence
  Description of Artificial Sequence: Synthetic oligonucleotide
gcgggtcccccaatcggtggg

SEQ ID NO: 341063 - DNA, 21 bp, Artificial Sequence
  Description of Artificial Sequence: Synthetic oligonucleotide
cgggtcccccaatcggtgggc

SEQ ID NO: 341064 - DNA, 22 bp, Artificial Sequence
  Description of Artificial Sequence: Synthetic oligonucleotide
gggtcccccaatcggtgggcgt

SEQ ID NO: 341065 - DNA, 22 bp, Artificial Sequence
  Description of Artificial Sequence: Synthetic oligonucleotide
ggtcccccaatcggtgggcgtg

SEQ ID NO: 341066 - DNA, 23 bp, Artificial Sequence
  Description of Artificial Sequence: Synthetic oligonucleotide
gtcccccaatcggtgggcgtgca

SEQ ID NO: 341067 - DNA, 23 bp, Artificial Sequence
  Description of Artificial Sequence: Synthetic oligonucleotide
tcccccaatcggtgggcgtgcag

SEQ ID NO: 341068 - DNA, 22 bp, Artificial Sequence
  Description of Artificial Sequence: Synthetic oligonucleotide
cccccaatcggtgggcgtgcag

SEQ ID NO: 341069 - DNA, 23 bp, Artificial Sequence
  Description of Artificial Sequence: Synthetic oligonucleotide
ccccaatcggtgggcgtgcagct

SEQ ID NO: 341070 - DNA, 23 bp, Artificial Sequence
  Description of Artificial Sequence: Synthetic oligonucleotide
cccaatcggtgggcgtgcagctc

SEQ ID NO: 341071 - DNA, 24 bp, Artificial Sequence
  Description of Artificial Sequence: Synthetic oligonucleotide
ccaatcggtgggcgtgcagctcga

SEQ ID NO: 341072 - DNA, 24 bp, Artificial Sequence
  Description of Artificial Sequence: Synthetic oligonucleotide
caatcggtgggcgtgcagctcgag

SEQ ID NO: 341073 - DNA, 26 bp, Artificial Sequence
  Description of Artificial Sequence: Synthetic oligonucleotide
aatcggtgggcgtgcagctcgaggat

SEQ ID NO: 341074 - DNA, 25 bp, Artificial Sequence
  Description of Artificial Sequence: Synthetic oligonucleotide
atcggtgggcgtgcagctcgaggat

SEQ ID NO: 341075 - DNA, 24 bp, Artificial Sequence
  Description of Artificial Sequence: Synthetic oligonucleotide
tcggtgggcgtgcagctcgaggat

SEQ ID NO: 341076 - DNA, 23 bp, Artificial Sequence
  Description of Artificial Sequence: Synthetic oligonucleotide
cggtgggcgtgcagctcgaggat

SEQ ID NO: 341077 - DNA, 24 bp, Artificial Sequence
  Description of Artificial Sequence: Synthetic oligonucleotide
ggtgggcgtgcagctcgaggatgt

SEQ ID NO: 341078 - DNA, 24 bp, Artificial Sequence
  Description of Artificial Sequence: Synthetic oligonucleotide
gtgggcgtgcagctcgaggatgtg

SEQ ID NO: 341079 - DNA, 24 bp, Artificial Sequence
  Description of Artificial Sequence: Synthetic oligonucleotide
tgggcgtgcagctcgaggatgtgc

SEQ ID NO: 341080 - DNA, 23 bp, Artificial Sequence
  Description of Artificial Sequence: Synthetic oligonucleotide
gggcgtgcagctcgaggatgtgc

SEQ ID NO: 341081 - DNA, 23 bp, Artificial Sequence
  Description of Artificial Sequence: Synthetic oligonucleotide
ggcgtgcagctcgaggatgtgcg

SEQ ID NO: 341082 - DNA, 23 bp, Artificial Sequence
  Description of Artificial Sequence: Synthetic oligonucleotide
gcgtgcagctcgaggatgtgcgc

SEQ ID NO: 341083 - DNA, 23 bp, Artificial Sequence
  Description of Artificial Sequence: Synthetic oligonucleotide
cgtgcagctcgaggatgtgcgcc

SEQ ID NO: 341084 - DNA, 24 bp, Artificial Sequence
  Description of Artificial Sequence: Synthetic oligonucleotide
gtgcagctcgaggatgtgcgccga

SEQ ID NO: 341085 - DNA, 24 bp, Artificial Sequence
  Description of Artificial Sequence: Synthetic oligonucleotide
tgcagctcgaggatgtgcgccgag

SEQ ID NO: 341086 - DNA, 23 bp, Artificial Sequence
  Description of Artificial Sequence: Synthetic oligonucleotide
gcagctcgaggatgtgcgccgag

SEQ ID NO: 341087 - DNA, 24 bp, Artificial Sequence
  Description of Artificial Sequence: Synthetic oligonucleotide
cagctcgaggatgtgcgccgagga

SEQ ID NO: 341088 - DNA, 25 bp, Artificial Sequence
  Description of Artificial Sequence: Synthetic oligonucleotide
agctcgaggatgtgcgccgaggaca

SEQ ID NO: 341089 - DNA, 24 bp, Artificial Sequence
  Description of Artificial Sequence: Synthetic oligonucleotide
gctcgaggatgtgcgccgaggaca

SEQ ID NO: 341090 - DNA, 24 bp, Artificial Sequence
  Description of Artificial Sequence: Synthetic oligonucleotide
ctcgaggatgtgcgccgaggacac

SEQ ID NO: 341091 - DNA, 26 bp, Artificial Sequence
  Description of Artificial Sequence: Synthetic oligonucleotide
tcgaggatgtgcgccgaggacacgta

SEQ ID NO: 341092 - DNA, 25 bp, Artificial Sequence
  Description of Artificial Sequence: Synthetic oligonucleotide
cgaggatgtgcgccgaggacacgta

SEQ ID NO: 341093 - DNA, 26 bp, Artificial Sequence
  Description of Artificial Sequence: Synthetic oligonucleotide
gaggatgtgcgccgaggacacgtagt

SEQ ID NO: 341094 - DNA, 27 bp, Artificial Sequence
  Description of Artificial Sequence: Synthetic oligonucleotide
aggatgtgcgccgaggacacgtagtga

SEQ ID NO: 341095 - DNA, 27 bp, Artificial Sequence
  Description of Artificial Sequence: Synthetic oligonucleotide
ggatgtgcgccgaggacacgtagtgaa

SEQ ID NO: 341096 - DNA, 28 bp, Artificial Sequence
  Description of Artificial Sequence: Synthetic oligonucleotide
gatgtgcgccgaggacacgtagtgaaac

SEQ ID NO: 341097 - DNA, 28 bp, Artificial Sequence
  Description of Artificial Sequence: Synthetic oligonucleotide
atgtgcgccgaggacacgtagtgaaacg

SEQ ID NO: 341098 - DNA, 27 bp, Artificial Sequence
  Description of Artificial Sequence: Synthetic oligonucleotide
tgtgcgccgaggacacgtagtgaaacg

SEQ ID NO: 341099 - DNA, 27 bp, Artificial Sequence
  Description of Artificial Sequence: Synthetic oligonucleotide
gtgcgccgaggacacgtagtgaaacga

SEQ ID NO: 341100 - DNA, 28 bp, Artificial Sequence
  Description of Artificial Sequence: Synthetic oligonucleotide
tgcgccgaggacacgtagtgaaacgatc

SEQ ID NO: 341101 - DNA, 27 bp, Artificial Sequence
  Description of Artificial Sequence: Synthetic oligonucleotide
gcgccgaggacacgtagtgaaacgatc

SEQ ID NO: 341102 - DNA, 28 bp, Artificial Sequence
  Description of Artificial Sequence: Synthetic oligonucleotide
cgccgaggacacgtagtgaaacgatcag

SEQ ID NO: 341103 - DNA, 29 bp, Artificial Sequence
  Description of Artificial Sequence: Synthetic oligonucleotide
gccgaggacacgtagtgaaacgatcagtg

SEQ ID NO: 341104 - DNA, 31 bp, Artificial Sequence
  Description of Artificial Sequence: Synthetic oligonucleotide
ccgaggacacgtagtgaaacgatcagtgtac

SEQ ID NO: 341105 - DNA, 31 bp, Artificial Sequence
  Description of Artificial Sequence: Synthetic oligonucleotide
cgaggacacgtagtgaaacgatcagtgtacc

SEQ ID NO: 341106 - DNA, 32 bp, Artificial Sequence
  Description of Artificial Sequence: Synthetic oligonucleotide
gaggacacgtagtgaaacgatcagtgtacctg

SEQ ID NO: 341107 - DNA, 33 bp, Artificial Sequence
  Description of Artificial Sequence: Synthetic oligonucleotide
aggacacgtagtgaaacgatcagtgtacctgag

SEQ ID NO: 341108 - DNA, 32 bp, Artificial Sequence
  Description of Artificial Sequence: Synthetic oligonucleotide
ggacacgtagtgaaacgatcagtgtacctgag

SEQ ID NO: 341109 - DNA, 35 bp, Artificial Sequence
  Description of Artificial Sequence: Synthetic oligonucleotide
gacacgtagtgaaacgatcagtgtacctgagaaag

SEQ ID NO: 341110 - DNA, 35 bp, Artificial Sequence
  Description of Artificial Sequence: Synthetic oligonucleotide
acacgtagtgaaacgatcagtgtacctgagaaagc

SEQ ID NO: 341111 - DNA, 34 bp, Artificial Sequence
  Description of Artificial Sequence: Synthetic oligonucleotide
cacgtagtgaaacgatcagtgtacctgagaaagc

SEQ ID NO: 341112 - DNA, 34 bp, Artificial Sequence
  Description of Artificial Sequence: Synthetic oligonucleotide
acgtagtgaaacgatcagtgtacctgagaaagcc

SEQ ID NO: 341113 - DNA, 33 bp, Artificial Sequence
  Description of Artificial Sequence: Synthetic oligonucleotide
cgtagtgaaacgatcagtgtacctgagaaagcc

SEQ ID NO: 341114 - DNA, 35 bp, Artificial Sequence
  Description of Artificial Sequence: Synthetic oligonucleotide
gtagtgaaacgatcagtgtacctgagaaagccatc

SEQ ID NO: 341115 - DNA, 36 bp, Artificial Sequence
  Description of Artificial Sequence: Synthetic oligonucleotide
tagtgaaacgatcagtgtacctgagaaagccatctc

SEQ ID NO: 341116 - DNA, 35 bp, Artificial Sequence
  Description of Artificial Sequence: Synthetic oligonucleotide
agtgaaacgatcagtgtacctgagaaagccatctc

SEQ ID NO: 341117 - DNA, 34 bp, Artificial Sequence
  Description of Artificial Sequence: Synthetic oligonucleotide
gtgaaacgatcagtgtacctgagaaagccatctc

SEQ ID NO: 341118 - DNA, 34 bp, Artificial Sequence
  Description of Artificial Sequence: Synthetic oligonucleotide
tgaaacgatcagtgtacctgagaaagccatctcg

SEQ ID NO: 341119 - DNA, 33 bp, Artificial Sequence
  Description of Artificial Sequence: Synthetic oligonucleotide
gaaacgatcagtgtacctgagaaagccatctcg

SEQ ID NO: 341120 - DNA, 40 bp, Artificial Sequence
  Description of Artificial Sequence: Synthetic oligonucleotide
aaacgatcagtgtacctgagaaagccatctcgttataatg

SEQ ID NO: 341121 - DNA, 39 bp, Artificial Sequence
  Description of Artificial Sequence: Synthetic oligonucleotide
aacgatcagtgtacctgagaaagccatctcgttataatg

SEQ ID NO: 341122 - DNA, 38 bp, Artificial Sequence
  Description of Artificial Sequence: Synthetic oligonucleotide
acgatcagtgtacctgagaaagccatctcgttataatg

SEQ ID NO: 341123 - DNA, 37 bp, Artificial Sequence
  Description of Artificial Sequence: Synthetic oligonucleotide
cgatcagtgtacctgagaaagccatctcgttataatg

SEQ ID NO: 341124 - DNA, 38 bp, Artificial Sequence
  Description of Artificial Sequence: Synthetic oligonucleotide
gatcagtgtacctgagaaagccatctcgttataatgtc

SEQ ID NO: 341125 - DNA, 38 bp, Artificial Sequence
  Description of Artificial Sequence: Synthetic oligonucleotide
atcagtgtacctgagaaagccatctcgttataatgtcc

SEQ ID NO: 341126 - DNA, 37 bp, Artificial Sequence
  Description of Artificial Sequence: Synthetic oligonucleotide
tcagtgtacctgagaaagccatctcgttataatgtcc

SEQ ID NO: 341127 - DNA, 36 bp, Artificial Sequence
  Description of Artificial Sequence: Synthetic oligonucleotide
cagtgtacctgagaaagccatctcgttataatgtcc

SEQ ID NO: 341128 - DNA, 36 bp, Artificial Sequence
  Description of Artificial Sequence: Synthetic oligonucleotide
agtgtacctgagaaagccatctcgttataatgtccg

SEQ ID NO: 341129 - DNA, 35 bp, Artificial Sequence
  Description of Artificial Sequence: Synthetic oligonucleotide
gtgtacctgagaaagccatctcgttataatgtccg

SEQ ID NO: 341130 - DNA, 35 bp, Artificial Sequence
  Description of Artificial Sequence: Synthetic oligonucleotide
tgtacctgagaaagccatctcgttataatgtccgc

SEQ ID NO: 341131 - DNA, 34 bp, Artificial Sequence
  Description of Artificial Sequence: Synthetic oligonucleotide
gtacctgagaaagccatctcgttataatgtccgc

SEQ ID NO: 341132 - DNA, 35 bp, Artificial Sequence
  Description of Artificial Sequence: Synthetic oligonucleotide
tacctgagaaagccatctcgttataatgtccgctg

SEQ ID NO: 341133 - DNA, 34 bp, Artificial Sequence
  Description of Artificial Sequence: Synthetic oligonucleotide
acctgagaaagccatctcgttataatgtccgctg

SEQ ID NO: 341134 - DNA, 33 bp, Artificial Sequence
  Description of Artificial Sequence: Synthetic oligonucleotide
cctgagaaagccatctcgttataatgtccgctg

SEQ ID NO: 341135 - DNA, 33 bp, Artificial Sequence
  Description of Artificial Sequence: Synthetic oligonucleotide
ctgagaaagccatctcgttataatgtccgctgc

SEQ ID NO: 341136 - DNA, 34 bp, Artificial Sequence
  Description of Artificial Sequence: Synthetic oligonucleotide
tgagaaagccatctcgttataatgtccgctgctc

SEQ ID NO: 341137 - DNA, 33 bp, Artificial Sequence
  Description of Artificial Sequence: Synthetic oligonucleotide
gagaaagccatctcgttataatgtccgctgctc

SEQ ID NO: 341138 - DNA, 33 bp, Artificial Sequence
  Description of Artificial Sequence: Synthetic oligonucleotide
agaaagccatctcgttataatgtccgctgctcc

SEQ ID NO: 341139 - DNA, 32 bp, Artificial Sequence
  Description of Artificial Sequence: Synthetic oligonucleotide
gaaagccatctcgttataatgtccgctgctcc

SEQ ID NO: 341140 - DNA, 32 bp, Artificial Sequence
  Description of Artificial Sequence: Synthetic oligonucleotide
aaagccatctcgttataatgtccgctgctccc

SEQ ID NO: 341141 - DNA, 31 bp, Artificial Sequence
  Description of Artificial Sequence: Synthetic oligonucleotide
aagccatctcgttataatgtccgctgctccc

SEQ ID NO: 341142 - DNA, 30 bp, Artificial Sequence
  Description of Artificial Sequence: Synthetic oligonucleotide
agccatctcgttataatgtccgctgctccc

SEQ ID NO: 341143 - DNA, 29 bp, Artificial Sequence
  Description of Artificial Sequence: Synthetic oligonucleotide
gccatctcgttataatgtccgctgctccc

SEQ ID NO: 341144 - DNA, 29 bp, Artificial Sequence
  Description of Artificial Sequence: Synthetic oligonucleotide
ccatctcgttataatgtccgctgctcccc

SEQ ID NO: 341145 - DNA, 32 bp, Artificial Sequence
  Description of Artificial Sequence: Synthetic oligonucleotide
catctcgttataatgtccgctgctcccctaag

SEQ ID NO: 341146 - DNA, 32 bp, Artificial Sequence
  Description of Artificial Sequence: Synthetic oligonucleotide
atctcgttataatgtccgctgctcccctaagg

SEQ ID NO: 341147 - DNA, 31 bp, Artificial Sequence
  Description of Artificial Sequence: Synthetic oligonucleotide
tctcgttataatgtccgctgctcccctaagg

SEQ ID NO: 341148 - DNA, 30 bp, Artificial Sequence
  Description of Artificial Sequence: Synthetic oligonucleotide
ctcgttataatgtccgctgctcccctaagg

SEQ ID NO: 341149 - DNA, 31 bp, Artificial Sequence
  Description of Artificial Sequence: Synthetic oligonucleotide
tcgttataatgtccgctgctcccctaaggtg

SEQ ID NO: 341150 - DNA, 30 bp, Artificial Sequence
  Description of Artificial Sequence: Synthetic oligonucleotide
cgttataatgtccgctgctcccctaaggtg

SEQ ID NO: 341151 - DNA, 30 bp, Artificial Sequence
  Description of Artificial Sequence: Synthetic oligonucleotide
gttataatgtccgctgctcccctaaggtgg

SEQ ID NO: 341152 - DNA, 31 bp, Artificial Sequence
  Description of Artificial Sequence: Synthetic oligonucleotide
ttataatgtccgctgctcccctaaggtggac

SEQ ID NO: 341153 - DNA, 30 bp, Artificial Sequence
  Description of Artificial Sequence: Synthetic oligonucleotide
tataatgtccgctgctcccctaaggtggac

SEQ ID NO: 341154 - DNA, 29 bp, Artificial Sequence
  Description of Artificial Sequence: Synthetic oligonucleotide
ataatgtccgctgctcccctaaggtggac

SEQ ID NO: 341155 - DNA, 28 bp, Artificial Sequence
  Description of Artificial Sequence: Synthetic oligonucleotide
taatgtccgctgctcccctaaggtggac

SEQ ID NO: 341156 - DNA, 27 bp, Artificial Sequence
  Description of Artificial Sequence: Synthetic oligonucleotide
aatgtccgctgctcccctaaggtggac

SEQ ID NO: 341157 - DNA, 27 bp, Artificial Sequence
  Description of Artificial Sequence: Synthetic oligonucleotide
atgtccgctgctcccctaaggtggaca

SEQ ID NO: 341158 - DNA, 27 bp, Artificial Sequence
  Description of Artificial Sequence: Synthetic oligonucleotide
tgtccgctgctcccctaaggtggacat

SEQ ID NO: 341159 - DNA, 26 bp, Artificial Sequence
  Description of Artificial Sequence: Synthetic oligonucleotide
gtccgctgctcccctaaggtggacat

SEQ ID NO: 341160 - DNA, 27 bp, Artificial Sequence
  Description of Artificial Sequence: Synthetic oligonucleotide
tccgctgctcccctaaggtggacatca

SEQ ID NO: 341161 - DNA, 26 bp, Artificial Sequence
  Description of Artificial Sequence: Synthetic oligonucleotide
ccgctgctcccctaaggtggacatca

SEQ ID NO: 341162 - DNA, 26 bp, Artificial Sequence
  Description of Artificial Sequence: Synthetic oligonucleotide
cgctgctcccctaaggtggacatcac

SEQ ID NO: 341163 - DNA, 26 bp, Artificial Sequence
  Description of Artificial Sequence: Synthetic oligonucleotide
gctgctcccctaaggtggacatcacc

SEQ ID NO: 341164 - DNA, 27 bp, Artificial Sequence
  Description of Artificial Sequence: Synthetic oligonucleotide
ctgctcccctaaggtggacatcaccct

SEQ ID NO: 341165 - DNA, 29 bp, Artificial Sequence
  Description of Artificial Sequence: Synthetic oligonucleotide
tgctcccctaaggtggacatcacccttac

SEQ ID NO: 341166 - DNA, 28 bp, Artificial Sequence
  Description of Artificial Sequence: Synthetic oligonucleotide
gctcccctaaggtggacatcacccttac

SEQ ID NO: 341167 - DNA, 28 bp, Artificial Sequence
  Description of Artificial Sequence: Synthetic oligonucleotide
ctcccctaaggtggacatcacccttacc

SEQ ID NO: 341168 - DNA, 29 bp, Artificial Sequence
  Description of Artificial Sequence: Synthetic oligonucleotide
tcccctaaggtggacatcacccttacctc

SEQ ID NO: 341169 - DNA, 28 bp, Artificial Sequence
  Description of Artificial Sequence: Synthetic oligonucleotide
cccctaaggtggacatcacccttacctc

SEQ ID NO: 341170 - DNA, 29 bp, Artificial Sequence
  Description of Artificial Sequence: Synthetic oligonucleotide
ccctaaggtggacatcacccttacctcag

SEQ ID NO: 341171 - DNA, 32 bp, Artificial Sequence
  Description of Artificial Sequence: Synthetic oligonucleotide
cctaaggtggacatcacccttacctcagaaag

SEQ ID NO: 341172 - DNA, 33 bp, Artificial Sequence
  Description of Artificial Sequence: Synthetic oligonucleotide
ctaaggtggacatcacccttacctcagaaagtg

SEQ ID NO: 341173 - DNA, 34 bp, Artificial Sequence
  Description of Artificial Sequence: Synthetic oligonucleotide
taaggtggacatcacccttacctcagaaagtgac

SEQ ID NO: 341174 - DNA, 33 bp, Artificial Sequence
  Description of Artificial Sequence: Synthetic oligonucleotide
aaggtggacatcacccttacctcagaaagtgac

SEQ ID NO: 341175 - DNA, 32 bp, Artificial Sequence
  Description of Artificial Sequence: Synthetic oligonucleotide
aggtggacatcacccttacctcagaaagtgac

SEQ ID NO: 341176 - DNA, 31 bp, Artificial Sequence
  Description of Artificial Sequence: Synthetic oligonucleotide
ggtggacatcacccttacctcagaaagtgac

SEQ ID NO: 341177 - DNA, 33 bp, Artificial Sequence
  Description of Artificial Sequence: Synthetic oligonucleotide
gtggacatcacccttacctcagaaagtgacttc

SEQ ID NO: 341178 - DNA, 33 bp, Artificial Sequence
  Description of Artificial Sequence: Synthetic oligonucleotide
tggacatcacccttacctcagaaagtgacttcg

SEQ ID NO: 341179 - DNA, 32 bp, Artificial Sequence
  Description of Artificial Sequence: Synthetic oligonucleotide
ggacatcacccttacctcagaaagtgacttcg

SEQ ID NO: 341180 - DNA, 32 bp, Artificial Sequence
  Description of Artificial Sequence: Synthetic oligonucleotide
gacatcacccttacctcagaaagtgacttcgc

SEQ ID NO: 341181 - DNA, 33 bp, Artificial Sequence
  Description of Artificial Sequence: Synthetic oligonucleotide
acatcacccttacctcagaaagtgacttcgcag

SEQ ID NO: 341182 - DNA, 32 bp, Artificial Sequence
  Description of Artificial Sequence: Synthetic oligonucleotide
catcacccttacctcagaaagtgacttcgcag

SEQ ID NO: 341183 - DNA, 33 bp, Artificial Sequence
  Description of Artificial Sequence: Synthetic oligonucleotide
atcacccttacctcagaaagtgacttcgcagtc

SEQ ID NO: 341184 - DNA, 32 bp, Artificial Sequence
  Description of Artificial Sequence: Synthetic oligonucleotide
tcacccttacctcagaaagtgacttcgcagtc

SEQ ID NO: 341185 - DNA, 31 bp, Artificial Sequence
  Description of Artificial Sequence: Synthetic oligonucleotide
cacccttacctcagaaagtgacttcgcagtc

SEQ ID NO: 341186 - DNA, 31 bp, Artificial Sequence
  Description of Artificial Sequence: Synthetic oligonucleotide
acccttacctcagaaagtgacttcgcagtcc

SEQ ID NO: 341187 - DNA, 30 bp, Artificial Sequence
  Description of Artificial Sequence: Synthetic oligonucleotide
cccttacctcagaaagtgacttcgcagtcc

SEQ ID NO: 341188 - DNA, 31 bp, Artificial Sequence
  Description of Artificial Sequence: Synthetic oligonucleotide
ccttacctcagaaagtgacttcgcagtcctc

SEQ ID NO: 341189 - DNA, 32 bp, Artificial Sequence
  Description of Artificial Sequence: Synthetic oligonucleotide
cttacctcagaaagtgacttcgcagtcctcag

SEQ ID NO: 341190 - DNA, 33 bp, Artificial Sequence
  Description of Artificial Sequence: Synthetic oligonucleotide
ttacctcagaaagtgacttcgcagtcctcagtc

SEQ ID NO: 341191 - DNA, 32 bp, Artificial Sequence
  Description of Artificial Sequence: Synthetic oligonucleotide
tacctcagaaagtgacttcgcagtcctcagtc

SEQ ID NO: 341192 - DNA, 31 bp, Artificial Sequence
  Description of Artificial Sequence: Synthetic oligonucleotide
acctcagaaagtgacttcgcagtcctcagtc

SEQ ID NO: 341193 - DNA, 30 bp, Artificial Sequence
  Description of Artificial Sequence: Synthetic oligonucleotide
cctcagaaagtgacttcgcagtcctcagtc

SEQ ID NO: 341194 - DNA, 31 bp, Artificial Sequence
  Description of Artificial Sequence: Synthetic oligonucleotide
ctcagaaagtgacttcgcagtcctcagtcac

SEQ ID NO: 341195 - DNA, 31 bp, Artificial Sequence
  Description of Artificial Sequence: Synthetic oligonucleotide
tcagaaagtgacttcgcagtcctcagtcacc

SEQ ID NO: 341196 - DNA, 30 bp, Artificial Sequence
  Description of Artificial Sequence: Synthetic oligonucleotide
cagaaagtgacttcgcagtcctcagtcacc

SEQ ID NO: 341197 - DNA, 31 bp, Artificial Sequence
  Description of Artificial Sequence: Synthetic oligonucleotide
agaaagtgacttcgcagtcctcagtcaccag

SEQ ID NO: 341198 - DNA, 30 bp, Artificial Sequence
  Description of Artificial Sequence: Synthetic oligonucleotide
gaaagtgacttcgcagtcctcagtcaccag

SEQ ID NO: 341199 - DNA, 30 bp, Artificial Sequence
  Description of Artificial Sequence: Synthetic oligonucleotide
aaagtgacttcgcagtcctcagtcaccagg

SEQ ID NO: 341200 - DNA, 29 bp, Artificial Sequence
  Description of Artificial Sequence: Synthetic oligonucleotide
aagtgacttcgcagtcctcagtcaccagg

SEQ ID NO: 341201 - DNA, 28 bp, Artificial Sequence
  Description of Artificial Sequence: Synthetic oligonucleotide
agtgacttcgcagtcctcagtcaccagg

SEQ ID NO: 341202 - DNA, 27 bp, Artificial Sequence
  Description of Artificial Sequence: Synthetic oligonucleotide
gtgacttcgcagtcctcagtcaccagg

SEQ ID NO: 341203 - DNA, 28 bp, Artificial Sequence
  Description of Artificial Sequence: Synthetic oligonucleotide
tgacttcgcagtcctcagtcaccaggtg

SEQ ID NO: 341204 - DNA, 27 bp, Artificial Sequence
  Description of Artificial Sequence: Synthetic oligonucleotide
gacttcgcagtcctcagtcaccaggtg

SEQ ID NO: 341205 - DNA, 27 bp, Artificial Sequence
  Description of Artificial Sequence: Synthetic oligonucleotide
acttcgcagtcctcagtcaccaggtgc

SEQ ID NO: 341206 - DNA, 26 bp, Artificial Sequence
  Description of Artificial Sequence: Synthetic oligonucleotide
cttcgcagtcctcagtcaccaggtgc

SEQ ID NO: 341207 - DNA, 26 bp, Artificial Sequence
  Description of Artificial Sequence: Synthetic oligonucleotide
ttcgcagtcctcagtcaccaggtgcc

SEQ ID NO: 341208 - DNA, 25 bp, Artificial Sequence
  Description of Artificial Sequence: Synthetic oligonucleotide
tcgcagtcctcagtcaccaggtgcc

SEQ ID NO: 341209 - DNA, 24 bp, Artificial Sequence
  Description of Artificial Sequence: Synthetic oligonucleotide
cgcagtcctcagtcaccaggtgcc

SEQ ID NO: 341210 - DNA, 26 bp, Artificial Sequence
  Description of Artificial Sequence: Synthetic oligonucleotide
gcagtcctcagtcaccaggtgccgtt

SEQ ID NO: 341211 - DNA, 27 bp, Artificial Sequence
  Description of Artificial Sequence: Synthetic oligonucleotide
cagtcctcagtcaccaggtgccgttga

SEQ ID NO: 341212 - DNA, 29 bp, Artificial Sequence
  Description of Artificial Sequence: Synthetic oligonucleotide
agtcctcagtcaccaggtgccgttgaaag

SEQ ID NO: 341213 - DNA, 28 bp, Artificial Sequence
  Description of Artificial Sequence: Synthetic oligonucleotide
gtcctcagtcaccaggtgccgttgaaag

SEQ ID NO: 341214 - DNA, 30 bp, Artificial Sequence
  Description of Artificial Sequence: Synthetic oligonucleotide
tcctcagtcaccaggtgccgttgaaagatc

SEQ ID NO: 341215 - DNA, 29 bp, Artificial Sequence
  Description of Artificial Sequence: Synthetic oligonucleotide
cctcagtcaccaggtgccgttgaaagatc

SEQ ID NO: 341216 - DNA, 29 bp, Artificial Sequence
  Description of Artificial Sequence: Synthetic oligonucleotide
ctcagtcaccaggtgccgttgaaagatcc

SEQ ID NO: 341217 - DNA, 29 bp, Artificial Sequence
  Description of Artificial Sequence: Synthetic oligonucleotide
tcagtcaccaggtgccgttgaaagatccg

SEQ ID NO: 341218 - DNA, 28 bp, Artificial Sequence
  Description of Artificial Sequence: Synthetic oligonucleotide
cagtcaccaggtgccgttgaaagatccg

SEQ ID NO: 341219 - DNA, 30 bp, Artificial Sequence
  Description of Artificial Sequence: Synthetic oligonucleotide
agtcaccaggtgccgttgaaagatccgaag

SEQ ID NO: 341220 - DNA, 29 bp, Artificial Sequence
  Description of Artificial Sequence: Synthetic oligonucleotide
gtcaccaggtgccgttgaaagatccgaag

SEQ ID NO: 341221 - DNA, 30 bp, Artificial Sequence
  Description of Artificial Sequence: Synthetic oligonucleotide
tcaccaggtgccgttgaaagatccgaagag

SEQ ID NO: 341222 - DNA, 29 bp, Artificial Sequence
  Description of Artificial Sequence: Synthetic oligonucleotide
caccaggtgccgttgaaagatccgaagag

SEQ ID NO: 341223 - DNA, 29 bp, Artificial Sequence
  Description of Artificial Sequence: Synthetic oligonucleotide
accaggtgccgttgaaagatccgaagagc

SEQ ID NO: 341224 - DNA, 28 bp, Artificial Sequence
  Description of Artificial Sequence: Synthetic oligonucleotide
ccaggtgccgttgaaagatccgaagagc

SEQ ID NO: 341225 - DNA, 29 bp, Artificial Sequence
  Description of Artificial Sequence: Synthetic oligonucleotide
caggtgccgttgaaagatccgaagagctc

SEQ ID NO: 341226 - DNA, 30 bp, Artificial Sequence
  Description of Artificial Sequence: Synthetic oligonucleotide
aggtgccgttgaaagatccgaagagctctg

SEQ ID NO: 341227 - DNA, 29 bp, Artificial Sequence
  Description of Artificial Sequence: Synthetic oligonucleotide
ggtgccgttgaaagatccgaagagctctg

SEQ ID NO: 341228 - DNA, 29 bp, Artificial Sequence
  Description of Artificial Sequence: Synthetic oligonucleotide
gtgccgttgaaagatccgaagagctctgg

SEQ ID NO: 341229 - DNA, 29 bp, Artificial Sequence
  Description of Artificial Sequence: Synthetic oligonucleotide
tgccgttgaaagatccgaagagctctggc

SEQ ID NO: 341230 - DNA, 28 bp, Artificial Sequence
  Description of Artificial Sequence: Synthetic oligonucleotide
gccgttgaaagatccgaagagctctggc

SEQ ID NO: 341231 - DNA, 28 bp, Artificial Sequence
  Description of Artificial Sequence: Synthetic oligonucleotide
ccgttgaaagatccgaagagctctggcc

SEQ ID NO: 341232 - DNA, 29 bp, Artificial Sequence
  Description of Artificial Sequence: Synthetic oligonucleotide
cgttgaaagatccgaagagctctggcctc

SEQ ID NO: 341233 - DNA, 29 bp, Artificial Sequence
  Description of Artificial Sequence: Synthetic oligonucleotide
gttgaaagatccgaagagctctggcctcc

SEQ ID NO: 341234 - DNA, 31 bp, Artificial Sequence
  Description of Artificial Sequence: Synthetic oligonucleotide
ttgaaagatccgaagagctctggcctccaac

SEQ ID NO: 341235 - DNA, 30 bp, Artificial Sequence
  Description of Artificial Sequence: Synthetic oligonucleotide
tgaaagatccgaagagctctggcctccaac

SEQ ID NO: 341236 - DNA, 29 bp, Artificial Sequence
  Description of Artificial Sequence: Synthetic oligonucleotide
gaaagatccgaagagctctggcctccaac

SEQ ID NO: 341237 - DNA, 31 bp, Artificial Sequence
  Description of Artificial Sequence: Synthetic oligonucleotide
aaagatccgaagagctctggcctccaacaac

SEQ ID NO: 341238 - DNA, 30 bp, Artificial Sequence
  Description of Artificial Sequence: Synthetic oligonucleotide
aagatccgaagagctctggcctccaacaac

SEQ ID NO: 341239 - DNA, 29 bp, Artificial Sequence
  Description of Artificial Sequence: Synthetic oligonucleotide
agatccgaagagctctggcctccaacaac

SEQ ID NO: 341240 - DNA, 28 bp, Artificial Sequence
  Description of Artificial Sequence: Synthetic oligonucleotide
gatccgaagagctctggcctccaacaac

SEQ ID NO: 341241 - DNA, 29 bp, Artificial Sequence
  Description of Artificial Sequence: Synthetic oligonucleotide
atccgaagagctctggcctccaacaactc

SEQ ID NO: 341242 - DNA, 28 bp, Artificial Sequence
  Description of Artificial Sequence: Synthetic oligonucleotide
tccgaagagctctggcctccaacaactc

SEQ ID NO: 341243 - DNA, 27 bp, Artificial Sequence
  Description of Artificial Sequence: Synthetic oligonucleotide
ccgaagagctctggcctccaacaactc

SEQ ID NO: 341244 - DNA, 27 bp, Artificial Sequence
  Description of Artificial Sequence: Synthetic oligonucleotide
cgaagagctctggcctccaacaactcc

SEQ ID NO: 341245 - DNA, 28 bp, Artificial Sequence
  Description of Artificial Sequence: Synthetic oligonucleotide
gaagagctctggcctccaacaactcctc

SEQ ID NO: 341246 - DNA, 29 bp, Artificial Sequence
  Description of Artificial Sequence: Synthetic oligonucleotide
aagagctctggcctccaacaactcctctg

SEQ ID NO: 341247 - DNA, 28 bp, Artificial Sequence
  Description of Artificial Sequence: Synthetic oligonucleotide
agagctctggcctccaacaactcctctg

SEQ ID NO: 341248 - DNA, 27 bp, Artificial Sequence
  Description of Artificial Sequence: Synthetic oligonucleotide
gagctctggcctccaacaactcctctg

SEQ ID NO: 341249 - DNA, 28 bp, Artificial Sequence
  Description of Artificial Sequence: Synthetic oligonucleotide
agctctggcctccaacaactcctctgag

SEQ ID NO: 341250 - DNA, 27 bp, Artificial Sequence
  Description of Artificial Sequence: Synthetic oligonucleotide
gctctggcctccaacaactcctctgag

SEQ ID NO: 341251 - DNA, 27 bp, Artificial Sequence
  Description of Artificial Sequence: Synthetic oligonucleotide
ctctggcctccaacaactcctctgagg

SEQ ID NO: 341252 - DNA, 27 bp, Artificial Sequence
  Description of Artificial Sequence: Synthetic oligonucleotide
tctggcctccaacaactcctctgaggc

SEQ ID NO: 341253 - DNA, 26 bp, Artificial Sequence
  Description of Artificial Sequence: Synthetic oligonucleotide
ctggcctccaacaactcctctgaggc

SEQ ID NO: 341254 - DNA, 26 bp, Artificial Sequence
  Description of Artificial Sequence: Synthetic oligonucleotide
tggcctccaacaactcctctgaggcc

SEQ ID NO: 341255 - DNA, 25 bp, Artificial Sequence
  Description of Artificial Sequence: Synthetic oligonucleotide
ggcctccaacaactcctctgaggcc

SEQ ID NO: 341256 - DNA, 26 bp, Artificial Sequence
  Description of Artificial Sequence: Synthetic oligonucleotide
gcctccaacaactcctctgaggccct

SEQ ID NO: 341257 - DNA, 27 bp, Artificial Sequence
  Description of Artificial Sequence: Synthetic oligonucleotide
cctccaacaactcctctgaggccctgt

SEQ ID NO: 341258 - DNA, 27 bp, Artificial Sequence
  Description of Artificial Sequence: Synthetic oligonucleotide
ctccaacaactcctctgaggccctgtg

SEQ ID NO: 341259 - DNA, 27 bp, Artificial Sequence
  Description of Artificial Sequence: Synthetic oligonucleotide
tccaacaactcctctgaggccctgtgg

SEQ ID NO: 341260 - DNA, 27 bp, Artificial Sequence
  Description of Artificial Sequence: Synthetic oligonucleotide
ccaacaactcctctgaggccctgtggt

SEQ ID NO: 341261 - DNA, 27 bp, Artificial Sequence
  Description of Artificial Sequence: Synthetic oligonucleotide
caacaactcctctgaggccctgtggtc

SEQ ID NO: 341262 - DNA, 27 bp, Artificial Sequence
  Description of Artificial Sequence: Synthetic oligonucleotide
aacaactcctctgaggccctgtggtcc

SEQ ID NO: 341263 - DNA, 27 bp, Artificial Sequence
  Description of Artificial Sequence: Synthetic oligonucleotide
acaactcctctgaggccctgtggtcca

SEQ ID NO: 341264 - DNA, 26 bp, Artificial Sequence
  Description of Artificial Sequence: Synthetic oligonucleotide
caactcctctgaggccctgtggtcca

SEQ ID NO: 341265 - DNA, 26 bp, Artificial Sequence
  Description of Artificial Sequence: Synthetic oligonucleotide
aactcctctgaggccctgtggtccag

SEQ ID NO: 341266 - DNA, 25 bp, Artificial Sequence
  Description of Artificial Sequence: Synthetic oligonucleotide
actcctctgaggccctgtggtccag

SEQ ID NO: 341267 - DNA, 24 bp, Artificial Sequence
  Description of Artificial Sequence: Synthetic oligonucleotide
ctcctctgaggccctgtggtccag

SEQ ID NO: 341268 - DNA, 25 bp, Artificial Sequence
  Description of Artificial Sequence: Synthetic oligonucleotide
tcctctgaggccctgtggtccagct

SEQ ID NO: 341269 - DNA, 24 bp, Artificial Sequence
  Description of Artificial Sequence: Synthetic oligonucleotide
cctctgaggccctgtggtccagct

SEQ ID NO: 341270 - DNA, 24 bp, Artificial Sequence
  Description of Artificial Sequence: Synthetic oligonucleotide
ctctgaggccctgtggtccagctc

SEQ ID NO: 341271 - DNA, 25 bp, Artificial Sequence
  Description of Artificial Sequence: Synthetic oligonucleotide
tctgaggccctgtggtccagctcgt

SEQ ID NO: 341272 - DNA, 24 bp, Artificial Sequence
  Description of Artificial Sequence: Synthetic oligonucleotide
ctgaggccctgtggtccagctcgt

SEQ ID NO: 341273 - DNA, 24 bp, Artificial Sequence
  Description of Artificial Sequence: Synthetic oligonucleotide
tgaggccctgtggtccagctcgtg

SEQ ID NO: 341274 - DNA, 23 bp, Artificial Sequence
  Description of Artificial Sequence: Synthetic oligonucleotide
gaggccctgtggtccagctcgtg

SEQ ID NO: 341275 - DNA, 23 bp, Artificial Sequence
  Description of Artificial Sequence: Synthetic oligonucleotide
aggccctgtggtccagctcgtgg

SEQ ID NO: 341276 - DNA, 22 bp, Artificial Sequence
  Description of Artificial Sequence: Synthetic oligonucleotide
ggccctgtggtccagctcgtgg

SEQ ID NO: 341277 - DNA, 22 bp, Artificial Sequence
  Description of Artificial Sequence: Synthetic oligonucleotide
gccctgtggtccagctcgtggc

SEQ ID NO: 341278 - DNA, 22 bp, Artificial Sequence
  Description of Artificial Sequence: Synthetic oligonucleotide
ccctgtggtccagctcgtggcc

SEQ ID NO: 341279 - DNA, 25 bp, Artificial Sequence
  Description of Artificial Sequence: Synthetic oligonucleotide
cctgtggtccagctcgtggcccata

SEQ ID NO: 341280 - DNA, 25 bp, Artificial Sequence
  Description of Artificial Sequence: Synthetic oligonucleotide
ctgtggtccagctcgtggcccatac

SEQ ID NO: 341281 - DNA, 25 bp, Artificial Sequence
  Description of Artificial Sequence: Synthetic oligonucleotide
tgtggtccagctcgtggcccatacg

SEQ ID NO: 341282 - DNA, 24 bp, Artificial Sequence
  Description of Artificial Sequence: Synthetic oligonucleotide
gtggtccagctcgtggcccatacg

SEQ ID NO: 341283 - DNA, 24 bp, Artificial Sequence
  Description of Artificial Sequence: Synthetic oligonucleotide
tggtccagctcgtggcccatacgc

SEQ ID NO: 341284 - DNA, 23 bp, Artificial Sequence
  Description of Artificial Sequence: Synthetic oligonucleotide
ggtccagctcgtggcccatacgc

SEQ ID NO: 341285 - DNA, 25 bp, Artificial Sequence
  Description of Artificial Sequence: Synthetic oligonucleotide
gtccagctcgtggcccatacgccat

SEQ ID NO: 341286 - DNA, 25 bp, Artificial Sequence
  Description of Artificial Sequence: Synthetic oligonucleotide
tccagctcgtggcccatacgccatg

SEQ ID NO: 341287 - DNA, 24 bp, Artificial Sequence
  Description of Artificial Sequence: Synthetic oligonucleotide
ccagctcgtggcccatacgccatg

SEQ ID NO: 341288 - DNA, 24 bp, Artificial Sequence
  Description of Artificial Sequence: Synthetic oligonucleotide
cagctcgtggcccatacgccatgg

SEQ ID NO: 341289 - DNA, 27 bp, Artificial Sequence
  Description of Artificial Sequence: Synthetic oligonucleotide
agctcgtggcccatacgccatggcaaa

SEQ ID NO: 341290 - DNA, 27 bp, Artificial Sequence
  Description of Artificial Sequence: Synthetic oligonucleotide
gctcgtggcccatacgccatggcaaaa

SEQ ID NO: 341291 - DNA, 27 bp, Artificial Sequence
  Description of Artificial Sequence: Synthetic oligonucleotide
ctcgtggcccatacgccatggcaaaag

SEQ ID NO: 341292 - DNA, 27 bp, Artificial Sequence
  Description of Artificial Sequence: Synthetic oligonucleotide
tcgtggcccatacgccatggcaaaagg

SEQ ID NO: 341293 - DNA, 27 bp, Artificial Sequence
  Description of Artificial Sequence: Synthetic oligonucleotide
cgtggcccatacgccatggcaaaagga

SEQ ID NO: 341294 - DNA, 27 bp, Artificial Sequence
  Description of Artificial Sequence: Synthetic oligonucleotide
gtggcccatacgccatggcaaaaggac

SEQ ID NO: 341295 - DNA, 28 bp, Artificial Sequence
  Description of Artificial Sequence: Synthetic oligonucleotide
tggcccatacgccatggcaaaaggactc

SEQ ID NO: 341296 - DNA, 27 bp, Artificial Sequence
  Description of Artificial Sequence: Synthetic oligonucleotide
ggcccatacgccatggcaaaaggactc

SEQ ID NO: 341297 - DNA, 28 bp, Artificial Sequence
  Description of Artificial Sequence: Synthetic oligonucleotide
gcccatacgccatggcaaaaggactcac

SEQ ID NO: 341298 - DNA, 29 bp, Artificial Sequence
  Description of Artificial Sequence: Synthetic oligonucleotide
cccatacgccatggcaaaaggactcactg

SEQ ID NO: 341299 - DNA, 30 bp, Artificial Sequence
  Description of Artificial Sequence: Synthetic oligonucleotide
ccatacgccatggcaaaaggactcactgtc

SEQ ID NO: 341300 - DNA, 30 bp, Artificial Sequence
  Description of Artificial Sequence: Synthetic oligonucleotide
catacgccatggcaaaaggactcactgtcc

SEQ ID NO: 341301 - DNA, 31 bp, Artificial Sequence
  Description of Artificial Sequence: Synthetic oligonucleotide
atacgccatggcaaaaggactcactgtccag

SEQ ID NO: 341302 - DNA, 30 bp, Artificial Sequence
  Description of Artificial Sequence: Synthetic oligonucleotide
tacgccatggcaaaaggactcactgtccag

SEQ ID NO: 341303 - DNA, 29 bp, Artificial Sequence
  Description of Artificial Sequence: Synthetic oligonucleotide
acgccatggcaaaaggactcactgtccag

SEQ ID NO: 341304 - DNA, 28 bp, Artificial Sequence
  Description of Artificial Sequence: Synthetic oligonucleotide
cgccatggcaaaaggactcactgtccag

SEQ ID NO: 341305 - DNA, 30 bp, Artificial Sequence
  Description of Artificial Sequence: Synthetic oligonucleotide
gccatggcaaaaggactcactgtccagatc

SEQ ID NO: 341306 - DNA, 30 bp, Artificial Sequence
  Description of Artificial Sequence: Synthetic oligonucleotide
ccatggcaaaaggactcactgtccagatcg

SEQ ID NO: 341307 - DNA, 31 bp, Artificial Sequence
  Description of Artificial Sequence: Synthetic oligonucleotide
catggcaaaaggactcactgtccagatcgac

SEQ ID NO: 341308 - DNA, 34 bp, Artificial Sequence
  Description of Artificial Sequence: Synthetic oligonucleotide
atggcaaaaggactcactgtccagatcgacaaac

SEQ ID NO: 341309 - DNA, 33 bp, Artificial Sequence
  Description of Artificial Sequence: Synthetic oligonucleotide
tggcaaaaggactcactgtccagatcgacaaac

SEQ ID NO: 341310 - DNA, 32 bp, Artificial Sequence
  Description of Artificial Sequence: Synthetic oligonucleotide
ggcaaaaggactcactgtccagatcgacaaac

SEQ ID NO: 341311 - DNA, 34 bp, Artificial Sequence
  Description of Artificial Sequence: Synthetic oligonucleotide
gcaaaaggactcactgtccagatcgacaaacaac

SEQ ID NO: 341312 - DNA, 34 bp, Artificial Sequence
  Description of Artificial Sequence: Synthetic oligonucleotide
caaaaggactcactgtccagatcgacaaacaacc

SEQ ID NO: 341313 - DNA, 35 bp, Artificial Sequence
  Description of Artificial Sequence: Synthetic oligonucleotide
aaaaggactcactgtccagatcgacaaacaaccag

SEQ ID NO: 341314 - DNA, 34 bp, Artificial Sequence
  Description of Artificial Sequence: Synthetic oligonucleotide
aaaggactcactgtccagatcgacaaacaaccag

SEQ ID NO: 341315 - DNA, 33 bp, Artificial Sequence
  Description of Artificial Sequence: Synthetic oligonucleotide
aaggactcactgtccagatcgacaaacaaccag

SEQ ID NO: 341316 - DNA, 32 bp, Artificial Sequence
  Description of Artificial Sequence: Synthetic oligonucleotide
aggactcactgtccagatcgacaaacaaccag

SEQ ID NO: 341317 - DNA, 31 bp, Artificial Sequence
  Description of Artificial Sequence: Synthetic oligonucleotide
ggactcactgtccagatcgacaaacaaccag

SEQ ID NO: 341318 - DNA, 31 bp, Artificial Sequence
  Description of Artificial Sequence: Synthetic oligonucleotide
gactcactgtccagatcgacaaacaaccagg

SEQ ID NO: 341319 - DNA, 31 bp, Artificial Sequence
  Description of Artificial Sequence: Synthetic oligonucleotide
actcactgtccagatcgacaaacaaccaggg

SEQ ID NO: 341320 - DNA, 30 bp, Artificial Sequence
  Description of Artificial Sequence: Synthetic oligonucleotide
ctcactgtccagatcgacaaacaaccaggg

SEQ ID NO: 341321 - DNA, 33 bp, Artificial Sequence
  Description of Artificial Sequence: Synthetic oligonucleotide
tcactgtccagatcgacaaacaaccagggtatg

SEQ ID NO: 341322 - DNA, 32 bp, Artificial Sequence
  Description of Artificial Sequence: Synthetic oligonucleotide
cactgtccagatcgacaaacaaccagggtatg

SEQ ID NO: 341323 - DNA, 34 bp, Artificial Sequence
  Description of Artificial Sequence: Synthetic oligonucleotide
actgtccagatcgacaaacaaccagggtatgaac

SEQ ID NO: 341324 - DNA, 33 bp, Artificial Sequence
  Description of Artificial Sequence: Synthetic oligonucleotide
ctgtccagatcgacaaacaaccagggtatgaac

SEQ ID NO: 341325 - DNA, 33 bp, Artificial Sequence
  Description of Artificial Sequence: Synthetic oligonucleotide
tgtccagatcgacaaacaaccagggtatgaacc

SEQ ID NO: 341326 - DNA, 32 bp, Artificial Sequence
  Description of Artificial Sequence: Synthetic oligonucleotide
gtccagatcgacaaacaaccagggtatgaacc

SEQ ID NO: 341327 - DNA, 33 bp, Artificial Sequence
  Description of Artificial Sequence: Synthetic oligonucleotide
tccagatcgacaaacaaccagggtatgaacctg

SEQ ID NO: 341328 - DNA, 32 bp, Artificial Sequence
  Description of Artificial Sequence: Synthetic oligonucleotide
ccagatcgacaaacaaccagggtatgaacctg

SEQ ID NO: 341329 - DNA, 32 bp, Artificial Sequence
  Description of Artificial Sequence: Synthetic oligonucleotide
cagatcgacaaacaaccagggtatgaacctgc

SEQ ID NO: 341330 - DNA, 33 bp, Artificial Sequence
  Description of Artificial Sequence: Synthetic oligonucleotide
agatcgacaaacaaccagggtatgaacctgctc

SEQ ID NO: 341331 - DNA, 32 bp, Artificial Sequence
  Description of Artificial Sequence: Synthetic oligonucleotide
gatcgacaaacaaccagggtatgaacctgctc

SEQ ID NO: 341332 - DNA, 34 bp, Artificial Sequence
  Description of Artificial Sequence: Synthetic oligonucleotide
atcgacaaacaaccagggtatgaacctgctcatc

SEQ ID NO: 341333 - DNA, 33 bp, Artificial Sequence
  Description of Artificial Sequence: Synthetic oligonucleotide
tcgacaaacaaccagggtatgaacctgctcatc

SEQ ID NO: 341334 - DNA, 32 bp, Artificial Sequence
  Description of Artificial Sequence: Synthetic oligonucleotide
cgacaaacaaccagggtatgaacctgctcatc

SEQ ID NO: 341335 - DNA, 33 bp, Artificial Sequence
  Description of Artificial Sequence: Synthetic oligonucleotide
gacaaacaaccagggtatgaacctgctcatctc

SEQ ID NO: 341336 - DNA, 33 bp, Artificial Sequence
  Description of Artificial Sequence: Synthetic oligonucleotide
acaaacaaccagggtatgaacctgctcatctcc

SEQ ID NO: 341337 - DNA, 32 bp, Artificial Sequence
  Description of Artificial Sequence: Synthetic oligonucleotide
caaacaaccagggtatgaacctgctcatctcc

SEQ ID NO: 341338 - DNA, 33 bp, Artificial Sequence
  Description of Artificial Sequence: Synthetic oligonucleotide
aaacaaccagggtatgaacctgctcatctcctc

SEQ ID NO: 341339 - DNA, 32 bp, Artificial Sequence
  Description of Artificial Sequence: Synthetic oligonucleotide
aacaaccagggtatgaacctgctcatctcctc

SEQ ID NO: 341340 - DNA, 31 bp, Artificial Sequence
  Description of Artificial Sequence: Synthetic oligonucleotide
acaaccagggtatgaacctgctcatctcctc

SEQ ID NO: 341341 - DNA, 30 bp, Artificial Sequence
  Description of Artificial Sequence: Synthetic oligonucleotide
caaccagggtatgaacctgctcatctcctc

SEQ ID NO: 341342 - DNA, 31 bp, Artificial Sequence
  Description of Artificial Sequence: Synthetic oligonucleotide
aaccagggtatgaacctgctcatctcctctc

SEQ ID NO: 341343 - DNA, 30 bp, Artificial Sequence
  Description of Artificial Sequence: Synthetic oligonucleotide
accagggtatgaacctgctcatctcctctc

SEQ ID NO: 341344 - DNA, 29 bp, Artificial Sequence
  Description of Artificial Sequence: Synthetic oligonucleotide
ccagggtatgaacctgctcatctcctctc

SEQ ID NO: 341345 - DNA, 29 bp, Artificial Sequence
  Description of Artificial Sequence: Synthetic oligonucleotide
cagggtatgaacctgctcatctcctctcc

SEQ ID NO: 341346 - DNA, 29 bp, Artificial Sequence
  Description of Artificial Sequence: Synthetic oligonucleotide
agggtatgaacctgctcatctcctctccc

SEQ ID NO: 341347 - DNA, 28 bp, Artificial Sequence
  Description of Artificial Sequence: Synthetic oligonucleotide
gggtatgaacctgctcatctcctctccc

SEQ ID NO: 341348 - DNA, 28 bp, Artificial Sequence
  Description of Artificial Sequence: Synthetic oligonucleotide
ggtatgaacctgctcatctcctctcccc

SEQ ID NO: 341349 - DNA, 28 bp, Artificial Sequence
  Description of Artificial Sequence: Synthetic oligonucleotide
gtatgaacctgctcatctcctctccccg

SEQ ID NO: 341350 - DNA, 28 bp, Artificial Sequence
  Description of Artificial Sequence: Synthetic oligonucleotide
tatgaacctgctcatctcctctccccgg

SEQ ID NO: 341351 - DNA, 27 bp, Artificial Sequence
  Description of Artificial Sequence: Synthetic oligonucleotide
atgaacctgctcatctcctctccccgg

SEQ ID NO: 341352 - DNA, 26 bp, Artificial Sequence
  Description of Artificial Sequence: Synthetic oligonucleotide
tgaacctgctcatctcctctccccgg

SEQ ID NO: 341353 - DNA, 25 bp, Artificial Sequence
  Description of Artificial Sequence: Synthetic oligonucleotide
gaacctgctcatctcctctccccgg

SEQ ID NO: 341354 - DNA, 25 bp, Artificial Sequence
  Description of Artificial Sequence: Synthetic oligonucleotide
aacctgctcatctcctctccccggg

SEQ ID NO: 341355 - DNA, 24 bp, Artificial Sequence
  Description of Artificial Sequence: Synthetic oligonucleotide
acctgctcatctcctctccccggg

SEQ ID NO: 341356 - DNA, 23 bp, Artificial Sequence
  Description of Artificial Sequence: Synthetic oligonucleotide
cctgctcatctcctctccccggg

SEQ ID NO: 341357 - DNA, 23 bp, Artificial Sequence
  Description of Artificial Sequence: Synthetic oligonucleotide
ctgctcatctcctctccccgggg

SEQ ID NO: 341358 - DNA, 23 bp, Artificial Sequence
  Description of Artificial Sequence: Synthetic oligonucleotide
tgctcatctcctctccccggggg

SEQ ID NO: 341359 - DNA, 22 bp, Artificial Sequence
  Description of Artificial Sequence: Synthetic oligonucleotide
gctcatctcctctccccggggg

SEQ ID NO: 341360 - DNA, 23 bp, Artificial Sequence
  Description of Artificial Sequence: Synthetic oligonucleotide
ctcatctcctctccccgggggca

SEQ ID NO: 341361 - DNA, 23 bp, Artificial Sequence
  Description of Artificial Sequence: Synthetic oligonucleotide
tcatctcctctccccgggggcag

SEQ ID NO: 341362 - DNA, 22 bp, Artificial Sequence
  Description of Artificial Sequence: Synthetic oligonucleotide
catctcctctccccgggggcag

SEQ ID NO: 341363 - DNA, 23 bp, Artificial Sequence
  Description of Artificial Sequence: Synthetic oligonucleotide
atctcctctccccgggggcagct

SEQ ID NO: 341364 - DNA, 22 bp, Artificial Sequence
  Description of Artificial Sequence: Synthetic oligonucleotide
tctcctctccccgggggcagct

SEQ ID NO: 341365 - DNA, 21 bp, Artificial Sequence
  Description of Artificial Sequence: Synthetic oligonucleotide
ctcctctccccgggggcagct

SEQ ID NO: 341366 - DNA, 26 bp, Artificial Sequence
  Description of Artificial Sequence: Synthetic oligonucleotide
tcctctccccgggggcagctcttttt

SEQ ID NO: 341367 - DNA, 25 bp, Artificial Sequence
  Description of Artificial Sequence: Synthetic oligonucleotide
cctctccccgggggcagctcttttt

SEQ ID NO: 341368 - DNA, 25 bp, Artificial Sequence
  Description of Artificial Sequence: Synthetic oligonucleotide
ctctccccgggggcagctctttttg

SEQ ID NO: 341369 - DNA, 26 bp, Artificial Sequence
  Description of Artificial Sequence: Synthetic oligonucleotide
tctccccgggggcagctctttttgga

SEQ ID NO: 341370 - DNA, 25 bp, Artificial Sequence
  Description of Artificial Sequence: Synthetic oligonucleotide
ctccccgggggcagctctttttgga

SEQ ID NO: 341371 - DNA, 26 bp, Artificial Sequence
  Description of Artificial Sequence: Synthetic oligonucleotide
tccccgggggcagctctttttggaga

SEQ ID NO: 341372 - DNA, 25 bp, Artificial Sequence
  Description of Artificial Sequence: Synthetic oligonucleotide
ccccgggggcagctctttttggaga

SEQ ID NO: 341373 - DNA, 25 bp, Artificial Sequence
  Description of Artificial Sequence: Synthetic oligonucleotide
cccgggggcagctctttttggagac

SEQ ID NO: 341374 - DNA, 25 bp, Artificial Sequence
  Description of Artificial Sequence: Synthetic oligonucleotide
ccgggggcagctctttttggagacg

SEQ ID NO: 341375 - DNA, 26 bp, Artificial Sequence
  Description of Artificial Sequence: Synthetic oligonucleotide
cgggggcagctctttttggagacgga

SEQ ID NO: 341376 - DNA, 26 bp, Artificial Sequence
  Description of Artificial Sequence: Synthetic oligonucleotide
gggggcagctctttttggagacggac

SEQ ID NO: 341377 - DNA, 27 bp, Artificial Sequence
  Description of Artificial Sequence: Synthetic oligonucleotide
ggggcagctctttttggagacggacct

SEQ ID NO: 341378 - DNA, 27 bp, Artificial Sequence
  Description of Artificial Sequence: Synthetic oligonucleotide
gggcagctctttttggagacggacctg

SEQ ID NO: 341379 - DNA, 27 bp, Artificial Sequence
  Description of Artificial Sequence: Synthetic oligonucleotide
ggcagctctttttggagacggacctgc

SEQ ID NO: 341380 - DNA, 27 bp, Artificial Sequence
  Description of Artificial Sequence: Synthetic oligonucleotide
gcagctctttttggagacggacctgcc

SEQ ID NO: 341381 - DNA, 27 bp, Artificial Sequence
  Description of Artificial Sequence: Synthetic oligonucleotide
cagctctttttggagacggacctgccc

SEQ ID NO: 341382 - DNA, 32 bp, Artificial Sequence
  Description of Artificial Sequence: Synthetic oligonucleotide
agctctttttggagacggacctgcccatttag

SEQ ID NO: 341383 - DNA, 31 bp, Artificial Sequence
  Description of Artificial Sequence: Synthetic oligonucleotide
gctctttttggagacggacctgcccatttag

SEQ ID NO: 341384 - DNA, 33 bp, Artificial Sequence
  Description of Artificial Sequence: Synthetic oligonucleotide
ctctttttggagacggacctgcccatttagaac

SEQ ID NO: 341385 - DNA, 33 bp, Artificial Sequence
  Description of Artificial Sequence: Synthetic oligonucleotide
tctttttggagacggacctgcccatttagaacc

SEQ ID NO: 341386 - DNA, 32 bp, Artificial Sequence
  Description of Artificial Sequence: Synthetic oligonucleotide
ctttttggagacggacctgcccatttagaacc

SEQ ID NO: 341387 - DNA, 32 bp, Artificial Sequence
  Description of Artificial Sequence: Synthetic oligonucleotide
tttttggagacggacctgcccatttagaaccc

SEQ ID NO: 341388 - DNA, 31 bp, Artificial Sequence
  Description of Artificial Sequence: Synthetic oligonucleotide
ttttggagacggacctgcccatttagaaccc

SEQ ID NO: 341389 - DNA, 30 bp, Artificial Sequence
  Description of Artificial Sequence: Synthetic oligonucleotide
tttggagacggacctgcccatttagaaccc

SEQ ID NO: 341390 - DNA, 29 bp, Artificial Sequence
  Description of Artificial Sequence: Synthetic oligonucleotide
ttggagacggacctgcccatttagaaccc

SEQ ID NO: 341391 - DNA, 28 bp, Artificial Sequence
  Description of Artificial Sequence: Synthetic oligonucleotide
tggagacggacctgcccatttagaaccc

SEQ ID NO: 341392 - DNA, 27 bp, Artificial Sequence
  Description of Artificial Sequence: Synthetic oligonucleotide
ggagacggacctgcccatttagaaccc

SEQ ID NO: 341393 - DNA, 28 bp, Artificial Sequence
  Description of Artificial Sequence: Synthetic oligonucleotide
gagacggacctgcccatttagaaccctg

SEQ ID NO: 341394 - DNA, 28 bp, Artificial Sequence
  Description of Artificial Sequence: Synthetic oligonucleotide
agacggacctgcccatttagaaccctgg

SEQ ID NO: 341395 - DNA, 27 bp, Artificial Sequence
  Description of Artificial Sequence: Synthetic oligonucleotide
gacggacctgcccatttagaaccctgg

SEQ ID NO: 341396 - DNA, 27 bp, Artificial Sequence
  Description of Artificial Sequence: Synthetic oligonucleotide
acggacctgcccatttagaaccctggc

SEQ ID NO: 341397 - DNA, 26 bp, Artificial Sequence
  Description of Artificial Sequence: Synthetic oligonucleotide
cggacctgcccatttagaaccctggc

SEQ ID NO: 341398 - DNA, 27 bp, Artificial Sequence
  Description of Artificial Sequence: Synthetic oligonucleotide
ggacctgcccatttagaaccctggcga

SEQ ID NO: 341399 - DNA, 27 bp, Artificial Sequence
  Description of Artificial Sequence: Synthetic oligonucleotide
gacctgcccatttagaaccctggcgag

SEQ ID NO: 341400 - DNA, 27 bp, Artificial Sequence
  Description of Artificial Sequence: Synthetic oligonucleotide
acctgcccatttagaaccctggcgagc

SEQ ID NO: 341401 - DNA, 26 bp, Artificial Sequence
  Description of Artificial Sequence: Synthetic oligonucleotide
cctgcccatttagaaccctggcgagc

SEQ ID NO: 341402 - DNA, 26 bp, Artificial Sequence
  Description of Artificial Sequence: Synthetic oligonucleotide
ctgcccatttagaaccctggcgagcg

SEQ ID NO: 341403 - DNA, 26 bp, Artificial Sequence
  Description of Artificial Sequence: Synthetic oligonucleotide
tgcccatttagaaccctggcgagcgg

SEQ ID NO: 341404 - DNA, 25 bp, Artificial Sequence
  Description of Artificial Sequence: Synthetic oligonucleotide
gcccatttagaaccctggcgagcgg

SEQ ID NO: 341405 - DNA, 27 bp, Artificial Sequence
  Description of Artificial Sequence: Synthetic oligonucleotide
cccatttagaaccctggcgagcgggtt

SEQ ID NO: 341406 - DNA, 27 bp, Artificial Sequence
  Description of Artificial Sequence: Synthetic oligonucleotide
ccatttagaaccctggcgagcgggttc

SEQ ID NO: 341407 - DNA, 27 bp, Artificial Sequence
  Description of Artificial Sequence: Synthetic oligonucleotide
catttagaaccctggcgagcgggttcc

SEQ ID NO: 341408 - DNA, 27 bp, Artificial Sequence
  Description of Artificial Sequence: Synthetic oligonucleotide
atttagaaccctggcgagcgggttccg

SEQ ID NO: 341409 - DNA, 27 bp, Artificial Sequence
  Description of Artificial Sequence: Synthetic oligonucleotide
tttagaaccctggcgagcgggttccgt

SEQ ID NO: 341410 - DNA, 27 bp, Artificial Sequence
  Description of Artificial Sequence: Synthetic oligonucleotide
ttagaaccctggcgagcgggttccgta

SEQ ID NO: 341411 - DNA, 26 bp, Artificial Sequence
  Description of Artificial Sequence: Synthetic oligonucleotide
tagaaccctggcgagcgggttccgta

SEQ ID NO: 341412 - DNA, 25 bp, Artificial Sequence
  Description of Artificial Sequence: Synthetic oligonucleotide
agaaccctggcgagcgggttccgta

SEQ ID NO: 341413 - DNA, 24 bp, Artificial Sequence
  Description of Artificial Sequence: Synthetic oligonucleotide
gaaccctggcgagcgggttccgta

SEQ ID NO: 341414 - DNA, 24 bp, Artificial Sequence
  Description of Artificial Sequence: Synthetic oligonucleotide
aaccctggcgagcgggttccgtac

SEQ ID NO: 341415 - DNA, 23 bp, Artificial Sequence
  Description of Artificial Sequence: Synthetic oligonucleotide
accctggcgagcgggttccgtac

SEQ ID NO: 341416 - DNA, 22 bp, Artificial Sequence
  Description of Artificial Sequence: Synthetic oligonucleotide
ccctggcgagcgggttccgtac

SEQ ID NO: 341417 - DNA, 22 bp, Artificial Sequence
  Description of Artificial Sequence: Synthetic oligonucleotide
cctggcgagcgggttccgtacc

SEQ ID NO: 341418 - DNA, 22 bp, Artificial Sequence
  Description of Artificial Sequence: Synthetic oligonucleotide
ctggcgagcgggttccgtaccg

SEQ ID NO: 341419 - DNA, 22 bp, Artificial Sequence
  Description of Artificial Sequence: Synthetic oligonucleotide
tggcgagcgggttccgtaccgg

SEQ ID NO: 341420 - DNA, 21 bp, Artificial Sequence
  Description of Artificial Sequence: Synthetic oligonucleotide
ggcgagcgggttccgtaccgg

SEQ ID NO: 341421 - DNA, 22 bp, Artificial Sequence
  Description of Artificial Sequence: Synthetic oligonucleotide
gcgagcgggttccgtaccgggt

SEQ ID NO: 341422 - DNA, 25 bp, Artificial Sequence
  Description of Artificial Sequence: Synthetic oligonucleotide
cgagcgggttccgtaccgggtgttt

SEQ ID NO: 341423 - DNA, 25 bp, Artificial Sequence
  Description of Artificial Sequence: Synthetic oligonucleotide
gagcgggttccgtaccgggtgtttg

SEQ ID NO: 341424 - DNA, 26 bp, Artificial Sequence
  Description of Artificial Sequence: Synthetic oligonucleotide
agcgggttccgtaccgggtgtttgct

SEQ ID NO: 341425 - DNA, 25 bp, Artificial Sequence
  Description of Artificial Sequence: Synthetic oligonucleotide
gcgggttccgtaccgggtgtttgct

SEQ ID NO: 341426 - DNA, 26 bp, Artificial Sequence
  Description of Artificial Sequence: Synthetic oligonucleotide
cgggttccgtaccgggtgtttgctct

SEQ ID NO: 341427 - DNA, 26 bp, Artificial Sequence
  Description of Artificial Sequence: Synthetic oligonucleotide
gggttccgtaccgggtgtttgctctg

SEQ ID NO: 341428 - DNA, 27 bp, Artificial Sequence
  Description of Artificial Sequence: Synthetic oligonucleotide
ggttccgtaccgggtgtttgctctgca

SEQ ID NO: 341429 - DNA, 28 bp, Artificial Sequence
  Description of Artificial Sequence: Synthetic oligonucleotide
gttccgtaccgggtgtttgctctgcatc

SEQ ID NO: 341430 - DNA, 29 bp, Artificial Sequence
  Description of Artificial Sequence: Synthetic oligonucleotide
ttccgtaccgggtgtttgctctgcatcag

SEQ ID NO: 341431 - DNA, 28 bp, Artificial Sequence
  Description of Artificial Sequence: Synthetic oligonucleotide
tccgtaccgggtgtttgctctgcatcag

SEQ ID NO: 341432 - DNA, 27 bp, Artificial Sequence
  Description of Artificial Sequence: Synthetic oligonucleotide
ccgtaccgggtgtttgctctgcatcag

SEQ ID NO: 341433 - DNA, 29 bp, Artificial Sequence
  Description of Artificial Sequence: Synthetic oligonucleotide
cgtaccgggtgtttgctctgcatcagaag

SEQ ID NO: 341434 - DNA, 31 bp, Artificial Sequence
  Description of Artificial Sequence: Synthetic oligonucleotide
gtaccgggtgtttgctctgcatcagaagaag

SEQ ID NO: 341435 - DNA, 31 bp, Artificial Sequence
  Description of Artificial Sequence: Synthetic oligonucleotide
taccgggtgtttgctctgcatcagaagaagc

SEQ ID NO: 341436 - DNA, 30 bp, Artificial Sequence
  Description of Artificial Sequence: Synthetic oligonucleotide
accgggtgtttgctctgcatcagaagaagc

SEQ ID NO: 341437 - DNA, 29 bp, Artificial Sequence
  Description of Artificial Sequence: Synthetic oligonucleotide
ccgggtgtttgctctgcatcagaagaagc

SEQ ID NO: 341438 - DNA, 29 bp, Artificial Sequence
  Description of Artificial Sequence: Synthetic oligonucleotide
cgggtgtttgctctgcatcagaagaagcg

SEQ ID NO: 341439 - DNA, 29 bp, Artificial Sequence
  Description of Artificial Sequence: Synthetic oligonucleotide
gggtgtttgctctgcatcagaagaagcgc

SEQ ID NO: 341440 - DNA, 29 bp, Artificial Sequence
  Description of Artificial Sequence: Synthetic oligonucleotide
ggtgtttgctctgcatcagaagaagcgcc

SEQ ID NO: 341441 - DNA, 29 bp, Artificial Sequence
  Description of Artificial Sequence: Synthetic oligonucleotide
gtgtttgctctgcatcagaagaagcgccc

SEQ ID NO: 341442 - DNA, 29 bp, Artificial Sequence
  Description of Artificial Sequence: Synthetic oligonucleotide
tgtttgctctgcatcagaagaagcgcccg

SEQ ID NO: 341443 - DNA, 28 bp, Artificial Sequence
  Description of Artificial Sequence: Synthetic oligonucleotide
gtttgctctgcatcagaagaagcgcccg

SEQ ID NO: 341444 - DNA, 29 bp, Artificial Sequence
  Description of Artificial Sequence: Synthetic oligonucleotide
tttgctctgcatcagaagaagcgcccgag

SEQ ID NO: 341445 - DNA, 28 bp, Artificial Sequence
  Description of Artificial Sequence: Synthetic oligonucleotide
ttgctctgcatcagaagaagcgcccgag

SEQ ID NO: 341446 - DNA, 27 bp, Artificial Sequence
  Description of Artificial Sequence: Synthetic oligonucleotide
tgctctgcatcagaagaagcgcccgag

SEQ ID NO: 341447 - DNA, 26 bp, Artificial Sequence
  Description of Artificial Sequence: Synthetic oligonucleotide
gctctgcatcagaagaagcgcccgag

SEQ ID NO: 341448 - DNA, 27 bp, Artificial Sequence
  Description of Artificial Sequence: Synthetic oligonucleotide
ctctgcatcagaagaagcgcccgagga

SEQ ID NO: 341449 - DNA, 27 bp, Artificial Sequence
  Description of Artificial Sequence: Synthetic oligonucleotide
tctgcatcagaagaagcgcccgaggac

SEQ ID NO: 341450 - DNA, 27 bp, Artificial Sequence
  Description of Artificial Sequence: Synthetic oligonucleotide
ctgcatcagaagaagcgcccgaggact

SEQ ID NO: 341451 - DNA, 27 bp, Artificial Sequence
  Description of Artificial Sequence: Synthetic oligonucleotide
tgcatcagaagaagcgcccgaggactg

SEQ ID NO: 341452 - DNA, 27 bp, Artificial Sequence
  Description of Artificial Sequence: Synthetic oligonucleotide
gcatcagaagaagcgcccgaggactga

SEQ ID NO: 341453 - DNA, 27 bp, Artificial Sequence
  Description of Artificial Sequence: Synthetic oligonucleotide
catcagaagaagcgcccgaggactgac

SEQ ID NO: 341454 - DNA, 28 bp, Artificial Sequence
  Description of Artificial Sequence: Synthetic oligonucleotide
atcagaagaagcgcccgaggactgacac

SEQ ID NO: 341455 - DNA, 27 bp, Artificial Sequence
  Description of Artificial Sequence: Synthetic oligonucleotide
tcagaagaagcgcccgaggactgacac

SEQ ID NO: 341456 - DNA, 26 bp, Artificial Sequence
  Description of Artificial Sequence: Synthetic oligonucleotide
cagaagaagcgcccgaggactgacac

SEQ ID NO: 341457 - DNA, 27 bp, Artificial Sequence
  Description of Artificial Sequence: Synthetic oligonucleotide
agaagaagcgcccgaggactgacacct

SEQ ID NO: 341458 - DNA, 27 bp, Artificial Sequence
  Description of Artificial Sequence: Synthetic oligonucleotide
gaagaagcgcccgaggactgacacctt

SEQ ID NO: 341459 - DNA, 27 bp, Artificial Sequence
  Description of Artificial Sequence: Synthetic oligonucleotide
aagaagcgcccgaggactgacaccttc

SEQ ID NO: 341460 - DNA, 27 bp, Artificial Sequence
  Description of Artificial Sequence: Synthetic oligonucleotide
agaagcgcccgaggactgacaccttca

SEQ ID NO: 341461 - DNA, 26 bp, Artificial Sequence
  Description of Artificial Sequence: Synthetic oligonucleotide
gaagcgcccgaggactgacaccttca

SEQ ID NO: 341462 - DNA, 27 bp, Artificial Sequence
  Description of Artificial Sequence: Synthetic oligonucleotide
aagcgcccgaggactgacaccttcaca

SEQ ID NO: 341463 - DNA, 26 bp, Artificial Sequence
  Description of Artificial Sequence: Synthetic oligonucleotide
agcgcccgaggactgacaccttcaca

SEQ ID NO: 341464 - DNA, 25 bp, Artificial Sequence
  Description of Artificial Sequence: Synthetic oligonucleotide
gcgcccgaggactgacaccttcaca

SEQ ID NO: 341465 - DNA, 26 bp, Artificial Sequence
  Description of Artificial Sequence: Synthetic oligonucleotide
cgcccgaggactgacaccttcacagt

SEQ ID NO: 341466 - DNA, 27 bp, Artificial Sequence
  Description of Artificial Sequence: Synthetic oligonucleotide
gcccgaggactgacaccttcacagtca

SEQ ID NO: 341467 - DNA, 28 bp, Artificial Sequence
  Description of Artificial Sequence: Synthetic oligonucleotide
cccgaggactgacaccttcacagtcaag

SEQ ID NO: 341468 - DNA, 28 bp, Artificial Sequence
  Description of Artificial Sequence: Synthetic oligonucleotide
ccgaggactgacaccttcacagtcaagg

SEQ ID NO: 341469 - DNA, 29 bp, Artificial Sequence
  Description of Artificial Sequence: Synthetic oligonucleotide
cgaggactgacaccttcacagtcaaggtg

SEQ ID NO: 341470 - DNA, 29 bp, Artificial Sequence
  Description of Artificial Sequence: Synthetic oligonucleotide
gaggactgacaccttcacagtcaaggtgg

SEQ ID NO: 341471 - DNA, 30 bp, Artificial Sequence
  Description of Artificial Sequence: Synthetic oligonucleotide
aggactgacaccttcacagtcaaggtggag

SEQ ID NO: 341472 - DNA, 29 bp, Artificial Sequence
  Description of Artificial Sequence: Synthetic oligonucleotide
ggactgacaccttcacagtcaaggtggag

SEQ ID NO: 341473 - DNA, 31 bp, Artificial Sequence
  Description of Artificial Sequence: Synthetic oligonucleotide
gactgacaccttcacagtcaaggtggagaag

SEQ ID NO: 341474 - DNA, 32 bp, Artificial Sequence
  Description of Artificial Sequence: Synthetic oligonucleotide
actgacaccttcacagtcaaggtggagaagtc

SEQ ID NO: 341475 - DNA, 31 bp, Artificial Sequence
  Description of Artificial Sequence: Synthetic oligonucleotide
ctgacaccttcacagtcaaggtggagaagtc

SEQ ID NO: 341476 - DNA, 32 bp, Artificial Sequence
  Description of Artificial Sequence: Synthetic oligonucleotide
tgacaccttcacagtcaaggtggagaagtctc

SEQ ID NO: 341477 - DNA, 31 bp, Artificial Sequence
  Description of Artificial Sequence: Synthetic oligonucleotide
gacaccttcacagtcaaggtggagaagtctc

SEQ ID NO: 341478 - DNA, 32 bp, Artificial Sequence
  Description of Artificial Sequence: Synthetic oligonucleotide
acaccttcacagtcaaggtggagaagtctcac

SEQ ID NO: 341479 - DNA, 31 bp, Artificial Sequence
  Description of Artificial Sequence: Synthetic oligonucleotide
caccttcacagtcaaggtggagaagtctcac

SEQ ID NO: 341480 - DNA, 31 bp, Artificial Sequence
  Description of Artificial Sequence: Synthetic oligonucleotide
accttcacagtcaaggtggagaagtctcacg

SEQ ID NO: 341481 - DNA, 30 bp, Artificial Sequence
  Description of Artificial Sequence: Synthetic oligonucleotide
ccttcacagtcaaggtggagaagtctcacg

SEQ ID NO: 341482 - DNA, 30 bp, Artificial Sequence
  Description of Artificial Sequence: Synthetic oligonucleotide
cttcacagtcaaggtggagaagtctcacgg

SEQ ID NO: 341483 - DNA, 30 bp, Artificial Sequence
  Description of Artificial Sequence: Synthetic oligonucleotide
ttcacagtcaaggtggagaagtctcacggc

SEQ ID NO: 341484 - DNA, 29 bp, Artificial Sequence
  Description of Artificial Sequence: Synthetic oligonucleotide
tcacagtcaaggtggagaagtctcacggc

SEQ ID NO: 341485 - DNA, 28 bp, Artificial Sequence
  Description of Artificial Sequence: Synthetic oligonucleotide
cacagtcaaggtggagaagtctcacggc

SEQ ID NO: 341486 - DNA, 28 bp, Artificial Sequence
  Description of Artificial Sequence: Synthetic oligonucleotide
acagtcaaggtggagaagtctcacggcg

SEQ ID NO: 341487 - DNA, 27 bp, Artificial Sequence
  Description of Artificial Sequence: Synthetic oligonucleotide
cagtcaaggtggagaagtctcacggcg

SEQ ID NO: 341488 - DNA, 28 bp, Artificial Sequence
  Description of Artificial Sequence: Synthetic oligonucleotide
agtcaaggtggagaagtctcacggcgtc

SEQ ID NO: 341489 - DNA, 27 bp, Artificial Sequence
  Description of Artificial Sequence: Synthetic oligonucleotide
gtcaaggtggagaagtctcacggcgtc

SEQ ID NO: 341490 - DNA, 27 bp, Artificial Sequence
  Description of Artificial Sequence: Synthetic oligonucleotide
tcaaggtggagaagtctcacggcgtcc

SEQ ID NO: 341491 - DNA, 26 bp, Artificial Sequence
  Description of Artificial Sequence: Synthetic oligonucleotide
caaggtggagaagtctcacggcgtcc

SEQ ID NO: 341492 - DNA, 26 bp, Artificial Sequence
  Description of Artificial Sequence: Synthetic oligonucleotide
aaggtggagaagtctcacggcgtccg

SEQ ID NO: 341493 - DNA, 25 bp, Artificial Sequence
  Description of Artificial Sequence: Synthetic oligonucleotide
aggtggagaagtctcacggcgtccg

SEQ ID NO: 341494 - DNA, 24 bp, Artificial Sequence
  Description of Artificial Sequence: Synthetic oligonucleotide
ggtggagaagtctcacggcgtccg

SEQ ID NO: 341495 - DNA, 24 bp, Artificial Sequence
  Description of Artificial Sequence: Synthetic oligonucleotide
gtggagaagtctcacggcgtccgc

SEQ ID NO: 341496 - DNA, 25 bp, Artificial Sequence
  Description of Artificial Sequence: Synthetic oligonucleotide
tggagaagtctcacggcgtccgcgt

SEQ ID NO: 341497 - DNA, 24 bp, Artificial Sequence
  Description of Artificial Sequence: Synthetic oligonucleotide
ggagaagtctcacggcgtccgcgt

SEQ ID NO: 341498 - DNA, 24 bp, Artificial Sequence
  Description of Artificial Sequence: Synthetic oligonucleotide
gagaagtctcacggcgtccgcgtg

SEQ ID NO: 341499 - DNA, 24 bp, Artificial Sequence
  Description of Artificial Sequence: Synthetic oligonucleotide
agaagtctcacggcgtccgcgtgc

SEQ ID NO: 341500 - DNA, 23 bp, Artificial Sequence
  Description of Artificial Sequence: Synthetic oligonucleotide
gaagtctcacggcgtccgcgtgc

SEQ ID NO: 341501 - DNA, 23 bp, Artificial Sequence
  Description of Artificial Sequence: Synthetic oligonucleotide
aagtctcacggcgtccgcgtgcc

SEQ ID NO: 341502 - DNA, 22 bp, Artificial Sequence
  Description of Artificial Sequence: Synthetic oligonucleotide
agtctcacggcgtccgcgtgcc

SEQ ID NO: 341503 - DNA, 21 bp, Artificial Sequence
  Description of Artificial Sequence: Synthetic oligonucleotide
gtctcacggcgtccgcgtgcc

SEQ ID NO: 341504 - DNA, 23 bp, Artificial Sequence
  Description of Artificial Sequence: Synthetic oligonucleotide
tctcacggcgtccgcgtgccgaa

SEQ ID NO: 341505 - DNA, 22 bp, Artificial Sequence
  Description of Artificial Sequence: Synthetic oligonucleotide
ctcacggcgtccgcgtgccgaa

SEQ ID NO: 341506 - DNA, 24 bp, Artificial Sequence
  Description of Artificial Sequence: Synthetic oligonucleotide
tcacggcgtccgcgtgccgaagaa

SEQ ID NO: 341507 - DNA, 23 bp, Artificial Sequence
  Description of Artificial Sequence: Synthetic oligonucleotide
cacggcgtccgcgtgccgaagaa

SEQ ID NO: 341508 - DNA, 23 bp, Artificial Sequence
  Description of Artificial Sequence: Synthetic oligonucleotide
acggcgtccgcgtgccgaagaag

SEQ ID NO: 341509 - DNA, 22 bp, Artificial Sequence
  Description of Artificial Sequence: Synthetic oligonucleotide
cggcgtccgcgtgccgaagaag

SEQ ID NO: 341510 - DNA, 23 bp, Artificial Sequence
  Description of Artificial Sequence: Synthetic oligonucleotide
ggcgtccgcgtgccgaagaagga

SEQ ID NO: 341511 - DNA, 23 bp, Artificial Sequence
  Description of Artificial Sequence: Synthetic oligonucleotide
gcgtccgcgtgccgaagaaggac

SEQ ID NO: 341512 - DNA, 24 bp, Artificial Sequence
  Description of Artificial Sequence: Synthetic oligonucleotide
cgtccgcgtgccgaagaaggacgt

SEQ ID NO: 341513 - DNA, 26 bp, Artificial Sequence
  Description of Artificial Sequence: Synthetic oligonucleotide
gtccgcgtgccgaagaaggacgtgta

SEQ ID NO: 341514 - DNA, 27 bp, Artificial Sequence
  Description of Artificial Sequence: Synthetic oligonucleotide
tccgcgtgccgaagaaggacgtgtaca

SEQ ID NO: 341515 - DNA, 27 bp, Artificial Sequence
  Description of Artificial Sequence: Synthetic oligonucleotide
ccgcgtgccgaagaaggacgtgtacat

SEQ ID NO: 341516 - DNA, 27 bp, Artificial Sequence
  Description of Artificial Sequence: Synthetic oligonucleotide
cgcgtgccgaagaaggacgtgtacatg

SEQ ID NO: 341517 - DNA, 27 bp, Artificial Sequence
  Description of Artificial Sequence: Synthetic oligonucleotide
gcgtgccgaagaaggacgtgtacatgg

SEQ ID NO: 341518 - DNA, 27 bp, Artificial Sequence
  Description of Artificial Sequence: Synthetic oligonucleotide
cgtgccgaagaaggacgtgtacatggc

SEQ ID NO: 341519 - DNA, 27 bp, Artificial Sequence
  Description of Artificial Sequence: Synthetic oligonucleotide
gtgccgaagaaggacgtgtacatggcc

SEQ ID NO: 341520 - DNA, 28 bp, Artificial Sequence
  Description of Artificial Sequence: Synthetic oligonucleotide
tgccgaagaaggacgtgtacatggcctc

SEQ ID NO: 341521 - DNA, 27 bp, Artificial Sequence
  Description of Artificial Sequence: Synthetic oligonucleotide
gccgaagaaggacgtgtacatggcctc

SEQ ID NO: 341522 - DNA, 27 bp, Artificial Sequence
  Description of Artificial Sequence: Synthetic oligonucleotide
ccgaagaaggacgtgtacatggcctcg

SEQ ID NO: 341523 - DNA, 28 bp, Artificial Sequence
  Description of Artificial Sequence: Synthetic oligonucleotide
cgaagaaggacgtgtacatggcctcgtc

SEQ ID NO: 341524 - DNA, 28 bp, Artificial Sequence
  Description of Artificial Sequence: Synthetic oligonucleotide
gaagaaggacgtgtacatggcctcgtcc

SEQ ID NO: 341525 - DNA, 30 bp, Artificial Sequence
  Description of Artificial Sequence: Synthetic oligonucleotide
aagaaggacgtgtacatggcctcgtccaac

SEQ ID NO: 341526 - DNA, 29 bp, Artificial Sequence
  Description of Artificial Sequence: Synthetic oligonucleotide
agaaggacgtgtacatggcctcgtccaac

SEQ ID NO: 341527 - DNA, 28 bp, Artificial Sequence
  Description of Artificial Sequence: Synthetic oligonucleotide
gaaggacgtgtacatggcctcgtccaac

SEQ ID NO: 341528 - DNA, 30 bp, Artificial Sequence
  Description of Artificial Sequence: Synthetic oligonucleotide
aaggacgtgtacatggcctcgtccaacttc

SEQ ID NO: 341529 - DNA, 29 bp, Artificial Sequence
  Description of Artificial Sequence: Synthetic oligonucleotide
aggacgtgtacatggcctcgtccaacttc

SEQ ID NO: 341530 - DNA, 28 bp, Artificial Sequence
  Description of Artificial Sequence: Synthetic oligonucleotide
ggacgtgtacatggcctcgtccaacttc

SEQ ID NO: 341531 - DNA, 28 bp, Artificial Sequence
  Description of Artificial Sequence: Synthetic oligonucleotide
gacgtgtacatggcctcgtccaacttcc

SEQ ID NO: 341532 - DNA, 29 bp, Artificial Sequence
  Description of Artificial Sequence: Synthetic oligonucleotide
acgtgtacatggcctcgtccaacttccag

SEQ ID NO: 341533 - DNA, 28 bp, Artificial Sequence
  Description of Artificial Sequence: Synthetic oligonucleotide
cgtgtacatggcctcgtccaacttccag

SEQ ID NO: 341534 - DNA, 28 bp, Artificial Sequence
  Description of Artificial Sequence: Synthetic oligonucleotide
gtgtacatggcctcgtccaacttccagg

SEQ ID NO: 341535 - DNA, 30 bp, Artificial Sequence
  Description of Artificial Sequence: Synthetic oligonucleotide
tgtacatggcctcgtccaacttccaggaag

SEQ ID NO: 341536 - DNA, 29 bp, Artificial Sequence
  Description of Artificial Sequence: Synthetic oligonucleotide
gtacatggcctcgtccaacttccaggaag

SEQ ID NO: 341537 - DNA, 30 bp, Artificial Sequence
  Description of Artificial Sequence: Synthetic oligonucleotide
tacatggcctcgtccaacttccaggaagac

SEQ ID NO: 341538 - DNA, 29 bp, Artificial Sequence
  Description of Artificial Sequence: Synthetic oligonucleotide
acatggcctcgtccaacttccaggaagac

SEQ ID NO: 341539 - DNA, 28 bp, Artificial Sequence
  Description of Artificial Sequence: Synthetic oligonucleotide
catggcctcgtccaacttccaggaagac

SEQ ID NO: 341540 - DNA, 31 bp, Artificial Sequence
  Description of Artificial Sequence: Synthetic oligonucleotide
atggcctcgtccaacttccaggaagactttg

SEQ ID NO: 341541 - DNA, 30 bp, Artificial Sequence
  Description of Artificial Sequence: Synthetic oligonucleotide
tggcctcgtccaacttccaggaagactttg

SEQ ID NO: 341542 - DNA, 29 bp, Artificial Sequence
  Description of Artificial Sequence: Synthetic oligonucleotide
ggcctcgtccaacttccaggaagactttg

SEQ ID NO: 341543 - DNA, 30 bp, Artificial Sequence
  Description of Artificial Sequence: Synthetic oligonucleotide
gcctcgtccaacttccaggaagactttgtg

SEQ ID NO: 341544 - DNA, 32 bp, Artificial Sequence
  Description of Artificial Sequence: Synthetic oligonucleotide
cctcgtccaacttccaggaagactttgtgttc

SEQ ID NO: 341545 - DNA, 32 bp, Artificial Sequence
  Description of Artificial Sequence: Synthetic oligonucleotide
ctcgtccaacttccaggaagactttgtgttcc

SEQ ID NO: 341546 - DNA, 32 bp, Artificial Sequence
  Description of Artificial Sequence: Synthetic oligonucleotide
tcgtccaacttccaggaagactttgtgttccc

SEQ ID NO: 341547 - DNA, 31 bp, Artificial Sequence
  Description of Artificial Sequence: Synthetic oligonucleotide
cgtccaacttccaggaagactttgtgttccc

SEQ ID NO: 341548 - DNA, 32 bp, Artificial Sequence
  Description of Artificial Sequence: Synthetic oligonucleotide
gtccaacttccaggaagactttgtgttcccag

SEQ ID NO: 341549 - DNA, 33 bp, Artificial Sequence
  Description of Artificial Sequence: Synthetic oligonucleotide
tccaacttccaggaagactttgtgttcccagac

SEQ ID NO: 341550 - DNA, 32 bp, Artificial Sequence
  Description of Artificial Sequence: Synthetic oligonucleotide
ccaacttccaggaagactttgtgttcccagac

SEQ ID NO: 341551 - DNA, 34 bp, Artificial Sequence
  Description of Artificial Sequence: Synthetic oligonucleotide
caacttccaggaagactttgtgttcccagacaac

SEQ ID NO: 341552 - DNA, 35 bp, Artificial Sequence
  Description of Artificial Sequence: Synthetic oligonucleotide
aacttccaggaagactttgtgttcccagacaactc

SEQ ID NO: 341553 - DNA, 34 bp, Artificial Sequence
  Description of Artificial Sequence: Synthetic oligonucleotide
acttccaggaagactttgtgttcccagacaactc

SEQ ID NO: 341554 - DNA, 33 bp, Artificial Sequence
  Description of Artificial Sequence: Synthetic oligonucleotide
cttccaggaagactttgtgttcccagacaactc

SEQ ID NO: 341555 - DNA, 34 bp, Artificial Sequence
  Description of Artificial Sequence: Synthetic oligonucleotide
ttccaggaagactttgtgttcccagacaactcag

SEQ ID NO: 341556 - DNA, 33 bp, Artificial Sequence
  Description of Artificial Sequence: Synthetic oligonucleotide
tccaggaagactttgtgttcccagacaactcag

SEQ ID NO: 341557 - DNA, 32 bp, Artificial Sequence
  Description of Artificial Sequence: Synthetic oligonucleotide
ccaggaagactttgtgttcccagacaactcag

SEQ ID NO: 341558 - DNA, 33 bp, Artificial Sequence
  Description of Artificial Sequence: Synthetic oligonucleotide
caggaagactttgtgttcccagacaactcagag

SEQ ID NO: 341559 - DNA, 33 bp, Artificial Sequence
  Description of Artificial Sequence: Synthetic oligonucleotide
aggaagactttgtgttcccagacaactcagagc

SEQ ID NO: 341560 - DNA, 32 bp, Artificial Sequence
  Description of Artificial Sequence: Synthetic oligonucleotide
ggaagactttgtgttcccagacaactcagagc

SEQ ID NO: 341561 - DNA, 32 bp, Artificial Sequence
  Description of Artificial Sequence: Synthetic oligonucleotide
gaagactttgtgttcccagacaactcagagcc

SEQ ID NO: 341562 - DNA, 33 bp, Artificial Sequence
  Description of Artificial Sequence: Synthetic oligonucleotide
aagactttgtgttcccagacaactcagagcctg

SEQ ID NO: 341563 - DNA, 32 bp, Artificial Sequence
  Description of Artificial Sequence: Synthetic oligonucleotide
agactttgtgttcccagacaactcagagcctg

SEQ ID NO: 341564 - DNA, 31 bp, Artificial Sequence
  Description of Artificial Sequence: Synthetic oligonucleotide
gactttgtgttcccagacaactcagagcctg

SEQ ID NO: 341565 - DNA, 31 bp, Artificial Sequence
  Description of Artificial Sequence: Synthetic oligonucleotide
actttgtgttcccagacaactcagagcctgg

SEQ ID NO: 341566 - DNA, 30 bp, Artificial Sequence
  Description of Artificial Sequence: Synthetic oligonucleotide
ctttgtgttcccagacaactcagagcctgg

SEQ ID NO: 341567 - DNA, 30 bp, Artificial Sequence
  Description of Artificial Sequence: Synthetic oligonucleotide
tttgtgttcccagacaactcagagcctggg

SEQ ID NO: 341568 - DNA, 29 bp, Artificial Sequence
  Description of Artificial Sequence: Synthetic oligonucleotide
ttgtgttcccagacaactcagagcctggg

SEQ ID NO: 341569 - DNA, 28 bp, Artificial Sequence
  Description of Artificial Sequence: Synthetic oligonucleotide
tgtgttcccagacaactcagagcctggg

SEQ ID NO: 341570 - DNA, 27 bp, Artificial Sequence
  Description of Artificial Sequence: Synthetic oligonucleotide
gtgttcccagacaactcagagcctggg

SEQ ID NO: 341571 - DNA, 28 bp, Artificial Sequence
  Description of Artificial Sequence: Synthetic oligonucleotide
tgttcccagacaactcagagcctgggac

SEQ ID NO: 341572 - DNA, 27 bp, Artificial Sequence
  Description of Artificial Sequence: Synthetic oligonucleotide
gttcccagacaactcagagcctgggac

SEQ ID NO: 341573 - DNA, 27 bp, Artificial Sequence
  Description of Artificial Sequence: Synthetic oligonucleotide
ttcccagacaactcagagcctgggacc

SEQ ID NO: 341574 - DNA, 27 bp, Artificial Sequence
  Description of Artificial Sequence: Synthetic oligonucleotide
tcccagacaactcagagcctgggacct

SEQ ID NO: 341575 - DNA, 26 bp, Artificial Sequence
  Description of Artificial Sequence: Synthetic oligonucleotide
cccagacaactcagagcctgggacct

SEQ ID NO: 341576 - DNA, 26 bp, Artificial Sequence
  Description of Artificial Sequence: Synthetic oligonucleotide
ccagacaactcagagcctgggacctg

SEQ ID NO: 341577 - DNA, 27 bp, Artificial Sequence
  Description of Artificial Sequence: Synthetic oligonucleotide
cagacaactcagagcctgggacctggt

SEQ ID NO: 341578 - DNA, 28 bp, Artificial Sequence
  Description of Artificial Sequence: Synthetic oligonucleotide
agacaactcagagcctgggacctggtag

SEQ ID NO: 341579 - DNA, 27 bp, Artificial Sequence
  Description of Artificial Sequence: Synthetic oligonucleotide
gacaactcagagcctgggacctggtag

SEQ ID NO: 341580 - DNA, 29 bp, Artificial Sequence
  Description of Artificial Sequence: Synthetic oligonucleotide
acaactcagagcctgggacctggtagatc

SEQ ID NO: 341581 - DNA, 28 bp, Artificial Sequence
  Description of Artificial Sequence: Synthetic oligonucleotide
caactcagagcctgggacctggtagatc

SEQ ID NO: 341582 - DNA, 29 bp, Artificial Sequence
  Description of Artificial Sequence: Synthetic oligonucleotide
aactcagagcctgggacctggtagatctc

SEQ ID NO: 341583 - DNA, 28 bp, Artificial Sequence
  Description of Artificial Sequence: Synthetic oligonucleotide
actcagagcctgggacctggtagatctc

SEQ ID NO: 341584 - DNA, 27 bp, Artificial Sequence
  Description of Artificial Sequence: Synthetic oligonucleotide
ctcagagcctgggacctggtagatctc

SEQ ID NO: 341585 - DNA, 28 bp, Artificial Sequence
  Description of Artificial Sequence: Synthetic oligonucleotide
tcagagcctgggacctggtagatctcag

SEQ ID NO: 341586 - DNA, 27 bp, Artificial Sequence
  Description of Artificial Sequence: Synthetic oligonucleotide
cagagcctgggacctggtagatctcag

SEQ ID NO: 341587 - DNA, 27 bp, Artificial Sequence
  Description of Artificial Sequence: Synthetic oligonucleotide
agagcctgggacctggtagatctcagg

SEQ ID NO: 341588 - DNA, 26 bp, Artificial Sequence
  Description of Artificial Sequence: Synthetic oligonucleotide
gagcctgggacctggtagatctcagg

SEQ ID NO: 341589 - DNA, 26 bp, Artificial Sequence
  Description of Artificial Sequence: Synthetic oligonucleotide
agcctgggacctggtagatctcaggc

SEQ ID NO: 341590 - DNA, 25 bp, Artificial Sequence
  Description of Artificial Sequence: Synthetic oligonucleotide
gcctgggacctggtagatctcaggc

SEQ ID NO: 341591 - DNA, 25 bp, Artificial Sequence
  Description of Artificial Sequence: Synthetic oligonucleotide
cctgggacctggtagatctcaggcc

SEQ ID NO: 341592 - DNA, 27 bp, Artificial Sequence
  Description of Artificial Sequence: Synthetic oligonucleotide
ctgggacctggtagatctcaggccgat

SEQ ID NO: 341593 - DNA, 28 bp, Artificial Sequence
  Description of Artificial Sequence: Synthetic oligonucleotide
tgggacctggtagatctcaggccgattc

SEQ ID NO: 341594 - DNA, 27 bp, Artificial Sequence
  Description of Artificial Sequence: Synthetic oligonucleotide
gggacctggtagatctcaggccgattc

SEQ ID NO: 341595 - DNA, 28 bp, Artificial Sequence
  Description of Artificial Sequence: Synthetic oligonucleotide
ggacctggtagatctcaggccgattctc

SEQ ID NO: 341596 - DNA, 29 bp, Artificial Sequence
  Description of Artificial Sequence: Synthetic oligonucleotide
gacctggtagatctcaggccgattctctg

SEQ ID NO: 341597 - DNA, 31 bp, Artificial Sequence
  Description of Artificial Sequence: Synthetic oligonucleotide
acctggtagatctcaggccgattctctgatg

SEQ ID NO: 341598 - DNA, 30 bp, Artificial Sequence
  Description of Artificial Sequence: Synthetic oligonucleotide
cctggtagatctcaggccgattctctgatg

SEQ ID NO: 341599 - DNA, 30 bp, Artificial Sequence
  Description of Artificial Sequence: Synthetic oligonucleotide
ctggtagatctcaggccgattctctgatgg

SEQ ID NO: 341600 - DNA, 30 bp, Artificial Sequence
  Description of Artificial Sequence: Synthetic oligonucleotide
tggtagatctcaggccgattctctgatggc

SEQ ID NO: 341601 - DNA, 29 bp, Artificial Sequence
  Description of Artificial Sequence: Synthetic oligonucleotide
ggtagatctcaggccgattctctgatggc

SEQ ID NO: 341602 - DNA, 29 bp, Artificial Sequence
  Description of Artificial Sequence: Synthetic oligonucleotide
gtagatctcaggccgattctctgatggcc

SEQ ID NO: 341603 - DNA, 30 bp, Artificial Sequence
  Description of Artificial Sequence: Synthetic oligonucleotide
tagatctcaggccgattctctgatggcctg

SEQ ID NO: 341604 - DNA, 29 bp, Artificial Sequence
  Description of Artificial Sequence: Synthetic oligonucleotide
agatctcaggccgattctctgatggcctg

SEQ ID NO: 341605 - DNA, 28 bp, Artificial Sequence
  Description of Artificial Sequence: Synthetic oligonucleotide
gatctcaggccgattctctgatggcctg

SEQ ID NO: 341606 - DNA, 28 bp, Artificial Sequence
  Description of Artificial Sequence: Synthetic oligonucleotide
atctcaggccgattctctgatggcctgc

SEQ ID NO: 341607 - DNA, 27 bp, Artificial Sequence
  Description of Artificial Sequence: Synthetic oligonucleotide
tctcaggccgattctctgatggcctgc

SEQ ID NO: 341608 - DNA, 27 bp, Artificial Sequence
  Description of Artificial Sequence: Synthetic oligonucleotide
ctcaggccgattctctgatggcctgca

SEQ ID NO: 341609 - DNA, 29 bp, Artificial Sequence
  Description of Artificial Sequence: Synthetic oligonucleotide
tcaggccgattctctgatggcctgcaatc

SEQ ID NO: 341610 - DNA, 28 bp, Artificial Sequence
  Description of Artificial Sequence: Synthetic oligonucleotide
caggccgattctctgatggcctgcaatc

SEQ ID NO: 341611 - DNA, 28 bp, Artificial Sequence
  Description of Artificial Sequence: Synthetic oligonucleotide
aggccgattctctgatggcctgcaatcc

SEQ ID NO: 341612 - DNA, 27 bp, Artificial Sequence
  Description of Artificial Sequence: Synthetic oligonucleotide
ggccgattctctgatggcctgcaatcc

SEQ ID NO: 341613 - DNA, 29 bp, Artificial Sequence
  Description of Artificial Sequence: Synthetic oligonucleotide
gccgattctctgatggcctgcaatccaac

SEQ ID NO: 341614 - DNA, 30 bp, Artificial Sequence
  Description of Artificial Sequence: Synthetic oligonucleotide
ccgattctctgatggcctgcaatccaacac

SEQ ID NO: 341615 - DNA, 30 bp, Artificial Sequence
  Description of Artificial Sequence: Synthetic oligonucleotide
cgattctctgatggcctgcaatccaacacc

SEQ ID NO: 341616 - DNA, 31 bp, Artificial Sequence
  Description of Artificial Sequence: Synthetic oligonucleotide
gattctctgatggcctgcaatccaacaccag

SEQ ID NO: 341617 - DNA, 31 bp, Artificial Sequence
  Description of Artificial Sequence: Synthetic oligonucleotide
attctctgatggcctgcaatccaacaccagc

SEQ ID NO: 341618 - DNA, 30 bp, Artificial Sequence
  Description of Artificial Sequence: Synthetic oligonucleotide
ttctctgatggcctgcaatccaacaccagc

SEQ ID NO: 341619 - DNA, 29 bp, Artificial Sequence
  Description of Artificial Sequence: Synthetic oligonucleotide
tctctgatggcctgcaatccaacaccagc

SEQ ID NO: 341620 - DNA, 28 bp, Artificial Sequence
  Description of Artificial Sequence: Synthetic oligonucleotide
ctctgatggcctgcaatccaacaccagc

SEQ ID NO: 341621 - DNA, 29 bp, Artificial Sequence
  Description of Artificial Sequence: Synthetic oligonucleotide
tctgatggcctgcaatccaacaccagcac

SEQ ID NO: 341622 - DNA, 28 bp, Artificial Sequence
  Description of Artificial Sequence: Synthetic oligonucleotide
ctgatggcctgcaatccaacaccagcac

SEQ ID NO: 341623 - DNA, 28 bp, Artificial Sequence
  Description of Artificial Sequence: Synthetic oligonucleotide
tgatggcctgcaatccaacaccagcacc

SEQ ID NO: 341624 - DNA, 27 bp, Artificial Sequence
  Description of Artificial Sequence: Synthetic oligonucleotide
gatggcctgcaatccaacaccagcacc

SEQ ID NO: 341625 - DNA, 27 bp, Artificial Sequence
  Description of Artificial Sequence: Synthetic oligonucleotide
atggcctgcaatccaacaccagcaccc

SEQ ID NO: 341626 - DNA, 27 bp, Artificial Sequence
  Description of Artificial Sequence: Synthetic oligonucleotide
tggcctgcaatccaacaccagcaccca

SEQ ID NO: 341627 - DNA, 26 bp, Artificial Sequence
  Description of Artificial Sequence: Synthetic oligonucleotide
ggcctgcaatccaacaccagcaccca

SEQ ID NO: 341628 - DNA, 27 bp, Artificial Sequence
  Description of Artificial Sequence: Synthetic oligonucleotide
gcctgcaatccaacaccagcacccact

SEQ ID NO: 341629 - DNA, 29 bp, Artificial Sequence
  Description of Artificial Sequence: Synthetic oligonucleotide
cctgcaatccaacaccagcacccactttg

SEQ ID NO: 341630 - DNA, 30 bp, Artificial Sequence
  Description of Artificial Sequence: Synthetic oligonucleotide
ctgcaatccaacaccagcacccactttgag

SEQ ID NO: 341631 - DNA, 30 bp, Artificial Sequence
  Description of Artificial Sequence: Synthetic oligonucleotide
tgcaatccaacaccagcacccactttgagg

SEQ ID NO: 341632 - DNA, 29 bp, Artificial Sequence
  Description of Artificial Sequence: Synthetic oligonucleotide
gcaatccaacaccagcacccactttgagg

SEQ ID NO: 341633 - DNA, 30 bp, Artificial Sequence
  Description of Artificial Sequence: Synthetic oligonucleotide
caatccaacaccagcacccactttgaggtg

SEQ ID NO: 341634 - DNA, 32 bp, Artificial Sequence
  Description of Artificial Sequence: Synthetic oligonucleotide
aatccaacaccagcacccactttgaggtgtag

SEQ ID NO: 341635 - DNA, 31 bp, Artificial Sequence
  Description of Artificial Sequence: Synthetic oligonucleotide
atccaacaccagcacccactttgaggtgtag

SEQ ID NO: 341636 - DNA, 30 bp, Artificial Sequence
  Description of Artificial Sequence: Synthetic oligonucleotide
tccaacaccagcacccactttgaggtgtag

SEQ ID NO: 341637 - DNA, 29 bp, Artificial Sequence
  Description of Artificial Sequence: Synthetic oligonucleotide
ccaacaccagcacccactttgaggtgtag

SEQ ID NO: 341638 - DNA, 35 bp, Artificial Sequence
  Description of Artificial Sequence: Synthetic oligonucleotide
caacaccagcacccactttgaggtgtagaaatatg

SEQ ID NO: 341639 - DNA, 36 bp, Artificial Sequence
  Description of Artificial Sequence: Synthetic oligonucleotide
aacaccagcacccactttgaggtgtagaaatatgac

SEQ ID NO: 341640 - DNA, 35 bp, Artificial Sequence
  Description of Artificial Sequence: Synthetic oligonucleotide
acaccagcacccactttgaggtgtagaaatatgac

SEQ ID NO: 341641 - DNA, 34 bp, Artificial Sequence
  Description of Artificial Sequence: Synthetic oligonucleotide
caccagcacccactttgaggtgtagaaatatgac

SEQ ID NO: 341642 - DNA, 34 bp, Artificial Sequence
  Description of Artificial Sequence: Synthetic oligonucleotide
accagcacccactttgaggtgtagaaatatgacc

SEQ ID NO: 341643 - DNA, 33 bp, Artificial Sequence
  Description of Artificial Sequence: Synthetic oligonucleotide
ccagcacccactttgaggtgtagaaatatgacc

SEQ ID NO: 341644 - DNA, 35 bp, Artificial Sequence
  Description of Artificial Sequence: Synthetic oligonucleotide
cagcacccactttgaggtgtagaaatatgaccttc

SEQ ID NO: 341645 - DNA, 35 bp, Artificial Sequence
  Description of Artificial Sequence: Synthetic oligonucleotide
agcacccactttgaggtgtagaaatatgaccttcc

SEQ ID NO: 341646 - DNA, 34 bp, Artificial Sequence
  Description of Artificial Sequence: Synthetic oligonucleotide
gcacccactttgaggtgtagaaatatgaccttcc

SEQ ID NO: 341647 - DNA, 34 bp, Artificial Sequence
  Description of Artificial Sequence: Synthetic oligonucleotide
cacccactttgaggtgtagaaatatgaccttccc

SEQ ID NO: 341648 - DNA, 36 bp, Artificial Sequence
  Description of Artificial Sequence: Synthetic oligonucleotide
acccactttgaggtgtagaaatatgaccttcccaag

SEQ ID NO: 341649 - DNA, 35 bp, Artificial Sequence
  Description of Artificial Sequence: Synthetic oligonucleotide
cccactttgaggtgtagaaatatgaccttcccaag

SEQ ID NO: 341650 - DNA, 38 bp, Artificial Sequence
  Description of Artificial Sequence: Synthetic oligonucleotide
ccactttgaggtgtagaaatatgaccttcccaagtttg

SEQ ID NO: 341651 - DNA, 39 bp, Artificial Sequence
  Description of Artificial Sequence: Synthetic oligonucleotide
cactttgaggtgtagaaatatgaccttcccaagtttgag

SEQ ID NO: 341652 - DNA, 39 bp, Artificial Sequence
  Description of Artificial Sequence: Synthetic oligonucleotide
actttgaggtgtagaaatatgaccttcccaagtttgagg

SEQ ID NO: 341653 - DNA, 38 bp, Artificial Sequence
  Description of Artificial Sequence: Synthetic oligonucleotide
ctttgaggtgtagaaatatgaccttcccaagtttgagg

SEQ ID NO: 341654 - DNA, 39 bp, Artificial Sequence
  Description of Artificial Sequence: Synthetic oligonucleotide
tttgaggtgtagaaatatgaccttcccaagtttgaggtg

SEQ ID NO: 341655 - DNA, 38 bp, Artificial Sequence
  Description of Artificial Sequence: Synthetic oligonucleotide
ttgaggtgtagaaatatgaccttcccaagtttgaggtg

SEQ ID NO: 341656 - DNA, 37 bp, Artificial Sequence
  Description of Artificial Sequence: Synthetic oligonucleotide
tgaggtgtagaaatatgaccttcccaagtttgaggtg

SEQ ID NO: 341657 - DNA, 36 bp, Artificial Sequence
  Description of Artificial Sequence: Synthetic oligonucleotide
gaggtgtagaaatatgaccttcccaagtttgaggtg

SEQ ID NO: 341658 - DNA, 38 bp, Artificial Sequence
  Description of Artificial Sequence: Synthetic oligonucleotide
aggtgtagaaatatgaccttcccaagtttgaggtgtag

SEQ ID NO: 341659 - DNA, 37 bp, Artificial Sequence
  Description of Artificial Sequence: Synthetic oligonucleotide
ggtgtagaaatatgaccttcccaagtttgaggtgtag

SEQ ID NO: 341660 - DNA, 39 bp, Artificial Sequence
  Description of Artificial Sequence: Synthetic oligonucleotide
gtgtagaaatatgaccttcccaagtttgaggtgtagatc

SEQ ID NO: 341661 - DNA, 40 bp, Artificial Sequence
  Description of Artificial Sequence: Synthetic oligonucleotide
tgtagaaatatgaccttcccaagtttgaggtgtagatcac

SEQ ID NO: 341662 - DNA, 39 bp, Artificial Sequence
  Description of Artificial Sequence: Synthetic oligonucleotide
gtagaaatatgaccttcccaagtttgaggtgtagatcac

SEQ ID NO: 341663 - DNA, 39 bp, Artificial Sequence
  Description of Artificial Sequence: Synthetic oligonucleotide
tagaaatatgaccttcccaagtttgaggtgtagatcacc

SEQ ID NO: 341664 - DNA, 38 bp, Artificial Sequence
  Description of Artificial Sequence: Synthetic oligonucleotide
agaaatatgaccttcccaagtttgaggtgtagatcacc

SEQ ID NO: 341665 - DNA, 37 bp, Artificial Sequence
  Description of Artificial Sequence: Synthetic oligonucleotide
gaaatatgaccttcccaagtttgaggtgtagatcacc

SEQ ID NO: 341666 - DNA, 37 bp, Artificial Sequence
  Description of Artificial Sequence: Synthetic oligonucleotide
aaatatgaccttcccaagtttgaggtgtagatcaccc

SEQ ID NO: 341667 - DNA, 36 bp, Artificial Sequence
  Description of Artificial Sequence: Synthetic oligonucleotide
aatatgaccttcccaagtttgaggtgtagatcaccc

SEQ ID NO: 341668 - DNA, 35 bp, Artificial Sequence
  Description of Artificial Sequence: Synthetic oligonucleotide
atatgaccttcccaagtttgaggtgtagatcaccc

SEQ ID NO: 341669 - DNA, 34 bp, Artificial Sequence
  Description of Artificial Sequence: Synthetic oligonucleotide
tatgaccttcccaagtttgaggtgtagatcaccc

SEQ ID NO: 341670 - DNA, 33 bp, Artificial Sequence
  Description of Artificial Sequence: Synthetic oligonucleotide
atgaccttcccaagtttgaggtgtagatcaccc

SEQ ID NO: 341671 - DNA, 32 bp, Artificial Sequence
  Description of Artificial Sequence: Synthetic oligonucleotide
tgaccttcccaagtttgaggtgtagatcaccc

SEQ ID NO: 341672 - DNA, 31 bp, Artificial Sequence
  Description of Artificial Sequence: Synthetic oligonucleotide
gaccttcccaagtttgaggtgtagatcaccc

SEQ ID NO: 341673 - DNA, 31 bp, Artificial Sequence
  Description of Artificial Sequence: Synthetic oligonucleotide
accttcccaagtttgaggtgtagatcacccg

SEQ ID NO: 341674 - DNA, 30 bp, Artificial Sequence
  Description of Artificial Sequence: Synthetic oligonucleotide
ccttcccaagtttgaggtgtagatcacccg

SEQ ID NO: 341675 - DNA, 31 bp, Artificial Sequence
  Description of Artificial Sequence: Synthetic oligonucleotide
cttcccaagtttgaggtgtagatcacccgtg

SEQ ID NO: 341676 - DNA, 31 bp, Artificial Sequence
  Description of Artificial Sequence: Synthetic oligonucleotide
ttcccaagtttgaggtgtagatcacccgtgg

SEQ ID NO: 341677 - DNA, 30 bp, Artificial Sequence
  Description of Artificial Sequence: Synthetic oligonucleotide
tcccaagtttgaggtgtagatcacccgtgg

SEQ ID NO: 341678 - DNA, 29 bp, Artificial Sequence
  Description of Artificial Sequence: Synthetic oligonucleotide
cccaagtttgaggtgtagatcacccgtgg

SEQ ID NO: 341679 - DNA, 32 bp, Artificial Sequence
  Description of Artificial Sequence: Synthetic oligonucleotide
ccaagtttgaggtgtagatcacccgtggaaag

SEQ ID NO: 341680 - DNA, 32 bp, Artificial Sequence
  Description of Artificial Sequence: Synthetic oligonucleotide
caagtttgaggtgtagatcacccgtggaaagc

SEQ ID NO: 341681 - DNA, 32 bp, Artificial Sequence
  Description of Artificial Sequence: Synthetic oligonucleotide
aagtttgaggtgtagatcacccgtggaaagcc

SEQ ID NO: 341682 - DNA, 31 bp, Artificial Sequence
  Description of Artificial Sequence: Synthetic oligonucleotide
agtttgaggtgtagatcacccgtggaaagcc

SEQ ID NO: 341683 - DNA, 30 bp, Artificial Sequence
  Description of Artificial Sequence: Synthetic oligonucleotide
gtttgaggtgtagatcacccgtggaaagcc

SEQ ID NO: 341684 - DNA, 30 bp, Artificial Sequence
  Description of Artificial Sequence: Synthetic oligonucleotide
tttgaggtgtagatcacccgtggaaagccg

SEQ ID NO: 341685 - DNA, 29 bp, Artificial Sequence
  Description of Artificial Sequence: Synthetic oligonucleotide
ttgaggtgtagatcacccgtggaaagccg

SEQ ID NO: 341686 - DNA, 28 bp, Artificial Sequence
  Description of Artificial Sequence: Synthetic oligonucleotide
tgaggtgtagatcacccgtggaaagccg

SEQ ID NO: 341687 - DNA, 27 bp, Artificial Sequence
  Description of Artificial Sequence: Synthetic oligonucleotide
gaggtgtagatcacccgtggaaagccg

SEQ ID NO: 341688 - DNA, 29 bp, Artificial Sequence
  Description of Artificial Sequence: Synthetic oligonucleotide
aggtgtagatcacccgtggaaagccgtac

SEQ ID NO: 341689 - DNA, 28 bp, Artificial Sequence
  Description of Artificial Sequence: Synthetic oligonucleotide
ggtgtagatcacccgtggaaagccgtac

SEQ ID NO: 341690 - DNA, 30 bp, Artificial Sequence
  Description of Artificial Sequence: Synthetic oligonucleotide
gtgtagatcacccgtggaaagccgtacatc

SEQ ID NO: 341691 - DNA, 30 bp, Artificial Sequence
  Description of Artificial Sequence: Synthetic oligonucleotide
tgtagatcacccgtggaaagccgtacatcc

SEQ ID NO: 341692 - DNA, 29 bp, Artificial Sequence
  Description of Artificial Sequence: Synthetic oligonucleotide
gtagatcacccgtggaaagccgtacatcc

SEQ ID NO: 341693 - DNA, 30 bp, Artificial Sequence
  Description of Artificial Sequence: Synthetic oligonucleotide
tagatcacccgtggaaagccgtacatcctg

SEQ ID NO: 341694 - DNA, 29 bp, Artificial Sequence
  Description of Artificial Sequence: Synthetic oligonucleotide
agatcacccgtggaaagccgtacatcctg

SEQ ID NO: 341695 - DNA, 28 bp, Artificial Sequence
  Description of Artificial Sequence: Synthetic oligonucleotide
gatcacccgtggaaagccgtacatcctg

SEQ ID NO: 341696 - DNA, 29 bp, Artificial Sequence
  Description of Artificial Sequence: Synthetic oligonucleotide
atcacccgtggaaagccgtacatcctgtc

SEQ ID NO: 341697 - DNA, 28 bp, Artificial Sequence
  Description of Artificial Sequence: Synthetic oligonucleotide
tcacccgtggaaagccgtacatcctgtc

SEQ ID NO: 341698 - DNA, 27 bp, Artificial Sequence
  Description of Artificial Sequence: Synthetic oligonucleotide
cacccgtggaaagccgtacatcctgtc

SEQ ID NO: 341699 - DNA, 27 bp, Artificial Sequence
  Description of Artificial Sequence: Synthetic oligonucleotide
acccgtggaaagccgtacatcctgtcg

SEQ ID NO: 341700 - DNA, 26 bp, Artificial Sequence
  Description of Artificial Sequence: Synthetic oligonucleotide
cccgtggaaagccgtacatcctgtcg

SEQ ID NO: 341701 - DNA, 27 bp, Artificial Sequence
  Description of Artificial Sequence: Synthetic oligonucleotide
ccgtggaaagccgtacatcctgtcggt

SEQ ID NO: 341702 - DNA, 27 bp, Artificial Sequence
  Description of Artificial Sequence: Synthetic oligonucleotide
cgtggaaagccgtacatcctgtcggtg

SEQ ID NO: 341703 - DNA, 27 bp, Artificial Sequence
  Description of Artificial Sequence: Synthetic oligonucleotide
gtggaaagccgtacatcctgtcggtgc

SEQ ID NO: 341704 - DNA, 27 bp, Artificial Sequence
  Description of Artificial Sequence: Synthetic oligonucleotide
tggaaagccgtacatcctgtcggtgcc

SEQ ID NO: 341705 - DNA, 27 bp, Artificial Sequence
  Description of Artificial Sequence: Synthetic oligonucleotide
ggaaagccgtacatcctgtcggtgcca

SEQ ID NO: 341706 - DNA, 27 bp, Artificial Sequence
  Description of Artificial Sequence: Synthetic oligonucleotide
gaaagccgtacatcctgtcggtgccag

SEQ ID NO: 341707 - DNA, 27 bp, Artificial Sequence
  Description of Artificial Sequence: Synthetic oligonucleotide
aaagccgtacatcctgtcggtgccagc

SEQ ID NO: 341708 - DNA, 26 bp, Artificial Sequence
  Description of Artificial Sequence: Synthetic oligonucleotide
aagccgtacatcctgtcggtgccagc

SEQ ID NO: 341709 - DNA, 25 bp, Artificial Sequence
  Description of Artificial Sequence: Synthetic oligonucleotide
agccgtacatcctgtcggtgccagc

SEQ ID NO: 341710 - DNA, 24 bp, Artificial Sequence
  Description of Artificial Sequence: Synthetic oligonucleotide
gccgtacatcctgtcggtgccagc

SEQ ID NO: 341711 - DNA, 24 bp, Artificial Sequence
  Description of Artificial Sequence: Synthetic oligonucleotide
ccgtacatcctgtcggtgccagcc

SEQ ID NO: 341712 - DNA, 26 bp, Artificial Sequence
  Description of Artificial Sequence: Synthetic oligonucleotide
cgtacatcctgtcggtgccagcccat

SEQ ID NO: 341713 - DNA, 27 bp, Artificial Sequence
  Description of Artificial Sequence: Synthetic oligonucleotide
gtacatcctgtcggtgccagcccatct

SEQ ID NO: 341714 - DNA, 28 bp, Artificial Sequence
  Description of Artificial Sequence: Synthetic oligonucleotide
tacatcctgtcggtgccagcccatcttg

SEQ ID NO: 341715 - DNA, 27 bp, Artificial Sequence
  Description of Artificial Sequence: Synthetic oligonucleotide
acatcctgtcggtgccagcccatcttg

SEQ ID NO: 341716 - DNA, 27 bp, Artificial Sequence
  Description of Artificial Sequence: Synthetic oligonucleotide
catcctgtcggtgccagcccatcttga

SEQ ID NO: 341717 - DNA, 28 bp, Artificial Sequence
  Description of Artificial Sequence: Synthetic oligonucleotide
atcctgtcggtgccagcccatcttgaag

SEQ ID NO: 341718 - DNA, 27 bp, Artificial Sequence
  Description of Artificial Sequence: Synthetic oligonucleotide
tcctgtcggtgccagcccatcttgaag

SEQ ID NO: 341719 - DNA, 27 bp, Artificial Sequence
  Description of Artificial Sequence: Synthetic oligonucleotide
cctgtcggtgccagcccatcttgaaga

SEQ ID NO: 341720 - DNA, 30 bp, Artificial Sequence
  Description of Artificial Sequence: Synthetic oligonucleotide
ctgtcggtgccagcccatcttgaagaaatg

SEQ ID NO: 341721 - DNA, 30 bp, Artificial Sequence
  Description of Artificial Sequence: Synthetic oligonucleotide
tgtcggtgccagcccatcttgaagaaatgc

SEQ ID NO: 341722 - DNA, 29 bp, Artificial Sequence
  Description of Artificial Sequence: Synthetic oligonucleotide
gtcggtgccagcccatcttgaagaaatgc

SEQ ID NO: 341723 - DNA, 30 bp, Artificial Sequence
  Description of Artificial Sequence: Synthetic oligonucleotide
tcggtgccagcccatcttgaagaaatgcag

SEQ ID NO: 341724 - DNA, 29 bp, Artificial Sequence
  Description of Artificial Sequence: Synthetic oligonucleotide
cggtgccagcccatcttgaagaaatgcag

SEQ ID NO: 341725 - DNA, 32 bp, Artificial Sequence
  Description of Artificial Sequence: Synthetic oligonucleotide
ggtgccagcccatcttgaagaaatgcagatag

SEQ ID NO: 341726 - DNA, 33 bp, Artificial Sequence
  Description of Artificial Sequence: Synthetic oligonucleotide
gtgccagcccatcttgaagaaatgcagatagac

SEQ ID NO: 341727 - DNA, 35 bp, Artificial Sequence
  Description of Artificial Sequence: Synthetic oligonucleotide
tgccagcccatcttgaagaaatgcagatagacatc

SEQ ID NO: 341728 - DNA, 34 bp, Artificial Sequence
  Description of Artificial Sequence: Synthetic oligonucleotide
gccagcccatcttgaagaaatgcagatagacatc

SEQ ID NO: 341729 - DNA, 34 bp, Artificial Sequence
  Description of Artificial Sequence: Synthetic oligonucleotide
ccagcccatcttgaagaaatgcagatagacatcc

SEQ ID NO: 341730 - DNA, 35 bp, Artificial Sequence
  Description of Artificial Sequence: Synthetic oligonucleotide
cagcccatcttgaagaaatgcagatagacatcctg

SEQ ID NO: 341731 - DNA, 35 bp, Artificial Sequence
  Description of Artificial Sequence: Synthetic oligonucleotide
agcccatcttgaagaaatgcagatagacatcctgg

SEQ ID NO: 341732 - DNA, 34 bp, Artificial Sequence
  Description of Artificial Sequence: Synthetic oligonucleotide
gcccatcttgaagaaatgcagatagacatcctgg

SEQ ID NO: 341733 - DNA, 34 bp, Artificial Sequence
  Description of Artificial Sequence: Synthetic oligonucleotide
cccatcttgaagaaatgcagatagacatcctggc

SEQ ID NO: 341734 - DNA, 34 bp, Artificial Sequence
  Description of Artificial Sequence: Synthetic oligonucleotide
ccatcttgaagaaatgcagatagacatcctggcc

SEQ ID NO: 341735 - DNA, 35 bp, Artificial Sequence
  Description of Artificial Sequence: Synthetic oligonucleotide
catcttgaagaaatgcagatagacatcctggccag

SEQ ID NO: 341736 - DNA, 35 bp, Artificial Sequence
  Description of Artificial Sequence: Synthetic oligonucleotide
atcttgaagaaatgcagatagacatcctggccagg

SEQ ID NO: 341737 - DNA, 34 bp, Artificial Sequence
  Description of Artificial Sequence: Synthetic oligonucleotide
tcttgaagaaatgcagatagacatcctggccagg

SEQ ID NO: 341738 - DNA, 33 bp, Artificial Sequence
  Description of Artificial Sequence: Synthetic oligonucleotide
cttgaagaaatgcagatagacatcctggccagg

SEQ ID NO: 341739 - DNA, 35 bp, Artificial Sequence
  Description of Artificial Sequence: Synthetic oligonucleotide
ttgaagaaatgcagatagacatcctggccaggtag

SEQ ID NO: 341740 - DNA, 34 bp, Artificial Sequence
  Description of Artificial Sequence: Synthetic oligonucleotide
tgaagaaatgcagatagacatcctggccaggtag

SEQ ID NO: 341741 - DNA, 33 bp, Artificial Sequence
  Description of Artificial Sequence: Synthetic oligonucleotide
gaagaaatgcagatagacatcctggccaggtag

SEQ ID NO: 341742 - DNA, 35 bp, Artificial Sequence
  Description of Artificial Sequence: Synthetic oligonucleotide
aagaaatgcagatagacatcctggccaggtagatc

SEQ ID NO: 341743 - DNA, 34 bp, Artificial Sequence
  Description of Artificial Sequence: Synthetic oligonucleotide
agaaatgcagatagacatcctggccaggtagatc

SEQ ID NO: 341744 - DNA, 33 bp, Artificial Sequence
  Description of Artificial Sequence: Synthetic oligonucleotide
gaaatgcagatagacatcctggccaggtagatc

SEQ ID NO: 341745 - DNA, 36 bp, Artificial Sequence
  Description of Artificial Sequence: Synthetic oligonucleotide
aaatgcagatagacatcctggccaggtagatctatg

SEQ ID NO: 341746 - DNA, 35 bp, Artificial Sequence
  Description of Artificial Sequence: Synthetic oligonucleotide
aatgcagatagacatcctggccaggtagatctatg

SEQ ID NO: 341747 - DNA, 34 bp, Artificial Sequence
  Description of Artificial Sequence: Synthetic oligonucleotide
atgcagatagacatcctggccaggtagatctatg

SEQ ID NO: 341748 - DNA, 33 bp, Artificial Sequence
  Description of Artificial Sequence: Synthetic oligonucleotide
tgcagatagacatcctggccaggtagatctatg

SEQ ID NO: 341749 - DNA, 32 bp, Artificial Sequence
  Description of Artificial Sequence: Synthetic oligonucleotide
gcagatagacatcctggccaggtagatctatg

SEQ ID NO: 341750 - DNA, 32 bp, Artificial Sequence
  Description of Artificial Sequence: Synthetic oligonucleotide
cagatagacatcctggccaggtagatctatgg

SEQ ID NO: 341751 - DNA, 32 bp, Artificial Sequence
  Description of Artificial Sequence: Synthetic oligonucleotide
agatagacatcctggccaggtagatctatggg

SEQ ID NO: 341752 - DNA, 31 bp, Artificial Sequence
  Description of Artificial Sequence: Synthetic oligonucleotide
gatagacatcctggccaggtagatctatggg

SEQ ID NO: 341753 - DNA, 33 bp, Artificial Sequence
  Description of Artificial Sequence: Synthetic oligonucleotide
atagacatcctggccaggtagatctatgggtag

SEQ ID NO: 341754 - DNA, 32 bp, Artificial Sequence
  Description of Artificial Sequence: Synthetic oligonucleotide
tagacatcctggccaggtagatctatgggtag

SEQ ID NO: 341755 - DNA, 31 bp, Artificial Sequence
  Description of Artificial Sequence: Synthetic oligonucleotide
agacatcctggccaggtagatctatgggtag

SEQ ID NO: 341756 - DNA, 30 bp, Artificial Sequence
  Description of Artificial Sequence: Synthetic oligonucleotide
gacatcctggccaggtagatctatgggtag

SEQ ID NO: 341757 - DNA, 30 bp, Artificial Sequence
  Description of Artificial Sequence: Synthetic oligonucleotide
acatcctggccaggtagatctatgggtagc

SEQ ID NO: 341758 - DNA, 29 bp, Artificial Sequence
  Description of Artificial Sequence: Synthetic oligonucleotide
catcctggccaggtagatctatgggtagc

SEQ ID NO: 341759 - DNA, 29 bp, Artificial Sequence
  Description of Artificial Sequence: Synthetic oligonucleotide
atcctggccaggtagatctatgggtagcc

SEQ ID NO: 341760 - DNA, 28 bp, Artificial Sequence
  Description of Artificial Sequence: Synthetic oligonucleotide
tcctggccaggtagatctatgggtagcc

SEQ ID NO: 341761 - DNA, 27 bp, Artificial Sequence
  Description of Artificial Sequence: Synthetic oligonucleotide
cctggccaggtagatctatgggtagcc

SEQ ID NO: 341762 - DNA, 28 bp, Artificial Sequence
  Description of Artificial Sequence: Synthetic oligonucleotide
ctggccaggtagatctatgggtagccag

SEQ ID NO: 341763 - DNA, 29 bp, Artificial Sequence
  Description of Artificial Sequence: Synthetic oligonucleotide
tggccaggtagatctatgggtagccagtg

SEQ ID NO: 341764 - DNA, 28 bp, Artificial Sequence
  Description of Artificial Sequence: Synthetic oligonucleotide
ggccaggtagatctatgggtagccagtg

SEQ ID NO: 341765 - DNA, 28 bp, Artificial Sequence
  Description of Artificial Sequence: Synthetic oligonucleotide
gccaggtagatctatgggtagccagtgc

SEQ ID NO: 341766 - DNA, 29 bp, Artificial Sequence
  Description of Artificial Sequence: Synthetic oligonucleotide
ccaggtagatctatgggtagccagtgctg

SEQ ID NO: 341767 - DNA, 29 bp, Artificial Sequence
  Description of Artificial Sequence: Synthetic oligonucleotide
caggtagatctatgggtagccagtgctgg

SEQ ID NO: 341768 - DNA, 29 bp, Artificial Sequence
  Description of Artificial Sequence: Synthetic oligonucleotide
aggtagatctatgggtagccagtgctggg

SEQ ID NO: 341769 - DNA, 28 bp, Artificial Sequence
  Description of Artificial Sequence: Synthetic oligonucleotide
ggtagatctatgggtagccagtgctggg

SEQ ID NO: 341770 - DNA, 28 bp, Artificial Sequence
  Description of Artificial Sequence: Synthetic oligonucleotide
gtagatctatgggtagccagtgctgggg

SEQ ID NO: 341771 - DNA, 28 bp, Artificial Sequence
  Description of Artificial Sequence: Synthetic oligonucleotide
tagatctatgggtagccagtgctggggg

SEQ ID NO: 341772 - DNA, 27 bp, Artificial Sequence
  Description of Artificial Sequence: Synthetic oligonucleotide
agatctatgggtagccagtgctggggg

SEQ ID NO: 341773 - DNA, 27 bp, Artificial Sequence
  Description of Artificial Sequence: Synthetic oligonucleotide
gatctatgggtagccagtgctgggggt

SEQ ID NO: 341774 - DNA, 27 bp, Artificial Sequence
  Description of Artificial Sequence: Synthetic oligonucleotide
atctatgggtagccagtgctgggggtg

SEQ ID NO: 341775 - DNA, 26 bp, Artificial Sequence
  Description of Artificial Sequence: Synthetic oligonucleotide
tctatgggtagccagtgctgggggtg

SEQ ID NO: 341776 - DNA, 25 bp, Artificial Sequence
  Description of Artificial Sequence: Synthetic oligonucleotide
ctatgggtagccagtgctgggggtg

SEQ ID NO: 341777 - DNA, 25 bp, Artificial Sequence
  Description of Artificial Sequence: Synthetic oligonucleotide
tatgggtagccagtgctgggggtgg

SEQ ID NO: 341778 - DNA, 24 bp, Artificial Sequence
  Description of Artificial Sequence: Synthetic oligonucleotide
atgggtagccagtgctgggggtgg

SEQ ID NO: 341779 - DNA, 23 bp, Artificial Sequence
  Description of Artificial Sequence: Synthetic oligonucleotide
tgggtagccagtgctgggggtgg

SEQ ID NO: 341780 - DNA, 22 bp, Artificial Sequence
  Description of Artificial Sequence: Synthetic oligonucleotide
gggtagccagtgctgggggtgg

SEQ ID NO: 341781 - DNA, 26 bp, Artificial Sequence
  Description of Artificial Sequence: Synthetic oligonucleotide
ggtagccagtgctgggggtggcttat

SEQ ID NO: 341782 - DNA, 27 bp, Artificial Sequence
  Description of Artificial Sequence: Synthetic oligonucleotide
gtagccagtgctgggggtggcttatgt

SEQ ID NO: 341783 - DNA, 27 bp, Artificial Sequence
  Description of Artificial Sequence: Synthetic oligonucleotide
tagccagtgctgggggtggcttatgtg

SEQ ID NO: 341784 - DNA, 26 bp, Artificial Sequence
  Description of Artificial Sequence: Synthetic oligonucleotide
agccagtgctgggggtggcttatgtg

SEQ ID NO: 341785 - DNA, 25 bp, Artificial Sequence
  Description of Artificial Sequence: Synthetic oligonucleotide
gccagtgctgggggtggcttatgtg

SEQ ID NO: 341786 - DNA, 25 bp, Artificial Sequence
  Description of Artificial Sequence: Synthetic oligonucleotide
ccagtgctgggggtggcttatgtgc

SEQ ID NO: 341787 - DNA, 25 bp, Artificial Sequence
  Description of Artificial Sequence: Synthetic oligonucleotide
cagtgctgggggtggcttatgtgcg

SEQ ID NO: 341788 - DNA, 27 bp, Artificial Sequence
  Description of Artificial Sequence: Synthetic oligonucleotide
agtgctgggggtggcttatgtgcgcat

SEQ ID NO: 341789 - DNA, 27 bp, Artificial Sequence
  Description of Artificial Sequence: Synthetic oligonucleotide
gtgctgggggtggcttatgtgcgcatt

SEQ ID NO: 341790 - DNA, 27 bp, Artificial Sequence
  Description of Artificial Sequence: Synthetic oligonucleotide
tgctgggggtggcttatgtgcgcattg

SEQ ID NO: 341791 - DNA, 26 bp, Artificial Sequence
  Description of Artificial Sequence: Synthetic oligonucleotide
gctgggggtggcttatgtgcgcattg

SEQ ID NO: 341792 - DNA, 26 bp, Artificial Sequence
  Description of Artificial Sequence: Synthetic oligonucleotide
ctgggggtggcttatgtgcgcattgg

SEQ ID NO: 341793 - DNA, 26 bp, Artificial Sequence
  Description of Artificial Sequence: Synthetic oligonucleotide
tgggggtggcttatgtgcgcattggg

SEQ ID NO: 341794 - DNA, 25 bp, Artificial Sequence
  Description of Artificial Sequence: Synthetic oligonucleotide
gggggtggcttatgtgcgcattggg

SEQ ID NO: 341795 - DNA, 26 bp, Artificial Sequence
  Description of Artificial Sequence: Synthetic oligonucleotide
ggggtggcttatgtgcgcattgggct

SEQ ID NO: 341796 - DNA, 26 bp, Artificial Sequence
  Description of Artificial Sequence: Synthetic oligonucleotide
gggtggcttatgtgcgcattgggctc

SEQ ID NO: 341797 - DNA, 27 bp, Artificial Sequence
  Description of Artificial Sequence: Synthetic oligonucleotide
ggtggcttatgtgcgcattgggctcca

SEQ ID NO: 341798 - DNA, 28 bp, Artificial Sequence
  Description of Artificial Sequence: Synthetic oligonucleotide
gtggcttatgtgcgcattgggctccaag

SEQ ID NO: 341799 - DNA, 30 bp, Artificial Sequence
  Description of Artificial Sequence: Synthetic oligonucleotide
tggcttatgtgcgcattgggctccaagatg

SEQ ID NO: 341800 - DNA, 29 bp, Artificial Sequence
  Description of Artificial Sequence: Synthetic oligonucleotide
ggcttatgtgcgcattgggctccaagatg

SEQ ID NO: 341801 - DNA, 30 bp, Artificial Sequence
  Description of Artificial Sequence: Synthetic oligonucleotide
gcttatgtgcgcattgggctccaagatgag

SEQ ID NO: 341802 - DNA, 30 bp, Artificial Sequence
  Description of Artificial Sequence: Synthetic oligonucleotide
cttatgtgcgcattgggctccaagatgagg

SEQ ID NO: 341803 - DNA, 32 bp, Artificial Sequence
  Description of Artificial Sequence: Synthetic oligonucleotide
ttatgtgcgcattgggctccaagatgaggaag

SEQ ID NO: 341804 - DNA, 31 bp, Artificial Sequence
  Description of Artificial Sequence: Synthetic oligonucleotide
tatgtgcgcattgggctccaagatgaggaag

SEQ ID NO: 341805 - DNA, 30 bp, Artificial Sequence
  Description of Artificial Sequence: Synthetic oligonucleotide
atgtgcgcattgggctccaagatgaggaag

SEQ ID NO: 341806 - DNA, 29 bp, Artificial Sequence
  Description of Artificial Sequence: Synthetic oligonucleotide
tgtgcgcattgggctccaagatgaggaag

SEQ ID NO: 341807 - DNA, 28 bp, Artificial Sequence
  Description of Artificial Sequence: Synthetic oligonucleotide
gtgcgcattgggctccaagatgaggaag

SEQ ID NO: 341808 - DNA, 28 bp, Artificial Sequence
  Description of Artificial Sequence: Synthetic oligonucleotide
tgcgcattgggctccaagatgaggaagg

SEQ ID NO: 341809 - DNA, 27 bp, Artificial Sequence
  Description of Artificial Sequence: Synthetic oligonucleotide
gcgcattgggctccaagatgaggaagg

SEQ ID NO: 341810 - DNA, 30 bp, Artificial Sequence
  Description of Artificial Sequence: Synthetic oligonucleotide
cgcattgggctccaagatgaggaaggtaag

SEQ ID NO: 341811 - DNA, 32 bp, Artificial Sequence
  Description of Artificial Sequence: Synthetic oligonucleotide
gcattgggctccaagatgaggaaggtaagaag

SEQ ID NO: 341812 - DNA, 33 bp, Artificial Sequence
  Description of Artificial Sequence: Synthetic oligonucleotide
cattgggctccaagatgaggaaggtaagaagtc

SEQ ID NO: 341813 - DNA, 36 bp, Artificial Sequence
  Description of Artificial Sequence: Synthetic oligonucleotide
attgggctccaagatgaggaaggtaagaagtctttc

SEQ ID NO: 341814 - DNA, 35 bp, Artificial Sequence
  Description of Artificial Sequence: Synthetic oligonucleotide
ttgggctccaagatgaggaaggtaagaagtctttc

SEQ ID NO: 341815 - DNA, 34 bp, Artificial Sequence
  Description of Artificial Sequence: Synthetic oligonucleotide
tgggctccaagatgaggaaggtaagaagtctttc

SEQ ID NO: 341816 - DNA, 33 bp, Artificial Sequence
  Description of Artificial Sequence: Synthetic oligonucleotide
gggctccaagatgaggaaggtaagaagtctttc

SEQ ID NO: 341817 - DNA, 36 bp, Artificial Sequence
  Description of Artificial Sequence: Synthetic oligonucleotide
ggctccaagatgaggaaggtaagaagtctttctttc

SEQ ID NO: 341818 - DNA, 36 bp, Artificial Sequence
  Description of Artificial Sequence: Synthetic oligonucleotide
gctccaagatgaggaaggtaagaagtctttctttcc

SEQ ID NO: 341819 - DNA, 36 bp, Artificial Sequence
  Description of Artificial Sequence: Synthetic oligonucleotide
ctccaagatgaggaaggtaagaagtctttctttccg

SEQ ID NO: 341820 - DNA, 36 bp, Artificial Sequence
  Description of Artificial Sequence: Synthetic oligonucleotide
tccaagatgaggaaggtaagaagtctttctttccgg

SEQ ID NO: 341821 - DNA, 35 bp, Artificial Sequence
  Description of Artificial Sequence: Synthetic oligonucleotide
ccaagatgaggaaggtaagaagtctttctttccgg

SEQ ID NO: 341822 - DNA, 35 bp, Artificial Sequence
  Description of Artificial Sequence: Synthetic oligonucleotide
caagatgaggaaggtaagaagtctttctttccggg

SEQ ID NO: 341823 - DNA, 35 bp, Artificial Sequence
  Description of Artificial Sequence: Synthetic oligonucleotide
aagatgaggaaggtaagaagtctttctttccgggg

SEQ ID NO: 341824 - DNA, 34 bp, Artificial Sequence
  Description of Artificial Sequence: Synthetic oligonucleotide
agatgaggaaggtaagaagtctttctttccgggg

SEQ ID NO: 341825 - DNA, 33 bp, Artificial Sequence
  Description of Artificial Sequence: Synthetic oligonucleotide
gatgaggaaggtaagaagtctttctttccgggg

SEQ ID NO: 341826 - DNA, 33 bp, Artificial Sequence
  Description of Artificial Sequence: Synthetic oligonucleotide
atgaggaaggtaagaagtctttctttccggggc

SEQ ID NO: 341827 - DNA, 32 bp, Artificial Sequence
  Description of Artificial Sequence: Synthetic oligonucleotide
tgaggaaggtaagaagtctttctttccggggc

SEQ ID NO: 341828 - DNA, 31 bp, Artificial Sequence
  Description of Artificial Sequence: Synthetic oligonucleotide
gaggaaggtaagaagtctttctttccggggc

SEQ ID NO: 341829 - DNA, 32 bp, Artificial Sequence
  Description of Artificial Sequence: Synthetic oligonucleotide
aggaaggtaagaagtctttctttccggggctg

SEQ ID NO: 341830 - DNA, 31 bp, Artificial Sequence
  Description of Artificial Sequence: Synthetic oligonucleotide
ggaaggtaagaagtctttctttccggggctg

SEQ ID NO: 341831 - DNA, 31 bp, Artificial Sequence
  Description of Artificial Sequence: Synthetic oligonucleotide
gaaggtaagaagtctttctttccggggctgg

SEQ ID NO: 341832 - DNA, 32 bp, Artificial Sequence
  Description of Artificial Sequence: Synthetic oligonucleotide
aaggtaagaagtctttctttccggggctggac

SEQ ID NO: 341833 - DNA, 31 bp, Artificial Sequence
  Description of Artificial Sequence: Synthetic oligonucleotide
aggtaagaagtctttctttccggggctggac

SEQ ID NO: 341834 - DNA, 30 bp, Artificial Sequence
  Description of Artificial Sequence: Synthetic oligonucleotide
ggtaagaagtctttctttccggggctggac

SEQ ID NO: 341835 - DNA, 31 bp, Artificial Sequence
  Description of Artificial Sequence: Synthetic oligonucleotide
gtaagaagtctttctttccggggctggacag

SEQ ID NO: 341836 - DNA, 32 bp, Artificial Sequence
  Description of Artificial Sequence: Synthetic oligonucleotide
taagaagtctttctttccggggctggacagtc

SEQ ID NO: 341837 - DNA, 31 bp, Artificial Sequence
  Description of Artificial Sequence: Synthetic oligonucleotide
aagaagtctttctttccggggctggacagtc

SEQ ID NO: 341838 - DNA, 30 bp, Artificial Sequence
  Description of Artificial Sequence: Synthetic oligonucleotide
agaagtctttctttccggggctggacagtc

SEQ ID NO: 341839 - DNA, 29 bp, Artificial Sequence
  Description of Artificial Sequence: Synthetic oligonucleotide
gaagtctttctttccggggctggacagtc

SEQ ID NO: 341840 - DNA, 30 bp, Artificial Sequence
  Description of Artificial Sequence: Synthetic oligonucleotide
aagtctttctttccggggctggacagtcag

SEQ ID NO: 341841 - DNA, 29 bp, Artificial Sequence
  Description of Artificial Sequence: Synthetic oligonucleotide
agtctttctttccggggctggacagtcag

SEQ ID NO: 341842 - DNA, 28 bp, Artificial Sequence
  Description of Artificial Sequence: Synthetic oligonucleotide
gtctttctttccggggctggacagtcag

SEQ ID NO: 341843 - DNA, 29 bp, Artificial Sequence
  Description of Artificial Sequence: Synthetic oligonucleotide
tctttctttccggggctggacagtcagac

SEQ ID NO: 341844 - DNA, 28 bp, Artificial Sequence
  Description of Artificial Sequence: Synthetic oligonucleotide
ctttctttccggggctggacagtcagac

SEQ ID NO: 341845 - DNA, 28 bp, Artificial Sequence
  Description of Artificial Sequence: Synthetic oligonucleotide
tttctttccggggctggacagtcagacc

SEQ ID NO: 341846 - DNA, 27 bp, Artificial Sequence
  Description of Artificial Sequence: Synthetic oligonucleotide
ttctttccggggctggacagtcagacc

SEQ ID NO: 341847 - DNA, 27 bp, Artificial Sequence
  Description of Artificial Sequence: Synthetic oligonucleotide
tctttccggggctggacagtcagacct

SEQ ID NO: 341848 - DNA, 27 bp, Artificial Sequence
  Description of Artificial Sequence: Synthetic oligonucleotide
ctttccggggctggacagtcagaccta

SEQ ID NO: 341849 - DNA, 27 bp, Artificial Sequence
  Description of Artificial Sequence: Synthetic oligonucleotide
tttccggggctggacagtcagacctag

SEQ ID NO: 341850 - DNA, 26 bp, Artificial Sequence
  Description of Artificial Sequence: Synthetic oligonucleotide
ttccggggctggacagtcagacctag

SEQ ID NO: 341851 - DNA, 25 bp, Artificial Sequence
  Description of Artificial Sequence: Synthetic oligonucleotide
tccggggctggacagtcagacctag

SEQ ID NO: 341852 - DNA, 24 bp, Artificial Sequence
  Description of Artificial Sequence: Synthetic oligonucleotide
ccggggctggacagtcagacctag

SEQ ID NO: 341853 - DNA, 25 bp, Artificial Sequence
  Description of Artificial Sequence: Synthetic oligonucleotide
cggggctggacagtcagacctagct

SEQ ID NO: 341854 - DNA, 25 bp, Artificial Sequence
  Description of Artificial Sequence: Synthetic oligonucleotide
ggggctggacagtcagacctagctg

SEQ ID NO: 341855 - DNA, 26 bp, Artificial Sequence
  Description of Artificial Sequence: Synthetic oligonucleotide
gggctggacagtcagacctagctggt

SEQ ID NO: 341856 - DNA, 27 bp, Artificial Sequence
  Description of Artificial Sequence: Synthetic oligonucleotide
ggctggacagtcagacctagctggtga

SEQ ID NO: 341857 - DNA, 29 bp, Artificial Sequence
  Description of Artificial Sequence: Synthetic oligonucleotide
gctggacagtcagacctagctggtgattg

SEQ ID NO: 341858 - DNA, 29 bp, Artificial Sequence
  Description of Artificial Sequence: Synthetic oligonucleotide
ctggacagtcagacctagctggtgattgg

SEQ ID NO: 341859 - DNA, 30 bp, Artificial Sequence
  Description of Artificial Sequence: Synthetic oligonucleotide
tggacagtcagacctagctggtgattggac

SEQ ID NO: 341860 - DNA, 29 bp, Artificial Sequence
  Description of Artificial Sequence: Synthetic oligonucleotide
ggacagtcagacctagctggtgattggac

SEQ ID NO: 341861 - DNA, 30 bp, Artificial Sequence
  Description of Artificial Sequence: Synthetic oligonucleotide
gacagtcagacctagctggtgattggacag

SEQ ID NO: 341862 - DNA, 31 bp, Artificial Sequence
  Description of Artificial Sequence: Synthetic oligonucleotide
acagtcagacctagctggtgattggacagag

SEQ ID NO: 341863 - DNA, 30 bp, Artificial Sequence
  Description of Artificial Sequence: Synthetic oligonucleotide
cagtcagacctagctggtgattggacagag

SEQ ID NO: 341864 - DNA, 30 bp, Artificial Sequence
  Description of Artificial Sequence: Synthetic oligonucleotide
agtcagacctagctggtgattggacagagg

SEQ ID NO: 341865 - DNA, 29 bp, Artificial Sequence
  Description of Artificial Sequence: Synthetic oligonucleotide
gtcagacctagctggtgattggacagagg

SEQ ID NO: 341866 - DNA, 29 bp, Artificial Sequence
  Description of Artificial Sequence: Synthetic oligonucleotide
tcagacctagctggtgattggacagaggc

SEQ ID NO: 341867 - DNA, 28 bp, Artificial Sequence
  Description of Artificial Sequence: Synthetic oligonucleotide
cagacctagctggtgattggacagaggc

SEQ ID NO: 341868 - DNA, 29 bp, Artificial Sequence
  Description of Artificial Sequence: Synthetic oligonucleotide
agacctagctggtgattggacagaggcac

SEQ ID NO: 341869 - DNA, 28 bp, Artificial Sequence
  Description of Artificial Sequence: Synthetic oligonucleotide
gacctagctggtgattggacagaggcac

SEQ ID NO: 341870 - DNA, 32 bp, Artificial Sequence
  Description of Artificial Sequence: Synthetic oligonucleotide
acctagctggtgattggacagaggcacatttc

SEQ ID NO: 341871 - DNA, 31 bp, Artificial Sequence
  Description of Artificial Sequence: Synthetic oligonucleotide
cctagctggtgattggacagaggcacatttc

SEQ ID NO: 341872 - DNA, 31 bp, Artificial Sequence
  Description of Artificial Sequence: Synthetic oligonucleotide
ctagctggtgattggacagaggcacatttcc

SEQ ID NO: 341873 - DNA, 31 bp, Artificial Sequence
  Description of Artificial Sequence: Synthetic oligonucleotide
tagctggtgattggacagaggcacatttccg

SEQ ID NO: 341874 - DNA, 30 bp, Artificial Sequence
  Description of Artificial Sequence: Synthetic oligonucleotide
agctggtgattggacagaggcacatttccg

SEQ ID NO: 341875 - DNA, 29 bp, Artificial Sequence
  Description of Artificial Sequence: Synthetic oligonucleotide
gctggtgattggacagaggcacatttccg

SEQ ID NO: 341876 - DNA, 30 bp, Artificial Sequence
  Description of Artificial Sequence: Synthetic oligonucleotide
ctggtgattggacagaggcacatttccgtc

SEQ ID NO: 341877 - DNA, 31 bp, Artificial Sequence
  Description of Artificial Sequence: Synthetic oligonucleotide
tggtgattggacagaggcacatttccgtctc

SEQ ID NO: 341878 - DNA, 30 bp, Artificial Sequence
  Description of Artificial Sequence: Synthetic oligonucleotide
ggtgattggacagaggcacatttccgtctc

SEQ ID NO: 341879 - DNA, 33 bp, Artificial Sequence
  Description of Artificial Sequence: Synthetic oligonucleotide
gtgattggacagaggcacatttccgtctcaaag

SEQ ID NO: 341880 - DNA, 33 bp, Artificial Sequence
  Description of Artificial Sequence: Synthetic oligonucleotide
tgattggacagaggcacatttccgtctcaaagg

SEQ ID NO: 341881 - DNA, 32 bp, Artificial Sequence
  Description of Artificial Sequence: Synthetic oligonucleotide
gattggacagaggcacatttccgtctcaaagg

SEQ ID NO: 341882 - DNA, 32 bp, Artificial Sequence
  Description of Artificial Sequence: Synthetic oligonucleotide
attggacagaggcacatttccgtctcaaaggg

SEQ ID NO: 341883 - DNA, 31 bp, Artificial Sequence
  Description of Artificial Sequence: Synthetic oligonucleotide
ttggacagaggcacatttccgtctcaaaggg

SEQ ID NO: 341884 - DNA, 30 bp, Artificial Sequence
  Description of Artificial Sequence: Synthetic oligonucleotide
tggacagaggcacatttccgtctcaaaggg

SEQ ID NO: 341885 - DNA, 29 bp, Artificial Sequence
  Description of Artificial Sequence: Synthetic oligonucleotide
ggacagaggcacatttccgtctcaaaggg

SEQ ID NO: 341886 - DNA, 30 bp, Artificial Sequence
  Description of Artificial Sequence: Synthetic oligonucleotide
gacagaggcacatttccgtctcaaagggag

SEQ ID NO: 341887 - DNA, 31 bp, Artificial Sequence
  Description of Artificial Sequence: Synthetic oligonucleotide
acagaggcacatttccgtctcaaagggagag

SEQ ID NO: 341888 - DNA, 30 bp, Artificial Sequence
  Description of Artificial Sequence: Synthetic oligonucleotide
cagaggcacatttccgtctcaaagggagag

SEQ ID NO: 341889 - DNA, 32 bp, Artificial Sequence
  Description of Artificial Sequence: Synthetic oligonucleotide
agaggcacatttccgtctcaaagggagagttc

SEQ ID NO: 341890 - DNA, 31 bp, Artificial Sequence
  Description of Artificial Sequence: Synthetic oligonucleotide
gaggcacatttccgtctcaaagggagagttc

SEQ ID NO: 341891 - DNA, 31 bp, Artificial Sequence
  Description of Artificial Sequence: Synthetic oligonucleotide
aggcacatttccgtctcaaagggagagttcc

SEQ ID NO: 341892 - DNA, 30 bp, Artificial Sequence
  Description of Artificial Sequence: Synthetic oligonucleotide
ggcacatttccgtctcaaagggagagttcc

SEQ ID NO: 341893 - DNA, 31 bp, Artificial Sequence
  Description of Artificial Sequence: Synthetic oligonucleotide
gcacatttccgtctcaaagggagagttccac

SEQ ID NO: 341894 - DNA, 31 bp, Artificial Sequence
  Description of Artificial Sequence: Synthetic oligonucleotide
cacatttccgtctcaaagggagagttccacg

SEQ ID NO: 341895 - DNA, 32 bp, Artificial Sequence
  Description of Artificial Sequence: Synthetic oligonucleotide
acatttccgtctcaaagggagagttccacgac

SEQ ID NO: 341896 - DNA, 31 bp, Artificial Sequence
  Description of Artificial Sequence: Synthetic oligonucleotide
catttccgtctcaaagggagagttccacgac

SEQ ID NO: 341897 - DNA, 31 bp, Artificial Sequence
  Description of Artificial Sequence: Synthetic oligonucleotide
atttccgtctcaaagggagagttccacgacg

SEQ ID NO: 341898 - DNA, 30 bp, Artificial Sequence
  Description of Artificial Sequence: Synthetic oligonucleotide
tttccgtctcaaagggagagttccacgacg

SEQ ID NO: 341899 - DNA, 29 bp, Artificial Sequence
  Description of Artificial Sequence: Synthetic oligonucleotide
ttccgtctcaaagggagagttccacgacg

SEQ ID NO: 341900 - DNA, 28 bp, Artificial Sequence
  Description of Artificial Sequence: Synthetic oligonucleotide
tccgtctcaaagggagagttccacgacg

SEQ ID NO: 341901 - DNA, 27 bp, Artificial Sequence
  Description of Artificial Sequence: Synthetic oligonucleotide
ccgtctcaaagggagagttccacgacg

SEQ ID NO: 341902 - DNA, 27 bp, Artificial Sequence
  Description of Artificial Sequence: Synthetic oligonucleotide
cgtctcaaagggagagttccacgacgc

SEQ ID NO: 341903 - DNA, 27 bp, Artificial Sequence
  Description of Artificial Sequence: Synthetic oligonucleotide
gtctcaaagggagagttccacgacgcc

SEQ ID NO: 341904 - DNA, 27 bp, Artificial Sequence
  Description of Artificial Sequence: Synthetic oligonucleotide
tctcaaagggagagttccacgacgccc

SEQ ID NO: 341905 - DNA, 27 bp, Artificial Sequence
  Description of Artificial Sequence: Synthetic oligonucleotide
ctcaaagggagagttccacgacgccct

SEQ ID NO: 341906 - DNA, 27 bp, Artificial Sequence
  Description of Artificial Sequence: Synthetic oligonucleotide
tcaaagggagagttccacgacgccctg

SEQ ID NO: 341907 - DNA, 26 bp, Artificial Sequence
  Description of Artificial Sequence: Synthetic oligonucleotide
caaagggagagttccacgacgccctg

SEQ ID NO: 341908 - DNA, 27 bp, Artificial Sequence
  Description of Artificial Sequence: Synthetic oligonucleotide
aaagggagagttccacgacgccctgca

SEQ ID NO: 341909 - DNA, 26 bp, Artificial Sequence
  Description of Artificial Sequence: Synthetic oligonucleotide
aagggagagttccacgacgccctgca

SEQ ID NO: 341910 - DNA, 25 bp, Artificial Sequence
  Description of Artificial Sequence: Synthetic oligonucleotide
agggagagttccacgacgccctgca

SEQ ID NO: 341911 - DNA, 24 bp, Artificial Sequence
  Description of Artificial Sequence: Synthetic oligonucleotide
gggagagttccacgacgccctgca

SEQ ID NO: 341912 - DNA, 26 bp, Artificial Sequence
  Description of Artificial Sequence: Synthetic oligonucleotide
ggagagttccacgacgccctgcagaa

SEQ ID NO: 341913 - DNA, 26 bp, Artificial Sequence
  Description of Artificial Sequence: Synthetic oligonucleotide
gagagttccacgacgccctgcagaag

SEQ ID NO: 341914 - DNA, 27 bp, Artificial Sequence
  Description of Artificial Sequence: Synthetic oligonucleotide
agagttccacgacgccctgcagaagct

SEQ ID NO: 341915 - DNA, 26 bp, Artificial Sequence
  Description of Artificial Sequence: Synthetic oligonucleotide
gagttccacgacgccctgcagaagct

SEQ ID NO: 341916 - DNA, 27 bp, Artificial Sequence
  Description of Artificial Sequence: Synthetic oligonucleotide
agttccacgacgccctgcagaagctga

SEQ ID NO: 341917 - DNA, 27 bp, Artificial Sequence
  Description of Artificial Sequence: Synthetic oligonucleotide
gttccacgacgccctgcagaagctgat

SEQ ID NO: 341918 - DNA, 30 bp, Artificial Sequence
  Description of Artificial Sequence: Synthetic oligonucleotide
ttccacgacgccctgcagaagctgattatg

SEQ ID NO: 341919 - DNA, 29 bp, Artificial Sequence
  Description of Artificial Sequence: Synthetic oligonucleotide
tccacgacgccctgcagaagctgattatg

SEQ ID NO: 341920 - DNA, 28 bp, Artificial Sequence
  Description of Artificial Sequence: Synthetic oligonucleotide
ccacgacgccctgcagaagctgattatg

SEQ ID NO: 341921 - DNA, 28 bp, Artificial Sequence
  Description of Artificial Sequence: Synthetic oligonucleotide
cacgacgccctgcagaagctgattatgg

SEQ ID NO: 341922 - DNA, 28 bp, Artificial Sequence
  Description of Artificial Sequence: Synthetic oligonucleotide
acgacgccctgcagaagctgattatggg

SEQ ID NO: 341923 - DNA, 27 bp, Artificial Sequence
  Description of Artificial Sequence: Synthetic oligonucleotide
cgacgccctgcagaagctgattatggg

SEQ ID NO: 341924 - DNA, 27 bp, Artificial Sequence
  Description of Artificial Sequence: Synthetic oligonucleotide
gacgccctgcagaagctgattatgggc

SEQ ID NO: 341925 - DNA, 31 bp, Artificial Sequence
  Description of Artificial Sequence: Synthetic oligonucleotide
acgccctgcagaagctgattatgggcataac

SEQ ID NO: 341926 - DNA, 30 bp, Artificial Sequence
  Description of Artificial Sequence: Synthetic oligonucleotide
cgccctgcagaagctgattatgggcataac

SEQ ID NO: 341927 - DNA, 31 bp, Artificial Sequence
  Description of Artificial Sequence: Synthetic oligonucleotide
gccctgcagaagctgattatgggcataactg

SEQ ID NO: 341928 - DNA, 32 bp, Artificial Sequence
  Description of Artificial Sequence: Synthetic oligonucleotide
ccctgcagaagctgattatgggcataactgac

SEQ ID NO: 341929 - DNA, 32 bp, Artificial Sequence
  Description of Artificial Sequence: Synthetic oligonucleotide
cctgcagaagctgattatgggcataactgacc

SEQ ID NO: 341930 - DNA, 33 bp, Artificial Sequence
  Description of Artificial Sequence: Synthetic oligonucleotide
ctgcagaagctgattatgggcataactgacctc

SEQ ID NO: 341931 - DNA, 33 bp, Artificial Sequence
  Description of Artificial Sequence: Synthetic oligonucleotide
tgcagaagctgattatgggcataactgacctcg

SEQ ID NO: 341932 - DNA, 32 bp, Artificial Sequence
  Description of Artificial Sequence: Synthetic oligonucleotide
gcagaagctgattatgggcataactgacctcg

SEQ ID NO: 341933 - DNA, 33 bp, Artificial Sequence
  Description of Artificial Sequence: Synthetic oligonucleotide
cagaagctgattatgggcataactgacctcgag

SEQ ID NO: 341934 - DNA, 33 bp, Artificial Sequence
  Description of Artificial Sequence: Synthetic oligonucleotide
agaagctgattatgggcataactgacctcgagg

SEQ ID NO: 341935 - DNA, 32 bp, Artificial Sequence
  Description of Artificial Sequence: Synthetic oligonucleotide
gaagctgattatgggcataactgacctcgagg

SEQ ID NO: 341936 - DNA, 32 bp, Artificial Sequence
  Description of Artificial Sequence: Synthetic oligonucleotide
aagctgattatgggcataactgacctcgaggg

SEQ ID NO: 341937 - DNA, 31 bp, Artificial Sequence
  Description of Artificial Sequence: Synthetic oligonucleotide
agctgattatgggcataactgacctcgaggg

SEQ ID NO: 341938 - DNA, 30 bp, Artificial Sequence
  Description of Artificial Sequence: Synthetic oligonucleotide
gctgattatgggcataactgacctcgaggg

SEQ ID NO: 341939 - DNA, 30 bp, Artificial Sequence
  Description of Artificial Sequence: Synthetic oligonucleotide
ctgattatgggcataactgacctcgagggg

SEQ ID NO: 341940 - DNA, 30 bp, Artificial Sequence
  Description of Artificial Sequence: Synthetic oligonucleotide
tgattatgggcataactgacctcgaggggc

SEQ ID NO: 341941 - DNA, 29 bp, Artificial Sequence
  Description of Artificial Sequence: Synthetic oligonucleotide
gattatgggcataactgacctcgaggggc

SEQ ID NO: 341942 - DNA, 30 bp, Artificial Sequence
  Description of Artificial Sequence: Synthetic oligonucleotide
attatgggcataactgacctcgaggggctg

SEQ ID NO: 341943 - DNA, 29 bp, Artificial Sequence
  Description of Artificial Sequence: Synthetic oligonucleotide
ttatgggcataactgacctcgaggggctg

SEQ ID NO: 341944 - DNA, 28 bp, Artificial Sequence
  Description of Artificial Sequence: Synthetic oligonucleotide
tatgggcataactgacctcgaggggctg

SEQ ID NO: 341945 - DNA, 27 bp, Artificial Sequence
  Description of Artificial Sequence: Synthetic oligonucleotide
atgggcataactgacctcgaggggctg

SEQ ID NO: 341946 - DNA, 26 bp, Artificial Sequence
  Description of Artificial Sequence: Synthetic oligonucleotide
tgggcataactgacctcgaggggctg

SEQ ID NO: 341947 - DNA, 25 bp, Artificial Sequence
  Description of Artificial Sequence: Synthetic oligonucleotide
gggcataactgacctcgaggggctg

SEQ ID NO: 341948 - DNA, 25 bp, Artificial Sequence
  Description of Artificial Sequence: Synthetic oligonucleotide
ggcataactgacctcgaggggctgc

SEQ ID NO: 341949 - DNA, 25 bp, Artificial Sequence
  Description of Artificial Sequence: Synthetic oligonucleotide
gcataactgacctcgaggggctgcc

SEQ ID NO: 341950 - DNA, 25 bp, Artificial Sequence
  Description of Artificial Sequence: Synthetic oligonucleotide
cataactgacctcgaggggctgccc

SEQ ID NO: 341951 - DNA, 26 bp, Artificial Sequence
  Description of Artificial Sequence: Synthetic oligonucleotide
ataactgacctcgaggggctgcccct

SEQ ID NO: 341952 - DNA, 25 bp, Artificial Sequence
  Description of Artificial Sequence: Synthetic oligonucleotide
taactgacctcgaggggctgcccct

SEQ ID NO: 341953 - DNA, 24 bp, Artificial Sequence
  Description of Artificial Sequence: Synthetic oligonucleotide
aactgacctcgaggggctgcccct

SEQ ID NO: 341954 - DNA, 23 bp, Artificial Sequence
  Description of Artificial Sequence: Synthetic oligonucleotide
actgacctcgaggggctgcccct

SEQ ID NO: 341955 - DNA, 22 bp, Artificial Sequence
  Description of Artificial Sequence: Synthetic oligonucleotide
ctgacctcgaggggctgcccct

SEQ ID NO: 341956 - DNA, 24 bp, Artificial Sequence
  Description of Artificial Sequence: Synthetic oligonucleotide
tgacctcgaggggctgcccctcta

SEQ ID NO: 341957 - DNA, 23 bp, Artificial Sequence
  Description of Artificial Sequence: Synthetic oligonucleotide
gacctcgaggggctgcccctcta

SEQ ID NO: 341958 - DNA, 23 bp, Artificial Sequence
  Description of Artificial Sequence: Synthetic oligonucleotide
acctcgaggggctgcccctctac

SEQ ID NO: 341959 - DNA, 22 bp, Artificial Sequence
  Description of Artificial Sequence: Synthetic oligonucleotide
cctcgaggggctgcccctctac

SEQ ID NO: 341960 - DNA, 24 bp, Artificial Sequence
  Description of Artificial Sequence: Synthetic oligonucleotide
ctcgaggggctgcccctctacgta

SEQ ID NO: 341961 - DNA, 24 bp, Artificial Sequence
  Description of Artificial Sequence: Synthetic oligonucleotide
tcgaggggctgcccctctacgtag

SEQ ID NO: 341962 - DNA, 23 bp, Artificial Sequence
  Description of Artificial Sequence: Synthetic oligonucleotide
cgaggggctgcccctctacgtag

SEQ ID NO: 341963 - DNA, 24 bp, Artificial Sequence
  Description of Artificial Sequence: Synthetic oligonucleotide
gaggggctgcccctctacgtagct

SEQ ID NO: 341964 - DNA, 24 bp, Artificial Sequence
  Description of Artificial Sequence: Synthetic oligonucleotide
aggggctgcccctctacgtagctg

SEQ ID NO: 341965 - DNA, 23 bp, Artificial Sequence
  Description of Artificial Sequence: Synthetic oligonucleotide
ggggctgcccctctacgtagctg

SEQ ID NO: 341966 - DNA, 24 bp, Artificial Sequence
  Description of Artificial Sequence: Synthetic oligonucleotide
gggctgcccctctacgtagctgca

SEQ ID NO: 341967 - DNA, 24 bp, Artificial Sequence
  Description of Artificial Sequence: Synthetic oligonucleotide
ggctgcccctctacgtagctgcag

SEQ ID NO: 341968 - DNA, 24 bp, Artificial Sequence
  Description of Artificial Sequence: Synthetic oligonucleotide
gctgcccctctacgtagctgcagc

SEQ ID NO: 341969 - DNA, 26 bp, Artificial Sequence
  Description of Artificial Sequence: Synthetic oligonucleotide
ctgcccctctacgtagctgcagcctt

SEQ ID NO: 341970 - DNA, 27 bp, Artificial Sequence
  Description of Artificial Sequence: Synthetic oligonucleotide
tgcccctctacgtagctgcagccttca

SEQ ID NO: 341971 - DNA, 27 bp, Artificial Sequence
  Description of Artificial Sequence: Synthetic oligonucleotide
gcccctctacgtagctgcagccttcat

SEQ ID NO: 341972 - DNA, 28 bp, Artificial Sequence
  Description of Artificial Sequence: Synthetic oligonucleotide
cccctctacgtagctgcagccttcattg

SEQ ID NO: 341973 - DNA, 29 bp, Artificial Sequence
  Description of Artificial Sequence: Synthetic oligonucleotide
ccctctacgtagctgcagccttcattgag

SEQ ID NO: 341974 - DNA, 30 bp, Artificial Sequence
  Description of Artificial Sequence: Synthetic oligonucleotide
cctctacgtagctgcagccttcattgagtg

SEQ ID NO: 341975 - DNA, 31 bp, Artificial Sequence
  Description of Artificial Sequence: Synthetic oligonucleotide
ctctacgtagctgcagccttcattgagtgtc

SEQ ID NO: 341976 - DNA, 31 bp, Artificial Sequence
  Description of Artificial Sequence: Synthetic oligonucleotide
tctacgtagctgcagccttcattgagtgtcc

SEQ ID NO: 341977 - DNA, 30 bp, Artificial Sequence
  Description of Artificial Sequence: Synthetic oligonucleotide
ctacgtagctgcagccttcattgagtgtcc

SEQ ID NO: 341978 - DNA, 31 bp, Artificial Sequence
  Description of Artificial Sequence: Synthetic oligonucleotide
tacgtagctgcagccttcattgagtgtccag

SEQ ID NO: 341979 - DNA, 30 bp, Artificial Sequence
  Description of Artificial Sequence: Synthetic oligonucleotide
acgtagctgcagccttcattgagtgtccag

SEQ ID NO: 341980 - DNA, 29 bp, Artificial Sequence
  Description of Artificial Sequence: Synthetic oligonucleotide
cgtagctgcagccttcattgagtgtccag

SEQ ID NO: 341981 - DNA, 29 bp, Artificial Sequence
  Description of Artificial Sequence: Synthetic oligonucleotide
gtagctgcagccttcattgagtgtccagg

SEQ ID NO: 341982 - DNA, 30 bp, Artificial Sequence
  Description of Artificial Sequence: Synthetic oligonucleotide
tagctgcagccttcattgagtgtccaggtg

SEQ ID NO: 341983 - DNA, 29 bp, Artificial Sequence
  Description of Artificial Sequence: Synthetic oligonucleotide
agctgcagccttcattgagtgtccaggtg

SEQ ID NO: 341984 - DNA, 28 bp, Artificial Sequence
  Description of Artificial Sequence: Synthetic oligonucleotide
gctgcagccttcattgagtgtccaggtg

SEQ ID NO: 341985 - DNA, 28 bp, Artificial Sequence
  Description of Artificial Sequence: Synthetic oligonucleotide
ctgcagccttcattgagtgtccaggtgg

SEQ ID NO: 341986 - DNA, 28 bp, Artificial Sequence
  Description of Artificial Sequence: Synthetic oligonucleotide
tgcagccttcattgagtgtccaggtggc

SEQ ID NO: 341987 - DNA, 27 bp, Artificial Sequence
  Description of Artificial Sequence: Synthetic oligonucleotide
gcagccttcattgagtgtccaggtggc

SEQ ID NO: 341988 - DNA, 27 bp, Artificial Sequence
  Description of Artificial Sequence: Synthetic oligonucleotide
cagccttcattgagtgtccaggtggcg

SEQ ID NO: 341989 - DNA, 28 bp, Artificial Sequence
  Description of Artificial Sequence: Synthetic oligonucleotide
agccttcattgagtgtccaggtggcgag

SEQ ID NO: 341990 - DNA, 27 bp, Artificial Sequence
  Description of Artificial Sequence: Synthetic oligonucleotide
gccttcattgagtgtccaggtggcgag

SEQ ID NO: 341991 - DNA, 29 bp, Artificial Sequence
  Description of Artificial Sequence: Synthetic oligonucleotide
ccttcattgagtgtccaggtggcgagatg

SEQ ID NO: 341992 - DNA, 29 bp, Artificial Sequence
  Description of Artificial Sequence: Synthetic oligonucleotide
cttcattgagtgtccaggtggcgagatgg

SEQ ID NO: 341993 - DNA, 30 bp, Artificial Sequence
  Description of Artificial Sequence: Synthetic oligonucleotide
ttcattgagtgtccaggtggcgagatggag

SEQ ID NO: 341994 - DNA, 29 bp, Artificial Sequence
  Description of Artificial Sequence: Synthetic oligonucleotide
tcattgagtgtccaggtggcgagatggag

SEQ ID NO: 341995 - DNA, 28 bp, Artificial Sequence
  Description of Artificial Sequence: Synthetic oligonucleotide
cattgagtgtccaggtggcgagatggag

SEQ ID NO: 341996 - DNA, 28 bp, Artificial Sequence
  Description of Artificial Sequence: Synthetic oligonucleotide
attgagtgtccaggtggcgagatggagc

SEQ ID NO: 341997 - DNA, 27 bp, Artificial Sequence
  Description of Artificial Sequence: Synthetic oligonucleotide
ttgagtgtccaggtggcgagatggagc

SEQ ID NO: 341998 - DNA, 27 bp, Artificial Sequence
  Description of Artificial Sequence: Synthetic oligonucleotide
tgagtgtccaggtggcgagatggagca

SEQ ID NO: 341999 - DNA, 26 bp, Artificial Sequence
  Description of Artificial Sequence: Synthetic oligonucleotide
gagtgtccaggtggcgagatggagca

SEQ ID NO: 342000 - DNA, 26 bp, Artificial Sequence
  Description of Artificial Sequence: Synthetic oligonucleotide
agtgtccaggtggcgagatggagcag

SEQ ID NO: 342001 - DNA, 25 bp, Artificial Sequence
  Description of Artificial Sequence: Synthetic oligonucleotide
gtgtccaggtggcgagatggagcag

SEQ ID NO: 342002 - DNA, 25 bp, Artificial Sequence
  Description of Artificial Sequence: Synthetic oligonucleotide
tgtccaggtggcgagatggagcagg

SEQ ID NO: 342003 - DNA, 24 bp, Artificial Sequence
  Description of Artificial Sequence: Synthetic oligonucleotide
gtccaggtggcgagatggagcagg

SEQ ID NO: 342004 - DNA, 25 bp, Artificial Sequence
  Description of Artificial Sequence: Synthetic oligonucleotide
tccaggtggcgagatggagcaggca

SEQ ID NO: 342005 - DNA, 24 bp, Artificial Sequence
  Description of Artificial Sequence: Synthetic oligonucleotide
ccaggtggcgagatggagcaggca

SEQ ID NO: 342006 - DNA, 25 bp, Artificial Sequence
  Description of Artificial Sequence: Synthetic oligonucleotide
caggtggcgagatggagcaggcaga

SEQ ID NO: 342007 - DNA, 25 bp, Artificial Sequence
  Description of Artificial Sequence: Synthetic oligonucleotide
aggtggcgagatggagcaggcagag

SEQ ID NO: 342008 - DNA, 24 bp, Artificial Sequence
  Description of Artificial Sequence: Synthetic oligonucleotide
ggtggcgagatggagcaggcagag

SEQ ID NO: 342009 - DNA, 25 bp, Artificial Sequence
  Description of Artificial Sequence: Synthetic oligonucleotide
gtggcgagatggagcaggcagagca

SEQ ID NO: 342010 - DNA, 26 bp, Artificial Sequence
  Description of Artificial Sequence: Synthetic oligonucleotide
tggcgagatggagcaggcagagcaca

SEQ ID NO: 342011 - DNA, 25 bp, Artificial Sequence
  Description of Artificial Sequence: Synthetic oligonucleotide
ggcgagatggagcaggcagagcaca

SEQ ID NO: 342012 - DNA, 27 bp, Artificial Sequence
  Description of Artificial Sequence: Synthetic oligonucleotide
gcgagatggagcaggcagagcacacat

SEQ ID NO: 342013 - DNA, 27 bp, Artificial Sequence
  Description of Artificial Sequence: Synthetic oligonucleotide
cgagatggagcaggcagagcacacatc

SEQ ID NO: 342014 - DNA, 27 bp, Artificial Sequence
  Description of Artificial Sequence: Synthetic oligonucleotide
gagatggagcaggcagagcacacatcc

SEQ ID NO: 342015 - DNA, 28 bp, Artificial Sequence
  Description of Artificial Sequence: Synthetic oligonucleotide
agatggagcaggcagagcacacatcctg

SEQ ID NO: 342016 - DNA, 27 bp, Artificial Sequence
  Description of Artificial Sequence: Synthetic oligonucleotide
gatggagcaggcagagcacacatcctg

SEQ ID NO: 342017 - DNA, 27 bp, Artificial Sequence
  Description of Artificial Sequence: Synthetic oligonucleotide
atggagcaggcagagcacacatcctgc

SEQ ID NO: 342018 - DNA, 27 bp, Artificial Sequence
  Description of Artificial Sequence: Synthetic oligonucleotide
tggagcaggcagagcacacatcctgct

SEQ ID NO: 342019 - DNA, 27 bp, Artificial Sequence
  Description of Artificial Sequence: Synthetic oligonucleotide
ggagcaggcagagcacacatcctgcta

SEQ ID NO: 342020 - DNA, 31 bp, Artificial Sequence
  Description of Artificial Sequence: Synthetic oligonucleotide
gagcaggcagagcacacatcctgctattttg

SEQ ID NO: 342021 - DNA, 32 bp, Artificial Sequence
  Description of Artificial Sequence: Synthetic oligonucleotide
agcaggcagagcacacatcctgctattttgtg

SEQ ID NO: 342022 - DNA, 31 bp, Artificial Sequence
  Description of Artificial Sequence: Synthetic oligonucleotide
gcaggcagagcacacatcctgctattttgtg

SEQ ID NO: 342023 - DNA, 32 bp, Artificial Sequence
  Description of Artificial Sequence: Synthetic oligonucleotide
caggcagagcacacatcctgctattttgtgac

SEQ ID NO: 342024 - DNA, 34 bp, Artificial Sequence
  Description of Artificial Sequence: Synthetic oligonucleotide
aggcagagcacacatcctgctattttgtgacatc

SEQ ID NO: 342025 - DNA, 33 bp, Artificial Sequence
  Description of Artificial Sequence: Synthetic oligonucleotide
ggcagagcacacatcctgctattttgtgacatc

SEQ ID NO: 342026 - DNA, 34 bp, Artificial Sequence
  Description of Artificial Sequence: Synthetic oligonucleotide
gcagagcacacatcctgctattttgtgacatctc

SEQ ID NO: 342027 - DNA, 34 bp, Artificial Sequence
  Description of Artificial Sequence: Synthetic oligonucleotide
cagagcacacatcctgctattttgtgacatctcc

SEQ ID NO: 342028 - DNA, 34 bp, Artificial Sequence
  Description of Artificial Sequence: Synthetic oligonucleotide
agagcacacatcctgctattttgtgacatctccc

SEQ ID NO: 342029 - DNA, 33 bp, Artificial Sequence
  Description of Artificial Sequence: Synthetic oligonucleotide
gagcacacatcctgctattttgtgacatctccc

SEQ ID NO: 342030 - DNA, 35 bp, Artificial Sequence
  Description of Artificial Sequence: Synthetic oligonucleotide
agcacacatcctgctattttgtgacatctccctac

SEQ ID NO: 342031 - DNA, 34 bp, Artificial Sequence
  Description of Artificial Sequence: Synthetic oligonucleotide
gcacacatcctgctattttgtgacatctccctac

SEQ ID NO: 342032 - DNA, 35 bp, Artificial Sequence
  Description of Artificial Sequence: Synthetic oligonucleotide
cacacatcctgctattttgtgacatctccctactc

SEQ ID NO: 342033 - DNA, 35 bp, Artificial Sequence
  Description of Artificial Sequence: Synthetic oligonucleotide
acacatcctgctattttgtgacatctccctactcc

SEQ ID NO: 342034 - DNA, 34 bp, Artificial Sequence
  Description of Artificial Sequence: Synthetic oligonucleotide
cacatcctgctattttgtgacatctccctactcc

SEQ ID NO: 342035 - DNA, 36 bp, Artificial Sequence
  Description of Artificial Sequence: Synthetic oligonucleotide
acatcctgctattttgtgacatctccctactccttg

SEQ ID NO: 342036 - DNA, 35 bp, Artificial Sequence
  Description of Artificial Sequence: Synthetic oligonucleotide
catcctgctattttgtgacatctccctactccttg

SEQ ID NO: 342037 - DNA, 35 bp, Artificial Sequence
  Description of Artificial Sequence: Synthetic oligonucleotide
atcctgctattttgtgacatctccctactccttgg

SEQ ID NO: 342038 - DNA, 34 bp, Artificial Sequence
  Description of Artificial Sequence: Synthetic oligonucleotide
tcctgctattttgtgacatctccctactccttgg

SEQ ID NO: 342039 - DNA, 33 bp, Artificial Sequence
  Description of Artificial Sequence: Synthetic oligonucleotide
cctgctattttgtgacatctccctactccttgg

SEQ ID NO: 342040 - DNA, 35 bp, Artificial Sequence
  Description of Artificial Sequence: Synthetic oligonucleotide
ctgctattttgtgacatctccctactccttggaac

SEQ ID NO: 342041 - DNA, 38 bp, Artificial Sequence
  Description of Artificial Sequence: Synthetic oligonucleotide
tgctattttgtgacatctccctactccttggaacttag

SEQ ID NO: 342042 - DNA, 37 bp, Artificial Sequence
  Description of Artificial Sequence: Synthetic oligonucleotide
gctattttgtgacatctccctactccttggaacttag

SEQ ID NO: 342043 - DNA, 37 bp, Artificial Sequence
  Description of Artificial Sequence: Synthetic oligonucleotide
ctattttgtgacatctccctactccttggaacttagc

SEQ ID NO: 342044 - DNA, 39 bp, Artificial Sequence
  Description of Artificial Sequence: Synthetic oligonucleotide
tattttgtgacatctccctactccttggaacttagcaag

SEQ ID NO: 342045 - DNA, 38 bp, Artificial Sequence
  Description of Artificial Sequence: Synthetic oligonucleotide
attttgtgacatctccctactccttggaacttagcaag

SEQ ID NO: 342046 - DNA, 37 bp, Artificial Sequence
  Description of Artificial Sequence: Synthetic oligonucleotide
ttttgtgacatctccctactccttggaacttagcaag

SEQ ID NO: 342047 - DNA, 36 bp, Artificial Sequence
  Description of Artificial Sequence: Synthetic oligonucleotide
tttgtgacatctccctactccttggaacttagcaag

SEQ ID NO: 342048 - DNA, 35 bp, Artificial Sequence
  Description of Artificial Sequence: Synthetic oligonucleotide
ttgtgacatctccctactccttggaacttagcaag

SEQ ID NO: 342049 - DNA, 34 bp, Artificial Sequence
  Description of Artificial Sequence: Synthetic oligonucleotide
tgtgacatctccctactccttggaacttagcaag

SEQ ID NO: 342050 - DNA, 33 bp, Artificial Sequence
  Description of Artificial Sequence: Synthetic oligonucleotide
gtgacatctccctactccttggaacttagcaag

SEQ ID NO: 342051 - DNA, 34 bp, Artificial Sequence
  Description of Artificial Sequence: Synthetic oligonucleotide
tgacatctccctactccttggaacttagcaagtc

SEQ ID NO: 342052 - DNA, 33 bp, Artificial Sequence
  Description of Artificial Sequence: Synthetic oligonucleotide
gacatctccctactccttggaacttagcaagtc

SEQ ID NO: 342053 - DNA, 33 bp, Artificial Sequence
  Description of Artificial Sequence: Synthetic oligonucleotide
acatctccctactccttggaacttagcaagtcc

SEQ ID NO: 342054 - DNA, 32 bp, Artificial Sequence
  Description of Artificial Sequence: Synthetic oligonucleotide
catctccctactccttggaacttagcaagtcc

SEQ ID NO: 342055 - DNA, 34 bp, Artificial Sequence
  Description of Artificial Sequence: Synthetic oligonucleotide
atctccctactccttggaacttagcaagtccaag

SEQ ID NO: 342056 - DNA, 33 bp, Artificial Sequence
  Description of Artificial Sequence: Synthetic oligonucleotide
tctccctactccttggaacttagcaagtccaag

SEQ ID NO: 342057 - DNA, 32 bp, Artificial Sequence
  Description of Artificial Sequence: Synthetic oligonucleotide
ctccctactccttggaacttagcaagtccaag

SEQ ID NO: 342058 - DNA, 32 bp, Artificial Sequence
  Description of Artificial Sequence: Synthetic oligonucleotide
tccctactccttggaacttagcaagtccaagc

SEQ ID NO: 342059 - DNA, 31 bp, Artificial Sequence
  Description of Artificial Sequence: Synthetic oligonucleotide
ccctactccttggaacttagcaagtccaagc

SEQ ID NO: 342060 - DNA, 31 bp, Artificial Sequence
  Description of Artificial Sequence: Synthetic oligonucleotide
cctactccttggaacttagcaagtccaagcg

SEQ ID NO: 342061 - DNA, 32 bp, Artificial Sequence
  Description of Artificial Sequence: Synthetic oligonucleotide
ctactccttggaacttagcaagtccaagcgac

SEQ ID NO: 342062 - DNA, 33 bp, Artificial Sequence
  Description of Artificial Sequence: Synthetic oligonucleotide
tactccttggaacttagcaagtccaagcgactc

SEQ ID NO: 342063 - DNA, 32 bp, Artificial Sequence
  Description of Artificial Sequence: Synthetic oligonucleotide
actccttggaacttagcaagtccaagcgactc

SEQ ID NO: 342064 - DNA, 31 bp, Artificial Sequence
  Description of Artificial Sequence: Synthetic oligonucleotide
ctccttggaacttagcaagtccaagcgactc

SEQ ID NO: 342065 - DNA, 31 bp, Artificial Sequence
  Description of Artificial Sequence: Synthetic oligonucleotide
tccttggaacttagcaagtccaagcgactcc

SEQ ID NO: 342066 - DNA, 30 bp, Artificial Sequence
  Description of Artificial Sequence: Synthetic oligonucleotide
ccttggaacttagcaagtccaagcgactcc

SEQ ID NO: 342067 - DNA, 32 bp, Artificial Sequence
  Description of Artificial Sequence: Synthetic oligonucleotide
cttggaacttagcaagtccaagcgactccttg

SEQ ID NO: 342068 - DNA, 33 bp, Artificial Sequence
  Description of Artificial Sequence: Synthetic oligonucleotide
ttggaacttagcaagtccaagcgactccttgtg

SEQ ID NO: 342069 - DNA, 32 bp, Artificial Sequence
  Description of Artificial Sequence: Synthetic oligonucleotide
tggaacttagcaagtccaagcgactccttgtg

SEQ ID NO: 342070 - DNA, 31 bp, Artificial Sequence
  Description of Artificial Sequence: Synthetic oligonucleotide
ggaacttagcaagtccaagcgactccttgtg

SEQ ID NO: 342071 - DNA, 31 bp, Artificial Sequence
  Description of Artificial Sequence: Synthetic oligonucleotide
gaacttagcaagtccaagcgactccttgtgc

SEQ ID NO: 342072 - DNA, 31 bp, Artificial Sequence
  Description of Artificial Sequence: Synthetic oligonucleotide
aacttagcaagtccaagcgactccttgtgcc

SEQ ID NO: 342073 - DNA, 30 bp, Artificial Sequence
  Description of Artificial Sequence: Synthetic oligonucleotide
acttagcaagtccaagcgactccttgtgcc

SEQ ID NO: 342074 - DNA, 29 bp, Artificial Sequence
  Description of Artificial Sequence: Synthetic oligonucleotide
cttagcaagtccaagcgactccttgtgcc

SEQ ID NO: 342075 - DNA, 30 bp, Artificial Sequence
  Description of Artificial Sequence: Synthetic oligonucleotide
ttagcaagtccaagcgactccttgtgccag

SEQ ID NO: 342076 - DNA, 29 bp, Artificial Sequence
  Description of Artificial Sequence: Synthetic oligonucleotide
tagcaagtccaagcgactccttgtgccag

SEQ ID NO: 342077 - DNA, 28 bp, Artificial Sequence
  Description of Artificial Sequence: Synthetic oligonucleotide
agcaagtccaagcgactccttgtgccag

SEQ ID NO: 342078 - DNA, 27 bp, Artificial Sequence
  Description of Artificial Sequence: Synthetic oligonucleotide
gcaagtccaagcgactccttgtgccag

SEQ ID NO: 342079 - DNA, 27 bp, Artificial Sequence
  Description of Artificial Sequence: Synthetic oligonucleotide
caagtccaagcgactccttgtgccagg

SEQ ID NO: 342080 - DNA, 27 bp, Artificial Sequence
  Description of Artificial Sequence: Synthetic oligonucleotide
aagtccaagcgactccttgtgccaggg

SEQ ID NO: 342081 - DNA, 26 bp, Artificial Sequence
  Description of Artificial Sequence: Synthetic oligonucleotide
agtccaagcgactccttgtgccaggg

SEQ ID NO: 342082 - DNA, 25 bp, Artificial Sequence
  Description of Artificial Sequence: Synthetic oligonucleotide
gtccaagcgactccttgtgccaggg

SEQ ID NO: 342083 - DNA, 25 bp, Artificial Sequence
  Description of Artificial Sequence: Synthetic oligonucleotide
tccaagcgactccttgtgccagggg

SEQ ID NO: 342084 - DNA, 24 bp, Artificial Sequence
  Description of Artificial Sequence: Synthetic oligonucleotide
ccaagcgactccttgtgccagggg

SEQ ID NO: 342085 - DNA, 24 bp, Artificial Sequence
  Description of Artificial Sequence: Synthetic oligonucleotide
caagcgactccttgtgccaggggc

SEQ ID NO: 342086 - DNA, 24 bp, Artificial Sequence
  Description of Artificial Sequence: Synthetic oligonucleotide
aagcgactccttgtgccaggggcc

SEQ ID NO: 342087 - DNA, 23 bp, Artificial Sequence
  Description of Artificial Sequence: Synthetic oligonucleotide
agcgactccttgtgccaggggcc

SEQ ID NO: 342088 - DNA, 22 bp, Artificial Sequence
  Description of Artificial Sequence: Synthetic oligonucleotide
gcgactccttgtgccaggggcc

SEQ ID NO: 342089 - DNA, 22 bp, Artificial Sequence
  Description of Artificial Sequence: Synthetic oligonucleotide
cgactccttgtgccaggggccc

SEQ ID NO: 342090 - DNA, 22 bp, Artificial Sequence
  Description of Artificial Sequence: Synthetic oligonucleotide
gactccttgtgccaggggcccc

SEQ ID NO: 342091 - DNA, 24 bp, Artificial Sequence
  Description of Artificial Sequence: Synthetic oligonucleotide
actccttgtgccaggggcccccat

SEQ ID NO: 342092 - DNA, 23 bp, Artificial Sequence
  Description of Artificial Sequence: Synthetic oligonucleotide
ctccttgtgccaggggcccccat

SEQ ID NO: 342093 - DNA, 23 bp, Artificial Sequence
  Description of Artificial Sequence: Synthetic oligonucleotide
tccttgtgccaggggcccccatc

SEQ ID NO: 342094 - DNA, 22 bp, Artificial Sequence
  Description of Artificial Sequence: Synthetic oligonucleotide
ccttgtgccaggggcccccatc

SEQ ID NO: 342095 - DNA, 23 bp, Artificial Sequence
  Description of Artificial Sequence: Synthetic oligonucleotide
cttgtgccaggggcccccatcct

SEQ ID NO: 342096 - DNA, 23 bp, Artificial Sequence
  Description of Artificial Sequence: Synthetic oligonucleotide
ttgtgccaggggcccccatcctg

SEQ ID NO: 342097 - DNA, 22 bp, Artificial Sequence
  Description of Artificial Sequence: Synthetic oligonucleotide
tgtgccaggggcccccatcctg

SEQ ID NO: 342098 - DNA, 21 bp, Artificial Sequence
  Description of Artificial Sequence: Synthetic oligonucleotide
gtgccaggggcccccatcctg

SEQ ID NO: 342099 - DNA, 22 bp, Artificial Sequence
  Description of Artificial Sequence: Synthetic oligonucleotide
tgccaggggcccccatcctgct

SEQ ID NO: 342100 - DNA, 21 bp, Artificial Sequence
  Description of Artificial Sequence: Synthetic oligonucleotide
gccaggggcccccatcctgct

SEQ ID NO: 342101 - DNA, 21 bp, Artificial Sequence
  Description of Artificial Sequence: Synthetic oligonucleotide
ccaggggcccccatcctgctg

SEQ ID NO: 342102 - DNA, 22 bp, Artificial Sequence
  Description of Artificial Sequence: Synthetic oligonucleotide
caggggcccccatcctgctgct

SEQ ID NO: 342103 - DNA, 22 bp, Artificial Sequence
  Description of Artificial Sequence: Synthetic oligonucleotide
aggggcccccatcctgctgctg

SEQ ID NO: 342104 - DNA, 21 bp, Artificial Sequence
  Description of Artificial Sequence: Synthetic oligonucleotide
ggggcccccatcctgctgctg

SEQ ID NO: 342105 - DNA, 21 bp, Artificial Sequence
  Description of Artificial Sequence: Synthetic oligonucleotide
gggcccccatcctgctgctgg

SEQ ID NO: 342106 - DNA, 21 bp, Artificial Sequence
  Description of Artificial Sequence: Synthetic oligonucleotide
ggcccccatcctgctgctggc

SEQ ID NO: 342107 - DNA, 23 bp, Artificial Sequence
  Description of Artificial Sequence: Synthetic oligonucleotide
gcccccatcctgctgctggcctt

SEQ ID NO: 342108 - DNA, 23 bp, Artificial Sequence
  Description of Artificial Sequence: Synthetic oligonucleotide
cccccatcctgctgctggccttg

SEQ ID NO: 342109 - DNA, 24 bp, Artificial Sequence
  Description of Artificial Sequence: Synthetic oligonucleotide
ccccatcctgctgctggccttggt

SEQ ID NO: 342110 - DNA, 24 bp, Artificial Sequence
  Description of Artificial Sequence: Synthetic oligonucleotide
cccatcctgctgctggccttggtg

SEQ ID NO: 342111 - DNA, 24 bp, Artificial Sequence
  Description of Artificial Sequence: Synthetic oligonucleotide
ccatcctgctgctggccttggtgc

SEQ ID NO: 342112 - DNA, 25 bp, Artificial Sequence
  Description of Artificial Sequence: Synthetic oligonucleotide
catcctgctgctggccttggtgcgt

SEQ ID NO: 342113 - DNA, 26 bp, Artificial Sequence
  Description of Artificial Sequence: Synthetic oligonucleotide
atcctgctgctggccttggtgcgtga

SEQ ID NO: 342114 - DNA, 25 bp, Artificial Sequence
  Description of Artificial Sequence: Synthetic oligonucleotide
tcctgctgctggccttggtgcgtga

SEQ ID NO: 342115 - DNA, 24 bp, Artificial Sequence
  Description of Artificial Sequence: Synthetic oligonucleotide
cctgctgctggccttggtgcgtga

SEQ ID NO: 342116 - DNA, 26 bp, Artificial Sequence
  Description of Artificial Sequence: Synthetic oligonucleotide
ctgctgctggccttggtgcgtgagat

SEQ ID NO: 342117 - DNA, 27 bp, Artificial Sequence
  Description of Artificial Sequence: Synthetic oligonucleotide
tgctgctggccttggtgcgtgagatga

SEQ ID NO: 342118 - DNA, 26 bp, Artificial Sequence
  Description of Artificial Sequence: Synthetic oligonucleotide
gctgctggccttggtgcgtgagatga

SEQ ID NO: 342119 - DNA, 27 bp, Artificial Sequence
  Description of Artificial Sequence: Synthetic oligonucleotide
ctgctggccttggtgcgtgagatgaca

SEQ ID NO: 342120 - DNA, 27 bp, Artificial Sequence
  Description of Artificial Sequence: Synthetic oligonucleotide
tgctggccttggtgcgtgagatgacag

SEQ ID NO: 342121 - DNA, 26 bp, Artificial Sequence
  Description of Artificial Sequence: Synthetic oligonucleotide
gctggccttggtgcgtgagatgacag

SEQ ID NO: 342122 - DNA, 26 bp, Artificial Sequence
  Description of Artificial Sequence: Synthetic oligonucleotide
ctggccttggtgcgtgagatgacagg

SEQ ID NO: 342123 - DNA, 27 bp, Artificial Sequence
  Description of Artificial Sequence: Synthetic oligonucleotide
tggccttggtgcgtgagatgacaggct

SEQ ID NO: 342124 - DNA, 26 bp, Artificial Sequence
  Description of Artificial Sequence: Synthetic oligonucleotide
ggccttggtgcgtgagatgacaggct

SEQ ID NO: 342125 - DNA, 26 bp, Artificial Sequence
  Description of Artificial Sequence: Synthetic oligonucleotide
gccttggtgcgtgagatgacaggctc

SEQ ID NO: 342126 - DNA, 26 bp, Artificial Sequence
  Description of Artificial Sequence: Synthetic oligonucleotide
ccttggtgcgtgagatgacaggctcc

SEQ ID NO: 342127 - DNA, 26 bp, Artificial Sequence
  Description of Artificial Sequence: Synthetic oligonucleotide
cttggtgcgtgagatgacaggctccc

SEQ ID NO: 342128 - DNA, 27 bp, Artificial Sequence
  Description of Artificial Sequence: Synthetic oligonucleotide
ttggtgcgtgagatgacaggctcccga

SEQ ID NO: 342129 - DNA, 26 bp, Artificial Sequence
  Description of Artificial Sequence: Synthetic oligonucleotide
tggtgcgtgagatgacaggctcccga

SEQ ID NO: 342130 - DNA, 25 bp, Artificial Sequence
  Description of Artificial Sequence: Synthetic oligonucleotide
ggtgcgtgagatgacaggctcccga

SEQ ID NO: 342131 - DNA, 25 bp, Artificial Sequence
  Description of Artificial Sequence: Synthetic oligonucleotide
gtgcgtgagatgacaggctcccgag

SEQ ID NO: 342132 - DNA, 27 bp, Artificial Sequence
  Description of Artificial Sequence: Synthetic oligonucleotide
tgcgtgagatgacaggctcccgagctt

SEQ ID NO: 342133 - DNA, 26 bp, Artificial Sequence
  Description of Artificial Sequence: Synthetic oligonucleotide
gcgtgagatgacaggctcccgagctt

SEQ ID NO: 342134 - DNA, 27 bp, Artificial Sequence
  Description of Artificial Sequence: Synthetic oligonucleotide
cgtgagatgacaggctcccgagcttct

SEQ ID NO: 342135 - DNA, 27 bp, Artificial Sequence
  Description of Artificial Sequence: Synthetic oligonucleotide
gtgagatgacaggctcccgagcttctg

SEQ ID NO: 342136 - DNA, 27 bp, Artificial Sequence
  Description of Artificial Sequence: Synthetic oligonucleotide
tgagatgacaggctcccgagcttctgg

SEQ ID NO: 342137 - DNA, 26 bp, Artificial Sequence
  Description of Artificial Sequence: Synthetic oligonucleotide
gagatgacaggctcccgagcttctgg

SEQ ID NO: 342138 - DNA, 27 bp, Artificial Sequence
  Description of Artificial Sequence: Synthetic oligonucleotide
agatgacaggctcccgagcttctggga

SEQ ID NO: 342139 - DNA, 27 bp, Artificial Sequence
  Description of Artificial Sequence: Synthetic oligonucleotide
gatgacaggctcccgagcttctgggat

SEQ ID NO: 342140 - DNA, 28 bp, Artificial Sequence
  Description of Artificial Sequence: Synthetic oligonucleotide
atgacaggctcccgagcttctgggattc

SEQ ID NO: 342141 - DNA, 27 bp, Artificial Sequence
  Description of Artificial Sequence: Synthetic oligonucleotide
tgacaggctcccgagcttctgggattc

SEQ ID NO: 342142 - DNA, 26 bp, Artificial Sequence
  Description of Artificial Sequence: Synthetic oligonucleotide
gacaggctcccgagcttctgggattc

SEQ ID NO: 342143 - DNA, 27 bp, Artificial Sequence
  Description of Artificial Sequence: Synthetic oligonucleotide
acaggctcccgagcttctgggattcct

SEQ ID NO: 342144 - DNA, 26 bp, Artificial Sequence
  Description of Artificial Sequence: Synthetic oligonucleotide
caggctcccgagcttctgggattcct

SEQ ID NO: 342145 - DNA, 27 bp, Artificial Sequence
  Description of Artificial Sequence: Synthetic oligonucleotide
aggctcccgagcttctgggattcctgt

SEQ ID NO: 342146 - DNA, 26 bp, Artificial Sequence
  Description of Artificial Sequence: Synthetic oligonucleotide
ggctcccgagcttctgggattcctgt

SEQ ID NO: 342147 - DNA, 27 bp, Artificial Sequence
  Description of Artificial Sequence: Synthetic oligonucleotide
gctcccgagcttctgggattcctgtct

SEQ ID NO: 342148 - DNA, 29 bp, Artificial Sequence
  Description of Artificial Sequence: Synthetic oligonucleotide
ctcccgagcttctgggattcctgtctaag

SEQ ID NO: 342149 - DNA, 32 bp, Artificial Sequence
  Description of Artificial Sequence: Synthetic oligonucleotide
tcccgagcttctgggattcctgtctaagtttc

SEQ ID NO: 342150 - DNA, 31 bp, Artificial Sequence
  Description of Artificial Sequence: Synthetic oligonucleotide
cccgagcttctgggattcctgtctaagtttc

SEQ ID NO: 342151 - DNA, 32 bp, Artificial Sequence
  Description of Artificial Sequence: Synthetic oligonucleotide
ccgagcttctgggattcctgtctaagtttctg

SEQ ID NO: 342152 - DNA, 32 bp, Artificial Sequence
  Description of Artificial Sequence: Synthetic oligonucleotide
cgagcttctgggattcctgtctaagtttctgg

SEQ ID NO: 342153 - DNA, 32 bp, Artificial Sequence
  Description of Artificial Sequence: Synthetic oligonucleotide
gagcttctgggattcctgtctaagtttctggc

SEQ ID NO: 342154 - DNA, 33 bp, Artificial Sequence
  Description of Artificial Sequence: Synthetic oligonucleotide
agcttctgggattcctgtctaagtttctggcac

SEQ ID NO: 342155 - DNA, 32 bp, Artificial Sequence
  Description of Artificial Sequence: Synthetic oligonucleotide
gcttctgggattcctgtctaagtttctggcac

SEQ ID NO: 342156 - DNA, 32 bp, Artificial Sequence
  Description of Artificial Sequence: Synthetic oligonucleotide
cttctgggattcctgtctaagtttctggcacg

SEQ ID NO: 342157 - DNA, 32 bp, Artificial Sequence
  Description of Artificial Sequence: Synthetic oligonucleotide
ttctgggattcctgtctaagtttctggcacgg

SEQ ID NO: 342158 - DNA, 31 bp, Artificial Sequence
  Description of Artificial Sequence: Synthetic oligonucleotide
tctgggattcctgtctaagtttctggcacgg

SEQ ID NO: 342159 - DNA, 30 bp, Artificial Sequence
  Description of Artificial Sequence: Synthetic oligonucleotide
ctgggattcctgtctaagtttctggcacgg

SEQ ID NO: 342160 - DNA, 31 bp, Artificial Sequence
  Description of Artificial Sequence: Synthetic oligonucleotide
tgggattcctgtctaagtttctggcacggtg

SEQ ID NO: 342161 - DNA, 30 bp, Artificial Sequence
  Description of Artificial Sequence: Synthetic oligonucleotide
gggattcctgtctaagtttctggcacggtg

SEQ ID NO: 342162 - DNA, 31 bp, Artificial Sequence
  Description of Artificial Sequence: Synthetic oligonucleotide
ggattcctgtctaagtttctggcacggtgtc

SEQ ID NO: 342163 - DNA, 33 bp, Artificial Sequence
  Description of Artificial Sequence: Synthetic oligonucleotide
gattcctgtctaagtttctggcacggtgtcatc

SEQ ID NO: 342164 - DNA, 34 bp, Artificial Sequence
  Description of Artificial Sequence: Synthetic oligonucleotide
attcctgtctaagtttctggcacggtgtcatctc

SEQ ID NO: 342165 - DNA, 33 bp, Artificial Sequence
  Description of Artificial Sequence: Synthetic oligonucleotide
ttcctgtctaagtttctggcacggtgtcatctc

SEQ ID NO: 342166 - DNA, 32 bp, Artificial Sequence
  Description of Artificial Sequence: Synthetic oligonucleotide
tcctgtctaagtttctggcacggtgtcatctc

SEQ ID NO: 342167 - DNA, 31 bp, Artificial Sequence
  Description of Artificial Sequence: Synthetic oligonucleotide
cctgtctaagtttctggcacggtgtcatctc

SEQ ID NO: 342168 - DNA, 31 bp, Artificial Sequence
  Description of Artificial Sequence: Synthetic oligonucleotide
ctgtctaagtttctggcacggtgtcatctcc

SEQ ID NO: 342169 - DNA, 32 bp, Artificial Sequence
  Description of Artificial Sequence: Synthetic oligonucleotide
tgtctaagtttctggcacggtgtcatctcctg

SEQ ID NO: 342170 - DNA, 31 bp, Artificial Sequence
  Description of Artificial Sequence: Synthetic oligonucleotide
gtctaagtttctggcacggtgtcatctcctg

SEQ ID NO: 342171 - DNA, 31 bp, Artificial Sequence
  Description of Artificial Sequence: Synthetic oligonucleotide
tctaagtttctggcacggtgtcatctcctgg

SEQ ID NO: 342172 - DNA, 30 bp, Artificial Sequence
  Description of Artificial Sequence: Synthetic oligonucleotide
ctaagtttctggcacggtgtcatctcctgg

SEQ ID NO: 342173 - DNA, 30 bp, Artificial Sequence
  Description of Artificial Sequence: Synthetic oligonucleotide
taagtttctggcacggtgtcatctcctggg

SEQ ID NO: 342174 - DNA, 29 bp, Artificial Sequence
  Description of Artificial Sequence: Synthetic oligonucleotide
aagtttctggcacggtgtcatctcctggg

SEQ ID NO: 342175 - DNA, 28 bp, Artificial Sequence
  Description of Artificial Sequence: Synthetic oligonucleotide
agtttctggcacggtgtcatctcctggg

SEQ ID NO: 342176 - DNA, 27 bp, Artificial Sequence
  Description of Artificial Sequence: Synthetic oligonucleotide
gtttctggcacggtgtcatctcctggg

SEQ ID NO: 342177 - DNA, 28 bp, Artificial Sequence
  Description of Artificial Sequence: Synthetic oligonucleotide
tttctggcacggtgtcatctcctgggac

SEQ ID NO: 342178 - DNA, 27 bp, Artificial Sequence
  Description of Artificial Sequence: Synthetic oligonucleotide
ttctggcacggtgtcatctcctgggac

SEQ ID NO: 342179 - DNA, 27 bp, Artificial Sequence
  Description of Artificial Sequence: Synthetic oligonucleotide
tctggcacggtgtcatctcctgggact

SEQ ID NO: 342180 - DNA, 26 bp, Artificial Sequence
  Description of Artificial Sequence: Synthetic oligonucleotide
ctggcacggtgtcatctcctgggact

SEQ ID NO: 342181 - DNA, 27 bp, Artificial Sequence
  Description of Artificial Sequence: Synthetic oligonucleotide
tggcacggtgtcatctcctgggactgt

SEQ ID NO: 342182 - DNA, 27 bp, Artificial Sequence
  Description of Artificial Sequence: Synthetic oligonucleotide
ggcacggtgtcatctcctgggactgtt

SEQ ID NO: 342183 - DNA, 27 bp, Artificial Sequence
  Description of Artificial Sequence: Synthetic oligonucleotide
gcacggtgtcatctcctgggactgttc

SEQ ID NO: 342184 - DNA, 27 bp, Artificial Sequence
  Description of Artificial Sequence: Synthetic oligonucleotide
cacggtgtcatctcctgggactgttcc

SEQ ID NO: 342185 - DNA, 28 bp, Artificial Sequence
  Description of Artificial Sequence: Synthetic oligonucleotide
acggtgtcatctcctgggactgttcctg

SEQ ID NO: 342186 - DNA, 27 bp, Artificial Sequence
  Description of Artificial Sequence: Synthetic oligonucleotide
cggtgtcatctcctgggactgttcctg

SEQ ID NO: 342187 - DNA, 29 bp, Artificial Sequence
  Description of Artificial Sequence: Synthetic oligonucleotide
ggtgtcatctcctgggactgttcctgtag

SEQ ID NO: 342188 - DNA, 30 bp, Artificial Sequence
  Description of Artificial Sequence: Synthetic oligonucleotide
gtgtcatctcctgggactgttcctgtagtc

SEQ ID NO: 342189 - DNA, 30 bp, Artificial Sequence
  Description of Artificial Sequence: Synthetic oligonucleotide
tgtcatctcctgggactgttcctgtagtcc

SEQ ID NO: 342190 - DNA, 29 bp, Artificial Sequence
  Description of Artificial Sequence: Synthetic oligonucleotide
gtcatctcctgggactgttcctgtagtcc

SEQ ID NO: 342191 - DNA, 30 bp, Artificial Sequence
  Description of Artificial Sequence: Synthetic oligonucleotide
tcatctcctgggactgttcctgtagtccag

SEQ ID NO: 342192 - DNA, 29 bp, Artificial Sequence
  Description of Artificial Sequence: Synthetic oligonucleotide
catctcctgggactgttcctgtagtccag

SEQ ID NO: 342193 - DNA, 29 bp, Artificial Sequence
  Description of Artificial Sequence: Synthetic oligonucleotide
atctcctgggactgttcctgtagtccagg

SEQ ID NO: 342194 - DNA, 28 bp, Artificial Sequence
  Description of Artificial Sequence: Synthetic oligonucleotide
tctcctgggactgttcctgtagtccagg

SEQ ID NO: 342195 - DNA, 27 bp, Artificial Sequence
  Description of Artificial Sequence: Synthetic oligonucleotide
ctcctgggactgttcctgtagtccagg

SEQ ID NO: 342196 - DNA, 28 bp, Artificial Sequence
  Description of Artificial Sequence: Synthetic oligonucleotide
tcctgggactgttcctgtagtccaggag

SEQ ID NO: 342197 - DNA, 27 bp, Artificial Sequence
  Description of Artificial Sequence: Synthetic oligonucleotide
cctgggactgttcctgtagtccaggag

SEQ ID NO: 342198 - DNA, 30 bp, Artificial Sequence
  Description of Artificial Sequence: Synthetic oligonucleotide
ctgggactgttcctgtagtccaggagattc

SEQ ID NO: 342199 - DNA, 31 bp, Artificial Sequence
  Description of Artificial Sequence: Synthetic oligonucleotide
tgggactgttcctgtagtccaggagattcag

SEQ ID NO: 342200 - DNA, 30 bp, Artificial Sequence
  Description of Artificial Sequence: Synthetic oligonucleotide
gggactgttcctgtagtccaggagattcag

SEQ ID NO: 342201 - DNA, 30 bp, Artificial Sequence
  Description of Artificial Sequence: Synthetic oligonucleotide
ggactgttcctgtagtccaggagattcagc

SEQ ID NO: 342202 - DNA, 34 bp, Artificial Sequence
  Description of Artificial Sequence: Synthetic oligonucleotide
gactgttcctgtagtccaggagattcagcaatac

SEQ ID NO: 342203 - DNA, 35 bp, Artificial Sequence
  Description of Artificial Sequence: Synthetic oligonucleotide
actgttcctgtagtccaggagattcagcaatacac

SEQ ID NO: 342204 - DNA, 34 bp, Artificial Sequence
  Description of Artificial Sequence: Synthetic oligonucleotide
ctgttcctgtagtccaggagattcagcaatacac

SEQ ID NO: 342205 - DNA, 35 bp, Artificial Sequence
  Description of Artificial Sequence: Synthetic oligonucleotide
tgttcctgtagtccaggagattcagcaatacacag

SEQ ID NO: 342206 - DNA, 34 bp, Artificial Sequence
  Description of Artificial Sequence: Synthetic oligonucleotide
gttcctgtagtccaggagattcagcaatacacag

SEQ ID NO: 342207 - DNA, 35 bp, Artificial Sequence
  Description of Artificial Sequence: Synthetic oligonucleotide
ttcctgtagtccaggagattcagcaatacacagac

SEQ ID NO: 342208 - DNA, 34 bp, Artificial Sequence
  Description of Artificial Sequence: Synthetic oligonucleotide
tcctgtagtccaggagattcagcaatacacagac

SEQ ID NO: 342209 - DNA, 33 bp, Artificial Sequence
  Description of Artificial Sequence: Synthetic oligonucleotide
cctgtagtccaggagattcagcaatacacagac

SEQ ID NO: 342210 - DNA, 33 bp, Artificial Sequence
  Description of Artificial Sequence: Synthetic oligonucleotide
ctgtagtccaggagattcagcaatacacagacg

SEQ ID NO: 342211 - DNA, 33 bp, Artificial Sequence
  Description of Artificial Sequence: Synthetic oligonucleotide
tgtagtccaggagattcagcaatacacagacgc

SEQ ID NO: 342212 - DNA, 32 bp, Artificial Sequence
  Description of Artificial Sequence: Synthetic oligonucleotide
gtagtccaggagattcagcaatacacagacgc

SEQ ID NO: 342213 - DNA, 32 bp, Artificial Sequence
  Description of Artificial Sequence: Synthetic oligonucleotide
tagtccaggagattcagcaatacacagacgcg

SEQ ID NO: 342214 - DNA, 31 bp, Artificial Sequence
  Description of Artificial Sequence: Synthetic oligonucleotide
agtccaggagattcagcaatacacagacgcg

SEQ ID NO: 342215 - DNA, 30 bp, Artificial Sequence
  Description of Artificial Sequence: Synthetic oligonucleotide
gtccaggagattcagcaatacacagacgcg

SEQ ID NO: 342216 - DNA, 31 bp, Artificial Sequence
  Description of Artificial Sequence: Synthetic oligonucleotide
tccaggagattcagcaatacacagacgcgag

SEQ ID NO: 342217 - DNA, 30 bp, Artificial Sequence
  Description of Artificial Sequence: Synthetic oligonucleotide
ccaggagattcagcaatacacagacgcgag

SEQ ID NO: 342218 - DNA, 30 bp, Artificial Sequence
  Description of Artificial Sequence: Synthetic oligonucleotide
caggagattcagcaatacacagacgcgagc

SEQ ID NO: 342219 - DNA, 30 bp, Artificial Sequence
  Description of Artificial Sequence: Synthetic oligonucleotide
aggagattcagcaatacacagacgcgagcg

SEQ ID NO: 342220 - DNA, 29 bp, Artificial Sequence
  Description of Artificial Sequence: Synthetic oligonucleotide
ggagattcagcaatacacagacgcgagcg

SEQ ID NO: 342221 - DNA, 29 bp, Artificial Sequence
  Description of Artificial Sequence: Synthetic oligonucleotide
gagattcagcaatacacagacgcgagcgg

SEQ ID NO: 342222 - DNA, 29 bp, Artificial Sequence
  Description of Artificial Sequence: Synthetic oligonucleotide
agattcagcaatacacagacgcgagcggc

SEQ ID NO: 342223 - DNA, 28 bp, Artificial Sequence
  Description of Artificial Sequence: Synthetic oligonucleotide
gattcagcaatacacagacgcgagcggc

SEQ ID NO: 342224 - DNA, 28 bp, Artificial Sequence
  Description of Artificial Sequence: Synthetic oligonucleotide
attcagcaatacacagacgcgagcggcc

SEQ ID NO: 342225 - DNA, 27 bp, Artificial Sequence
  Description of Artificial Sequence: Synthetic oligonucleotide
ttcagcaatacacagacgcgagcggcc

SEQ ID NO: 342226 - DNA, 27 bp, Artificial Sequence
  Description of Artificial Sequence: Synthetic oligonucleotide
tcagcaatacacagacgcgagcggcca

SEQ ID NO: 342227 - DNA, 27 bp, Artificial Sequence
  Description of Artificial Sequence: Synthetic oligonucleotide
cagcaatacacagacgcgagcggccat

SEQ ID NO: 342228 - DNA, 27 bp, Artificial Sequence
  Description of Artificial Sequence: Synthetic oligonucleotide
agcaatacacagacgcgagcggccatg

SEQ ID NO: 342229 - DNA, 27 bp, Artificial Sequence
  Description of Artificial Sequence: Synthetic oligonucleotide
gcaatacacagacgcgagcggccatgt

SEQ ID NO: 342230 - DNA, 27 bp, Artificial Sequence
  Description of Artificial Sequence: Synthetic oligonucleotide
caatacacagacgcgagcggccatgtc

SEQ ID NO: 342231 - DNA, 28 bp, Artificial Sequence
  Description of Artificial Sequence: Synthetic oligonucleotide
aatacacagacgcgagcggccatgtcag

SEQ ID NO: 342232 - DNA, 27 bp, Artificial Sequence
  Description of Artificial Sequence: Synthetic oligonucleotide
atacacagacgcgagcggccatgtcag

SEQ ID NO: 342233 - DNA, 26 bp, Artificial Sequence
  Description of Artificial Sequence: Synthetic oligonucleotide
tacacagacgcgagcggccatgtcag

SEQ ID NO: 342234 - DNA, 25 bp, Artificial Sequence
  Description of Artificial Sequence: Synthetic oligonucleotide
acacagacgcgagcggccatgtcag

SEQ ID NO: 342235 - DNA, 24 bp, Artificial Sequence
  Description of Artificial Sequence: Synthetic oligonucleotide
cacagacgcgagcggccatgtcag

SEQ ID NO: 342236 - DNA, 27 bp, Artificial Sequence
  Description of Artificial Sequence: Synthetic oligonucleotide
acagacgcgagcggccatgtcagcatt

SEQ ID NO: 342237 - DNA, 26 bp, Artificial Sequence
  Description of Artificial Sequence: Synthetic oligonucleotide
cagacgcgagcggccatgtcagcatt

SEQ ID NO: 342238 - DNA, 26 bp, Artificial Sequence
  Description of Artificial Sequence: Synthetic oligonucleotide
agacgcgagcggccatgtcagcattg

SEQ ID NO: 342239 - DNA, 25 bp, Artificial Sequence
  Description of Artificial Sequence: Synthetic oligonucleotide
gacgcgagcggccatgtcagcattg

SEQ ID NO: 342240 - DNA, 27 bp, Artificial Sequence
  Description of Artificial Sequence: Synthetic oligonucleotide
acgcgagcggccatgtcagcattgcaa

SEQ ID NO: 342241 - DNA, 27 bp, Artificial Sequence
  Description of Artificial Sequence: Synthetic oligonucleotide
cgcgagcggccatgtcagcattgcaat

SEQ ID NO: 342242 - DNA, 33 bp, Artificial Sequence
  Description of Artificial Sequence: Synthetic oligonucleotide
gcgagcggccatgtcagcattgcaataattaac

SEQ ID NO: 342243 - DNA, 33 bp, Artificial Sequence
  Description of Artificial Sequence: Synthetic oligonucleotide
cgagcggccatgtcagcattgcaataattaacc

SEQ ID NO: 342244 - DNA, 33 bp, Artificial Sequence
  Description of Artificial Sequence: Synthetic oligonucleotide
gagcggccatgtcagcattgcaataattaaccc

SEQ ID NO: 342245 - DNA, 34 bp, Artificial Sequence
  Description of Artificial Sequence: Synthetic oligonucleotide
agcggccatgtcagcattgcaataattaaccctc

SEQ ID NO: 342246 - DNA, 33 bp, Artificial Sequence
  Description of Artificial Sequence: Synthetic oligonucleotide
gcggccatgtcagcattgcaataattaaccctc

SEQ ID NO: 342247 - DNA, 34 bp, Artificial Sequence
  Description of Artificial Sequence: Synthetic oligonucleotide
cggccatgtcagcattgcaataattaaccctcag

SEQ ID NO: 342248 - DNA, 35 bp, Artificial Sequence
  Description of Artificial Sequence: Synthetic oligonucleotide
ggccatgtcagcattgcaataattaaccctcagac

SEQ ID NO: 342249 - DNA, 35 bp, Artificial Sequence
  Description of Artificial Sequence: Synthetic oligonucleotide
gccatgtcagcattgcaataattaaccctcagacg

SEQ ID NO: 342250 - DNA, 37 bp, Artificial Sequence
  Description of Artificial Sequence: Synthetic oligonucleotide
ccatgtcagcattgcaataattaaccctcagacgatc

SEQ ID NO: 342251 - DNA, 38 bp, Artificial Sequence
  Description of Artificial Sequence: Synthetic oligonucleotide
catgtcagcattgcaataattaaccctcagacgatctc

SEQ ID NO: 342252 - DNA, 39 bp, Artificial Sequence
  Description of Artificial Sequence: Synthetic oligonucleotide
atgtcagcattgcaataattaaccctcagacgatctcag

SEQ ID NO: 342253 - DNA, 38 bp, Artificial Sequence
  Description of Artificial Sequence: Synthetic oligonucleotide
tgtcagcattgcaataattaaccctcagacgatctcag

SEQ ID NO: 342254 - DNA, 37 bp, Artificial Sequence
  Description of Artificial Sequence: Synthetic oligonucleotide
gtcagcattgcaataattaaccctcagacgatctcag

SEQ ID NO: 342255 - DNA, 38 bp, Artificial Sequence
  Description of Artificial Sequence: Synthetic oligonucleotide
tcagcattgcaataattaaccctcagacgatctcagag

SEQ ID NO: 342256 - DNA, 37 bp, Artificial Sequence
  Description of Artificial Sequence: Synthetic oligonucleotide
cagcattgcaataattaaccctcagacgatctcagag

SEQ ID NO: 342257 - DNA, 37 bp, Artificial Sequence
  Description of Artificial Sequence: Synthetic oligonucleotide
agcattgcaataattaaccctcagacgatctcagagg

SEQ ID NO: 342258 - DNA, 36 bp, Artificial Sequence
  Description of Artificial Sequence: Synthetic oligonucleotide
gcattgcaataattaaccctcagacgatctcagagg

SEQ ID NO: 342259 - DNA, 37 bp, Artificial Sequence
  Description of Artificial Sequence: Synthetic oligonucleotide
cattgcaataattaaccctcagacgatctcagaggtg

SEQ ID NO: 342260 - DNA, 37 bp, Artificial Sequence
  Description of Artificial Sequence: Synthetic oligonucleotide
attgcaataattaaccctcagacgatctcagaggtgc

SEQ ID NO: 342261 - DNA, 36 bp, Artificial Sequence
  Description of Artificial Sequence: Synthetic oligonucleotide
ttgcaataattaaccctcagacgatctcagaggtgc

SEQ ID NO: 342262 - DNA, 35 bp, Artificial Sequence
  Description of Artificial Sequence: Synthetic oligonucleotide
tgcaataattaaccctcagacgatctcagaggtgc

SEQ ID NO: 342263 - DNA, 34 bp, Artificial Sequence
  Description of Artificial Sequence: Synthetic oligonucleotide
gcaataattaaccctcagacgatctcagaggtgc

SEQ ID NO: 342264 - DNA, 35 bp, Artificial Sequence
  Description of Artificial Sequence: Synthetic oligonucleotide
caataattaaccctcagacgatctcagaggtgcag

SEQ ID NO: 342265 - DNA, 35 bp, Artificial Sequence
  Description of Artificial Sequence: Synthetic oligonucleotide
aataattaaccctcagacgatctcagaggtgcagc

SEQ ID NO: 342266 - DNA, 34 bp, Artificial Sequence
  Description of Artificial Sequence: Synthetic oligonucleotide
ataattaaccctcagacgatctcagaggtgcagc

SEQ ID NO: 342267 - DNA, 33 bp, Artificial Sequence
  Description of Artificial Sequence: Synthetic oligonucleotide
taattaaccctcagacgatctcagaggtgcagc

SEQ ID NO: 342268 - DNA, 32 bp, Artificial Sequence
  Description of Artificial Sequence: Synthetic oligonucleotide
aattaaccctcagacgatctcagaggtgcagc

SEQ ID NO: 342269 - DNA, 31 bp, Artificial Sequence
  Description of Artificial Sequence: Synthetic oligonucleotide
attaaccctcagacgatctcagaggtgcagc

SEQ ID NO: 342270 - DNA, 30 bp, Artificial Sequence
  Description of Artificial Sequence: Synthetic oligonucleotide
ttaaccctcagacgatctcagaggtgcagc

SEQ ID NO: 342271 - DNA, 29 bp, Artificial Sequence
  Description of Artificial Sequence: Synthetic oligonucleotide
taaccctcagacgatctcagaggtgcagc

SEQ ID NO: 342272 - DNA, 28 bp, Artificial Sequence
  Description of Artificial Sequence: Synthetic oligonucleotide
aaccctcagacgatctcagaggtgcagc

SEQ ID NO: 342273 - DNA, 27 bp, Artificial Sequence
  Description of Artificial Sequence: Synthetic oligonucleotide
accctcagacgatctcagaggtgcagc

SEQ ID NO: 342274 - DNA, 27 bp, Artificial Sequence
  Description of Artificial Sequence: Synthetic oligonucleotide
ccctcagacgatctcagaggtgcagct

SEQ ID NO: 342275 - DNA, 27 bp, Artificial Sequence
  Description of Artificial Sequence: Synthetic oligonucleotide
cctcagacgatctcagaggtgcagctc

SEQ ID NO: 342276 - DNA, 28 bp, Artificial Sequence
  Description of Artificial Sequence: Synthetic oligonucleotide
ctcagacgatctcagaggtgcagctctg

SEQ ID NO: 342277 - DNA, 29 bp, Artificial Sequence
  Description of Artificial Sequence: Synthetic oligonucleotide
tcagacgatctcagaggtgcagctctgag

SEQ ID NO: 342278 - DNA, 28 bp, Artificial Sequence
  Description of Artificial Sequence: Synthetic oligonucleotide
cagacgatctcagaggtgcagctctgag

SEQ ID NO: 342279 - DNA, 31 bp, Artificial Sequence
  Description of Artificial Sequence: Synthetic oligonucleotide
agacgatctcagaggtgcagctctgagtatc

SEQ ID NO: 342280 - DNA, 30 bp, Artificial Sequence
  Description of Artificial Sequence: Synthetic oligonucleotide
gacgatctcagaggtgcagctctgagtatc

SEQ ID NO: 342281 - DNA, 31 bp, Artificial Sequence
  Description of Artificial Sequence: Synthetic oligonucleotide
acgatctcagaggtgcagctctgagtatctg

SEQ ID NO: 342282 - DNA, 30 bp, Artificial Sequence
  Description of Artificial Sequence: Synthetic oligonucleotide
cgatctcagaggtgcagctctgagtatctg

SEQ ID NO: 342283 - DNA, 30 bp, Artificial Sequence
  Description of Artificial Sequence: Synthetic oligonucleotide
gatctcagaggtgcagctctgagtatctgc

SEQ ID NO: 342284 - DNA, 31 bp, Artificial Sequence
  Description of Artificial Sequence: Synthetic oligonucleotide
atctcagaggtgcagctctgagtatctgctg

SEQ ID NO: 342285 - DNA, 30 bp, Artificial Sequence
  Description of Artificial Sequence: Synthetic oligonucleotide
tctcagaggtgcagctctgagtatctgctg

SEQ ID NO: 342286 - DNA, 29 bp, Artificial Sequence
  Description of Artificial Sequence: Synthetic oligonucleotide
ctcagaggtgcagctctgagtatctgctg

SEQ ID NO: 342287 - DNA, 29 bp, Artificial Sequence
  Description of Artificial Sequence: Synthetic oligonucleotide
tcagaggtgcagctctgagtatctgctgg

SEQ ID NO: 342288 - DNA, 28 bp, Artificial Sequence
  Description of Artificial Sequence: Synthetic oligonucleotide
cagaggtgcagctctgagtatctgctgg

SEQ ID NO: 342289 - DNA, 28 bp, Artificial Sequence
  Description of Artificial Sequence: Synthetic oligonucleotide
agaggtgcagctctgagtatctgctggc

SEQ ID NO: 342290 - DNA, 27 bp, Artificial Sequence
  Description of Artificial Sequence: Synthetic oligonucleotide
gaggtgcagctctgagtatctgctggc

SEQ ID NO: 342291 - DNA, 28 bp, Artificial Sequence
  Description of Artificial Sequence: Synthetic oligonucleotide
aggtgcagctctgagtatctgctggctc

SEQ ID NO: 342292 - DNA, 27 bp, Artificial Sequence
  Description of Artificial Sequence: Synthetic oligonucleotide
ggtgcagctctgagtatctgctggctc

SEQ ID NO: 342293 - DNA, 27 bp, Artificial Sequence
  Description of Artificial Sequence: Synthetic oligonucleotide
gtgcagctctgagtatctgctggctcc

SEQ ID NO: 342294 - DNA, 27 bp, Artificial Sequence
  Description of Artificial Sequence: Synthetic oligonucleotide
tgcagctctgagtatctgctggctccc

SEQ ID NO: 342295 - DNA, 26 bp, Artificial Sequence
  Description of Artificial Sequence: Synthetic oligonucleotide
gcagctctgagtatctgctggctccc

SEQ ID NO: 342296 - DNA, 27 bp, Artificial Sequence
  Description of Artificial Sequence: Synthetic oligonucleotide
cagctctgagtatctgctggctcccca

SEQ ID NO: 342297 - DNA, 27 bp, Artificial Sequence
  Description of Artificial Sequence: Synthetic oligonucleotide
agctctgagtatctgctggctccccag

SEQ ID NO: 342298 - DNA, 27 bp, Artificial Sequence
  Description of Artificial Sequence: Synthetic oligonucleotide
gctctgagtatctgctggctccccaga

SEQ ID NO: 342299 - DNA, 28 bp, Artificial Sequence
  Description of Artificial Sequence: Synthetic oligonucleotide
ctctgagtatctgctggctccccagatc

SEQ ID NO: 342300 - DNA, 28 bp, Artificial Sequence
  Description of Artificial Sequence: Synthetic oligonucleotide
tctgagtatctgctggctccccagatcc

SEQ ID NO: 342301 - DNA, 27 bp, Artificial Sequence
  Description of Artificial Sequence: Synthetic oligonucleotide
ctgagtatctgctggctccccagatcc

SEQ ID NO: 342302 - DNA, 28 bp, Artificial Sequence
  Description of Artificial Sequence: Synthetic oligonucleotide
tgagtatctgctggctccccagatccag

SEQ ID NO: 342303 - DNA, 27 bp, Artificial Sequence
  Description of Artificial Sequence: Synthetic oligonucleotide
gagtatctgctggctccccagatccag

SEQ ID NO: 342304 - DNA, 27 bp, Artificial Sequence
  Description of Artificial Sequence: Synthetic oligonucleotide
agtatctgctggctccccagatccagc

SEQ ID NO: 342305 - DNA, 26 bp, Artificial Sequence
  Description of Artificial Sequence: Synthetic oligonucleotide
gtatctgctggctccccagatccagc

SEQ ID NO: 342306 - DNA, 27 bp, Artificial Sequence
  Description of Artificial Sequence: Synthetic oligonucleotide
tatctgctggctccccagatccagcga

SEQ ID NO: 342307 - DNA, 27 bp, Artificial Sequence
  Description of Artificial Sequence: Synthetic oligonucleotide
atctgctggctccccagatccagcgaa

SEQ ID NO: 342308 - DNA, 27 bp, Artificial Sequence
  Description of Artificial Sequence: Synthetic oligonucleotide
tctgctggctccccagatccagcgaaa

SEQ ID NO: 342309 - DNA, 26 bp, Artificial Sequence
  Description of Artificial Sequence: Synthetic oligonucleotide
ctgctggctccccagatccagcgaaa

SEQ ID NO: 342310 - DNA, 26 bp, Artificial Sequence
  Description of Artificial Sequence: Synthetic oligonucleotide
tgctggctccccagatccagcgaaag

SEQ ID NO: 342311 - DNA, 25 bp, Artificial Sequence
  Description of Artificial Sequence: Synthetic oligonucleotide
gctggctccccagatccagcgaaag

SEQ ID NO: 342312 - DNA, 25 bp, Artificial Sequence
  Description of Artificial Sequence: Synthetic oligonucleotide
ctggctccccagatccagcgaaagc

SEQ ID NO: 342313 - DNA, 26 bp, Artificial Sequence
  Description of Artificial Sequence: Synthetic oligonucleotide
tggctccccagatccagcgaaagcca

SEQ ID NO: 342314 - DNA, 25 bp, Artificial Sequence
  Description of Artificial Sequence: Synthetic oligonucleotide
ggctccccagatccagcgaaagcca

SEQ ID NO: 342315 - DNA, 25 bp, Artificial Sequence
  Description of Artificial Sequence: Synthetic oligonucleotide
gctccccagatccagcgaaagccag

SEQ ID NO: 342316 - DNA, 25 bp, Artificial Sequence
  Description of Artificial Sequence: Synthetic oligonucleotide
ctccccagatccagcgaaagccagg

SEQ ID NO: 342317 - DNA, 26 bp, Artificial Sequence
  Description of Artificial Sequence: Synthetic oligonucleotide
tccccagatccagcgaaagccaggct

SEQ ID NO: 342318 - DNA, 25 bp, Artificial Sequence
  Description of Artificial Sequence: Synthetic oligonucleotide
ccccagatccagcgaaagccaggct

SEQ ID NO: 342319 - DNA, 26 bp, Artificial Sequence
  Description of Artificial Sequence: Synthetic oligonucleotide
cccagatccagcgaaagccaggctga

SEQ ID NO: 342320 - DNA, 27 bp, Artificial Sequence
  Description of Artificial Sequence: Synthetic oligonucleotide
ccagatccagcgaaagccaggctgact

SEQ ID NO: 342321 - DNA, 27 bp, Artificial Sequence
  Description of Artificial Sequence: Synthetic oligonucleotide
cagatccagcgaaagccaggctgactg

SEQ ID NO: 342322 - DNA, 28 bp, Artificial Sequence
  Description of Artificial Sequence: Synthetic oligonucleotide
agatccagcgaaagccaggctgactgtg

SEQ ID NO: 342323 - DNA, 27 bp, Artificial Sequence
  Description of Artificial Sequence: Synthetic oligonucleotide
gatccagcgaaagccaggctgactgtg

SEQ ID NO: 342324 - DNA, 27 bp, Artificial Sequence
  Description of Artificial Sequence: Synthetic oligonucleotide
atccagcgaaagccaggctgactgtgg

SEQ ID NO: 342325 - DNA, 26 bp, Artificial Sequence
  Description of Artificial Sequence: Synthetic oligonucleotide
tccagcgaaagccaggctgactgtgg

SEQ ID NO: 342326 - DNA, 25 bp, Artificial Sequence
  Description of Artificial Sequence: Synthetic oligonucleotide
ccagcgaaagccaggctgactgtgg

SEQ ID NO: 342327 - DNA, 26 bp, Artificial Sequence
  Description of Artificial Sequence: Synthetic oligonucleotide
cagcgaaagccaggctgactgtggca

SEQ ID NO: 342328 - DNA, 26 bp, Artificial Sequence
  Description of Artificial Sequence: Synthetic oligonucleotide
agcgaaagccaggctgactgtggcac

SEQ ID NO: 342329 - DNA, 25 bp, Artificial Sequence
  Description of Artificial Sequence: Synthetic oligonucleotide
gcgaaagccaggctgactgtggcac

SEQ ID NO: 342330 - DNA, 25 bp, Artificial Sequence
  Description of Artificial Sequence: Synthetic oligonucleotide
cgaaagccaggctgactgtggcacc

SEQ ID NO: 342331 - DNA, 25 bp, Artificial Sequence
  Description of Artificial Sequence: Synthetic oligonucleotide
gaaagccaggctgactgtggcaccc

SEQ ID NO: 342332 - DNA, 25 bp, Artificial Sequence
  Description of Artificial Sequence: Synthetic oligonucleotide
aaagccaggctgactgtggcacccc

SEQ ID NO: 342333 - DNA, 24 bp, Artificial Sequence
  Description of Artificial Sequence: Synthetic oligonucleotide
aagccaggctgactgtggcacccc

SEQ ID NO: 342334 - DNA, 23 bp, Artificial Sequence
  Description of Artificial Sequence: Synthetic oligonucleotide
agccaggctgactgtggcacccc

SEQ ID NO: 342335 - DNA, 22 bp, Artificial Sequence
  Description of Artificial Sequence: Synthetic oligonucleotide
gccaggctgactgtggcacccc

SEQ ID NO: 342336 - DNA, 23 bp, Artificial Sequence
  Description of Artificial Sequence: Synthetic oligonucleotide
ccaggctgactgtggcaccccca

SEQ ID NO: 342337 - DNA, 23 bp, Artificial Sequence
  Description of Artificial Sequence: Synthetic oligonucleotide
caggctgactgtggcacccccac

SEQ ID NO: 342338 - DNA, 25 bp, Artificial Sequence
  Description of Artificial Sequence: Synthetic oligonucleotide
aggctgactgtggcacccccacctt

SEQ ID NO: 342339 - DNA, 24 bp, Artificial Sequence
  Description of Artificial Sequence: Synthetic oligonucleotide
ggctgactgtggcacccccacctt

SEQ ID NO: 342340 - DNA, 25 bp, Artificial Sequence
  Description of Artificial Sequence: Synthetic oligonucleotide
gctgactgtggcacccccaccttga

SEQ ID NO: 342341 - DNA, 25 bp, Artificial Sequence
  Description of Artificial Sequence: Synthetic oligonucleotide
ctgactgtggcacccccaccttgag

SEQ ID NO: 342342 - DNA, 26 bp, Artificial Sequence
  Description of Artificial Sequence: Synthetic oligonucleotide
tgactgtggcacccccaccttgagga

SEQ ID NO: 342343 - DNA, 25 bp, Artificial Sequence
  Description of Artificial Sequence: Synthetic oligonucleotide
gactgtggcacccccaccttgagga

SEQ ID NO: 342344 - DNA, 25 bp, Artificial Sequence
  Description of Artificial Sequence: Synthetic oligonucleotide
actgtggcacccccaccttgaggag

SEQ ID NO: 342345 - DNA, 24 bp, Artificial Sequence
  Description of Artificial Sequence: Synthetic oligonucleotide
ctgtggcacccccaccttgaggag

SEQ ID NO: 342346 - DNA, 24 bp, Artificial Sequence
  Description of Artificial Sequence: Synthetic oligonucleotide
tgtggcacccccaccttgaggagg

SEQ ID NO: 342347 - DNA, 23 bp, Artificial Sequence
  Description of Artificial Sequence: Synthetic oligonucleotide
gtggcacccccaccttgaggagg

SEQ ID NO: 342348 - DNA, 23 bp, Artificial Sequence
  Description of Artificial Sequence: Synthetic oligonucleotide
tggcacccccaccttgaggaggc

SEQ ID NO: 342349 - DNA, 22 bp, Artificial Sequence
  Description of Artificial Sequence: Synthetic oligonucleotide
ggcacccccaccttgaggaggc

SEQ ID NO: 342350 - DNA, 22 bp, Artificial Sequence
  Description of Artificial Sequence: Synthetic oligonucleotide
gcacccccaccttgaggaggcc

SEQ ID NO: 342351 - DNA, 22 bp, Artificial Sequence
  Description of Artificial Sequence: Synthetic oligonucleotide
cacccccaccttgaggaggccc

SEQ ID NO: 342352 - DNA, 22 bp, Artificial Sequence
  Description of Artificial Sequence: Synthetic oligonucleotide
acccccaccttgaggaggcccg

SEQ ID NO: 342353 - DNA, 21 bp, Artificial Sequence
  Description of Artificial Sequence: Synthetic oligonucleotide
cccccaccttgaggaggcccg

SEQ ID NO: 342354 - DNA, 21 bp, Artificial Sequence
  Description of Artificial Sequence: Synthetic oligonucleotide
ccccaccttgaggaggcccgg

SEQ ID NO: 342355 - DNA, 21 bp, Artificial Sequence
  Description of Artificial Sequence: Synthetic oligonucleotide
cccaccttgaggaggcccggg

SEQ ID NO: 342356 - DNA, 24 bp, Artificial Sequence
  Description of Artificial Sequence: Synthetic oligonucleotide
ccaccttgaggaggcccggggttt

SEQ ID NO: 342357 - DNA, 25 bp, Artificial Sequence
  Description of Artificial Sequence: Synthetic oligonucleotide
caccttgaggaggcccggggtttct

SEQ ID NO: 342358 - DNA, 26 bp, Artificial Sequence
  Description of Artificial Sequence: Synthetic oligonucleotide
accttgaggaggcccggggtttctga

SEQ ID NO: 342359 - DNA, 25 bp, Artificial Sequence
  Description of Artificial Sequence: Synthetic oligonucleotide
ccttgaggaggcccggggtttctga

SEQ ID NO: 342360 - DNA, 27 bp, Artificial Sequence
  Description of Artificial Sequence: Synthetic oligonucleotide
cttgaggaggcccggggtttctgacta

SEQ ID NO: 342361 - DNA, 29 bp, Artificial Sequence
  Description of Artificial Sequence: Synthetic oligonucleotide
ttgaggaggcccggggtttctgactattg

SEQ ID NO: 342362 - DNA, 28 bp, Artificial Sequence
  Description of Artificial Sequence: Synthetic oligonucleotide
tgaggaggcccggggtttctgactattg

SEQ ID NO: 342363 - DNA, 27 bp, Artificial Sequence
  Description of Artificial Sequence: Synthetic oligonucleotide
gaggaggcccggggtttctgactattg

SEQ ID NO: 342364 - DNA, 28 bp, Artificial Sequence
  Description of Artificial Sequence: Synthetic oligonucleotide
aggaggcccggggtttctgactattgag

SEQ ID NO: 342365 - DNA, 27 bp, Artificial Sequence
  Description of Artificial Sequence: Synthetic oligonucleotide
ggaggcccggggtttctgactattgag

SEQ ID NO: 342366 - DNA, 27 bp, Artificial Sequence
  Description of Artificial Sequence: Synthetic oligonucleotide
gaggcccggggtttctgactattgagc

SEQ ID NO: 342367 - DNA, 27 bp, Artificial Sequence
  Description of Artificial Sequence: Synthetic oligonucleotide
aggcccggggtttctgactattgagcc

SEQ ID NO: 342368 - DNA, 26 bp, Artificial Sequence
  Description of Artificial Sequence: Synthetic oligonucleotide
ggcccggggtttctgactattgagcc

SEQ ID NO: 342369 - DNA, 26 bp, Artificial Sequence
  Description of Artificial Sequence: Synthetic oligonucleotide
gcccggggtttctgactattgagccg

SEQ ID NO: 342370 - DNA, 26 bp, Artificial Sequence
  Description of Artificial Sequence: Synthetic oligonucleotide
cccggggtttctgactattgagccgc

SEQ ID NO: 342371 - DNA, 26 bp, Artificial Sequence
  Description of Artificial Sequence: Synthetic oligonucleotide
ccggggtttctgactattgagccgcc

SEQ ID NO: 342372 - DNA, 26 bp, Artificial Sequence
  Description of Artificial Sequence: Synthetic oligonucleotide
cggggtttctgactattgagccgccg

SEQ ID NO: 342373 - DNA, 27 bp, Artificial Sequence
  Description of Artificial Sequence: Synthetic oligonucleotide
ggggtttctgactattgagccgccgga

SEQ ID NO: 342374 - DNA, 29 bp, Artificial Sequence
  Description of Artificial Sequence: Synthetic oligonucleotide
gggtttctgactattgagccgccggattc

SEQ ID NO: 342375 - DNA, 30 bp, Artificial Sequence
  Description of Artificial Sequence: Synthetic oligonucleotide
ggtttctgactattgagccgccggattcac

SEQ ID NO: 342376 - DNA, 30 bp, Artificial Sequence
  Description of Artificial Sequence: Synthetic oligonucleotide
gtttctgactattgagccgccggattcacg

SEQ ID NO: 342377 - DNA, 31 bp, Artificial Sequence
  Description of Artificial Sequence: Synthetic oligonucleotide
tttctgactattgagccgccggattcacgac

SEQ ID NO: 342378 - DNA, 30 bp, Artificial Sequence
  Description of Artificial Sequence: Synthetic oligonucleotide
ttctgactattgagccgccggattcacgac

SEQ ID NO: 342379 - DNA, 29 bp, Artificial Sequence
  Description of Artificial Sequence: Synthetic oligonucleotide
tctgactattgagccgccggattcacgac

SEQ ID NO: 342380 - DNA, 28 bp, Artificial Sequence
  Description of Artificial Sequence: Synthetic oligonucleotide
ctgactattgagccgccggattcacgac

SEQ ID NO: 342381 - DNA, 28 bp, Artificial Sequence
  Description of Artificial Sequence: Synthetic oligonucleotide
tgactattgagccgccggattcacgacc

SEQ ID NO: 342382 - DNA, 27 bp, Artificial Sequence
  Description of Artificial Sequence: Synthetic oligonucleotide
gactattgagccgccggattcacgacc

SEQ ID NO: 342383 - DNA, 28 bp, Artificial Sequence
  Description of Artificial Sequence: Synthetic oligonucleotide
actattgagccgccggattcacgacctc

SEQ ID NO: 342384 - DNA, 27 bp, Artificial Sequence
  Description of Artificial Sequence: Synthetic oligonucleotide
ctattgagccgccggattcacgacctc

SEQ ID NO: 342385 - DNA, 27 bp, Artificial Sequence
  Description of Artificial Sequence: Synthetic oligonucleotide
tattgagccgccggattcacgacctcc

SEQ ID NO: 342386 - DNA, 27 bp, Artificial Sequence
  Description of Artificial Sequence: Synthetic oligonucleotide
attgagccgccggattcacgacctcct

SEQ ID NO: 342387 - DNA, 26 bp, Artificial Sequence
  Description of Artificial Sequence: Synthetic oligonucleotide
ttgagccgccggattcacgacctcct

SEQ ID NO: 342388 - DNA, 25 bp, Artificial Sequence
  Description of Artificial Sequence: Synthetic oligonucleotide
tgagccgccggattcacgacctcct

SEQ ID NO: 342389 - DNA, 24 bp, Artificial Sequence
  Description of Artificial Sequence: Synthetic oligonucleotide
gagccgccggattcacgacctcct

SEQ ID NO: 342390 - DNA, 24 bp, Artificial Sequence
  Description of Artificial Sequence: Synthetic oligonucleotide
agccgccggattcacgacctcctg

SEQ ID NO: 342391 - DNA, 23 bp, Artificial Sequence
  Description of Artificial Sequence: Synthetic oligonucleotide
gccgccggattcacgacctcctg

SEQ ID NO: 342392 - DNA, 24 bp, Artificial Sequence
  Description of Artificial Sequence: Synthetic oligonucleotide
ccgccggattcacgacctcctggt

SEQ ID NO: 342393 - DNA, 26 bp, Artificial Sequence
  Description of Artificial Sequence: Synthetic oligonucleotide
cgccggattcacgacctcctggtgtt

SEQ ID NO: 342394 - DNA, 26 bp, Artificial Sequence
  Description of Artificial Sequence: Synthetic oligonucleotide
gccggattcacgacctcctggtgttg

SEQ ID NO: 342395 - DNA, 26 bp, Artificial Sequence
  Description of Artificial Sequence: Synthetic oligonucleotide
ccggattcacgacctcctggtgttgg

SEQ ID NO: 342396 - DNA, 26 bp, Artificial Sequence
  Description of Artificial Sequence: Synthetic oligonucleotide
cggattcacgacctcctggtgttggg

SEQ ID NO: 342397 - DNA, 27 bp, Artificial Sequence
  Description of Artificial Sequence: Synthetic oligonucleotide
ggattcacgacctcctggtgttggggt

SEQ ID NO: 342398 - DNA, 27 bp, Artificial Sequence
  Description of Artificial Sequence: Synthetic oligonucleotide
gattcacgacctcctggtgttggggtc

SEQ ID NO: 342399 - DNA, 28 bp, Artificial Sequence
  Description of Artificial Sequence: Synthetic oligonucleotide
attcacgacctcctggtgttggggtcac

SEQ ID NO: 342400 - DNA, 27 bp, Artificial Sequence
  Description of Artificial Sequence: Synthetic oligonucleotide
ttcacgacctcctggtgttggggtcac

SEQ ID NO: 342401 - DNA, 27 bp, Artificial Sequence
  Description of Artificial Sequence: Synthetic oligonucleotide
tcacgacctcctggtgttggggtcact

SEQ ID NO: 342402 - DNA, 26 bp, Artificial Sequence
  Description of Artificial Sequence: Synthetic oligonucleotide
cacgacctcctggtgttggggtcact

SEQ ID NO: 342403 - DNA, 27 bp, Artificial Sequence
  Description of Artificial Sequence: Synthetic oligonucleotide
acgacctcctggtgttggggtcactct

SEQ ID NO: 342404 - DNA, 26 bp, Artificial Sequence
  Description of Artificial Sequence: Synthetic oligonucleotide
cgacctcctggtgttggggtcactct

SEQ ID NO: 342405 - DNA, 27 bp, Artificial Sequence
  Description of Artificial Sequence: Synthetic oligonucleotide
gacctcctggtgttggggtcactctga

SEQ ID NO: 342406 - DNA, 28 bp, Artificial Sequence
  Description of Artificial Sequence: Synthetic oligonucleotide
acctcctggtgttggggtcactctgaag

SEQ ID NO: 342407 - DNA, 27 bp, Artificial Sequence
  Description of Artificial Sequence: Synthetic oligonucleotide
cctcctggtgttggggtcactctgaag

SEQ ID NO: 342408 - DNA, 27 bp, Artificial Sequence
  Description of Artificial Sequence: Synthetic oligonucleotide
ctcctggtgttggggtcactctgaagc

SEQ ID NO: 342409 - DNA, 28 bp, Artificial Sequence
  Description of Artificial Sequence: Synthetic oligonucleotide
tcctggtgttggggtcactctgaagctg

SEQ ID NO: 342410 - DNA, 27 bp, Artificial Sequence
  Description of Artificial Sequence: Synthetic oligonucleotide
cctggtgttggggtcactctgaagctg

SEQ ID NO: 342411 - DNA, 29 bp, Artificial Sequence
  Description of Artificial Sequence: Synthetic oligonucleotide
ctggtgttggggtcactctgaagctgaac

SEQ ID NO: 342412 - DNA, 31 bp, Artificial Sequence
  Description of Artificial Sequence: Synthetic oligonucleotide
tggtgttggggtcactctgaagctgaacttg

SEQ ID NO: 342413 - DNA, 30 bp, Artificial Sequence
  Description of Artificial Sequence: Synthetic oligonucleotide
ggtgttggggtcactctgaagctgaacttg

SEQ ID NO: 342414 - DNA, 30 bp, Artificial Sequence
  Description of Artificial Sequence: Synthetic oligonucleotide
gtgttggggtcactctgaagctgaacttgg

SEQ ID NO: 342415 - DNA, 30 bp, Artificial Sequence
  Description of Artificial Sequence: Synthetic oligonucleotide
tgttggggtcactctgaagctgaacttggg

SEQ ID NO: 342416 - DNA, 29 bp, Artificial Sequence
  Description of Artificial Sequence: Synthetic oligonucleotide
gttggggtcactctgaagctgaacttggg

SEQ ID NO: 342417 - DNA, 30 bp, Artificial Sequence
  Description of Artificial Sequence: Synthetic oligonucleotide
ttggggtcactctgaagctgaacttgggag

SEQ ID NO: 342418 - DNA, 29 bp, Artificial Sequence
  Description of Artificial Sequence: Synthetic oligonucleotide
tggggtcactctgaagctgaacttgggag

SEQ ID NO: 342419 - DNA, 28 bp, Artificial Sequence
  Description of Artificial Sequence: Synthetic oligonucleotide
ggggtcactctgaagctgaacttgggag

SEQ ID NO: 342420 - DNA, 28 bp, Artificial Sequence
  Description of Artificial Sequence: Synthetic oligonucleotide
gggtcactctgaagctgaacttgggagc

SEQ ID NO: 342421 - DNA, 28 bp, Artificial Sequence
  Description of Artificial Sequence: Synthetic oligonucleotide
ggtcactctgaagctgaacttgggagcc

SEQ ID NO: 342422 - DNA, 28 bp, Artificial Sequence
  Description of Artificial Sequence: Synthetic oligonucleotide
gtcactctgaagctgaacttgggagccg

SEQ ID NO: 342423 - DNA, 29 bp, Artificial Sequence
  Description of Artificial Sequence: Synthetic oligonucleotide
tcactctgaagctgaacttgggagccgtg

SEQ ID NO: 342424 - DNA, 28 bp, Artificial Sequence
  Description of Artificial Sequence: Synthetic oligonucleotide
cactctgaagctgaacttgggagccgtg

SEQ ID NO: 342425 - DNA, 28 bp, Artificial Sequence
  Description of Artificial Sequence: Synthetic oligonucleotide
actctgaagctgaacttgggagccgtgg

SEQ ID NO: 342426 - DNA, 27 bp, Artificial Sequence
  Description of Artificial Sequence: Synthetic oligonucleotide
ctctgaagctgaacttgggagccgtgg

SEQ ID NO: 342427 - DNA, 27 bp, Artificial Sequence
  Description of Artificial Sequence: Synthetic oligonucleotide
tctgaagctgaacttgggagccgtggc

SEQ ID NO: 342428 - DNA, 26 bp, Artificial Sequence
  Description of Artificial Sequence: Synthetic oligonucleotide
ctgaagctgaacttgggagccgtggc

SEQ ID NO: 342429 - DNA, 27 bp, Artificial Sequence
  Description of Artificial Sequence: Synthetic oligonucleotide
tgaagctgaacttgggagccgtggcca

SEQ ID NO: 342430 - DNA, 26 bp, Artificial Sequence
  Description of Artificial Sequence: Synthetic oligonucleotide
gaagctgaacttgggagccgtggcca

SEQ ID NO: 342431 - DNA, 27 bp, Artificial Sequence
  Description of Artificial Sequence: Synthetic oligonucleotide
aagctgaacttgggagccgtggccagt

SEQ ID NO: 342432 - DNA, 26 bp, Artificial Sequence
  Description of Artificial Sequence: Synthetic oligonucleotide
agctgaacttgggagccgtggccagt

SEQ ID NO: 342433 - DNA, 25 bp, Artificial Sequence
  Description of Artificial Sequence: Synthetic oligonucleotide
gctgaacttgggagccgtggccagt

SEQ ID NO: 342434 - DNA, 25 bp, Artificial Sequence
  Description of Artificial Sequence: Synthetic oligonucleotide
ctgaacttgggagccgtggccagtg

SEQ ID NO: 342435 - DNA, 25 bp, Artificial Sequence
  Description of Artificial Sequence: Synthetic oligonucleotide
tgaacttgggagccgtggccagtgg

SEQ ID NO: 342436 - DNA, 24 bp, Artificial Sequence
  Description of Artificial Sequence: Synthetic oligonucleotide
gaacttgggagccgtggccagtgg

SEQ ID NO: 342437 - DNA, 24 bp, Artificial Sequence
  Description of Artificial Sequence: Synthetic oligonucleotide
aacttgggagccgtggccagtggg

SEQ ID NO: 342438 - DNA, 23 bp, Artificial Sequence
  Description of Artificial Sequence: Synthetic oligonucleotide
acttgggagccgtggccagtggg

SEQ ID NO: 342439 - DNA, 22 bp, Artificial Sequence
  Description of Artificial Sequence: Synthetic oligonucleotide
cttgggagccgtggccagtggg

SEQ ID NO: 342440 - DNA, 22 bp, Artificial Sequence
  Description of Artificial Sequence: Synthetic oligonucleotide
ttgggagccgtggccagtgggg

SEQ ID NO: 342441 - DNA, 21 bp, Artificial Sequence
  Description of Artificial Sequence: Synthetic oligonucleotide
tgggagccgtggccagtgggg

SEQ ID NO: 342442 - DNA, 20 bp, Artificial Sequence
  Description of Artificial Sequence: Synthetic oligonucleotide
gggagccgtggccagtgggg

SEQ ID NO: 342443 - DNA, 20 bp, Artificial Sequence
  Description of Artificial Sequence: Synthetic oligonucleotide
ggagccgtggccagtggggc

SEQ ID NO: 342444 - DNA, 21 bp, Artificial Sequence
  Description of Artificial Sequence: Synthetic oligonucleotide
gagccgtggccagtggggcga

SEQ ID NO: 342445 - DNA, 21 bp, Artificial Sequence
  Description of Artificial Sequence: Synthetic oligonucleotide
agccgtggccagtggggcgac

SEQ ID NO: 342446 - DNA, 20 bp, Artificial Sequence
  Description of Artificial Sequence: Synthetic oligonucleotide
gccgtggccagtggggcgac

SEQ ID NO: 342447 - DNA, 24 bp, Artificial Sequence
  Description of Artificial Sequence: Synthetic oligonucleotide
ccgtggccagtggggcgacctttt

SEQ ID NO: 342448 - DNA, 25 bp, Artificial Sequence
  Description of Artificial Sequence: Synthetic oligonucleotide
cgtggccagtggggcgaccttttct

SEQ ID NO: 342449 - DNA, 27 bp, Artificial Sequence
  Description of Artificial Sequence: Synthetic oligonucleotide
gtggccagtggggcgaccttttctgat

SEQ ID NO: 342450 - DNA, 29 bp, Artificial Sequence
  Description of Artificial Sequence: Synthetic oligonucleotide
tggccagtggggcgaccttttctgattac

SEQ ID NO: 342451 - DNA, 28 bp, Artificial Sequence
  Description of Artificial Sequence: Synthetic oligonucleotide
ggccagtggggcgaccttttctgattac

SEQ ID NO: 342452 - DNA, 30 bp, Artificial Sequence
  Description of Artificial Sequence: Synthetic oligonucleotide
gccagtggggcgaccttttctgattactac

SEQ ID NO: 342453 - DNA, 32 bp, Artificial Sequence
  Description of Artificial Sequence: Synthetic oligonucleotide
ccagtggggcgaccttttctgattactacttc

SEQ ID NO: 342454 - DNA, 34 bp, Artificial Sequence
  Description of Artificial Sequence: Synthetic oligonucleotide
cagtggggcgaccttttctgattactacttcatg

SEQ ID NO: 342455 - DNA, 36 bp, Artificial Sequence
  Description of Artificial Sequence: Synthetic oligonucleotide
agtggggcgaccttttctgattactacttcatgatc

SEQ ID NO: 342456 - DNA, 35 bp, Artificial Sequence
  Description of Artificial Sequence: Synthetic oligonucleotide
gtggggcgaccttttctgattactacttcatgatc

SEQ ID NO: 342457 - DNA, 35 bp, Artificial Sequence
  Description of Artificial Sequence: Synthetic oligonucleotide
tggggcgaccttttctgattactacttcatgatcc

SEQ ID NO: 342458 - DNA, 34 bp, Artificial Sequence
  Description of Artificial Sequence: Synthetic oligonucleotide
ggggcgaccttttctgattactacttcatgatcc

SEQ ID NO: 342459 - DNA, 37 bp, Artificial Sequence
  Description of Artificial Sequence: Synthetic oligonucleotide
gggcgaccttttctgattactacttcatgatcctttc

SEQ ID NO: 342460 - DNA, 37 bp, Artificial Sequence
  Description of Artificial Sequence: Synthetic oligonucleotide
ggcgaccttttctgattactacttcatgatcctttcc

SEQ ID NO: 342461 - DNA, 37 bp, Artificial Sequence
  Description of Artificial Sequence: Synthetic oligonucleotide
gcgaccttttctgattactacttcatgatcctttccc

SEQ ID NO: 342462 - DNA, 37 bp, Artificial Sequence
  Description of Artificial Sequence: Synthetic oligonucleotide
cgaccttttctgattactacttcatgatcctttcccg

SEQ ID NO: 342463 - DNA, 38 bp, Artificial Sequence
  Description of Artificial Sequence: Synthetic oligonucleotide
gaccttttctgattactacttcatgatcctttcccgag

SEQ ID NO: 342464 - DNA, 38 bp, Artificial Sequence
  Description of Artificial Sequence: Synthetic oligonucleotide
accttttctgattactacttcatgatcctttcccgagg

SEQ ID NO: 342465 - DNA, 37 bp, Artificial Sequence
  Description of Artificial Sequence: Synthetic oligonucleotide
ccttttctgattactacttcatgatcctttcccgagg

SEQ ID NO: 342466 - DNA, 37 bp, Artificial Sequence
  Description of Artificial Sequence: Synthetic oligonucleotide
cttttctgattactacttcatgatcctttcccgaggg

SEQ ID NO: 342467 - DNA, 37 bp, Artificial Sequence
  Description of Artificial Sequence: Synthetic oligonucleotide
ttttctgattactacttcatgatcctttcccgagggg

SEQ ID NO: 342468 - DNA, 36 bp, Artificial Sequence
  Description of Artificial Sequence: Synthetic oligonucleotide
tttctgattactacttcatgatcctttcccgagggg

SEQ ID NO: 342469 - DNA, 35 bp, Artificial Sequence
  Description of Artificial Sequence: Synthetic oligonucleotide
ttctgattactacttcatgatcctttcccgagggg

SEQ ID NO: 342470 - DNA, 34 bp, Artificial Sequence
  Description of Artificial Sequence: Synthetic oligonucleotide
tctgattactacttcatgatcctttcccgagggg

SEQ ID NO: 342471 - DNA, 33 bp, Artificial Sequence
  Description of Artificial Sequence: Synthetic oligonucleotide
ctgattactacttcatgatcctttcccgagggg

SEQ ID NO: 342472 - DNA, 34 bp, Artificial Sequence
  Description of Artificial Sequence: Synthetic oligonucleotide
tgattactacttcatgatcctttcccgaggggag

SEQ ID NO: 342473 - DNA, 33 bp, Artificial Sequence
  Description of Artificial Sequence: Synthetic oligonucleotide
gattactacttcatgatcctttcccgaggggag

SEQ ID NO: 342474 - DNA, 35 bp, Artificial Sequence
  Description of Artificial Sequence: Synthetic oligonucleotide
attactacttcatgatcctttcccgaggggagatc

SEQ ID NO: 342475 - DNA, 34 bp, Artificial Sequence
  Description of Artificial Sequence: Synthetic oligonucleotide
ttactacttcatgatcctttcccgaggggagatc

SEQ ID NO: 342476 - DNA, 33 bp, Artificial Sequence
  Description of Artificial Sequence: Synthetic oligonucleotide
tactacttcatgatcctttcccgaggggagatc

SEQ ID NO: 342477 - DNA, 32 bp, Artificial Sequence
  Description of Artificial Sequence: Synthetic oligonucleotide
actacttcatgatcctttcccgaggggagatc

SEQ ID NO: 342478 - DNA, 31 bp, Artificial Sequence
  Description of Artificial Sequence: Synthetic oligonucleotide
ctacttcatgatcctttcccgaggggagatc

SEQ ID NO: 342479 - DNA, 31 bp, Artificial Sequence
  Description of Artificial Sequence: Synthetic oligonucleotide
tacttcatgatcctttcccgaggggagatcg

SEQ ID NO: 342480 - DNA, 30 bp, Artificial Sequence
  Description of Artificial Sequence: Synthetic oligonucleotide
acttcatgatcctttcccgaggggagatcg

SEQ ID NO: 342481 - DNA, 29 bp, Artificial Sequence
  Description of Artificial Sequence: Synthetic oligonucleotide
cttcatgatcctttcccgaggggagatcg

SEQ ID NO: 342482 - DNA, 30 bp, Artificial Sequence
  Description of Artificial Sequence: Synthetic oligonucleotide
ttcatgatcctttcccgaggggagatcgtg

SEQ ID NO: 342483 - DNA, 29 bp, Artificial Sequence
  Description of Artificial Sequence: Synthetic oligonucleotide
tcatgatcctttcccgaggggagatcgtg

SEQ ID NO: 342484 - DNA, 28 bp, Artificial Sequence
  Description of Artificial Sequence: Synthetic oligonucleotide
catgatcctttcccgaggggagatcgtg

SEQ ID NO: 342485 - DNA, 30 bp, Artificial Sequence
  Description of Artificial Sequence: Synthetic oligonucleotide
atgatcctttcccgaggggagatcgtgtac

SEQ ID NO: 342486 - DNA, 29 bp, Artificial Sequence
  Description of Artificial Sequence: Synthetic oligonucleotide
tgatcctttcccgaggggagatcgtgtac

SEQ ID NO: 342487 - DNA, 28 bp, Artificial Sequence
  Description of Artificial Sequence: Synthetic oligonucleotide
gatcctttcccgaggggagatcgtgtac

SEQ ID NO: 342488 - DNA, 30 bp, Artificial Sequence
  Description of Artificial Sequence: Synthetic oligonucleotide
atcctttcccgaggggagatcgtgtacatg

SEQ ID NO: 342489 - DNA, 29 bp, Artificial Sequence
  Description of Artificial Sequence: Synthetic oligonucleotide
tcctttcccgaggggagatcgtgtacatg

SEQ ID NO: 342490 - DNA, 28 bp, Artificial Sequence
  Description of Artificial Sequence: Synthetic oligonucleotide
cctttcccgaggggagatcgtgtacatg

SEQ ID NO: 342491 - DNA, 31 bp, Artificial Sequence
  Description of Artificial Sequence: Synthetic oligonucleotide
ctttcccgaggggagatcgtgtacatgaatc

SEQ ID NO: 342492 - DNA, 31 bp, Artificial Sequence
  Description of Artificial Sequence: Synthetic oligonucleotide
tttcccgaggggagatcgtgtacatgaatcg

SEQ ID NO: 342493 - DNA, 30 bp, Artificial Sequence
  Description of Artificial Sequence: Synthetic oligonucleotide
ttcccgaggggagatcgtgtacatgaatcg

SEQ ID NO: 342494 - DNA, 29 bp, Artificial Sequence
  Description of Artificial Sequence: Synthetic oligonucleotide
tcccgaggggagatcgtgtacatgaatcg

SEQ ID NO: 342495 - DNA, 28 bp, Artificial Sequence
  Description of Artificial Sequence: Synthetic oligonucleotide
cccgaggggagatcgtgtacatgaatcg

SEQ ID NO: 342496 - DNA, 29 bp, Artificial Sequence
  Description of Artificial Sequence: Synthetic oligonucleotide
ccgaggggagatcgtgtacatgaatcgtg

SEQ ID NO: 342497 - DNA, 30 bp, Artificial Sequence
  Description of Artificial Sequence: Synthetic oligonucleotide
cgaggggagatcgtgtacatgaatcgtgag

SEQ ID NO: 342498 - DNA, 30 bp, Artificial Sequence
  Description of Artificial Sequence: Synthetic oligonucleotide
gaggggagatcgtgtacatgaatcgtgagc

SEQ ID NO: 342499 - DNA, 30 bp, Artificial Sequence
  Description of Artificial Sequence: Synthetic oligonucleotide
aggggagatcgtgtacatgaatcgtgagcc

SEQ ID NO: 342500 - DNA, 29 bp, Artificial Sequence
  Description of Artificial Sequence: Synthetic oligonucleotide
ggggagatcgtgtacatgaatcgtgagcc

SEQ ID NO: 342501 - DNA, 29 bp, Artificial Sequence
  Description of Artificial Sequence: Synthetic oligonucleotide
gggagatcgtgtacatgaatcgtgagccc

SEQ ID NO: 342502 - DNA, 31 bp, Artificial Sequence
  Description of Artificial Sequence: Synthetic oligonucleotide
ggagatcgtgtacatgaatcgtgagcccaag

SEQ ID NO: 342503 - DNA, 32 bp, Artificial Sequence
  Description of Artificial Sequence: Synthetic oligonucleotide
gagatcgtgtacatgaatcgtgagcccaagtg

SEQ ID NO: 342504 - DNA, 32 bp, Artificial Sequence
  Description of Artificial Sequence: Synthetic oligonucleotide
agatcgtgtacatgaatcgtgagcccaagtgg

SEQ ID NO: 342505 - DNA, 31 bp, Artificial Sequence
  Description of Artificial Sequence: Synthetic oligonucleotide
gatcgtgtacatgaatcgtgagcccaagtgg

SEQ ID NO: 342506 - DNA, 32 bp, Artificial Sequence
  Description of Artificial Sequence: Synthetic oligonucleotide
atcgtgtacatgaatcgtgagcccaagtggac

SEQ ID NO: 342507 - DNA, 31 bp, Artificial Sequence
  Description of Artificial Sequence: Synthetic oligonucleotide
tcgtgtacatgaatcgtgagcccaagtggac

SEQ ID NO: 342508 - DNA, 30 bp, Artificial Sequence
  Description of Artificial Sequence: Synthetic oligonucleotide
cgtgtacatgaatcgtgagcccaagtggac

SEQ ID NO: 342509 - DNA, 30 bp, Artificial Sequence
  Description of Artificial Sequence: Synthetic oligonucleotide
gtgtacatgaatcgtgagcccaagtggacc

SEQ ID NO: 342510 - DNA, 30 bp, Artificial Sequence
  Description of Artificial Sequence: Synthetic oligonucleotide
tgtacatgaatcgtgagcccaagtggaccc

SEQ ID NO: 342511 - DNA, 29 bp, Artificial Sequence
  Description of Artificial Sequence: Synthetic oligonucleotide
gtacatgaatcgtgagcccaagtggaccc

SEQ ID NO: 342512 - DNA, 30 bp, Artificial Sequence
  Description of Artificial Sequence: Synthetic oligonucleotide
tacatgaatcgtgagcccaagtggaccctg

SEQ ID NO: 342513 - DNA, 29 bp, Artificial Sequence
  Description of Artificial Sequence: Synthetic oligonucleotide
acatgaatcgtgagcccaagtggaccctg

SEQ ID NO: 342514 - DNA, 28 bp, Artificial Sequence
  Description of Artificial Sequence: Synthetic oligonucleotide
catgaatcgtgagcccaagtggaccctg

SEQ ID NO: 342515 - DNA, 29 bp, Artificial Sequence
  Description of Artificial Sequence: Synthetic oligonucleotide
atgaatcgtgagcccaagtggaccctgag

SEQ ID NO: 342516 - DNA, 28 bp, Artificial Sequence
  Description of Artificial Sequence: Synthetic oligonucleotide
tgaatcgtgagcccaagtggaccctgag

SEQ ID NO: 342517 - DNA, 27 bp, Artificial Sequence
  Description of Artificial Sequence: Synthetic oligonucleotide
gaatcgtgagcccaagtggaccctgag

SEQ ID NO: 342518 - DNA, 27 bp, Artificial Sequence
  Description of Artificial Sequence: Synthetic oligonucleotide
aatcgtgagcccaagtggaccctgagc

SEQ ID NO: 342519 - DNA, 27 bp, Artificial Sequence
  Description of Artificial Sequence: Synthetic oligonucleotide
atcgtgagcccaagtggaccctgagct

SEQ ID NO: 342520 - DNA, 26 bp, Artificial Sequence
  Description of Artificial Sequence: Synthetic oligonucleotide
tcgtgagcccaagtggaccctgagct

SEQ ID NO: 342521 - DNA, 25 bp, Artificial Sequence
  Description of Artificial Sequence: Synthetic oligonucleotide
cgtgagcccaagtggaccctgagct

SEQ ID NO: 342522 - DNA, 25 bp, Artificial Sequence
  Description of Artificial Sequence: Synthetic oligonucleotide
gtgagcccaagtggaccctgagctc

SEQ ID NO: 342523 - DNA, 25 bp, Artificial Sequence
  Description of Artificial Sequence: Synthetic oligonucleotide
tgagcccaagtggaccctgagctcg

SEQ ID NO: 342524 - DNA, 24 bp, Artificial Sequence
  Description of Artificial Sequence: Synthetic oligonucleotide
gagcccaagtggaccctgagctcg

SEQ ID NO: 342525 - DNA, 25 bp, Artificial Sequence
  Description of Artificial Sequence: Synthetic oligonucleotide
agcccaagtggaccctgagctcggt

SEQ ID NO: 342526 - DNA, 24 bp, Artificial Sequence
  Description of Artificial Sequence: Synthetic oligonucleotide
gcccaagtggaccctgagctcggt

SEQ ID NO: 342527 - DNA, 25 bp, Artificial Sequence
  Description of Artificial Sequence: Synthetic oligonucleotide
cccaagtggaccctgagctcggtct

SEQ ID NO: 342528 - DNA, 25 bp, Artificial Sequence
  Description of Artificial Sequence: Synthetic oligonucleotide
ccaagtggaccctgagctcggtctc

SEQ ID NO: 342529 - DNA, 25 bp, Artificial Sequence
  Description of Artificial Sequence: Synthetic oligonucleotide
caagtggaccctgagctcggtctcc

SEQ ID NO: 342530 - DNA, 26 bp, Artificial Sequence
  Description of Artificial Sequence: Synthetic oligonucleotide
aagtggaccctgagctcggtctccgt

SEQ ID NO: 342531 - DNA, 25 bp, Artificial Sequence
  Description of Artificial Sequence: Synthetic oligonucleotide
agtggaccctgagctcggtctccgt

SEQ ID NO: 342532 - DNA, 24 bp, Artificial Sequence
  Description of Artificial Sequence: Synthetic oligonucleotide
gtggaccctgagctcggtctccgt

SEQ ID NO: 342533 - DNA, 27 bp, Artificial Sequence
  Description of Artificial Sequence: Synthetic oligonucleotide
tggaccctgagctcggtctccgtgttt

SEQ ID NO: 342534 - DNA, 26 bp, Artificial Sequence
  Description of Artificial Sequence: Synthetic oligonucleotide
ggaccctgagctcggtctccgtgttt

SEQ ID NO: 342535 - DNA, 27 bp, Artificial Sequence
  Description of Artificial Sequence: Synthetic oligonucleotide
gaccctgagctcggtctccgtgtttgt

SEQ ID NO: 342536 - DNA, 27 bp, Artificial Sequence
  Description of Artificial Sequence: Synthetic oligonucleotide
accctgagctcggtctccgtgtttgtg

SEQ ID NO: 342537 - DNA, 26 bp, Artificial Sequence
  Description of Artificial Sequence: Synthetic oligonucleotide
ccctgagctcggtctccgtgtttgtg

SEQ ID NO: 342538 - DNA, 27 bp, Artificial Sequence
  Description of Artificial Sequence: Synthetic oligonucleotide
cctgagctcggtctccgtgtttgtgca

SEQ ID NO: 342539 - DNA, 27 bp, Artificial Sequence
  Description of Artificial Sequence: Synthetic oligonucleotide
ctgagctcggtctccgtgtttgtgcac

SEQ ID NO: 342540 - DNA, 27 bp, Artificial Sequence
  Description of Artificial Sequence: Synthetic oligonucleotide
tgagctcggtctccgtgtttgtgcacc

SEQ ID NO: 342541 - DNA, 27 bp, Artificial Sequence
  Description of Artificial Sequence: Synthetic oligonucleotide
gagctcggtctccgtgtttgtgcacca

SEQ ID NO: 342542 - DNA, 28 bp, Artificial Sequence
  Description of Artificial Sequence: Synthetic oligonucleotide
agctcggtctccgtgtttgtgcaccatc

SEQ ID NO: 342543 - DNA, 27 bp, Artificial Sequence
  Description of Artificial Sequence: Synthetic oligonucleotide
gctcggtctccgtgtttgtgcaccatc

SEQ ID NO: 342544 - DNA, 28 bp, Artificial Sequence
  Description of Artificial Sequence: Synthetic oligonucleotide
ctcggtctccgtgtttgtgcaccatcac

SEQ ID NO: 342545 - DNA, 28 bp, Artificial Sequence
  Description of Artificial Sequence: Synthetic oligonucleotide
tcggtctccgtgtttgtgcaccatcacc

SEQ ID NO: 342546 - DNA, 27 bp, Artificial Sequence
  Description of Artificial Sequence: Synthetic oligonucleotide
cggtctccgtgtttgtgcaccatcacc

SEQ ID NO: 342547 - DNA, 28 bp, Artificial Sequence
  Description of Artificial Sequence: Synthetic oligonucleotide
ggtctccgtgtttgtgcaccatcaccag

SEQ ID NO: 342548 - DNA, 28 bp, Artificial Sequence
  Description of Artificial Sequence: Synthetic oligonucleotide
gtctccgtgtttgtgcaccatcaccagg

SEQ ID NO: 342549 - DNA, 28 bp, Artificial Sequence
  Description of Artificial Sequence: Synthetic oligonucleotide
tctccgtgtttgtgcaccatcaccaggc

SEQ ID NO: 342550 - DNA, 27 bp, Artificial Sequence
  Description of Artificial Sequence: Synthetic oligonucleotide
ctccgtgtttgtgcaccatcaccaggc

SEQ ID NO: 342551 - DNA, 28 bp, Artificial Sequence
  Description of Artificial Sequence: Synthetic oligonucleotide
tccgtgtttgtgcaccatcaccaggcac

SEQ ID NO: 342552 - DNA, 27 bp, Artificial Sequence
  Description of Artificial Sequence: Synthetic oligonucleotide
ccgtgtttgtgcaccatcaccaggcac

SEQ ID NO: 342553 - DNA, 27 bp, Artificial Sequence
  Description of Artificial Sequence: Synthetic oligonucleotide
cgtgtttgtgcaccatcaccaggcacc

SEQ ID NO: 342554 - DNA, 27 bp, Artificial Sequence
  Description of Artificial Sequence: Synthetic oligonucleotide
gtgtttgtgcaccatcaccaggcaccc

SEQ ID NO: 342555 - DNA, 28 bp, Artificial Sequence
  Description of Artificial Sequence: Synthetic oligonucleotide
tgtttgtgcaccatcaccaggcaccctc

SEQ ID NO: 342556 - DNA, 27 bp, Artificial Sequence
  Description of Artificial Sequence: Synthetic oligonucleotide
gtttgtgcaccatcaccaggcaccctc

SEQ ID NO: 342557 - DNA, 27 bp, Artificial Sequence
  Description of Artificial Sequence: Synthetic oligonucleotide
tttgtgcaccatcaccaggcaccctcg

SEQ ID NO: 342558 - DNA, 27 bp, Artificial Sequence
  Description of Artificial Sequence: Synthetic oligonucleotide
ttgtgcaccatcaccaggcaccctcgt

SEQ ID NO: 342559 - DNA, 27 bp, Artificial Sequence
  Description of Artificial Sequence: Synthetic oligonucleotide
tgtgcaccatcaccaggcaccctcgtt

SEQ ID NO: 342560 - DNA, 26 bp, Artificial Sequence
  Description of Artificial Sequence: Synthetic oligonucleotide
gtgcaccatcaccaggcaccctcgtt

SEQ ID NO: 342561 - DNA, 27 bp, Artificial Sequence
  Description of Artificial Sequence: Synthetic oligonucleotide
tgcaccatcaccaggcaccctcgttct

SEQ ID NO: 342562 - DNA, 27 bp, Artificial Sequence
  Description of Artificial Sequence: Synthetic oligonucleotide
gcaccatcaccaggcaccctcgttcta

SEQ ID NO: 342563 - DNA, 27 bp, Artificial Sequence
  Description of Artificial Sequence: Synthetic oligonucleotide
caccatcaccaggcaccctcgttctac

SEQ ID NO: 342564 - DNA, 30 bp, Artificial Sequence
  Description of Artificial Sequence: Synthetic oligonucleotide
accatcaccaggcaccctcgttctactttc

SEQ ID NO: 342565 - DNA, 29 bp, Artificial Sequence
  Description of Artificial Sequence: Synthetic oligonucleotide
ccatcaccaggcaccctcgttctactttc

SEQ ID NO: 342566 - DNA, 30 bp, Artificial Sequence
  Description of Artificial Sequence: Synthetic oligonucleotide
catcaccaggcaccctcgttctactttctg

SEQ ID NO: 342567 - DNA, 30 bp, Artificial Sequence
  Description of Artificial Sequence: Synthetic oligonucleotide
atcaccaggcaccctcgttctactttctgg

SEQ ID NO: 342568 - DNA, 29 bp, Artificial Sequence
  Description of Artificial Sequence: Synthetic oligonucleotide
tcaccaggcaccctcgttctactttctgg

SEQ ID NO: 342569 - DNA, 28 bp, Artificial Sequence
  Description of Artificial Sequence: Synthetic oligonucleotide
caccaggcaccctcgttctactttctgg

SEQ ID NO: 342570 - DNA, 28 bp, Artificial Sequence
  Description of Artificial Sequence: Synthetic oligonucleotide
accaggcaccctcgttctactttctggc

SEQ ID NO: 342571 - DNA, 27 bp, Artificial Sequence
  Description of Artificial Sequence: Synthetic oligonucleotide
ccaggcaccctcgttctactttctggc

SEQ ID NO: 342572 - DNA, 27 bp, Artificial Sequence
  Description of Artificial Sequence: Synthetic oligonucleotide
caggcaccctcgttctactttctggcc

SEQ ID NO: 342573 - DNA, 29 bp, Artificial Sequence
  Description of Artificial Sequence: Synthetic oligonucleotide
aggcaccctcgttctactttctggccttc

SEQ ID NO: 342574 - DNA, 28 bp, Artificial Sequence
  Description of Artificial Sequence: Synthetic oligonucleotide
ggcaccctcgttctactttctggccttc

SEQ ID NO: 342575 - DNA, 30 bp, Artificial Sequence
  Description of Artificial Sequence: Synthetic oligonucleotide
gcaccctcgttctactttctggccttcttc

SEQ ID NO: 342576 - DNA, 32 bp, Artificial Sequence
  Description of Artificial Sequence: Synthetic oligonucleotide
caccctcgttctactttctggccttcttctac

SEQ ID NO: 342577 - DNA, 32 bp, Artificial Sequence
  Description of Artificial Sequence: Synthetic oligonucleotide
accctcgttctactttctggccttcttctacc

SEQ ID NO: 342578 - DNA, 31 bp, Artificial Sequence
  Description of Artificial Sequence: Synthetic oligonucleotide
ccctcgttctactttctggccttcttctacc

SEQ ID NO: 342579 - DNA, 33 bp, Artificial Sequence
  Description of Artificial Sequence: Synthetic oligonucleotide
cctcgttctactttctggccttcttctaccatg

SEQ ID NO: 342580 - DNA, 33 bp, Artificial Sequence
  Description of Artificial Sequence: Synthetic oligonucleotide
ctcgttctactttctggccttcttctaccatgg

SEQ ID NO: 342581 - DNA, 34 bp, Artificial Sequence
  Description of Artificial Sequence: Synthetic oligonucleotide
tcgttctactttctggccttcttctaccatggtg

SEQ ID NO: 342582 - DNA, 33 bp, Artificial Sequence
  Description of Artificial Sequence: Synthetic oligonucleotide
cgttctactttctggccttcttctaccatggtg

SEQ ID NO: 342583 - DNA, 34 bp, Artificial Sequence
  Description of Artificial Sequence: Synthetic oligonucleotide
gttctactttctggccttcttctaccatggtgac

SEQ ID NO: 342584 - DNA, 34 bp, Artificial Sequence
  Description of Artificial Sequence: Synthetic oligonucleotide
ttctactttctggccttcttctaccatggtgacc

SEQ ID NO: 342585 - DNA, 33 bp, Artificial Sequence
  Description of Artificial Sequence: Synthetic oligonucleotide
tctactttctggccttcttctaccatggtgacc

SEQ ID NO: 342586 - DNA, 32 bp, Artificial Sequence
  Description of Artificial Sequence: Synthetic oligonucleotide
ctactttctggccttcttctaccatggtgacc

SEQ ID NO: 342587 - DNA, 33 bp, Artificial Sequence
  Description of Artificial Sequence: Synthetic oligonucleotide
tactttctggccttcttctaccatggtgaccac

SEQ ID NO: 342588 - DNA, 32 bp, Artificial Sequence
  Description of Artificial Sequence: Synthetic oligonucleotide
actttctggccttcttctaccatggtgaccac

SEQ ID NO: 342589 - DNA, 31 bp, Artificial Sequence
  Description of Artificial Sequence: Synthetic oligonucleotide
ctttctggccttcttctaccatggtgaccac

SEQ ID NO: 342590 - DNA, 31 bp, Artificial Sequence
  Description of Artificial Sequence: Synthetic oligonucleotide
tttctggccttcttctaccatggtgaccacc

SEQ ID NO: 342591 - DNA, 30 bp, Artificial Sequence
  Description of Artificial Sequence: Synthetic oligonucleotide
ttctggccttcttctaccatggtgaccacc

SEQ ID NO: 342592 - DNA, 29 bp, Artificial Sequence
  Description of Artificial Sequence: Synthetic oligonucleotide
tctggccttcttctaccatggtgaccacc

SEQ ID NO: 342593 - DNA, 28 bp, Artificial Sequence
  Description of Artificial Sequence: Synthetic oligonucleotide
ctggccttcttctaccatggtgaccacc

SEQ ID NO: 342594 - DNA, 28 bp, Artificial Sequence
  Description of Artificial Sequence: Synthetic oligonucleotide
tggccttcttctaccatggtgaccaccc

SEQ ID NO: 342595 - DNA, 27 bp, Artificial Sequence
  Description of Artificial Sequence: Synthetic oligonucleotide
ggccttcttctaccatggtgaccaccc

SEQ ID NO: 342596 - DNA, 28 bp, Artificial Sequence
  Description of Artificial Sequence: Synthetic oligonucleotide
gccttcttctaccatggtgaccacccac

SEQ ID NO: 342597 - DNA, 29 bp, Artificial Sequence
  Description of Artificial Sequence: Synthetic oligonucleotide
ccttcttctaccatggtgaccacccactg

SEQ ID NO: 342598 - DNA, 29 bp, Artificial Sequence
  Description of Artificial Sequence: Synthetic oligonucleotide
cttcttctaccatggtgaccacccactgg

SEQ ID NO: 342599 - DNA, 29 bp, Artificial Sequence
  Description of Artificial Sequence: Synthetic oligonucleotide
ttcttctaccatggtgaccacccactggc

SEQ ID NO: 342600 - DNA, 28 bp, Artificial Sequence
  Description of Artificial Sequence: Synthetic oligonucleotide
tcttctaccatggtgaccacccactggc

SEQ ID NO: 342601 - DNA, 27 bp, Artificial Sequence
  Description of Artificial Sequence: Synthetic oligonucleotide
cttctaccatggtgaccacccactggc

SEQ ID NO: 342602 - DNA, 27 bp, Artificial Sequence
  Description of Artificial Sequence: Synthetic oligonucleotide
ttctaccatggtgaccacccactggcc

SEQ ID NO: 342603 - DNA, 27 bp, Artificial Sequence
  Description of Artificial Sequence: Synthetic oligonucleotide
tctaccatggtgaccacccactggcca

SEQ ID NO: 342604 - DNA, 27 bp, Artificial Sequence
  Description of Artificial Sequence: Synthetic oligonucleotide
ctaccatggtgaccacccactggccaa

SEQ ID NO: 342605 - DNA, 27 bp, Artificial Sequence
  Description of Artificial Sequence: Synthetic oligonucleotide
taccatggtgaccacccactggccaac

SEQ ID NO: 342606 - DNA, 27 bp, Artificial Sequence
  Description of Artificial Sequence: Synthetic oligonucleotide
accatggtgaccacccactggccaact

SEQ ID NO: 342607 - DNA, 26 bp, Artificial Sequence
  Description of Artificial Sequence: Synthetic oligonucleotide
ccatggtgaccacccactggccaact

SEQ ID NO: 342608 - DNA, 26 bp, Artificial Sequence
  Description of Artificial Sequence: Synthetic oligonucleotide
catggtgaccacccactggccaactg

SEQ ID NO: 342609 - DNA, 26 bp, Artificial Sequence
  Description of Artificial Sequence: Synthetic oligonucleotide
atggtgaccacccactggccaactgc

SEQ ID NO: 342610 - DNA, 25 bp, Artificial Sequence
  Description of Artificial Sequence: Synthetic oligonucleotide
tggtgaccacccactggccaactgc

SEQ ID NO: 342611 - DNA, 24 bp, Artificial Sequence
  Description of Artificial Sequence: Synthetic oligonucleotide
ggtgaccacccactggccaactgc

SEQ ID NO: 342612 - DNA, 25 bp, Artificial Sequence
  Description of Artificial Sequence: Synthetic oligonucleotide
gtgaccacccactggccaactgcct

SEQ ID NO: 342613 - DNA, 25 bp, Artificial Sequence
  Description of Artificial Sequence: Synthetic oligonucleotide
tgaccacccactggccaactgcctg

SEQ ID NO: 342614 - DNA, 24 bp, Artificial Sequence
  Description of Artificial Sequence: Synthetic oligonucleotide
gaccacccactggccaactgcctg

SEQ ID NO: 342615 - DNA, 24 bp, Artificial Sequence
  Description of Artificial Sequence: Synthetic oligonucleotide
accacccactggccaactgcctgc

SEQ ID NO: 342616 - DNA, 23 bp, Artificial Sequence
  Description of Artificial Sequence: Synthetic oligonucleotide
ccacccactggccaactgcctgc

SEQ ID NO: 342617 - DNA, 24 bp, Artificial Sequence
  Description of Artificial Sequence: Synthetic oligonucleotide
cacccactggccaactgcctgcga

SEQ ID NO: 342618 - DNA, 25 bp, Artificial Sequence
  Description of Artificial Sequence: Synthetic oligonucleotide
acccactggccaactgcctgcgagt

SEQ ID NO: 342619 - DNA, 24 bp, Artificial Sequence
  Description of Artificial Sequence: Synthetic oligonucleotide
cccactggccaactgcctgcgagt

SEQ ID NO: 342620 - DNA, 24 bp, Artificial Sequence
  Description of Artificial Sequence: Synthetic oligonucleotide
ccactggccaactgcctgcgagtc

SEQ ID NO: 342621 - DNA, 26 bp, Artificial Sequence
  Description of Artificial Sequence: Synthetic oligonucleotide
cactggccaactgcctgcgagtcgat

SEQ ID NO: 342622 - DNA, 27 bp, Artificial Sequence
  Description of Artificial Sequence: Synthetic oligonucleotide
actggccaactgcctgcgagtcgatgt

SEQ ID NO: 342623 - DNA, 26 bp, Artificial Sequence
  Description of Artificial Sequence: Synthetic oligonucleotide
ctggccaactgcctgcgagtcgatgt

SEQ ID NO: 342624 - DNA, 26 bp, Artificial Sequence
  Description of Artificial Sequence: Synthetic oligonucleotide
tggccaactgcctgcgagtcgatgtc

SEQ ID NO: 342625 - DNA, 25 bp, Artificial Sequence
  Description of Artificial Sequence: Synthetic oligonucleotide
ggccaactgcctgcgagtcgatgtc

SEQ ID NO: 342626 - DNA, 26 bp, Artificial Sequence
  Description of Artificial Sequence: Synthetic oligonucleotide
gccaactgcctgcgagtcgatgtcca

SEQ ID NO: 342627 - DNA, 26 bp, Artificial Sequence
  Description of Artificial Sequence: Synthetic oligonucleotide
ccaactgcctgcgagtcgatgtccag

SEQ ID NO: 342628 - DNA, 26 bp, Artificial Sequence
  Description of Artificial Sequence: Synthetic oligonucleotide
caactgcctgcgagtcgatgtccagc

SEQ ID NO: 342629 - DNA, 27 bp, Artificial Sequence
  Description of Artificial Sequence: Synthetic oligonucleotide
aactgcctgcgagtcgatgtccagcct

SEQ ID NO: 342630 - DNA, 26 bp, Artificial Sequence
  Description of Artificial Sequence: Synthetic oligonucleotide
actgcctgcgagtcgatgtccagcct

SEQ ID NO: 342631 - DNA, 25 bp, Artificial Sequence
  Description of Artificial Sequence: Synthetic oligonucleotide
ctgcctgcgagtcgatgtccagcct

SEQ ID NO: 342632 - DNA, 25 bp, Artificial Sequence
  Description of Artificial Sequence: Synthetic oligonucleotide
tgcctgcgagtcgatgtccagcctg

SEQ ID NO: 342633 - DNA, 24 bp, Artificial Sequence
  Description of Artificial Sequence: Synthetic oligonucleotide
gcctgcgagtcgatgtccagcctg

SEQ ID NO: 342634 - DNA, 24 bp, Artificial Sequence
  Description of Artificial Sequence: Synthetic oligonucleotide
cctgcgagtcgatgtccagcctgg

SEQ ID NO: 342635 - DNA, 24 bp, Artificial Sequence
  Description of Artificial Sequence: Synthetic oligonucleotide
ctgcgagtcgatgtccagcctggg

SEQ ID NO: 342636 - DNA, 24 bp, Artificial Sequence
  Description of Artificial Sequence: Synthetic oligonucleotide
tgcgagtcgatgtccagcctgggg

SEQ ID NO: 342637 - DNA, 23 bp, Artificial Sequence
  Description of Artificial Sequence: Synthetic oligonucleotide
gcgagtcgatgtccagcctgggg

SEQ ID NO: 342638 - DNA, 23 bp, Artificial Sequence
  Description of Artificial Sequence: Synthetic oligonucleotide
cgagtcgatgtccagcctggggc

SEQ ID NO: 342639 - DNA, 24 bp, Artificial Sequence
  Description of Artificial Sequence: Synthetic oligonucleotide
gagtcgatgtccagcctggggcct

SEQ ID NO: 342640 - DNA, 24 bp, Artificial Sequence
  Description of Artificial Sequence: Synthetic oligonucleotide
agtcgatgtccagcctggggcctc

SEQ ID NO: 342641 - DNA, 23 bp, Artificial Sequence
  Description of Artificial Sequence: Synthetic oligonucleotide
gtcgatgtccagcctggggcctc

SEQ ID NO: 342642 - DNA, 23 bp, Artificial Sequence
  Description of Artificial Sequence: Synthetic oligonucleotide
tcgatgtccagcctggggcctcc

SEQ ID NO: 342643 - DNA, 22 bp, Artificial Sequence
  Description of Artificial Sequence: Synthetic oligonucleotide
cgatgtccagcctggggcctcc

SEQ ID NO: 342644 - DNA, 23 bp, Artificial Sequence
  Description of Artificial Sequence: Synthetic oligonucleotide
gatgtccagcctggggcctccga

SEQ ID NO: 342645 - DNA, 23 bp, Artificial Sequence
  Description of Artificial Sequence: Synthetic oligonucleotide
atgtccagcctggggcctccgag

SEQ ID NO: 342646 - DNA, 22 bp, Artificial Sequence
  Description of Artificial Sequence: Synthetic oligonucleotide
tgtccagcctggggcctccgag

SEQ ID NO: 342647 - DNA, 21 bp, Artificial Sequence
  Description of Artificial Sequence: Synthetic oligonucleotide
gtccagcctggggcctccgag

SEQ ID NO: 342648 - DNA, 21 bp, Artificial Sequence
  Description of Artificial Sequence: Synthetic oligonucleotide
tccagcctggggcctccgagg

SEQ ID NO: 342649 - DNA, 20 bp, Artificial Sequence
  Description of Artificial Sequence: Synthetic oligonucleotide
ccagcctggggcctccgagg

SEQ ID NO: 342650 - DNA, 20 bp, Artificial Sequence
  Description of Artificial Sequence: Synthetic oligonucleotide
cagcctggggcctccgaggg

SEQ ID NO: 342651 - DNA, 22 bp, Artificial Sequence
  Description of Artificial Sequence: Synthetic oligonucleotide
agcctggggcctccgagggcaa

SEQ ID NO: 342652 - DNA, 21 bp, Artificial Sequence
  Description of Artificial Sequence: Synthetic oligonucleotide
gcctggggcctccgagggcaa

SEQ ID NO: 342653 - DNA, 21 bp, Artificial Sequence
  Description of Artificial Sequence: Synthetic oligonucleotide
cctggggcctccgagggcaac

SEQ ID NO: 342654 - DNA, 22 bp, Artificial Sequence
  Description of Artificial Sequence: Synthetic oligonucleotide
ctggggcctccgagggcaacct

SEQ ID NO: 342655 - DNA, 22 bp, Artificial Sequence
  Description of Artificial Sequence: Synthetic oligonucleotide
tggggcctccgagggcaacctg

SEQ ID NO: 342656 - DNA, 21 bp, Artificial Sequence
  Description of Artificial Sequence: Synthetic oligonucleotide
ggggcctccgagggcaacctg

SEQ ID NO: 342657 - DNA, 22 bp, Artificial Sequence
  Description of Artificial Sequence: Synthetic oligonucleotide
gggcctccgagggcaacctgga

SEQ ID NO: 342658 - DNA, 22 bp, Artificial Sequence
  Description of Artificial Sequence: Synthetic oligonucleotide
ggcctccgagggcaacctggag

SEQ ID NO: 342659 - DNA, 23 bp, Artificial Sequence
  Description of Artificial Sequence: Synthetic oligonucleotide
gcctccgagggcaacctggagct

SEQ ID NO: 342660 - DNA, 24 bp, Artificial Sequence
  Description of Artificial Sequence: Synthetic oligonucleotide
cctccgagggcaacctggagctct

SEQ ID NO: 342661 - DNA, 24 bp, Artificial Sequence
  Description of Artificial Sequence: Synthetic oligonucleotide
ctccgagggcaacctggagctctg

SEQ ID NO: 342662 - DNA, 24 bp, Artificial Sequence
  Description of Artificial Sequence: Synthetic oligonucleotide
tccgagggcaacctggagctctgc

SEQ ID NO: 342663 - DNA, 23 bp, Artificial Sequence
  Description of Artificial Sequence: Synthetic oligonucleotide
ccgagggcaacctggagctctgc

SEQ ID NO: 342664 - DNA, 24 bp, Artificial Sequence
  Description of Artificial Sequence: Synthetic oligonucleotide
cgagggcaacctggagctctgcgt

SEQ ID NO: 342665 - DNA, 24 bp, Artificial Sequence
  Description of Artificial Sequence: Synthetic oligonucleotide
gagggcaacctggagctctgcgtg

SEQ ID NO: 342666 - DNA, 25 bp, Artificial Sequence
  Description of Artificial Sequence: Synthetic oligonucleotide
agggcaacctggagctctgcgtgga

SEQ ID NO: 342667 - DNA, 24 bp, Artificial Sequence
  Description of Artificial Sequence: Synthetic oligonucleotide
gggcaacctggagctctgcgtgga

SEQ ID NO: 342668 - DNA, 24 bp, Artificial Sequence
  Description of Artificial Sequence: Synthetic oligonucleotide
ggcaacctggagctctgcgtggac

SEQ ID NO: 342669 - DNA, 24 bp, Artificial Sequence
  Description of Artificial Sequence: Synthetic oligonucleotide
gcaacctggagctctgcgtggacg

SEQ ID NO: 342670 - DNA, 25 bp, Artificial Sequence
  Description of Artificial Sequence: Synthetic oligonucleotide
caacctggagctctgcgtggacgct

SEQ ID NO: 342671 - DNA, 25 bp, Artificial Sequence
  Description of Artificial Sequence: Synthetic oligonucleotide
aacctggagctctgcgtggacgctg

SEQ ID NO: 342672 - DNA, 24 bp, Artificial Sequence
  Description of Artificial Sequence: Synthetic oligonucleotide
acctggagctctgcgtggacgctg

SEQ ID NO: 342673 - DNA, 23 bp, Artificial Sequence
  Description of Artificial Sequence: Synthetic oligonucleotide
cctggagctctgcgtggacgctg

SEQ ID NO: 342674 - DNA, 23 bp, Artificial Sequence
  Description of Artificial Sequence: Synthetic oligonucleotide
ctggagctctgcgtggacgctgc

SEQ ID NO: 342675 - DNA, 25 bp, Artificial Sequence
  Description of Artificial Sequence: Synthetic oligonucleotide
tggagctctgcgtggacgctgccaa

SEQ ID NO: 342676 - DNA, 24 bp, Artificial Sequence
  Description of Artificial Sequence: Synthetic oligonucleotide
ggagctctgcgtggacgctgccaa

SEQ ID NO: 342677 - DNA, 24 bp, Artificial Sequence
  Description of Artificial Sequence: Synthetic oligonucleotide
gagctctgcgtggacgctgccaag

SEQ ID NO: 342678 - DNA, 25 bp, Artificial Sequence
  Description of Artificial Sequence: Synthetic oligonucleotide
agctctgcgtggacgctgccaagca

SEQ ID NO: 342679 - DNA, 24 bp, Artificial Sequence
  Description of Artificial Sequence: Synthetic oligonucleotide
gctctgcgtggacgctgccaagca

SEQ ID NO: 342680 - DNA, 26 bp, Artificial Sequence
  Description of Artificial Sequence: Synthetic oligonucleotide
ctctgcgtggacgctgccaagcacta

SEQ ID NO: 342681 - DNA, 26 bp, Artificial Sequence
  Description of Artificial Sequence: Synthetic oligonucleotide
tctgcgtggacgctgccaagcactac

SEQ ID NO: 342682 - DNA, 25 bp, Artificial Sequence
  Description of Artificial Sequence: Synthetic oligonucleotide
ctgcgtggacgctgccaagcactac

SEQ ID NO: 342683 - DNA, 25 bp, Artificial Sequence
  Description of Artificial Sequence: Synthetic oligonucleotide
tgcgtggacgctgccaagcactacc

SEQ ID NO: 342684 - DNA, 24 bp, Artificial Sequence
  Description of Artificial Sequence: Synthetic oligonucleotide
gcgtggacgctgccaagcactacc

SEQ ID NO: 342685 - DNA, 24 bp, Artificial Sequence
  Description of Artificial Sequence: Synthetic oligonucleotide
cgtggacgctgccaagcactaccg

SEQ ID NO: 342686 - DNA, 26 bp, Artificial Sequence
  Description of Artificial Sequence: Synthetic oligonucleotide
gtggacgctgccaagcactaccggaa

SEQ ID NO: 342687 - DNA, 26 bp, Artificial Sequence
  Description of Artificial Sequence: Synthetic oligonucleotide
tggacgctgccaagcactaccggaac

SEQ ID NO: 342688 - DNA, 25 bp, Artificial Sequence
  Description of Artificial Sequence: Synthetic oligonucleotide
ggacgctgccaagcactaccggaac

SEQ ID NO: 342689 - DNA, 25 bp, Artificial Sequence
  Description of Artificial Sequence: Synthetic oligonucleotide
gacgctgccaagcactaccggaacc

SEQ ID NO: 342690 - DNA, 25 bp, Artificial Sequence
  Description of Artificial Sequence: Synthetic oligonucleotide
acgctgccaagcactaccggaaccg

SEQ ID NO: 342691 - DNA, 24 bp, Artificial Sequence
  Description of Artificial Sequence: Synthetic oligonucleotide
cgctgccaagcactaccggaaccg

SEQ ID NO: 342692 - DNA, 24 bp, Artificial Sequence
  Description of Artificial Sequence: Synthetic oligonucleotide
gctgccaagcactaccggaaccgg

SEQ ID NO: 342693 - DNA, 25 bp, Artificial Sequence
  Description of Artificial Sequence: Synthetic oligonucleotide
ctgccaagcactaccggaaccggga

SEQ ID NO: 342694 - DNA, 26 bp, Artificial Sequence
  Description of Artificial Sequence: Synthetic oligonucleotide
tgccaagcactaccggaaccgggagt

SEQ ID NO: 342695 - DNA, 25 bp, Artificial Sequence
  Description of Artificial Sequence: Synthetic oligonucleotide
gccaagcactaccggaaccgggagt

SEQ ID NO: 342696 - DNA, 25 bp, Artificial Sequence
  Description of Artificial Sequence: Synthetic oligonucleotide
ccaagcactaccggaaccgggagtc

SEQ ID NO: 342697 - DNA, 25 bp, Artificial Sequence
  Description of Artificial Sequence: Synthetic oligonucleotide
caagcactaccggaaccgggagtcc

SEQ ID NO: 342698 - DNA, 26 bp, Artificial Sequence
  Description of Artificial Sequence: Synthetic oligonucleotide
aagcactaccggaaccgggagtccga

SEQ ID NO: 342699 - DNA, 25 bp, Artificial Sequence
  Description of Artificial Sequence: Synthetic oligonucleotide
agcactaccggaaccgggagtccga

SEQ ID NO: 342700 - DNA, 24 bp, Artificial Sequence
  Description of Artificial Sequence: Synthetic oligonucleotide
gcactaccggaaccgggagtccga

SEQ ID NO: 342701 - DNA, 26 bp, Artificial Sequence
  Description of Artificial Sequence: Synthetic oligonucleotide
cactaccggaaccgggagtccgagaa

SEQ ID NO: 342702 - DNA, 26 bp, Artificial Sequence
  Description of Artificial Sequence: Synthetic oligonucleotide
actaccggaaccgggagtccgagaag

SEQ ID NO: 342703 - DNA, 25 bp, Artificial Sequence
  Description of Artificial Sequence: Synthetic oligonucleotide
ctaccggaaccgggagtccgagaag

SEQ ID NO: 342704 - DNA, 26 bp, Artificial Sequence
  Description of Artificial Sequence: Synthetic oligonucleotide
taccggaaccgggagtccgagaagct

SEQ ID NO: 342705 - DNA, 25 bp, Artificial Sequence
  Description of Artificial Sequence: Synthetic oligonucleotide
accggaaccgggagtccgagaagct

SEQ ID NO: 342706 - DNA, 24 bp, Artificial Sequence
  Description of Artificial Sequence: Synthetic oligonucleotide
ccggaaccgggagtccgagaagct

SEQ ID NO: 342707 - DNA, 24 bp, Artificial Sequence
  Description of Artificial Sequence: Synthetic oligonucleotide
cggaaccgggagtccgagaagctc

SEQ ID NO: 342708 - DNA, 25 bp, Artificial Sequence
  Description of Artificial Sequence: Synthetic oligonucleotide
ggaaccgggagtccgagaagctcca

SEQ ID NO: 342709 - DNA, 27 bp, Artificial Sequence
  Description of Artificial Sequence: Synthetic oligonucleotide
gaaccgggagtccgagaagctccagtt

SEQ ID NO: 342710 - DNA, 28 bp, Artificial Sequence
  Description of Artificial Sequence: Synthetic oligonucleotide
aaccgggagtccgagaagctccagttag

SEQ ID NO: 342711 - DNA, 27 bp, Artificial Sequence
  Description of Artificial Sequence: Synthetic oligonucleotide
accgggagtccgagaagctccagttag

SEQ ID NO: 342712 - DNA, 27 bp, Artificial Sequence
  Description of Artificial Sequence: Synthetic oligonucleotide
ccgggagtccgagaagctccagttaga

SEQ ID NO: 342713 - DNA, 29 bp, Artificial Sequence
  Description of Artificial Sequence: Synthetic oligonucleotide
cgggagtccgagaagctccagttagaaac

SEQ ID NO: 342714 - DNA, 29 bp, Artificial Sequence
  Description of Artificial Sequence: Synthetic oligonucleotide
gggagtccgagaagctccagttagaaacc

SEQ ID NO: 342715 - DNA, 29 bp, Artificial Sequence
  Description of Artificial Sequence: Synthetic oligonucleotide
ggagtccgagaagctccagttagaaaccc

SEQ ID NO: 342716 - DNA, 30 bp, Artificial Sequence
  Description of Artificial Sequence: Synthetic oligonucleotide
gagtccgagaagctccagttagaaacccac

SEQ ID NO: 342717 - DNA, 31 bp, Artificial Sequence
  Description of Artificial Sequence: Synthetic oligonucleotide
agtccgagaagctccagttagaaacccactc

SEQ ID NO: 342718 - DNA, 30 bp, Artificial Sequence
  Description of Artificial Sequence: Synthetic oligonucleotide
gtccgagaagctccagttagaaacccactc

SEQ ID NO: 342719 - DNA, 30 bp, Artificial Sequence
  Description of Artificial Sequence: Synthetic oligonucleotide
tccgagaagctccagttagaaacccactcc

SEQ ID NO: 342720 - DNA, 29 bp, Artificial Sequence
  Description of Artificial Sequence: Synthetic oligonucleotide
ccgagaagctccagttagaaacccactcc

SEQ ID NO: 342721 - DNA, 29 bp, Artificial Sequence
  Description of Artificial Sequence: Synthetic oligonucleotide
cgagaagctccagttagaaacccactccc

SEQ ID NO: 342722 - DNA, 31 bp, Artificial Sequence
  Description of Artificial Sequence: Synthetic oligonucleotide
gagaagctccagttagaaacccactccctag

SEQ ID NO: 342723 - DNA, 31 bp, Artificial Sequence
  Description of Artificial Sequence: Synthetic oligonucleotide
agaagctccagttagaaacccactccctagg

SEQ ID NO: 342724 - DNA, 30 bp, Artificial Sequence
  Description of Artificial Sequence: Synthetic oligonucleotide
gaagctccagttagaaacccactccctagg

SEQ ID NO: 342725 - DNA, 30 bp, Artificial Sequence
  Description of Artificial Sequence: Synthetic oligonucleotide
aagctccagttagaaacccactccctaggc

SEQ ID NO: 342726 - DNA, 29 bp, Artificial Sequence
  Description of Artificial Sequence: Synthetic oligonucleotide
agctccagttagaaacccactccctaggc

SEQ ID NO: 342727 - DNA, 28 bp, Artificial Sequence
  Description of Artificial Sequence: Synthetic oligonucleotide
gctccagttagaaacccactccctaggc

SEQ ID NO: 342728 - DNA, 28 bp, Artificial Sequence
  Description of Artificial Sequence: Synthetic oligonucleotide
ctccagttagaaacccactccctaggcc

SEQ ID NO: 342729 - DNA, 29 bp, Artificial Sequence
  Description of Artificial Sequence: Synthetic oligonucleotide
tccagttagaaacccactccctaggcctg

SEQ ID NO: 342730 - DNA, 28 bp, Artificial Sequence
  Description of Artificial Sequence: Synthetic oligonucleotide
ccagttagaaacccactccctaggcctg

SEQ ID NO: 342731 - DNA, 28 bp, Artificial Sequence
  Description of Artificial Sequence: Synthetic oligonucleotide
cagttagaaacccactccctaggcctgg

SEQ ID NO: 342732 - DNA, 29 bp, Artificial Sequence
  Description of Artificial Sequence: Synthetic oligonucleotide
agttagaaacccactccctaggcctggtg

SEQ ID NO: 342733 - DNA, 28 bp, Artificial Sequence
  Description of Artificial Sequence: Synthetic oligonucleotide
gttagaaacccactccctaggcctggtg

SEQ ID NO: 342734 - DNA, 28 bp, Artificial Sequence
  Description of Artificial Sequence: Synthetic oligonucleotide
ttagaaacccactccctaggcctggtgg

SEQ ID NO: 342735 - DNA, 27 bp, Artificial Sequence
  Description of Artificial Sequence: Synthetic oligonucleotide
tagaaacccactccctaggcctggtgg

SEQ ID NO: 342736 - DNA, 26 bp, Artificial Sequence
  Description of Artificial Sequence: Synthetic oligonucleotide
agaaacccactccctaggcctggtgg

SEQ ID NO: 342737 - DNA, 25 bp, Artificial Sequence
  Description of Artificial Sequence: Synthetic oligonucleotide
gaaacccactccctaggcctggtgg

SEQ ID NO: 342738 - DNA, 25 bp, Artificial Sequence
  Description of Artificial Sequence: Synthetic oligonucleotide
aaacccactccctaggcctggtggc

SEQ ID NO: 342739 - DNA, 24 bp, Artificial Sequence
  Description of Artificial Sequence: Synthetic oligonucleotide
aacccactccctaggcctggtggc

SEQ ID NO: 342740 - DNA, 23 bp, Artificial Sequence
  Description of Artificial Sequence: Synthetic oligonucleotide
acccactccctaggcctggtggc

SEQ ID NO: 342741 - DNA, 22 bp, Artificial Sequence
  Description of Artificial Sequence: Synthetic oligonucleotide
cccactccctaggcctggtggc

SEQ ID NO: 342742 - DNA, 22 bp, Artificial Sequence
  Description of Artificial Sequence: Synthetic oligonucleotide
ccactccctaggcctggtggcc

SEQ ID NO: 342743 - DNA, 23 bp, Artificial Sequence
  Description of Artificial Sequence: Synthetic oligonucleotide
cactccctaggcctggtggccct

SEQ ID NO: 342744 - DNA, 23 bp, Artificial Sequence
  Description of Artificial Sequence: Synthetic oligonucleotide
actccctaggcctggtggccctg

SEQ ID NO: 342745 - DNA, 22 bp, Artificial Sequence
  Description of Artificial Sequence: Synthetic oligonucleotide
ctccctaggcctggtggccctg

SEQ ID NO: 342746 - DNA, 22 bp, Artificial Sequence
  Description of Artificial Sequence: Synthetic oligonucleotide
tccctaggcctggtggccctgg

SEQ ID NO: 342747 - DNA, 21 bp, Artificial Sequence
  Description of Artificial Sequence: Synthetic oligonucleotide
ccctaggcctggtggccctgg

SEQ ID NO: 342748 - DNA, 22 bp, Artificial Sequence
  Description of Artificial Sequence: Synthetic oligonucleotide
cctaggcctggtggccctggga

SEQ ID NO: 342749 - DNA, 22 bp, Artificial Sequence
  Description of Artificial Sequence: Synthetic oligonucleotide
ctaggcctggtggccctgggag

SEQ ID NO: 342750 - DNA, 22 bp, Artificial Sequence
  Description of Artificial Sequence: Synthetic oligonucleotide
taggcctggtggccctgggagc

SEQ ID NO: 342751 - DNA, 21 bp, Artificial Sequence
  Description of Artificial Sequence: Synthetic oligonucleotide
aggcctggtggccctgggagc

SEQ ID NO: 342752 - DNA, 20 bp, Artificial Sequence
  Description of Artificial Sequence: Synthetic oligonucleotide
ggcctggtggccctgggagc

SEQ ID NO: 342753 - DNA, 22 bp, Artificial Sequence
  Description of Artificial Sequence: Synthetic oligonucleotide
gcctggtggccctgggagccat

SEQ ID NO: 342754 - DNA, 22 bp, Artificial Sequence
  Description of Artificial Sequence: Synthetic oligonucleotide
cctggtggccctgggagccatg

SEQ ID NO: 342755 - DNA, 23 bp, Artificial Sequence
  Description of Artificial Sequence: Synthetic oligonucleotide
ctggtggccctgggagccatgga

SEQ ID NO: 342756 - DNA, 24 bp, Artificial Sequence
  Description of Artificial Sequence: Synthetic oligonucleotide
tggtggccctgggagccatggaca

SEQ ID NO: 342757 - DNA, 23 bp, Artificial Sequence
  Description of Artificial Sequence: Synthetic oligonucleotide
ggtggccctgggagccatggaca

SEQ ID NO: 342758 - DNA, 24 bp, Artificial Sequence
  Description of Artificial Sequence: Synthetic oligonucleotide
gtggccctgggagccatggacaca

SEQ ID NO: 342759 - DNA, 24 bp, Artificial Sequence
  Description of Artificial Sequence: Synthetic oligonucleotide
tggccctgggagccatggacacag

SEQ ID NO: 342760 - DNA, 23 bp, Artificial Sequence
  Description of Artificial Sequence: Synthetic oligonucleotide
ggccctgggagccatggacacag

SEQ ID NO: 342761 - DNA, 24 bp, Artificial Sequence
  Description of Artificial Sequence: Synthetic oligonucleotide
gccctgggagccatggacacaggt

SEQ ID NO: 342762 - DNA, 25 bp, Artificial Sequence
  Description of Artificial Sequence: Synthetic oligonucleotide
ccctgggagccatggacacaggtct

SEQ ID NO: 342763 - DNA, 27 bp, Artificial Sequence
  Description of Artificial Sequence: Synthetic oligonucleotide
cctgggagccatggacacaggtctgta

SEQ ID NO: 342764 - DNA, 28 bp, Artificial Sequence
  Description of Artificial Sequence: Synthetic oligonucleotide
ctgggagccatggacacaggtctgtatg

SEQ ID NO: 342765 - DNA, 28 bp, Artificial Sequence
  Description of Artificial Sequence: Synthetic oligonucleotide
tgggagccatggacacaggtctgtatgc

SEQ ID NO: 342766 - DNA, 27 bp, Artificial Sequence
  Description of Artificial Sequence: Synthetic oligonucleotide
gggagccatggacacaggtctgtatgc

SEQ ID NO: 342767 - DNA, 28 bp, Artificial Sequence
  Description of Artificial Sequence: Synthetic oligonucleotide
ggagccatggacacaggtctgtatgcag

SEQ ID NO: 342768 - DNA, 28 bp, Artificial Sequence
  Description of Artificial Sequence: Synthetic oligonucleotide
gagccatggacacaggtctgtatgcagc

SEQ ID NO: 342769 - DNA, 29 bp, Artificial Sequence
  Description of Artificial Sequence: Synthetic oligonucleotide
agccatggacacaggtctgtatgcagcag

SEQ ID NO: 342770 - DNA, 28 bp, Artificial Sequence
  Description of Artificial Sequence: Synthetic oligonucleotide
gccatggacacaggtctgtatgcagcag

SEQ ID NO: 342771 - DNA, 28 bp, Artificial Sequence
  Description of Artificial Sequence: Synthetic oligonucleotide
ccatggacacaggtctgtatgcagcagg

SEQ ID NO: 342772 - DNA, 28 bp, Artificial Sequence
  Description of Artificial Sequence: Synthetic oligonucleotide
catggacacaggtctgtatgcagcaggc

SEQ ID NO: 342773 - DNA, 29 bp, Artificial Sequence
  Description of Artificial Sequence: Synthetic oligonucleotide
atggacacaggtctgtatgcagcaggcag

SEQ ID NO: 342774 - DNA, 28 bp, Artificial Sequence
  Description of Artificial Sequence: Synthetic oligonucleotide
tggacacaggtctgtatgcagcaggcag

SEQ ID NO: 342775 - DNA, 27 bp, Artificial Sequence
  Description of Artificial Sequence: Synthetic oligonucleotide
ggacacaggtctgtatgcagcaggcag

SEQ ID NO: 342776 - DNA, 27 bp, Artificial Sequence
  Description of Artificial Sequence: Synthetic oligonucleotide
gacacaggtctgtatgcagcaggcagc

SEQ ID NO: 342777 - DNA, 29 bp, Artificial Sequence
  Description of Artificial Sequence: Synthetic oligonucleotide
acacaggtctgtatgcagcaggcagctag

SEQ ID NO: 342778 - DNA, 28 bp, Artificial Sequence
  Description of Artificial Sequence: Synthetic oligonucleotide
cacaggtctgtatgcagcaggcagctag

SEQ ID NO: 342779 - DNA, 29 bp, Artificial Sequence
  Description of Artificial Sequence: Synthetic oligonucleotide
acaggtctgtatgcagcaggcagctagtc

SEQ ID NO: 342780 - DNA, 28 bp, Artificial Sequence
  Description of Artificial Sequence: Synthetic oligonucleotide
caggtctgtatgcagcaggcagctagtc

SEQ ID NO: 342781 - DNA, 28 bp, Artificial Sequence
  Description of Artificial Sequence: Synthetic oligonucleotide
aggtctgtatgcagcaggcagctagtcc

SEQ ID NO: 342782 - DNA, 27 bp, Artificial Sequence
  Description of Artificial Sequence: Synthetic oligonucleotide
ggtctgtatgcagcaggcagctagtcc

SEQ ID NO: 342783 - DNA, 27 bp, Artificial Sequence
  Description of Artificial Sequence: Synthetic oligonucleotide
gtctgtatgcagcaggcagctagtccc

SEQ ID NO: 342784 - DNA, 28 bp, Artificial Sequence
  Description of Artificial Sequence: Synthetic oligonucleotide
tctgtatgcagcaggcagctagtcccac

SEQ ID NO: 342785 - DNA, 27 bp, Artificial Sequence
  Description of Artificial Sequence: Synthetic oligonucleotide
ctgtatgcagcaggcagctagtcccac

SEQ ID NO: 342786 - DNA, 29 bp, Artificial Sequence
  Description of Artificial Sequence: Synthetic oligonucleotide
tgtatgcagcaggcagctagtcccacatg

SEQ ID NO: 342787 - DNA, 28 bp, Artificial Sequence
  Description of Artificial Sequence: Synthetic oligonucleotide
gtatgcagcaggcagctagtcccacatg

SEQ ID NO: 342788 - DNA, 28 bp, Artificial Sequence
  Description of Artificial Sequence: Synthetic oligonucleotide
tatgcagcaggcagctagtcccacatgc

SEQ ID NO: 342789 - DNA, 27 bp, Artificial Sequence
  Description of Artificial Sequence: Synthetic oligonucleotide
atgcagcaggcagctagtcccacatgc

SEQ ID NO: 342790 - DNA, 26 bp, Artificial Sequence
  Description of Artificial Sequence: Synthetic oligonucleotide
tgcagcaggcagctagtcccacatgc

SEQ ID NO: 342791 - DNA, 25 bp, Artificial Sequence
  Description of Artificial Sequence: Synthetic oligonucleotide
gcagcaggcagctagtcccacatgc

SEQ ID NO: 342792 - DNA, 25 bp, Artificial Sequence
  Description of Artificial Sequence: Synthetic oligonucleotide
cagcaggcagctagtcccacatgcc

SEQ ID NO: 342793 - DNA, 25 bp, Artificial Sequence
  Description of Artificial Sequence: Synthetic oligonucleotide
agcaggcagctagtcccacatgccc

SEQ ID NO: 342794 - DNA, 24 bp, Artificial Sequence
  Description of Artificial Sequence: Synthetic oligonucleotide
gcaggcagctagtcccacatgccc

SEQ ID NO: 342795 - DNA, 25 bp, Artificial Sequence
  Description of Artificial Sequence: Synthetic oligonucleotide
caggcagctagtcccacatgcccct

SEQ ID NO: 342796 - DNA, 27 bp, Artificial Sequence
  Description of Artificial Sequence: Synthetic oligonucleotide
aggcagctagtcccacatgcccctcaa

SEQ ID NO: 342797 - DNA, 26 bp, Artificial Sequence
  Description of Artificial Sequence: Synthetic oligonucleotide
ggcagctagtcccacatgcccctcaa

SEQ ID NO: 342798 - DNA, 27 bp, Artificial Sequence
  Description of Artificial Sequence: Synthetic oligonucleotide
gcagctagtcccacatgcccctcaaga

SEQ ID NO: 342799 - DNA, 28 bp, Artificial Sequence
  Description of Artificial Sequence: Synthetic oligonucleotide
cagctagtcccacatgcccctcaagatg

SEQ ID NO: 342800 - DNA, 28 bp, Artificial Sequence
  Description of Artificial Sequence: Synthetic oligonucleotide
agctagtcccacatgcccctcaagatgg

SEQ ID NO: 342801 - DNA, 27 bp, Artificial Sequence
  Description of Artificial Sequence: Synthetic oligonucleotide
gctagtcccacatgcccctcaagatgg

SEQ ID NO: 342802 - DNA, 27 bp, Artificial Sequence
  Description of Artificial Sequence: Synthetic oligonucleotide
ctagtcccacatgcccctcaagatggg

SEQ ID NO: 342803 - DNA, 27 bp, Artificial Sequence
  Description of Artificial Sequence: Synthetic oligonucleotide
tagtcccacatgcccctcaagatgggc

SEQ ID NO: 342804 - DNA, 27 bp, Artificial Sequence
  Description of Artificial Sequence: Synthetic oligonucleotide
agtcccacatgcccctcaagatgggca

SEQ ID NO: 342805 - DNA, 27 bp, Artificial Sequence
  Description of Artificial Sequence: Synthetic oligonucleotide
gtcccacatgcccctcaagatgggcaa

SEQ ID NO: 342806 - DNA, 27 bp, Artificial Sequence
  Description of Artificial Sequence: Synthetic oligonucleotide
tcccacatgcccctcaagatgggcaag

SEQ ID NO: 342807 - DNA, 26 bp, Artificial Sequence
  Description of Artificial Sequence: Synthetic oligonucleotide
cccacatgcccctcaagatgggcaag

SEQ ID NO: 342808 - DNA, 27 bp, Artificial Sequence
  Description of Artificial Sequence: Synthetic oligonucleotide
ccacatgcccctcaagatgggcaagct

SEQ ID NO: 342809 - DNA, 27 bp, Artificial Sequence
  Description of Artificial Sequence: Synthetic oligonucleotide
cacatgcccctcaagatgggcaagctc

SEQ ID NO: 342810 - DNA, 30 bp, Artificial Sequence
  Description of Artificial Sequence: Synthetic oligonucleotide
acatgcccctcaagatgggcaagctctttg

SEQ ID NO: 342811 - DNA, 29 bp, Artificial Sequence
  Description of Artificial Sequence: Synthetic oligonucleotide
catgcccctcaagatgggcaagctctttg

SEQ ID NO: 342812 - DNA, 31 bp, Artificial Sequence
  Description of Artificial Sequence: Synthetic oligonucleotide
atgcccctcaagatgggcaagctctttgaag

SEQ ID NO: 342813 - DNA, 30 bp, Artificial Sequence
  Description of Artificial Sequence: Synthetic oligonucleotide
tgcccctcaagatgggcaagctctttgaag

SEQ ID NO: 342814 - DNA, 29 bp, Artificial Sequence
  Description of Artificial Sequence: Synthetic oligonucleotide
gcccctcaagatgggcaagctctttgaag

SEQ ID NO: 342815 - DNA, 29 bp, Artificial Sequence
  Description of Artificial Sequence: Synthetic oligonucleotide
cccctcaagatgggcaagctctttgaagg

SEQ ID NO: 342816 - DNA, 32 bp, Artificial Sequence
  Description of Artificial Sequence: Synthetic oligonucleotide
ccctcaagatgggcaagctctttgaaggtatg

SEQ ID NO: 342817 - DNA, 34 bp, Artificial Sequence
  Description of Artificial Sequence: Synthetic oligonucleotide
cctcaagatgggcaagctctttgaaggtatgaac

SEQ ID NO: 342818 - DNA, 35 bp, Artificial Sequence
  Description of Artificial Sequence: Synthetic oligonucleotide
ctcaagatgggcaagctctttgaaggtatgaacag

SEQ ID NO: 342819 - DNA, 35 bp, Artificial Sequence
  Description of Artificial Sequence: Synthetic oligonucleotide
tcaagatgggcaagctctttgaaggtatgaacagg

SEQ ID NO: 342820 - DNA, 34 bp, Artificial Sequence
  Description of Artificial Sequence: Synthetic oligonucleotide
caagatgggcaagctctttgaaggtatgaacagg

SEQ ID NO: 342821 - DNA, 37 bp, Artificial Sequence
  Description of Artificial Sequence: Synthetic oligonucleotide
aagatgggcaagctctttgaaggtatgaacaggtatg

SEQ ID NO: 342822 - DNA, 36 bp, Artificial Sequence
  Description of Artificial Sequence: Synthetic oligonucleotide
agatgggcaagctctttgaaggtatgaacaggtatg

SEQ ID NO: 342823 - DNA, 35 bp, Artificial Sequence
  Description of Artificial Sequence: Synthetic oligonucleotide
gatgggcaagctctttgaaggtatgaacaggtatg

SEQ ID NO: 342824 - DNA, 36 bp, Artificial Sequence
  Description of Artificial Sequence: Synthetic oligonucleotide
atgggcaagctctttgaaggtatgaacaggtatgac

SEQ ID NO: 342825 - DNA, 35 bp, Artificial Sequence
  Description of Artificial Sequence: Synthetic oligonucleotide
tgggcaagctctttgaaggtatgaacaggtatgac

SEQ ID NO: 342826 - DNA, 34 bp, Artificial Sequence
  Description of Artificial Sequence: Synthetic oligonucleotide
gggcaagctctttgaaggtatgaacaggtatgac

SEQ ID NO: 342827 - DNA, 34 bp, Artificial Sequence
  Description of Artificial Sequence: Synthetic oligonucleotide
ggcaagctctttgaaggtatgaacaggtatgacc

SEQ ID NO: 342828 - DNA, 35 bp, Artificial Sequence
  Description of Artificial Sequence: Synthetic oligonucleotide
gcaagctctttgaaggtatgaacaggtatgacctc

SEQ ID NO: 342829 - DNA, 35 bp, Artificial Sequence
  Description of Artificial Sequence: Synthetic oligonucleotide
caagctctttgaaggtatgaacaggtatgacctcc

SEQ ID NO: 342830 - DNA, 35 bp, Artificial Sequence
  Description of Artificial Sequence: Synthetic oligonucleotide
aagctctttgaaggtatgaacaggtatgacctccg

SEQ ID NO: 342831 - DNA, 34 bp, Artificial Sequence
  Description of Artificial Sequence: Synthetic oligonucleotide
agctctttgaaggtatgaacaggtatgacctccg

SEQ ID NO: 342832 - DNA, 33 bp, Artificial Sequence
  Description of Artificial Sequence: Synthetic oligonucleotide
gctctttgaaggtatgaacaggtatgacctccg

SEQ ID NO: 342833 - DNA, 33 bp, Artificial Sequence
  Description of Artificial Sequence: Synthetic oligonucleotide
ctctttgaaggtatgaacaggtatgacctccgc

SEQ ID NO: 342834 - DNA, 34 bp, Artificial Sequence
  Description of Artificial Sequence: Synthetic oligonucleotide
tctttgaaggtatgaacaggtatgacctccgctg

SEQ ID NO: 342835 - DNA, 33 bp, Artificial Sequence
  Description of Artificial Sequence: Synthetic oligonucleotide
ctttgaaggtatgaacaggtatgacctccgctg

SEQ ID NO: 342836 - DNA, 34 bp, Artificial Sequence
  Description of Artificial Sequence: Synthetic oligonucleotide
tttgaaggtatgaacaggtatgacctccgctgtg

SEQ ID NO: 342837 - DNA, 33 bp, Artificial Sequence
  Description of Artificial Sequence: Synthetic oligonucleotide
ttgaaggtatgaacaggtatgacctccgctgtg

SEQ ID NO: 342838 - DNA, 32 bp, Artificial Sequence
  Description of Artificial Sequence: Synthetic oligonucleotide
tgaaggtatgaacaggtatgacctccgctgtg

SEQ ID NO: 342839 - DNA, 31 bp, Artificial Sequence
  Description of Artificial Sequence: Synthetic oligonucleotide
gaaggtatgaacaggtatgacctccgctgtg

SEQ ID NO: 342840 - DNA, 31 bp, Artificial Sequence
  Description of Artificial Sequence: Synthetic oligonucleotide
aaggtatgaacaggtatgacctccgctgtgg

SEQ ID NO: 342841 - DNA, 30 bp, Artificial Sequence
  Description of Artificial Sequence: Synthetic oligonucleotide
aggtatgaacaggtatgacctccgctgtgg

SEQ ID NO: 342842 - DNA, 29 bp, Artificial Sequence
  Description of Artificial Sequence: Synthetic oligonucleotide
ggtatgaacaggtatgacctccgctgtgg

SEQ ID NO: 342843 - DNA, 30 bp, Artificial Sequence
  Description of Artificial Sequence: Synthetic oligonucleotide
gtatgaacaggtatgacctccgctgtggtc

SEQ ID NO: 342844 - DNA, 30 bp, Artificial Sequence
  Description of Artificial Sequence: Synthetic oligonucleotide
tatgaacaggtatgacctccgctgtggtcg

SEQ ID NO: 342845 - DNA, 29 bp, Artificial Sequence
  Description of Artificial Sequence: Synthetic oligonucleotide
atgaacaggtatgacctccgctgtggtcg

SEQ ID NO: 342846 - DNA, 28 bp, Artificial Sequence
  Description of Artificial Sequence: Synthetic oligonucleotide
tgaacaggtatgacctccgctgtggtcg

SEQ ID NO: 342847 - DNA, 27 bp, Artificial Sequence
  Description of Artificial Sequence: Synthetic oligonucleotide
gaacaggtatgacctccgctgtggtcg

SEQ ID NO: 342848 - DNA, 28 bp, Artificial Sequence
  Description of Artificial Sequence: Synthetic oligonucleotide
aacaggtatgacctccgctgtggtcgtg

SEQ ID NO: 342849 - DNA, 27 bp, Artificial Sequence
  Description of Artificial Sequence: Synthetic oligonucleotide
acaggtatgacctccgctgtggtcgtg

SEQ ID NO: 342850 - DNA, 26 bp, Artificial Sequence
  Description of Artificial Sequence: Synthetic oligonucleotide
caggtatgacctccgctgtggtcgtg

SEQ ID NO: 342851 - DNA, 26 bp, Artificial Sequence
  Description of Artificial Sequence: Synthetic oligonucleotide
aggtatgacctccgctgtggtcgtgg

SEQ ID NO: 342852 - DNA, 25 bp, Artificial Sequence
  Description of Artificial Sequence: Synthetic oligonucleotide
ggtatgacctccgctgtggtcgtgg

SEQ ID NO: 342853 - DNA, 25 bp, Artificial Sequence
  Description of Artificial Sequence: Synthetic oligonucleotide
gtatgacctccgctgtggtcgtggg

SEQ ID NO: 342854 - DNA, 25 bp, Artificial Sequence
  Description of Artificial Sequence: Synthetic oligonucleotide
tatgacctccgctgtggtcgtgggg

SEQ ID NO: 342855 - DNA, 24 bp, Artificial Sequence
  Description of Artificial Sequence: Synthetic oligonucleotide
atgacctccgctgtggtcgtgggg

SEQ ID NO: 342856 - DNA, 23 bp, Artificial Sequence
  Description of Artificial Sequence: Synthetic oligonucleotide
tgacctccgctgtggtcgtgggg

SEQ ID NO: 342857 - DNA, 22 bp, Artificial Sequence
  Description of Artificial Sequence: Synthetic oligonucleotide
gacctccgctgtggtcgtgggg

SEQ ID NO: 342858 - DNA, 23 bp, Artificial Sequence
  Description of Artificial Sequence: Synthetic oligonucleotide
acctccgctgtggtcgtgggggt

SEQ ID NO: 342859 - DNA, 22 bp, Artificial Sequence
  Description of Artificial Sequence: Synthetic oligonucleotide
cctccgctgtggtcgtgggggt

SEQ ID NO: 342860 - DNA, 22 bp, Artificial Sequence
  Description of Artificial Sequence: Synthetic oligonucleotide
ctccgctgtggtcgtgggggtg

SEQ ID NO: 342861 - DNA, 22 bp, Artificial Sequence
  Description of Artificial Sequence: Synthetic oligonucleotide
tccgctgtggtcgtgggggtgg

SEQ ID NO: 342862 - DNA, 21 bp, Artificial Sequence
  Description of Artificial Sequence: Synthetic oligonucleotide
ccgctgtggtcgtgggggtgg

SEQ ID NO: 342863 - DNA, 21 bp, Artificial Sequence
  Description of Artificial Sequence: Synthetic oligonucleotide
cgctgtggtcgtgggggtggc

SEQ ID NO: 342864 - DNA, 22 bp, Artificial Sequence
  Description of Artificial Sequence: Synthetic oligonucleotide
gctgtggtcgtgggggtggcga

SEQ ID NO: 342865 - DNA, 23 bp, Artificial Sequence
  Description of Artificial Sequence: Synthetic oligonucleotide
ctgtggtcgtgggggtggcgaca

SEQ ID NO: 342866 - DNA, 24 bp, Artificial Sequence
  Description of Artificial Sequence: Synthetic oligonucleotide
tgtggtcgtgggggtggcgacagt

SEQ ID NO: 342867 - DNA, 23 bp, Artificial Sequence
  Description of Artificial Sequence: Synthetic oligonucleotide
gtggtcgtgggggtggcgacagt

SEQ ID NO: 342868 - DNA, 23 bp, Artificial Sequence
  Description of Artificial Sequence: Synthetic oligonucleotide
tggtcgtgggggtggcgacagtg

SEQ ID NO: 342869 - DNA, 22 bp, Artificial Sequence
  Description of Artificial Sequence: Synthetic oligonucleotide
ggtcgtgggggtggcgacagtg

SEQ ID NO: 342870 - DNA, 22 bp, Artificial Sequence
  Description of Artificial Sequence: Synthetic oligonucleotide
gtcgtgggggtggcgacagtgc

SEQ ID NO: 342871 - DNA, 22 bp, Artificial Sequence
  Description of Artificial Sequence: Synthetic oligonucleotide
tcgtgggggtggcgacagtgcc

SEQ ID NO: 342872 - DNA, 21 bp, Artificial Sequence
  Description of Artificial Sequence: Synthetic oligonucleotide
cgtgggggtggcgacagtgcc

SEQ ID NO: 342873 - DNA, 23 bp, Artificial Sequence
  Description of Artificial Sequence: Synthetic oligonucleotide
gtgggggtggcgacagtgccgtt

SEQ ID NO: 342874 - DNA, 24 bp, Artificial Sequence
  Description of Artificial Sequence: Synthetic oligonucleotide
tgggggtggcgacagtgccgttca

SEQ ID NO: 342875 - DNA, 23 bp, Artificial Sequence
  Description of Artificial Sequence: Synthetic oligonucleotide
gggggtggcgacagtgccgttca

SEQ ID NO: 342876 - DNA, 23 bp, Artificial Sequence
  Description of Artificial Sequence: Synthetic oligonucleotide
ggggtggcgacagtgccgttcag

SEQ ID NO: 342877 - DNA, 24 bp, Artificial Sequence
  Description of Artificial Sequence: Synthetic oligonucleotide
gggtggcgacagtgccgttcaggt

SEQ ID NO: 342878 - DNA, 26 bp, Artificial Sequence
  Description of Artificial Sequence: Synthetic oligonucleotide
ggtggcgacagtgccgttcaggtgta

SEQ ID NO: 342879 - DNA, 26 bp, Artificial Sequence
  Description of Artificial Sequence: Synthetic oligonucleotide
gtggcgacagtgccgttcaggtgtac

SEQ ID NO: 342880 - DNA, 27 bp, Artificial Sequence
  Description of Artificial Sequence: Synthetic oligonucleotide
tggcgacagtgccgttcaggtgtacca

SEQ ID NO: 342881 - DNA, 26 bp, Artificial Sequence
  Description of Artificial Sequence: Synthetic oligonucleotide
ggcgacagtgccgttcaggtgtacca

SEQ ID NO: 342882 - DNA, 26 bp, Artificial Sequence
  Description of Artificial Sequence: Synthetic oligonucleotide
gcgacagtgccgttcaggtgtaccag

SEQ ID NO: 342883 - DNA, 26 bp, Artificial Sequence
  Description of Artificial Sequence: Synthetic oligonucleotide
cgacagtgccgttcaggtgtaccagg

SEQ ID NO: 342884 - DNA, 27 bp, Artificial Sequence
  Description of Artificial Sequence: Synthetic oligonucleotide
gacagtgccgttcaggtgtaccaggca

SEQ ID NO: 342885 - DNA, 27 bp, Artificial Sequence
  Description of Artificial Sequence: Synthetic oligonucleotide
acagtgccgttcaggtgtaccaggcag

SEQ ID NO: 342886 - DNA, 26 bp, Artificial Sequence
  Description of Artificial Sequence: Synthetic oligonucleotide
cagtgccgttcaggtgtaccaggcag

SEQ ID NO: 342887 - DNA, 26 bp, Artificial Sequence
  Description of Artificial Sequence: Synthetic oligonucleotide
agtgccgttcaggtgtaccaggcagc

SEQ ID NO: 342888 - DNA, 25 bp, Artificial Sequence
  Description of Artificial Sequence: Synthetic oligonucleotide
gtgccgttcaggtgtaccaggcagc

SEQ ID NO: 342889 - DNA, 25 bp, Artificial Sequence
  Description of Artificial Sequence: Synthetic oligonucleotide
tgccgttcaggtgtaccaggcagcc

SEQ ID NO: 342890 - DNA, 24 bp, Artificial Sequence
  Description of Artificial Sequence: Synthetic oligonucleotide
gccgttcaggtgtaccaggcagcc

SEQ ID NO: 342891 - DNA, 24 bp, Artificial Sequence
  Description of Artificial Sequence: Synthetic oligonucleotide
ccgttcaggtgtaccaggcagccg

SEQ ID NO: 342892 - DNA, 24 bp, Artificial Sequence
  Description of Artificial Sequence: Synthetic oligonucleotide
cgttcaggtgtaccaggcagccgg

SEQ ID NO: 342893 - DNA, 24 bp, Artificial Sequence
  Description of Artificial Sequence: Synthetic oligonucleotide
gttcaggtgtaccaggcagccggc

SEQ ID NO: 342894 - DNA, 25 bp, Artificial Sequence
  Description of Artificial Sequence: Synthetic oligonucleotide
ttcaggtgtaccaggcagccggcct

SEQ ID NO: 342895 - DNA, 24 bp, Artificial Sequence
  Description of Artificial Sequence: Synthetic oligonucleotide
tcaggtgtaccaggcagccggcct

SEQ ID NO: 342896 - DNA, 23 bp, Artificial Sequence
  Description of Artificial Sequence: Synthetic oligonucleotide
caggtgtaccaggcagccggcct

SEQ ID NO: 342897 - DNA, 23 bp, Artificial Sequence
  Description of Artificial Sequence: Synthetic oligonucleotide
aggtgtaccaggcagccggcctg

SEQ ID NO: 342898 - DNA, 22 bp, Artificial Sequence
  Description of Artificial Sequence: Synthetic oligonucleotide
ggtgtaccaggcagccggcctg

SEQ ID NO: 342899 - DNA, 22 bp, Artificial Sequence
  Description of Artificial Sequence: Synthetic oligonucleotide
gtgtaccaggcagccggcctgg

SEQ ID NO: 342900 - DNA, 22 bp, Artificial Sequence
  Description of Artificial Sequence: Synthetic oligonucleotide
tgtaccaggcagccggcctggc

SEQ ID NO: 342901 - DNA, 21 bp, Artificial Sequence
  Description of Artificial Sequence: Synthetic oligonucleotide
gtaccaggcagccggcctggc

SEQ ID NO: 342902 - DNA, 25 bp, Artificial Sequence
  Description of Artificial Sequence: Synthetic oligonucleotide
taccaggcagccggcctggccattt

SEQ ID NO: 342903 - DNA, 24 bp, Artificial Sequence
  Description of Artificial Sequence: Synthetic oligonucleotide
accaggcagccggcctggccattt

SEQ ID NO: 342904 - DNA, 23 bp, Artificial Sequence
  Description of Artificial Sequence: Synthetic oligonucleotide
ccaggcagccggcctggccattt

SEQ ID NO: 342905 - DNA, 24 bp, Artificial Sequence
  Description of Artificial Sequence: Synthetic oligonucleotide
caggcagccggcctggccatttct

SEQ ID NO: 342906 - DNA, 26 bp, Artificial Sequence
  Description of Artificial Sequence: Synthetic oligonucleotide
aggcagccggcctggccatttctgat

SEQ ID NO: 342907 - DNA, 25 bp, Artificial Sequence
  Description of Artificial Sequence: Synthetic oligonucleotide
ggcagccggcctggccatttctgat

SEQ ID NO: 342908 - DNA, 25 bp, Artificial Sequence
  Description of Artificial Sequence: Synthetic oligonucleotide
gcagccggcctggccatttctgatg

SEQ ID NO: 342909 - DNA, 26 bp, Artificial Sequence
  Description of Artificial Sequence: Synthetic oligonucleotide
cagccggcctggccatttctgatgca

SEQ ID NO: 342910 - DNA, 27 bp, Artificial Sequence
  Description of Artificial Sequence: Synthetic oligonucleotide
agccggcctggccatttctgatgcaga

SEQ ID NO: 342911 - DNA, 26 bp, Artificial Sequence
  Description of Artificial Sequence: Synthetic oligonucleotide
gccggcctggccatttctgatgcaga

SEQ ID NO: 342912 - DNA, 26 bp, Artificial Sequence
  Description of Artificial Sequence: Synthetic oligonucleotide
ccggcctggccatttctgatgcagac

SEQ ID NO: 342913 - DNA, 27 bp, Artificial Sequence
  Description of Artificial Sequence: Synthetic oligonucleotide
cggcctggccatttctgatgcagacca

SEQ ID NO: 342914 - DNA, 27 bp, Artificial Sequence
  Description of Artificial Sequence: Synthetic oligonucleotide
ggcctggccatttctgatgcagaccag

SEQ ID NO: 342915 - DNA, 28 bp, Artificial Sequence
  Description of Artificial Sequence: Synthetic oligonucleotide
gcctggccatttctgatgcagaccagtg

SEQ ID NO: 342916 - DNA, 28 bp, Artificial Sequence
  Description of Artificial Sequence: Synthetic oligonucleotide
cctggccatttctgatgcagaccagtgc

SEQ ID NO: 342917 - DNA, 29 bp, Artificial Sequence
  Description of Artificial Sequence: Synthetic oligonucleotide
ctggccatttctgatgcagaccagtgcac

SEQ ID NO: 342918 - DNA, 29 bp, Artificial Sequence
  Description of Artificial Sequence: Synthetic oligonucleotide
tggccatttctgatgcagaccagtgcacc

SEQ ID NO: 342919 - DNA, 28 bp, Artificial Sequence
  Description of Artificial Sequence: Synthetic oligonucleotide
ggccatttctgatgcagaccagtgcacc

SEQ ID NO: 342920 - DNA, 32 bp, Artificial Sequence
  Description of Artificial Sequence: Synthetic oligonucleotide
gccatttctgatgcagaccagtgcaccttatc

SEQ ID NO: 342921 - DNA, 32 bp, Artificial Sequence
  Description of Artificial Sequence: Synthetic oligonucleotide
ccatttctgatgcagaccagtgcaccttatcc

SEQ ID NO: 342922 - DNA, 33 bp, Artificial Sequence
  Description of Artificial Sequence: Synthetic oligonucleotide
catttctgatgcagaccagtgcaccttatcctg

SEQ ID NO: 342923 - DNA, 36 bp, Artificial Sequence
  Description of Artificial Sequence: Synthetic oligonucleotide
atttctgatgcagaccagtgcaccttatcctgaaag

SEQ ID NO: 342924 - DNA, 35 bp, Artificial Sequence
  Description of Artificial Sequence: Synthetic oligonucleotide
tttctgatgcagaccagtgcaccttatcctgaaag

SEQ ID NO: 342925 - DNA, 34 bp, Artificial Sequence
  Description of Artificial Sequence: Synthetic oligonucleotide
ttctgatgcagaccagtgcaccttatcctgaaag

SEQ ID NO: 342926 - DNA, 33 bp, Artificial Sequence
  Description of Artificial Sequence: Synthetic oligonucleotide
tctgatgcagaccagtgcaccttatcctgaaag

SEQ ID NO: 342927 - DNA, 32 bp, Artificial Sequence
  Description of Artificial Sequence: Synthetic oligonucleotide
ctgatgcagaccagtgcaccttatcctgaaag

SEQ ID NO: 342928 - DNA, 33 bp, Artificial Sequence
  Description of Artificial Sequence: Synthetic oligonucleotide
tgatgcagaccagtgcaccttatcctgaaagag

SEQ ID NO: 342929 - DNA, 32 bp, Artificial Sequence
  Description of Artificial Sequence: Synthetic oligonucleotide
gatgcagaccagtgcaccttatcctgaaagag

SEQ ID NO: 342930 - DNA, 33 bp, Artificial Sequence
  Description of Artificial Sequence: Synthetic oligonucleotide
atgcagaccagtgcaccttatcctgaaagagac

SEQ ID NO: 342931 - DNA, 32 bp, Artificial Sequence
  Description of Artificial Sequence: Synthetic oligonucleotide
tgcagaccagtgcaccttatcctgaaagagac

SEQ ID NO: 342932 - DNA, 31 bp, Artificial Sequence
  Description of Artificial Sequence: Synthetic oligonucleotide
gcagaccagtgcaccttatcctgaaagagac

SEQ ID NO: 342933 - DNA, 34 bp, Artificial Sequence
  Description of Artificial Sequence: Synthetic oligonucleotide
cagaccagtgcaccttatcctgaaagagacaaag

SEQ ID NO: 342934 - DNA, 34 bp, Artificial Sequence
  Description of Artificial Sequence: Synthetic oligonucleotide
agaccagtgcaccttatcctgaaagagacaaagc

SEQ ID NO: 342935 - DNA, 33 bp, Artificial Sequence
  Description of Artificial Sequence: Synthetic oligonucleotide
gaccagtgcaccttatcctgaaagagacaaagc

SEQ ID NO: 342936 - DNA, 34 bp, Artificial Sequence
  Description of Artificial Sequence: Synthetic oligonucleotide
accagtgcaccttatcctgaaagagacaaagctg

SEQ ID NO: 342937 - DNA, 33 bp, Artificial Sequence
  Description of Artificial Sequence: Synthetic oligonucleotide
ccagtgcaccttatcctgaaagagacaaagctg

SEQ ID NO: 342938 - DNA, 34 bp, Artificial Sequence
  Description of Artificial Sequence: Synthetic oligonucleotide
cagtgcaccttatcctgaaagagacaaagctgtc

SEQ ID NO: 342939 - DNA, 34 bp, Artificial Sequence
  Description of Artificial Sequence: Synthetic oligonucleotide
agtgcaccttatcctgaaagagacaaagctgtcc

SEQ ID NO: 342940 - DNA, 33 bp, Artificial Sequence
  Description of Artificial Sequence: Synthetic oligonucleotide
gtgcaccttatcctgaaagagacaaagctgtcc

SEQ ID NO: 342941 - DNA, 33 bp, Artificial Sequence
  Description of Artificial Sequence: Synthetic oligonucleotide
tgcaccttatcctgaaagagacaaagctgtccg

SEQ ID NO: 342942 - DNA, 32 bp, Artificial Sequence
  Description of Artificial Sequence: Synthetic oligonucleotide
gcaccttatcctgaaagagacaaagctgtccg

SEQ ID NO: 342943 - DNA, 34 bp, Artificial Sequence
  Description of Artificial Sequence: Synthetic oligonucleotide
caccttatcctgaaagagacaaagctgtccgaag

SEQ ID NO: 342944 - DNA, 34 bp, Artificial Sequence
  Description of Artificial Sequence: Synthetic oligonucleotide
accttatcctgaaagagacaaagctgtccgaagg

SEQ ID NO: 342945 - DNA, 33 bp, Artificial Sequence
  Description of Artificial Sequence: Synthetic oligonucleotide
ccttatcctgaaagagacaaagctgtccgaagg

SEQ ID NO: 342946 - DNA, 34 bp, Artificial Sequence
  Description of Artificial Sequence: Synthetic oligonucleotide
cttatcctgaaagagacaaagctgtccgaaggag

SEQ ID NO: 342947 - DNA, 36 bp, Artificial Sequence
  Description of Artificial Sequence: Synthetic oligonucleotide
ttatcctgaaagagacaaagctgtccgaaggagaag

SEQ ID NO: 342948 - DNA, 35 bp, Artificial Sequence
  Description of Artificial Sequence: Synthetic oligonucleotide
tatcctgaaagagacaaagctgtccgaaggagaag

SEQ ID NO: 342949 - DNA, 34 bp, Artificial Sequence
  Description of Artificial Sequence: Synthetic oligonucleotide
atcctgaaagagacaaagctgtccgaaggagaag

SEQ ID NO: 342950 - DNA, 33 bp, Artificial Sequence
  Description of Artificial Sequence: Synthetic oligonucleotide
tcctgaaagagacaaagctgtccgaaggagaag

SEQ ID NO: 342951 - DNA, 32 bp, Artificial Sequence
  Description of Artificial Sequence: Synthetic oligonucleotide
cctgaaagagacaaagctgtccgaaggagaag

SEQ ID NO: 342952 - DNA, 33 bp, Artificial Sequence
  Description of Artificial Sequence: Synthetic oligonucleotide
ctgaaagagacaaagctgtccgaaggagaagtc

SEQ ID NO: 342953 - DNA, 35 bp, Artificial Sequence
  Description of Artificial Sequence: Synthetic oligonucleotide
tgaaagagacaaagctgtccgaaggagaagtcaac

SEQ ID NO: 342954 - DNA, 34 bp, Artificial Sequence
  Description of Artificial Sequence: Synthetic oligonucleotide
gaaagagacaaagctgtccgaaggagaagtcaac

SEQ ID NO: 342955 - DNA, 34 bp, Artificial Sequence
  Description of Artificial Sequence: Synthetic oligonucleotide
aaagagacaaagctgtccgaaggagaagtcaacc

SEQ ID NO: 342956 - DNA, 33 bp, Artificial Sequence
  Description of Artificial Sequence: Synthetic oligonucleotide
aagagacaaagctgtccgaaggagaagtcaacc

SEQ ID NO: 342957 - DNA, 32 bp, Artificial Sequence
  Description of Artificial Sequence: Synthetic oligonucleotide
agagacaaagctgtccgaaggagaagtcaacc

SEQ ID NO: 342958 - DNA, 31 bp, Artificial Sequence
  Description of Artificial Sequence: Synthetic oligonucleotide
gagacaaagctgtccgaaggagaagtcaacc

SEQ ID NO: 342959 - DNA, 31 bp, Artificial Sequence
  Description of Artificial Sequence: Synthetic oligonucleotide
agacaaagctgtccgaaggagaagtcaaccc

SEQ ID NO: 342960 - DNA, 30 bp, Artificial Sequence
  Description of Artificial Sequence: Synthetic oligonucleotide
gacaaagctgtccgaaggagaagtcaaccc

SEQ ID NO: 342961 - DNA, 30 bp, Artificial Sequence
  Description of Artificial Sequence: Synthetic oligonucleotide
acaaagctgtccgaaggagaagtcaacccg

SEQ ID NO: 342962 - DNA, 29 bp, Artificial Sequence
  Description of Artificial Sequence: Synthetic oligonucleotide
caaagctgtccgaaggagaagtcaacccg

SEQ ID NO: 342963 - DNA, 29 bp, Artificial Sequence
  Description of Artificial Sequence: Synthetic oligonucleotide
aaagctgtccgaaggagaagtcaacccgg

SEQ ID NO: 342964 - DNA, 28 bp, Artificial Sequence
  Description of Artificial Sequence: Synthetic oligonucleotide
aagctgtccgaaggagaagtcaacccgg

SEQ ID NO: 342965 - DNA, 27 bp, Artificial Sequence
  Description of Artificial Sequence: Synthetic oligonucleotide
agctgtccgaaggagaagtcaacccgg

SEQ ID NO: 342966 - DNA, 27 bp, Artificial Sequence
  Description of Artificial Sequence: Synthetic oligonucleotide
gctgtccgaaggagaagtcaacccgga

SEQ ID NO: 342967 - DNA, 31 bp, Artificial Sequence
  Description of Artificial Sequence: Synthetic oligonucleotide
ctgtccgaaggagaagtcaacccggataaag

SEQ ID NO: 342968 - DNA, 32 bp, Artificial Sequence
  Description of Artificial Sequence: Synthetic oligonucleotide
tgtccgaaggagaagtcaacccggataaagag

SEQ ID NO: 342969 - DNA, 31 bp, Artificial Sequence
  Description of Artificial Sequence: Synthetic oligonucleotide
gtccgaaggagaagtcaacccggataaagag

SEQ ID NO: 342970 - DNA, 34 bp, Artificial Sequence
  Description of Artificial Sequence: Synthetic oligonucleotide
tccgaaggagaagtcaacccggataaagagaaag

SEQ ID NO: 342971 - DNA, 33 bp, Artificial Sequence
  Description of Artificial Sequence: Synthetic oligonucleotide
ccgaaggagaagtcaacccggataaagagaaag

SEQ ID NO: 342972 - DNA, 33 bp, Artificial Sequence
  Description of Artificial Sequence: Synthetic oligonucleotide
cgaaggagaagtcaacccggataaagagaaagg

SEQ ID NO: 342973 - DNA, 34 bp, Artificial Sequence
  Description of Artificial Sequence: Synthetic oligonucleotide
gaaggagaagtcaacccggataaagagaaaggtg

SEQ ID NO: 342974 - DNA, 36 bp, Artificial Sequence
  Description of Artificial Sequence: Synthetic oligonucleotide
aaggagaagtcaacccggataaagagaaaggtgaac

SEQ ID NO: 342975 - DNA, 35 bp, Artificial Sequence
  Description of Artificial Sequence: Synthetic oligonucleotide
aggagaagtcaacccggataaagagaaaggtgaac

SEQ ID NO: 342976 - DNA, 34 bp, Artificial Sequence
  Description of Artificial Sequence: Synthetic oligonucleotide
ggagaagtcaacccggataaagagaaaggtgaac

SEQ ID NO: 342977 - DNA, 36 bp, Artificial Sequence
  Description of Artificial Sequence: Synthetic oligonucleotide
gagaagtcaacccggataaagagaaaggtgaacttc

SEQ ID NO: 342978 - DNA, 36 bp, Artificial Sequence
  Description of Artificial Sequence: Synthetic oligonucleotide
agaagtcaacccggataaagagaaaggtgaacttcg

SEQ ID NO: 342979 - DNA, 35 bp, Artificial Sequence
  Description of Artificial Sequence: Synthetic oligonucleotide
gaagtcaacccggataaagagaaaggtgaacttcg

SEQ ID NO: 342980 - DNA, 39 bp, Artificial Sequence
  Description of Artificial Sequence: Synthetic oligonucleotide
aagtcaacccggataaagagaaaggtgaacttcgaaaag

SEQ ID NO: 342981 - DNA, 38 bp, Artificial Sequence
  Description of Artificial Sequence: Synthetic oligonucleotide
agtcaacccggataaagagaaaggtgaacttcgaaaag

SEQ ID NO: 342982 - DNA, 37 bp, Artificial Sequence
  Description of Artificial Sequence: Synthetic oligonucleotide
gtcaacccggataaagagaaaggtgaacttcgaaaag

SEQ ID NO: 342983 - DNA, 37 bp, Artificial Sequence
  Description of Artificial Sequence: Synthetic oligonucleotide
tcaacccggataaagagaaaggtgaacttcgaaaagg

SEQ ID NO: 342984 - DNA, 36 bp, Artificial Sequence
  Description of Artificial Sequence: Synthetic oligonucleotide
caacccggataaagagaaaggtgaacttcgaaaagg

SEQ ID NO: 342985 - DNA, 36 bp, Artificial Sequence
  Description of Artificial Sequence: Synthetic oligonucleotide
aacccggataaagagaaaggtgaacttcgaaaaggc

SEQ ID NO: 342986 - DNA, 35 bp, Artificial Sequence
  Description of Artificial Sequence: Synthetic oligonucleotide
acccggataaagagaaaggtgaacttcgaaaaggc

SEQ ID NO: 342987 - DNA, 34 bp, Artificial Sequence
  Description of Artificial Sequence: Synthetic oligonucleotide
cccggataaagagaaaggtgaacttcgaaaaggc

SEQ ID NO: 342988 - DNA, 34 bp, Artificial Sequence
  Description of Artificial Sequence: Synthetic oligonucleotide
ccggataaagagaaaggtgaacttcgaaaaggcg

SEQ ID NO: 342989 - DNA, 40 bp, Artificial Sequence
  Description of Artificial Sequence: Synthetic oligonucleotide
cggataaagagaaaggtgaacttcgaaaaggcgaataatg

SEQ ID NO: 342990 - DNA, 41 bp, Artificial Sequence
  Description of Artificial Sequence: Synthetic oligonucleotide
ggataaagagaaaggtgaacttcgaaaaggcgaataatgag

SEQ ID NO: 342991 - DNA, 46 bp, Artificial Sequence
  Description of Artificial Sequence: Synthetic oligonucleotide
gataaagagaaaggtgaacttcgaaaaggcgaataatgagaatttg

SEQ ID NO: 342992 - DNA, 46 bp, Artificial Sequence
  Description of Artificial Sequence: Synthetic oligonucleotide
ataaagagaaaggtgaacttcgaaaaggcgaataatgagaatttgg

SEQ ID NO: 342993 - DNA, 45 bp, Artificial Sequence
  Description of Artificial Sequence: Synthetic oligonucleotide
taaagagaaaggtgaacttcgaaaaggcgaataatgagaatttgg

SEQ ID NO: 342994 - DNA, 44 bp, Artificial Sequence
  Description of Artificial Sequence: Synthetic oligonucleotide
aaagagaaaggtgaacttcgaaaaggcgaataatgagaatttgg

SEQ ID NO: 342995 - DNA, 43 bp, Artificial Sequence
  Description of Artificial Sequence: Synthetic oligonucleotide
aagagaaaggtgaacttcgaaaaggcgaataatgagaatttgg

SEQ ID NO: 342996 - DNA, 42 bp, Artificial Sequence
  Description of Artificial Sequence: Synthetic oligonucleotide
agagaaaggtgaacttcgaaaaggcgaataatgagaatttgg

SEQ ID NO: 342997 - DNA, 41 bp, Artificial Sequence
  Description of Artificial Sequence: Synthetic oligonucleotide
gagaaaggtgaacttcgaaaaggcgaataatgagaatttgg

SEQ ID NO: 342998 - DNA, 41 bp, Artificial Sequence
  Description of Artificial Sequence: Synthetic oligonucleotide
agaaaggtgaacttcgaaaaggcgaataatgagaatttggg

SEQ ID NO: 342999 - DNA, 40 bp, Artificial Sequence
  Description of Artificial Sequence: Synthetic oligonucleotide
gaaaggtgaacttcgaaaaggcgaataatgagaatttggg

SEQ ID NO: 343000 - DNA, 41 bp, Artificial Sequence
  Description of Artificial Sequence: Synthetic oligonucleotide
aaaggtgaacttcgaaaaggcgaataatgagaatttgggtc

SEQ ID NO: 343001 - DNA, 40 bp, Artificial Sequence
  Description of Artificial Sequence: Synthetic oligonucleotide
aaggtgaacttcgaaaaggcgaataatgagaatttgggtc

SEQ ID NO: 343002 - DNA, 39 bp, Artificial Sequence
  Description of Artificial Sequence: Synthetic oligonucleotide
aggtgaacttcgaaaaggcgaataatgagaatttgggtc

SEQ ID NO: 343003 - DNA, 38 bp, Artificial Sequence
  Description of Artificial Sequence: Synthetic oligonucleotide
ggtgaacttcgaaaaggcgaataatgagaatttgggtc

SEQ ID NO: 343004 - DNA, 39 bp, Artificial Sequence
  Description of Artificial Sequence: Synthetic oligonucleotide
gtgaacttcgaaaaggcgaataatgagaatttgggtcag

SEQ ID NO: 343005 - DNA, 42 bp, Artificial Sequence
  Description of Artificial Sequence: Synthetic oligonucleotide
tgaacttcgaaaaggcgaataatgagaatttgggtcagaatg

SEQ ID NO: 343006 - DNA, 41 bp, Artificial Sequence
  Description of Artificial Sequence: Synthetic oligonucleotide
gaacttcgaaaaggcgaataatgagaatttgggtcagaatg

SEQ ID NO: 343007 - DNA, 41 bp, Artificial Sequence
  Description of Artificial Sequence: Synthetic oligonucleotide
aacttcgaaaaggcgaataatgagaatttgggtcagaatgc

SEQ ID NO: 343008 - DNA, 40 bp, Artificial Sequence
  Description of Artificial Sequence: Synthetic oligonucleotide
acttcgaaaaggcgaataatgagaatttgggtcagaatgc

SEQ ID NO: 343009 - DNA, 39 bp, Artificial Sequence
  Description of Artificial Sequence: Synthetic oligonucleotide
cttcgaaaaggcgaataatgagaatttgggtcagaatgc

SEQ ID NO: 343010 - DNA, 41 bp, Artificial Sequence
  Description of Artificial Sequence: Synthetic oligonucleotide
ttcgaaaaggcgaataatgagaatttgggtcagaatgcttc

SEQ ID NO: 343011 - DNA, 40 bp, Artificial Sequence
  Description of Artificial Sequence: Synthetic oligonucleotide
tcgaaaaggcgaataatgagaatttgggtcagaatgcttc

SEQ ID NO: 343012 - DNA, 39 bp, Artificial Sequence
  Description of Artificial Sequence: Synthetic oligonucleotide
cgaaaaggcgaataatgagaatttgggtcagaatgcttc

SEQ ID NO: 343013 - DNA, 39 bp, Artificial Sequence
  Description of Artificial Sequence: Synthetic oligonucleotide
gaaaaggcgaataatgagaatttgggtcagaatgcttcc

SEQ ID NO: 343014 - DNA, 39 bp, Artificial Sequence
  Description of Artificial Sequence: Synthetic oligonucleotide
aaaaggcgaataatgagaatttgggtcagaatgcttccc

SEQ ID NO: 343015 - DNA, 38 bp, Artificial Sequence
  Description of Artificial Sequence: Synthetic oligonucleotide
aaaggcgaataatgagaatttgggtcagaatgcttccc

SEQ ID NO: 343016 - DNA, 37 bp, Artificial Sequence
  Description of Artificial Sequence: Synthetic oligonucleotide
aaggcgaataatgagaatttgggtcagaatgcttccc

SEQ ID NO: 343017 - DNA, 36 bp, Artificial Sequence
  Description of Artificial Sequence: Synthetic oligonucleotide
aggcgaataatgagaatttgggtcagaatgcttccc

SEQ ID NO: 343018 - DNA, 35 bp, Artificial Sequence
  Description of Artificial Sequence: Synthetic oligonucleotide
ggcgaataatgagaatttgggtcagaatgcttccc

SEQ ID NO: 343019 - DNA, 35 bp, Artificial Sequence
  Description of Artificial Sequence: Synthetic oligonucleotide
gcgaataatgagaatttgggtcagaatgcttcccg

SEQ ID NO: 343020 - DNA, 35 bp, Artificial Sequence
  Description of Artificial Sequence: Synthetic oligonucleotide
cgaataatgagaatttgggtcagaatgcttcccgg

SEQ ID NO: 343021 - DNA, 36 bp, Artificial Sequence
  Description of Artificial Sequence: Synthetic oligonucleotide
gaataatgagaatttgggtcagaatgcttcccggac

SEQ ID NO: 343022 - DNA, 37 bp, Artificial Sequence
  Description of Artificial Sequence: Synthetic oligonucleotide
aataatgagaatttgggtcagaatgcttcccggacag

SEQ ID NO: 343023 - DNA, 36 bp, Artificial Sequence
  Description of Artificial Sequence: Synthetic oligonucleotide
ataatgagaatttgggtcagaatgcttcccggacag

SEQ ID NO: 343024 - DNA, 35 bp, Artificial Sequence
  Description of Artificial Sequence: Synthetic oligonucleotide
taatgagaatttgggtcagaatgcttcccggacag

SEQ ID NO: 343025 - DNA, 34 bp, Artificial Sequence
  Description of Artificial Sequence: Synthetic oligonucleotide
aatgagaatttgggtcagaatgcttcccggacag

SEQ ID NO: 343026 - DNA, 33 bp, Artificial Sequence
  Description of Artificial Sequence: Synthetic oligonucleotide
atgagaatttgggtcagaatgcttcccggacag

SEQ ID NO: 343027 - DNA, 32 bp, Artificial Sequence
  Description of Artificial Sequence: Synthetic oligonucleotide
tgagaatttgggtcagaatgcttcccggacag

SEQ ID NO: 343028 - DNA, 31 bp, Artificial Sequence
  Description of Artificial Sequence: Synthetic oligonucleotide
gagaatttgggtcagaatgcttcccggacag

SEQ ID NO: 343029 - DNA, 31 bp, Artificial Sequence
  Description of Artificial Sequence: Synthetic oligonucleotide
agaatttgggtcagaatgcttcccggacagc

SEQ ID NO: 343030 - DNA, 30 bp, Artificial Sequence
  Description of Artificial Sequence: Synthetic oligonucleotide
gaatttgggtcagaatgcttcccggacagc

SEQ ID NO: 343031 - DNA, 30 bp, Artificial Sequence
  Description of Artificial Sequence: Synthetic oligonucleotide
aatttgggtcagaatgcttcccggacagcc

SEQ ID NO: 343032 - DNA, 29 bp, Artificial Sequence
  Description of Artificial Sequence: Synthetic oligonucleotide
atttgggtcagaatgcttcccggacagcc

SEQ ID NO: 343033 - DNA, 28 bp, Artificial Sequence
  Description of Artificial Sequence: Synthetic oligonucleotide
tttgggtcagaatgcttcccggacagcc

SEQ ID NO: 343034 - DNA, 27 bp, Artificial Sequence
  Description of Artificial Sequence: Synthetic oligonucleotide
ttgggtcagaatgcttcccggacagcc

SEQ ID NO: 343035 - DNA, 27 bp, Artificial Sequence
  Description of Artificial Sequence: Synthetic oligonucleotide
tgggtcagaatgcttcccggacagcca

SEQ ID NO: 343036 - DNA, 27 bp, Artificial Sequence
  Description of Artificial Sequence: Synthetic oligonucleotide
gggtcagaatgcttcccggacagccaa

SEQ ID NO: 343037 - DNA, 27 bp, Artificial Sequence
  Description of Artificial Sequence: Synthetic oligonucleotide
ggtcagaatgcttcccggacagccaac

SEQ ID NO: 343038 - DNA, 27 bp, Artificial Sequence
  Description of Artificial Sequence: Synthetic oligonucleotide
gtcagaatgcttcccggacagccaacc

SEQ ID NO: 343039 - DNA, 27 bp, Artificial Sequence
  Description of Artificial Sequence: Synthetic oligonucleotide
tcagaatgcttcccggacagccaaccg

SEQ ID NO: 343040 - DNA, 26 bp, Artificial Sequence
  Description of Artificial Sequence: Synthetic oligonucleotide
cagaatgcttcccggacagccaaccg

SEQ ID NO: 343041 - DNA, 27 bp, Artificial Sequence
  Description of Artificial Sequence: Synthetic oligonucleotide
agaatgcttcccggacagccaaccgct

SEQ ID NO: 343042 - DNA, 26 bp, Artificial Sequence
  Description of Artificial Sequence: Synthetic oligonucleotide
gaatgcttcccggacagccaaccgct

SEQ ID NO: 343043 - DNA, 26 bp, Artificial Sequence
  Description of Artificial Sequence: Synthetic oligonucleotide
aatgcttcccggacagccaaccgctg

SEQ ID NO: 343044 - DNA, 25 bp, Artificial Sequence
  Description of Artificial Sequence: Synthetic oligonucleotide
atgcttcccggacagccaaccgctg

SEQ ID NO: 343045 - DNA, 24 bp, Artificial Sequence
  Description of Artificial Sequence: Synthetic oligonucleotide
tgcttcccggacagccaaccgctg

SEQ ID NO: 343046 - DNA, 23 bp, Artificial Sequence
  Description of Artificial Sequence: Synthetic oligonucleotide
gcttcccggacagccaaccgctg

SEQ ID NO: 343047 - DNA, 24 bp, Artificial Sequence
  Description of Artificial Sequence: Synthetic oligonucleotide
cttcccggacagccaaccgctgct

SEQ ID NO: 343048 - DNA, 24 bp, Artificial Sequence
  Description of Artificial Sequence: Synthetic oligonucleotide
ttcccggacagccaaccgctgctg

SEQ ID NO: 343049 - DNA, 23 bp, Artificial Sequence
  Description of Artificial Sequence: Synthetic oligonucleotide
tcccggacagccaaccgctgctg

SEQ ID NO: 343050 - DNA, 22 bp, Artificial Sequence
  Description of Artificial Sequence: Synthetic oligonucleotide
cccggacagccaaccgctgctg

SEQ ID NO: 343051 - DNA, 22 bp, Artificial Sequence
  Description of Artificial Sequence: Synthetic oligonucleotide
ccggacagccaaccgctgctgc

SEQ ID NO: 343052 - DNA, 23 bp, Artificial Sequence
  Description of Artificial Sequence: Synthetic oligonucleotide
cggacagccaaccgctgctgcga

SEQ ID NO: 343053 - DNA, 23 bp, Artificial Sequence
  Description of Artificial Sequence: Synthetic oligonucleotide
ggacagccaaccgctgctgcgag

SEQ ID NO: 343054 - DNA, 25 bp, Artificial Sequence
  Description of Artificial Sequence: Synthetic oligonucleotide
gacagccaaccgctgctgcgaggat

SEQ ID NO: 343055 - DNA, 25 bp, Artificial Sequence
  Description of Artificial Sequence: Synthetic oligonucleotide
acagccaaccgctgctgcgaggatg

SEQ ID NO: 343056 - DNA, 24 bp, Artificial Sequence
  Description of Artificial Sequence: Synthetic oligonucleotide
cagccaaccgctgctgcgaggatg

SEQ ID NO: 343057 - DNA, 24 bp, Artificial Sequence
  Description of Artificial Sequence: Synthetic oligonucleotide
agccaaccgctgctgcgaggatgg

SEQ ID NO: 343058 - DNA, 23 bp, Artificial Sequence
  Description of Artificial Sequence: Synthetic oligonucleotide
gccaaccgctgctgcgaggatgg

SEQ ID NO: 343059 - DNA, 23 bp, Artificial Sequence
  Description of Artificial Sequence: Synthetic oligonucleotide
ccaaccgctgctgcgaggatggg

SEQ ID NO: 343060 - DNA, 24 bp, Artificial Sequence
  Description of Artificial Sequence: Synthetic oligonucleotide
caaccgctgctgcgaggatgggga

SEQ ID NO: 343061 - DNA, 25 bp, Artificial Sequence
  Description of Artificial Sequence: Synthetic oligonucleotide
aaccgctgctgcgaggatggggaga

SEQ ID NO: 343062 - DNA, 24 bp, Artificial Sequence
  Description of Artificial Sequence: Synthetic oligonucleotide
accgctgctgcgaggatggggaga

SEQ ID NO: 343063 - DNA, 23 bp, Artificial Sequence
  Description of Artificial Sequence: Synthetic oligonucleotide
ccgctgctgcgaggatggggaga

SEQ ID NO: 343064 - DNA, 24 bp, Artificial Sequence
  Description of Artificial Sequence: Synthetic oligonucleotide
cgctgctgcgaggatggggagaca

SEQ ID NO: 343065 - DNA, 24 bp, Artificial Sequence
  Description of Artificial Sequence: Synthetic oligonucleotide
gctgctgcgaggatggggagacac

SEQ ID NO: 343066 - DNA, 25 bp, Artificial Sequence
  Description of Artificial Sequence: Synthetic oligonucleotide
ctgctgcgaggatggggagacacgt

SEQ ID NO: 343067 - DNA, 26 bp, Artificial Sequence
  Description of Artificial Sequence: Synthetic oligonucleotide
tgctgcgaggatggggagacacgtct

SEQ ID NO: 343068 - DNA, 25 bp, Artificial Sequence
  Description of Artificial Sequence: Synthetic oligonucleotide
gctgcgaggatggggagacacgtct

SEQ ID NO: 343069 - DNA, 25 bp, Artificial Sequence
  Description of Artificial Sequence: Synthetic oligonucleotide
ctgcgaggatggggagacacgtctc

SEQ ID NO: 343070 - DNA, 25 bp, Artificial Sequence
  Description of Artificial Sequence: Synthetic oligonucleotide
tgcgaggatggggagacacgtctcc

SEQ ID NO: 343071 - DNA, 24 bp, Artificial Sequence
  Description of Artificial Sequence: Synthetic oligonucleotide
gcgaggatggggagacacgtctcc

SEQ ID NO: 343072 - DNA, 24 bp, Artificial Sequence
  Description of Artificial Sequence: Synthetic oligonucleotide
cgaggatggggagacacgtctccc

SEQ ID NO: 343073 - DNA, 26 bp, Artificial Sequence
  Description of Artificial Sequence: Synthetic oligonucleotide
gaggatggggagacacgtctccccat

SEQ ID NO: 343074 - DNA, 27 bp, Artificial Sequence
  Description of Artificial Sequence: Synthetic oligonucleotide
aggatggggagacacgtctccccatga

SEQ ID NO: 343075 - DNA, 27 bp, Artificial Sequence
  Description of Artificial Sequence: Synthetic oligonucleotide
ggatggggagacacgtctccccatgat

SEQ ID NO: 343076 - DNA, 27 bp, Artificial Sequence
  Description of Artificial Sequence: Synthetic oligonucleotide
gatggggagacacgtctccccatgatg

SEQ ID NO: 343077 - DNA, 27 bp, Artificial Sequence
  Description of Artificial Sequence: Synthetic oligonucleotide
atggggagacacgtctccccatgatgg

SEQ ID NO: 343078 - DNA, 26 bp, Artificial Sequence
  Description of Artificial Sequence: Synthetic oligonucleotide
tggggagacacgtctccccatgatgg

SEQ ID NO: 343079 - DNA, 25 bp, Artificial Sequence
  Description of Artificial Sequence: Synthetic oligonucleotide
ggggagacacgtctccccatgatgg

SEQ ID NO: 343080 - DNA, 27 bp, Artificial Sequence
  Description of Artificial Sequence: Synthetic oligonucleotide
gggagacacgtctccccatgatgggtt

SEQ ID NO: 343081 - DNA, 27 bp, Artificial Sequence
  Description of Artificial Sequence: Synthetic oligonucleotide
ggagacacgtctccccatgatgggttc

SEQ ID NO: 343082 - DNA, 27 bp, Artificial Sequence
  Description of Artificial Sequence: Synthetic oligonucleotide
gagacacgtctccccatgatgggttcc

SEQ ID NO: 343083 - DNA, 28 bp, Artificial Sequence
  Description of Artificial Sequence: Synthetic oligonucleotide
agacacgtctccccatgatgggttcctg

SEQ ID NO: 343084 - DNA, 27 bp, Artificial Sequence
  Description of Artificial Sequence: Synthetic oligonucleotide
gacacgtctccccatgatgggttcctg

SEQ ID NO: 343085 - DNA, 27 bp, Artificial Sequence
  Description of Artificial Sequence: Synthetic oligonucleotide
acacgtctccccatgatgggttcctgc

SEQ ID NO: 343086 - DNA, 26 bp, Artificial Sequence
  Description of Artificial Sequence: Synthetic oligonucleotide
cacgtctccccatgatgggttcctgc

SEQ ID NO: 343087 - DNA, 27 bp, Artificial Sequence
  Description of Artificial Sequence: Synthetic oligonucleotide
acgtctccccatgatgggttcctgcgt

SEQ ID NO: 343088 - DNA, 26 bp, Artificial Sequence
  Description of Artificial Sequence: Synthetic oligonucleotide
cgtctccccatgatgggttcctgcgt

SEQ ID NO: 343089 - DNA, 26 bp, Artificial Sequence
  Description of Artificial Sequence: Synthetic oligonucleotide
gtctccccatgatgggttcctgcgtg

SEQ ID NO: 343090 - DNA, 27 bp, Artificial Sequence
  Description of Artificial Sequence: Synthetic oligonucleotide
tctccccatgatgggttcctgcgtgca

SEQ ID NO: 343091 - DNA, 26 bp, Artificial Sequence
  Description of Artificial Sequence: Synthetic oligonucleotide
ctccccatgatgggttcctgcgtgca

SEQ ID NO: 343092 - DNA, 26 bp, Artificial Sequence
  Description of Artificial Sequence: Synthetic oligonucleotide
tccccatgatgggttcctgcgtgcag

SEQ ID NO: 343093 - DNA, 25 bp, Artificial Sequence
  Description of Artificial Sequence: Synthetic oligonucleotide
ccccatgatgggttcctgcgtgcag

SEQ ID NO: 343094 - DNA, 25 bp, Artificial Sequence
  Description of Artificial Sequence: Synthetic oligonucleotide
cccatgatgggttcctgcgtgcagc

SEQ ID NO: 343095 - DNA, 25 bp, Artificial Sequence
  Description of Artificial Sequence: Synthetic oligonucleotide
ccatgatgggttcctgcgtgcagcg

SEQ ID NO: 343096 - DNA, 25 bp, Artificial Sequence
  Description of Artificial Sequence: Synthetic oligonucleotide
catgatgggttcctgcgtgcagcgg

SEQ ID NO: 343097 - DNA, 25 bp, Artificial Sequence
  Description of Artificial Sequence: Synthetic oligonucleotide
atgatgggttcctgcgtgcagcggg

SEQ ID NO: 343098 - DNA, 24 bp, Artificial Sequence
  Description of Artificial Sequence: Synthetic oligonucleotide
tgatgggttcctgcgtgcagcggg

SEQ ID NO: 343099 - DNA, 23 bp, Artificial Sequence
  Description of Artificial Sequence: Synthetic oligonucleotide
gatgggttcctgcgtgcagcggg

SEQ ID NO: 343100 - DNA, 24 bp, Artificial Sequence
  Description of Artificial Sequence: Synthetic oligonucleotide
atgggttcctgcgtgcagcgggct

SEQ ID NO: 343101 - DNA, 23 bp, Artificial Sequence
  Description of Artificial Sequence: Synthetic oligonucleotide
tgggttcctgcgtgcagcgggct

SEQ ID NO: 343102 - DNA, 22 bp, Artificial Sequence
  Description of Artificial Sequence: Synthetic oligonucleotide
gggttcctgcgtgcagcgggct

SEQ ID NO: 343103 - DNA, 22 bp, Artificial Sequence
  Description of Artificial Sequence: Synthetic oligonucleotide
ggttcctgcgtgcagcgggctg

SEQ ID NO: 343104 - DNA, 22 bp, Artificial Sequence
  Description of Artificial Sequence: Synthetic oligonucleotide
gttcctgcgtgcagcgggctgc

SEQ ID NO: 343105 - DNA, 22 bp, Artificial Sequence
  Description of Artificial Sequence: Synthetic oligonucleotide
ttcctgcgtgcagcgggctgcc

SEQ ID NO: 343106 - DNA, 21 bp, Artificial Sequence
  Description of Artificial Sequence: Synthetic oligonucleotide
tcctgcgtgcagcgggctgcc

SEQ ID NO: 343107 - DNA, 20 bp, Artificial Sequence
  Description of Artificial Sequence: Synthetic oligonucleotide
cctgcgtgcagcgggctgcc

SEQ ID NO: 343108 - DNA, 20 bp, Artificial Sequence
  Description of Artificial Sequence: Synthetic oligonucleotide
ctgcgtgcagcgggctgccc

SEQ ID NO: 343109 - DNA, 20 bp, Artificial Sequence
  Description of Artificial Sequence: Synthetic oligonucleotide
tgcgtgcagcgggctgcccg

SEQ ID NO: 343110 - DNA, 20 bp, Artificial Sequence
  Description of Artificial Sequence: Synthetic oligonucleotide
gcgtgcagcgggctgcccgt

SEQ ID NO: 343111 - DNA, 20 bp, Artificial Sequence
  Description of Artificial Sequence: Synthetic oligonucleotide
cgtgcagcgggctgcccgct

SEQ ID NO: 343112 - DNA, 20 bp, Artificial Sequence
  Description of Artificial Sequence: Synthetic oligonucleotide
gtgcagcgggctgcccgcgt

SEQ ID NO: 343113 - DNA, 20 bp, Artificial Sequence
  Description of Artificial Sequence: Synthetic oligonucleotide
tgcagcgggctgcccgcgtg

SEQ ID NO: 343114 - DNA, 20 bp, Artificial Sequence
  Description of Artificial Sequence: Synthetic oligonucleotide
gcagcgggctgcccgcgtgt

SEQ ID NO: 343115 - DNA, 20 bp, Artificial Sequence
  Description of Artificial Sequence: Synthetic oligonucleotide
cagcgggctgcccgcgtgga

SEQ ID NO: 343116 - DNA, 20 bp, Artificial Sequence
  Description of Artificial Sequence: Synthetic oligonucleotide
agcgggctgcccgcgtggag

SEQ ID NO: 343117 - DNA, 20 bp, Artificial Sequence
  Description of Artificial Sequence: Synthetic oligonucleotide
gcgggctgcccgcgtggagt

SEQ ID NO: 343118 - DNA, 20 bp, Artificial Sequence
  Description of Artificial Sequence: Synthetic oligonucleotide
cgggctgcccgcgtggagca

SEQ ID NO: 343119 - DNA, 20 bp, Artificial Sequence
  Description of Artificial Sequence: Synthetic oligonucleotide
gggctgcccgcgtggagcag

SEQ ID NO: 343120 - DNA, 20 bp, Artificial Sequence
  Description of Artificial Sequence: Synthetic oligonucleotide
ggctgcccgcgtggagcagc

SEQ ID NO: 343121 - DNA, 20 bp, Artificial Sequence
  Description of Artificial Sequence: Synthetic oligonucleotide
gctgcccgcgtggagcagcc

SEQ ID NO: 343122 - DNA, 20 bp, Artificial Sequence
  Description of Artificial Sequence: Synthetic oligonucleotide
ctgcccgcgtggagcagccg

SEQ ID NO: 343123 - DNA, 21 bp, Artificial Sequence
  Description of Artificial Sequence: Synthetic oligonucleotide
tgcccgcgtggagcagccggt

SEQ ID NO: 343124 - DNA, 20 bp, Artificial Sequence
  Description of Artificial Sequence: Synthetic oligonucleotide
gcccgcgtggagcagccggt

SEQ ID NO: 343125 - DNA, 21 bp, Artificial Sequence
  Description of Artificial Sequence: Synthetic oligonucleotide
cccgcgtggagcagccggtct

SEQ ID NO: 343126 - DNA, 21 bp, Artificial Sequence
  Description of Artificial Sequence: Synthetic oligonucleotide
ccgcgtggagcagccggtctg

SEQ ID NO: 343127 - DNA, 21 bp, Artificial Sequence
  Description of Artificial Sequence: Synthetic oligonucleotide
cgcgtggagcagccggtctgc

SEQ ID NO: 343128 - DNA, 21 bp, Artificial Sequence
  Description of Artificial Sequence: Synthetic oligonucleotide
gcgtggagcagccggtctgcc

SEQ ID NO: 343129 - DNA, 21 bp, Artificial Sequence
  Description of Artificial Sequence: Synthetic oligonucleotide
cgtggagcagccggtctgccg

SEQ ID NO: 343130 - DNA, 21 bp, Artificial Sequence
  Description of Artificial Sequence: Synthetic oligonucleotide
gtggagcagccggtctgccgg

SEQ ID NO: 343131 - DNA, 22 bp, Artificial Sequence
  Description of Artificial Sequence: Synthetic oligonucleotide
tggagcagccggtctgccggga

SEQ ID NO: 343132 - DNA, 21 bp, Artificial Sequence
  Description of Artificial Sequence: Synthetic oligonucleotide
ggagcagccggtctgccggga

SEQ ID NO: 343133 - DNA, 21 bp, Artificial Sequence
  Description of Artificial Sequence: Synthetic oligonucleotide
gagcagccggtctgccgggac

SEQ ID NO: 343134 - DNA, 21 bp, Artificial Sequence
  Description of Artificial Sequence: Synthetic oligonucleotide
agcagccggtctgccgggacc

SEQ ID NO: 343135 - DNA, 20 bp, Artificial Sequence
  Description of Artificial Sequence: Synthetic oligonucleotide
gcagccggtctgccgggacc

SEQ ID NO: 343136 - DNA, 20 bp, Artificial Sequence
  Description of Artificial Sequence: Synthetic oligonucleotide
cagccggtctgccgggaccc

SEQ ID NO: 343137 - DNA, 22 bp, Artificial Sequence
  Description of Artificial Sequence: Synthetic oligonucleotide
agccggtctgccgggacccctt

SEQ ID NO: 343138 - DNA, 21 bp, Artificial Sequence
  Description of Artificial Sequence: Synthetic oligonucleotide
gccggtctgccgggacccctt

SEQ ID NO: 343139 - DNA, 21 bp, Artificial Sequence
  Description of Artificial Sequence: Synthetic oligonucleotide
ccggtctgccgggaccccttc

SEQ ID NO: 343140 - DNA, 22 bp, Artificial Sequence
  Description of Artificial Sequence: Synthetic oligonucleotide
cggtctgccgggaccccttcct

SEQ ID NO: 343141 - DNA, 23 bp, Artificial Sequence
  Description of Artificial Sequence: Synthetic oligonucleotide
ggtctgccgggaccccttcctga

SEQ ID NO: 343142 - DNA, 23 bp, Artificial Sequence
  Description of Artificial Sequence: Synthetic oligonucleotide
gtctgccgggaccccttcctgac

SEQ ID NO: 343143 - DNA, 24 bp, Artificial Sequence
  Description of Artificial Sequence: Synthetic oligonucleotide
tctgccgggaccccttcctgacct

SEQ ID NO: 343144 - DNA, 23 bp, Artificial Sequence
  Description of Artificial Sequence: Synthetic oligonucleotide
ctgccgggaccccttcctgacct

SEQ ID NO: 343145 - DNA, 23 bp, Artificial Sequence
  Description of Artificial Sequence: Synthetic oligonucleotide
tgccgggaccccttcctgacctg

SEQ ID NO: 343146 - DNA, 22 bp, Artificial Sequence
  Description of Artificial Sequence: Synthetic oligonucleotide
gccgggaccccttcctgacctg

SEQ ID NO: 343147 - DNA, 23 bp, Artificial Sequence
  Description of Artificial Sequence: Synthetic oligonucleotide
ccgggaccccttcctgacctgct

SEQ ID NO: 343148 - DNA, 23 bp, Artificial Sequence
  Description of Artificial Sequence: Synthetic oligonucleotide
cgggaccccttcctgacctgctg

SEQ ID NO: 343149 - DNA, 23 bp, Artificial Sequence
  Description of Artificial Sequence: Synthetic oligonucleotide
gggaccccttcctgacctgctgc

SEQ ID NO: 343150 - DNA, 27 bp, Artificial Sequence
  Description of Artificial Sequence: Synthetic oligonucleotide
ggaccccttcctgacctgctgcctatt

SEQ ID NO: 343151 - DNA, 28 bp, Artificial Sequence
  Description of Artificial Sequence: Synthetic oligonucleotide
gaccccttcctgacctgctgcctatttg

SEQ ID NO: 343152 - DNA, 28 bp, Artificial Sequence
  Description of Artificial Sequence: Synthetic oligonucleotide
accccttcctgacctgctgcctatttgc

SEQ ID NO: 343153 - DNA, 27 bp, Artificial Sequence
  Description of Artificial Sequence: Synthetic oligonucleotide
ccccttcctgacctgctgcctatttgc

SEQ ID NO: 343154 - DNA, 28 bp, Artificial Sequence
  Description of Artificial Sequence: Synthetic oligonucleotide
cccttcctgacctgctgcctatttgctg

SEQ ID NO: 343155 - DNA, 29 bp, Artificial Sequence
  Description of Artificial Sequence: Synthetic oligonucleotide
ccttcctgacctgctgcctatttgctgac

SEQ ID NO: 343156 - DNA, 30 bp, Artificial Sequence
  Description of Artificial Sequence: Synthetic oligonucleotide
cttcctgacctgctgcctatttgctgacag

SEQ ID NO: 343157 - DNA, 31 bp, Artificial Sequence
  Description of Artificial Sequence: Synthetic oligonucleotide
ttcctgacctgctgcctatttgctgacagtc

SEQ ID NO: 343158 - DNA, 30 bp, Artificial Sequence
  Description of Artificial Sequence: Synthetic oligonucleotide
tcctgacctgctgcctatttgctgacagtc

SEQ ID NO: 343159 - DNA, 29 bp, Artificial Sequence
  Description of Artificial Sequence: Synthetic oligonucleotide
cctgacctgctgcctatttgctgacagtc

SEQ ID NO: 343160 - DNA, 30 bp, Artificial Sequence
  Description of Artificial Sequence: Synthetic oligonucleotide
ctgacctgctgcctatttgctgacagtctg

SEQ ID NO: 343161 - DNA, 30 bp, Artificial Sequence
  Description of Artificial Sequence: Synthetic oligonucleotide
tgacctgctgcctatttgctgacagtctgc

SEQ ID NO: 343162 - DNA, 29 bp, Artificial Sequence
  Description of Artificial Sequence: Synthetic oligonucleotide
gacctgctgcctatttgctgacagtctgc

SEQ ID NO: 343163 - DNA, 29 bp, Artificial Sequence
  Description of Artificial Sequence: Synthetic oligonucleotide
acctgctgcctatttgctgacagtctgcg

SEQ ID NO: 343164 - DNA, 28 bp, Artificial Sequence
  Description of Artificial Sequence: Synthetic oligonucleotide
cctgctgcctatttgctgacagtctgcg

SEQ ID NO: 343165 - DNA, 28 bp, Artificial Sequence
  Description of Artificial Sequence: Synthetic oligonucleotide
ctgctgcctatttgctgacagtctgcgc

SEQ ID NO: 343166 - DNA, 30 bp, Artificial Sequence
  Description of Artificial Sequence: Synthetic oligonucleotide
tgctgcctatttgctgacagtctgcgctag

SEQ ID NO: 343167 - DNA, 29 bp, Artificial Sequence
  Description of Artificial Sequence: Synthetic oligonucleotide
gctgcctatttgctgacagtctgcgctag

SEQ ID NO: 343168 - DNA, 31 bp, Artificial Sequence
  Description of Artificial Sequence: Synthetic oligonucleotide
ctgcctatttgctgacagtctgcgctagaag

SEQ ID NO: 343169 - DNA, 32 bp, Artificial Sequence
  Description of Artificial Sequence: Synthetic oligonucleotide
tgcctatttgctgacagtctgcgctagaagag

SEQ ID NO: 343170 - DNA, 31 bp, Artificial Sequence
  Description of Artificial Sequence: Synthetic oligonucleotide
gcctatttgctgacagtctgcgctagaagag

SEQ ID NO: 343171 - DNA, 31 bp, Artificial Sequence
  Description of Artificial Sequence: Synthetic oligonucleotide
cctatttgctgacagtctgcgctagaagagc

SEQ ID NO: 343172 - DNA, 32 bp, Artificial Sequence
  Description of Artificial Sequence: Synthetic oligonucleotide
ctatttgctgacagtctgcgctagaagagcac

SEQ ID NO: 343173 - DNA, 32 bp, Artificial Sequence
  Description of Artificial Sequence: Synthetic oligonucleotide
tatttgctgacagtctgcgctagaagagcacg

SEQ ID NO: 343174 - DNA, 31 bp, Artificial Sequence
  Description of Artificial Sequence: Synthetic oligonucleotide
atttgctgacagtctgcgctagaagagcacg

SEQ ID NO: 343175 - DNA, 30 bp, Artificial Sequence
  Description of Artificial Sequence: Synthetic oligonucleotide
tttgctgacagtctgcgctagaagagcacg

SEQ ID NO: 343176 - DNA, 29 bp, Artificial Sequence
  Description of Artificial Sequence: Synthetic oligonucleotide
ttgctgacagtctgcgctagaagagcacg

SEQ ID NO: 343177 - DNA, 28 bp, Artificial Sequence
  Description of Artificial Sequence: Synthetic oligonucleotide
tgctgacagtctgcgctagaagagcacg

SEQ ID NO: 343178 - DNA, 27 bp, Artificial Sequence
  Description of Artificial Sequence: Synthetic oligonucleotide
gctgacagtctgcgctagaagagcacg

SEQ ID NO: 343179 - DNA, 27 bp, Artificial Sequence
  Description of Artificial Sequence: Synthetic oligonucleotide
ctgacagtctgcgctagaagagcacgg

SEQ ID NO: 343180 - DNA, 28 bp, Artificial Sequence
  Description of Artificial Sequence: Synthetic oligonucleotide
tgacagtctgcgctagaagagcacggac

SEQ ID NO: 343181 - DNA, 27 bp, Artificial Sequence
  Description of Artificial Sequence: Synthetic oligonucleotide
gacagtctgcgctagaagagcacggac

SEQ ID NO: 343182 - DNA, 29 bp, Artificial Sequence
  Description of Artificial Sequence: Synthetic oligonucleotide
acagtctgcgctagaagagcacggacaag

SEQ ID NO: 343183 - DNA, 28 bp, Artificial Sequence
  Description of Artificial Sequence: Synthetic oligonucleotide
cagtctgcgctagaagagcacggacaag

SEQ ID NO: 343184 - DNA, 28 bp, Artificial Sequence
  Description of Artificial Sequence: Synthetic oligonucleotide
agtctgcgctagaagagcacggacaagg

SEQ ID NO: 343185 - DNA, 27 bp, Artificial Sequence
  Description of Artificial Sequence: Synthetic oligonucleotide
gtctgcgctagaagagcacggacaagg

SEQ ID NO: 343186 - DNA, 27 bp, Artificial Sequence
  Description of Artificial Sequence: Synthetic oligonucleotide
tctgcgctagaagagcacggacaaggg

SEQ ID NO: 343187 - DNA, 26 bp, Artificial Sequence
  Description of Artificial Sequence: Synthetic oligonucleotide
ctgcgctagaagagcacggacaaggg

SEQ ID NO: 343188 - DNA, 26 bp, Artificial Sequence
  Description of Artificial Sequence: Synthetic oligonucleotide
tgcgctagaagagcacggacaagggg

SEQ ID NO: 343189 - DNA, 25 bp, Artificial Sequence
  Description of Artificial Sequence: Synthetic oligonucleotide
gcgctagaagagcacggacaagggg

SEQ ID NO: 343190 - DNA, 26 bp, Artificial Sequence
  Description of Artificial Sequence: Synthetic oligonucleotide
cgctagaagagcacggacaaggggca

SEQ ID NO: 343191 - DNA, 26 bp, Artificial Sequence
  Description of Artificial Sequence: Synthetic oligonucleotide
gctagaagagcacggacaaggggcag

SEQ ID NO: 343192 - DNA, 26 bp, Artificial Sequence
  Description of Artificial Sequence: Synthetic oligonucleotide
ctagaagagcacggacaaggggcagg

SEQ ID NO: 343193 - DNA, 26 bp, Artificial Sequence
  Description of Artificial Sequence: Synthetic oligonucleotide
tagaagagcacggacaaggggcaggc

SEQ ID NO: 343194 - DNA, 25 bp, Artificial Sequence
  Description of Artificial Sequence: Synthetic oligonucleotide
agaagagcacggacaaggggcaggc

SEQ ID NO: 343195 - DNA, 24 bp, Artificial Sequence
  Description of Artificial Sequence: Synthetic oligonucleotide
gaagagcacggacaaggggcaggc

SEQ ID NO: 343196 - DNA, 24 bp, Artificial Sequence
  Description of Artificial Sequence: Synthetic oligonucleotide
aagagcacggacaaggggcaggcg

SEQ ID NO: 343197 - DNA, 23 bp, Artificial Sequence
  Description of Artificial Sequence: Synthetic oligonucleotide
agagcacggacaaggggcaggcg

SEQ ID NO: 343198 - DNA, 22 bp, Artificial Sequence
  Description of Artificial Sequence: Synthetic oligonucleotide
gagcacggacaaggggcaggcg

SEQ ID NO: 343199 - DNA, 22 bp, Artificial Sequence
  Description of Artificial Sequence: Synthetic oligonucleotide
agcacggacaaggggcaggcgg

SEQ ID NO: 343200 - DNA, 21 bp, Artificial Sequence
  Description of Artificial Sequence: Synthetic oligonucleotide
gcacggacaaggggcaggcgg

SEQ ID NO: 343201 - DNA, 21 bp, Artificial Sequence
  Description of Artificial Sequence: Synthetic oligonucleotide
cacggacaaggggcaggcggg

SEQ ID NO: 343202 - DNA, 21 bp, Artificial Sequence
  Description of Artificial Sequence: Synthetic oligonucleotide
acggacaaggggcaggcgggc

SEQ ID NO: 343203 - DNA, 20 bp, Artificial Sequence
  Description of Artificial Sequence: Synthetic oligonucleotide
cggacaaggggcaggcgggc

SEQ ID NO: 343204 - DNA, 21 bp, Artificial Sequence
  Description of Artificial Sequence: Synthetic oligonucleotide
ggacaaggggcaggcgggcgt

SEQ ID NO: 343205 - DNA, 21 bp, Artificial Sequence
  Description of Artificial Sequence: Synthetic oligonucleotide
gacaaggggcaggcgggcgtc

SEQ ID NO: 343206 - DNA, 23 bp, Artificial Sequence
  Description of Artificial Sequence: Synthetic oligonucleotide
acaaggggcaggcgggcgtccaa

SEQ ID NO: 343207 - DNA, 22 bp, Artificial Sequence
  Description of Artificial Sequence: Synthetic oligonucleotide
caaggggcaggcgggcgtccaa

SEQ ID NO: 343208 - DNA, 22 bp, Artificial Sequence
  Description of Artificial Sequence: Synthetic oligonucleotide
aaggggcaggcgggcgtccaac

SEQ ID NO: 343209 - DNA, 21 bp, Artificial Sequence
  Description of Artificial Sequence: Synthetic oligonucleotide
aggggcaggcgggcgtccaac

SEQ ID NO: 343210 - DNA, 20 bp, Artificial Sequence
  Description of Artificial Sequence: Synthetic oligonucleotide
ggggcaggcgggcgtccaac

SEQ ID NO: 343211 - DNA, 21 bp, Artificial Sequence
  Description of Artificial Sequence: Synthetic oligonucleotide
gggcaggcgggcgtccaacga

SEQ ID NO: 343212 - DNA, 21 bp, Artificial Sequence
  Description of Artificial Sequence: Synthetic oligonucleotide
ggcaggcgggcgtccaacgag

SEQ ID NO: 343213 - DNA, 21 bp, Artificial Sequence
  Description of Artificial Sequence: Synthetic oligonucleotide
gcaggcgggcgtccaacgagg

SEQ ID NO: 343214 - DNA, 21 bp, Artificial Sequence
  Description of Artificial Sequence: Synthetic oligonucleotide
caggcgggcgtccaacgaggc

SEQ ID NO: 343215 - DNA, 22 bp, Artificial Sequence
  Description of Artificial Sequence: Synthetic oligonucleotide
aggcgggcgtccaacgaggcct

SEQ ID NO: 343216 - DNA, 21 bp, Artificial Sequence
  Description of Artificial Sequence: Synthetic oligonucleotide
ggcgggcgtccaacgaggcct

SEQ ID NO: 343217 - DNA, 21 bp, Artificial Sequence
  Description of Artificial Sequence: Synthetic oligonucleotide
gcgggcgtccaacgaggcctg

SEQ ID NO: 343218 - DNA, 22 bp, Artificial Sequence
  Description of Artificial Sequence: Synthetic oligonucleotide
cgggcgtccaacgaggcctgga

SEQ ID NO: 343219 - DNA, 24 bp, Artificial Sequence
  Description of Artificial Sequence: Synthetic oligonucleotide
gggcgtccaacgaggcctggagat

SEQ ID NO: 343220 - DNA, 24 bp, Artificial Sequence
  Description of Artificial Sequence: Synthetic oligonucleotide
ggcgtccaacgaggcctggagatg

SEQ ID NO: 343221 - DNA, 25 bp, Artificial Sequence
  Description of Artificial Sequence: Synthetic oligonucleotide
gcgtccaacgaggcctggagatgct

SEQ ID NO: 343222 - DNA, 25 bp, Artificial Sequence
  Description of Artificial Sequence: Synthetic oligonucleotide
cgtccaacgaggcctggagatgctg

SEQ ID NO: 343223 - DNA, 26 bp, Artificial Sequence
  Description of Artificial Sequence: Synthetic oligonucleotide
gtccaacgaggcctggagatgctgca

SEQ ID NO: 343224 - DNA, 26 bp, Artificial Sequence
  Description of Artificial Sequence: Synthetic oligonucleotide
tccaacgaggcctggagatgctgcag

SEQ ID NO: 343225 - DNA, 25 bp, Artificial Sequence
  Description of Artificial Sequence: Synthetic oligonucleotide
ccaacgaggcctggagatgctgcag

SEQ ID NO: 343226 - DNA, 26 bp, Artificial Sequence
  Description of Artificial Sequence: Synthetic oligonucleotide
caacgaggcctggagatgctgcagga

SEQ ID NO: 343227 - DNA, 26 bp, Artificial Sequence
  Description of Artificial Sequence: Synthetic oligonucleotide
aacgaggcctggagatgctgcaggag

SEQ ID NO: 343228 - DNA, 25 bp, Artificial Sequence
  Description of Artificial Sequence: Synthetic oligonucleotide
acgaggcctggagatgctgcaggag

SEQ ID NO: 343229 - DNA, 24 bp, Artificial Sequence
  Description of Artificial Sequence: Synthetic oligonucleotide
cgaggcctggagatgctgcaggag

SEQ ID NO: 343230 - DNA, 25 bp, Artificial Sequence
  Description of Artificial Sequence: Synthetic oligonucleotide
gaggcctggagatgctgcaggagca

SEQ ID NO: 343231 - DNA, 25 bp, Artificial Sequence
  Description of Artificial Sequence: Synthetic oligonucleotide
aggcctggagatgctgcaggagcag

SEQ ID NO: 343232 - DNA, 24 bp, Artificial Sequence
  Description of Artificial Sequence: Synthetic oligonucleotide
ggcctggagatgctgcaggagcag

SEQ ID NO: 343233 - DNA, 25 bp, Artificial Sequence
  Description of Artificial Sequence: Synthetic oligonucleotide
gcctggagatgctgcaggagcagga

SEQ ID NO: 343234 - DNA, 25 bp, Artificial Sequence
  Description of Artificial Sequence: Synthetic oligonucleotide
cctggagatgctgcaggagcaggac

SEQ ID NO: 343235 - DNA, 26 bp, Artificial Sequence
  Description of Artificial Sequence: Synthetic oligonucleotide
ctggagatgctgcaggagcaggacct

SEQ ID NO: 343236 - DNA, 27 bp, Artificial Sequence
  Description of Artificial Sequence: Synthetic oligonucleotide
tggagatgctgcaggagcaggacctga

SEQ ID NO: 343237 - DNA, 27 bp, Artificial Sequence
  Description of Artificial Sequence: Synthetic oligonucleotide
ggagatgctgcaggagcaggacctgaa

SEQ ID NO: 343238 - DNA, 28 bp, Artificial Sequence
  Description of Artificial Sequence: Synthetic oligonucleotide
gagatgctgcaggagcaggacctgaatg

SEQ ID NO: 343239 - DNA, 30 bp, Artificial Sequence
  Description of Artificial Sequence: Synthetic oligonucleotide
agatgctgcaggagcaggacctgaatgatg

SEQ ID NO: 343240 - DNA, 29 bp, Artificial Sequence
  Description of Artificial Sequence: Synthetic oligonucleotide
gatgctgcaggagcaggacctgaatgatg

SEQ ID NO: 343241 - DNA, 30 bp, Artificial Sequence
  Description of Artificial Sequence: Synthetic oligonucleotide
atgctgcaggagcaggacctgaatgatgag

SEQ ID NO: 343242 - DNA, 29 bp, Artificial Sequence
  Description of Artificial Sequence: Synthetic oligonucleotide
tgctgcaggagcaggacctgaatgatgag

SEQ ID NO: 343243 - DNA, 28 bp, Artificial Sequence
  Description of Artificial Sequence: Synthetic oligonucleotide
gctgcaggagcaggacctgaatgatgag

SEQ ID NO: 343244 - DNA, 28 bp, Artificial Sequence
  Description of Artificial Sequence: Synthetic oligonucleotide
ctgcaggagcaggacctgaatgatgagg

SEQ ID NO: 343245 - DNA, 30 bp, Artificial Sequence
  Description of Artificial Sequence: Synthetic oligonucleotide
tgcaggagcaggacctgaatgatgaggaag

SEQ ID NO: 343246 - DNA, 29 bp, Artificial Sequence
  Description of Artificial Sequence: Synthetic oligonucleotide
gcaggagcaggacctgaatgatgaggaag

SEQ ID NO: 343247 - DNA, 30 bp, Artificial Sequence
  Description of Artificial Sequence: Synthetic oligonucleotide
caggagcaggacctgaatgatgaggaagac

SEQ ID NO: 343248 - DNA, 33 bp, Artificial Sequence
  Description of Artificial Sequence: Synthetic oligonucleotide
aggagcaggacctgaatgatgaggaagacattc

SEQ ID NO: 343249 - DNA, 32 bp, Artificial Sequence
  Description of Artificial Sequence: Synthetic oligonucleotide
ggagcaggacctgaatgatgaggaagacattc

SEQ ID NO: 343250 - DNA, 32 bp, Artificial Sequence
  Description of Artificial Sequence: Synthetic oligonucleotide
gagcaggacctgaatgatgaggaagacattcc

SEQ ID NO: 343251 - DNA, 32 bp, Artificial Sequence
  Description of Artificial Sequence: Synthetic oligonucleotide
agcaggacctgaatgatgaggaagacattccc

SEQ ID NO: 343252 - DNA, 31 bp, Artificial Sequence
  Description of Artificial Sequence: Synthetic oligonucleotide
gcaggacctgaatgatgaggaagacattccc

SEQ ID NO: 343253 - DNA, 31 bp, Artificial Sequence
  Description of Artificial Sequence: Synthetic oligonucleotide
caggacctgaatgatgaggaagacattcccc

SEQ ID NO: 343254 - DNA, 32 bp, Artificial Sequence
  Description of Artificial Sequence: Synthetic oligonucleotide
aggacctgaatgatgaggaagacattcccctg

SEQ ID NO: 343255 - DNA, 31 bp, Artificial Sequence
  Description of Artificial Sequence: Synthetic oligonucleotide
ggacctgaatgatgaggaagacattcccctg

SEQ ID NO: 343256 - DNA, 31 bp, Artificial Sequence
  Description of Artificial Sequence: Synthetic oligonucleotide
gacctgaatgatgaggaagacattcccctgc

SEQ ID NO: 343257 - DNA, 31 bp, Artificial Sequence
  Description of Artificial Sequence: Synthetic oligonucleotide
acctgaatgatgaggaagacattcccctgcg

SEQ ID NO: 343258 - DNA, 30 bp, Artificial Sequence
  Description of Artificial Sequence: Synthetic oligonucleotide
cctgaatgatgaggaagacattcccctgcg

SEQ ID NO: 343259 - DNA, 30 bp, Artificial Sequence
  Description of Artificial Sequence: Synthetic oligonucleotide
ctgaatgatgaggaagacattcccctgcgc

SEQ ID NO: 343260 - DNA, 31 bp, Artificial Sequence
  Description of Artificial Sequence: Synthetic oligonucleotide
tgaatgatgaggaagacattcccctgcgcag

SEQ ID NO: 343261 - DNA, 30 bp, Artificial Sequence
  Description of Artificial Sequence: Synthetic oligonucleotide
gaatgatgaggaagacattcccctgcgcag

SEQ ID NO: 343262 - DNA, 30 bp, Artificial Sequence
  Description of Artificial Sequence: Synthetic oligonucleotide
aatgatgaggaagacattcccctgcgcagc

SEQ ID NO: 343263 - DNA, 29 bp, Artificial Sequence
  Description of Artificial Sequence: Synthetic oligonucleotide
atgatgaggaagacattcccctgcgcagc

SEQ ID NO: 343264 - DNA, 28 bp, Artificial Sequence
  Description of Artificial Sequence: Synthetic oligonucleotide
tgatgaggaagacattcccctgcgcagc

SEQ ID NO: 343265 - DNA, 27 bp, Artificial Sequence
  Description of Artificial Sequence: Synthetic oligonucleotide
gatgaggaagacattcccctgcgcagc

SEQ ID NO: 343266 - DNA, 29 bp, Artificial Sequence
  Description of Artificial Sequence: Synthetic oligonucleotide
atgaggaagacattcccctgcgcagctac

SEQ ID NO: 343267 - DNA, 28 bp, Artificial Sequence
  Description of Artificial Sequence: Synthetic oligonucleotide
tgaggaagacattcccctgcgcagctac

SEQ ID NO: 343268 - DNA, 27 bp, Artificial Sequence
  Description of Artificial Sequence: Synthetic oligonucleotide
gaggaagacattcccctgcgcagctac

SEQ ID NO: 343269 - DNA, 29 bp, Artificial Sequence
  Description of Artificial Sequence: Synthetic oligonucleotide
aggaagacattcccctgcgcagctacttc

SEQ ID NO: 343270 - DNA, 28 bp, Artificial Sequence
  Description of Artificial Sequence: Synthetic oligonucleotide
ggaagacattcccctgcgcagctacttc

SEQ ID NO: 343271 - DNA, 28 bp, Artificial Sequence
  Description of Artificial Sequence: Synthetic oligonucleotide
gaagacattcccctgcgcagctacttcc

SEQ ID NO: 343272 - DNA, 28 bp, Artificial Sequence
  Description of Artificial Sequence: Synthetic oligonucleotide
aagacattcccctgcgcagctacttccc

SEQ ID NO: 343273 - DNA, 27 bp, Artificial Sequence
  Description of Artificial Sequence: Synthetic oligonucleotide
agacattcccctgcgcagctacttccc

SEQ ID NO: 343274 - DNA, 27 bp, Artificial Sequence
  Description of Artificial Sequence: Synthetic oligonucleotide
gacattcccctgcgcagctacttccca

SEQ ID NO: 343275 - DNA, 27 bp, Artificial Sequence
  Description of Artificial Sequence: Synthetic oligonucleotide
acattcccctgcgcagctacttcccag

SEQ ID NO: 343276 - DNA, 27 bp, Artificial Sequence
  Description of Artificial Sequence: Synthetic oligonucleotide
cattcccctgcgcagctacttcccaga

SEQ ID NO: 343277 - DNA, 27 bp, Artificial Sequence
  Description of Artificial Sequence: Synthetic oligonucleotide
attcccctgcgcagctacttcccagac

SEQ ID NO: 343278 - DNA, 27 bp, Artificial Sequence
  Description of Artificial Sequence: Synthetic oligonucleotide
ttcccctgcgcagctacttcccagaca

SEQ ID NO: 343279 - DNA, 27 bp, Artificial Sequence
  Description of Artificial Sequence: Synthetic oligonucleotide
tcccctgcgcagctacttcccagacaa

SEQ ID NO: 343280 - DNA, 26 bp, Artificial Sequence
  Description of Artificial Sequence: Synthetic oligonucleotide
cccctgcgcagctacttcccagacaa

SEQ ID NO: 343281 - DNA, 27 bp, Artificial Sequence
  Description of Artificial Sequence: Synthetic oligonucleotide
ccctgcgcagctacttcccagacaact

SEQ ID NO: 343282 - DNA, 27 bp, Artificial Sequence
  Description of Artificial Sequence: Synthetic oligonucleotide
cctgcgcagctacttcccagacaactg

SEQ ID NO: 343283 - DNA, 27 bp, Artificial Sequence
  Description of Artificial Sequence: Synthetic oligonucleotide
ctgcgcagctacttcccagacaactgg

SEQ ID NO: 343284 - DNA, 27 bp, Artificial Sequence
  Description of Artificial Sequence: Synthetic oligonucleotide
tgcgcagctacttcccagacaactggc

SEQ ID NO: 343285 - DNA, 27 bp, Artificial Sequence
  Description of Artificial Sequence: Synthetic oligonucleotide
gcgcagctacttcccagacaactggct

SEQ ID NO: 343286 - DNA, 27 bp, Artificial Sequence
  Description of Artificial Sequence: Synthetic oligonucleotide
cgcagctacttcccagacaactggctc

SEQ ID NO: 343287 - DNA, 28 bp, Artificial Sequence
  Description of Artificial Sequence: Synthetic oligonucleotide
gcagctacttcccagacaactggctcag

SEQ ID NO: 343288 - DNA, 28 bp, Artificial Sequence
  Description of Artificial Sequence: Synthetic oligonucleotide
cagctacttcccagacaactggctcagg

SEQ ID NO: 343289 - DNA, 29 bp, Artificial Sequence
  Description of Artificial Sequence: Synthetic oligonucleotide
agctacttcccagacaactggctcaggag

SEQ ID NO: 343290 - DNA, 28 bp, Artificial Sequence
  Description of Artificial Sequence: Synthetic oligonucleotide
gctacttcccagacaactggctcaggag

SEQ ID NO: 343291 - DNA, 29 bp, Artificial Sequence
  Description of Artificial Sequence: Synthetic oligonucleotide
ctacttcccagacaactggctcaggagag

SEQ ID NO: 343292 - DNA, 30 bp, Artificial Sequence
  Description of Artificial Sequence: Synthetic oligonucleotide
tacttcccagacaactggctcaggagagtg

SEQ ID NO: 343293 - DNA, 29 bp, Artificial Sequence
  Description of Artificial Sequence: Synthetic oligonucleotide
acttcccagacaactggctcaggagagtg

SEQ ID NO: 343294 - DNA, 28 bp, Artificial Sequence
  Description of Artificial Sequence: Synthetic oligonucleotide
cttcccagacaactggctcaggagagtg

SEQ ID NO: 343295 - DNA, 28 bp, Artificial Sequence
  Description of Artificial Sequence: Synthetic oligonucleotide
ttcccagacaactggctcaggagagtgg

SEQ ID NO: 343296 - DNA, 27 bp, Artificial Sequence
  Description of Artificial Sequence: Synthetic oligonucleotide
tcccagacaactggctcaggagagtgg

SEQ ID NO: 343297 - DNA, 27 bp, Artificial Sequence
  Description of Artificial Sequence: Synthetic oligonucleotide
cccagacaactggctcaggagagtggt

SEQ ID NO: 343298 - DNA, 29 bp, Artificial Sequence
  Description of Artificial Sequence: Synthetic oligonucleotide
ccagacaactggctcaggagagtggtaac

SEQ ID NO: 343299 - DNA, 30 bp, Artificial Sequence
  Description of Artificial Sequence: Synthetic oligonucleotide
cagacaactggctcaggagagtggtaacag

SEQ ID NO: 343300 - DNA, 31 bp, Artificial Sequence
  Description of Artificial Sequence: Synthetic oligonucleotide
agacaactggctcaggagagtggtaacagtg

SEQ ID NO: 343301 - DNA, 30 bp, Artificial Sequence
  Description of Artificial Sequence: Synthetic oligonucleotide
gacaactggctcaggagagtggtaacagtg

SEQ ID NO: 343302 - DNA, 30 bp, Artificial Sequence
  Description of Artificial Sequence: Synthetic oligonucleotide
acaactggctcaggagagtggtaacagtgg

SEQ ID NO: 343303 - DNA, 29 bp, Artificial Sequence
  Description of Artificial Sequence: Synthetic oligonucleotide
caactggctcaggagagtggtaacagtgg

SEQ ID NO: 343304 - DNA, 30 bp, Artificial Sequence
  Description of Artificial Sequence: Synthetic oligonucleotide
aactggctcaggagagtggtaacagtggag

SEQ ID NO: 343305 - DNA, 29 bp, Artificial Sequence
  Description of Artificial Sequence: Synthetic oligonucleotide
actggctcaggagagtggtaacagtggag

SEQ ID NO: 343306 - DNA, 28 bp, Artificial Sequence
  Description of Artificial Sequence: Synthetic oligonucleotide
ctggctcaggagagtggtaacagtggag

SEQ ID NO: 343307 - DNA, 28 bp, Artificial Sequence
  Description of Artificial Sequence: Synthetic oligonucleotide
tggctcaggagagtggtaacagtggagc

SEQ ID NO: 343308 - DNA, 27 bp, Artificial Sequence
  Description of Artificial Sequence: Synthetic oligonucleotide
ggctcaggagagtggtaacagtggagc

SEQ ID NO: 343309 - DNA, 27 bp, Artificial Sequence
  Description of Artificial Sequence: Synthetic oligonucleotide
gctcaggagagtggtaacagtggagcg

SEQ ID NO: 343310 - DNA, 27 bp, Artificial Sequence
  Description of Artificial Sequence: Synthetic oligonucleotide
ctcaggagagtggtaacagtggagcgc

SEQ ID NO: 343311 - DNA, 30 bp, Artificial Sequence
  Description of Artificial Sequence: Synthetic oligonucleotide
tcaggagagtggtaacagtggagcgctttc

SEQ ID NO: 343312 - DNA, 29 bp, Artificial Sequence
  Description of Artificial Sequence: Synthetic oligonucleotide
caggagagtggtaacagtggagcgctttc

SEQ ID NO: 343313 - DNA, 36 bp, Artificial Sequence
  Description of Artificial Sequence: Synthetic oligonucleotide
aggagagtggtaacagtggagcgctttcaattattg

SEQ ID NO: 343314 - DNA, 35 bp, Artificial Sequence
  Description of Artificial Sequence: Synthetic oligonucleotide
ggagagtggtaacagtggagcgctttcaattattg

SEQ ID NO: 343315 - DNA, 36 bp, Artificial Sequence
  Description of Artificial Sequence: Synthetic oligonucleotide
gagagtggtaacagtggagcgctttcaattattgac

SEQ ID NO: 343316 - DNA, 37 bp, Artificial Sequence
  Description of Artificial Sequence: Synthetic oligonucleotide
agagtggtaacagtggagcgctttcaattattgacac

SEQ ID NO: 343317 - DNA, 36 bp, Artificial Sequence
  Description of Artificial Sequence: Synthetic oligonucleotide
gagtggtaacagtggagcgctttcaattattgacac

SEQ ID NO: 343318 - DNA, 37 bp, Artificial Sequence
  Description of Artificial Sequence: Synthetic oligonucleotide
agtggtaacagtggagcgctttcaattattgacacag

SEQ ID NO: 343319 - DNA, 36 bp, Artificial Sequence
  Description of Artificial Sequence: Synthetic oligonucleotide
gtggtaacagtggagcgctttcaattattgacacag

SEQ ID NO: 343320 - DNA, 37 bp, Artificial Sequence
  Description of Artificial Sequence: Synthetic oligonucleotide
tggtaacagtggagcgctttcaattattgacacagtg

SEQ ID NO: 343321 - DNA, 36 bp, Artificial Sequence
  Description of Artificial Sequence: Synthetic oligonucleotide
ggtaacagtggagcgctttcaattattgacacagtg

SEQ ID NO: 343322 - DNA, 36 bp, Artificial Sequence
  Description of Artificial Sequence: Synthetic oligonucleotide
gtaacagtggagcgctttcaattattgacacagtgg

SEQ ID NO: 343323 - DNA, 36 bp, Artificial Sequence
  Description of Artificial Sequence: Synthetic oligonucleotide
taacagtggagcgctttcaattattgacacagtggc

SEQ ID NO: 343324 - DNA, 35 bp, Artificial Sequence
  Description of Artificial Sequence: Synthetic oligonucleotide
aacagtggagcgctttcaattattgacacagtggc

SEQ ID NO: 343325 - DNA, 34 bp, Artificial Sequence
  Description of Artificial Sequence: Synthetic oligonucleotide
acagtggagcgctttcaattattgacacagtggc

SEQ ID NO: 343326 - DNA, 33 bp, Artificial Sequence
  Description of Artificial Sequence: Synthetic oligonucleotide
cagtggagcgctttcaattattgacacagtggc

SEQ ID NO: 343327 - DNA, 34 bp, Artificial Sequence
  Description of Artificial Sequence: Synthetic oligonucleotide
agtggagcgctttcaattattgacacagtggctc

SEQ ID NO: 343328 - DNA, 33 bp, Artificial Sequence
  Description of Artificial Sequence: Synthetic oligonucleotide
gtggagcgctttcaattattgacacagtggctc

SEQ ID NO: 343329 - DNA, 33 bp, Artificial Sequence
  Description of Artificial Sequence: Synthetic oligonucleotide
tggagcgctttcaattattgacacagtggctcc

SEQ ID NO: 343330 - DNA, 32 bp, Artificial Sequence
  Description of Artificial Sequence: Synthetic oligonucleotide
ggagcgctttcaattattgacacagtggctcc

SEQ ID NO: 343331 - DNA, 32 bp, Artificial Sequence
  Description of Artificial Sequence: Synthetic oligonucleotide
gagcgctttcaattattgacacagtggctccc

SEQ ID NO: 343332 - DNA, 32 bp, Artificial Sequence
  Description of Artificial Sequence: Synthetic oligonucleotide
agcgctttcaattattgacacagtggctcccg

SEQ ID NO: 343333 - DNA, 31 bp, Artificial Sequence
  Description of Artificial Sequence: Synthetic oligonucleotide
gcgctttcaattattgacacagtggctcccg

SEQ ID NO: 343334 - DNA, 31 bp, Artificial Sequence
  Description of Artificial Sequence: Synthetic oligonucleotide
cgctttcaattattgacacagtggctcccgg

SEQ ID NO: 343335 - DNA, 32 bp, Artificial Sequence
  Description of Artificial Sequence: Synthetic oligonucleotide
gctttcaattattgacacagtggctcccggac

SEQ ID NO: 343336 - DNA, 33 bp, Artificial Sequence
  Description of Artificial Sequence: Synthetic oligonucleotide
ctttcaattattgacacagtggctcccggactc

SEQ ID NO: 343337 - DNA, 34 bp, Artificial Sequence
  Description of Artificial Sequence: Synthetic oligonucleotide
tttcaattattgacacagtggctcccggactctc

SEQ ID NO: 343338 - DNA, 33 bp, Artificial Sequence
  Description of Artificial Sequence: Synthetic oligonucleotide
ttcaattattgacacagtggctcccggactctc

SEQ ID NO: 343339 - DNA, 32 bp, Artificial Sequence
  Description of Artificial Sequence: Synthetic oligonucleotide
tcaattattgacacagtggctcccggactctc

SEQ ID NO: 343340 - DNA, 31 bp, Artificial Sequence
  Description of Artificial Sequence: Synthetic oligonucleotide
caattattgacacagtggctcccggactctc

SEQ ID NO: 343341 - DNA, 32 bp, Artificial Sequence
  Description of Artificial Sequence: Synthetic oligonucleotide
aattattgacacagtggctcccggactctctg

SEQ ID NO: 343342 - DNA, 31 bp, Artificial Sequence
  Description of Artificial Sequence: Synthetic oligonucleotide
attattgacacagtggctcccggactctctg

SEQ ID NO: 343343 - DNA, 30 bp, Artificial Sequence
  Description of Artificial Sequence: Synthetic oligonucleotide
ttattgacacagtggctcccggactctctg

SEQ ID NO: 343344 - DNA, 29 bp, Artificial Sequence
  Description of Artificial Sequence: Synthetic oligonucleotide
tattgacacagtggctcccggactctctg

SEQ ID NO: 343345 - DNA, 28 bp, Artificial Sequence
  Description of Artificial Sequence: Synthetic oligonucleotide
attgacacagtggctcccggactctctg

SEQ ID NO: 343346 - DNA, 27 bp, Artificial Sequence
  Description of Artificial Sequence: Synthetic oligonucleotide
ttgacacagtggctcccggactctctg

SEQ ID NO: 343347 - DNA, 27 bp, Artificial Sequence
  Description of Artificial Sequence: Synthetic oligonucleotide
tgacacagtggctcccggactctctgt

SEQ ID NO: 343348 - DNA, 26 bp, Artificial Sequence
  Description of Artificial Sequence: Synthetic oligonucleotide
gacacagtggctcccggactctctgt

SEQ ID NO: 343349 - DNA, 26 bp, Artificial Sequence
  Description of Artificial Sequence: Synthetic oligonucleotide
acacagtggctcccggactctctgtc

SEQ ID NO: 343350 - DNA, 25 bp, Artificial Sequence
  Description of Artificial Sequence: Synthetic oligonucleotide
cacagtggctcccggactctctgtc

SEQ ID NO: 343351 - DNA, 26 bp, Artificial Sequence
  Description of Artificial Sequence: Synthetic oligonucleotide
acagtggctcccggactctctgtcca

SEQ ID NO: 343352 - DNA, 25 bp, Artificial Sequence
  Description of Artificial Sequence: Synthetic oligonucleotide
cagtggctcccggactctctgtcca

SEQ ID NO: 343353 - DNA, 25 bp, Artificial Sequence
  Description of Artificial Sequence: Synthetic oligonucleotide
agtggctcccggactctctgtccac

SEQ ID NO: 343354 - DNA, 24 bp, Artificial Sequence
  Description of Artificial Sequence: Synthetic oligonucleotide
gtggctcccggactctctgtccac

SEQ ID NO: 343355 - DNA, 25 bp, Artificial Sequence
  Description of Artificial Sequence: Synthetic oligonucleotide
tggctcccggactctctgtccacgt

SEQ ID NO: 343356 - DNA, 24 bp, Artificial Sequence
  Description of Artificial Sequence: Synthetic oligonucleotide
ggctcccggactctctgtccacgt

SEQ ID NO: 343357 - DNA, 24 bp, Artificial Sequence
  Description of Artificial Sequence: Synthetic oligonucleotide
gctcccggactctctgtccacgtg

SEQ ID NO: 343358 - DNA, 24 bp, Artificial Sequence
  Description of Artificial Sequence: Synthetic oligonucleotide
ctcccggactctctgtccacgtgg

SEQ ID NO: 343359 - DNA, 25 bp, Artificial Sequence
  Description of Artificial Sequence: Synthetic oligonucleotide
tcccggactctctgtccacgtgggt

SEQ ID NO: 343360 - DNA, 24 bp, Artificial Sequence
  Description of Artificial Sequence: Synthetic oligonucleotide
cccggactctctgtccacgtgggt

SEQ ID NO: 343361 - DNA, 26 bp, Artificial Sequence
  Description of Artificial Sequence: Synthetic oligonucleotide
ccggactctctgtccacgtgggtgat

SEQ ID NO: 343362 - DNA, 26 bp, Artificial Sequence
  Description of Artificial Sequence: Synthetic oligonucleotide
cggactctctgtccacgtgggtgatc

SEQ ID NO: 343363 - DNA, 27 bp, Artificial Sequence
  Description of Artificial Sequence: Synthetic oligonucleotide
ggactctctgtccacgtgggtgatcca

SEQ ID NO: 343364 - DNA, 28 bp, Artificial Sequence
  Description of Artificial Sequence: Synthetic oligonucleotide
gactctctgtccacgtgggtgatccatg

SEQ ID NO: 343365 - DNA, 28 bp, Artificial Sequence
  Description of Artificial Sequence: Synthetic oligonucleotide
actctctgtccacgtgggtgatccatgg

SEQ ID NO: 343366 - DNA, 27 bp, Artificial Sequence
  Description of Artificial Sequence: Synthetic oligonucleotide
ctctctgtccacgtgggtgatccatgg

SEQ ID NO: 343367 - DNA, 27 bp, Artificial Sequence
  Description of Artificial Sequence: Synthetic oligonucleotide
tctctgtccacgtgggtgatccatggg

SEQ ID NO: 343368 - DNA, 26 bp, Artificial Sequence
  Description of Artificial Sequence: Synthetic oligonucleotide
ctctgtccacgtgggtgatccatggg

SEQ ID NO: 343369 - DNA, 27 bp, Artificial Sequence
  Description of Artificial Sequence: Synthetic oligonucleotide
tctgtccacgtgggtgatccatgggct

SEQ ID NO: 343370 - DNA, 26 bp, Artificial Sequence
  Description of Artificial Sequence: Synthetic oligonucleotide
ctgtccacgtgggtgatccatgggct

SEQ ID NO: 343371 - DNA, 27 bp, Artificial Sequence
  Description of Artificial Sequence: Synthetic oligonucleotide
tgtccacgtgggtgatccatgggctga

SEQ ID NO: 343372 - DNA, 26 bp, Artificial Sequence
  Description of Artificial Sequence: Synthetic oligonucleotide
gtccacgtgggtgatccatgggctga

SEQ ID NO: 343373 - DNA, 26 bp, Artificial Sequence
  Description of Artificial Sequence: Synthetic oligonucleotide
tccacgtgggtgatccatgggctgag

SEQ ID NO: 343374 - DNA, 25 bp, Artificial Sequence
  Description of Artificial Sequence: Synthetic oligonucleotide
ccacgtgggtgatccatgggctgag

SEQ ID NO: 343375 - DNA, 25 bp, Artificial Sequence
  Description of Artificial Sequence: Synthetic oligonucleotide
cacgtgggtgatccatgggctgagc

SEQ ID NO: 343376 - DNA, 26 bp, Artificial Sequence
  Description of Artificial Sequence: Synthetic oligonucleotide
acgtgggtgatccatgggctgagcct

SEQ ID NO: 343377 - DNA, 25 bp, Artificial Sequence
  Description of Artificial Sequence: Synthetic oligonucleotide
cgtgggtgatccatgggctgagcct

SEQ ID NO: 343378 - DNA, 26 bp, Artificial Sequence
  Description of Artificial Sequence: Synthetic oligonucleotide
gtgggtgatccatgggctgagcctga

SEQ ID NO: 343379 - DNA, 26 bp, Artificial Sequence
  Description of Artificial Sequence: Synthetic oligonucleotide
tgggtgatccatgggctgagcctgac

SEQ ID NO: 343380 - DNA, 25 bp, Artificial Sequence
  Description of Artificial Sequence: Synthetic oligonucleotide
gggtgatccatgggctgagcctgac

SEQ ID NO: 343381 - DNA, 27 bp, Artificial Sequence
  Description of Artificial Sequence: Synthetic oligonucleotide
ggtgatccatgggctgagcctgaccaa

SEQ ID NO: 343382 - DNA, 29 bp, Artificial Sequence
  Description of Artificial Sequence: Synthetic oligonucleotide
gtgatccatgggctgagcctgaccaaaac

SEQ ID NO: 343383 - DNA, 29 bp, Artificial Sequence
  Description of Artificial Sequence: Synthetic oligonucleotide
tgatccatgggctgagcctgaccaaaacc

SEQ ID NO: 343384 - DNA, 28 bp, Artificial Sequence
  Description of Artificial Sequence: Synthetic oligonucleotide
gatccatgggctgagcctgaccaaaacc

SEQ ID NO: 343385 - DNA, 31 bp, Artificial Sequence
  Description of Artificial Sequence: Synthetic oligonucleotide
atccatgggctgagcctgaccaaaaccatag

SEQ ID NO: 343386 - DNA, 30 bp, Artificial Sequence
  Description of Artificial Sequence: Synthetic oligonucleotide
tccatgggctgagcctgaccaaaaccatag

SEQ ID NO: 343387 - DNA, 29 bp, Artificial Sequence
  Description of Artificial Sequence: Synthetic oligonucleotide
ccatgggctgagcctgaccaaaaccatag

SEQ ID NO: 343388 - DNA, 29 bp, Artificial Sequence
  Description of Artificial Sequence: Synthetic oligonucleotide
catgggctgagcctgaccaaaaccatagg

SEQ ID NO: 343389 - DNA, 29 bp, Artificial Sequence
  Description of Artificial Sequence: Synthetic oligonucleotide
atgggctgagcctgaccaaaaccataggc

SEQ ID NO: 343390 - DNA, 28 bp, Artificial Sequence
  Description of Artificial Sequence: Synthetic oligonucleotide
tgggctgagcctgaccaaaaccataggc

SEQ ID NO: 343391 - DNA, 27 bp, Artificial Sequence
  Description of Artificial Sequence: Synthetic oligonucleotide
gggctgagcctgaccaaaaccataggc

SEQ ID NO: 343392 - DNA, 27 bp, Artificial Sequence
  Description of Artificial Sequence: Synthetic oligonucleotide
ggctgagcctgaccaaaaccataggcc

SEQ ID NO: 343393 - DNA, 30 bp, Artificial Sequence
  Description of Artificial Sequence: Synthetic oligonucleotide
gctgagcctgaccaaaaccataggcctatg

SEQ ID NO: 343394 - DNA, 31 bp, Artificial Sequence
  Description of Artificial Sequence: Synthetic oligonucleotide
ctgagcctgaccaaaaccataggcctatgag

SEQ ID NO: 343395 - DNA, 32 bp, Artificial Sequence
  Description of Artificial Sequence: Synthetic oligonucleotide
tgagcctgaccaaaaccataggcctatgagtg

SEQ ID NO: 343396 - DNA, 31 bp, Artificial Sequence
  Description of Artificial Sequence: Synthetic oligonucleotide
gagcctgaccaaaaccataggcctatgagtg

SEQ ID NO: 343397 - DNA, 31 bp, Artificial Sequence
  Description of Artificial Sequence: Synthetic oligonucleotide
agcctgaccaaaaccataggcctatgagtgg

SEQ ID NO: 343398 - DNA, 30 bp, Artificial Sequence
  Description of Artificial Sequence: Synthetic oligonucleotide
gcctgaccaaaaccataggcctatgagtgg

SEQ ID NO: 343399 - DNA, 30 bp, Artificial Sequence
  Description of Artificial Sequence: Synthetic oligonucleotide
cctgaccaaaaccataggcctatgagtggc

SEQ ID NO: 343400 - DNA, 30 bp, Artificial Sequence
  Description of Artificial Sequence: Synthetic oligonucleotide
ctgaccaaaaccataggcctatgagtggcc

SEQ ID NO: 343401 - DNA, 31 bp, Artificial Sequence
  Description of Artificial Sequence: Synthetic oligonucleotide
tgaccaaaaccataggcctatgagtggccac

SEQ ID NO: 343402 - DNA, 30 bp, Artificial Sequence
  Description of Artificial Sequence: Synthetic oligonucleotide
gaccaaaaccataggcctatgagtggccac

SEQ ID NO: 343403 - DNA, 30 bp, Artificial Sequence
  Description of Artificial Sequence: Synthetic oligonucleotide
accaaaaccataggcctatgagtggccacc

SEQ ID NO: 343404 - DNA, 29 bp, Artificial Sequence
  Description of Artificial Sequence: Synthetic oligonucleotide
ccaaaaccataggcctatgagtggccacc

SEQ ID NO: 343405 - DNA, 29 bp, Artificial Sequence
  Description of Artificial Sequence: Synthetic oligonucleotide
caaaaccataggcctatgagtggccaccg

SEQ ID NO: 343406 - DNA, 29 bp, Artificial Sequence
  Description of Artificial Sequence: Synthetic oligonucleotide
aaaaccataggcctatgagtggccaccgc

SEQ ID NO: 343407 - DNA, 28 bp, Artificial Sequence
  Description of Artificial Sequence: Synthetic oligonucleotide
aaaccataggcctatgagtggccaccgc

SEQ ID NO: 343408 - DNA, 27 bp, Artificial Sequence
  Description of Artificial Sequence: Synthetic oligonucleotide
aaccataggcctatgagtggccaccgc

SEQ ID NO: 343409 - DNA, 27 bp, Artificial Sequence
  Description of Artificial Sequence: Synthetic oligonucleotide
accataggcctatgagtggccaccgca

SEQ ID NO: 343410 - DNA, 26 bp, Artificial Sequence
  Description of Artificial Sequence: Synthetic oligonucleotide
ccataggcctatgagtggccaccgca

SEQ ID NO: 343411 - DNA, 27 bp, Artificial Sequence
  Description of Artificial Sequence: Synthetic oligonucleotide
cataggcctatgagtggccaccgcagt

SEQ ID NO: 343412 - DNA, 27 bp, Artificial Sequence
  Description of Artificial Sequence: Synthetic oligonucleotide
ataggcctatgagtggccaccgcagtc

SEQ ID NO: 343413 - DNA, 26 bp, Artificial Sequence
  Description of Artificial Sequence: Synthetic oligonucleotide
taggcctatgagtggccaccgcagtc

SEQ ID NO: 343414 - DNA, 25 bp, Artificial Sequence
  Description of Artificial Sequence: Synthetic oligonucleotide
aggcctatgagtggccaccgcagtc

SEQ ID NO: 343415 - DNA, 24 bp, Artificial Sequence
  Description of Artificial Sequence: Synthetic oligonucleotide
ggcctatgagtggccaccgcagtc

SEQ ID NO: 343416 - DNA, 25 bp, Artificial Sequence
  Description of Artificial Sequence: Synthetic oligonucleotide
gcctatgagtggccaccgcagtcca

SEQ ID NO: 343417 - DNA, 25 bp, Artificial Sequence
  Description of Artificial Sequence: Synthetic oligonucleotide
cctatgagtggccaccgcagtccag

SEQ ID NO: 343418 - DNA, 26 bp, Artificial Sequence
  Description of Artificial Sequence: Synthetic oligonucleotide
ctatgagtggccaccgcagtccagca

SEQ ID NO: 343419 - DNA, 26 bp, Artificial Sequence
  Description of Artificial Sequence: Synthetic oligonucleotide
tatgagtggccaccgcagtccagcac

SEQ ID NO: 343420 - DNA, 25 bp, Artificial Sequence
  Description of Artificial Sequence: Synthetic oligonucleotide
atgagtggccaccgcagtccagcac

SEQ ID NO: 343421 - DNA, 24 bp, Artificial Sequence
  Description of Artificial Sequence: Synthetic oligonucleotide
tgagtggccaccgcagtccagcac

SEQ ID NO: 343422 - DNA, 23 bp, Artificial Sequence
  Description of Artificial Sequence: Synthetic oligonucleotide
gagtggccaccgcagtccagcac

SEQ ID NO: 343423 - DNA, 23 bp, Artificial Sequence
  Description of Artificial Sequence: Synthetic oligonucleotide
agtggccaccgcagtccagcacc

SEQ ID NO: 343424 - DNA, 22 bp, Artificial Sequence
  Description of Artificial Sequence: Synthetic oligonucleotide
gtggccaccgcagtccagcacc

SEQ ID NO: 343425 - DNA, 22 bp, Artificial Sequence
  Description of Artificial Sequence: Synthetic oligonucleotide
tggccaccgcagtccagcaccg

SEQ ID NO: 343426 - DNA, 21 bp, Artificial Sequence
  Description of Artificial Sequence: Synthetic oligonucleotide
ggccaccgcagtccagcaccg

SEQ ID NO: 343427 - DNA, 21 bp, Artificial Sequence
  Description of Artificial Sequence: Synthetic oligonucleotide
gccaccgcagtccagcaccgg

SEQ ID NO: 343428 - DNA, 22 bp, Artificial Sequence
  Description of Artificial Sequence: Synthetic oligonucleotide
ccaccgcagtccagcaccgggt

SEQ ID NO: 343429 - DNA, 24 bp, Artificial Sequence
  Description of Artificial Sequence: Synthetic oligonucleotide
caccgcagtccagcaccgggtgtt

SEQ ID NO: 343430 - DNA, 24 bp, Artificial Sequence
  Description of Artificial Sequence: Synthetic oligonucleotide
accgcagtccagcaccgggtgttg

SEQ ID NO: 343431 - DNA, 23 bp, Artificial Sequence
  Description of Artificial Sequence: Synthetic oligonucleotide
ccgcagtccagcaccgggtgttg

SEQ ID NO: 343432 - DNA, 23 bp, Artificial Sequence
  Description of Artificial Sequence: Synthetic oligonucleotide
cgcagtccagcaccgggtgttgc

SEQ ID NO: 343433 - DNA, 23 bp, Artificial Sequence
  Description of Artificial Sequence: Synthetic oligonucleotide
gcagtccagcaccgggtgttgcg

SEQ ID NO: 343434 - DNA, 23 bp, Artificial Sequence
  Description of Artificial Sequence: Synthetic oligonucleotide
cagtccagcaccgggtgttgcgc

SEQ ID NO: 343435 - DNA, 24 bp, Artificial Sequence
  Description of Artificial Sequence: Synthetic oligonucleotide
agtccagcaccgggtgttgcgcga

SEQ ID NO: 343436 - DNA, 23 bp, Artificial Sequence
  Description of Artificial Sequence: Synthetic oligonucleotide
gtccagcaccgggtgttgcgcga

SEQ ID NO: 343437 - DNA, 25 bp, Artificial Sequence
  Description of Artificial Sequence: Synthetic oligonucleotide
tccagcaccgggtgttgcgcgagtt

SEQ ID NO: 343438 - DNA, 24 bp, Artificial Sequence
  Description of Artificial Sequence: Synthetic oligonucleotide
ccagcaccgggtgttgcgcgagtt

SEQ ID NO: 343439 - DNA, 24 bp, Artificial Sequence
  Description of Artificial Sequence: Synthetic oligonucleotide
cagcaccgggtgttgcgcgagttc

SEQ ID NO: 343440 - DNA, 25 bp, Artificial Sequence
  Description of Artificial Sequence: Synthetic oligonucleotide
agcaccgggtgttgcgcgagttcga

SEQ ID NO: 343441 - DNA, 24 bp, Artificial Sequence
  Description of Artificial Sequence: Synthetic oligonucleotide
gcaccgggtgttgcgcgagttcga

SEQ ID NO: 343442 - DNA, 24 bp, Artificial Sequence
  Description of Artificial Sequence: Synthetic oligonucleotide
caccgggtgttgcgcgagttcgac

SEQ ID NO: 343443 - DNA, 25 bp, Artificial Sequence
  Description of Artificial Sequence: Synthetic oligonucleotide
accgggtgttgcgcgagttcgacct

SEQ ID NO: 343444 - DNA, 24 bp, Artificial Sequence
  Description of Artificial Sequence: Synthetic oligonucleotide
ccgggtgttgcgcgagttcgacct

SEQ ID NO: 343445 - DNA, 24 bp, Artificial Sequence
  Description of Artificial Sequence: Synthetic oligonucleotide
cgggtgttgcgcgagttcgacctg

SEQ ID NO: 343446 - DNA, 25 bp, Artificial Sequence
  Description of Artificial Sequence: Synthetic oligonucleotide
gggtgttgcgcgagttcgacctgca

SEQ ID NO: 343447 - DNA, 25 bp, Artificial Sequence
  Description of Artificial Sequence: Synthetic oligonucleotide
ggtgttgcgcgagttcgacctgcac

SEQ ID NO: 343448 - DNA, 26 bp, Artificial Sequence
  Description of Artificial Sequence: Synthetic oligonucleotide
gtgttgcgcgagttcgacctgcacca

SEQ ID NO: 343449 - DNA, 26 bp, Artificial Sequence
  Description of Artificial Sequence: Synthetic oligonucleotide
tgttgcgcgagttcgacctgcaccac

SEQ ID NO: 343450 - DNA, 25 bp, Artificial Sequence
  Description of Artificial Sequence: Synthetic oligonucleotide
gttgcgcgagttcgacctgcaccac

SEQ ID NO: 343451 - DNA, 25 bp, Artificial Sequence
  Description of Artificial Sequence: Synthetic oligonucleotide
ttgcgcgagttcgacctgcaccacc

SEQ ID NO: 343452 - DNA, 24 bp, Artificial Sequence
  Description of Artificial Sequence: Synthetic oligonucleotide
tgcgcgagttcgacctgcaccacc

SEQ ID NO: 343453 - DNA, 23 bp, Artificial Sequence
  Description of Artificial Sequence: Synthetic oligonucleotide
gcgcgagttcgacctgcaccacc

SEQ ID NO: 343454 - DNA, 23 bp, Artificial Sequence
  Description of Artificial Sequence: Synthetic oligonucleotide
cgcgagttcgacctgcaccaccg

SEQ ID NO: 343455 - DNA, 23 bp, Artificial Sequence
  Description of Artificial Sequence: Synthetic oligonucleotide
gcgagttcgacctgcaccaccgc

SEQ ID NO: 343456 - DNA, 24 bp, Artificial Sequence
  Description of Artificial Sequence: Synthetic oligonucleotide
cgagttcgacctgcaccaccgcct

SEQ ID NO: 343457 - DNA, 24 bp, Artificial Sequence
  Description of Artificial Sequence: Synthetic oligonucleotide
gagttcgacctgcaccaccgcctg

SEQ ID NO: 343458 - DNA, 24 bp, Artificial Sequence
  Description of Artificial Sequence: Synthetic oligonucleotide
agttcgacctgcaccaccgcctgc

SEQ ID NO: 343459 - DNA, 23 bp, Artificial Sequence
  Description of Artificial Sequence: Synthetic oligonucleotide
gttcgacctgcaccaccgcctgc

SEQ ID NO: 343460 - DNA, 23 bp, Artificial Sequence
  Description of Artificial Sequence: Synthetic oligonucleotide
ttcgacctgcaccaccgcctgcc

SEQ ID NO: 343461 - DNA, 22 bp, Artificial Sequence
  Description of Artificial Sequence: Synthetic oligonucleotide
tcgacctgcaccaccgcctgcc

SEQ ID NO: 343462 - DNA, 21 bp, Artificial Sequence
  Description of Artificial Sequence: Synthetic oligonucleotide
cgacctgcaccaccgcctgcc

SEQ ID NO: 343463 - DNA, 23 bp, Artificial Sequence
  Description of Artificial Sequence: Synthetic oligonucleotide
gacctgcaccaccgcctgccgat

SEQ ID NO: 343464 - DNA, 24 bp, Artificial Sequence
  Description of Artificial Sequence: Synthetic oligonucleotide
acctgcaccaccgcctgccgatgt

SEQ ID NO: 343465 - DNA, 23 bp, Artificial Sequence
  Description of Artificial Sequence: Synthetic oligonucleotide
cctgcaccaccgcctgccgatgt

SEQ ID NO: 343466 - DNA, 24 bp, Artificial Sequence
  Description of Artificial Sequence: Synthetic oligonucleotide
ctgcaccaccgcctgccgatgtct

SEQ ID NO: 343467 - DNA, 25 bp, Artificial Sequence
  Description of Artificial Sequence: Synthetic oligonucleotide
tgcaccaccgcctgccgatgtctgt

SEQ ID NO: 343468 - DNA, 24 bp, Artificial Sequence
  Description of Artificial Sequence: Synthetic oligonucleotide
gcaccaccgcctgccgatgtctgt

SEQ ID NO: 343469 - DNA, 24 bp, Artificial Sequence
  Description of Artificial Sequence: Synthetic oligonucleotide
caccaccgcctgccgatgtctgtc

SEQ ID NO: 343470 - DNA, 24 bp, Artificial Sequence
  Description of Artificial Sequence: Synthetic oligonucleotide
accaccgcctgccgatgtctgtcg

SEQ ID NO: 343471 - DNA, 23 bp, Artificial Sequence
  Description of Artificial Sequence: Synthetic oligonucleotide
ccaccgcctgccgatgtctgtcg

SEQ ID NO: 343472 - DNA, 23 bp, Artificial Sequence
  Description of Artificial Sequence: Synthetic oligonucleotide
caccgcctgccgatgtctgtcgg

SEQ ID NO: 343473 - DNA, 23 bp, Artificial Sequence
  Description of Artificial Sequence: Synthetic oligonucleotide
accgcctgccgatgtctgtcggc

SEQ ID NO: 343474 - DNA, 22 bp, Artificial Sequence
  Description of Artificial Sequence: Synthetic oligonucleotide
ccgcctgccgatgtctgtcggc

SEQ ID NO: 343475 - DNA, 22 bp, Artificial Sequence
  Description of Artificial Sequence: Synthetic oligonucleotide
cgcctgccgatgtctgtcggcc

SEQ ID NO: 343476 - DNA, 22 bp, Artificial Sequence
  Description of Artificial Sequence: Synthetic oligonucleotide
gcctgccgatgtctgtcggccg

SEQ ID NO: 343477 - DNA, 25 bp, Artificial Sequence
  Description of Artificial Sequence: Synthetic oligonucleotide
cctgccgatgtctgtcggccgcttt

SEQ ID NO: 343478 - DNA, 26 bp, Artificial Sequence
  Description of Artificial Sequence: Synthetic oligonucleotide
ctgccgatgtctgtcggccgctttgt

SEQ ID NO: 343479 - DNA, 26 bp, Artificial Sequence
  Description of Artificial Sequence: Synthetic oligonucleotide
tgccgatgtctgtcggccgctttgtg

SEQ ID NO: 343480 - DNA, 25 bp, Artificial Sequence
  Description of Artificial Sequence: Synthetic oligonucleotide
gccgatgtctgtcggccgctttgtg

SEQ ID NO: 343481 - DNA, 26 bp, Artificial Sequence
  Description of Artificial Sequence: Synthetic oligonucleotide
ccgatgtctgtcggccgctttgtgca

SEQ ID NO: 343482 - DNA, 26 bp, Artificial Sequence
  Description of Artificial Sequence: Synthetic oligonucleotide
cgatgtctgtcggccgctttgtgcag

SEQ ID NO: 343483 - DNA, 27 bp, Artificial Sequence
  Description of Artificial Sequence: Synthetic oligonucleotide
gatgtctgtcggccgctttgtgcagct

SEQ ID NO: 343484 - DNA, 27 bp, Artificial Sequence
  Description of Artificial Sequence: Synthetic oligonucleotide
atgtctgtcggccgctttgtgcagctg

SEQ ID NO: 343485 - DNA, 26 bp, Artificial Sequence
  Description of Artificial Sequence: Synthetic oligonucleotide
tgtctgtcggccgctttgtgcagctg

SEQ ID NO: 343486 - DNA, 25 bp, Artificial Sequence
  Description of Artificial Sequence: Synthetic oligonucleotide
gtctgtcggccgctttgtgcagctg

SEQ ID NO: 343487 - DNA, 26 bp, Artificial Sequence
  Description of Artificial Sequence: Synthetic oligonucleotide
tctgtcggccgctttgtgcagctgga

SEQ ID NO: 343488 - DNA, 25 bp, Artificial Sequence
  Description of Artificial Sequence: Synthetic oligonucleotide
ctgtcggccgctttgtgcagctgga

SEQ ID NO: 343489 - DNA, 25 bp, Artificial Sequence
  Description of Artificial Sequence: Synthetic oligonucleotide
tgtcggccgctttgtgcagctggac

SEQ ID NO: 343490 - DNA, 24 bp, Artificial Sequence
  Description of Artificial Sequence: Synthetic oligonucleotide
gtcggccgctttgtgcagctggac

SEQ ID NO: 343491 - DNA, 25 bp, Artificial Sequence
  Description of Artificial Sequence: Synthetic oligonucleotide
tcggccgctttgtgcagctggacct

SEQ ID NO: 343492 - DNA, 24 bp, Artificial Sequence
  Description of Artificial Sequence: Synthetic oligonucleotide
cggccgctttgtgcagctggacct

SEQ ID NO: 343493 - DNA, 24 bp, Artificial Sequence
  Description of Artificial Sequence: Synthetic oligonucleotide
ggccgctttgtgcagctggacctg

SEQ ID NO: 343494 - DNA, 24 bp, Artificial Sequence
  Description of Artificial Sequence: Synthetic oligonucleotide
gccgctttgtgcagctggacctgc

SEQ ID NO: 343495 - DNA, 24 bp, Artificial Sequence
  Description of Artificial Sequence: Synthetic oligonucleotide
ccgctttgtgcagctggacctgcg

SEQ ID NO: 343496 - DNA, 24 bp, Artificial Sequence
  Description of Artificial Sequence: Synthetic oligonucleotide
cgctttgtgcagctggacctgcgg

SEQ ID NO: 343497 - DNA, 24 bp, Artificial Sequence
  Description of Artificial Sequence: Synthetic oligonucleotide
gctttgtgcagctggacctgcggc

SEQ ID NO: 343498 - DNA, 25 bp, Artificial Sequence
  Description of Artificial Sequence: Synthetic oligonucleotide
ctttgtgcagctggacctgcggcct

SEQ ID NO: 343499 - DNA, 26 bp, Artificial Sequence
  Description of Artificial Sequence: Synthetic oligonucleotide
tttgtgcagctggacctgcggcctct

SEQ ID NO: 343500 - DNA, 25 bp, Artificial Sequence
  Description of Artificial Sequence: Synthetic oligonucleotide
ttgtgcagctggacctgcggcctct

SEQ ID NO: 343501 - DNA, 24 bp, Artificial Sequence
  Description of Artificial Sequence: Synthetic oligonucleotide
tgtgcagctggacctgcggcctct

SEQ ID NO: 343502 - DNA, 23 bp, Artificial Sequence
  Description of Artificial Sequence: Synthetic oligonucleotide
gtgcagctggacctgcggcctct

SEQ ID NO: 343503 - DNA, 23 bp, Artificial Sequence
  Description of Artificial Sequence: Synthetic oligonucleotide
tgcagctggacctgcggcctctc

SEQ ID NO: 343504 - DNA, 22 bp, Artificial Sequence
  Description of Artificial Sequence: Synthetic oligonucleotide
gcagctggacctgcggcctctc

SEQ ID NO: 343505 - DNA, 23 bp, Artificial Sequence
  Description of Artificial Sequence: Synthetic oligonucleotide
cagctggacctgcggcctctcct

SEQ ID NO: 343506 - DNA, 27 bp, Artificial Sequence
  Description of Artificial Sequence: Synthetic oligonucleotide
agctggacctgcggcctctcctctata

SEQ ID NO: 343507 - DNA, 27 bp, Artificial Sequence
  Description of Artificial Sequence: Synthetic oligonucleotide
gctggacctgcggcctctcctctatat

SEQ ID NO: 343508 - DNA, 27 bp, Artificial Sequence
  Description of Artificial Sequence: Synthetic oligonucleotide
ctggacctgcggcctctcctctatatc

SEQ ID NO: 343509 - DNA, 29 bp, Artificial Sequence
  Description of Artificial Sequence: Synthetic oligonucleotide
tggacctgcggcctctcctctatatctac

SEQ ID NO: 343510 - DNA, 28 bp, Artificial Sequence
  Description of Artificial Sequence: Synthetic oligonucleotide
ggacctgcggcctctcctctatatctac

SEQ ID NO: 343511 - DNA, 28 bp, Artificial Sequence
  Description of Artificial Sequence: Synthetic oligonucleotide
gacctgcggcctctcctctatatctacc

SEQ ID NO: 343512 - DNA, 29 bp, Artificial Sequence
  Description of Artificial Sequence: Synthetic oligonucleotide
acctgcggcctctcctctatatctacctg

SEQ ID NO: 343513 - DNA, 28 bp, Artificial Sequence
  Description of Artificial Sequence: Synthetic oligonucleotide
cctgcggcctctcctctatatctacctg

SEQ ID NO: 343514 - DNA, 28 bp, Artificial Sequence
  Description of Artificial Sequence: Synthetic oligonucleotide
ctgcggcctctcctctatatctacctgg

SEQ ID NO: 343515 - DNA, 35 bp, Artificial Sequence
  Description of Artificial Sequence: Synthetic oligonucleotide
tgcggcctctcctctatatctacctggaaaaaaac

SEQ ID NO: 343516 - DNA, 34 bp, Artificial Sequence
  Description of Artificial Sequence: Synthetic oligonucleotide
gcggcctctcctctatatctacctggaaaaaaac

SEQ ID NO: 343517 - DNA, 34 bp, Artificial Sequence
  Description of Artificial Sequence: Synthetic oligonucleotide
cggcctctcctctatatctacctggaaaaaaacc

SEQ ID NO: 343518 - DNA, 35 bp, Artificial Sequence
  Description of Artificial Sequence: Synthetic oligonucleotide
ggcctctcctctatatctacctggaaaaaaacctg

SEQ ID NO: 343519 - DNA, 36 bp, Artificial Sequence
  Description of Artificial Sequence: Synthetic oligonucleotide
gcctctcctctatatctacctggaaaaaaacctgtc

SEQ ID NO: 343520 - DNA, 37 bp, Artificial Sequence
  Description of Artificial Sequence: Synthetic oligonucleotide
cctctcctctatatctacctggaaaaaaacctgtctg

SEQ ID NO: 343521 - DNA, 38 bp, Artificial Sequence
  Description of Artificial Sequence: Synthetic oligonucleotide
ctctcctctatatctacctggaaaaaaacctgtctgtg

SEQ ID NO: 343522 - DNA, 39 bp, Artificial Sequence
  Description of Artificial Sequence: Synthetic oligonucleotide
tctcctctatatctacctggaaaaaaacctgtctgtgag

SEQ ID NO: 343523 - DNA, 38 bp, Artificial Sequence
  Description of Artificial Sequence: Synthetic oligonucleotide
ctcctctatatctacctggaaaaaaacctgtctgtgag

SEQ ID NO: 343524 - DNA, 38 bp, Artificial Sequence
  Description of Artificial Sequence: Synthetic oligonucleotide
tcctctatatctacctggaaaaaaacctgtctgtgagc

SEQ ID NO: 343525 - DNA, 37 bp, Artificial Sequence
  Description of Artificial Sequence: Synthetic oligonucleotide
cctctatatctacctggaaaaaaacctgtctgtgagc

SEQ ID NO: 343526 - DNA, 37 bp, Artificial Sequence
  Description of Artificial Sequence: Synthetic oligonucleotide
ctctatatctacctggaaaaaaacctgtctgtgagcg

SEQ ID NO: 343527 - DNA, 38 bp, Artificial Sequence
  Description of Artificial Sequence: Synthetic oligonucleotide
tctatatctacctggaaaaaaacctgtctgtgagcgac

SEQ ID NO: 343528 - DNA, 37 bp, Artificial Sequence
  Description of Artificial Sequence: Synthetic oligonucleotide
ctatatctacctggaaaaaaacctgtctgtgagcgac

SEQ ID NO: 343529 - DNA, 37 bp, Artificial Sequence
  Description of Artificial Sequence: Synthetic oligonucleotide
tatatctacctggaaaaaaacctgtctgtgagcgacc

SEQ ID NO: 343530 - DNA, 36 bp, Artificial Sequence
  Description of Artificial Sequence: Synthetic oligonucleotide
atatctacctggaaaaaaacctgtctgtgagcgacc

SEQ ID NO: 343531 - DNA, 35 bp, Artificial Sequence
  Description of Artificial Sequence: Synthetic oligonucleotide
tatctacctggaaaaaaacctgtctgtgagcgacc

SEQ ID NO: 343532 - DNA, 34 bp, Artificial Sequence
  Description of Artificial Sequence: Synthetic oligonucleotide
atctacctggaaaaaaacctgtctgtgagcgacc

SEQ ID NO: 343533 - DNA, 33 bp, Artificial Sequence
  Description of Artificial Sequence: Synthetic oligonucleotide
tctacctggaaaaaaacctgtctgtgagcgacc

SEQ ID NO: 343534 - DNA, 32 bp, Artificial Sequence
  Description of Artificial Sequence: Synthetic oligonucleotide
ctacctggaaaaaaacctgtctgtgagcgacc

SEQ ID NO: 343535 - DNA, 33 bp, Artificial Sequence
  Description of Artificial Sequence: Synthetic oligonucleotide
tacctggaaaaaaacctgtctgtgagcgaccac

SEQ ID NO: 343536 - DNA, 32 bp, Artificial Sequence
  Description of Artificial Sequence: Synthetic oligonucleotide
acctggaaaaaaacctgtctgtgagcgaccac

SEQ ID NO: 343537 - DNA, 31 bp, Artificial Sequence
  Description of Artificial Sequence: Synthetic oligonucleotide
cctggaaaaaaacctgtctgtgagcgaccac

SEQ ID NO: 343538 - DNA, 31 bp, Artificial Sequence
  Description of Artificial Sequence: Synthetic oligonucleotide
ctggaaaaaaacctgtctgtgagcgaccacg

SEQ ID NO: 343539 - DNA, 32 bp, Artificial Sequence
  Description of Artificial Sequence: Synthetic oligonucleotide
tggaaaaaaacctgtctgtgagcgaccacgtg

SEQ ID NO: 343540 - DNA, 31 bp, Artificial Sequence
  Description of Artificial Sequence: Synthetic oligonucleotide
ggaaaaaaacctgtctgtgagcgaccacgtg

SEQ ID NO: 343541 - DNA, 32 bp, Artificial Sequence
  Description of Artificial Sequence: Synthetic oligonucleotide
gaaaaaaacctgtctgtgagcgaccacgtgtc

SEQ ID NO: 343542 - DNA, 32 bp, Artificial Sequence
  Description of Artificial Sequence: Synthetic oligonucleotide
aaaaaaacctgtctgtgagcgaccacgtgtcg

SEQ ID NO: 343543 - DNA, 31 bp, Artificial Sequence
  Description of Artificial Sequence: Synthetic oligonucleotide
aaaaaacctgtctgtgagcgaccacgtgtcg

SEQ ID NO: 343544 - DNA, 30 bp, Artificial Sequence
  Description of Artificial Sequence: Synthetic oligonucleotide
aaaaacctgtctgtgagcgaccacgtgtcg

SEQ ID NO: 343545 - DNA, 29 bp, Artificial Sequence
  Description of Artificial Sequence: Synthetic oligonucleotide
aaaacctgtctgtgagcgaccacgtgtcg

SEQ ID NO: 343546 - DNA, 28 bp, Artificial Sequence
  Description of Artificial Sequence: Synthetic oligonucleotide
aaacctgtctgtgagcgaccacgtgtcg

SEQ ID NO: 343547 - DNA, 27 bp, Artificial Sequence
  Description of Artificial Sequence: Synthetic oligonucleotide
aacctgtctgtgagcgaccacgtgtcg

SEQ ID NO: 343548 - DNA, 26 bp, Artificial Sequence
  Description of Artificial Sequence: Synthetic oligonucleotide
acctgtctgtgagcgaccacgtgtcg

SEQ ID NO: 343549 - DNA, 25 bp, Artificial Sequence
  Description of Artificial Sequence: Synthetic oligonucleotide
cctgtctgtgagcgaccacgtgtcg

SEQ ID NO: 343550 - DNA, 25 bp, Artificial Sequence
  Description of Artificial Sequence: Synthetic oligonucleotide
ctgtctgtgagcgaccacgtgtcgc

SEQ ID NO: 343551 - DNA, 26 bp, Artificial Sequence
  Description of Artificial Sequence: Synthetic oligonucleotide
tgtctgtgagcgaccacgtgtcgcca

SEQ ID NO: 343552 - DNA, 25 bp, Artificial Sequence
  Description of Artificial Sequence: Synthetic oligonucleotide
gtctgtgagcgaccacgtgtcgcca

SEQ ID NO: 343553 - DNA, 26 bp, Artificial Sequence
  Description of Artificial Sequence: Synthetic oligonucleotide
tctgtgagcgaccacgtgtcgccagt

SEQ ID NO: 343554 - DNA, 25 bp, Artificial Sequence
  Description of Artificial Sequence: Synthetic oligonucleotide
ctgtgagcgaccacgtgtcgccagt

SEQ ID NO: 343555 - DNA, 25 bp, Artificial Sequence
  Description of Artificial Sequence: Synthetic oligonucleotide
tgtgagcgaccacgtgtcgccagtg

SEQ ID NO: 343556 - DNA, 24 bp, Artificial Sequence
  Description of Artificial Sequence: Synthetic oligonucleotide
gtgagcgaccacgtgtcgccagtg

SEQ ID NO: 343557 - DNA, 25 bp, Artificial Sequence
  Description of Artificial Sequence: Synthetic oligonucleotide
tgagcgaccacgtgtcgccagtgga

SEQ ID NO: 343558 - DNA, 24 bp, Artificial Sequence
  Description of Artificial Sequence: Synthetic oligonucleotide
gagcgaccacgtgtcgccagtgga

SEQ ID NO: 343559 - DNA, 24 bp, Artificial Sequence
  Description of Artificial Sequence: Synthetic oligonucleotide
agcgaccacgtgtcgccagtggag

SEQ ID NO: 343560 - DNA, 23 bp, Artificial Sequence
  Description of Artificial Sequence: Synthetic oligonucleotide
gcgaccacgtgtcgccagtggag

SEQ ID NO: 343561 - DNA, 23 bp, Artificial Sequence
  Description of Artificial Sequence: Synthetic oligonucleotide
cgaccacgtgtcgccagtggagc

SEQ ID NO: 343562 - DNA, 23 bp, Artificial Sequence
  Description of Artificial Sequence: Synthetic oligonucleotide
gaccacgtgtcgccagtggagcg

SEQ ID NO: 343563 - DNA, 23 bp, Artificial Sequence
  Description of Artificial Sequence: Synthetic oligonucleotide
accacgtgtcgccagtggagcgg

SEQ ID NO: 343564 - DNA, 22 bp, Artificial Sequence
  Description of Artificial Sequence: Synthetic oligonucleotide
ccacgtgtcgccagtggagcgg

SEQ ID NO: 343565 - DNA, 23 bp, Artificial Sequence
  Description of Artificial Sequence: Synthetic oligonucleotide
cacgtgtcgccagtggagcggct

SEQ ID NO: 343566 - DNA, 24 bp, Artificial Sequence
  Description of Artificial Sequence: Synthetic oligonucleotide
acgtgtcgccagtggagcggctgt

SEQ ID NO: 343567 - DNA, 23 bp, Artificial Sequence
  Description of Artificial Sequence: Synthetic oligonucleotide
cgtgtcgccagtggagcggctgt

SEQ ID NO: 343568 - DNA, 23 bp, Artificial Sequence
  Description of Artificial Sequence: Synthetic oligonucleotide
gtgtcgccagtggagcggctgtg

SEQ ID NO: 343569 - DNA, 23 bp, Artificial Sequence
  Description of Artificial Sequence: Synthetic oligonucleotide
tgtcgccagtggagcggctgtgc

SEQ ID NO: 343570 - DNA, 22 bp, Artificial Sequence
  Description of Artificial Sequence: Synthetic oligonucleotide
gtcgccagtggagcggctgtgc

SEQ ID NO: 343571 - DNA, 23 bp, Artificial Sequence
  Description of Artificial Sequence: Synthetic oligonucleotide
tcgccagtggagcggctgtgcca

SEQ ID NO: 343572 - DNA, 22 bp, Artificial Sequence
  Description of Artificial Sequence: Synthetic oligonucleotide
cgccagtggagcggctgtgcca

SEQ ID NO: 343573 - DNA, 22 bp, Artificial Sequence
  Description of Artificial Sequence: Synthetic oligonucleotide
gccagtggagcggctgtgccag

SEQ ID NO: 343574 - DNA, 22 bp, Artificial Sequence
  Description of Artificial Sequence: Synthetic oligonucleotide
ccagtggagcggctgtgccagg

SEQ ID NO: 343575 - DNA, 23 bp, Artificial Sequence
  Description of Artificial Sequence: Synthetic oligonucleotide
cagtggagcggctgtgccaggct

SEQ ID NO: 343576 - DNA, 23 bp, Artificial Sequence
  Description of Artificial Sequence: Synthetic oligonucleotide
agtggagcggctgtgccaggctg

SEQ ID NO: 343577 - DNA, 22 bp, Artificial Sequence
  Description of Artificial Sequence: Synthetic oligonucleotide
gtggagcggctgtgccaggctg

SEQ ID NO: 343578 - DNA, 22 bp, Artificial Sequence
  Description of Artificial Sequence: Synthetic oligonucleotide
tggagcggctgtgccaggctgg

SEQ ID NO: 343579 - DNA, 21 bp, Artificial Sequence
  Description of Artificial Sequence: Synthetic oligonucleotide
ggagcggctgtgccaggctgg

SEQ ID NO: 343580 - DNA, 21 bp, Artificial Sequence
  Description of Artificial Sequence: Synthetic oligonucleotide
gagcggctgtgccaggctggg

SEQ ID NO: 343581 - DNA, 21 bp, Artificial Sequence
  Description of Artificial Sequence: Synthetic oligonucleotide
agcggctgtgccaggctgggg

SEQ ID NO: 343582 - DNA, 20 bp, Artificial Sequence
  Description of Artificial Sequence: Synthetic oligonucleotide
gcggctgtgccaggctgggg

SEQ ID NO: 343583 - DNA, 20 bp, Artificial Sequence
  Description of Artificial Sequence: Synthetic oligonucleotide
cggctgtgccaggctggggg

SEQ ID NO: 343584 - DNA, 20 bp, Artificial Sequence
  Description of Artificial Sequence: Synthetic oligonucleotide
ggctgtgccaggctgggggg

SEQ ID NO: 343585 - DNA, 20 bp, Artificial Sequence
  Description of Artificial Sequence: Synthetic oligonucleotide
gctgtgccaggctggggggg

SEQ ID NO: 343586 - DNA, 21 bp, Artificial Sequence
  Description of Artificial Sequence: Synthetic oligonucleotide
ctgtgccaggctgggggggga

SEQ ID NO: 343587 - DNA, 21 bp, Artificial Sequence
  Description of Artificial Sequence: Synthetic oligonucleotide
tgtgccaggctggggggggag

SEQ ID NO: 343588 - DNA, 20 bp, Artificial Sequence
  Description of Artificial Sequence: Synthetic oligonucleotide
gtgccaggctggggggggag

SEQ ID NO: 343589 - DNA, 20 bp, Artificial Sequence
  Description of Artificial Sequence: Synthetic oligonucleotide
tgccaggctggggggggagg

SEQ ID NO: 343590 - DNA, 20 bp, Artificial Sequence
  Description of Artificial Sequence: Synthetic oligonucleotide
gccaggctggggggggaggt

SEQ ID NO: 343591 - DNA, 20 bp, Artificial Sequence
  Description of Artificial Sequence: Synthetic oligonucleotide
ccaggctggggggggagggt

SEQ ID NO: 343592 - DNA, 20 bp, Artificial Sequence
  Description of Artificial Sequence: Synthetic oligonucleotide
caggctggggggggagggct

SEQ ID NO: 343593 - DNA, 20 bp, Artificial Sequence
  Description of Artificial Sequence: Synthetic oligonucleotide
aggctggggggggagggctg

SEQ ID NO: 343594 - DNA, 20 bp, Artificial Sequence
  Description of Artificial Sequence: Synthetic oligonucleotide
ggctggggggggagggctgt

SEQ ID NO: 343595 - DNA, 20 bp, Artificial Sequence
  Description of Artificial Sequence: Synthetic oligonucleotide
gctggggggggagggctgct

SEQ ID NO: 343596 - DNA, 20 bp, Artificial Sequence
  Description of Artificial Sequence: Synthetic oligonucleotide
ctggggggggagggctgcct

SEQ ID NO: 343597 - DNA, 20 bp, Artificial Sequence
  Description of Artificial Sequence: Synthetic oligonucleotide
tggggggggagggctgccct

SEQ ID NO: 343598 - DNA, 20 bp, Artificial Sequence
  Description of Artificial Sequence: Synthetic oligonucleotide
ggggggggagggctgccctt

SEQ ID NO: 343599 - DNA, 20 bp, Artificial Sequence
  Description of Artificial Sequence: Synthetic oligonucleotide
gggggggagggctgccccat

SEQ ID NO: 343600 - DNA, 20 bp, Artificial Sequence
  Description of Artificial Sequence: Synthetic oligonucleotide
ggggggagggctgccccagt

SEQ ID NO: 343601 - DNA, 20 bp, Artificial Sequence
  Description of Artificial Sequence: Synthetic oligonucleotide
gggggagggctgccccagca

SEQ ID NO: 343602 - DNA, 20 bp, Artificial Sequence
  Description of Artificial Sequence: Synthetic oligonucleotide
ggggagggctgccccagcag

SEQ ID NO: 343603 - DNA, 21 bp, Artificial Sequence
  Description of Artificial Sequence: Synthetic oligonucleotide
gggagggctgccccagcagga

SEQ ID NO: 343604 - DNA, 21 bp, Artificial Sequence
  Description of Artificial Sequence: Synthetic oligonucleotide
ggagggctgccccagcaggag

SEQ ID NO: 343605 - DNA, 22 bp, Artificial Sequence
  Description of Artificial Sequence: Synthetic oligonucleotide
gagggctgccccagcaggagct

SEQ ID NO: 343606 - DNA, 22 bp, Artificial Sequence
  Description of Artificial Sequence: Synthetic oligonucleotide
agggctgccccagcaggagctg

SEQ ID NO: 343607 - DNA, 21 bp, Artificial Sequence
  Description of Artificial Sequence: Synthetic oligonucleotide
gggctgccccagcaggagctg

SEQ ID NO: 343608 - DNA, 22 bp, Artificial Sequence
  Description of Artificial Sequence: Synthetic oligonucleotide
ggctgccccagcaggagctggt

SEQ ID NO: 343609 - DNA, 22 bp, Artificial Sequence
  Description of Artificial Sequence: Synthetic oligonucleotide
gctgccccagcaggagctggtg

SEQ ID NO: 343610 - DNA, 22 bp, Artificial Sequence
  Description of Artificial Sequence: Synthetic oligonucleotide
ctgccccagcaggagctggtgc

SEQ ID NO: 343611 - DNA, 23 bp, Artificial Sequence
  Description of Artificial Sequence: Synthetic oligonucleotide
tgccccagcaggagctggtgcca

SEQ ID NO: 343612 - DNA, 22 bp, Artificial Sequence
  Description of Artificial Sequence: Synthetic oligonucleotide
gccccagcaggagctggtgcca

SEQ ID NO: 343613 - DNA, 22 bp, Artificial Sequence
  Description of Artificial Sequence: Synthetic oligonucleotide
ccccagcaggagctggtgccag

SEQ ID NO: 343614 - DNA, 22 bp, Artificial Sequence
  Description of Artificial Sequence: Synthetic oligonucleotide
cccagcaggagctggtgccagc

SEQ ID NO: 343615 - DNA, 22 bp, Artificial Sequence
  Description of Artificial Sequence: Synthetic oligonucleotide
ccagcaggagctggtgccagcg

SEQ ID NO: 343616 - DNA, 22 bp, Artificial Sequence
  Description of Artificial Sequence: Synthetic oligonucleotide
cagcaggagctggtgccagcgg

SEQ ID NO: 343617 - DNA, 22 bp, Artificial Sequence
  Description of Artificial Sequence: Synthetic oligonucleotide
agcaggagctggtgccagcggg

SEQ ID NO: 343618 - DNA, 21 bp, Artificial Sequence
  Description of Artificial Sequence: Synthetic oligonucleotide
gcaggagctggtgccagcggg

SEQ ID NO: 343619 - DNA, 22 bp, Artificial Sequence
  Description of Artificial Sequence: Synthetic oligonucleotide
caggagctggtgccagcgggct

SEQ ID NO: 343620 - DNA, 23 bp, Artificial Sequence
  Description of Artificial Sequence: Synthetic oligonucleotide
aggagctggtgccagcgggctct

SEQ ID NO: 343621 - DNA, 22 bp, Artificial Sequence
  Description of Artificial Sequence: Synthetic oligonucleotide
ggagctggtgccagcgggctct

SEQ ID NO: 343622 - DNA, 22 bp, Artificial Sequence
  Description of Artificial Sequence: Synthetic oligonucleotide
gagctggtgccagcgggctctc

SEQ ID NO: 343623 - DNA, 22 bp, Artificial Sequence
  Description of Artificial Sequence: Synthetic oligonucleotide
agctggtgccagcgggctctcc

SEQ ID NO: 343624 - DNA, 21 bp, Artificial Sequence
  Description of Artificial Sequence: Synthetic oligonucleotide
gctggtgccagcgggctctcc

SEQ ID NO: 343625 - DNA, 21 bp, Artificial Sequence
  Description of Artificial Sequence: Synthetic oligonucleotide
ctggtgccagcgggctctccc

SEQ ID NO: 343626 - DNA, 21 bp, Artificial Sequence
  Description of Artificial Sequence: Synthetic oligonucleotide
tggtgccagcgggctctcccc

SEQ ID NO: 343627 - DNA, 20 bp, Artificial Sequence
  Description of Artificial Sequence: Synthetic oligonucleotide
ggtgccagcgggctctcccc

SEQ ID NO: 343628 - DNA, 20 bp, Artificial Sequence
  Description of Artificial Sequence: Synthetic oligonucleotide
gtgccagcgggctctccccg

SEQ ID NO: 343629 - DNA, 20 bp, Artificial Sequence
  Description of Artificial Sequence: Synthetic oligonucleotide
tgccagcgggctctccccgg

SEQ ID NO: 343630 - DNA, 20 bp, Artificial Sequence
  Description of Artificial Sequence: Synthetic oligonucleotide
gccagcgggctctccccggt

SEQ ID NO: 343631 - DNA, 20 bp, Artificial Sequence
  Description of Artificial Sequence: Synthetic oligonucleotide
ccagcgggctctccccggct

SEQ ID NO: 343632 - DNA, 20 bp, Artificial Sequence
  Description of Artificial Sequence: Synthetic oligonucleotide
cagcgggctctccccggcct

SEQ ID NO: 343633 - DNA, 22 bp, Artificial Sequence
  Description of Artificial Sequence: Synthetic oligonucleotide
agcgggctctccccggcctgat

SEQ ID NO: 343634 - DNA, 21 bp, Artificial Sequence
  Description of Artificial Sequence: Synthetic oligonucleotide
gcgggctctccccggcctgat

SEQ ID NO: 343635 - DNA, 21 bp, Artificial Sequence
  Description of Artificial Sequence: Synthetic oligonucleotide
cgggctctccccggcctgatg

SEQ ID NO: 343636 - DNA, 21 bp, Artificial Sequence
  Description of Artificial Sequence: Synthetic oligonucleotide
gggctctccccggcctgatgc

SEQ ID NO: 343637 - DNA, 23 bp, Artificial Sequence
  Description of Artificial Sequence: Synthetic oligonucleotide
ggctctccccggcctgatgcctt

SEQ ID NO: 343638 - DNA, 24 bp, Artificial Sequence
  Description of Artificial Sequence: Synthetic oligonucleotide
gctctccccggcctgatgccttct

SEQ ID NO: 343639 - DNA, 25 bp, Artificial Sequence
  Description of Artificial Sequence: Synthetic oligonucleotide
ctctccccggcctgatgccttctca

SEQ ID NO: 343640 - DNA, 26 bp, Artificial Sequence
  Description of Artificial Sequence: Synthetic oligonucleotide
tctccccggcctgatgccttctcagt

SEQ ID NO: 343641 - DNA, 25 bp, Artificial Sequence
  Description of Artificial Sequence: Synthetic oligonucleotide
ctccccggcctgatgccttctcagt

SEQ ID NO: 343642 - DNA, 25 bp, Artificial Sequence
  Description of Artificial Sequence: Synthetic oligonucleotide
tccccggcctgatgccttctcagtg

SEQ ID NO: 343643 - DNA, 24 bp, Artificial Sequence
  Description of Artificial Sequence: Synthetic oligonucleotide
ccccggcctgatgccttctcagtg

SEQ ID NO: 343644 - DNA, 25 bp, Artificial Sequence
  Description of Artificial Sequence: Synthetic oligonucleotide
cccggcctgatgccttctcagtggt

SEQ ID NO: 343645 - DNA, 25 bp, Artificial Sequence
  Description of Artificial Sequence: Synthetic oligonucleotide
ccggcctgatgccttctcagtggtg

SEQ ID NO: 343646 - DNA, 25 bp, Artificial Sequence
  Description of Artificial Sequence: Synthetic oligonucleotide
cggcctgatgccttctcagtggtgc

SEQ ID NO: 343647 - DNA, 25 bp, Artificial Sequence
  Description of Artificial Sequence: Synthetic oligonucleotide
ggcctgatgccttctcagtggtgcc

SEQ ID NO: 343648 - DNA, 26 bp, Artificial Sequence
  Description of Artificial Sequence: Synthetic oligonucleotide
gcctgatgccttctcagtggtgccct

SEQ ID NO: 343649 - DNA, 26 bp, Artificial Sequence
  Description of Artificial Sequence: Synthetic oligonucleotide
cctgatgccttctcagtggtgccctc

SEQ ID NO: 343650 - DNA, 26 bp, Artificial Sequence
  Description of Artificial Sequence: Synthetic oligonucleotide
ctgatgccttctcagtggtgccctcg

SEQ ID NO: 343651 - DNA, 26 bp, Artificial Sequence
  Description of Artificial Sequence: Synthetic oligonucleotide
tgatgccttctcagtggtgccctcgg

SEQ ID NO: 343652 - DNA, 25 bp, Artificial Sequence
  Description of Artificial Sequence: Synthetic oligonucleotide
gatgccttctcagtggtgccctcgg

SEQ ID NO: 343653 - DNA, 26 bp, Artificial Sequence
  Description of Artificial Sequence: Synthetic oligonucleotide
atgccttctcagtggtgccctcggca

SEQ ID NO: 343654 - DNA, 25 bp, Artificial Sequence
  Description of Artificial Sequence: Synthetic oligonucleotide
tgccttctcagtggtgccctcggca

SEQ ID NO: 343655 - DNA, 24 bp, Artificial Sequence
  Description of Artificial Sequence: Synthetic oligonucleotide
gccttctcagtggtgccctcggca

SEQ ID NO: 343656 - DNA, 24 bp, Artificial Sequence
  Description of Artificial Sequence: Synthetic oligonucleotide
ccttctcagtggtgccctcggcag

SEQ ID NO: 343657 - DNA, 24 bp, Artificial Sequence
  Description of Artificial Sequence: Synthetic oligonucleotide
cttctcagtggtgccctcggcagc

SEQ ID NO: 343658 - DNA, 24 bp, Artificial Sequence
  Description of Artificial Sequence: Synthetic oligonucleotide
ttctcagtggtgccctcggcagcc

SEQ ID NO: 343659 - DNA, 23 bp, Artificial Sequence
  Description of Artificial Sequence: Synthetic oligonucleotide
tctcagtggtgccctcggcagcc

SEQ ID NO: 343660 - DNA, 22 bp, Artificial Sequence
  Description of Artificial Sequence: Synthetic oligonucleotide
ctcagtggtgccctcggcagcc

SEQ ID NO: 343661 - DNA, 22 bp, Artificial Sequence
  Description of Artificial Sequence: Synthetic oligonucleotide
tcagtggtgccctcggcagccg

SEQ ID NO: 343662 - DNA, 21 bp, Artificial Sequence
  Description of Artificial Sequence: Synthetic oligonucleotide
cagtggtgccctcggcagccg

SEQ ID NO: 343663 - DNA, 21 bp, Artificial Sequence
  Description of Artificial Sequence: Synthetic oligonucleotide
agtggtgccctcggcagccgg

SEQ ID NO: 343664 - DNA, 20 bp, Artificial Sequence
  Description of Artificial Sequence: Synthetic oligonucleotide
gtggtgccctcggcagccgg

SEQ ID NO: 343665 - DNA, 20 bp, Artificial Sequence
  Description of Artificial Sequence: Synthetic oligonucleotide
tggtgccctcggcagccggc

SEQ ID NO: 343666 - DNA, 20 bp, Artificial Sequence
  Description of Artificial Sequence: Synthetic oligonucleotide
ggtgccctcggcagccggct

SEQ ID NO: 343667 - DNA, 20 bp, Artificial Sequence
  Description of Artificial Sequence: Synthetic oligonucleotide
gtgccctcggcagccggcgt

SEQ ID NO: 343668 - DNA, 20 bp, Artificial Sequence
  Description of Artificial Sequence: Synthetic oligonucleotide
tgccctcggcagccggcgct

SEQ ID NO: 343669 - DNA, 20 bp, Artificial Sequence
  Description of Artificial Sequence: Synthetic oligonucleotide
gccctcggcagccggcgctt

SEQ ID NO: 343670 - DNA, 20 bp, Artificial Sequence
  Description of Artificial Sequence: Synthetic oligonucleotide
ccctcggcagccggcgctgt

SEQ ID NO: 343671 - DNA, 21 bp, Artificial Sequence
  Description of Artificial Sequence: Synthetic oligonucleotide
cctcggcagccggcgctgtgt

SEQ ID NO: 343672 - DNA, 22 bp, Artificial Sequence
  Description of Artificial Sequence: Synthetic oligonucleotide
ctcggcagccggcgctgtgtca

SEQ ID NO: 343673 - DNA, 23 bp, Artificial Sequence
  Description of Artificial Sequence: Synthetic oligonucleotide
tcggcagccggcgctgtgtcact

SEQ ID NO: 343674 - DNA, 22 bp, Artificial Sequence
  Description of Artificial Sequence: Synthetic oligonucleotide
cggcagccggcgctgtgtcact

SEQ ID NO: 343675 - DNA, 24 bp, Artificial Sequence
  Description of Artificial Sequence: Synthetic oligonucleotide
ggcagccggcgctgtgtcactgaa

SEQ ID NO: 343676 - DNA, 24 bp, Artificial Sequence
  Description of Artificial Sequence: Synthetic oligonucleotide
gcagccggcgctgtgtcactgaag

SEQ ID NO: 343677 - DNA, 25 bp, Artificial Sequence
  Description of Artificial Sequence: Synthetic oligonucleotide
cagccggcgctgtgtcactgaaggt

SEQ ID NO: 343678 - DNA, 25 bp, Artificial Sequence
  Description of Artificial Sequence: Synthetic oligonucleotide
agccggcgctgtgtcactgaaggtg

SEQ ID NO: 343679 - DNA, 24 bp, Artificial Sequence
  Description of Artificial Sequence: Synthetic oligonucleotide
gccggcgctgtgtcactgaaggtg

SEQ ID NO: 343680 - DNA, 25 bp, Artificial Sequence
  Description of Artificial Sequence: Synthetic oligonucleotide
ccggcgctgtgtcactgaaggtgct

SEQ ID NO: 343681 - DNA, 25 bp, Artificial Sequence
  Description of Artificial Sequence: Synthetic oligonucleotide
cggcgctgtgtcactgaaggtgctg

SEQ ID NO: 343682 - DNA, 25 bp, Artificial Sequence
  Description of Artificial Sequence: Synthetic oligonucleotide
ggcgctgtgtcactgaaggtgctgg

SEQ ID NO: 343683 - DNA, 26 bp, Artificial Sequence
  Description of Artificial Sequence: Synthetic oligonucleotide
gcgctgtgtcactgaaggtgctggct

SEQ ID NO: 343684 - DNA, 26 bp, Artificial Sequence
  Description of Artificial Sequence: Synthetic oligonucleotide
cgctgtgtcactgaaggtgctggctc

SEQ ID NO: 343685 - DNA, 27 bp, Artificial Sequence
  Description of Artificial Sequence: Synthetic oligonucleotide
gctgtgtcactgaaggtgctggctcga

SEQ ID NO: 343686 - DNA, 27 bp, Artificial Sequence
  Description of Artificial Sequence: Synthetic oligonucleotide
ctgtgtcactgaaggtgctggctcgag

SEQ ID NO: 343687 - DNA, 27 bp, Artificial Sequence
  Description of Artificial Sequence: Synthetic oligonucleotide
tgtgtcactgaaggtgctggctcgagc

SEQ ID NO: 343688 - DNA, 26 bp, Artificial Sequence
  Description of Artificial Sequence: Synthetic oligonucleotide
gtgtcactgaaggtgctggctcgagc

SEQ ID NO: 343689 - DNA, 27 bp, Artificial Sequence
  Description of Artificial Sequence: Synthetic oligonucleotide
tgtcactgaaggtgctggctcgagcgt

SEQ ID NO: 343690 - DNA, 26 bp, Artificial Sequence
  Description of Artificial Sequence: Synthetic oligonucleotide
gtcactgaaggtgctggctcgagcgt

SEQ ID NO: 343691 - DNA, 26 bp, Artificial Sequence
  Description of Artificial Sequence: Synthetic oligonucleotide
tcactgaaggtgctggctcgagcgtc

SEQ ID NO: 343692 - DNA, 25 bp, Artificial Sequence
  Description of Artificial Sequence: Synthetic oligonucleotide
cactgaaggtgctggctcgagcgtc

SEQ ID NO: 343693 - DNA, 27 bp, Artificial Sequence
  Description of Artificial Sequence: Synthetic oligonucleotide
actgaaggtgctggctcgagcgtcctt

SEQ ID NO: 343694 - DNA, 26 bp, Artificial Sequence
  Description of Artificial Sequence: Synthetic oligonucleotide
ctgaaggtgctggctcgagcgtcctt

SEQ ID NO: 343695 - DNA, 26 bp, Artificial Sequence
  Description of Artificial Sequence: Synthetic oligonucleotide
tgaaggtgctggctcgagcgtccttc

SEQ ID NO: 343696 - DNA, 25 bp, Artificial Sequence
  Description of Artificial Sequence: Synthetic oligonucleotide
gaaggtgctggctcgagcgtccttc

SEQ ID NO: 343697 - DNA, 27 bp, Artificial Sequence
  Description of Artificial Sequence: Synthetic oligonucleotide
aaggtgctggctcgagcgtccttcgat

SEQ ID NO: 343698 - DNA, 27 bp, Artificial Sequence
  Description of Artificial Sequence: Synthetic oligonucleotide
aggtgctggctcgagcgtccttcgatt

SEQ ID NO: 343699 - DNA, 27 bp, Artificial Sequence
  Description of Artificial Sequence: Synthetic oligonucleotide
ggtgctggctcgagcgtccttcgattt

SEQ ID NO: 343700 - DNA, 27 bp, Artificial Sequence
  Description of Artificial Sequence: Synthetic oligonucleotide
gtgctggctcgagcgtccttcgatttc

SEQ ID NO: 343701 - DNA, 27 bp, Artificial Sequence
  Description of Artificial Sequence: Synthetic oligonucleotide
tgctggctcgagcgtccttcgatttcc

SEQ ID NO: 343702 - DNA, 26 bp, Artificial Sequence
  Description of Artificial Sequence: Synthetic oligonucleotide
gctggctcgagcgtccttcgatttcc

SEQ ID NO: 343703 - DNA, 27 bp, Artificial Sequence
  Description of Artificial Sequence: Synthetic oligonucleotide
ctggctcgagcgtccttcgatttccct

SEQ ID NO: 343704 - DNA, 27 bp, Artificial Sequence
  Description of Artificial Sequence: Synthetic oligonucleotide
tggctcgagcgtccttcgatttccctg

SEQ ID NO: 343705 - DNA, 27 bp, Artificial Sequence
  Description of Artificial Sequence: Synthetic oligonucleotide
ggctcgagcgtccttcgatttccctgt

SEQ ID NO: 343706 - DNA, 27 bp, Artificial Sequence
  Description of Artificial Sequence: Synthetic oligonucleotide
gctcgagcgtccttcgatttccctgtg

SEQ ID NO: 343707 - DNA, 27 bp, Artificial Sequence
  Description of Artificial Sequence: Synthetic oligonucleotide
ctcgagcgtccttcgatttccctgtgc

SEQ ID NO: 343708 - DNA, 27 bp, Artificial Sequence
  Description of Artificial Sequence: Synthetic oligonucleotide
tcgagcgtccttcgatttccctgtgcg

SEQ ID NO: 343709 - DNA, 27 bp, Artificial Sequence
  Description of Artificial Sequence: Synthetic oligonucleotide
cgagcgtccttcgatttccctgtgcga

SEQ ID NO: 343710 - DNA, 27 bp, Artificial Sequence
  Description of Artificial Sequence: Synthetic oligonucleotide
gagcgtccttcgatttccctgtgcgag

SEQ ID NO: 343711 - DNA, 29 bp, Artificial Sequence
  Description of Artificial Sequence: Synthetic oligonucleotide
agcgtccttcgatttccctgtgcgagatg

SEQ ID NO: 343712 - DNA, 28 bp, Artificial Sequence
  Description of Artificial Sequence: Synthetic oligonucleotide
gcgtccttcgatttccctgtgcgagatg

SEQ ID NO: 343713 - DNA, 28 bp, Artificial Sequence
  Description of Artificial Sequence: Synthetic oligonucleotide
cgtccttcgatttccctgtgcgagatgc

SEQ ID NO: 343714 - DNA, 28 bp, Artificial Sequence
  Description of Artificial Sequence: Synthetic oligonucleotide
gtccttcgatttccctgtgcgagatgcg

SEQ ID NO: 343715 - DNA, 28 bp, Artificial Sequence
  Description of Artificial Sequence: Synthetic oligonucleotide
tccttcgatttccctgtgcgagatgcgg

SEQ ID NO: 343716 - DNA, 27 bp, Artificial Sequence
  Description of Artificial Sequence: Synthetic oligonucleotide
ccttcgatttccctgtgcgagatgcgg

SEQ ID NO: 343717 - DNA, 28 bp, Artificial Sequence
  Description of Artificial Sequence: Synthetic oligonucleotide
cttcgatttccctgtgcgagatgcggag

SEQ ID NO: 343718 - DNA, 29 bp, Artificial Sequence
  Description of Artificial Sequence: Synthetic oligonucleotide
ttcgatttccctgtgcgagatgcggagtc

SEQ ID NO: 343719 - DNA, 28 bp, Artificial Sequence
  Description of Artificial Sequence: Synthetic oligonucleotide
tcgatttccctgtgcgagatgcggagtc

SEQ ID NO: 343720 - DNA, 27 bp, Artificial Sequence
  Description of Artificial Sequence: Synthetic oligonucleotide
cgatttccctgtgcgagatgcggagtc

SEQ ID NO: 343721 - DNA, 27 bp, Artificial Sequence
  Description of Artificial Sequence: Synthetic oligonucleotide
gatttccctgtgcgagatgcggagtcc

SEQ ID NO: 343722 - DNA, 29 bp, Artificial Sequence
  Description of Artificial Sequence: Synthetic oligonucleotide
atttccctgtgcgagatgcggagtccaag

SEQ ID NO: 343723 - DNA, 28 bp, Artificial Sequence
  Description of Artificial Sequence: Synthetic oligonucleotide
tttccctgtgcgagatgcggagtccaag

SEQ ID NO: 343724 - DNA, 27 bp, Artificial Sequence
  Description of Artificial Sequence: Synthetic oligonucleotide
ttccctgtgcgagatgcggagtccaag

SEQ ID NO: 343725 - DNA, 26 bp, Artificial Sequence
  Description of Artificial Sequence: Synthetic oligonucleotide
tccctgtgcgagatgcggagtccaag

SEQ ID NO: 343726 - DNA, 25 bp, Artificial Sequence
  Description of Artificial Sequence: Synthetic oligonucleotide
ccctgtgcgagatgcggagtccaag

SEQ ID NO: 343727 - DNA, 27 bp, Artificial Sequence
  Description of Artificial Sequence: Synthetic oligonucleotide
cctgtgcgagatgcggagtccaaggta

SEQ ID NO: 343728 - DNA, 27 bp, Artificial Sequence
  Description of Artificial Sequence: Synthetic oligonucleotide
ctgtgcgagatgcggagtccaaggtac

SEQ ID NO: 343729 - DNA, 28 bp, Artificial Sequence
  Description of Artificial Sequence: Synthetic oligonucleotide
tgtgcgagatgcggagtccaaggtactg

SEQ ID NO: 343730 - DNA, 27 bp, Artificial Sequence
  Description of Artificial Sequence: Synthetic oligonucleotide
gtgcgagatgcggagtccaaggtactg

SEQ ID NO: 343731 - DNA, 27 bp, Artificial Sequence
  Description of Artificial Sequence: Synthetic oligonucleotide
tgcgagatgcggagtccaaggtactgc

SEQ ID NO: 343732 - DNA, 27 bp, Artificial Sequence
  Description of Artificial Sequence: Synthetic oligonucleotide
gcgagatgcggagtccaaggtactgca

SEQ ID NO: 343733 - DNA, 27 bp, Artificial Sequence
  Description of Artificial Sequence: Synthetic oligonucleotide
cgagatgcggagtccaaggtactgcag

SEQ ID NO: 343734 - DNA, 30 bp, Artificial Sequence
  Description of Artificial Sequence: Synthetic oligonucleotide
gagatgcggagtccaaggtactgcagattc

SEQ ID NO: 343735 - DNA, 31 bp, Artificial Sequence
  Description of Artificial Sequence: Synthetic oligonucleotide
agatgcggagtccaaggtactgcagattcag

SEQ ID NO: 343736 - DNA, 30 bp, Artificial Sequence
  Description of Artificial Sequence: Synthetic oligonucleotide
gatgcggagtccaaggtactgcagattcag

SEQ ID NO: 343737 - DNA, 32 bp, Artificial Sequence
  Description of Artificial Sequence: Synthetic oligonucleotide
atgcggagtccaaggtactgcagattcagaag

SEQ ID NO: 343738 - DNA, 31 bp, Artificial Sequence
  Description of Artificial Sequence: Synthetic oligonucleotide
tgcggagtccaaggtactgcagattcagaag

SEQ ID NO: 343739 - DNA, 30 bp, Artificial Sequence
  Description of Artificial Sequence: Synthetic oligonucleotide
gcggagtccaaggtactgcagattcagaag

SEQ ID NO: 343740 - DNA, 30 bp, Artificial Sequence
  Description of Artificial Sequence: Synthetic oligonucleotide
cggagtccaaggtactgcagattcagaagg

SEQ ID NO: 343741 - DNA, 32 bp, Artificial Sequence
  Description of Artificial Sequence: Synthetic oligonucleotide
ggagtccaaggtactgcagattcagaaggaag

SEQ ID NO: 343742 - DNA, 32 bp, Artificial Sequence
  Description of Artificial Sequence: Synthetic oligonucleotide
gagtccaaggtactgcagattcagaaggaagc

SEQ ID NO: 343743 - DNA, 32 bp, Artificial Sequence
  Description of Artificial Sequence: Synthetic oligonucleotide
agtccaaggtactgcagattcagaaggaagcg

SEQ ID NO: 343744 - DNA, 31 bp, Artificial Sequence
  Description of Artificial Sequence: Synthetic oligonucleotide
gtccaaggtactgcagattcagaaggaagcg

SEQ ID NO: 343745 - DNA, 31 bp, Artificial Sequence
  Description of Artificial Sequence: Synthetic oligonucleotide
tccaaggtactgcagattcagaaggaagcgg

SEQ ID NO: 343746 - DNA, 30 bp, Artificial Sequence
  Description of Artificial Sequence: Synthetic oligonucleotide
ccaaggtactgcagattcagaaggaagcgg

SEQ ID NO: 343747 - DNA, 30 bp, Artificial Sequence
  Description of Artificial Sequence: Synthetic oligonucleotide
caaggtactgcagattcagaaggaagcggc

SEQ ID NO: 343748 - DNA, 30 bp, Artificial Sequence
  Description of Artificial Sequence: Synthetic oligonucleotide
aaggtactgcagattcagaaggaagcggcc

SEQ ID NO: 343749 - DNA, 29 bp, Artificial Sequence
  Description of Artificial Sequence: Synthetic oligonucleotide
aggtactgcagattcagaaggaagcggcc

SEQ ID NO: 343750 - DNA, 28 bp, Artificial Sequence
  Description of Artificial Sequence: Synthetic oligonucleotide
ggtactgcagattcagaaggaagcggcc

SEQ ID NO: 343751 - DNA, 30 bp, Artificial Sequence
  Description of Artificial Sequence: Synthetic oligonucleotide
gtactgcagattcagaaggaagcggccatc

SEQ ID NO: 343752 - DNA, 30 bp, Artificial Sequence
  Description of Artificial Sequence: Synthetic oligonucleotide
tactgcagattcagaaggaagcggccatcc

SEQ ID NO: 343753 - DNA, 29 bp, Artificial Sequence
  Description of Artificial Sequence: Synthetic oligonucleotide
actgcagattcagaaggaagcggccatcc

SEQ ID NO: 343754 - DNA, 28 bp, Artificial Sequence
  Description of Artificial Sequence: Synthetic oligonucleotide
ctgcagattcagaaggaagcggccatcc

SEQ ID NO: 343755 - DNA, 31 bp, Artificial Sequence
  Description of Artificial Sequence: Synthetic oligonucleotide
tgcagattcagaaggaagcggccatccaaag

SEQ ID NO: 343756 - DNA, 30 bp, Artificial Sequence
  Description of Artificial Sequence: Synthetic oligonucleotide
gcagattcagaaggaagcggccatccaaag

SEQ ID NO: 343757 - DNA, 31 bp, Artificial Sequence
  Description of Artificial Sequence: Synthetic oligonucleotide
cagattcagaaggaagcggccatccaaagag

SEQ ID NO: 343758 - DNA, 32 bp, Artificial Sequence
  Description of Artificial Sequence: Synthetic oligonucleotide
agattcagaaggaagcggccatccaaagagag

SEQ ID NO: 343759 - DNA, 31 bp, Artificial Sequence
  Description of Artificial Sequence: Synthetic oligonucleotide
gattcagaaggaagcggccatccaaagagag

SEQ ID NO: 343760 - DNA, 31 bp, Artificial Sequence
  Description of Artificial Sequence: Synthetic oligonucleotide
attcagaaggaagcggccatccaaagagagg

SEQ ID NO: 343761 - DNA, 30 bp, Artificial Sequence
  Description of Artificial Sequence: Synthetic oligonucleotide
ttcagaaggaagcggccatccaaagagagg

SEQ ID NO: 343762 - DNA, 29 bp, Artificial Sequence
  Description of Artificial Sequence: Synthetic oligonucleotide
tcagaaggaagcggccatccaaagagagg

SEQ ID NO: 343763 - DNA, 28 bp, Artificial Sequence
  Description of Artificial Sequence: Synthetic oligonucleotide
cagaaggaagcggccatccaaagagagg

SEQ ID NO: 343764 - DNA, 29 bp, Artificial Sequence
  Description of Artificial Sequence: Synthetic oligonucleotide
agaaggaagcggccatccaaagagaggag

SEQ ID NO: 343765 - DNA, 28 bp, Artificial Sequence
  Description of Artificial Sequence: Synthetic oligonucleotide
gaaggaagcggccatccaaagagaggag

SEQ ID NO: 343766 - DNA, 28 bp, Artificial Sequence
  Description of Artificial Sequence: Synthetic oligonucleotide
aaggaagcggccatccaaagagaggagg

SEQ ID NO: 343767 - DNA, 27 bp, Artificial Sequence
  Description of Artificial Sequence: Synthetic oligonucleotide
aggaagcggccatccaaagagaggagg

SEQ ID NO: 343768 - DNA, 27 bp, Artificial Sequence
  Description of Artificial Sequence: Synthetic oligonucleotide
ggaagcggccatccaaagagaggaggt

SEQ ID NO: 343769 - DNA, 27 bp, Artificial Sequence
  Description of Artificial Sequence: Synthetic oligonucleotide
gaagcggccatccaaagagaggaggtg

SEQ ID NO: 343770 - DNA, 27 bp, Artificial Sequence
  Description of Artificial Sequence: Synthetic oligonucleotide
aagcggccatccaaagagaggaggtgg

SEQ ID NO: 343771 - DNA, 27 bp, Artificial Sequence
  Description of Artificial Sequence: Synthetic oligonucleotide
agcggccatccaaagagaggaggtggt

SEQ ID NO: 343772 - DNA, 26 bp, Artificial Sequence
  Description of Artificial Sequence: Synthetic oligonucleotide
gcggccatccaaagagaggaggtggt

SEQ ID NO: 343773 - DNA, 27 bp, Artificial Sequence
  Description of Artificial Sequence: Synthetic oligonucleotide
cggccatccaaagagaggaggtggtct

SEQ ID NO: 343774 - DNA, 29 bp, Artificial Sequence
  Description of Artificial Sequence: Synthetic oligonucleotide
ggccatccaaagagaggaggtggtctatg

SEQ ID NO: 343775 - DNA, 31 bp, Artificial Sequence
  Description of Artificial Sequence: Synthetic oligonucleotide
gccatccaaagagaggaggtggtctatgtac

SEQ ID NO: 343776 - DNA, 32 bp, Artificial Sequence
  Description of Artificial Sequence: Synthetic oligonucleotide
ccatccaaagagaggaggtggtctatgtactc

SEQ ID NO: 343777 - DNA, 34 bp, Artificial Sequence
  Description of Artificial Sequence: Synthetic oligonucleotide
catccaaagagaggaggtggtctatgtactcaac

SEQ ID NO: 343778 - DNA, 34 bp, Artificial Sequence
  Description of Artificial Sequence: Synthetic oligonucleotide
atccaaagagaggaggtggtctatgtactcaacc

SEQ ID NO: 343779 - DNA, 33 bp, Artificial Sequence
  Description of Artificial Sequence: Synthetic oligonucleotide
tccaaagagaggaggtggtctatgtactcaacc

SEQ ID NO: 343780 - DNA, 32 bp, Artificial Sequence
  Description of Artificial Sequence: Synthetic oligonucleotide
ccaaagagaggaggtggtctatgtactcaacc

SEQ ID NO: 343781 - DNA, 32 bp, Artificial Sequence
  Description of Artificial Sequence: Synthetic oligonucleotide
caaagagaggaggtggtctatgtactcaaccc

SEQ ID NO: 343782 - DNA, 32 bp, Artificial Sequence
  Description of Artificial Sequence: Synthetic oligonucleotide
aaagagaggaggtggtctatgtactcaacccg

SEQ ID NO: 343783 - DNA, 31 bp, Artificial Sequence
  Description of Artificial Sequence: Synthetic oligonucleotide
aagagaggaggtggtctatgtactcaacccg

SEQ ID NO: 343784 - DNA, 30 bp, Artificial Sequence
  Description of Artificial Sequence: Synthetic oligonucleotide
agagaggaggtggtctatgtactcaacccg

SEQ ID NO: 343785 - DNA, 29 bp, Artificial Sequence
  Description of Artificial Sequence: Synthetic oligonucleotide
gagaggaggtggtctatgtactcaacccg

SEQ ID NO: 343786 - DNA, 31 bp, Artificial Sequence
  Description of Artificial Sequence: Synthetic oligonucleotide
agaggaggtggtctatgtactcaacccgttg

SEQ ID NO: 343787 - DNA, 30 bp, Artificial Sequence
  Description of Artificial Sequence: Synthetic oligonucleotide
gaggaggtggtctatgtactcaacccgttg

SEQ ID NO: 343788 - DNA, 30 bp, Artificial Sequence
  Description of Artificial Sequence: Synthetic oligonucleotide
aggaggtggtctatgtactcaacccgttgg

SEQ ID NO: 343789 - DNA, 29 bp, Artificial Sequence
  Description of Artificial Sequence: Synthetic oligonucleotide
ggaggtggtctatgtactcaacccgttgg

SEQ ID NO: 343790 - DNA, 30 bp, Artificial Sequence
  Description of Artificial Sequence: Synthetic oligonucleotide
gaggtggtctatgtactcaacccgttggac

SEQ ID NO: 343791 - DNA, 30 bp, Artificial Sequence
  Description of Artificial Sequence: Synthetic oligonucleotide
aggtggtctatgtactcaacccgttggacc

SEQ ID NO: 343792 - DNA, 29 bp, Artificial Sequence
  Description of Artificial Sequence: Synthetic oligonucleotide
ggtggtctatgtactcaacccgttggacc

SEQ ID NO: 343793 - DNA, 30 bp, Artificial Sequence
  Description of Artificial Sequence: Synthetic oligonucleotide
gtggtctatgtactcaacccgttggaccac

SEQ ID NO: 343794 - DNA, 30 bp, Artificial Sequence
  Description of Artificial Sequence: Synthetic oligonucleotide
tggtctatgtactcaacccgttggaccacg

SEQ ID NO: 343795 - DNA, 29 bp, Artificial Sequence
  Description of Artificial Sequence: Synthetic oligonucleotide
ggtctatgtactcaacccgttggaccacg

SEQ ID NO: 343796 - DNA, 29 bp, Artificial Sequence
  Description of Artificial Sequence: Synthetic oligonucleotide
gtctatgtactcaacccgttggaccacgg

SEQ ID NO: 343797 - DNA, 30 bp, Artificial Sequence
  Description of Artificial Sequence: Synthetic oligonucleotide
tctatgtactcaacccgttggaccacggag

SEQ ID NO: 343798 - DNA, 29 bp, Artificial Sequence
  Description of Artificial Sequence: Synthetic oligonucleotide
ctatgtactcaacccgttggaccacggag

SEQ ID NO: 343799 - DNA, 29 bp, Artificial Sequence
  Description of Artificial Sequence: Synthetic oligonucleotide
tatgtactcaacccgttggaccacggagg

SEQ ID NO: 343800 - DNA, 28 bp, Artificial Sequence
  Description of Artificial Sequence: Synthetic oligonucleotide
atgtactcaacccgttggaccacggagg

SEQ ID NO: 343801 - DNA, 27 bp, Artificial Sequence
  Description of Artificial Sequence: Synthetic oligonucleotide
tgtactcaacccgttggaccacggagg

SEQ ID NO: 343802 - DNA, 26 bp, Artificial Sequence
  Description of Artificial Sequence: Synthetic oligonucleotide
gtactcaacccgttggaccacggagg

SEQ ID NO: 343803 - DNA, 26 bp, Artificial Sequence
  Description of Artificial Sequence: Synthetic oligonucleotide
tactcaacccgttggaccacggaggc

SEQ ID NO: 343804 - DNA, 25 bp, Artificial Sequence
  Description of Artificial Sequence: Synthetic oligonucleotide
actcaacccgttggaccacggaggc

SEQ ID NO: 343805 - DNA, 24 bp, Artificial Sequence
  Description of Artificial Sequence: Synthetic oligonucleotide
ctcaacccgttggaccacggaggc

SEQ ID NO: 343806 - DNA, 24 bp, Artificial Sequence
  Description of Artificial Sequence: Synthetic oligonucleotide
tcaacccgttggaccacggaggcc

SEQ ID NO: 343807 - DNA, 23 bp, Artificial Sequence
  Description of Artificial Sequence: Synthetic oligonucleotide
caacccgttggaccacggaggcc

SEQ ID NO: 343808 - DNA, 23 bp, Artificial Sequence
  Description of Artificial Sequence: Synthetic oligonucleotide
aacccgttggaccacggaggccg

SEQ ID NO: 343809 - DNA, 22 bp, Artificial Sequence
  Description of Artificial Sequence: Synthetic oligonucleotide
acccgttggaccacggaggccg

SEQ ID NO: 343810 - DNA, 21 bp, Artificial Sequence
  Description of Artificial Sequence: Synthetic oligonucleotide
cccgttggaccacggaggccg

SEQ ID NO: 343811 - DNA, 22 bp, Artificial Sequence
  Description of Artificial Sequence: Synthetic oligonucleotide
ccgttggaccacggaggccgga

SEQ ID NO: 343812 - DNA, 22 bp, Artificial Sequence
  Description of Artificial Sequence: Synthetic oligonucleotide
cgttggaccacggaggccggag

SEQ ID NO: 343813 - DNA, 24 bp, Artificial Sequence
  Description of Artificial Sequence: Synthetic oligonucleotide
gttggaccacggaggccggagctt

SEQ ID NO: 343814 - DNA, 24 bp, Artificial Sequence
  Description of Artificial Sequence: Synthetic oligonucleotide
ttggaccacggaggccggagcttg

SEQ ID NO: 343815 - DNA, 23 bp, Artificial Sequence
  Description of Artificial Sequence: Synthetic oligonucleotide
tggaccacggaggccggagcttg

SEQ ID NO: 343816 - DNA, 22 bp, Artificial Sequence
  Description of Artificial Sequence: Synthetic oligonucleotide
ggaccacggaggccggagcttg

SEQ ID NO: 343817 - DNA, 27 bp, Artificial Sequence
  Description of Artificial Sequence: Synthetic oligonucleotide
gaccacggaggccggagcttggaaatt

SEQ ID NO: 343818 - DNA, 27 bp, Artificial Sequence
  Description of Artificial Sequence: Synthetic oligonucleotide
accacggaggccggagcttggaaattc

SEQ ID NO: 343819 - DNA, 26 bp, Artificial Sequence
  Description of Artificial Sequence: Synthetic oligonucleotide
ccacggaggccggagcttggaaattc

SEQ ID NO: 343820 - DNA, 27 bp, Artificial Sequence
  Description of Artificial Sequence: Synthetic oligonucleotide
cacggaggccggagcttggaaattcct

SEQ ID NO: 343821 - DNA, 27 bp, Artificial Sequence
  Description of Artificial Sequence: Synthetic oligonucleotide
acggaggccggagcttggaaattcctg

SEQ ID NO: 343822 - DNA, 26 bp, Artificial Sequence
  Description of Artificial Sequence: Synthetic oligonucleotide
cggaggccggagcttggaaattcctg

SEQ ID NO: 343823 - DNA, 26 bp, Artificial Sequence
  Description of Artificial Sequence: Synthetic oligonucleotide
ggaggccggagcttggaaattcctgg

SEQ ID NO: 343824 - DNA, 27 bp, Artificial Sequence
  Description of Artificial Sequence: Synthetic oligonucleotide
gaggccggagcttggaaattcctggca

SEQ ID NO: 343825 - DNA, 28 bp, Artificial Sequence
  Description of Artificial Sequence: Synthetic oligonucleotide
aggccggagcttggaaattcctggcaac

SEQ ID NO: 343826 - DNA, 27 bp, Artificial Sequence
  Description of Artificial Sequence: Synthetic oligonucleotide
ggccggagcttggaaattcctggcaac

SEQ ID NO: 343827 - DNA, 28 bp, Artificial Sequence
  Description of Artificial Sequence: Synthetic oligonucleotide
gccggagcttggaaattcctggcaacac

SEQ ID NO: 343828 - DNA, 29 bp, Artificial Sequence
  Description of Artificial Sequence: Synthetic oligonucleotide
ccggagcttggaaattcctggcaacactg

SEQ ID NO: 343829 - DNA, 31 bp, Artificial Sequence
  Description of Artificial Sequence: Synthetic oligonucleotide
cggagcttggaaattcctggcaacactgatc

SEQ ID NO: 343830 - DNA, 31 bp, Artificial Sequence
  Description of Artificial Sequence: Synthetic oligonucleotide
ggagcttggaaattcctggcaacactgatcc

SEQ ID NO: 343831 - DNA, 31 bp, Artificial Sequence
  Description of Artificial Sequence: Synthetic oligonucleotide
gagcttggaaattcctggcaacactgatccc

SEQ ID NO: 343832 - DNA, 36 bp, Artificial Sequence
  Description of Artificial Sequence: Synthetic oligonucleotide
agcttggaaattcctggcaacactgatcccattatg

SEQ ID NO: 343833 - DNA, 35 bp, Artificial Sequence
  Description of Artificial Sequence: Synthetic oligonucleotide
gcttggaaattcctggcaacactgatcccattatg

SEQ ID NO: 343834 - DNA, 37 bp, Artificial Sequence
  Description of Artificial Sequence: Synthetic oligonucleotide
cttggaaattcctggcaacactgatcccattatgatc

SEQ ID NO: 343835 - DNA, 37 bp, Artificial Sequence
  Description of Artificial Sequence: Synthetic oligonucleotide
ttggaaattcctggcaacactgatcccattatgatcc

SEQ ID NO: 343836 - DNA, 36 bp, Artificial Sequence
  Description of Artificial Sequence: Synthetic oligonucleotide
tggaaattcctggcaacactgatcccattatgatcc

SEQ ID NO: 343837 - DNA, 35 bp, Artificial Sequence
  Description of Artificial Sequence: Synthetic oligonucleotide
ggaaattcctggcaacactgatcccattatgatcc

SEQ ID NO: 343838 - DNA, 35 bp, Artificial Sequence
  Description of Artificial Sequence: Synthetic oligonucleotide
gaaattcctggcaacactgatcccattatgatccc

SEQ ID NO: 343839 - DNA, 36 bp, Artificial Sequence
  Description of Artificial Sequence: Synthetic oligonucleotide
aaattcctggcaacactgatcccattatgatcccag

SEQ ID NO: 343840 - DNA, 35 bp, Artificial Sequence
  Description of Artificial Sequence: Synthetic oligonucleotide
aattcctggcaacactgatcccattatgatcccag

SEQ ID NO: 343841 - DNA, 34 bp, Artificial Sequence
  Description of Artificial Sequence: Synthetic oligonucleotide
attcctggcaacactgatcccattatgatcccag

SEQ ID NO: 343842 - DNA, 33 bp, Artificial Sequence
  Description of Artificial Sequence: Synthetic oligonucleotide
ttcctggcaacactgatcccattatgatcccag

SEQ ID NO: 343843 - DNA, 32 bp, Artificial Sequence
  Description of Artificial Sequence: Synthetic oligonucleotide
tcctggcaacactgatcccattatgatcccag

SEQ ID NO: 343844 - DNA, 31 bp, Artificial Sequence
  Description of Artificial Sequence: Synthetic oligonucleotide
cctggcaacactgatcccattatgatcccag

SEQ ID NO: 343845 - DNA, 33 bp, Artificial Sequence
  Description of Artificial Sequence: Synthetic oligonucleotide
ctggcaacactgatcccattatgatcccagatg

SEQ ID NO: 343846 - DNA, 33 bp, Artificial Sequence
  Description of Artificial Sequence: Synthetic oligonucleotide
tggcaacactgatcccattatgatcccagatgg

SEQ ID NO: 343847 - DNA, 32 bp, Artificial Sequence
  Description of Artificial Sequence: Synthetic oligonucleotide
ggcaacactgatcccattatgatcccagatgg

SEQ ID NO: 343848 - DNA, 32 bp, Artificial Sequence
  Description of Artificial Sequence: Synthetic oligonucleotide
gcaacactgatcccattatgatcccagatggg

SEQ ID NO: 343849 - DNA, 32 bp, Artificial Sequence
  Description of Artificial Sequence: Synthetic oligonucleotide
caacactgatcccattatgatcccagatgggg

SEQ ID NO: 343850 - DNA, 33 bp, Artificial Sequence
  Description of Artificial Sequence: Synthetic oligonucleotide
aacactgatcccattatgatcccagatggggac

SEQ ID NO: 343851 - DNA, 32 bp, Artificial Sequence
  Description of Artificial Sequence: Synthetic oligonucleotide
acactgatcccattatgatcccagatggggac

SEQ ID NO: 343852 - DNA, 31 bp, Artificial Sequence
  Description of Artificial Sequence: Synthetic oligonucleotide
cactgatcccattatgatcccagatggggac

SEQ ID NO: 343853 - DNA, 36 bp, Artificial Sequence
  Description of Artificial Sequence: Synthetic oligonucleotide
actgatcccattatgatcccagatggggacattaac

SEQ ID NO: 343854 - DNA, 35 bp, Artificial Sequence
  Description of Artificial Sequence: Synthetic oligonucleotide
ctgatcccattatgatcccagatggggacattaac

SEQ ID NO: 343855 - DNA, 36 bp, Artificial Sequence
  Description of Artificial Sequence: Synthetic oligonucleotide
tgatcccattatgatcccagatggggacattaacag

SEQ ID NO: 343856 - DNA, 35 bp, Artificial Sequence
  Description of Artificial Sequence: Synthetic oligonucleotide
gatcccattatgatcccagatggggacattaacag

SEQ ID NO: 343857 - DNA, 35 bp, Artificial Sequence
  Description of Artificial Sequence: Synthetic oligonucleotide
atcccattatgatcccagatggggacattaacagc

SEQ ID NO: 343858 - DNA, 34 bp, Artificial Sequence
  Description of Artificial Sequence: Synthetic oligonucleotide
tcccattatgatcccagatggggacattaacagc

SEQ ID NO: 343859 - DNA, 33 bp, Artificial Sequence
  Description of Artificial Sequence: Synthetic oligonucleotide
cccattatgatcccagatggggacattaacagc

SEQ ID NO: 343860 - DNA, 35 bp, Artificial Sequence
  Description of Artificial Sequence: Synthetic oligonucleotide
ccattatgatcccagatggggacattaacagcttc

SEQ ID NO: 343861 - DNA, 35 bp, Artificial Sequence
  Description of Artificial Sequence: Synthetic oligonucleotide
cattatgatcccagatggggacattaacagcttcg

SEQ ID NO: 343862 - DNA, 36 bp, Artificial Sequence
  Description of Artificial Sequence: Synthetic oligonucleotide
attatgatcccagatggggacattaacagcttcgtc

SEQ ID NO: 343863 - DNA, 35 bp, Artificial Sequence
  Description of Artificial Sequence: Synthetic oligonucleotide
ttatgatcccagatggggacattaacagcttcgtc

SEQ ID NO: 343864 - DNA, 34 bp, Artificial Sequence
  Description of Artificial Sequence: Synthetic oligonucleotide
tatgatcccagatggggacattaacagcttcgtc

SEQ ID NO: 343865 - DNA, 33 bp, Artificial Sequence
  Description of Artificial Sequence: Synthetic oligonucleotide
atgatcccagatggggacattaacagcttcgtc

SEQ ID NO: 343866 - DNA, 32 bp, Artificial Sequence
  Description of Artificial Sequence: Synthetic oligonucleotide
tgatcccagatggggacattaacagcttcgtc

SEQ ID NO: 343867 - DNA, 31 bp, Artificial Sequence
  Description of Artificial Sequence: Synthetic oligonucleotide
gatcccagatggggacattaacagcttcgtc

SEQ ID NO: 343868 - DNA, 32 bp, Artificial Sequence
  Description of Artificial Sequence: Synthetic oligonucleotide
atcccagatggggacattaacagcttcgtcag

SEQ ID NO: 343869 - DNA, 31 bp, Artificial Sequence
  Description of Artificial Sequence: Synthetic oligonucleotide
tcccagatggggacattaacagcttcgtcag

SEQ ID NO: 343870 - DNA, 30 bp, Artificial Sequence
  Description of Artificial Sequence: Synthetic oligonucleotide
cccagatggggacattaacagcttcgtcag

SEQ ID NO: 343871 - DNA, 30 bp, Artificial Sequence
  Description of Artificial Sequence: Synthetic oligonucleotide
ccagatggggacattaacagcttcgtcagg

SEQ ID NO: 343872 - DNA, 30 bp, Artificial Sequence
  Description of Artificial Sequence: Synthetic oligonucleotide
cagatggggacattaacagcttcgtcaggg

SEQ ID NO: 343873 - DNA, 33 bp, Artificial Sequence
  Description of Artificial Sequence: Synthetic oligonucleotide
agatggggacattaacagcttcgtcagggtaac

SEQ ID NO: 343874 - DNA, 32 bp, Artificial Sequence
  Description of Artificial Sequence: Synthetic oligonucleotide
gatggggacattaacagcttcgtcagggtaac

SEQ ID NO: 343875 - DNA, 33 bp, Artificial Sequence
  Description of Artificial Sequence: Synthetic oligonucleotide
atggggacattaacagcttcgtcagggtaacag

SEQ ID NO: 343876 - DNA, 32 bp, Artificial Sequence
  Description of Artificial Sequence: Synthetic oligonucleotide
tggggacattaacagcttcgtcagggtaacag

SEQ ID NO: 343877 - DNA, 31 bp, Artificial Sequence
  Description of Artificial Sequence: Synthetic oligonucleotide
ggggacattaacagcttcgtcagggtaacag

SEQ ID NO: 343878 - DNA, 31 bp, Artificial Sequence
  Description of Artificial Sequence: Synthetic oligonucleotide
gggacattaacagcttcgtcagggtaacagc

SEQ ID NO: 343879 - DNA, 31 bp, Artificial Sequence
  Description of Artificial Sequence: Synthetic oligonucleotide
ggacattaacagcttcgtcagggtaacagcc

SEQ ID NO: 343880 - DNA, 32 bp, Artificial Sequence
  Description of Artificial Sequence: Synthetic oligonucleotide
gacattaacagcttcgtcagggtaacagcctc

SEQ ID NO: 343881 - DNA, 33 bp, Artificial Sequence
  Description of Artificial Sequence: Synthetic oligonucleotide
acattaacagcttcgtcagggtaacagcctcac

SEQ ID NO: 343882 - DNA, 32 bp, Artificial Sequence
  Description of Artificial Sequence: Synthetic oligonucleotide
cattaacagcttcgtcagggtaacagcctcac

SEQ ID NO: 343883 - DNA, 34 bp, Artificial Sequence
  Description of Artificial Sequence: Synthetic oligonucleotide
attaacagcttcgtcagggtaacagcctcacatc

SEQ ID NO: 343884 - DNA, 33 bp, Artificial Sequence
  Description of Artificial Sequence: Synthetic oligonucleotide
ttaacagcttcgtcagggtaacagcctcacatc

SEQ ID NO: 343885 - DNA, 32 bp, Artificial Sequence
  Description of Artificial Sequence: Synthetic oligonucleotide
taacagcttcgtcagggtaacagcctcacatc

SEQ ID NO: 343886 - DNA, 31 bp, Artificial Sequence
  Description of Artificial Sequence: Synthetic oligonucleotide
aacagcttcgtcagggtaacagcctcacatc

SEQ ID NO: 343887 - DNA, 30 bp, Artificial Sequence
  Description of Artificial Sequence: Synthetic oligonucleotide
acagcttcgtcagggtaacagcctcacatc

SEQ ID NO: 343888 - DNA, 29 bp, Artificial Sequence
  Description of Artificial Sequence: Synthetic oligonucleotide
cagcttcgtcagggtaacagcctcacatc

SEQ ID NO: 343889 - DNA, 29 bp, Artificial Sequence
  Description of Artificial Sequence: Synthetic oligonucleotide
agcttcgtcagggtaacagcctcacatcc

SEQ ID NO: 343890 - DNA, 28 bp, Artificial Sequence
  Description of Artificial Sequence: Synthetic oligonucleotide
gcttcgtcagggtaacagcctcacatcc

SEQ ID NO: 343891 - DNA, 31 bp, Artificial Sequence
  Description of Artificial Sequence: Synthetic oligonucleotide
cttcgtcagggtaacagcctcacatccattg

SEQ ID NO: 343892 - DNA, 31 bp, Artificial Sequence
  Description of Artificial Sequence: Synthetic oligonucleotide
ttcgtcagggtaacagcctcacatccattgg

SEQ ID NO: 343893 - DNA, 30 bp, Artificial Sequence
  Description of Artificial Sequence: Synthetic oligonucleotide
tcgtcagggtaacagcctcacatccattgg

SEQ ID NO: 343894 - DNA, 29 bp, Artificial Sequence
  Description of Artificial Sequence: Synthetic oligonucleotide
cgtcagggtaacagcctcacatccattgg

SEQ ID NO: 343895 - DNA, 30 bp, Artificial Sequence
  Description of Artificial Sequence: Synthetic oligonucleotide
gtcagggtaacagcctcacatccattggtc

SEQ ID NO: 343896 - DNA, 31 bp, Artificial Sequence
  Description of Artificial Sequence: Synthetic oligonucleotide
tcagggtaacagcctcacatccattggtcac

SEQ ID NO: 343897 - DNA, 30 bp, Artificial Sequence
  Description of Artificial Sequence: Synthetic oligonucleotide
cagggtaacagcctcacatccattggtcac

SEQ ID NO: 343898 - DNA, 34 bp, Artificial Sequence
  Description of Artificial Sequence: Synthetic oligonucleotide
agggtaacagcctcacatccattggtcactttag

SEQ ID NO: 343899 - DNA, 33 bp, Artificial Sequence
  Description of Artificial Sequence: Synthetic oligonucleotide
gggtaacagcctcacatccattggtcactttag

SEQ ID NO: 343900 - DNA, 33 bp, Artificial Sequence
  Description of Artificial Sequence: Synthetic oligonucleotide
ggtaacagcctcacatccattggtcactttagg

SEQ ID NO: 343901 - DNA, 33 bp, Artificial Sequence
  Description of Artificial Sequence: Synthetic oligonucleotide
gtaacagcctcacatccattggtcactttaggg

SEQ ID NO: 343902 - DNA, 34 bp, Artificial Sequence
  Description of Artificial Sequence: Synthetic oligonucleotide
taacagcctcacatccattggtcactttagggtc

SEQ ID NO: 343903 - DNA, 33 bp, Artificial Sequence
  Description of Artificial Sequence: Synthetic oligonucleotide
aacagcctcacatccattggtcactttagggtc

SEQ ID NO: 343904 - DNA, 32 bp, Artificial Sequence
  Description of Artificial Sequence: Synthetic oligonucleotide
acagcctcacatccattggtcactttagggtc

SEQ ID NO: 343905 - DNA, 31 bp, Artificial Sequence
  Description of Artificial Sequence: Synthetic oligonucleotide
cagcctcacatccattggtcactttagggtc

SEQ ID NO: 343906 - DNA, 32 bp, Artificial Sequence
  Description of Artificial Sequence: Synthetic oligonucleotide
agcctcacatccattggtcactttagggtctg

SEQ ID NO: 343907 - DNA, 31 bp, Artificial Sequence
  Description of Artificial Sequence: Synthetic oligonucleotide
gcctcacatccattggtcactttagggtctg

SEQ ID NO: 343908 - DNA, 32 bp, Artificial Sequence
  Description of Artificial Sequence: Synthetic oligonucleotide
cctcacatccattggtcactttagggtctgag

SEQ ID NO: 343909 - DNA, 32 bp, Artificial Sequence
  Description of Artificial Sequence: Synthetic oligonucleotide
ctcacatccattggtcactttagggtctgagg

SEQ ID NO: 343910 - DNA, 32 bp, Artificial Sequence
  Description of Artificial Sequence: Synthetic oligonucleotide
tcacatccattggtcactttagggtctgaggg

SEQ ID NO: 343911 - DNA, 31 bp, Artificial Sequence
  Description of Artificial Sequence: Synthetic oligonucleotide
cacatccattggtcactttagggtctgaggg

SEQ ID NO: 343912 - DNA, 31 bp, Artificial Sequence
  Description of Artificial Sequence: Synthetic oligonucleotide
acatccattggtcactttagggtctgagggg

SEQ ID NO: 343913 - DNA, 30 bp, Artificial Sequence
  Description of Artificial Sequence: Synthetic oligonucleotide
catccattggtcactttagggtctgagggg

SEQ ID NO: 343914 - DNA, 30 bp, Artificial Sequence
  Description of Artificial Sequence: Synthetic oligonucleotide
atccattggtcactttagggtctgaggggc

SEQ ID NO: 343915 - DNA, 29 bp, Artificial Sequence
  Description of Artificial Sequence: Synthetic oligonucleotide
tccattggtcactttagggtctgaggggc

SEQ ID NO: 343916 - DNA, 28 bp, Artificial Sequence
  Description of Artificial Sequence: Synthetic oligonucleotide
ccattggtcactttagggtctgaggggc

SEQ ID NO: 343917 - DNA, 28 bp, Artificial Sequence
  Description of Artificial Sequence: Synthetic oligonucleotide
cattggtcactttagggtctgaggggcc

SEQ ID NO: 343918 - DNA, 28 bp, Artificial Sequence
  Description of Artificial Sequence: Synthetic oligonucleotide
attggtcactttagggtctgaggggccc

SEQ ID NO: 343919 - DNA, 27 bp, Artificial Sequence
  Description of Artificial Sequence: Synthetic oligonucleotide
ttggtcactttagggtctgaggggccc

SEQ ID NO: 343920 - DNA, 27 bp, Artificial Sequence
  Description of Artificial Sequence: Synthetic oligonucleotide
tggtcactttagggtctgaggggccct

SEQ ID NO: 343921 - DNA, 27 bp, Artificial Sequence
  Description of Artificial Sequence: Synthetic oligonucleotide
ggtcactttagggtctgaggggccctt

SEQ ID NO: 343922 - DNA, 27 bp, Artificial Sequence
  Description of Artificial Sequence: Synthetic oligonucleotide
gtcactttagggtctgaggggcccttg

SEQ ID NO: 343923 - DNA, 28 bp, Artificial Sequence
  Description of Artificial Sequence: Synthetic oligonucleotide
tcactttagggtctgaggggcccttgtc

SEQ ID NO: 343924 - DNA, 27 bp, Artificial Sequence
  Description of Artificial Sequence: Synthetic oligonucleotide
cactttagggtctgaggggcccttgtc

SEQ ID NO: 343925 - DNA, 28 bp, Artificial Sequence
  Description of Artificial Sequence: Synthetic oligonucleotide
actttagggtctgaggggcccttgtcac

SEQ ID NO: 343926 - DNA, 27 bp, Artificial Sequence
  Description of Artificial Sequence: Synthetic oligonucleotide
ctttagggtctgaggggcccttgtcac

SEQ ID NO: 343927 - DNA, 27 bp, Artificial Sequence
  Description of Artificial Sequence: Synthetic oligonucleotide
tttagggtctgaggggcccttgtcacg

SEQ ID NO: 343928 - DNA, 27 bp, Artificial Sequence
  Description of Artificial Sequence: Synthetic oligonucleotide
ttagggtctgaggggcccttgtcacga

SEQ ID NO: 343929 - DNA, 26 bp, Artificial Sequence
  Description of Artificial Sequence: Synthetic oligonucleotide
tagggtctgaggggcccttgtcacga

SEQ ID NO: 343930 - DNA, 25 bp, Artificial Sequence
  Description of Artificial Sequence: Synthetic oligonucleotide
agggtctgaggggcccttgtcacga

SEQ ID NO: 343931 - DNA, 24 bp, Artificial Sequence
  Description of Artificial Sequence: Synthetic oligonucleotide
gggtctgaggggcccttgtcacga

SEQ ID NO: 343932 - DNA, 24 bp, Artificial Sequence
  Description of Artificial Sequence: Synthetic oligonucleotide
ggtctgaggggcccttgtcacgag

SEQ ID NO: 343933 - DNA, 25 bp, Artificial Sequence
  Description of Artificial Sequence: Synthetic oligonucleotide
gtctgaggggcccttgtcacgagga

SEQ ID NO: 343934 - DNA, 25 bp, Artificial Sequence
  Description of Artificial Sequence: Synthetic oligonucleotide
tctgaggggcccttgtcacgaggag

SEQ ID NO: 343935 - DNA, 24 bp, Artificial Sequence
  Description of Artificial Sequence: Synthetic oligonucleotide
ctgaggggcccttgtcacgaggag

SEQ ID NO: 343936 - DNA, 24 bp, Artificial Sequence
  Description of Artificial Sequence: Synthetic oligonucleotide
tgaggggcccttgtcacgaggagg

SEQ ID NO: 343937 - DNA, 23 bp, Artificial Sequence
  Description of Artificial Sequence: Synthetic oligonucleotide
gaggggcccttgtcacgaggagg

SEQ ID NO: 343938 - DNA, 23 bp, Artificial Sequence
  Description of Artificial Sequence: Synthetic oligonucleotide
aggggcccttgtcacgaggaggc

SEQ ID NO: 343939 - DNA, 22 bp, Artificial Sequence
  Description of Artificial Sequence: Synthetic oligonucleotide
ggggcccttgtcacgaggaggc

SEQ ID NO: 343940 - DNA, 23 bp, Artificial Sequence
  Description of Artificial Sequence: Synthetic oligonucleotide
gggcccttgtcacgaggaggcgt

SEQ ID NO: 343941 - DNA, 23 bp, Artificial Sequence
  Description of Artificial Sequence: Synthetic oligonucleotide
ggcccttgtcacgaggaggcgtc

SEQ ID NO: 343942 - DNA, 23 bp, Artificial Sequence
  Description of Artificial Sequence: Synthetic oligonucleotide
gcccttgtcacgaggaggcgtcg

SEQ ID NO: 343943 - DNA, 23 bp, Artificial Sequence
  Description of Artificial Sequence: Synthetic oligonucleotide
cccttgtcacgaggaggcgtcgc

SEQ ID NO: 343944 - DNA, 24 bp, Artificial Sequence
  Description of Artificial Sequence: Synthetic oligonucleotide
ccttgtcacgaggaggcgtcgcct

SEQ ID NO: 343945 - DNA, 24 bp, Artificial Sequence
  Description of Artificial Sequence: Synthetic oligonucleotide
cttgtcacgaggaggcgtcgcctc

SEQ ID NO: 343946 - DNA, 24 bp, Artificial Sequence
  Description of Artificial Sequence: Synthetic oligonucleotide
ttgtcacgaggaggcgtcgcctcc

SEQ ID NO: 343947 - DNA, 23 bp, Artificial Sequence
  Description of Artificial Sequence: Synthetic oligonucleotide
tgtcacgaggaggcgtcgcctcc

SEQ ID NO: 343948 - DNA, 22 bp, Artificial Sequence
  Description of Artificial Sequence: Synthetic oligonucleotide
gtcacgaggaggcgtcgcctcc

SEQ ID NO: 343949 - DNA, 23 bp, Artificial Sequence
  Description of Artificial Sequence: Synthetic oligonucleotide
tcacgaggaggcgtcgcctccct

SEQ ID NO: 343950 - DNA, 22 bp, Artificial Sequence
  Description of Artificial Sequence: Synthetic oligonucleotide
cacgaggaggcgtcgcctccct

SEQ ID NO: 343951 - DNA, 24 bp, Artificial Sequence
  Description of Artificial Sequence: Synthetic oligonucleotide
acgaggaggcgtcgcctccctcat

SEQ ID NO: 343952 - DNA, 23 bp, Artificial Sequence
  Description of Artificial Sequence: Synthetic oligonucleotide
cgaggaggcgtcgcctccctcat

SEQ ID NO: 343953 - DNA, 24 bp, Artificial Sequence
  Description of Artificial Sequence: Synthetic oligonucleotide
gaggaggcgtcgcctccctcatga

SEQ ID NO: 343954 - DNA, 24 bp, Artificial Sequence
  Description of Artificial Sequence: Synthetic oligonucleotide
aggaggcgtcgcctccctcatgag

SEQ ID NO: 343955 - DNA, 23 bp, Artificial Sequence
  Description of Artificial Sequence: Synthetic oligonucleotide
ggaggcgtcgcctccctcatgag

SEQ ID NO: 343956 - DNA, 23 bp, Artificial Sequence
  Description of Artificial Sequence: Synthetic oligonucleotide
gaggcgtcgcctccctcatgagg

SEQ ID NO: 343957 - DNA, 25 bp, Artificial Sequence
  Description of Artificial Sequence: Synthetic oligonucleotide
aggcgtcgcctccctcatgaggctt

SEQ ID NO: 343958 - DNA, 24 bp, Artificial Sequence
  Description of Artificial Sequence: Synthetic oligonucleotide
ggcgtcgcctccctcatgaggctt

SEQ ID NO: 343959 - DNA, 24 bp, Artificial Sequence
  Description of Artificial Sequence: Synthetic oligonucleotide
gcgtcgcctccctcatgaggcttc

SEQ ID NO: 343960 - DNA, 25 bp, Artificial Sequence
  Description of Artificial Sequence: Synthetic oligonucleotide
cgtcgcctccctcatgaggcttcgt

SEQ ID NO: 343961 - DNA, 25 bp, Artificial Sequence
  Description of Artificial Sequence: Synthetic oligonucleotide
gtcgcctccctcatgaggcttcgtc

SEQ ID NO: 343962 - DNA, 26 bp, Artificial Sequence
  Description of Artificial Sequence: Synthetic oligonucleotide
tcgcctccctcatgaggcttcgtcga

SEQ ID NO: 343963 - DNA, 25 bp, Artificial Sequence
  Description of Artificial Sequence: Synthetic oligonucleotide
cgcctccctcatgaggcttcgtcga

SEQ ID NO: 343964 - DNA, 25 bp, Artificial Sequence
  Description of Artificial Sequence: Synthetic oligonucleotide
gcctccctcatgaggcttcgtcgag

SEQ ID NO: 343965 - DNA, 25 bp, Artificial Sequence
  Description of Artificial Sequence: Synthetic oligonucleotide
cctccctcatgaggcttcgtcgagg

SEQ ID NO: 343966 - DNA, 26 bp, Artificial Sequence
  Description of Artificial Sequence: Synthetic oligonucleotide
ctccctcatgaggcttcgtcgaggct

SEQ ID NO: 343967 - DNA, 27 bp, Artificial Sequence
  Description of Artificial Sequence: Synthetic oligonucleotide
tccctcatgaggcttcgtcgaggctga

SEQ ID NO: 343968 - DNA, 26 bp, Artificial Sequence
  Description of Artificial Sequence: Synthetic oligonucleotide
ccctcatgaggcttcgtcgaggctga

SEQ ID NO: 343969 - DNA, 26 bp, Artificial Sequence
  Description of Artificial Sequence: Synthetic oligonucleotide
cctcatgaggcttcgtcgaggctgag

SEQ ID NO: 343970 - DNA, 26 bp, Artificial Sequence
  Description of Artificial Sequence: Synthetic oligonucleotide
ctcatgaggcttcgtcgaggctgagg

SEQ ID NO: 343971 - DNA, 26 bp, Artificial Sequence
  Description of Artificial Sequence: Synthetic oligonucleotide
tcatgaggcttcgtcgaggctgaggg

SEQ ID NO: 343972 - DNA, 25 bp, Artificial Sequence
  Description of Artificial Sequence: Synthetic oligonucleotide
catgaggcttcgtcgaggctgaggg

SEQ ID NO: 343973 - DNA, 26 bp, Artificial Sequence
  Description of Artificial Sequence: Synthetic oligonucleotide
atgaggcttcgtcgaggctgagggga

SEQ ID NO: 343974 - DNA, 25 bp, Artificial Sequence
  Description of Artificial Sequence: Synthetic oligonucleotide
tgaggcttcgtcgaggctgagggga

SEQ ID NO: 343975 - DNA, 24 bp, Artificial Sequence
  Description of Artificial Sequence: Synthetic oligonucleotide
gaggcttcgtcgaggctgagggga

SEQ ID NO: 343976 - DNA, 24 bp, Artificial Sequence
  Description of Artificial Sequence: Synthetic oligonucleotide
aggcttcgtcgaggctgaggggag

SEQ ID NO: 343977 - DNA, 23 bp, Artificial Sequence
  Description of Artificial Sequence: Synthetic oligonucleotide
ggcttcgtcgaggctgaggggag

SEQ ID NO: 343978 - DNA, 26 bp, Artificial Sequence
  Description of Artificial Sequence: Synthetic oligonucleotide
gcttcgtcgaggctgaggggagcaat

SEQ ID NO: 343979 - DNA, 26 bp, Artificial Sequence
  Description of Artificial Sequence: Synthetic oligonucleotide
cttcgtcgaggctgaggggagcaatc

SEQ ID NO: 343980 - DNA, 27 bp, Artificial Sequence
  Description of Artificial Sequence: Synthetic oligonucleotide
ttcgtcgaggctgaggggagcaatcca

SEQ ID NO: 343981 - DNA, 27 bp, Artificial Sequence
  Description of Artificial Sequence: Synthetic oligonucleotide
tcgtcgaggctgaggggagcaatccat

SEQ ID NO: 343982 - DNA, 26 bp, Artificial Sequence
  Description of Artificial Sequence: Synthetic oligonucleotide
cgtcgaggctgaggggagcaatccat

SEQ ID NO: 343983 - DNA, 27 bp, Artificial Sequence
  Description of Artificial Sequence: Synthetic oligonucleotide
gtcgaggctgaggggagcaatccatga

SEQ ID NO: 343984 - DNA, 28 bp, Artificial Sequence
  Description of Artificial Sequence: Synthetic oligonucleotide
tcgaggctgaggggagcaatccatgatc

SEQ ID NO: 343985 - DNA, 27 bp, Artificial Sequence
  Description of Artificial Sequence: Synthetic oligonucleotide
cgaggctgaggggagcaatccatgatc

SEQ ID NO: 343986 - DNA, 29 bp, Artificial Sequence
  Description of Artificial Sequence: Synthetic oligonucleotide
gaggctgaggggagcaatccatgatcttc

SEQ ID NO: 343987 - DNA, 31 bp, Artificial Sequence
  Description of Artificial Sequence: Synthetic oligonucleotide
aggctgaggggagcaatccatgatcttcttg

SEQ ID NO: 343988 - DNA, 30 bp, Artificial Sequence
  Description of Artificial Sequence: Synthetic oligonucleotide
ggctgaggggagcaatccatgatcttcttg

SEQ ID NO: 343989 - DNA, 30 bp, Artificial Sequence
  Description of Artificial Sequence: Synthetic oligonucleotide
gctgaggggagcaatccatgatcttcttgg

SEQ ID NO: 343990 - DNA, 30 bp, Artificial Sequence
  Description of Artificial Sequence: Synthetic oligonucleotide
ctgaggggagcaatccatgatcttcttggc

SEQ ID NO: 343991 - DNA, 31 bp, Artificial Sequence
  Description of Artificial Sequence: Synthetic oligonucleotide
tgaggggagcaatccatgatcttcttggctc

SEQ ID NO: 343992 - DNA, 30 bp, Artificial Sequence
  Description of Artificial Sequence: Synthetic oligonucleotide
gaggggagcaatccatgatcttcttggctc

SEQ ID NO: 343993 - DNA, 30 bp, Artificial Sequence
  Description of Artificial Sequence: Synthetic oligonucleotide
aggggagcaatccatgatcttcttggctcc

SEQ ID NO: 343994 - DNA, 29 bp, Artificial Sequence
  Description of Artificial Sequence: Synthetic oligonucleotide
ggggagcaatccatgatcttcttggctcc

SEQ ID NO: 343995 - DNA, 29 bp, Artificial Sequence
  Description of Artificial Sequence: Synthetic oligonucleotide
gggagcaatccatgatcttcttggctccc

SEQ ID NO: 343996 - DNA, 30 bp, Artificial Sequence
  Description of Artificial Sequence: Synthetic oligonucleotide
ggagcaatccatgatcttcttggctcccac

SEQ ID NO: 343997 - DNA, 31 bp, Artificial Sequence
  Description of Artificial Sequence: Synthetic oligonucleotide
gagcaatccatgatcttcttggctcccacac

SEQ ID NO: 343998 - DNA, 32 bp, Artificial Sequence
  Description of Artificial Sequence: Synthetic oligonucleotide
agcaatccatgatcttcttggctcccacactg

SEQ ID NO: 343999 - DNA, 31 bp, Artificial Sequence
  Description of Artificial Sequence: Synthetic oligonucleotide
gcaatccatgatcttcttggctcccacactg

SEQ ID NO: 344000 - DNA, 31 bp, Artificial Sequence
  Description of Artificial Sequence: Synthetic oligonucleotide
caatccatgatcttcttggctcccacactgg

SEQ ID NO: 344001 - DNA, 31 bp, Artificial Sequence
  Description of Artificial Sequence: Synthetic oligonucleotide
aatccatgatcttcttggctcccacactggc

SEQ ID NO: 344002 - DNA, 30 bp, Artificial Sequence
  Description of Artificial Sequence: Synthetic oligonucleotide
atccatgatcttcttggctcccacactggc

SEQ ID NO: 344003 - DNA, 29 bp, Artificial Sequence
  Description of Artificial Sequence: Synthetic oligonucleotide
tccatgatcttcttggctcccacactggc

SEQ ID NO: 344004 - DNA, 28 bp, Artificial Sequence
  Description of Artificial Sequence: Synthetic oligonucleotide
ccatgatcttcttggctcccacactggc

SEQ ID NO: 344005 - DNA, 29 bp, Artificial Sequence
  Description of Artificial Sequence: Synthetic oligonucleotide
catgatcttcttggctcccacactggctc

SEQ ID NO: 344006 - DNA, 29 bp, Artificial Sequence
  Description of Artificial Sequence: Synthetic oligonucleotide
atgatcttcttggctcccacactggctcc

SEQ ID NO: 344007 - DNA, 28 bp, Artificial Sequence
  Description of Artificial Sequence: Synthetic oligonucleotide
tgatcttcttggctcccacactggctcc

SEQ ID NO: 344008 - DNA, 27 bp, Artificial Sequence
  Description of Artificial Sequence: Synthetic oligonucleotide
gatcttcttggctcccacactggctcc

SEQ ID NO: 344009 - DNA, 29 bp, Artificial Sequence
  Description of Artificial Sequence: Synthetic oligonucleotide
atcttcttggctcccacactggctccttc

SEQ ID NO: 344010 - DNA, 28 bp, Artificial Sequence
  Description of Artificial Sequence: Synthetic oligonucleotide
tcttcttggctcccacactggctccttc

SEQ ID NO: 344011 - DNA, 27 bp, Artificial Sequence
  Description of Artificial Sequence: Synthetic oligonucleotide
cttcttggctcccacactggctccttc

SEQ ID NO: 344012 - DNA, 27 bp, Artificial Sequence
  Description of Artificial Sequence: Synthetic oligonucleotide
ttcttggctcccacactggctccttcc

SEQ ID NO: 344013 - DNA, 26 bp, Artificial Sequence
  Description of Artificial Sequence: Synthetic oligonucleotide
tcttggctcccacactggctccttcc

SEQ ID NO: 344014 - DNA, 25 bp, Artificial Sequence
  Description of Artificial Sequence: Synthetic oligonucleotide
cttggctcccacactggctccttcc

SEQ ID NO: 344015 - DNA, 25 bp, Artificial Sequence
  Description of Artificial Sequence: Synthetic oligonucleotide
ttggctcccacactggctccttccc

SEQ ID NO: 344016 - DNA, 24 bp, Artificial Sequence
  Description of Artificial Sequence: Synthetic oligonucleotide
tggctcccacactggctccttccc

SEQ ID NO: 344017 - DNA, 23 bp, Artificial Sequence
  Description of Artificial Sequence: Synthetic oligonucleotide
ggctcccacactggctccttccc

SEQ ID NO: 344018 - DNA, 23 bp, Artificial Sequence
  Description of Artificial Sequence: Synthetic oligonucleotide
gctcccacactggctccttcccg

SEQ ID NO: 344019 - DNA, 25 bp, Artificial Sequence
  Description of Artificial Sequence: Synthetic oligonucleotide
ctcccacactggctccttcccgctt

SEQ ID NO: 344020 - DNA, 25 bp, Artificial Sequence
  Description of Artificial Sequence: Synthetic oligonucleotide
tcccacactggctccttcccgcttc

SEQ ID NO: 344021 - DNA, 24 bp, Artificial Sequence
  Description of Artificial Sequence: Synthetic oligonucleotide
cccacactggctccttcccgcttc

SEQ ID NO: 344022 - DNA, 25 bp, Artificial Sequence
  Description of Artificial Sequence: Synthetic oligonucleotide
ccacactggctccttcccgcttcct

SEQ ID NO: 344023 - DNA, 25 bp, Artificial Sequence
  Description of Artificial Sequence: Synthetic oligonucleotide
cacactggctccttcccgcttcctg

SEQ ID NO: 344024 - DNA, 26 bp, Artificial Sequence
  Description of Artificial Sequence: Synthetic oligonucleotide
acactggctccttcccgcttcctgga

SEQ ID NO: 344025 - DNA, 25 bp, Artificial Sequence
  Description of Artificial Sequence: Synthetic oligonucleotide
cactggctccttcccgcttcctgga

SEQ ID NO: 344026 - DNA, 27 bp, Artificial Sequence
  Description of Artificial Sequence: Synthetic oligonucleotide
actggctccttcccgcttcctggacaa

SEQ ID NO: 344027 - DNA, 26 bp, Artificial Sequence
  Description of Artificial Sequence: Synthetic oligonucleotide
ctggctccttcccgcttcctggacaa

SEQ ID NO: 344028 - DNA, 27 bp, Artificial Sequence
  Description of Artificial Sequence: Synthetic oligonucleotide
tggctccttcccgcttcctggacaaca

SEQ ID NO: 344029 - DNA, 26 bp, Artificial Sequence
  Description of Artificial Sequence: Synthetic oligonucleotide
ggctccttcccgcttcctggacaaca

SEQ ID NO: 344030 - DNA, 27 bp, Artificial Sequence
  Description of Artificial Sequence: Synthetic oligonucleotide
gctccttcccgcttcctggacaacaca

SEQ ID NO: 344031 - DNA, 27 bp, Artificial Sequence
  Description of Artificial Sequence: Synthetic oligonucleotide
ctccttcccgcttcctggacaacacag

SEQ ID NO: 344032 - DNA, 28 bp, Artificial Sequence
  Description of Artificial Sequence: Synthetic oligonucleotide
tccttcccgcttcctggacaacacagag

SEQ ID NO: 344033 - DNA, 27 bp, Artificial Sequence
  Description of Artificial Sequence: Synthetic oligonucleotide
ccttcccgcttcctggacaacacagag

SEQ ID NO: 344034 - DNA, 27 bp, Artificial Sequence
  Description of Artificial Sequence: Synthetic oligonucleotide
cttcccgcttcctggacaacacagagc

SEQ ID NO: 344035 - DNA, 28 bp, Artificial Sequence
  Description of Artificial Sequence: Synthetic oligonucleotide
ttcccgcttcctggacaacacagagcag

SEQ ID NO: 344036 - DNA, 27 bp, Artificial Sequence
  Description of Artificial Sequence: Synthetic oligonucleotide
tcccgcttcctggacaacacagagcag

SEQ ID NO: 344037 - DNA, 27 bp, Artificial Sequence
  Description of Artificial Sequence: Synthetic oligonucleotide
cccgcttcctggacaacacagagcaga

SEQ ID NO: 344038 - DNA, 27 bp, Artificial Sequence
  Description of Artificial Sequence: Synthetic oligonucleotide
ccgcttcctggacaacacagagcagag

SEQ ID NO: 344039 - DNA, 27 bp, Artificial Sequence
  Description of Artificial Sequence: Synthetic oligonucleotide
cgcttcctggacaacacagagcagagg

SEQ ID NO: 344040 - DNA, 28 bp, Artificial Sequence
  Description of Artificial Sequence: Synthetic oligonucleotide
gcttcctggacaacacagagcagaggag

SEQ ID NO: 344041 - DNA, 28 bp, Artificial Sequence
  Description of Artificial Sequence: Synthetic oligonucleotide
cttcctggacaacacagagcagaggagc

SEQ ID NO: 344042 - DNA, 29 bp, Artificial Sequence
  Description of Artificial Sequence: Synthetic oligonucleotide
ttcctggacaacacagagcagaggagcac

SEQ ID NO: 344043 - DNA, 28 bp, Artificial Sequence
  Description of Artificial Sequence: Synthetic oligonucleotide
tcctggacaacacagagcagaggagcac

SEQ ID NO: 344044 - DNA, 27 bp, Artificial Sequence
  Description of Artificial Sequence: Synthetic oligonucleotide
cctggacaacacagagcagaggagcac

SEQ ID NO: 344045 - DNA, 28 bp, Artificial Sequence
  Description of Artificial Sequence: Synthetic oligonucleotide
ctggacaacacagagcagaggagcacac

SEQ ID NO: 344046 - DNA, 29 bp, Artificial Sequence
  Description of Artificial Sequence: Synthetic oligonucleotide
tggacaacacagagcagaggagcacacag

SEQ ID NO: 344047 - DNA, 28 bp, Artificial Sequence
  Description of Artificial Sequence: Synthetic oligonucleotide
ggacaacacagagcagaggagcacacag

SEQ ID NO: 344048 - DNA, 28 bp, Artificial Sequence
  Description of Artificial Sequence: Synthetic oligonucleotide
gacaacacagagcagaggagcacacagc

SEQ ID NO: 344049 - DNA, 28 bp, Artificial Sequence
  Description of Artificial Sequence: Synthetic oligonucleotide
acaacacagagcagaggagcacacagcc

SEQ ID NO: 344050 - DNA, 27 bp, Artificial Sequence
  Description of Artificial Sequence: Synthetic oligonucleotide
caacacagagcagaggagcacacagcc

SEQ ID NO: 344051 - DNA, 28 bp, Artificial Sequence
  Description of Artificial Sequence: Synthetic oligonucleotide
aacacagagcagaggagcacacagcctc

SEQ ID NO: 344052 - DNA, 27 bp, Artificial Sequence
  Description of Artificial Sequence: Synthetic oligonucleotide
acacagagcagaggagcacacagcctc

SEQ ID NO: 344053 - DNA, 26 bp, Artificial Sequence
  Description of Artificial Sequence: Synthetic oligonucleotide
cacagagcagaggagcacacagcctc

SEQ ID NO: 344054 - DNA, 26 bp, Artificial Sequence
  Description of Artificial Sequence: Synthetic oligonucleotide
acagagcagaggagcacacagcctcc

SEQ ID NO: 344055 - DNA, 25 bp, Artificial Sequence
  Description of Artificial Sequence: Synthetic oligonucleotide
cagagcagaggagcacacagcctcc

SEQ ID NO: 344056 - DNA, 25 bp, Artificial Sequence
  Description of Artificial Sequence: Synthetic oligonucleotide
agagcagaggagcacacagcctccc

SEQ ID NO: 344057 - DNA, 24 bp, Artificial Sequence
  Description of Artificial Sequence: Synthetic oligonucleotide
gagcagaggagcacacagcctccc

SEQ ID NO: 344058 - DNA, 25 bp, Artificial Sequence
  Description of Artificial Sequence: Synthetic oligonucleotide
agcagaggagcacacagcctcccga

SEQ ID NO: 344059 - DNA, 24 bp, Artificial Sequence
  Description of Artificial Sequence: Synthetic oligonucleotide
gcagaggagcacacagcctcccga

SEQ ID NO: 344060 - DNA, 25 bp, Artificial Sequence
  Description of Artificial Sequence: Synthetic oligonucleotide
cagaggagcacacagcctcccgaca

SEQ ID NO: 344061 - DNA, 25 bp, Artificial Sequence
  Description of Artificial Sequence: Synthetic oligonucleotide
agaggagcacacagcctcccgacac

SEQ ID NO: 344062 - DNA, 24 bp, Artificial Sequence
  Description of Artificial Sequence: Synthetic oligonucleotide
gaggagcacacagcctcccgacac

SEQ ID NO: 344063 - DNA, 26 bp, Artificial Sequence
  Description of Artificial Sequence: Synthetic oligonucleotide
aggagcacacagcctcccgacaccaa

SEQ ID NO: 344064 - DNA, 25 bp, Artificial Sequence
  Description of Artificial Sequence: Synthetic oligonucleotide
ggagcacacagcctcccgacaccaa

SEQ ID NO: 344065 - DNA, 25 bp, Artificial Sequence
  Description of Artificial Sequence: Synthetic oligonucleotide
gagcacacagcctcccgacaccaag

SEQ ID NO: 344066 - DNA, 26 bp, Artificial Sequence
  Description of Artificial Sequence: Synthetic oligonucleotide
agcacacagcctcccgacaccaagga

SEQ ID NO: 344067 - DNA, 25 bp, Artificial Sequence
  Description of Artificial Sequence: Synthetic oligonucleotide
gcacacagcctcccgacaccaagga

SEQ ID NO: 344068 - DNA, 25 bp, Artificial Sequence
  Description of Artificial Sequence: Synthetic oligonucleotide
cacacagcctcccgacaccaaggac

SEQ ID NO: 344069 - DNA, 26 bp, Artificial Sequence
  Description of Artificial Sequence: Synthetic oligonucleotide
acacagcctcccgacaccaaggacga

SEQ ID NO: 344070 - DNA, 25 bp, Artificial Sequence
  Description of Artificial Sequence: Synthetic oligonucleotide
cacagcctcccgacaccaaggacga

SEQ ID NO: 344071 - DNA, 25 bp, Artificial Sequence
  Description of Artificial Sequence: Synthetic oligonucleotide
acagcctcccgacaccaaggacgac

SEQ ID NO: 344072 - DNA, 24 bp, Artificial Sequence
  Description of Artificial Sequence: Synthetic oligonucleotide
cagcctcccgacaccaaggacgac

SEQ ID NO: 344073 - DNA, 24 bp, Artificial Sequence
  Description of Artificial Sequence: Synthetic oligonucleotide
agcctcccgacaccaaggacgacg

SEQ ID NO: 344074 - DNA, 23 bp, Artificial Sequence
  Description of Artificial Sequence: Synthetic oligonucleotide
gcctcccgacaccaaggacgacg

SEQ ID NO: 344075 - DNA, 23 bp, Artificial Sequence
  Description of Artificial Sequence: Synthetic oligonucleotide
cctcccgacaccaaggacgacgc

SEQ ID NO: 344076 - DNA, 23 bp, Artificial Sequence
  Description of Artificial Sequence: Synthetic oligonucleotide
ctcccgacaccaaggacgacgcc

SEQ ID NO: 344077 - DNA, 24 bp, Artificial Sequence
  Description of Artificial Sequence: Synthetic oligonucleotide
tcccgacaccaaggacgacgccgt

SEQ ID NO: 344078 - DNA, 23 bp, Artificial Sequence
  Description of Artificial Sequence: Synthetic oligonucleotide
cccgacaccaaggacgacgccgt

SEQ ID NO: 344079 - DNA, 23 bp, Artificial Sequence
  Description of Artificial Sequence: Synthetic oligonucleotide
ccgacaccaaggacgacgccgtg

SEQ ID NO: 344080 - DNA, 25 bp, Artificial Sequence
  Description of Artificial Sequence: Synthetic oligonucleotide
cgacaccaaggacgacgccgtggtt

SEQ ID NO: 344081 - DNA, 26 bp, Artificial Sequence
  Description of Artificial Sequence: Synthetic oligonucleotide
gacaccaaggacgacgccgtggttct

SEQ ID NO: 344082 - DNA, 27 bp, Artificial Sequence
  Description of Artificial Sequence: Synthetic oligonucleotide
acaccaaggacgacgccgtggttctga

SEQ ID NO: 344083 - DNA, 27 bp, Artificial Sequence
  Description of Artificial Sequence: Synthetic oligonucleotide
caccaaggacgacgccgtggttctgat

SEQ ID NO: 344084 - DNA, 27 bp, Artificial Sequence
  Description of Artificial Sequence: Synthetic oligonucleotide
accaaggacgacgccgtggttctgatc

SEQ ID NO: 344085 - DNA, 26 bp, Artificial Sequence
  Description of Artificial Sequence: Synthetic oligonucleotide
ccaaggacgacgccgtggttctgatc

SEQ ID NO: 344086 - DNA, 27 bp, Artificial Sequence
  Description of Artificial Sequence: Synthetic oligonucleotide
caaggacgacgccgtggttctgatcca

SEQ ID NO: 344087 - DNA, 27 bp, Artificial Sequence
  Description of Artificial Sequence: Synthetic oligonucleotide
aaggacgacgccgtggttctgatccac

SEQ ID NO: 344088 - DNA, 27 bp, Artificial Sequence
  Description of Artificial Sequence: Synthetic oligonucleotide
aggacgacgccgtggttctgatccaca

SEQ ID NO: 344089 - DNA, 27 bp, Artificial Sequence
  Description of Artificial Sequence: Synthetic oligonucleotide
ggacgacgccgtggttctgatccacaa

SEQ ID NO: 344090 - DNA, 28 bp, Artificial Sequence
  Description of Artificial Sequence: Synthetic oligonucleotide
gacgacgccgtggttctgatccacaaag

SEQ ID NO: 344091 - DNA, 28 bp, Artificial Sequence
  Description of Artificial Sequence: Synthetic oligonucleotide
acgacgccgtggttctgatccacaaagg

SEQ ID NO: 344092 - DNA, 27 bp, Artificial Sequence
  Description of Artificial Sequence: Synthetic oligonucleotide
cgacgccgtggttctgatccacaaagg

SEQ ID NO: 344093 - DNA, 27 bp, Artificial Sequence
  Description of Artificial Sequence: Synthetic oligonucleotide
gacgccgtggttctgatccacaaaggc

SEQ ID NO: 344094 - DNA, 29 bp, Artificial Sequence
  Description of Artificial Sequence: Synthetic oligonucleotide
acgccgtggttctgatccacaaaggctac

SEQ ID NO: 344095 - DNA, 28 bp, Artificial Sequence
  Description of Artificial Sequence: Synthetic oligonucleotide
cgccgtggttctgatccacaaaggctac

SEQ ID NO: 344096 - DNA, 30 bp, Artificial Sequence
  Description of Artificial Sequence: Synthetic oligonucleotide
gccgtggttctgatccacaaaggctacttg

SEQ ID NO: 344097 - DNA, 30 bp, Artificial Sequence
  Description of Artificial Sequence: Synthetic oligonucleotide
ccgtggttctgatccacaaaggctacttgc

SEQ ID NO: 344098 - DNA, 30 bp, Artificial Sequence
  Description of Artificial Sequence: Synthetic oligonucleotide
cgtggttctgatccacaaaggctacttgcg

SEQ ID NO: 344099 - DNA, 30 bp, Artificial Sequence
  Description of Artificial Sequence: Synthetic oligonucleotide
gtggttctgatccacaaaggctacttgcgg

SEQ ID NO: 344100 - DNA, 32 bp, Artificial Sequence
  Description of Artificial Sequence: Synthetic oligonucleotide
tggttctgatccacaaaggctacttgcggatc

SEQ ID NO: 344101 - DNA, 31 bp, Artificial Sequence
  Description of Artificial Sequence: Synthetic oligonucleotide
ggttctgatccacaaaggctacttgcggatc

SEQ ID NO: 344102 - DNA, 31 bp, Artificial Sequence
  Description of Artificial Sequence: Synthetic oligonucleotide
gttctgatccacaaaggctacttgcggatcc

SEQ ID NO: 344103 - DNA, 32 bp, Artificial Sequence
  Description of Artificial Sequence: Synthetic oligonucleotide
ttctgatccacaaaggctacttgcggatcctg

SEQ ID NO: 344104 - DNA, 31 bp, Artificial Sequence
  Description of Artificial Sequence: Synthetic oligonucleotide
tctgatccacaaaggctacttgcggatcctg

SEQ ID NO: 344105 - DNA, 30 bp, Artificial Sequence
  Description of Artificial Sequence: Synthetic oligonucleotide
ctgatccacaaaggctacttgcggatcctg

SEQ ID NO: 344106 - DNA, 30 bp, Artificial Sequence
  Description of Artificial Sequence: Synthetic oligonucleotide
tgatccacaaaggctacttgcggatcctgc

SEQ ID NO: 344107 - DNA, 29 bp, Artificial Sequence
  Description of Artificial Sequence: Synthetic oligonucleotide
gatccacaaaggctacttgcggatcctgc

SEQ ID NO: 344108 - DNA, 30 bp, Artificial Sequence
  Description of Artificial Sequence: Synthetic oligonucleotide
atccacaaaggctacttgcggatcctgcag

SEQ ID NO: 344109 - DNA, 29 bp, Artificial Sequence
  Description of Artificial Sequence: Synthetic oligonucleotide
tccacaaaggctacttgcggatcctgcag

SEQ ID NO: 344110 - DNA, 28 bp, Artificial Sequence
  Description of Artificial Sequence: Synthetic oligonucleotide
ccacaaaggctacttgcggatcctgcag

SEQ ID NO: 344111 - DNA, 31 bp, Artificial Sequence
  Description of Artificial Sequence: Synthetic oligonucleotide
cacaaaggctacttgcggatcctgcagtttc

SEQ ID NO: 344112 - DNA, 31 bp, Artificial Sequence
  Description of Artificial Sequence: Synthetic oligonucleotide
acaaaggctacttgcggatcctgcagtttcg

SEQ ID NO: 344113 - DNA, 30 bp, Artificial Sequence
  Description of Artificial Sequence: Synthetic oligonucleotide
caaaggctacttgcggatcctgcagtttcg

SEQ ID NO: 344114 - DNA, 30 bp, Artificial Sequence
  Description of Artificial Sequence: Synthetic oligonucleotide
aaaggctacttgcggatcctgcagtttcgc

SEQ ID NO: 344115 - DNA, 29 bp, Artificial Sequence
  Description of Artificial Sequence: Synthetic oligonucleotide
aaggctacttgcggatcctgcagtttcgc

SEQ ID NO: 344116 - DNA, 28 bp, Artificial Sequence
  Description of Artificial Sequence: Synthetic oligonucleotide
aggctacttgcggatcctgcagtttcgc

SEQ ID NO: 344117 - DNA, 27 bp, Artificial Sequence
  Description of Artificial Sequence: Synthetic oligonucleotide
ggctacttgcggatcctgcagtttcgc

SEQ ID NO: 344118 - DNA, 29 bp, Artificial Sequence
  Description of Artificial Sequence: Synthetic oligonucleotide
gctacttgcggatcctgcagtttcgcaag

SEQ ID NO: 344119 - DNA, 29 bp, Artificial Sequence
  Description of Artificial Sequence: Synthetic oligonucleotide
ctacttgcggatcctgcagtttcgcaagg

SEQ ID NO: 344120 - DNA, 29 bp, Artificial Sequence
  Description of Artificial Sequence: Synthetic oligonucleotide
tacttgcggatcctgcagtttcgcaaggc

SEQ ID NO: 344121 - DNA, 28 bp, Artificial Sequence
  Description of Artificial Sequence: Synthetic oligonucleotide
acttgcggatcctgcagtttcgcaaggc

SEQ ID NO: 344122 - DNA, 27 bp, Artificial Sequence
  Description of Artificial Sequence: Synthetic oligonucleotide
cttgcggatcctgcagtttcgcaaggc

SEQ ID NO: 344123 - DNA, 27 bp, Artificial Sequence
  Description of Artificial Sequence: Synthetic oligonucleotide
ttgcggatcctgcagtttcgcaaggcg

SEQ ID NO: 344124 - DNA, 26 bp, Artificial Sequence
  Description of Artificial Sequence: Synthetic oligonucleotide
tgcggatcctgcagtttcgcaaggcg

SEQ ID NO: 344125 - DNA, 25 bp, Artificial Sequence
  Description of Artificial Sequence: Synthetic oligonucleotide
gcggatcctgcagtttcgcaaggcg

SEQ ID NO: 344126 - DNA, 27 bp, Artificial Sequence
  Description of Artificial Sequence: Synthetic oligonucleotide
cggatcctgcagtttcgcaaggcggat

SEQ ID NO: 344127 - DNA, 27 bp, Artificial Sequence
  Description of Artificial Sequence: Synthetic oligonucleotide
ggatcctgcagtttcgcaaggcggatc

SEQ ID NO: 344128 - DNA, 27 bp, Artificial Sequence
  Description of Artificial Sequence: Synthetic oligonucleotide
gatcctgcagtttcgcaaggcggatcg

SEQ ID NO: 344129 - DNA, 29 bp, Artificial Sequence
  Description of Artificial Sequence: Synthetic oligonucleotide
atcctgcagtttcgcaaggcggatcgttc

SEQ ID NO: 344130 - DNA, 28 bp, Artificial Sequence
  Description of Artificial Sequence: Synthetic oligonucleotide
tcctgcagtttcgcaaggcggatcgttc

SEQ ID NO: 344131 - DNA, 27 bp, Artificial Sequence
  Description of Artificial Sequence: Synthetic oligonucleotide
cctgcagtttcgcaaggcggatcgttc

SEQ ID NO: 344132 - DNA, 27 bp, Artificial Sequence
  Description of Artificial Sequence: Synthetic oligonucleotide
ctgcagtttcgcaaggcggatcgttcc

SEQ ID NO: 344133 - DNA, 30 bp, Artificial Sequence
  Description of Artificial Sequence: Synthetic oligonucleotide
tgcagtttcgcaaggcggatcgttcctatg

SEQ ID NO: 344134 - DNA, 29 bp, Artificial Sequence
  Description of Artificial Sequence: Synthetic oligonucleotide
gcagtttcgcaaggcggatcgttcctatg

SEQ ID NO: 344135 - DNA, 29 bp, Artificial Sequence
  Description of Artificial Sequence: Synthetic oligonucleotide
cagtttcgcaaggcggatcgttcctatgg

SEQ ID NO: 344136 - DNA, 29 bp, Artificial Sequence
  Description of Artificial Sequence: Synthetic oligonucleotide
agtttcgcaaggcggatcgttcctatggg

SEQ ID NO: 344137 - DNA, 28 bp, Artificial Sequence
  Description of Artificial Sequence: Synthetic oligonucleotide
gtttcgcaaggcggatcgttcctatggg

SEQ ID NO: 344138 - DNA, 28 bp, Artificial Sequence
  Description of Artificial Sequence: Synthetic oligonucleotide
tttcgcaaggcggatcgttcctatgggg

SEQ ID NO: 344139 - DNA, 27 bp, Artificial Sequence
  Description of Artificial Sequence: Synthetic oligonucleotide
ttcgcaaggcggatcgttcctatgggg

SEQ ID NO: 344140 - DNA, 26 bp, Artificial Sequence
  Description of Artificial Sequence: Synthetic oligonucleotide
tcgcaaggcggatcgttcctatgggg

SEQ ID NO: 344141 - DNA, 25 bp, Artificial Sequence
  Description of Artificial Sequence: Synthetic oligonucleotide
cgcaaggcggatcgttcctatgggg

SEQ ID NO: 344142 - DNA, 27 bp, Artificial Sequence
  Description of Artificial Sequence: Synthetic oligonucleotide
gcaaggcggatcgttcctatggggctt

SEQ ID NO: 344143 - DNA, 27 bp, Artificial Sequence
  Description of Artificial Sequence: Synthetic oligonucleotide
caaggcggatcgttcctatggggcttg

SEQ ID NO: 344144 - DNA, 27 bp, Artificial Sequence
  Description of Artificial Sequence: Synthetic oligonucleotide
aaggcggatcgttcctatggggcttgg

SEQ ID NO: 344145 - DNA, 27 bp, Artificial Sequence
  Description of Artificial Sequence: Synthetic oligonucleotide
aggcggatcgttcctatggggcttggt

SEQ ID NO: 344146 - DNA, 27 bp, Artificial Sequence
  Description of Artificial Sequence: Synthetic oligonucleotide
ggcggatcgttcctatggggcttggtt

SEQ ID NO: 344147 - DNA, 27 bp, Artificial Sequence
  Description of Artificial Sequence: Synthetic oligonucleotide
gcggatcgttcctatggggcttggttc

SEQ ID NO: 344148 - DNA, 28 bp, Artificial Sequence
  Description of Artificial Sequence: Synthetic oligonucleotide
cggatcgttcctatggggcttggttctc

SEQ ID NO: 344149 - DNA, 29 bp, Artificial Sequence
  Description of Artificial Sequence: Synthetic oligonucleotide
ggatcgttcctatggggcttggttctcac

SEQ ID NO: 344150 - DNA, 29 bp, Artificial Sequence
  Description of Artificial Sequence: Synthetic oligonucleotide
gatcgttcctatggggcttggttctcacg

SEQ ID NO: 344151 - DNA, 29 bp, Artificial Sequence
  Description of Artificial Sequence: Synthetic oligonucleotide
atcgttcctatggggcttggttctcacgg

SEQ ID NO: 344152 - DNA, 28 bp, Artificial Sequence
  Description of Artificial Sequence: Synthetic oligonucleotide
tcgttcctatggggcttggttctcacgg

SEQ ID NO: 344153 - DNA, 27 bp, Artificial Sequence
  Description of Artificial Sequence: Synthetic oligonucleotide
cgttcctatggggcttggttctcacgg

SEQ ID NO: 344154 - DNA, 27 bp, Artificial Sequence
  Description of Artificial Sequence: Synthetic oligonucleotide
gttcctatggggcttggttctcacggg

SEQ ID NO: 344155 - DNA, 28 bp, Artificial Sequence
  Description of Artificial Sequence: Synthetic oligonucleotide
ttcctatggggcttggttctcacgggac

SEQ ID NO: 344156 - DNA, 27 bp, Artificial Sequence
  Description of Artificial Sequence: Synthetic oligonucleotide
tcctatggggcttggttctcacgggac

SEQ ID NO: 344157 - DNA, 27 bp, Artificial Sequence
  Description of Artificial Sequence: Synthetic oligonucleotide
cctatggggcttggttctcacgggact

SEQ ID NO: 344158 - DNA, 27 bp, Artificial Sequence
  Description of Artificial Sequence: Synthetic oligonucleotide
ctatggggcttggttctcacgggactg

SEQ ID NO: 344159 - DNA, 27 bp, Artificial Sequence
  Description of Artificial Sequence: Synthetic oligonucleotide
tatggggcttggttctcacgggactgc

SEQ ID NO: 344160 - DNA, 27 bp, Artificial Sequence
  Description of Artificial Sequence: Synthetic oligonucleotide
atggggcttggttctcacgggactgca

SEQ ID NO: 344161 - DNA, 26 bp, Artificial Sequence
  Description of Artificial Sequence: Synthetic oligonucleotide
tggggcttggttctcacgggactgca

SEQ ID NO: 344162 - DNA, 25 bp, Artificial Sequence
  Description of Artificial Sequence: Synthetic oligonucleotide
ggggcttggttctcacgggactgca

SEQ ID NO: 344163 - DNA, 25 bp, Artificial Sequence
  Description of Artificial Sequence: Synthetic oligonucleotide
gggcttggttctcacgggactgcag

SEQ ID NO: 344164 - DNA, 26 bp, Artificial Sequence
  Description of Artificial Sequence: Synthetic oligonucleotide
ggcttggttctcacgggactgcagca

SEQ ID NO: 344165 - DNA, 26 bp, Artificial Sequence
  Description of Artificial Sequence: Synthetic oligonucleotide
gcttggttctcacgggactgcagcac

SEQ ID NO: 344166 - DNA, 27 bp, Artificial Sequence
  Description of Artificial Sequence: Synthetic oligonucleotide
cttggttctcacgggactgcagcacct

SEQ ID NO: 344167 - DNA, 27 bp, Artificial Sequence
  Description of Artificial Sequence: Synthetic oligonucleotide
ttggttctcacgggactgcagcacctc

SEQ ID NO: 344168 - DNA, 26 bp, Artificial Sequence
  Description of Artificial Sequence: Synthetic oligonucleotide
tggttctcacgggactgcagcacctc

SEQ ID NO: 344169 - DNA, 25 bp, Artificial Sequence
  Description of Artificial Sequence: Synthetic oligonucleotide
ggttctcacgggactgcagcacctc

SEQ ID NO: 344170 - DNA, 25 bp, Artificial Sequence
  Description of Artificial Sequence: Synthetic oligonucleotide
gttctcacgggactgcagcacctcg

SEQ ID NO: 344171 - DNA, 26 bp, Artificial Sequence
  Description of Artificial Sequence: Synthetic oligonucleotide
ttctcacgggactgcagcacctcgct

SEQ ID NO: 344172 - DNA, 25 bp, Artificial Sequence
  Description of Artificial Sequence: Synthetic oligonucleotide
tctcacgggactgcagcacctcgct

SEQ ID NO: 344173 - DNA, 24 bp, Artificial Sequence
  Description of Artificial Sequence: Synthetic oligonucleotide
ctcacgggactgcagcacctcgct

SEQ ID NO: 344174 - DNA, 25 bp, Artificial Sequence
  Description of Artificial Sequence: Synthetic oligonucleotide
tcacgggactgcagcacctcgctca

SEQ ID NO: 344175 - DNA, 24 bp, Artificial Sequence
  Description of Artificial Sequence: Synthetic oligonucleotide
cacgggactgcagcacctcgctca

SEQ ID NO: 344176 - DNA, 25 bp, Artificial Sequence
  Description of Artificial Sequence: Synthetic oligonucleotide
acgggactgcagcacctcgctcaca

SEQ ID NO: 344177 - DNA, 24 bp, Artificial Sequence
  Description of Artificial Sequence: Synthetic oligonucleotide
cgggactgcagcacctcgctcaca

SEQ ID NO: 344178 - DNA, 24 bp, Artificial Sequence
  Description of Artificial Sequence: Synthetic oligonucleotide
gggactgcagcacctcgctcacag

SEQ ID NO: 344179 - DNA, 24 bp, Artificial Sequence
  Description of Artificial Sequence: Synthetic oligonucleotide
ggactgcagcacctcgctcacagc

SEQ ID NO: 344180 - DNA, 27 bp, Artificial Sequence
  Description of Artificial Sequence: Synthetic oligonucleotide
gactgcagcacctcgctcacagcgttt

SEQ ID NO: 344181 - DNA, 27 bp, Artificial Sequence
  Description of Artificial Sequence: Synthetic oligonucleotide
actgcagcacctcgctcacagcgtttg

SEQ ID NO: 344182 - DNA, 27 bp, Artificial Sequence
  Description of Artificial Sequence: Synthetic oligonucleotide
ctgcagcacctcgctcacagcgtttgt

SEQ ID NO: 344183 - DNA, 27 bp, Artificial Sequence
  Description of Artificial Sequence: Synthetic oligonucleotide
tgcagcacctcgctcacagcgtttgtg

SEQ ID NO: 344184 - DNA, 27 bp, Artificial Sequence
  Description of Artificial Sequence: Synthetic oligonucleotide
gcagcacctcgctcacagcgtttgtgt

SEQ ID NO: 344185 - DNA, 28 bp, Artificial Sequence
  Description of Artificial Sequence: Synthetic oligonucleotide
cagcacctcgctcacagcgtttgtgttg

SEQ ID NO: 344186 - DNA, 30 bp, Artificial Sequence
  Description of Artificial Sequence: Synthetic oligonucleotide
agcacctcgctcacagcgtttgtgttgtag

SEQ ID NO: 344187 - DNA, 29 bp, Artificial Sequence
  Description of Artificial Sequence: Synthetic oligonucleotide
gcacctcgctcacagcgtttgtgttgtag

SEQ ID NO: 344188 - DNA, 29 bp, Artificial Sequence
  Description of Artificial Sequence: Synthetic oligonucleotide
cacctcgctcacagcgtttgtgttgtagg

SEQ ID NO: 344189 - DNA, 30 bp, Artificial Sequence
  Description of Artificial Sequence: Synthetic oligonucleotide
acctcgctcacagcgtttgtgttgtaggtc

SEQ ID NO: 344190 - DNA, 29 bp, Artificial Sequence
  Description of Artificial Sequence: Synthetic oligonucleotide
cctcgctcacagcgtttgtgttgtaggtc

SEQ ID NO: 344191 - DNA, 29 bp, Artificial Sequence
  Description of Artificial Sequence: Synthetic oligonucleotide
ctcgctcacagcgtttgtgttgtaggtcc

SEQ ID NO: 344192 - DNA, 30 bp, Artificial Sequence
  Description of Artificial Sequence: Synthetic oligonucleotide
tcgctcacagcgtttgtgttgtaggtcctg

SEQ ID NO: 344193 - DNA, 29 bp, Artificial Sequence
  Description of Artificial Sequence: Synthetic oligonucleotide
cgctcacagcgtttgtgttgtaggtcctg

SEQ ID NO: 344194 - DNA, 30 bp, Artificial Sequence
  Description of Artificial Sequence: Synthetic oligonucleotide
gctcacagcgtttgtgttgtaggtcctgac

SEQ ID NO: 344195 - DNA, 33 bp, Artificial Sequence
  Description of Artificial Sequence: Synthetic oligonucleotide
ctcacagcgtttgtgttgtaggtcctgactttg

SEQ ID NO: 344196 - DNA, 33 bp, Artificial Sequence
  Description of Artificial Sequence: Synthetic oligonucleotide
tcacagcgtttgtgttgtaggtcctgactttgg

SEQ ID NO: 344197 - DNA, 32 bp, Artificial Sequence
  Description of Artificial Sequence: Synthetic oligonucleotide
cacagcgtttgtgttgtaggtcctgactttgg

SEQ ID NO: 344198 - DNA, 32 bp, Artificial Sequence
  Description of Artificial Sequence: Synthetic oligonucleotide
acagcgtttgtgttgtaggtcctgactttggc

SEQ ID NO: 344199 - DNA, 31 bp, Artificial Sequence
  Description of Artificial Sequence: Synthetic oligonucleotide
cagcgtttgtgttgtaggtcctgactttggc

SEQ ID NO: 344200 - DNA, 31 bp, Artificial Sequence
  Description of Artificial Sequence: Synthetic oligonucleotide
agcgtttgtgttgtaggtcctgactttggcc

SEQ ID NO: 344201 - DNA, 30 bp, Artificial Sequence
  Description of Artificial Sequence: Synthetic oligonucleotide
gcgtttgtgttgtaggtcctgactttggcc

SEQ ID NO: 344202 - DNA, 30 bp, Artificial Sequence
  Description of Artificial Sequence: Synthetic oligonucleotide
cgtttgtgttgtaggtcctgactttggccc

SEQ ID NO: 344203 - DNA, 31 bp, Artificial Sequence
  Description of Artificial Sequence: Synthetic oligonucleotide
gtttgtgttgtaggtcctgactttggcccac

SEQ ID NO: 344204 - DNA, 31 bp, Artificial Sequence
  Description of Artificial Sequence: Synthetic oligonucleotide
tttgtgttgtaggtcctgactttggcccacg

SEQ ID NO: 344205 - DNA, 30 bp, Artificial Sequence
  Description of Artificial Sequence: Synthetic oligonucleotide
ttgtgttgtaggtcctgactttggcccacg

SEQ ID NO: 344206 - DNA, 29 bp, Artificial Sequence
  Description of Artificial Sequence: Synthetic oligonucleotide
tgtgttgtaggtcctgactttggcccacg

SEQ ID NO: 344207 - DNA, 28 bp, Artificial Sequence
  Description of Artificial Sequence: Synthetic oligonucleotide
gtgttgtaggtcctgactttggcccacg

SEQ ID NO: 344208 - DNA, 29 bp, Artificial Sequence
  Description of Artificial Sequence: Synthetic oligonucleotide
tgttgtaggtcctgactttggcccacgag

SEQ ID NO: 344209 - DNA, 28 bp, Artificial Sequence
  Description of Artificial Sequence: Synthetic oligonucleotide
gttgtaggtcctgactttggcccacgag

SEQ ID NO: 344210 - DNA, 28 bp, Artificial Sequence
  Description of Artificial Sequence: Synthetic oligonucleotide
ttgtaggtcctgactttggcccacgagc

SEQ ID NO: 344211 - DNA, 27 bp, Artificial Sequence
  Description of Artificial Sequence: Synthetic oligonucleotide
tgtaggtcctgactttggcccacgagc

SEQ ID NO: 344212 - DNA, 27 bp, Artificial Sequence
  Description of Artificial Sequence: Synthetic oligonucleotide
gtaggtcctgactttggcccacgagca

SEQ ID NO: 344213 - DNA, 27 bp, Artificial Sequence
  Description of Artificial Sequence: Synthetic oligonucleotide
taggtcctgactttggcccacgagcag

SEQ ID NO: 344214 - DNA, 26 bp, Artificial Sequence
  Description of Artificial Sequence: Synthetic oligonucleotide
aggtcctgactttggcccacgagcag

SEQ ID NO: 344215 - DNA, 25 bp, Artificial Sequence
  Description of Artificial Sequence: Synthetic oligonucleotide
ggtcctgactttggcccacgagcag

SEQ ID NO: 344216 - DNA, 27 bp, Artificial Sequence
  Description of Artificial Sequence: Synthetic oligonucleotide
gtcctgactttggcccacgagcaggta

SEQ ID NO: 344217 - DNA, 27 bp, Artificial Sequence
  Description of Artificial Sequence: Synthetic oligonucleotide
tcctgactttggcccacgagcaggtac

SEQ ID NO: 344218 - DNA, 26 bp, Artificial Sequence
  Description of Artificial Sequence: Synthetic oligonucleotide
cctgactttggcccacgagcaggtac

SEQ ID NO: 344219 - DNA, 27 bp, Artificial Sequence
  Description of Artificial Sequence: Synthetic oligonucleotide
ctgactttggcccacgagcaggtacga

SEQ ID NO: 344220 - DNA, 27 bp, Artificial Sequence
  Description of Artificial Sequence: Synthetic oligonucleotide
tgactttggcccacgagcaggtacgag

SEQ ID NO: 344221 - DNA, 26 bp, Artificial Sequence
  Description of Artificial Sequence: Synthetic oligonucleotide
gactttggcccacgagcaggtacgag

SEQ ID NO: 344222 - DNA, 26 bp, Artificial Sequence
  Description of Artificial Sequence: Synthetic oligonucleotide
actttggcccacgagcaggtacgagg

SEQ ID NO: 344223 - DNA, 25 bp, Artificial Sequence
  Description of Artificial Sequence: Synthetic oligonucleotide
ctttggcccacgagcaggtacgagg

SEQ ID NO: 344224 - DNA, 26 bp, Artificial Sequence
  Description of Artificial Sequence: Synthetic oligonucleotide
tttggcccacgagcaggtacgaggct

SEQ ID NO: 344225 - DNA, 25 bp, Artificial Sequence
  Description of Artificial Sequence: Synthetic oligonucleotide
ttggcccacgagcaggtacgaggct

SEQ ID NO: 344226 - DNA, 24 bp, Artificial Sequence
  Description of Artificial Sequence: Synthetic oligonucleotide
tggcccacgagcaggtacgaggct

SEQ ID NO: 344227 - DNA, 23 bp, Artificial Sequence
  Description of Artificial Sequence: Synthetic oligonucleotide
ggcccacgagcaggtacgaggct

SEQ ID NO: 344228 - DNA, 23 bp, Artificial Sequence
  Description of Artificial Sequence: Synthetic oligonucleotide
gcccacgagcaggtacgaggctc

SEQ ID NO: 344229 - DNA, 23 bp, Artificial Sequence
  Description of Artificial Sequence: Synthetic oligonucleotide
cccacgagcaggtacgaggctcg

SEQ ID NO: 344230 - DNA, 23 bp, Artificial Sequence
  Description of Artificial Sequence: Synthetic oligonucleotide
ccacgagcaggtacgaggctcgc

SEQ ID NO: 344231 - DNA, 24 bp, Artificial Sequence
  Description of Artificial Sequence: Synthetic oligonucleotide
cacgagcaggtacgaggctcgcgt

SEQ ID NO: 344232 - DNA, 25 bp, Artificial Sequence
  Description of Artificial Sequence: Synthetic oligonucleotide
acgagcaggtacgaggctcgcgtga

SEQ ID NO: 344233 - DNA, 24 bp, Artificial Sequence
  Description of Artificial Sequence: Synthetic oligonucleotide
cgagcaggtacgaggctcgcgtga

SEQ ID NO: 344234 - DNA, 27 bp, Artificial Sequence
  Description of Artificial Sequence: Synthetic oligonucleotide
gagcaggtacgaggctcgcgtgagaaa

SEQ ID NO: 344235 - DNA, 27 bp, Artificial Sequence
  Description of Artificial Sequence: Synthetic oligonucleotide
agcaggtacgaggctcgcgtgagaaac

SEQ ID NO: 344236 - DNA, 27 bp, Artificial Sequence
  Description of Artificial Sequence: Synthetic oligonucleotide
gcaggtacgaggctcgcgtgagaaact

SEQ ID NO: 344237 - DNA, 27 bp, Artificial Sequence
  Description of Artificial Sequence: Synthetic oligonucleotide
caggtacgaggctcgcgtgagaaactc

SEQ ID NO: 344238 - DNA, 27 bp, Artificial Sequence
  Description of Artificial Sequence: Synthetic oligonucleotide
aggtacgaggctcgcgtgagaaactcc

SEQ ID NO: 344239 - DNA, 27 bp, Artificial Sequence
  Description of Artificial Sequence: Synthetic oligonucleotide
ggtacgaggctcgcgtgagaaactcca

SEQ ID NO: 344240 - DNA, 27 bp, Artificial Sequence
  Description of Artificial Sequence: Synthetic oligonucleotide
gtacgaggctcgcgtgagaaactccag

SEQ ID NO: 344241 - DNA, 27 bp, Artificial Sequence
  Description of Artificial Sequence: Synthetic oligonucleotide
tacgaggctcgcgtgagaaactccagg

SEQ ID NO: 344242 - DNA, 27 bp, Artificial Sequence
  Description of Artificial Sequence: Synthetic oligonucleotide
acgaggctcgcgtgagaaactccagga

SEQ ID NO: 344243 - DNA, 26 bp, Artificial Sequence
  Description of Artificial Sequence: Synthetic oligonucleotide
cgaggctcgcgtgagaaactccagga

SEQ ID NO: 344244 - DNA, 27 bp, Artificial Sequence
  Description of Artificial Sequence: Synthetic oligonucleotide
gaggctcgcgtgagaaactccaggaga

SEQ ID NO: 344245 - DNA, 27 bp, Artificial Sequence
  Description of Artificial Sequence: Synthetic oligonucleotide
aggctcgcgtgagaaactccaggagac

SEQ ID NO: 344246 - DNA, 27 bp, Artificial Sequence
  Description of Artificial Sequence: Synthetic oligonucleotide
ggctcgcgtgagaaactccaggagaca

SEQ ID NO: 344247 - DNA, 28 bp, Artificial Sequence
  Description of Artificial Sequence: Synthetic oligonucleotide
gctcgcgtgagaaactccaggagacaac

SEQ ID NO: 344248 - DNA, 31 bp, Artificial Sequence
  Description of Artificial Sequence: Synthetic oligonucleotide
ctcgcgtgagaaactccaggagacaactaac

SEQ ID NO: 344249 - DNA, 32 bp, Artificial Sequence
  Description of Artificial Sequence: Synthetic oligonucleotide
tcgcgtgagaaactccaggagacaactaactg

SEQ ID NO: 344250 - DNA, 31 bp, Artificial Sequence
  Description of Artificial Sequence: Synthetic oligonucleotide
cgcgtgagaaactccaggagacaactaactg

SEQ ID NO: 344251 - DNA, 31 bp, Artificial Sequence
  Description of Artificial Sequence: Synthetic oligonucleotide
gcgtgagaaactccaggagacaactaactgg

SEQ ID NO: 344252 - DNA, 31 bp, Artificial Sequence
  Description of Artificial Sequence: Synthetic oligonucleotide
cgtgagaaactccaggagacaactaactggc

SEQ ID NO: 344253 - DNA, 33 bp, Artificial Sequence
  Description of Artificial Sequence: Synthetic oligonucleotide
gtgagaaactccaggagacaactaactggcatc

SEQ ID NO: 344254 - DNA, 34 bp, Artificial Sequence
  Description of Artificial Sequence: Synthetic oligonucleotide
tgagaaactccaggagacaactaactggcatctg

SEQ ID NO: 344255 - DNA, 33 bp, Artificial Sequence
  Description of Artificial Sequence: Synthetic oligonucleotide
gagaaactccaggagacaactaactggcatctg

SEQ ID NO: 344256 - DNA, 34 bp, Artificial Sequence
  Description of Artificial Sequence: Synthetic oligonucleotide
agaaactccaggagacaactaactggcatctgtc

SEQ ID NO: 344257 - DNA, 33 bp, Artificial Sequence
  Description of Artificial Sequence: Synthetic oligonucleotide
gaaactccaggagacaactaactggcatctgtc

SEQ ID NO: 344258 - DNA, 33 bp, Artificial Sequence
  Description of Artificial Sequence: Synthetic oligonucleotide
aaactccaggagacaactaactggcatctgtcc

SEQ ID NO: 344259 - DNA, 32 bp, Artificial Sequence
  Description of Artificial Sequence: Synthetic oligonucleotide
aactccaggagacaactaactggcatctgtcc

SEQ ID NO: 344260 - DNA, 31 bp, Artificial Sequence
  Description of Artificial Sequence: Synthetic oligonucleotide
actccaggagacaactaactggcatctgtcc

SEQ ID NO: 344261 - DNA, 30 bp, Artificial Sequence
  Description of Artificial Sequence: Synthetic oligonucleotide
ctccaggagacaactaactggcatctgtcc

SEQ ID NO: 344262 - DNA, 30 bp, Artificial Sequence
  Description of Artificial Sequence: Synthetic oligonucleotide
tccaggagacaactaactggcatctgtccc

SEQ ID NO: 344263 - DNA, 29 bp, Artificial Sequence
  Description of Artificial Sequence: Synthetic oligonucleotide
ccaggagacaactaactggcatctgtccc

SEQ ID NO: 344264 - DNA, 30 bp, Artificial Sequence
  Description of Artificial Sequence: Synthetic oligonucleotide
caggagacaactaactggcatctgtcccac

SEQ ID NO: 344265 - DNA, 30 bp, Artificial Sequence
  Description of Artificial Sequence: Synthetic oligonucleotide
aggagacaactaactggcatctgtcccacc

SEQ ID NO: 344266 - DNA, 29 bp, Artificial Sequence
  Description of Artificial Sequence: Synthetic oligonucleotide
ggagacaactaactggcatctgtcccacc

SEQ ID NO: 344267 - DNA, 30 bp, Artificial Sequence
  Description of Artificial Sequence: Synthetic oligonucleotide
gagacaactaactggcatctgtcccaccag

SEQ ID NO: 344268 - DNA, 30 bp, Artificial Sequence
  Description of Artificial Sequence: Synthetic oligonucleotide
agacaactaactggcatctgtcccaccagc

SEQ ID NO: 344269 - DNA, 29 bp, Artificial Sequence
  Description of Artificial Sequence: Synthetic oligonucleotide
gacaactaactggcatctgtcccaccagc

SEQ ID NO: 344270 - DNA, 30 bp, Artificial Sequence
  Description of Artificial Sequence: Synthetic oligonucleotide
acaactaactggcatctgtcccaccagcag

SEQ ID NO: 344271 - DNA, 29 bp, Artificial Sequence
  Description of Artificial Sequence: Synthetic oligonucleotide
caactaactggcatctgtcccaccagcag

SEQ ID NO: 344272 - DNA, 29 bp, Artificial Sequence
  Description of Artificial Sequence: Synthetic oligonucleotide
aactaactggcatctgtcccaccagcagg

SEQ ID NO: 344273 - DNA, 28 bp, Artificial Sequence
  Description of Artificial Sequence: Synthetic oligonucleotide
actaactggcatctgtcccaccagcagg

SEQ ID NO: 344274 - DNA, 27 bp, Artificial Sequence
  Description of Artificial Sequence: Synthetic oligonucleotide
ctaactggcatctgtcccaccagcagg

SEQ ID NO: 344275 - DNA, 27 bp, Artificial Sequence
  Description of Artificial Sequence: Synthetic oligonucleotide
taactggcatctgtcccaccagcaggc

SEQ ID NO: 344276 - DNA, 27 bp, Artificial Sequence
  Description of Artificial Sequence: Synthetic oligonucleotide
aactggcatctgtcccaccagcaggct

SEQ ID NO: 344277 - DNA, 26 bp, Artificial Sequence
  Description of Artificial Sequence: Synthetic oligonucleotide
actggcatctgtcccaccagcaggct

SEQ ID NO: 344278 - DNA, 25 bp, Artificial Sequence
  Description of Artificial Sequence: Synthetic oligonucleotide
ctggcatctgtcccaccagcaggct

SEQ ID NO: 344279 - DNA, 26 bp, Artificial Sequence
  Description of Artificial Sequence: Synthetic oligonucleotide
tggcatctgtcccaccagcaggctca

SEQ ID NO: 344280 - DNA, 25 bp, Artificial Sequence
  Description of Artificial Sequence: Synthetic oligonucleotide
ggcatctgtcccaccagcaggctca

SEQ ID NO: 344281 - DNA, 25 bp, Artificial Sequence
  Description of Artificial Sequence: Synthetic oligonucleotide
gcatctgtcccaccagcaggctcac

SEQ ID NO: 344282 - DNA, 25 bp, Artificial Sequence
  Description of Artificial Sequence: Synthetic oligonucleotide
catctgtcccaccagcaggctcacg

SEQ ID NO: 344283 - DNA, 25 bp, Artificial Sequence
  Description of Artificial Sequence: Synthetic oligonucleotide
atctgtcccaccagcaggctcacgg

SEQ ID NO: 344284 - DNA, 24 bp, Artificial Sequence
  Description of Artificial Sequence: Synthetic oligonucleotide
tctgtcccaccagcaggctcacgg

SEQ ID NO: 344285 - DNA, 23 bp, Artificial Sequence
  Description of Artificial Sequence: Synthetic oligonucleotide
ctgtcccaccagcaggctcacgg

SEQ ID NO: 344286 - DNA, 24 bp, Artificial Sequence
  Description of Artificial Sequence: Synthetic oligonucleotide
tgtcccaccagcaggctcacggct

SEQ ID NO: 344287 - DNA, 23 bp, Artificial Sequence
  Description of Artificial Sequence: Synthetic oligonucleotide
gtcccaccagcaggctcacggct

SEQ ID NO: 344288 - DNA, 23 bp, Artificial Sequence
  Description of Artificial Sequence: Synthetic oligonucleotide
tcccaccagcaggctcacggctc

SEQ ID NO: 344289 - DNA, 22 bp, Artificial Sequence
  Description of Artificial Sequence: Synthetic oligonucleotide
cccaccagcaggctcacggctc

SEQ ID NO: 344290 - DNA, 24 bp, Artificial Sequence
  Description of Artificial Sequence: Synthetic oligonucleotide
ccaccagcaggctcacggctcgta

SEQ ID NO: 344291 - DNA, 24 bp, Artificial Sequence
  Description of Artificial Sequence: Synthetic oligonucleotide
caccagcaggctcacggctcgtac

SEQ ID NO: 344292 - DNA, 25 bp, Artificial Sequence
  Description of Artificial Sequence: Synthetic oligonucleotide
accagcaggctcacggctcgtacca

SEQ ID NO: 344293 - DNA, 24 bp, Artificial Sequence
  Description of Artificial Sequence: Synthetic oligonucleotide
ccagcaggctcacggctcgtacca

SEQ ID NO: 344294 - DNA, 24 bp, Artificial Sequence
  Description of Artificial Sequence: Synthetic oligonucleotide
cagcaggctcacggctcgtaccag

SEQ ID NO: 344295 - DNA, 25 bp, Artificial Sequence
  Description of Artificial Sequence: Synthetic oligonucleotide
agcaggctcacggctcgtaccagga

SEQ ID NO: 344296 - DNA, 24 bp, Artificial Sequence
  Description of Artificial Sequence: Synthetic oligonucleotide
gcaggctcacggctcgtaccagga

SEQ ID NO: 344297 - DNA, 24 bp, Artificial Sequence
  Description of Artificial Sequence: Synthetic oligonucleotide
caggctcacggctcgtaccaggac

SEQ ID NO: 344298 - DNA, 24 bp, Artificial Sequence
  Description of Artificial Sequence: Synthetic oligonucleotide
aggctcacggctcgtaccaggacc

SEQ ID NO: 344299 - DNA, 23 bp, Artificial Sequence
  Description of Artificial Sequence: Synthetic oligonucleotide
ggctcacggctcgtaccaggacc

SEQ ID NO: 344300 - DNA, 23 bp, Artificial Sequence
  Description of Artificial Sequence: Synthetic oligonucleotide
gctcacggctcgtaccaggaccc

SEQ ID NO: 344301 - DNA, 24 bp, Artificial Sequence
  Description of Artificial Sequence: Synthetic oligonucleotide
ctcacggctcgtaccaggacccgt

SEQ ID NO: 344302 - DNA, 25 bp, Artificial Sequence
  Description of Artificial Sequence: Synthetic oligonucleotide
tcacggctcgtaccaggacccgtgt

SEQ ID NO: 344303 - DNA, 24 bp, Artificial Sequence
  Description of Artificial Sequence: Synthetic oligonucleotide
cacggctcgtaccaggacccgtgt

SEQ ID NO: 344304 - DNA, 24 bp, Artificial Sequence
  Description of Artificial Sequence: Synthetic oligonucleotide
acggctcgtaccaggacccgtgtc

SEQ ID NO: 344305 - DNA, 23 bp, Artificial Sequence
  Description of Artificial Sequence: Synthetic oligonucleotide
cggctcgtaccaggacccgtgtc

SEQ ID NO: 344306 - DNA, 24 bp, Artificial Sequence
  Description of Artificial Sequence: Synthetic oligonucleotide
ggctcgtaccaggacccgtgtcca

SEQ ID NO: 344307 - DNA, 25 bp, Artificial Sequence
  Description of Artificial Sequence: Synthetic oligonucleotide
gctcgtaccaggacccgtgtccagt

SEQ ID NO: 344308 - DNA, 27 bp, Artificial Sequence
  Description of Artificial Sequence: Synthetic oligonucleotide
ctcgtaccaggacccgtgtccagtgat

SEQ ID NO: 344309 - DNA, 28 bp, Artificial Sequence
  Description of Artificial Sequence: Synthetic oligonucleotide
tcgtaccaggacccgtgtccagtgatag

SEQ ID NO: 344310 - DNA, 27 bp, Artificial Sequence
  Description of Artificial Sequence: Synthetic oligonucleotide
cgtaccaggacccgtgtccagtgatag

SEQ ID NO: 344311 - DNA, 28 bp, Artificial Sequence
  Description of Artificial Sequence: Synthetic oligonucleotide
gtaccaggacccgtgtccagtgatagac

SEQ ID NO: 344312 - DNA, 29 bp, Artificial Sequence
  Description of Artificial Sequence: Synthetic oligonucleotide
taccaggacccgtgtccagtgatagacag

SEQ ID NO: 344313 - DNA, 28 bp, Artificial Sequence
  Description of Artificial Sequence: Synthetic oligonucleotide
accaggacccgtgtccagtgatagacag

SEQ ID NO: 344314 - DNA, 27 bp, Artificial Sequence
  Description of Artificial Sequence: Synthetic oligonucleotide
ccaggacccgtgtccagtgatagacag

SEQ ID NO: 344315 - DNA, 27 bp, Artificial Sequence
  Description of Artificial Sequence: Synthetic oligonucleotide
caggacccgtgtccagtgatagacagg

SEQ ID NO: 344316 - DNA, 28 bp, Artificial Sequence
  Description of Artificial Sequence: Synthetic oligonucleotide
aggacccgtgtccagtgatagacaggac

SEQ ID NO: 344317 - DNA, 27 bp, Artificial Sequence
  Description of Artificial Sequence: Synthetic oligonucleotide
ggacccgtgtccagtgatagacaggac

SEQ ID NO: 344318 - DNA, 27 bp, Artificial Sequence
  Description of Artificial Sequence: Synthetic oligonucleotide
gacccgtgtccagtgatagacaggacc

SEQ ID NO: 344319 - DNA, 29 bp, Artificial Sequence
  Description of Artificial Sequence: Synthetic oligonucleotide
acccgtgtccagtgatagacaggaccatg

SEQ ID NO: 344320 - DNA, 28 bp, Artificial Sequence
  Description of Artificial Sequence: Synthetic oligonucleotide
cccgtgtccagtgatagacaggaccatg

SEQ ID NO: 344321 - DNA, 28 bp, Artificial Sequence
  Description of Artificial Sequence: Synthetic oligonucleotide
ccgtgtccagtgatagacaggaccatgc

SEQ ID NO: 344322 - DNA, 29 bp, Artificial Sequence
  Description of Artificial Sequence: Synthetic oligonucleotide
cgtgtccagtgatagacaggaccatgcag

SEQ ID NO: 344323 - DNA, 29 bp, Artificial Sequence
  Description of Artificial Sequence: Synthetic oligonucleotide
gtgtccagtgatagacaggaccatgcagg

SEQ ID NO: 344324 - DNA, 29 bp, Artificial Sequence
  Description of Artificial Sequence: Synthetic oligonucleotide
tgtccagtgatagacaggaccatgcaggg

SEQ ID NO: 344325 - DNA, 28 bp, Artificial Sequence
  Description of Artificial Sequence: Synthetic oligonucleotide
gtccagtgatagacaggaccatgcaggg

SEQ ID NO: 344326 - DNA, 28 bp, Artificial Sequence
  Description of Artificial Sequence: Synthetic oligonucleotide
tccagtgatagacaggaccatgcagggc

SEQ ID NO: 344327 - DNA, 27 bp, Artificial Sequence
  Description of Artificial Sequence: Synthetic oligonucleotide
ccagtgatagacaggaccatgcagggc

SEQ ID NO: 344328 - DNA, 27 bp, Artificial Sequence
  Description of Artificial Sequence: Synthetic oligonucleotide
cagtgatagacaggaccatgcagggcg

SEQ ID NO: 344329 - DNA, 27 bp, Artificial Sequence
  Description of Artificial Sequence: Synthetic oligonucleotide
agtgatagacaggaccatgcagggcgg

SEQ ID NO: 344330 - DNA, 27 bp, Artificial Sequence
  Description of Artificial Sequence: Synthetic oligonucleotide
gtgatagacaggaccatgcagggcggt

SEQ ID NO: 344331 - DNA, 29 bp, Artificial Sequence
  Description of Artificial Sequence: Synthetic oligonucleotide
tgatagacaggaccatgcagggcggtttg

SEQ ID NO: 344332 - DNA, 28 bp, Artificial Sequence
  Description of Artificial Sequence: Synthetic oligonucleotide
gatagacaggaccatgcagggcggtttg

SEQ ID NO: 344333 - DNA, 28 bp, Artificial Sequence
  Description of Artificial Sequence: Synthetic oligonucleotide
atagacaggaccatgcagggcggtttgg

SEQ ID NO: 344334 - DNA, 27 bp, Artificial Sequence
  Description of Artificial Sequence: Synthetic oligonucleotide
tagacaggaccatgcagggcggtttgg

SEQ ID NO: 344335 - DNA, 27 bp, Artificial Sequence
  Description of Artificial Sequence: Synthetic oligonucleotide
agacaggaccatgcagggcggtttggt

SEQ ID NO: 344336 - DNA, 26 bp, Artificial Sequence
  Description of Artificial Sequence: Synthetic oligonucleotide
gacaggaccatgcagggcggtttggt

SEQ ID NO: 344337 - DNA, 26 bp, Artificial Sequence
  Description of Artificial Sequence: Synthetic oligonucleotide
acaggaccatgcagggcggtttggtg

SEQ ID NO: 344338 - DNA, 25 bp, Artificial Sequence
  Description of Artificial Sequence: Synthetic oligonucleotide
caggaccatgcagggcggtttggtg

SEQ ID NO: 344339 - DNA, 25 bp, Artificial Sequence
  Description of Artificial Sequence: Synthetic oligonucleotide
aggaccatgcagggcggtttggtgc

SEQ ID NO: 344340 - DNA, 24 bp, Artificial Sequence
  Description of Artificial Sequence: Synthetic oligonucleotide
ggaccatgcagggcggtttggtgc

SEQ ID NO: 344341 - DNA, 24 bp, Artificial Sequence
  Description of Artificial Sequence: Synthetic oligonucleotide
gaccatgcagggcggtttggtgcg

SEQ ID NO: 344342 - DNA, 27 bp, Artificial Sequence
  Description of Artificial Sequence: Synthetic oligonucleotide
accatgcagggcggtttggtgcgcaat

SEQ ID NO: 344343 - DNA, 26 bp, Artificial Sequence
  Description of Artificial Sequence: Synthetic oligonucleotide
ccatgcagggcggtttggtgcgcaat

SEQ ID NO: 344344 - DNA, 27 bp, Artificial Sequence
  Description of Artificial Sequence: Synthetic oligonucleotide
catgcagggcggtttggtgcgcaatga

SEQ ID NO: 344345 - DNA, 28 bp, Artificial Sequence
  Description of Artificial Sequence: Synthetic oligonucleotide
atgcagggcggtttggtgcgcaatgatg

SEQ ID NO: 344346 - DNA, 27 bp, Artificial Sequence
  Description of Artificial Sequence: Synthetic oligonucleotide
tgcagggcggtttggtgcgcaatgatg

SEQ ID NO: 344347 - DNA, 27 bp, Artificial Sequence
  Description of Artificial Sequence: Synthetic oligonucleotide
gcagggcggtttggtgcgcaatgatgt

SEQ ID NO: 344348 - DNA, 27 bp, Artificial Sequence
  Description of Artificial Sequence: Synthetic oligonucleotide
cagggcggtttggtgcgcaatgatgtg

SEQ ID NO: 344349 - DNA, 28 bp, Artificial Sequence
  Description of Artificial Sequence: Synthetic oligonucleotide
agggcggtttggtgcgcaatgatgtgac

SEQ ID NO: 344350 - DNA, 27 bp, Artificial Sequence
  Description of Artificial Sequence: Synthetic oligonucleotide
gggcggtttggtgcgcaatgatgtgac

SEQ ID NO: 344351 - DNA, 28 bp, Artificial Sequence
  Description of Artificial Sequence: Synthetic oligonucleotide
ggcggtttggtgcgcaatgatgtgactg

SEQ ID NO: 344352 - DNA, 29 bp, Artificial Sequence
  Description of Artificial Sequence: Synthetic oligonucleotide
gcggtttggtgcgcaatgatgtgactgtg

SEQ ID NO: 344353 - DNA, 29 bp, Artificial Sequence
  Description of Artificial Sequence: Synthetic oligonucleotide
cggtttggtgcgcaatgatgtgactgtgg

SEQ ID NO: 344354 - DNA, 29 bp, Artificial Sequence
  Description of Artificial Sequence: Synthetic oligonucleotide
ggtttggtgcgcaatgatgtgactgtggc

SEQ ID NO: 344355 - DNA, 30 bp, Artificial Sequence
  Description of Artificial Sequence: Synthetic oligonucleotide
gtttggtgcgcaatgatgtgactgtggctc

SEQ ID NO: 344356 - DNA, 31 bp, Artificial Sequence
  Description of Artificial Sequence: Synthetic oligonucleotide
tttggtgcgcaatgatgtgactgtggctctc

SEQ ID NO: 344357 - DNA, 30 bp, Artificial Sequence
  Description of Artificial Sequence: Synthetic oligonucleotide
ttggtgcgcaatgatgtgactgtggctctc

SEQ ID NO: 344358 - DNA, 29 bp, Artificial Sequence
  Description of Artificial Sequence: Synthetic oligonucleotide
tggtgcgcaatgatgtgactgtggctctc

SEQ ID NO: 344359 - DNA, 28 bp, Artificial Sequence
  Description of Artificial Sequence: Synthetic oligonucleotide
ggtgcgcaatgatgtgactgtggctctc

SEQ ID NO: 344360 - DNA, 29 bp, Artificial Sequence
  Description of Artificial Sequence: Synthetic oligonucleotide
gtgcgcaatgatgtgactgtggctctcac

SEQ ID NO: 344361 - DNA, 30 bp, Artificial Sequence
  Description of Artificial Sequence: Synthetic oligonucleotide
tgcgcaatgatgtgactgtggctctcacag

SEQ ID NO: 344362 - DNA, 29 bp, Artificial Sequence
  Description of Artificial Sequence: Synthetic oligonucleotide
gcgcaatgatgtgactgtggctctcacag

SEQ ID NO: 344363 - DNA, 29 bp, Artificial Sequence
  Description of Artificial Sequence: Synthetic oligonucleotide
cgcaatgatgtgactgtggctctcacagc

SEQ ID NO: 344364 - DNA, 29 bp, Artificial Sequence
  Description of Artificial Sequence: Synthetic oligonucleotide
gcaatgatgtgactgtggctctcacagcc

SEQ ID NO: 344365 - DNA, 32 bp, Artificial Sequence
  Description of Artificial Sequence: Synthetic oligonucleotide
caatgatgtgactgtggctctcacagccattg

SEQ ID NO: 344366 - DNA, 33 bp, Artificial Sequence
  Description of Artificial Sequence: Synthetic oligonucleotide
aatgatgtgactgtggctctcacagccattgtg

SEQ ID NO: 344367 - DNA, 32 bp, Artificial Sequence
  Description of Artificial Sequence: Synthetic oligonucleotide
atgatgtgactgtggctctcacagccattgtg

SEQ ID NO: 344368 - DNA, 31 bp, Artificial Sequence
  Description of Artificial Sequence: Synthetic oligonucleotide
tgatgtgactgtggctctcacagccattgtg

SEQ ID NO: 344369 - DNA, 30 bp, Artificial Sequence
  Description of Artificial Sequence: Synthetic oligonucleotide
gatgtgactgtggctctcacagccattgtg

SEQ ID NO: 344370 - DNA, 31 bp, Artificial Sequence
  Description of Artificial Sequence: Synthetic oligonucleotide
atgtgactgtggctctcacagccattgtgac

SEQ ID NO: 344371 - DNA, 30 bp, Artificial Sequence
  Description of Artificial Sequence: Synthetic oligonucleotide
tgtgactgtggctctcacagccattgtgac

SEQ ID NO: 344372 - DNA, 29 bp, Artificial Sequence
  Description of Artificial Sequence: Synthetic oligonucleotide
gtgactgtggctctcacagccattgtgac

SEQ ID NO: 344373 - DNA, 29 bp, Artificial Sequence
  Description of Artificial Sequence: Synthetic oligonucleotide
tgactgtggctctcacagccattgtgacc

SEQ ID NO: 344374 - DNA, 28 bp, Artificial Sequence
  Description of Artificial Sequence: Synthetic oligonucleotide
gactgtggctctcacagccattgtgacc

SEQ ID NO: 344375 - DNA, 30 bp, Artificial Sequence
  Description of Artificial Sequence: Synthetic oligonucleotide
actgtggctctcacagccattgtgaccaac

SEQ ID NO: 344376 - DNA, 29 bp, Artificial Sequence
  Description of Artificial Sequence: Synthetic oligonucleotide
ctgtggctctcacagccattgtgaccaac

SEQ ID NO: 344377 - DNA, 29 bp, Artificial Sequence
  Description of Artificial Sequence: Synthetic oligonucleotide
tgtggctctcacagccattgtgaccaacg

SEQ ID NO: 344378 - DNA, 28 bp, Artificial Sequence
  Description of Artificial Sequence: Synthetic oligonucleotide
gtggctctcacagccattgtgaccaacg

SEQ ID NO: 344379 - DNA, 28 bp, Artificial Sequence
  Description of Artificial Sequence: Synthetic oligonucleotide
tggctctcacagccattgtgaccaacgc

SEQ ID NO: 344380 - DNA, 27 bp, Artificial Sequence
  Description of Artificial Sequence: Synthetic oligonucleotide
ggctctcacagccattgtgaccaacgc

SEQ ID NO: 344381 - DNA, 27 bp, Artificial Sequence
  Description of Artificial Sequence: Synthetic oligonucleotide
gctctcacagccattgtgaccaacgcc

SEQ ID NO: 344382 - DNA, 27 bp, Artificial Sequence
  Description of Artificial Sequence: Synthetic oligonucleotide
ctctcacagccattgtgaccaacgccc

SEQ ID NO: 344383 - DNA, 29 bp, Artificial Sequence
  Description of Artificial Sequence: Synthetic oligonucleotide
tctcacagccattgtgaccaacgcccttc

SEQ ID NO: 344384 - DNA, 28 bp, Artificial Sequence
  Description of Artificial Sequence: Synthetic oligonucleotide
ctcacagccattgtgaccaacgcccttc

SEQ ID NO: 344385 - DNA, 30 bp, Artificial Sequence
  Description of Artificial Sequence: Synthetic oligonucleotide
tcacagccattgtgaccaacgcccttcaac

SEQ ID NO: 344386 - DNA, 29 bp, Artificial Sequence
  Description of Artificial Sequence: Synthetic oligonucleotide
cacagccattgtgaccaacgcccttcaac

SEQ ID NO: 344387 - DNA, 31 bp, Artificial Sequence
  Description of Artificial Sequence: Synthetic oligonucleotide
acagccattgtgaccaacgcccttcaacatg

SEQ ID NO: 344388 - DNA, 30 bp, Artificial Sequence
  Description of Artificial Sequence: Synthetic oligonucleotide
cagccattgtgaccaacgcccttcaacatg

SEQ ID NO: 344389 - DNA, 30 bp, Artificial Sequence
  Description of Artificial Sequence: Synthetic oligonucleotide
agccattgtgaccaacgcccttcaacatgg

SEQ ID NO: 344390 - DNA, 29 bp, Artificial Sequence
  Description of Artificial Sequence: Synthetic oligonucleotide
gccattgtgaccaacgcccttcaacatgg

SEQ ID NO: 344391 - DNA, 29 bp, Artificial Sequence
  Description of Artificial Sequence: Synthetic oligonucleotide
ccattgtgaccaacgcccttcaacatggg

SEQ ID NO: 344392 - DNA, 29 bp, Artificial Sequence
  Description of Artificial Sequence: Synthetic oligonucleotide
cattgtgaccaacgcccttcaacatgggc

SEQ ID NO: 344393 - DNA, 30 bp, Artificial Sequence
  Description of Artificial Sequence: Synthetic oligonucleotide
attgtgaccaacgcccttcaacatgggctg

SEQ ID NO: 344394 - DNA, 29 bp, Artificial Sequence
  Description of Artificial Sequence: Synthetic oligonucleotide
ttgtgaccaacgcccttcaacatgggctg

SEQ ID NO: 344395 - DNA, 28 bp, Artificial Sequence
  Description of Artificial Sequence: Synthetic oligonucleotide
tgtgaccaacgcccttcaacatgggctg

SEQ ID NO: 344396 - DNA, 27 bp, Artificial Sequence
  Description of Artificial Sequence: Synthetic oligonucleotide
gtgaccaacgcccttcaacatgggctg

SEQ ID NO: 344397 - DNA, 27 bp, Artificial Sequence
  Description of Artificial Sequence: Synthetic oligonucleotide
tgaccaacgcccttcaacatgggctgc

SEQ ID NO: 344398 - DNA, 26 bp, Artificial Sequence
  Description of Artificial Sequence: Synthetic oligonucleotide
gaccaacgcccttcaacatgggctgc

SEQ ID NO: 344399 - DNA, 26 bp, Artificial Sequence
  Description of Artificial Sequence: Synthetic oligonucleotide
accaacgcccttcaacatgggctgcc

SEQ ID NO: 344400 - DNA, 25 bp, Artificial Sequence
  Description of Artificial Sequence: Synthetic oligonucleotide
ccaacgcccttcaacatgggctgcc

SEQ ID NO: 344401 - DNA, 25 bp, Artificial Sequence
  Description of Artificial Sequence: Synthetic oligonucleotide
caacgcccttcaacatgggctgccc

SEQ ID NO: 344402 - DNA, 26 bp, Artificial Sequence
  Description of Artificial Sequence: Synthetic oligonucleotide
aacgcccttcaacatgggctgcccgt

SEQ ID NO: 344403 - DNA, 25 bp, Artificial Sequence
  Description of Artificial Sequence: Synthetic oligonucleotide
acgcccttcaacatgggctgcccgt

SEQ ID NO: 344404 - DNA, 24 bp, Artificial Sequence
  Description of Artificial Sequence: Synthetic oligonucleotide
cgcccttcaacatgggctgcccgt

SEQ ID NO: 344405 - DNA, 26 bp, Artificial Sequence
  Description of Artificial Sequence: Synthetic oligonucleotide
gcccttcaacatgggctgcccgtctt

SEQ ID NO: 344406 - DNA, 26 bp, Artificial Sequence
  Description of Artificial Sequence: Synthetic oligonucleotide
cccttcaacatgggctgcccgtcttc

SEQ ID NO: 344407 - DNA, 27 bp, Artificial Sequence
  Description of Artificial Sequence: Synthetic oligonucleotide
ccttcaacatgggctgcccgtcttcct

SEQ ID NO: 344408 - DNA, 27 bp, Artificial Sequence
  Description of Artificial Sequence: Synthetic oligonucleotide
cttcaacatgggctgcccgtcttcctg

SEQ ID NO: 344409 - DNA, 27 bp, Artificial Sequence
  Description of Artificial Sequence: Synthetic oligonucleotide
ttcaacatgggctgcccgtcttcctgg

SEQ ID NO: 344410 - DNA, 27 bp, Artificial Sequence
  Description of Artificial Sequence: Synthetic oligonucleotide
tcaacatgggctgcccgtcttcctgga

SEQ ID NO: 344411 - DNA, 27 bp, Artificial Sequence
  Description of Artificial Sequence: Synthetic oligonucleotide
caacatgggctgcccgtcttcctggat

SEQ ID NO: 344412 - DNA, 27 bp, Artificial Sequence
  Description of Artificial Sequence: Synthetic oligonucleotide
aacatgggctgcccgtcttcctggatg

SEQ ID NO: 344413 - DNA, 27 bp, Artificial Sequence
  Description of Artificial Sequence: Synthetic oligonucleotide
acatgggctgcccgtcttcctggatga

SEQ ID NO: 344414 - DNA, 26 bp, Artificial Sequence
  Description of Artificial Sequence: Synthetic oligonucleotide
catgggctgcccgtcttcctggatga

SEQ ID NO: 344415 - DNA, 26 bp, Artificial Sequence
  Description of Artificial Sequence: Synthetic oligonucleotide
atgggctgcccgtcttcctggatgag

SEQ ID NO: 344416 - DNA, 25 bp, Artificial Sequence
  Description of Artificial Sequence: Synthetic oligonucleotide
tgggctgcccgtcttcctggatgag

SEQ ID NO: 344417 - DNA, 24 bp, Artificial Sequence
  Description of Artificial Sequence: Synthetic oligonucleotide
gggctgcccgtcttcctggatgag

SEQ ID NO: 344418 - DNA, 24 bp, Artificial Sequence
  Description of Artificial Sequence: Synthetic oligonucleotide
ggctgcccgtcttcctggatgagg

SEQ ID NO: 344419 - DNA, 25 bp, Artificial Sequence
  Description of Artificial Sequence: Synthetic oligonucleotide
gctgcccgtcttcctggatgaggga

SEQ ID NO: 344420 - DNA, 25 bp, Artificial Sequence
  Description of Artificial Sequence: Synthetic oligonucleotide
ctgcccgtcttcctggatgagggag

SEQ ID NO: 344421 - DNA, 26 bp, Artificial Sequence
  Description of Artificial Sequence: Synthetic oligonucleotide
tgcccgtcttcctggatgagggagca

SEQ ID NO: 344422 - DNA, 25 bp, Artificial Sequence
  Description of Artificial Sequence: Synthetic oligonucleotide
gcccgtcttcctggatgagggagca

SEQ ID NO: 344423 - DNA, 26 bp, Artificial Sequence
  Description of Artificial Sequence: Synthetic oligonucleotide
cccgtcttcctggatgagggagcaga

SEQ ID NO: 344424 - DNA, 26 bp, Artificial Sequence
  Description of Artificial Sequence: Synthetic oligonucleotide
ccgtcttcctggatgagggagcagag

SEQ ID NO: 344425 - DNA, 26 bp, Artificial Sequence
  Description of Artificial Sequence: Synthetic oligonucleotide
cgtcttcctggatgagggagcagagc

SEQ ID NO: 344426 - DNA, 27 bp, Artificial Sequence
  Description of Artificial Sequence: Synthetic oligonucleotide
gtcttcctggatgagggagcagagcca

SEQ ID NO: 344427 - DNA, 29 bp, Artificial Sequence
  Description of Artificial Sequence: Synthetic oligonucleotide
tcttcctggatgagggagcagagccaatg

SEQ ID NO: 344428 - DNA, 28 bp, Artificial Sequence
  Description of Artificial Sequence: Synthetic oligonucleotide
cttcctggatgagggagcagagccaatg

SEQ ID NO: 344429 - DNA, 30 bp, Artificial Sequence
  Description of Artificial Sequence: Synthetic oligonucleotide
ttcctggatgagggagcagagccaatgaag

SEQ ID NO: 344430 - DNA, 29 bp, Artificial Sequence
  Description of Artificial Sequence: Synthetic oligonucleotide
tcctggatgagggagcagagccaatgaag

SEQ ID NO: 344431 - DNA, 28 bp, Artificial Sequence
  Description of Artificial Sequence: Synthetic oligonucleotide
cctggatgagggagcagagccaatgaag

SEQ ID NO: 344432 - DNA, 28 bp, Artificial Sequence
  Description of Artificial Sequence: Synthetic oligonucleotide
ctggatgagggagcagagccaatgaagc

SEQ ID NO: 344433 - DNA, 29 bp, Artificial Sequence
  Description of Artificial Sequence: Synthetic oligonucleotide
tggatgagggagcagagccaatgaagcag

SEQ ID NO: 344434 - DNA, 28 bp, Artificial Sequence
  Description of Artificial Sequence: Synthetic oligonucleotide
ggatgagggagcagagccaatgaagcag

SEQ ID NO: 344435 - DNA, 29 bp, Artificial Sequence
  Description of Artificial Sequence: Synthetic oligonucleotide
gatgagggagcagagccaatgaagcagac

SEQ ID NO: 344436 - DNA, 30 bp, Artificial Sequence
  Description of Artificial Sequence: Synthetic oligonucleotide
atgagggagcagagccaatgaagcagacag

SEQ ID NO: 344437 - DNA, 29 bp, Artificial Sequence
  Description of Artificial Sequence: Synthetic oligonucleotide
tgagggagcagagccaatgaagcagacag

SEQ ID NO: 344438 - DNA, 28 bp, Artificial Sequence
  Description of Artificial Sequence: Synthetic oligonucleotide
gagggagcagagccaatgaagcagacag

SEQ ID NO: 344439 - DNA, 29 bp, Artificial Sequence
  Description of Artificial Sequence: Synthetic oligonucleotide
agggagcagagccaatgaagcagacagtg

SEQ ID NO: 344440 - DNA, 28 bp, Artificial Sequence
  Description of Artificial Sequence: Synthetic oligonucleotide
gggagcagagccaatgaagcagacagtg

SEQ ID NO: 344441 - DNA, 28 bp, Artificial Sequence
  Description of Artificial Sequence: Synthetic oligonucleotide
ggagcagagccaatgaagcagacagtgg

SEQ ID NO: 344442 - DNA, 30 bp, Artificial Sequence
  Description of Artificial Sequence: Synthetic oligonucleotide
gagcagagccaatgaagcagacagtggaag

SEQ ID NO: 344443 - DNA, 30 bp, Artificial Sequence
  Description of Artificial Sequence: Synthetic oligonucleotide
agcagagccaatgaagcagacagtggaagc

SEQ ID NO: 344444 - DNA, 29 bp, Artificial Sequence
  Description of Artificial Sequence: Synthetic oligonucleotide
gcagagccaatgaagcagacagtggaagc

SEQ ID NO: 344445 - DNA, 29 bp, Artificial Sequence
  Description of Artificial Sequence: Synthetic oligonucleotide
cagagccaatgaagcagacagtggaagcg

SEQ ID NO: 344446 - DNA, 30 bp, Artificial Sequence
  Description of Artificial Sequence: Synthetic oligonucleotide
agagccaatgaagcagacagtggaagcgtc

SEQ ID NO: 344447 - DNA, 29 bp, Artificial Sequence
  Description of Artificial Sequence: Synthetic oligonucleotide
gagccaatgaagcagacagtggaagcgtc

SEQ ID NO: 344448 - DNA, 29 bp, Artificial Sequence
  Description of Artificial Sequence: Synthetic oligonucleotide
agccaatgaagcagacagtggaagcgtcc

SEQ ID NO: 344449 - DNA, 28 bp, Artificial Sequence
  Description of Artificial Sequence: Synthetic oligonucleotide
gccaatgaagcagacagtggaagcgtcc

SEQ ID NO: 344450 - DNA, 30 bp, Artificial Sequence
  Description of Artificial Sequence: Synthetic oligonucleotide
ccaatgaagcagacagtggaagcgtccatc

SEQ ID NO: 344451 - DNA, 31 bp, Artificial Sequence
  Description of Artificial Sequence: Synthetic oligonucleotide
caatgaagcagacagtggaagcgtccatctc

SEQ ID NO: 344452 - DNA, 34 bp, Artificial Sequence
  Description of Artificial Sequence: Synthetic oligonucleotide
aatgaagcagacagtggaagcgtccatctcatag

SEQ ID NO: 344453 - DNA, 33 bp, Artificial Sequence
  Description of Artificial Sequence: Synthetic oligonucleotide
atgaagcagacagtggaagcgtccatctcatag

SEQ ID NO: 344454 - DNA, 32 bp, Artificial Sequence
  Description of Artificial Sequence: Synthetic oligonucleotide
tgaagcagacagtggaagcgtccatctcatag

SEQ ID NO: 344455 - DNA, 31 bp, Artificial Sequence
  Description of Artificial Sequence: Synthetic oligonucleotide
gaagcagacagtggaagcgtccatctcatag

SEQ ID NO: 344456 - DNA, 31 bp, Artificial Sequence
  Description of Artificial Sequence: Synthetic oligonucleotide
aagcagacagtggaagcgtccatctcatagg

SEQ ID NO: 344457 - DNA, 30 bp, Artificial Sequence
  Description of Artificial Sequence: Synthetic oligonucleotide
agcagacagtggaagcgtccatctcatagg

SEQ ID NO: 344458 - DNA, 29 bp, Artificial Sequence
  Description of Artificial Sequence: Synthetic oligonucleotide
gcagacagtggaagcgtccatctcatagg

SEQ ID NO: 344459 - DNA, 29 bp, Artificial Sequence
  Description of Artificial Sequence: Synthetic oligonucleotide
cagacagtggaagcgtccatctcataggc

SEQ ID NO: 344460 - DNA, 32 bp, Artificial Sequence
  Description of Artificial Sequence: Synthetic oligonucleotide
agacagtggaagcgtccatctcataggcaaac

SEQ ID NO: 344461 - DNA, 31 bp, Artificial Sequence
  Description of Artificial Sequence: Synthetic oligonucleotide
gacagtggaagcgtccatctcataggcaaac

SEQ ID NO: 344462 - DNA, 32 bp, Artificial Sequence
  Description of Artificial Sequence: Synthetic oligonucleotide
acagtggaagcgtccatctcataggcaaactg

SEQ ID NO: 344463 - DNA, 31 bp, Artificial Sequence
  Description of Artificial Sequence: Synthetic oligonucleotide
cagtggaagcgtccatctcataggcaaactg

SEQ ID NO: 344464 - DNA, 37 bp, Artificial Sequence
  Description of Artificial Sequence: Synthetic oligonucleotide
agtggaagcgtccatctcataggcaaactgatttttg

SEQ ID NO: 344465 - DNA, 36 bp, Artificial Sequence
  Description of Artificial Sequence: Synthetic oligonucleotide
gtggaagcgtccatctcataggcaaactgatttttg

SEQ ID NO: 344466 - DNA, 36 bp, Artificial Sequence
  Description of Artificial Sequence: Synthetic oligonucleotide
tggaagcgtccatctcataggcaaactgatttttgg

SEQ ID NO: 344467 - DNA, 35 bp, Artificial Sequence
  Description of Artificial Sequence: Synthetic oligonucleotide
ggaagcgtccatctcataggcaaactgatttttgg

SEQ ID NO: 344468 - DNA, 35 bp, Artificial Sequence
  Description of Artificial Sequence: Synthetic oligonucleotide
gaagcgtccatctcataggcaaactgatttttggg

SEQ ID NO: 344469 - DNA, 35 bp, Artificial Sequence
  Description of Artificial Sequence: Synthetic oligonucleotide
aagcgtccatctcataggcaaactgatttttgggc

SEQ ID NO: 344470 - DNA, 34 bp, Artificial Sequence
  Description of Artificial Sequence: Synthetic oligonucleotide
agcgtccatctcataggcaaactgatttttgggc

SEQ ID NO: 344471 - DNA, 33 bp, Artificial Sequence
  Description of Artificial Sequence: Synthetic oligonucleotide
gcgtccatctcataggcaaactgatttttgggc

SEQ ID NO: 344472 - DNA, 33 bp, Artificial Sequence
  Description of Artificial Sequence: Synthetic oligonucleotide
cgtccatctcataggcaaactgatttttgggcg

SEQ ID NO: 344473 - DNA, 34 bp, Artificial Sequence
  Description of Artificial Sequence: Synthetic oligonucleotide
gtccatctcataggcaaactgatttttgggcgag

SEQ ID NO: 344474 - DNA, 37 bp, Artificial Sequence
  Description of Artificial Sequence: Synthetic oligonucleotide
tccatctcataggcaaactgatttttgggcgagaaag

SEQ ID NO: 344475 - DNA, 36 bp, Artificial Sequence
  Description of Artificial Sequence: Synthetic oligonucleotide
ccatctcataggcaaactgatttttgggcgagaaag

SEQ ID NO: 344476 - DNA, 36 bp, Artificial Sequence
  Description of Artificial Sequence: Synthetic oligonucleotide
catctcataggcaaactgatttttgggcgagaaagc

SEQ ID NO: 344477 - DNA, 38 bp, Artificial Sequence
  Description of Artificial Sequence: Synthetic oligonucleotide
atctcataggcaaactgatttttgggcgagaaagcatg

SEQ ID NO: 344478 - DNA, 37 bp, Artificial Sequence
  Description of Artificial Sequence: Synthetic oligonucleotide
tctcataggcaaactgatttttgggcgagaaagcatg

SEQ ID NO: 344479 - DNA, 36 bp, Artificial Sequence
  Description of Artificial Sequence: Synthetic oligonucleotide
ctcataggcaaactgatttttgggcgagaaagcatg

SEQ ID NO: 344480 - DNA, 37 bp, Artificial Sequence
  Description of Artificial Sequence: Synthetic oligonucleotide
tcataggcaaactgatttttgggcgagaaagcatgtg

SEQ ID NO: 344481 - DNA, 36 bp, Artificial Sequence
  Description of Artificial Sequence: Synthetic oligonucleotide
cataggcaaactgatttttgggcgagaaagcatgtg

SEQ ID NO: 344482 - DNA, 36 bp, Artificial Sequence
  Description of Artificial Sequence: Synthetic oligonucleotide
ataggcaaactgatttttgggcgagaaagcatgtgc

SEQ ID NO: 344483 - DNA, 35 bp, Artificial Sequence
  Description of Artificial Sequence: Synthetic oligonucleotide
taggcaaactgatttttgggcgagaaagcatgtgc

SEQ ID NO: 344484 - DNA, 34 bp, Artificial Sequence
  Description of Artificial Sequence: Synthetic oligonucleotide
aggcaaactgatttttgggcgagaaagcatgtgc

SEQ ID NO: 344485 - DNA, 33 bp, Artificial Sequence
  Description of Artificial Sequence: Synthetic oligonucleotide
ggcaaactgatttttgggcgagaaagcatgtgc

SEQ ID NO: 344486 - DNA, 34 bp, Artificial Sequence
  Description of Artificial Sequence: Synthetic oligonucleotide
gcaaactgatttttgggcgagaaagcatgtgctg

SEQ ID NO: 344487 - DNA, 34 bp, Artificial Sequence
  Description of Artificial Sequence: Synthetic oligonucleotide
caaactgatttttgggcgagaaagcatgtgctgg

SEQ ID NO: 344488 - DNA, 34 bp, Artificial Sequence
  Description of Artificial Sequence: Synthetic oligonucleotide
aaactgatttttgggcgagaaagcatgtgctggg

SEQ ID NO: 344489 - DNA, 33 bp, Artificial Sequence
  Description of Artificial Sequence: Synthetic oligonucleotide
aactgatttttgggcgagaaagcatgtgctggg

SEQ ID NO: 344490 - DNA, 32 bp, Artificial Sequence
  Description of Artificial Sequence: Synthetic oligonucleotide
actgatttttgggcgagaaagcatgtgctggg

SEQ ID NO: 344491 - DNA, 31 bp, Artificial Sequence
  Description of Artificial Sequence: Synthetic oligonucleotide
ctgatttttgggcgagaaagcatgtgctggg

SEQ ID NO: 344492 - DNA, 31 bp, Artificial Sequence
  Description of Artificial Sequence: Synthetic oligonucleotide
tgatttttgggcgagaaagcatgtgctgggc

SEQ ID NO: 344493 - DNA, 30 bp, Artificial Sequence
  Description of Artificial Sequence: Synthetic oligonucleotide
gatttttgggcgagaaagcatgtgctgggc

SEQ ID NO: 344494 - DNA, 31 bp, Artificial Sequence
  Description of Artificial Sequence: Synthetic oligonucleotide
atttttgggcgagaaagcatgtgctgggcac

SEQ ID NO: 344495 - DNA, 30 bp, Artificial Sequence
  Description of Artificial Sequence: Synthetic oligonucleotide
tttttgggcgagaaagcatgtgctgggcac

SEQ ID NO: 344496 - DNA, 29 bp, Artificial Sequence
  Description of Artificial Sequence: Synthetic oligonucleotide
ttttgggcgagaaagcatgtgctgggcac

SEQ ID NO: 344497 - DNA, 28 bp, Artificial Sequence
  Description of Artificial Sequence: Synthetic oligonucleotide
tttgggcgagaaagcatgtgctgggcac

SEQ ID NO: 344498 - DNA, 27 bp, Artificial Sequence
  Description of Artificial Sequence: Synthetic oligonucleotide
ttgggcgagaaagcatgtgctgggcac

SEQ ID NO: 344499 - DNA, 26 bp, Artificial Sequence
  Description of Artificial Sequence: Synthetic oligonucleotide
tgggcgagaaagcatgtgctgggcac

SEQ ID NO: 344500 - DNA, 25 bp, Artificial Sequence
  Description of Artificial Sequence: Synthetic oligonucleotide
gggcgagaaagcatgtgctgggcac

SEQ ID NO: 344501 - DNA, 26 bp, Artificial Sequence
  Description of Artificial Sequence: Synthetic oligonucleotide
ggcgagaaagcatgtgctgggcacct

SEQ ID NO: 344502 - DNA, 26 bp, Artificial Sequence
  Description of Artificial Sequence: Synthetic oligonucleotide
gcgagaaagcatgtgctgggcacctg

SEQ ID NO: 344503 - DNA, 26 bp, Artificial Sequence
  Description of Artificial Sequence: Synthetic oligonucleotide
cgagaaagcatgtgctgggcacctgg

SEQ ID NO: 344504 - DNA, 27 bp, Artificial Sequence
  Description of Artificial Sequence: Synthetic oligonucleotide
gagaaagcatgtgctgggcacctgggt

SEQ ID NO: 344505 - DNA, 27 bp, Artificial Sequence
  Description of Artificial Sequence: Synthetic oligonucleotide
agaaagcatgtgctgggcacctgggtg

SEQ ID NO: 344506 - DNA, 26 bp, Artificial Sequence
  Description of Artificial Sequence: Synthetic oligonucleotide
gaaagcatgtgctgggcacctgggtg

SEQ ID NO: 344507 - DNA, 26 bp, Artificial Sequence
  Description of Artificial Sequence: Synthetic oligonucleotide
aaagcatgtgctgggcacctgggtgc

SEQ ID NO: 344508 - DNA, 25 bp, Artificial Sequence
  Description of Artificial Sequence: Synthetic oligonucleotide
aagcatgtgctgggcacctgggtgc

SEQ ID NO: 344509 - DNA, 24 bp, Artificial Sequence
  Description of Artificial Sequence: Synthetic oligonucleotide
agcatgtgctgggcacctgggtgc

SEQ ID NO: 344510 - DNA, 23 bp, Artificial Sequence
  Description of Artificial Sequence: Synthetic oligonucleotide
gcatgtgctgggcacctgggtgc

SEQ ID NO: 344511 - DNA, 23 bp, Artificial Sequence
  Description of Artificial Sequence: Synthetic oligonucleotide
catgtgctgggcacctgggtgcg

SEQ ID NO: 344512 - DNA, 24 bp, Artificial Sequence
  Description of Artificial Sequence: Synthetic oligonucleotide
atgtgctgggcacctgggtgcgca

SEQ ID NO: 344513 - DNA, 23 bp, Artificial Sequence
  Description of Artificial Sequence: Synthetic oligonucleotide
tgtgctgggcacctgggtgcgca

SEQ ID NO: 344514 - DNA, 22 bp, Artificial Sequence
  Description of Artificial Sequence: Synthetic oligonucleotide
gtgctgggcacctgggtgcgca

SEQ ID NO: 344515 - DNA, 22 bp, Artificial Sequence
  Description of Artificial Sequence: Synthetic oligonucleotide
tgctgggcacctgggtgcgcac

SEQ ID NO: 344516 - DNA, 21 bp, Artificial Sequence
  Description of Artificial Sequence: Synthetic oligonucleotide
gctgggcacctgggtgcgcac

SEQ ID NO: 344517 - DNA, 21 bp, Artificial Sequence
  Description of Artificial Sequence: Synthetic oligonucleotide
ctgggcacctgggtgcgcacg

SEQ ID NO: 344518 - DNA, 22 bp, Artificial Sequence
  Description of Artificial Sequence: Synthetic oligonucleotide
tgggcacctgggtgcgcacgca

SEQ ID NO: 344519 - DNA, 21 bp, Artificial Sequence
  Description of Artificial Sequence: Synthetic oligonucleotide
gggcacctgggtgcgcacgca

SEQ ID NO: 344520 - DNA, 21 bp, Artificial Sequence
  Description of Artificial Sequence: Synthetic oligonucleotide
ggcacctgggtgcgcacgcag

SEQ ID NO: 344521 - DNA, 22 bp, Artificial Sequence
  Description of Artificial Sequence: Synthetic oligonucleotide
gcacctgggtgcgcacgcagct

SEQ ID NO: 344522 - DNA, 22 bp, Artificial Sequence
  Description of Artificial Sequence: Synthetic oligonucleotide
cacctgggtgcgcacgcagctc

SEQ ID NO: 344523 - DNA, 22 bp, Artificial Sequence
  Description of Artificial Sequence: Synthetic oligonucleotide
acctgggtgcgcacgcagctcc

SEQ ID NO: 344524 - DNA, 21 bp, Artificial Sequence
  Description of Artificial Sequence: Synthetic oligonucleotide
cctgggtgcgcacgcagctcc

SEQ ID NO: 344525 - DNA, 23 bp, Artificial Sequence
  Description of Artificial Sequence: Synthetic oligonucleotide
ctgggtgcgcacgcagctcccat

SEQ ID NO: 344526 - DNA, 24 bp, Artificial Sequence
  Description of Artificial Sequence: Synthetic oligonucleotide
tgggtgcgcacgcagctcccatca

SEQ ID NO: 344527 - DNA, 23 bp, Artificial Sequence
  Description of Artificial Sequence: Synthetic oligonucleotide
gggtgcgcacgcagctcccatca

SEQ ID NO: 344528 - DNA, 23 bp, Artificial Sequence
  Description of Artificial Sequence: Synthetic oligonucleotide
ggtgcgcacgcagctcccatcac

SEQ ID NO: 344529 - DNA, 23 bp, Artificial Sequence
  Description of Artificial Sequence: Synthetic oligonucleotide
gtgcgcacgcagctcccatcacg

SEQ ID NO: 344530 - DNA, 23 bp, Artificial Sequence
  Description of Artificial Sequence: Synthetic oligonucleotide
tgcgcacgcagctcccatcacgg

SEQ ID NO: 344531 - DNA, 22 bp, Artificial Sequence
  Description of Artificial Sequence: Synthetic oligonucleotide
gcgcacgcagctcccatcacgg

SEQ ID NO: 344532 - DNA, 22 bp, Artificial Sequence
  Description of Artificial Sequence: Synthetic oligonucleotide
cgcacgcagctcccatcacggg

SEQ ID NO: 344533 - DNA, 25 bp, Artificial Sequence
  Description of Artificial Sequence: Synthetic oligonucleotide
gcacgcagctcccatcacgggctat

SEQ ID NO: 344534 - DNA, 25 bp, Artificial Sequence
  Description of Artificial Sequence: Synthetic oligonucleotide
cacgcagctcccatcacgggctatg

SEQ ID NO: 344535 - DNA, 25 bp, Artificial Sequence
  Description of Artificial Sequence: Synthetic oligonucleotide
acgcagctcccatcacgggctatgc

SEQ ID NO: 344536 - DNA, 24 bp, Artificial Sequence
  Description of Artificial Sequence: Synthetic oligonucleotide
cgcagctcccatcacgggctatgc

SEQ ID NO: 344537 - DNA, 24 bp, Artificial Sequence
  Description of Artificial Sequence: Synthetic oligonucleotide
gcagctcccatcacgggctatgcc

SEQ ID NO: 344538 - DNA, 25 bp, Artificial Sequence
  Description of Artificial Sequence: Synthetic oligonucleotide
cagctcccatcacgggctatgccct

SEQ ID NO: 344539 - DNA, 26 bp, Artificial Sequence
  Description of Artificial Sequence: Synthetic oligonucleotide
agctcccatcacgggctatgccctca

SEQ ID NO: 344540 - DNA, 25 bp, Artificial Sequence
  Description of Artificial Sequence: Synthetic oligonucleotide
gctcccatcacgggctatgccctca

SEQ ID NO: 344541 - DNA, 26 bp, Artificial Sequence
  Description of Artificial Sequence: Synthetic oligonucleotide
ctcccatcacgggctatgccctcaca

SEQ ID NO: 344542 - DNA, 27 bp, Artificial Sequence
  Description of Artificial Sequence: Synthetic oligonucleotide
tcccatcacgggctatgccctcacact

SEQ ID NO: 344543 - DNA, 26 bp, Artificial Sequence
  Description of Artificial Sequence: Synthetic oligonucleotide
cccatcacgggctatgccctcacact

SEQ ID NO: 344544 - DNA, 27 bp, Artificial Sequence
  Description of Artificial Sequence: Synthetic oligonucleotide
ccatcacgggctatgccctcacactga

SEQ ID NO: 344545 - DNA, 27 bp, Artificial Sequence
  Description of Artificial Sequence: Synthetic oligonucleotide
catcacgggctatgccctcacactgac

SEQ ID NO: 344546 - DNA, 27 bp, Artificial Sequence
  Description of Artificial Sequence: Synthetic oligonucleotide
atcacgggctatgccctcacactgacc

SEQ ID NO: 344547 - DNA, 27 bp, Artificial Sequence
  Description of Artificial Sequence: Synthetic oligonucleotide
tcacgggctatgccctcacactgacct

SEQ ID NO: 344548 - DNA, 27 bp, Artificial Sequence
  Description of Artificial Sequence: Synthetic oligonucleotide
cacgggctatgccctcacactgaccta

SEQ ID NO: 344549 - DNA, 27 bp, Artificial Sequence
  Description of Artificial Sequence: Synthetic oligonucleotide
acgggctatgccctcacactgacctag

SEQ ID NO: 344550 - DNA, 26 bp, Artificial Sequence
  Description of Artificial Sequence: Synthetic oligonucleotide
cgggctatgccctcacactgacctag

SEQ ID NO: 344551 - DNA, 26 bp, Artificial Sequence
  Description of Artificial Sequence: Synthetic oligonucleotide
gggctatgccctcacactgacctagg

SEQ ID NO: 344552 - DNA, 26 bp, Artificial Sequence
  Description of Artificial Sequence: Synthetic oligonucleotide
ggctatgccctcacactgacctaggc

SEQ ID NO: 344553 - DNA, 26 bp, Artificial Sequence
  Description of Artificial Sequence: Synthetic oligonucleotide
gctatgccctcacactgacctaggcg

SEQ ID NO: 344554 - DNA, 26 bp, Artificial Sequence
  Description of Artificial Sequence: Synthetic oligonucleotide
ctatgccctcacactgacctaggcgc

SEQ ID NO: 344555 - DNA, 27 bp, Artificial Sequence
  Description of Artificial Sequence: Synthetic oligonucleotide
tatgccctcacactgacctaggcgcct

SEQ ID NO: 344556 - DNA, 26 bp, Artificial Sequence
  Description of Artificial Sequence: Synthetic oligonucleotide
atgccctcacactgacctaggcgcct

SEQ ID NO: 344557 - DNA, 25 bp, Artificial Sequence
  Description of Artificial Sequence: Synthetic oligonucleotide
tgccctcacactgacctaggcgcct

SEQ ID NO: 344558 - DNA, 24 bp, Artificial Sequence
  Description of Artificial Sequence: Synthetic oligonucleotide
gccctcacactgacctaggcgcct

SEQ ID NO: 344559 - DNA, 25 bp, Artificial Sequence
  Description of Artificial Sequence: Synthetic oligonucleotide
ccctcacactgacctaggcgcctga

SEQ ID NO: 344560 - DNA, 25 bp, Artificial Sequence
  Description of Artificial Sequence: Synthetic oligonucleotide
cctcacactgacctaggcgcctgag

SEQ ID NO: 344561 - DNA, 26 bp, Artificial Sequence
  Description of Artificial Sequence: Synthetic oligonucleotide
ctcacactgacctaggcgcctgagga

SEQ ID NO: 344562 - DNA, 26 bp, Artificial Sequence
  Description of Artificial Sequence: Synthetic oligonucleotide
tcacactgacctaggcgcctgaggac

SEQ ID NO: 344563 - DNA, 25 bp, Artificial Sequence
  Description of Artificial Sequence: Synthetic oligonucleotide
cacactgacctaggcgcctgaggac

SEQ ID NO: 344564 - DNA, 26 bp, Artificial Sequence
  Description of Artificial Sequence: Synthetic oligonucleotide
acactgacctaggcgcctgaggacct

SEQ ID NO: 344565 - DNA, 25 bp, Artificial Sequence
  Description of Artificial Sequence: Synthetic oligonucleotide
cactgacctaggcgcctgaggacct

SEQ ID NO: 344566 - DNA, 25 bp, Artificial Sequence
  Description of Artificial Sequence: Synthetic oligonucleotide
actgacctaggcgcctgaggacctg

SEQ ID NO: 344567 - DNA, 24 bp, Artificial Sequence
  Description of Artificial Sequence: Synthetic oligonucleotide
ctgacctaggcgcctgaggacctg

SEQ ID NO: 344568 - DNA, 25 bp, Artificial Sequence
  Description of Artificial Sequence: Synthetic oligonucleotide
tgacctaggcgcctgaggacctgct

SEQ ID NO: 344569 - DNA, 24 bp, Artificial Sequence
  Description of Artificial Sequence: Synthetic oligonucleotide
gacctaggcgcctgaggacctgct

SEQ ID NO: 344570 - DNA, 24 bp, Artificial Sequence
  Description of Artificial Sequence: Synthetic oligonucleotide
acctaggcgcctgaggacctgctg

SEQ ID NO: 344571 - DNA, 23 bp, Artificial Sequence
  Description of Artificial Sequence: Synthetic oligonucleotide
cctaggcgcctgaggacctgctg

SEQ ID NO: 344572 - DNA, 23 bp, Artificial Sequence
  Description of Artificial Sequence: Synthetic oligonucleotide
ctaggcgcctgaggacctgctgg

SEQ ID NO: 344573 - DNA, 24 bp, Artificial Sequence
  Description of Artificial Sequence: Synthetic oligonucleotide
taggcgcctgaggacctgctgggt

SEQ ID NO: 344574 - DNA, 23 bp, Artificial Sequence
  Description of Artificial Sequence: Synthetic oligonucleotide
aggcgcctgaggacctgctgggt

SEQ ID NO: 344575 - DNA, 22 bp, Artificial Sequence
  Description of Artificial Sequence: Synthetic oligonucleotide
ggcgcctgaggacctgctgggt

SEQ ID NO: 344576 - DNA, 24 bp, Artificial Sequence
  Description of Artificial Sequence: Synthetic oligonucleotide
gcgcctgaggacctgctgggtgtt

SEQ ID NO: 344577 - DNA, 24 bp, Artificial Sequence
  Description of Artificial Sequence: Synthetic oligonucleotide
cgcctgaggacctgctgggtgttg

SEQ ID NO: 344578 - DNA, 24 bp, Artificial Sequence
  Description of Artificial Sequence: Synthetic oligonucleotide
gcctgaggacctgctgggtgttgc

SEQ ID NO: 344579 - DNA, 24 bp, Artificial Sequence
  Description of Artificial Sequence: Synthetic oligonucleotide
cctgaggacctgctgggtgttgcc

SEQ ID NO: 344580 - DNA, 25 bp, Artificial Sequence
  Description of Artificial Sequence: Synthetic oligonucleotide
ctgaggacctgctgggtgttgccga

SEQ ID NO: 344581 - DNA, 27 bp, Artificial Sequence
  Description of Artificial Sequence: Synthetic oligonucleotide
tgaggacctgctgggtgttgccgacaa

SEQ ID NO: 344582 - DNA, 26 bp, Artificial Sequence
  Description of Artificial Sequence: Synthetic oligonucleotide
gaggacctgctgggtgttgccgacaa

SEQ ID NO: 344583 - DNA, 27 bp, Artificial Sequence
  Description of Artificial Sequence: Synthetic oligonucleotide
aggacctgctgggtgttgccgacaaca

SEQ ID NO: 344584 - DNA, 27 bp, Artificial Sequence
  Description of Artificial Sequence: Synthetic oligonucleotide
ggacctgctgggtgttgccgacaacaa

SEQ ID NO: 344585 - DNA, 27 bp, Artificial Sequence
  Description of Artificial Sequence: Synthetic oligonucleotide
gacctgctgggtgttgccgacaacaac

SEQ ID NO: 344586 - DNA, 27 bp, Artificial Sequence
  Description of Artificial Sequence: Synthetic oligonucleotide
acctgctgggtgttgccgacaacaacc

SEQ ID NO: 344587 - DNA, 27 bp, Artificial Sequence
  Description of Artificial Sequence: Synthetic oligonucleotide
cctgctgggtgttgccgacaacaacca

SEQ ID NO: 344588 - DNA, 27 bp, Artificial Sequence
  Description of Artificial Sequence: Synthetic oligonucleotide
ctgctgggtgttgccgacaacaaccac

SEQ ID NO: 344589 - DNA, 29 bp, Artificial Sequence
  Description of Artificial Sequence: Synthetic oligonucleotide
tgctgggtgttgccgacaacaaccacatg

SEQ ID NO: 344590 - DNA, 28 bp, Artificial Sequence
  Description of Artificial Sequence: Synthetic oligonucleotide
gctgggtgttgccgacaacaaccacatg

SEQ ID NO: 344591 - DNA, 28 bp, Artificial Sequence
  Description of Artificial Sequence: Synthetic oligonucleotide
ctgggtgttgccgacaacaaccacatgg

SEQ ID NO: 344592 - DNA, 28 bp, Artificial Sequence
  Description of Artificial Sequence: Synthetic oligonucleotide
tgggtgttgccgacaacaaccacatggc

SEQ ID NO: 344593 - DNA, 27 bp, Artificial Sequence
  Description of Artificial Sequence: Synthetic oligonucleotide
gggtgttgccgacaacaaccacatggc

SEQ ID NO: 344594 - DNA, 30 bp, Artificial Sequence
  Description of Artificial Sequence: Synthetic oligonucleotide
ggtgttgccgacaacaaccacatggcaatc

SEQ ID NO: 344595 - DNA, 30 bp, Artificial Sequence
  Description of Artificial Sequence: Synthetic oligonucleotide
gtgttgccgacaacaaccacatggcaatcg

SEQ ID NO: 344596 - DNA, 30 bp, Artificial Sequence
  Description of Artificial Sequence: Synthetic oligonucleotide
tgttgccgacaacaaccacatggcaatcgc

SEQ ID NO: 344597 - DNA, 29 bp, Artificial Sequence
  Description of Artificial Sequence: Synthetic oligonucleotide
gttgccgacaacaaccacatggcaatcgc

SEQ ID NO: 344598 - DNA, 29 bp, Artificial Sequence
  Description of Artificial Sequence: Synthetic oligonucleotide
ttgccgacaacaaccacatggcaatcgcc

SEQ ID NO: 344599 - DNA, 28 bp, Artificial Sequence
  Description of Artificial Sequence: Synthetic oligonucleotide
tgccgacaacaaccacatggcaatcgcc

SEQ ID NO: 344600 - DNA, 27 bp, Artificial Sequence
  Description of Artificial Sequence: Synthetic oligonucleotide
gccgacaacaaccacatggcaatcgcc

SEQ ID NO: 344601 - DNA, 27 bp, Artificial Sequence
  Description of Artificial Sequence: Synthetic oligonucleotide
ccgacaacaaccacatggcaatcgccc

SEQ ID NO: 344602 - DNA, 28 bp, Artificial Sequence
  Description of Artificial Sequence: Synthetic oligonucleotide
cgacaacaaccacatggcaatcgcccag

SEQ ID NO: 344603 - DNA, 28 bp, Artificial Sequence
  Description of Artificial Sequence: Synthetic oligonucleotide
gacaacaaccacatggcaatcgcccagg

SEQ ID NO: 344604 - DNA, 29 bp, Artificial Sequence
  Description of Artificial Sequence: Synthetic oligonucleotide
acaacaaccacatggcaatcgcccaggag

SEQ ID NO: 344605 - DNA, 28 bp, Artificial Sequence
  Description of Artificial Sequence: Synthetic oligonucleotide
caacaaccacatggcaatcgcccaggag

SEQ ID NO: 344606 - DNA, 29 bp, Artificial Sequence
  Description of Artificial Sequence: Synthetic oligonucleotide
aacaaccacatggcaatcgcccaggagtc

SEQ ID NO: 344607 - DNA, 28 bp, Artificial Sequence
  Description of Artificial Sequence: Synthetic oligonucleotide
acaaccacatggcaatcgcccaggagtc

SEQ ID NO: 344608 - DNA, 27 bp, Artificial Sequence
  Description of Artificial Sequence: Synthetic oligonucleotide
caaccacatggcaatcgcccaggagtc

SEQ ID NO: 344609 - DNA, 28 bp, Artificial Sequence
  Description of Artificial Sequence: Synthetic oligonucleotide
aaccacatggcaatcgcccaggagtctg

SEQ ID NO: 344610 - DNA, 27 bp, Artificial Sequence
  Description of Artificial Sequence: Synthetic oligonucleotide
accacatggcaatcgcccaggagtctg

SEQ ID NO: 344611 - DNA, 26 bp, Artificial Sequence
  Description of Artificial Sequence: Synthetic oligonucleotide
ccacatggcaatcgcccaggagtctg

SEQ ID NO: 344612 - DNA, 27 bp, Artificial Sequence
  Description of Artificial Sequence: Synthetic oligonucleotide
cacatggcaatcgcccaggagtctgga

SEQ ID NO: 344613 - DNA, 27 bp, Artificial Sequence
  Description of Artificial Sequence: Synthetic oligonucleotide
acatggcaatcgcccaggagtctggag

SEQ ID NO: 344614 - DNA, 27 bp, Artificial Sequence
  Description of Artificial Sequence: Synthetic oligonucleotide
catggcaatcgcccaggagtctggaga

SEQ ID NO: 344615 - DNA, 30 bp, Artificial Sequence
  Description of Artificial Sequence: Synthetic oligonucleotide
atggcaatcgcccaggagtctggagatatc

SEQ ID NO: 344616 - DNA, 29 bp, Artificial Sequence
  Description of Artificial Sequence: Synthetic oligonucleotide
tggcaatcgcccaggagtctggagatatc

SEQ ID NO: 344617 - DNA, 28 bp, Artificial Sequence
  Description of Artificial Sequence: Synthetic oligonucleotide
ggcaatcgcccaggagtctggagatatc

SEQ ID NO: 344618 - DNA, 28 bp, Artificial Sequence
  Description of Artificial Sequence: Synthetic oligonucleotide
gcaatcgcccaggagtctggagatatcc

SEQ ID NO: 344619 - DNA, 29 bp, Artificial Sequence
  Description of Artificial Sequence: Synthetic oligonucleotide
caatcgcccaggagtctggagatatcctg

SEQ ID NO: 344620 - DNA, 31 bp, Artificial Sequence
  Description of Artificial Sequence: Synthetic oligonucleotide
aatcgcccaggagtctggagatatcctgtac

SEQ ID NO: 344621 - DNA, 30 bp, Artificial Sequence
  Description of Artificial Sequence: Synthetic oligonucleotide
atcgcccaggagtctggagatatcctgtac

SEQ ID NO: 344622 - DNA, 29 bp, Artificial Sequence
  Description of Artificial Sequence: Synthetic oligonucleotide
tcgcccaggagtctggagatatcctgtac

SEQ ID NO: 344623 - DNA, 28 bp, Artificial Sequence
  Description of Artificial Sequence: Synthetic oligonucleotide
cgcccaggagtctggagatatcctgtac

SEQ ID NO: 344624 - DNA, 29 bp, Artificial Sequence
  Description of Artificial Sequence: Synthetic oligonucleotide
gcccaggagtctggagatatcctgtactg

SEQ ID NO: 344625 - DNA, 29 bp, Artificial Sequence
  Description of Artificial Sequence: Synthetic oligonucleotide
cccaggagtctggagatatcctgtactgc

SEQ ID NO: 344626 - DNA, 29 bp, Artificial Sequence
  Description of Artificial Sequence: Synthetic oligonucleotide
ccaggagtctggagatatcctgtactgcg

SEQ ID NO: 344627 - DNA, 29 bp, Artificial Sequence
  Description of Artificial Sequence: Synthetic oligonucleotide
caggagtctggagatatcctgtactgcgg

SEQ ID NO: 344628 - DNA, 29 bp, Artificial Sequence
  Description of Artificial Sequence: Synthetic oligonucleotide
aggagtctggagatatcctgtactgcggc

SEQ ID NO: 344629 - DNA, 28 bp, Artificial Sequence
  Description of Artificial Sequence: Synthetic oligonucleotide
ggagtctggagatatcctgtactgcggc

SEQ ID NO: 344630 - DNA, 29 bp, Artificial Sequence
  Description of Artificial Sequence: Synthetic oligonucleotide
gagtctggagatatcctgtactgcggctc

SEQ ID NO: 344631 - DNA, 30 bp, Artificial Sequence
  Description of Artificial Sequence: Synthetic oligonucleotide
agtctggagatatcctgtactgcggctcag

SEQ ID NO: 344632 - DNA, 29 bp, Artificial Sequence
  Description of Artificial Sequence: Synthetic oligonucleotide
gtctggagatatcctgtactgcggctcag

SEQ ID NO: 344633 - DNA, 30 bp, Artificial Sequence
  Description of Artificial Sequence: Synthetic oligonucleotide
tctggagatatcctgtactgcggctcagtc

SEQ ID NO: 344634 - DNA, 29 bp, Artificial Sequence
  Description of Artificial Sequence: Synthetic oligonucleotide
ctggagatatcctgtactgcggctcagtc

SEQ ID NO: 344635 - DNA, 30 bp, Artificial Sequence
  Description of Artificial Sequence: Synthetic oligonucleotide
tggagatatcctgtactgcggctcagtctc

SEQ ID NO: 344636 - DNA, 29 bp, Artificial Sequence
  Description of Artificial Sequence: Synthetic oligonucleotide
ggagatatcctgtactgcggctcagtctc

SEQ ID NO: 344637 - DNA, 30 bp, Artificial Sequence
  Description of Artificial Sequence: Synthetic oligonucleotide
gagatatcctgtactgcggctcagtctctg

SEQ ID NO: 344638 - DNA, 30 bp, Artificial Sequence
  Description of Artificial Sequence: Synthetic oligonucleotide
agatatcctgtactgcggctcagtctctgg

SEQ ID NO: 344639 - DNA, 29 bp, Artificial Sequence
  Description of Artificial Sequence: Synthetic oligonucleotide
gatatcctgtactgcggctcagtctctgg

SEQ ID NO: 344640 - DNA, 31 bp, Artificial Sequence
  Description of Artificial Sequence: Synthetic oligonucleotide
atatcctgtactgcggctcagtctctggttc

SEQ ID NO: 344641 - DNA, 30 bp, Artificial Sequence
  Description of Artificial Sequence: Synthetic oligonucleotide
tatcctgtactgcggctcagtctctggttc

SEQ ID NO: 344642 - DNA, 29 bp, Artificial Sequence
  Description of Artificial Sequence: Synthetic oligonucleotide
atcctgtactgcggctcagtctctggttc

SEQ ID NO: 344643 - DNA, 28 bp, Artificial Sequence
  Description of Artificial Sequence: Synthetic oligonucleotide
tcctgtactgcggctcagtctctggttc

SEQ ID NO: 344644 - DNA, 27 bp, Artificial Sequence
  Description of Artificial Sequence: Synthetic oligonucleotide
cctgtactgcggctcagtctctggttc

SEQ ID NO: 344645 - DNA, 28 bp, Artificial Sequence
  Description of Artificial Sequence: Synthetic oligonucleotide
ctgtactgcggctcagtctctggttctc

SEQ ID NO: 344646 - DNA, 29 bp, Artificial Sequence
  Description of Artificial Sequence: Synthetic oligonucleotide
tgtactgcggctcagtctctggttctctg

SEQ ID NO: 344647 - DNA, 28 bp, Artificial Sequence
  Description of Artificial Sequence: Synthetic oligonucleotide
gtactgcggctcagtctctggttctctg

SEQ ID NO: 344648 - DNA, 29 bp, Artificial Sequence
  Description of Artificial Sequence: Synthetic oligonucleotide
tactgcggctcagtctctggttctctgag

SEQ ID NO: 344649 - DNA, 28 bp, Artificial Sequence
  Description of Artificial Sequence: Synthetic oligonucleotide
actgcggctcagtctctggttctctgag

SEQ ID NO: 344650 - DNA, 27 bp, Artificial Sequence
  Description of Artificial Sequence: Synthetic oligonucleotide
ctgcggctcagtctctggttctctgag

SEQ ID NO: 344651 - DNA, 27 bp, Artificial Sequence
  Description of Artificial Sequence: Synthetic oligonucleotide
tgcggctcagtctctggttctctgagc

SEQ ID NO: 344652 - DNA, 27 bp, Artificial Sequence
  Description of Artificial Sequence: Synthetic oligonucleotide
gcggctcagtctctggttctctgagca

SEQ ID NO: 344653 - DNA, 29 bp, Artificial Sequence
  Description of Artificial Sequence: Synthetic oligonucleotide
cggctcagtctctggttctctgagcaatg

SEQ ID NO: 344654 - DNA, 29 bp, Artificial Sequence
  Description of Artificial Sequence: Synthetic oligonucleotide
ggctcagtctctggttctctgagcaatgc

SEQ ID NO: 344655 - DNA, 29 bp, Artificial Sequence
  Description of Artificial Sequence: Synthetic oligonucleotide
gctcagtctctggttctctgagcaatgcg

SEQ ID NO: 344656 - DNA, 29 bp, Artificial Sequence
  Description of Artificial Sequence: Synthetic oligonucleotide
ctcagtctctggttctctgagcaatgcgg

SEQ ID NO: 344657 - DNA, 30 bp, Artificial Sequence
  Description of Artificial Sequence: Synthetic oligonucleotide
tcagtctctggttctctgagcaatgcggtg

SEQ ID NO: 344658 - DNA, 29 bp, Artificial Sequence
  Description of Artificial Sequence: Synthetic oligonucleotide
cagtctctggttctctgagcaatgcggtg

SEQ ID NO: 344659 - DNA, 30 bp, Artificial Sequence
  Description of Artificial Sequence: Synthetic oligonucleotide
agtctctggttctctgagcaatgcggtgtc

SEQ ID NO: 344660 - DNA, 29 bp, Artificial Sequence
  Description of Artificial Sequence: Synthetic oligonucleotide
gtctctggttctctgagcaatgcggtgtc

SEQ ID NO: 344661 - DNA, 29 bp, Artificial Sequence
  Description of Artificial Sequence: Synthetic oligonucleotide
tctctggttctctgagcaatgcggtgtcg

SEQ ID NO: 344662 - DNA, 28 bp, Artificial Sequence
  Description of Artificial Sequence: Synthetic oligonucleotide
ctctggttctctgagcaatgcggtgtcg

SEQ ID NO: 344663 - DNA, 28 bp, Artificial Sequence
  Description of Artificial Sequence: Synthetic oligonucleotide
tctggttctctgagcaatgcggtgtcgc

SEQ ID NO: 344664 - DNA, 27 bp, Artificial Sequence
  Description of Artificial Sequence: Synthetic oligonucleotide
ctggttctctgagcaatgcggtgtcgc

SEQ ID NO: 344665 - DNA, 27 bp, Artificial Sequence
  Description of Artificial Sequence: Synthetic oligonucleotide
tggttctctgagcaatgcggtgtcgcc

SEQ ID NO: 344666 - DNA, 26 bp, Artificial Sequence
  Description of Artificial Sequence: Synthetic oligonucleotide
ggttctctgagcaatgcggtgtcgcc

SEQ ID NO: 344667 - DNA, 27 bp, Artificial Sequence
  Description of Artificial Sequence: Synthetic oligonucleotide
gttctctgagcaatgcggtgtcgccct

SEQ ID NO: 344668 - DNA, 27 bp, Artificial Sequence
  Description of Artificial Sequence: Synthetic oligonucleotide
ttctctgagcaatgcggtgtcgccctc

SEQ ID NO: 344669 - DNA, 26 bp, Artificial Sequence
  Description of Artificial Sequence: Synthetic oligonucleotide
tctctgagcaatgcggtgtcgccctc

SEQ ID NO: 344670 - DNA, 25 bp, Artificial Sequence
  Description of Artificial Sequence: Synthetic oligonucleotide
ctctgagcaatgcggtgtcgccctc

SEQ ID NO: 344671 - DNA, 25 bp, Artificial Sequence
  Description of Artificial Sequence: Synthetic oligonucleotide
tctgagcaatgcggtgtcgccctcc

SEQ ID NO: 344672 - DNA, 24 bp, Artificial Sequence
  Description of Artificial Sequence: Synthetic oligonucleotide
ctgagcaatgcggtgtcgccctcc

SEQ ID NO: 344673 - DNA, 24 bp, Artificial Sequence
  Description of Artificial Sequence: Synthetic oligonucleotide
tgagcaatgcggtgtcgccctccc

SEQ ID NO: 344674 - DNA, 23 bp, Artificial Sequence
  Description of Artificial Sequence: Synthetic oligonucleotide
gagcaatgcggtgtcgccctccc

SEQ ID NO: 344675 - DNA, 23 bp, Artificial Sequence
  Description of Artificial Sequence: Synthetic oligonucleotide
agcaatgcggtgtcgccctcccc

SEQ ID NO: 344676 - DNA, 22 bp, Artificial Sequence
  Description of Artificial Sequence: Synthetic oligonucleotide
gcaatgcggtgtcgccctcccc

SEQ ID NO: 344677 - DNA, 22 bp, Artificial Sequence
  Description of Artificial Sequence: Synthetic oligonucleotide
caatgcggtgtcgccctccccg

SEQ ID NO: 344678 - DNA, 22 bp, Artificial Sequence
  Description of Artificial Sequence: Synthetic oligonucleotide
aatgcggtgtcgccctccccgg

SEQ ID NO: 344679 - DNA, 21 bp, Artificial Sequence
  Description of Artificial Sequence: Synthetic oligonucleotide
atgcggtgtcgccctccccgg

SEQ ID NO: 344680 - DNA, 20 bp, Artificial Sequence
  Description of Artificial Sequence: Synthetic oligonucleotide
tgcggtgtcgccctccccgg

SEQ ID NO: 344681 - DNA, 20 bp, Artificial Sequence
  Description of Artificial Sequence: Synthetic oligonucleotide
gcggtgtcgccctccccggt

SEQ ID NO: 344682 - DNA, 20 bp, Artificial Sequence
  Description of Artificial Sequence: Synthetic oligonucleotide
cggtgtcgccctccccggct

SEQ ID NO: 344683 - DNA, 20 bp, Artificial Sequence
  Description of Artificial Sequence: Synthetic oligonucleotide
ggtgtcgccctccccggctc

SEQ ID NO: 344684 - DNA, 21 bp, Artificial Sequence
  Description of Artificial Sequence: Synthetic oligonucleotide
gtgtcgccctccccggctcgt

SEQ ID NO: 344685 - DNA, 21 bp, Artificial Sequence
  Description of Artificial Sequence: Synthetic oligonucleotide
tgtcgccctccccggctcgtc

SEQ ID NO: 344686 - DNA, 20 bp, Artificial Sequence
  Description of Artificial Sequence: Synthetic oligonucleotide
gtcgccctccccggctcgtc

SEQ ID NO: 344687 - DNA, 20 bp, Artificial Sequence
  Description of Artificial Sequence: Synthetic oligonucleotide
tcgccctccccggctcgtcg

SEQ ID NO: 344688 - DNA, 20 bp, Artificial Sequence
  Description of Artificial Sequence: Synthetic oligonucleotide
cgccctccccggctcgtcgt

SEQ ID NO: 344689 - DNA, 21 bp, Artificial Sequence
  Description of Artificial Sequence: Synthetic oligonucleotide
gccctccccggctcgtcgcaa

SEQ ID NO: 344690 - DNA, 21 bp, Artificial Sequence
  Description of Artificial Sequence: Synthetic oligonucleotide
ccctccccggctcgtcgcaac

SEQ ID NO: 344691 - DNA, 21 bp, Artificial Sequence
  Description of Artificial Sequence: Synthetic oligonucleotide
cctccccggctcgtcgcaacc

SEQ ID NO: 344692 - DNA, 23 bp, Artificial Sequence
  Description of Artificial Sequence: Synthetic oligonucleotide
ctccccggctcgtcgcaaccctt

SEQ ID NO: 344693 - DNA, 23 bp, Artificial Sequence
  Description of Artificial Sequence: Synthetic oligonucleotide
tccccggctcgtcgcaacccttc

SEQ ID NO: 344694 - DNA, 22 bp, Artificial Sequence
  Description of Artificial Sequence: Synthetic oligonucleotide
ccccggctcgtcgcaacccttc

SEQ ID NO: 344695 - DNA, 22 bp, Artificial Sequence
  Description of Artificial Sequence: Synthetic oligonucleotide
cccggctcgtcgcaacccttcc

SEQ ID NO: 344696 - DNA, 23 bp, Artificial Sequence
  Description of Artificial Sequence: Synthetic oligonucleotide
ccggctcgtcgcaacccttccga

SEQ ID NO: 344697 - DNA, 23 bp, Artificial Sequence
  Description of Artificial Sequence: Synthetic oligonucleotide
cggctcgtcgcaacccttccgac

SEQ ID NO: 344698 - DNA, 23 bp, Artificial Sequence
  Description of Artificial Sequence: Synthetic oligonucleotide
ggctcgtcgcaacccttccgacc

SEQ ID NO: 344699 - DNA, 23 bp, Artificial Sequence
  Description of Artificial Sequence: Synthetic oligonucleotide
gctcgtcgcaacccttccgaccc

SEQ ID NO: 344700 - DNA, 25 bp, Artificial Sequence
  Description of Artificial Sequence: Synthetic oligonucleotide
ctcgtcgcaacccttccgacccctt

SEQ ID NO: 344701 - DNA, 25 bp, Artificial Sequence
  Description of Artificial Sequence: Synthetic oligonucleotide
tcgtcgcaacccttccgaccccttg

SEQ ID NO: 344702 - DNA, 24 bp, Artificial Sequence
  Description of Artificial Sequence: Synthetic oligonucleotide
cgtcgcaacccttccgaccccttg

SEQ ID NO: 344703 - DNA, 24 bp, Artificial Sequence
  Description of Artificial Sequence: Synthetic oligonucleotide
gtcgcaacccttccgaccccttgc

SEQ ID NO: 344704 - DNA, 24 bp, Artificial Sequence
  Description of Artificial Sequence: Synthetic oligonucleotide
tcgcaacccttccgaccccttgcc

SEQ ID NO: 344705 - DNA, 23 bp, Artificial Sequence
  Description of Artificial Sequence: Synthetic oligonucleotide
cgcaacccttccgaccccttgcc

SEQ ID NO: 344706 - DNA, 23 bp, Artificial Sequence
  Description of Artificial Sequence: Synthetic oligonucleotide
gcaacccttccgaccccttgccc

SEQ ID NO: 344707 - DNA, 24 bp, Artificial Sequence
  Description of Artificial Sequence: Synthetic oligonucleotide
caacccttccgaccccttgcccca

SEQ ID NO: 344708 - DNA, 24 bp, Artificial Sequence
  Description of Artificial Sequence: Synthetic oligonucleotide
aacccttccgaccccttgccccag

SEQ ID NO: 344709 - DNA, 23 bp, Artificial Sequence
  Description of Artificial Sequence: Synthetic oligonucleotide
acccttccgaccccttgccccag

SEQ ID NO: 344710 - DNA, 22 bp, Artificial Sequence
  Description of Artificial Sequence: Synthetic oligonucleotide
cccttccgaccccttgccccag

SEQ ID NO: 344711 - DNA, 22 bp, Artificial Sequence
  Description of Artificial Sequence: Synthetic oligonucleotide
ccttccgaccccttgccccagg

SEQ ID NO: 344712 - DNA, 22 bp, Artificial Sequence
  Description of Artificial Sequence: Synthetic oligonucleotide
cttccgaccccttgccccaggg

SEQ ID NO: 344713 - DNA, 22 bp, Artificial Sequence
  Description of Artificial Sequence: Synthetic oligonucleotide
ttccgaccccttgccccagggc

SEQ ID NO: 344714 - DNA, 21 bp, Artificial Sequence
  Description of Artificial Sequence: Synthetic oligonucleotide
tccgaccccttgccccagggc

SEQ ID NO: 344715 - DNA, 20 bp, Artificial Sequence
  Description of Artificial Sequence: Synthetic oligonucleotide
ccgaccccttgccccagggc

SEQ ID NO: 344716 - DNA, 20 bp, Artificial Sequence
  Description of Artificial Sequence: Synthetic oligonucleotide
cgaccccttgccccagggcc

SEQ ID NO: 344717 - DNA, 21 bp, Artificial Sequence
  Description of Artificial Sequence: Synthetic oligonucleotide
gaccccttgccccagggccca

SEQ ID NO: 344718 - DNA, 21 bp, Artificial Sequence
  Description of Artificial Sequence: Synthetic oligonucleotide
accccttgccccagggcccag

SEQ ID NO: 344719 - DNA, 20 bp, Artificial Sequence
  Description of Artificial Sequence: Synthetic oligonucleotide
ccccttgccccagggcccag

SEQ ID NO: 344720 - DNA, 20 bp, Artificial Sequence
  Description of Artificial Sequence: Synthetic oligonucleotide
cccttgccccagggcccagc

SEQ ID NO: 344721 - DNA, 20 bp, Artificial Sequence
  Description of Artificial Sequence: Synthetic oligonucleotide
ccttgccccagggcccagcc

SEQ ID NO: 344722 - DNA, 21 bp, Artificial Sequence
  Description of Artificial Sequence: Synthetic oligonucleotide
cttgccccagggcccagccct

SEQ ID NO: 344723 - DNA, 22 bp, Artificial Sequence
  Description of Artificial Sequence: Synthetic oligonucleotide
ttgccccagggcccagccctct

SEQ ID NO: 344724 - DNA, 21 bp, Artificial Sequence
  Description of Artificial Sequence: Synthetic oligonucleotide
tgccccagggcccagccctct

SEQ ID NO: 344725 - DNA, 20 bp, Artificial Sequence
  Description of Artificial Sequence: Synthetic oligonucleotide
gccccagggcccagccctct

SEQ ID NO: 344726 - DNA, 20 bp, Artificial Sequence
  Description of Artificial Sequence: Synthetic oligonucleotide
ccccagggcccagccctctg

SEQ ID NO: 344727 - DNA, 23 bp, Artificial Sequence
  Description of Artificial Sequence: Synthetic oligonucleotide
cccagggcccagccctctggatt

SEQ ID NO: 344728 - DNA, 26 bp, Artificial Sequence
  Description of Artificial Sequence: Synthetic oligonucleotide
ccagggcccagccctctggattgaat

SEQ ID NO: 344729 - DNA, 26 bp, Artificial Sequence
  Description of Artificial Sequence: Synthetic oligonucleotide
cagggcccagccctctggattgaatc

SEQ ID NO: 344730 - DNA, 27 bp, Artificial Sequence
  Description of Artificial Sequence: Synthetic oligonucleotide
agggcccagccctctggattgaatcca

SEQ ID NO: 344731 - DNA, 26 bp, Artificial Sequence
  Description of Artificial Sequence: Synthetic oligonucleotide
gggcccagccctctggattgaatcca

SEQ ID NO: 344732 - DNA, 27 bp, Artificial Sequence
  Description of Artificial Sequence: Synthetic oligonucleotide
ggcccagccctctggattgaatccaca

SEQ ID NO: 344733 - DNA, 27 bp, Artificial Sequence
  Description of Artificial Sequence: Synthetic oligonucleotide
gcccagccctctggattgaatccacag

SEQ ID NO: 344734 - DNA, 27 bp, Artificial Sequence
  Description of Artificial Sequence: Synthetic oligonucleotide
cccagccctctggattgaatccacagc

SEQ ID NO: 344735 - DNA, 27 bp, Artificial Sequence
  Description of Artificial Sequence: Synthetic oligonucleotide
ccagccctctggattgaatccacagcc

SEQ ID NO: 344736 - DNA, 29 bp, Artificial Sequence
  Description of Artificial Sequence: Synthetic oligonucleotide
cagccctctggattgaatccacagccttc

SEQ ID NO: 344737 - DNA, 29 bp, Artificial Sequence
  Description of Artificial Sequence: Synthetic oligonucleotide
agccctctggattgaatccacagccttcg

SEQ ID NO: 344738 - DNA, 28 bp, Artificial Sequence
  Description of Artificial Sequence: Synthetic oligonucleotide
gccctctggattgaatccacagccttcg

SEQ ID NO: 344739 - DNA, 28 bp, Artificial Sequence
  Description of Artificial Sequence: Synthetic oligonucleotide
ccctctggattgaatccacagccttcgc

SEQ ID NO: 344740 - DNA, 28 bp, Artificial Sequence
  Description of Artificial Sequence: Synthetic oligonucleotide
cctctggattgaatccacagccttcgcc

SEQ ID NO: 344741 - DNA, 28 bp, Artificial Sequence
  Description of Artificial Sequence: Synthetic oligonucleotide
ctctggattgaatccacagccttcgccc

SEQ ID NO: 344742 - DNA, 29 bp, Artificial Sequence
  Description of Artificial Sequence: Synthetic oligonucleotide
tctggattgaatccacagccttcgccctg

SEQ ID NO: 344743 - DNA, 28 bp, Artificial Sequence
  Description of Artificial Sequence: Synthetic oligonucleotide
ctggattgaatccacagccttcgccctg

SEQ ID NO: 344744 - DNA, 28 bp, Artificial Sequence
  Description of Artificial Sequence: Synthetic oligonucleotide
tggattgaatccacagccttcgccctgc

SEQ ID NO: 344745 - DNA, 27 bp, Artificial Sequence
  Description of Artificial Sequence: Synthetic oligonucleotide
ggattgaatccacagccttcgccctgc

SEQ ID NO: 344746 - DNA, 28 bp, Artificial Sequence
  Description of Artificial Sequence: Synthetic oligonucleotide
gattgaatccacagccttcgccctgctc

SEQ ID NO: 344747 - DNA, 28 bp, Artificial Sequence
  Description of Artificial Sequence: Synthetic oligonucleotide
attgaatccacagccttcgccctgctcc

SEQ ID NO: 344748 - DNA, 27 bp, Artificial Sequence
  Description of Artificial Sequence: Synthetic oligonucleotide
ttgaatccacagccttcgccctgctcc

SEQ ID NO: 344749 - DNA, 27 bp, Artificial Sequence
  Description of Artificial Sequence: Synthetic oligonucleotide
tgaatccacagccttcgccctgctcca

SEQ ID NO: 344750 - DNA, 26 bp, Artificial Sequence
  Description of Artificial Sequence: Synthetic oligonucleotide
gaatccacagccttcgccctgctcca

SEQ ID NO: 344751 - DNA, 26 bp, Artificial Sequence
  Description of Artificial Sequence: Synthetic oligonucleotide
aatccacagccttcgccctgctccac

SEQ ID NO: 344752 - DNA, 25 bp, Artificial Sequence
  Description of Artificial Sequence: Synthetic oligonucleotide
atccacagccttcgccctgctccac

SEQ ID NO: 344753 - DNA, 24 bp, Artificial Sequence
  Description of Artificial Sequence: Synthetic oligonucleotide
tccacagccttcgccctgctccac

SEQ ID NO: 344754 - DNA, 23 bp, Artificial Sequence
  Description of Artificial Sequence: Synthetic oligonucleotide
ccacagccttcgccctgctccac

SEQ ID NO: 344755 - DNA, 24 bp, Artificial Sequence
  Description of Artificial Sequence: Synthetic oligonucleotide
cacagccttcgccctgctccacct

SEQ ID NO: 344756 - DNA, 24 bp, Artificial Sequence
  Description of Artificial Sequence: Synthetic oligonucleotide
acagccttcgccctgctccacctc

SEQ ID NO: 344757 - DNA, 23 bp, Artificial Sequence
  Description of Artificial Sequence: Synthetic oligonucleotide
cagccttcgccctgctccacctc

SEQ ID NO: 344758 - DNA, 24 bp, Artificial Sequence
  Description of Artificial Sequence: Synthetic oligonucleotide
agccttcgccctgctccacctcct

SEQ ID NO: 344759 - DNA, 23 bp, Artificial Sequence
  Description of Artificial Sequence: Synthetic oligonucleotide
gccttcgccctgctccacctcct

SEQ ID NO: 344760 - DNA, 23 bp, Artificial Sequence
  Description of Artificial Sequence: Synthetic oligonucleotide
ccttcgccctgctccacctcctg

SEQ ID NO: 344761 - DNA, 25 bp, Artificial Sequence
  Description of Artificial Sequence: Synthetic oligonucleotide
cttcgccctgctccacctcctggtt

SEQ ID NO: 344762 - DNA, 26 bp, Artificial Sequence
  Description of Artificial Sequence: Synthetic oligonucleotide
ttcgccctgctccacctcctggttca

SEQ ID NO: 344763 - DNA, 25 bp, Artificial Sequence
  Description of Artificial Sequence: Synthetic oligonucleotide
tcgccctgctccacctcctggttca

SEQ ID NO: 344764 - DNA, 24 bp, Artificial Sequence
  Description of Artificial Sequence: Synthetic oligonucleotide
cgccctgctccacctcctggttca

SEQ ID NO: 344765 - DNA, 24 bp, Artificial Sequence
  Description of Artificial Sequence: Synthetic oligonucleotide
gccctgctccacctcctggttcac

SEQ ID NO: 344766 - DNA, 25 bp, Artificial Sequence
  Description of Artificial Sequence: Synthetic oligonucleotide
ccctgctccacctcctggttcacga

SEQ ID NO: 344767 - DNA, 25 bp, Artificial Sequence
  Description of Artificial Sequence: Synthetic oligonucleotide
cctgctccacctcctggttcacgag

SEQ ID NO: 344768 - DNA, 25 bp, Artificial Sequence
  Description of Artificial Sequence: Synthetic oligonucleotide
ctgctccacctcctggttcacgagg

SEQ ID NO: 344769 - DNA, 25 bp, Artificial Sequence
  Description of Artificial Sequence: Synthetic oligonucleotide
tgctccacctcctggttcacgaggc

SEQ ID NO: 344770 - DNA, 24 bp, Artificial Sequence
  Description of Artificial Sequence: Synthetic oligonucleotide
gctccacctcctggttcacgaggc

SEQ ID NO: 344771 - DNA, 27 bp, Artificial Sequence
  Description of Artificial Sequence: Synthetic oligonucleotide
ctccacctcctggttcacgaggccaaa

SEQ ID NO: 344772 - DNA, 27 bp, Artificial Sequence
  Description of Artificial Sequence: Synthetic oligonucleotide
tccacctcctggttcacgaggccaaag

SEQ ID NO: 344773 - DNA, 26 bp, Artificial Sequence
  Description of Artificial Sequence: Synthetic oligonucleotide
ccacctcctggttcacgaggccaaag

SEQ ID NO: 344774 - DNA, 27 bp, Artificial Sequence
  Description of Artificial Sequence: Synthetic oligonucleotide
cacctcctggttcacgaggccaaagca

SEQ ID NO: 344775 - DNA, 27 bp, Artificial Sequence
  Description of Artificial Sequence: Synthetic oligonucleotide
acctcctggttcacgaggccaaagcag

SEQ ID NO: 344776 - DNA, 27 bp, Artificial Sequence
  Description of Artificial Sequence: Synthetic oligonucleotide
cctcctggttcacgaggccaaagcaga

SEQ ID NO: 344777 - DNA, 27 bp, Artificial Sequence
  Description of Artificial Sequence: Synthetic oligonucleotide
ctcctggttcacgaggccaaagcagac

SEQ ID NO: 344778 - DNA, 29 bp, Artificial Sequence
  Description of Artificial Sequence: Synthetic oligonucleotide
tcctggttcacgaggccaaagcagacatg

SEQ ID NO: 344779 - DNA, 28 bp, Artificial Sequence
  Description of Artificial Sequence: Synthetic oligonucleotide
cctggttcacgaggccaaagcagacatg

SEQ ID NO: 344780 - DNA, 28 bp, Artificial Sequence
  Description of Artificial Sequence: Synthetic oligonucleotide
ctggttcacgaggccaaagcagacatgg

SEQ ID NO: 344781 - DNA, 28 bp, Artificial Sequence
  Description of Artificial Sequence: Synthetic oligonucleotide
tggttcacgaggccaaagcagacatggc

SEQ ID NO: 344782 - DNA, 27 bp, Artificial Sequence
  Description of Artificial Sequence: Synthetic oligonucleotide
ggttcacgaggccaaagcagacatggc

SEQ ID NO: 344783 - DNA, 28 bp, Artificial Sequence
  Description of Artificial Sequence: Synthetic oligonucleotide
gttcacgaggccaaagcagacatggcag

SEQ ID NO: 344784 - DNA, 29 bp, Artificial Sequence
  Description of Artificial Sequence: Synthetic oligonucleotide
ttcacgaggccaaagcagacatggcagac

SEQ ID NO: 344785 - DNA, 28 bp, Artificial Sequence
  Description of Artificial Sequence: Synthetic oligonucleotide
tcacgaggccaaagcagacatggcagac

SEQ ID NO: 344786 - DNA, 27 bp, Artificial Sequence
  Description of Artificial Sequence: Synthetic oligonucleotide
cacgaggccaaagcagacatggcagac

SEQ ID NO: 344787 - DNA, 27 bp, Artificial Sequence
  Description of Artificial Sequence: Synthetic oligonucleotide
acgaggccaaagcagacatggcagacg

SEQ ID NO: 344788 - DNA, 27 bp, Artificial Sequence
  Description of Artificial Sequence: Synthetic oligonucleotide
cgaggccaaagcagacatggcagacga

SEQ ID NO: 344789 - DNA, 27 bp, Artificial Sequence
  Description of Artificial Sequence: Synthetic oligonucleotide
gaggccaaagcagacatggcagacgag

SEQ ID NO: 344790 - DNA, 27 bp, Artificial Sequence
  Description of Artificial Sequence: Synthetic oligonucleotide
aggccaaagcagacatggcagacgagg

SEQ ID NO: 344791 - DNA, 26 bp, Artificial Sequence
  Description of Artificial Sequence: Synthetic oligonucleotide
ggccaaagcagacatggcagacgagg

SEQ ID NO: 344792 - DNA, 27 bp, Artificial Sequence
  Description of Artificial Sequence: Synthetic oligonucleotide
gccaaagcagacatggcagacgaggct

SEQ ID NO: 344793 - DNA, 28 bp, Artificial Sequence
  Description of Artificial Sequence: Synthetic oligonucleotide
ccaaagcagacatggcagacgaggcttc

SEQ ID NO: 344794 - DNA, 28 bp, Artificial Sequence
  Description of Artificial Sequence: Synthetic oligonucleotide
caaagcagacatggcagacgaggcttcg

SEQ ID NO: 344795 - DNA, 28 bp, Artificial Sequence
  Description of Artificial Sequence: Synthetic oligonucleotide
aaagcagacatggcagacgaggcttcgg

SEQ ID NO: 344796 - DNA, 27 bp, Artificial Sequence
  Description of Artificial Sequence: Synthetic oligonucleotide
aagcagacatggcagacgaggcttcgg

SEQ ID NO: 344797 - DNA, 26 bp, Artificial Sequence
  Description of Artificial Sequence: Synthetic oligonucleotide
agcagacatggcagacgaggcttcgg

SEQ ID NO: 344798 - DNA, 25 bp, Artificial Sequence
  Description of Artificial Sequence: Synthetic oligonucleotide
gcagacatggcagacgaggcttcgg

SEQ ID NO: 344799 - DNA, 25 bp, Artificial Sequence
  Description of Artificial Sequence: Synthetic oligonucleotide
cagacatggcagacgaggcttcggg

SEQ ID NO: 344800 - DNA, 26 bp, Artificial Sequence
  Description of Artificial Sequence: Synthetic oligonucleotide
agacatggcagacgaggcttcgggct

SEQ ID NO: 344801 - DNA, 25 bp, Artificial Sequence
  Description of Artificial Sequence: Synthetic oligonucleotide
gacatggcagacgaggcttcgggct

SEQ ID NO: 344802 - DNA, 25 bp, Artificial Sequence
  Description of Artificial Sequence: Synthetic oligonucleotide
acatggcagacgaggcttcgggctg

SEQ ID NO: 344803 - DNA, 24 bp, Artificial Sequence
  Description of Artificial Sequence: Synthetic oligonucleotide
catggcagacgaggcttcgggctg

SEQ ID NO: 344804 - DNA, 24 bp, Artificial Sequence
  Description of Artificial Sequence: Synthetic oligonucleotide
atggcagacgaggcttcgggctgg

SEQ ID NO: 344805 - DNA, 23 bp, Artificial Sequence
  Description of Artificial Sequence: Synthetic oligonucleotide
tggcagacgaggcttcgggctgg

SEQ ID NO: 344806 - DNA, 22 bp, Artificial Sequence
  Description of Artificial Sequence: Synthetic oligonucleotide
ggcagacgaggcttcgggctgg

SEQ ID NO: 344807 - DNA, 23 bp, Artificial Sequence
  Description of Artificial Sequence: Synthetic oligonucleotide
gcagacgaggcttcgggctggct

SEQ ID NO: 344808 - DNA, 24 bp, Artificial Sequence
  Description of Artificial Sequence: Synthetic oligonucleotide
cagacgaggcttcgggctggctca

SEQ ID NO: 344809 - DNA, 24 bp, Artificial Sequence
  Description of Artificial Sequence: Synthetic oligonucleotide
agacgaggcttcgggctggctcac

SEQ ID NO: 344810 - DNA, 23 bp, Artificial Sequence
  Description of Artificial Sequence: Synthetic oligonucleotide
gacgaggcttcgggctggctcac

SEQ ID NO: 344811 - DNA, 23 bp, Artificial Sequence
  Description of Artificial Sequence: Synthetic oligonucleotide
acgaggcttcgggctggctcacg

SEQ ID NO: 344812 - DNA, 22 bp, Artificial Sequence
  Description of Artificial Sequence: Synthetic oligonucleotide
cgaggcttcgggctggctcacg

SEQ ID NO: 344813 - DNA, 22 bp, Artificial Sequence
  Description of Artificial Sequence: Synthetic oligonucleotide
gaggcttcgggctggctcacgc

SEQ ID NO: 344814 - DNA, 23 bp, Artificial Sequence
  Description of Artificial Sequence: Synthetic oligonucleotide
aggcttcgggctggctcacgcgt

SEQ ID NO: 344815 - DNA, 22 bp, Artificial Sequence
  Description of Artificial Sequence: Synthetic oligonucleotide
ggcttcgggctggctcacgcgt

SEQ ID NO: 344816 - DNA, 23 bp, Artificial Sequence
  Description of Artificial Sequence: Synthetic oligonucleotide
gcttcgggctggctcacgcgtca

SEQ ID NO: 344817 - DNA, 23 bp, Artificial Sequence
  Description of Artificial Sequence: Synthetic oligonucleotide
cttcgggctggctcacgcgtcag

SEQ ID NO: 344818 - DNA, 23 bp, Artificial Sequence
  Description of Artificial Sequence: Synthetic oligonucleotide
ttcgggctggctcacgcgtcagg

SEQ ID NO: 344819 - DNA, 22 bp, Artificial Sequence
  Description of Artificial Sequence: Synthetic oligonucleotide
tcgggctggctcacgcgtcagg

SEQ ID NO: 344820 - DNA, 21 bp, Artificial Sequence
  Description of Artificial Sequence: Synthetic oligonucleotide
cgggctggctcacgcgtcagg

SEQ ID NO: 344821 - DNA, 21 bp, Artificial Sequence
  Description of Artificial Sequence: Synthetic oligonucleotide
gggctggctcacgcgtcaggg

SEQ ID NO: 344822 - DNA, 22 bp, Artificial Sequence
  Description of Artificial Sequence: Synthetic oligonucleotide
ggctggctcacgcgtcagggct

SEQ ID NO: 344823 - DNA, 22 bp, Artificial Sequence
  Description of Artificial Sequence: Synthetic oligonucleotide
gctggctcacgcgtcagggctg

SEQ ID NO: 344824 - DNA, 24 bp, Artificial Sequence
  Description of Artificial Sequence: Synthetic oligonucleotide
ctggctcacgcgtcagggctgctt

SEQ ID NO: 344825 - DNA, 24 bp, Artificial Sequence
  Description of Artificial Sequence: Synthetic oligonucleotide
tggctcacgcgtcagggctgcttc

SEQ ID NO: 344826 - DNA, 23 bp, Artificial Sequence
  Description of Artificial Sequence: Synthetic oligonucleotide
ggctcacgcgtcagggctgcttc

SEQ ID NO: 344827 - DNA, 25 bp, Artificial Sequence
  Description of Artificial Sequence: Synthetic oligonucleotide
gctcacgcgtcagggctgcttccaa

SEQ ID NO: 344828 - DNA, 25 bp, Artificial Sequence
  Description of Artificial Sequence: Synthetic oligonucleotide
ctcacgcgtcagggctgcttccaag

SEQ ID NO: 344829 - DNA, 25 bp, Artificial Sequence
  Description of Artificial Sequence: Synthetic oligonucleotide
tcacgcgtcagggctgcttccaagc

SEQ ID NO: 344830 - DNA, 24 bp, Artificial Sequence
  Description of Artificial Sequence: Synthetic oligonucleotide
cacgcgtcagggctgcttccaagc

SEQ ID NO: 344831 - DNA, 24 bp, Artificial Sequence
  Description of Artificial Sequence: Synthetic oligonucleotide
acgcgtcagggctgcttccaagcg

SEQ ID NO: 344832 - DNA, 23 bp, Artificial Sequence
  Description of Artificial Sequence: Synthetic oligonucleotide
cgcgtcagggctgcttccaagcg

SEQ ID NO: 344833 - DNA, 23 bp, Artificial Sequence
  Description of Artificial Sequence: Synthetic oligonucleotide
gcgtcagggctgcttccaagcgg

SEQ ID NO: 344834 - DNA, 26 bp, Artificial Sequence
  Description of Artificial Sequence: Synthetic oligonucleotide
cgtcagggctgcttccaagcgggatt

SEQ ID NO: 344835 - DNA, 26 bp, Artificial Sequence
  Description of Artificial Sequence: Synthetic oligonucleotide
gtcagggctgcttccaagcgggattc

SEQ ID NO: 344836 - DNA, 26 bp, Artificial Sequence
  Description of Artificial Sequence: Synthetic oligonucleotide
tcagggctgcttccaagcgggattcc

SEQ ID NO: 344837 - DNA, 25 bp, Artificial Sequence
  Description of Artificial Sequence: Synthetic oligonucleotide
cagggctgcttccaagcgggattcc

SEQ ID NO: 344838 - DNA, 25 bp, Artificial Sequence
  Description of Artificial Sequence: Synthetic oligonucleotide
agggctgcttccaagcgggattccg

SEQ ID NO: 344839 - DNA, 24 bp, Artificial Sequence
  Description of Artificial Sequence: Synthetic oligonucleotide
gggctgcttccaagcgggattccg

SEQ ID NO: 344840 - DNA, 25 bp, Artificial Sequence
  Description of Artificial Sequence: Synthetic oligonucleotide
ggctgcttccaagcgggattccgga

SEQ ID NO: 344841 - DNA, 27 bp, Artificial Sequence
  Description of Artificial Sequence: Synthetic oligonucleotide
gctgcttccaagcgggattccggagta

SEQ ID NO: 344842 - DNA, 27 bp, Artificial Sequence
  Description of Artificial Sequence: Synthetic oligonucleotide
ctgcttccaagcgggattccggagtac

SEQ ID NO: 344843 - DNA, 27 bp, Artificial Sequence
  Description of Artificial Sequence: Synthetic oligonucleotide
tgcttccaagcgggattccggagtacc

SEQ ID NO: 344844 - DNA, 26 bp, Artificial Sequence
  Description of Artificial Sequence: Synthetic oligonucleotide
gcttccaagcgggattccggagtacc

SEQ ID NO: 344845 - DNA, 27 bp, Artificial Sequence
  Description of Artificial Sequence: Synthetic oligonucleotide
cttccaagcgggattccggagtaccca

SEQ ID NO: 344846 - DNA, 28 bp, Artificial Sequence
  Description of Artificial Sequence: Synthetic oligonucleotide
ttccaagcgggattccggagtacccaac

SEQ ID NO: 344847 - DNA, 27 bp, Artificial Sequence
  Description of Artificial Sequence: Synthetic oligonucleotide
tccaagcgggattccggagtacccaac

SEQ ID NO: 344848 - DNA, 27 bp, Artificial Sequence
  Description of Artificial Sequence: Synthetic oligonucleotide
ccaagcgggattccggagtacccaaca

SEQ ID NO: 344849 - DNA, 27 bp, Artificial Sequence
  Description of Artificial Sequence: Synthetic oligonucleotide
caagcgggattccggagtacccaacac

SEQ ID NO: 344850 - DNA, 28 bp, Artificial Sequence
  Description of Artificial Sequence: Synthetic oligonucleotide
aagcgggattccggagtacccaacacac

SEQ ID NO: 344851 - DNA, 27 bp, Artificial Sequence
  Description of Artificial Sequence: Synthetic oligonucleotide
agcgggattccggagtacccaacacac

SEQ ID NO: 344852 - DNA, 26 bp, Artificial Sequence
  Description of Artificial Sequence: Synthetic oligonucleotide
gcgggattccggagtacccaacacac

SEQ ID NO: 344853 - DNA, 26 bp, Artificial Sequence
  Description of Artificial Sequence: Synthetic oligonucleotide
cgggattccggagtacccaacacacg

SEQ ID NO: 344854 - DNA, 27 bp, Artificial Sequence
  Description of Artificial Sequence: Synthetic oligonucleotide
gggattccggagtacccaacacacggt

SEQ ID NO: 344855 - DNA, 27 bp, Artificial Sequence
  Description of Artificial Sequence: Synthetic oligonucleotide
ggattccggagtacccaacacacggtg

SEQ ID NO: 344856 - DNA, 30 bp, Artificial Sequence
  Description of Artificial Sequence: Synthetic oligonucleotide
gattccggagtacccaacacacggtgaatg

SEQ ID NO: 344857 - DNA, 30 bp, Artificial Sequence
  Description of Artificial Sequence: Synthetic oligonucleotide
attccggagtacccaacacacggtgaatgc

SEQ ID NO: 344858 - DNA, 29 bp, Artificial Sequence
  Description of Artificial Sequence: Synthetic oligonucleotide
ttccggagtacccaacacacggtgaatgc

SEQ ID NO: 344859 - DNA, 28 bp, Artificial Sequence
  Description of Artificial Sequence: Synthetic oligonucleotide
tccggagtacccaacacacggtgaatgc

SEQ ID NO: 344860 - DNA, 27 bp, Artificial Sequence
  Description of Artificial Sequence: Synthetic oligonucleotide
ccggagtacccaacacacggtgaatgc

SEQ ID NO: 344861 - DNA, 27 bp, Artificial Sequence
  Description of Artificial Sequence: Synthetic oligonucleotide
cggagtacccaacacacggtgaatgcc

SEQ ID NO: 344862 - DNA, 27 bp, Artificial Sequence
  Description of Artificial Sequence: Synthetic oligonucleotide
ggagtacccaacacacggtgaatgccc

SEQ ID NO: 344863 - DNA, 28 bp, Artificial Sequence
  Description of Artificial Sequence: Synthetic oligonucleotide
gagtacccaacacacggtgaatgccctg

SEQ ID NO: 344864 - DNA, 28 bp, Artificial Sequence
  Description of Artificial Sequence: Synthetic oligonucleotide
agtacccaacacacggtgaatgccctgg

SEQ ID NO: 344865 - DNA, 27 bp, Artificial Sequence
  Description of Artificial Sequence: Synthetic oligonucleotide
gtacccaacacacggtgaatgccctgg

SEQ ID NO: 344866 - DNA, 29 bp, Artificial Sequence
  Description of Artificial Sequence: Synthetic oligonucleotide
tacccaacacacggtgaatgccctggaag

SEQ ID NO: 344867 - DNA, 28 bp, Artificial Sequence
  Description of Artificial Sequence: Synthetic oligonucleotide
acccaacacacggtgaatgccctggaag

SEQ ID NO: 344868 - DNA, 27 bp, Artificial Sequence
  Description of Artificial Sequence: Synthetic oligonucleotide
cccaacacacggtgaatgccctggaag

SEQ ID NO: 344869 - DNA, 27 bp, Artificial Sequence
  Description of Artificial Sequence: Synthetic oligonucleotide
ccaacacacggtgaatgccctggaagc

SEQ ID NO: 344870 - DNA, 27 bp, Artificial Sequence
  Description of Artificial Sequence: Synthetic oligonucleotide
caacacacggtgaatgccctggaagcc

SEQ ID NO: 344871 - DNA, 27 bp, Artificial Sequence
  Description of Artificial Sequence: Synthetic oligonucleotide
aacacacggtgaatgccctggaagccc

SEQ ID NO: 344872 - DNA, 27 bp, Artificial Sequence
  Description of Artificial Sequence: Synthetic oligonucleotide
acacacggtgaatgccctggaagccct

SEQ ID NO: 344873 - DNA, 26 bp, Artificial Sequence
  Description of Artificial Sequence: Synthetic oligonucleotide
cacacggtgaatgccctggaagccct

SEQ ID NO: 344874 - DNA, 27 bp, Artificial Sequence
  Description of Artificial Sequence: Synthetic oligonucleotide
acacggtgaatgccctggaagccctgt

SEQ ID NO: 344875 - DNA, 26 bp, Artificial Sequence
  Description of Artificial Sequence: Synthetic oligonucleotide
cacggtgaatgccctggaagccctgt

SEQ ID NO: 344876 - DNA, 27 bp, Artificial Sequence
  Description of Artificial Sequence: Synthetic oligonucleotide
acggtgaatgccctggaagccctgtct

SEQ ID NO: 344877 - DNA, 26 bp, Artificial Sequence
  Description of Artificial Sequence: Synthetic oligonucleotide
cggtgaatgccctggaagccctgtct

SEQ ID NO: 344878 - DNA, 26 bp, Artificial Sequence
  Description of Artificial Sequence: Synthetic oligonucleotide
ggtgaatgccctggaagccctgtctc

SEQ ID NO: 344879 - DNA, 26 bp, Artificial Sequence
  Description of Artificial Sequence: Synthetic oligonucleotide
gtgaatgccctggaagccctgtctcc

SEQ ID NO: 344880 - DNA, 27 bp, Artificial Sequence
  Description of Artificial Sequence: Synthetic oligonucleotide
tgaatgccctggaagccctgtctccct

SEQ ID NO: 344881 - DNA, 27 bp, Artificial Sequence
  Description of Artificial Sequence: Synthetic oligonucleotide
gaatgccctggaagccctgtctcccta

SEQ ID NO: 344882 - DNA, 27 bp, Artificial Sequence
  Description of Artificial Sequence: Synthetic oligonucleotide
aatgccctggaagccctgtctccctac

SEQ ID NO: 344883 - DNA, 27 bp, Artificial Sequence
  Description of Artificial Sequence: Synthetic oligonucleotide
atgccctggaagccctgtctccctact

SEQ ID NO: 344884 - DNA, 26 bp, Artificial Sequence
  Description of Artificial Sequence: Synthetic oligonucleotide
tgccctggaagccctgtctccctact

SEQ ID NO: 344885 - DNA, 25 bp, Artificial Sequence
  Description of Artificial Sequence: Synthetic oligonucleotide
gccctggaagccctgtctccctact

SEQ ID NO: 344886 - DNA, 25 bp, Artificial Sequence
  Description of Artificial Sequence: Synthetic oligonucleotide
ccctggaagccctgtctccctactg

SEQ ID NO: 344887 - DNA, 27 bp, Artificial Sequence
  Description of Artificial Sequence: Synthetic oligonucleotide
cctggaagccctgtctccctactggaa

SEQ ID NO: 344888 - DNA, 28 bp, Artificial Sequence
  Description of Artificial Sequence: Synthetic oligonucleotide
ctggaagccctgtctccctactggaatg

SEQ ID NO: 344889 - DNA, 28 bp, Artificial Sequence
  Description of Artificial Sequence: Synthetic oligonucleotide
tggaagccctgtctccctactggaatgc

SEQ ID NO: 344890 - DNA, 27 bp, Artificial Sequence
  Description of Artificial Sequence: Synthetic oligonucleotide
ggaagccctgtctccctactggaatgc

SEQ ID NO: 344891 - DNA, 27 bp, Artificial Sequence
  Description of Artificial Sequence: Synthetic oligonucleotide
gaagccctgtctccctactggaatgcc

SEQ ID NO: 344892 - DNA, 28 bp, Artificial Sequence
  Description of Artificial Sequence: Synthetic oligonucleotide
aagccctgtctccctactggaatgcctc

SEQ ID NO: 344893 - DNA, 27 bp, Artificial Sequence
  Description of Artificial Sequence: Synthetic oligonucleotide
agccctgtctccctactggaatgcctc

SEQ ID NO: 344894 - DNA, 26 bp, Artificial Sequence
  Description of Artificial Sequence: Synthetic oligonucleotide
gccctgtctccctactggaatgcctc

SEQ ID NO: 344895 - DNA, 26 bp, Artificial Sequence
  Description of Artificial Sequence: Synthetic oligonucleotide
ccctgtctccctactggaatgcctcc

SEQ ID NO: 344896 - DNA, 27 bp, Artificial Sequence
  Description of Artificial Sequence: Synthetic oligonucleotide
cctgtctccctactggaatgcctccca

SEQ ID NO: 344897 - DNA, 27 bp, Artificial Sequence
  Description of Artificial Sequence: Synthetic oligonucleotide
ctgtctccctactggaatgcctcccag

SEQ ID NO: 344898 - DNA, 28 bp, Artificial Sequence
  Description of Artificial Sequence: Synthetic oligonucleotide
tgtctccctactggaatgcctcccagac

SEQ ID NO: 344899 - DNA, 27 bp, Artificial Sequence
  Description of Artificial Sequence: Synthetic oligonucleotide
gtctccctactggaatgcctcccagac

SEQ ID NO: 344900 - DNA, 27 bp, Artificial Sequence
  Description of Artificial Sequence: Synthetic oligonucleotide
tctccctactggaatgcctcccagacc

SEQ ID NO: 344901 - DNA, 27 bp, Artificial Sequence
  Description of Artificial Sequence: Synthetic oligonucleotide
ctccctactggaatgcctcccagacca

SEQ ID NO: 344902 - DNA, 27 bp, Artificial Sequence
  Description of Artificial Sequence: Synthetic oligonucleotide
tccctactggaatgcctcccagaccac

SEQ ID NO: 344903 - DNA, 27 bp, Artificial Sequence
  Description of Artificial Sequence: Synthetic oligonucleotide
ccctactggaatgcctcccagaccact

SEQ ID NO: 344904 - DNA, 27 bp, Artificial Sequence
  Description of Artificial Sequence: Synthetic oligonucleotide
cctactggaatgcctcccagaccactg

SEQ ID NO: 344905 - DNA, 28 bp, Artificial Sequence
  Description of Artificial Sequence: Synthetic oligonucleotide
ctactggaatgcctcccagaccactgag

SEQ ID NO: 344906 - DNA, 28 bp, Artificial Sequence
  Description of Artificial Sequence: Synthetic oligonucleotide
tactggaatgcctcccagaccactgagc

SEQ ID NO: 344907 - DNA, 27 bp, Artificial Sequence
  Description of Artificial Sequence: Synthetic oligonucleotide
actggaatgcctcccagaccactgagc

SEQ ID NO: 344908 - DNA, 27 bp, Artificial Sequence
  Description of Artificial Sequence: Synthetic oligonucleotide
ctggaatgcctcccagaccactgagca

SEQ ID NO: 344909 - DNA, 27 bp, Artificial Sequence
  Description of Artificial Sequence: Synthetic oligonucleotide
tggaatgcctcccagaccactgagcag

SEQ ID NO: 344910 - DNA, 27 bp, Artificial Sequence
  Description of Artificial Sequence: Synthetic oligonucleotide
ggaatgcctcccagaccactgagcaga

SEQ ID NO: 344911 - DNA, 27 bp, Artificial Sequence
  Description of Artificial Sequence: Synthetic oligonucleotide
gaatgcctcccagaccactgagcagag

SEQ ID NO: 344912 - DNA, 27 bp, Artificial Sequence
  Description of Artificial Sequence: Synthetic oligonucleotide
aatgcctcccagaccactgagcagagg

SEQ ID NO: 344913 - DNA, 26 bp, Artificial Sequence
  Description of Artificial Sequence: Synthetic oligonucleotide
atgcctcccagaccactgagcagagg

SEQ ID NO: 344914 - DNA, 25 bp, Artificial Sequence
  Description of Artificial Sequence: Synthetic oligonucleotide
tgcctcccagaccactgagcagagg

SEQ ID NO: 344915 - DNA, 24 bp, Artificial Sequence
  Description of Artificial Sequence: Synthetic oligonucleotide
gcctcccagaccactgagcagagg

SEQ ID NO: 344916 - DNA, 24 bp, Artificial Sequence
  Description of Artificial Sequence: Synthetic oligonucleotide
cctcccagaccactgagcagaggg

SEQ ID NO: 344917 - DNA, 25 bp, Artificial Sequence
  Description of Artificial Sequence: Synthetic oligonucleotide
ctcccagaccactgagcagaggggt

SEQ ID NO: 344918 - DNA, 26 bp, Artificial Sequence
  Description of Artificial Sequence: Synthetic oligonucleotide
tcccagaccactgagcagaggggtca

SEQ ID NO: 344919 - DNA, 25 bp, Artificial Sequence
  Description of Artificial Sequence: Synthetic oligonucleotide
cccagaccactgagcagaggggtca

SEQ ID NO: 344920 - DNA, 27 bp, Artificial Sequence
  Description of Artificial Sequence: Synthetic oligonucleotide
ccagaccactgagcagaggggtcacaa

SEQ ID NO: 344921 - DNA, 28 bp, Artificial Sequence
  Description of Artificial Sequence: Synthetic oligonucleotide
cagaccactgagcagaggggtcacaatg

SEQ ID NO: 344922 - DNA, 29 bp, Artificial Sequence
  Description of Artificial Sequence: Synthetic oligonucleotide
agaccactgagcagaggggtcacaatgtg

SEQ ID NO: 344923 - DNA, 28 bp, Artificial Sequence
  Description of Artificial Sequence: Synthetic oligonucleotide
gaccactgagcagaggggtcacaatgtg

SEQ ID NO: 344924 - DNA, 29 bp, Artificial Sequence
  Description of Artificial Sequence: Synthetic oligonucleotide
accactgagcagaggggtcacaatgtgac

SEQ ID NO: 344925 - DNA, 28 bp, Artificial Sequence
  Description of Artificial Sequence: Synthetic oligonucleotide
ccactgagcagaggggtcacaatgtgac

SEQ ID NO: 344926 - DNA, 29 bp, Artificial Sequence
  Description of Artificial Sequence: Synthetic oligonucleotide
cactgagcagaggggtcacaatgtgacac

SEQ ID NO: 344927 - DNA, 30 bp, Artificial Sequence
  Description of Artificial Sequence: Synthetic oligonucleotide
actgagcagaggggtcacaatgtgacactc

SEQ ID NO: 344928 - DNA, 29 bp, Artificial Sequence
  Description of Artificial Sequence: Synthetic oligonucleotide
ctgagcagaggggtcacaatgtgacactc

SEQ ID NO: 344929 - DNA, 30 bp, Artificial Sequence
  Description of Artificial Sequence: Synthetic oligonucleotide
tgagcagaggggtcacaatgtgacactcag

SEQ ID NO: 344930 - DNA, 29 bp, Artificial Sequence
  Description of Artificial Sequence: Synthetic oligonucleotide
gagcagaggggtcacaatgtgacactcag

SEQ ID NO: 344931 - DNA, 29 bp, Artificial Sequence
  Description of Artificial Sequence: Synthetic oligonucleotide
agcagaggggtcacaatgtgacactcagc

SEQ ID NO: 344932 - DNA, 28 bp, Artificial Sequence
  Description of Artificial Sequence: Synthetic oligonucleotide
gcagaggggtcacaatgtgacactcagc

SEQ ID NO: 344933 - DNA, 29 bp, Artificial Sequence
  Description of Artificial Sequence: Synthetic oligonucleotide
cagaggggtcacaatgtgacactcagctc

SEQ ID NO: 344934 - DNA, 29 bp, Artificial Sequence
  Description of Artificial Sequence: Synthetic oligonucleotide
agaggggtcacaatgtgacactcagctcc

SEQ ID NO: 344935 - DNA, 28 bp, Artificial Sequence
  Description of Artificial Sequence: Synthetic oligonucleotide
gaggggtcacaatgtgacactcagctcc

SEQ ID NO: 344936 - DNA, 29 bp, Artificial Sequence
  Description of Artificial Sequence: Synthetic oligonucleotide
aggggtcacaatgtgacactcagctcctc

SEQ ID NO: 344937 - DNA, 28 bp, Artificial Sequence
  Description of Artificial Sequence: Synthetic oligonucleotide
ggggtcacaatgtgacactcagctcctc

SEQ ID NO: 344938 - DNA, 29 bp, Artificial Sequence
  Description of Artificial Sequence: Synthetic oligonucleotide
gggtcacaatgtgacactcagctcctcag

SEQ ID NO: 344939 - DNA, 29 bp, Artificial Sequence
  Description of Artificial Sequence: Synthetic oligonucleotide
ggtcacaatgtgacactcagctcctcagg

SEQ ID NO: 344940 - DNA, 29 bp, Artificial Sequence
  Description of Artificial Sequence: Synthetic oligonucleotide
gtcacaatgtgacactcagctcctcaggc

SEQ ID NO: 344941 - DNA, 29 bp, Artificial Sequence
  Description of Artificial Sequence: Synthetic oligonucleotide
tcacaatgtgacactcagctcctcaggcc

SEQ ID NO: 344942 - DNA, 28 bp, Artificial Sequence
  Description of Artificial Sequence: Synthetic oligonucleotide
cacaatgtgacactcagctcctcaggcc

SEQ ID NO: 344943 - DNA, 28 bp, Artificial Sequence
  Description of Artificial Sequence: Synthetic oligonucleotide
acaatgtgacactcagctcctcaggccg

SEQ ID NO: 344944 - DNA, 27 bp, Artificial Sequence
  Description of Artificial Sequence: Synthetic oligonucleotide
caatgtgacactcagctcctcaggccg

SEQ ID NO: 344945 - DNA, 27 bp, Artificial Sequence
  Description of Artificial Sequence: Synthetic oligonucleotide
aatgtgacactcagctcctcaggccgg

SEQ ID NO: 344946 - DNA, 27 bp, Artificial Sequence
  Description of Artificial Sequence: Synthetic oligonucleotide
atgtgacactcagctcctcaggccgga

SEQ ID NO: 344947 - DNA, 27 bp, Artificial Sequence
  Description of Artificial Sequence: Synthetic oligonucleotide
tgtgacactcagctcctcaggccggat

SEQ ID NO: 344948 - DNA, 27 bp, Artificial Sequence
  Description of Artificial Sequence: Synthetic oligonucleotide
gtgacactcagctcctcaggccggatt

SEQ ID NO: 344949 - DNA, 27 bp, Artificial Sequence
  Description of Artificial Sequence: Synthetic oligonucleotide
tgacactcagctcctcaggccggattg

SEQ ID NO: 344950 - DNA, 26 bp, Artificial Sequence
  Description of Artificial Sequence: Synthetic oligonucleotide
gacactcagctcctcaggccggattg

SEQ ID NO: 344951 - DNA, 26 bp, Artificial Sequence
  Description of Artificial Sequence: Synthetic oligonucleotide
acactcagctcctcaggccggattgg

SEQ ID NO: 344952 - DNA, 25 bp, Artificial Sequence
  Description of Artificial Sequence: Synthetic oligonucleotide
cactcagctcctcaggccggattgg

SEQ ID NO: 344953 - DNA, 27 bp, Artificial Sequence
  Description of Artificial Sequence: Synthetic oligonucleotide
actcagctcctcaggccggattgggtt

SEQ ID NO: 344954 - DNA, 26 bp, Artificial Sequence
  Description of Artificial Sequence: Synthetic oligonucleotide
ctcagctcctcaggccggattgggtt

SEQ ID NO: 344955 - DNA, 27 bp, Artificial Sequence
  Description of Artificial Sequence: Synthetic oligonucleotide
tcagctcctcaggccggattgggttca

SEQ ID NO: 344956 - DNA, 27 bp, Artificial Sequence
  Description of Artificial Sequence: Synthetic oligonucleotide
cagctcctcaggccggattgggttcaa

SEQ ID NO: 344957 - DNA, 27 bp, Artificial Sequence
  Description of Artificial Sequence: Synthetic oligonucleotide
agctcctcaggccggattgggttcaac

SEQ ID NO: 344958 - DNA, 27 bp, Artificial Sequence
  Description of Artificial Sequence: Synthetic oligonucleotide
gctcctcaggccggattgggttcaact

SEQ ID NO: 344959 - DNA, 27 bp, Artificial Sequence
  Description of Artificial Sequence: Synthetic oligonucleotide
ctcctcaggccggattgggttcaactc

SEQ ID NO: 344960 - DNA, 27 bp, Artificial Sequence
  Description of Artificial Sequence: Synthetic oligonucleotide
tcctcaggccggattgggttcaactcc

SEQ ID NO: 344961 - DNA, 26 bp, Artificial Sequence
  Description of Artificial Sequence: Synthetic oligonucleotide
cctcaggccggattgggttcaactcc

SEQ ID NO: 344962 - DNA, 27 bp, Artificial Sequence
  Description of Artificial Sequence: Synthetic oligonucleotide
ctcaggccggattgggttcaactccca

SEQ ID NO: 344963 - DNA, 27 bp, Artificial Sequence
  Description of Artificial Sequence: Synthetic oligonucleotide
tcaggccggattgggttcaactcccac

SEQ ID NO: 344964 - DNA, 26 bp, Artificial Sequence
  Description of Artificial Sequence: Synthetic oligonucleotide
caggccggattgggttcaactcccac

SEQ ID NO: 344965 - DNA, 26 bp, Artificial Sequence
  Description of Artificial Sequence: Synthetic oligonucleotide
aggccggattgggttcaactcccacg

SEQ ID NO: 344966 - DNA, 25 bp, Artificial Sequence
  Description of Artificial Sequence: Synthetic oligonucleotide
ggccggattgggttcaactcccacg

SEQ ID NO: 344967 - DNA, 25 bp, Artificial Sequence
  Description of Artificial Sequence: Synthetic oligonucleotide
gccggattgggttcaactcccacgc

SEQ ID NO: 344968 - DNA, 25 bp, Artificial Sequence
  Description of Artificial Sequence: Synthetic oligonucleotide
ccggattgggttcaactcccacgcg

SEQ ID NO: 344969 - DNA, 26 bp, Artificial Sequence
  Description of Artificial Sequence: Synthetic oligonucleotide
cggattgggttcaactcccacgcggt

SEQ ID NO: 344970 - DNA, 26 bp, Artificial Sequence
  Description of Artificial Sequence: Synthetic oligonucleotide
ggattgggttcaactcccacgcggtg

SEQ ID NO: 344971 - DNA, 27 bp, Artificial Sequence
  Description of Artificial Sequence: Synthetic oligonucleotide
gattgggttcaactcccacgcggtgca

SEQ ID NO: 344972 - DNA, 27 bp, Artificial Sequence
  Description of Artificial Sequence: Synthetic oligonucleotide
attgggttcaactcccacgcggtgcag

SEQ ID NO: 344973 - DNA, 26 bp, Artificial Sequence
  Description of Artificial Sequence: Synthetic oligonucleotide
ttgggttcaactcccacgcggtgcag

SEQ ID NO: 344974 - DNA, 25 bp, Artificial Sequence
  Description of Artificial Sequence: Synthetic oligonucleotide
tgggttcaactcccacgcggtgcag

SEQ ID NO: 344975 - DNA, 24 bp, Artificial Sequence
  Description of Artificial Sequence: Synthetic oligonucleotide
gggttcaactcccacgcggtgcag

SEQ ID NO: 344976 - DNA, 25 bp, Artificial Sequence
  Description of Artificial Sequence: Synthetic oligonucleotide
ggttcaactcccacgcggtgcagct

SEQ ID NO: 344977 - DNA, 27 bp, Artificial Sequence
  Description of Artificial Sequence: Synthetic oligonucleotide
gttcaactcccacgcggtgcagctgat

SEQ ID NO: 344978 - DNA, 27 bp, Artificial Sequence
  Description of Artificial Sequence: Synthetic oligonucleotide
ttcaactcccacgcggtgcagctgatc

SEQ ID NO: 344979 - DNA, 27 bp, Artificial Sequence
  Description of Artificial Sequence: Synthetic oligonucleotide
tcaactcccacgcggtgcagctgatca

SEQ ID NO: 344980 - DNA, 27 bp, Artificial Sequence
  Description of Artificial Sequence: Synthetic oligonucleotide
caactcccacgcggtgcagctgatcaa

SEQ ID NO: 344981 - DNA, 27 bp, Artificial Sequence
  Description of Artificial Sequence: Synthetic oligonucleotide
aactcccacgcggtgcagctgatcaac

SEQ ID NO: 344982 - DNA, 26 bp, Artificial Sequence
  Description of Artificial Sequence: Synthetic oligonucleotide
actcccacgcggtgcagctgatcaac

SEQ ID NO: 344983 - DNA, 25 bp, Artificial Sequence
  Description of Artificial Sequence: Synthetic oligonucleotide
ctcccacgcggtgcagctgatcaac

SEQ ID NO: 344984 - DNA, 25 bp, Artificial Sequence
  Description of Artificial Sequence: Synthetic oligonucleotide
tcccacgcggtgcagctgatcaacc

SEQ ID NO: 344985 - DNA, 24 bp, Artificial Sequence
  Description of Artificial Sequence: Synthetic oligonucleotide
cccacgcggtgcagctgatcaacc

SEQ ID NO: 344986 - DNA, 24 bp, Artificial Sequence
  Description of Artificial Sequence: Synthetic oligonucleotide
ccacgcggtgcagctgatcaaccg

SEQ ID NO: 344987 - DNA, 24 bp, Artificial Sequence
  Description of Artificial Sequence: Synthetic oligonucleotide
cacgcggtgcagctgatcaaccgc

SEQ ID NO: 344988 - DNA, 25 bp, Artificial Sequence
  Description of Artificial Sequence: Synthetic oligonucleotide
acgcggtgcagctgatcaaccgcca

SEQ ID NO: 344989 - DNA, 24 bp, Artificial Sequence
  Description of Artificial Sequence: Synthetic oligonucleotide
cgcggtgcagctgatcaaccgcca

SEQ ID NO: 344990 - DNA, 27 bp, Artificial Sequence
  Description of Artificial Sequence: Synthetic oligonucleotide
gcggtgcagctgatcaaccgccacatt

SEQ ID NO: 344991 - DNA, 27 bp, Artificial Sequence
  Description of Artificial Sequence: Synthetic oligonucleotide
cggtgcagctgatcaaccgccacattc

SEQ ID NO: 344992 - DNA, 27 bp, Artificial Sequence
  Description of Artificial Sequence: Synthetic oligonucleotide
ggtgcagctgatcaaccgccacattcg

SEQ ID NO: 344993 - DNA, 27 bp, Artificial Sequence
  Description of Artificial Sequence: Synthetic oligonucleotide
gtgcagctgatcaaccgccacattcgc

SEQ ID NO: 344994 - DNA, 27 bp, Artificial Sequence
  Description of Artificial Sequence: Synthetic oligonucleotide
tgcagctgatcaaccgccacattcgcg

SEQ ID NO: 344995 - DNA, 26 bp, Artificial Sequence
  Description of Artificial Sequence: Synthetic oligonucleotide
gcagctgatcaaccgccacattcgcg

SEQ ID NO: 344996 - DNA, 26 bp, Artificial Sequence
  Description of Artificial Sequence: Synthetic oligonucleotide
cagctgatcaaccgccacattcgcgg

SEQ ID NO: 344997 - DNA, 26 bp, Artificial Sequence
  Description of Artificial Sequence: Synthetic oligonucleotide
agctgatcaaccgccacattcgcggc

SEQ ID NO: 344998 - DNA, 25 bp, Artificial Sequence
  Description of Artificial Sequence: Synthetic oligonucleotide
gctgatcaaccgccacattcgcggc

SEQ ID NO: 344999 - DNA, 26 bp, Artificial Sequence
  Description of Artificial Sequence: Synthetic oligonucleotide
ctgatcaaccgccacattcgcggcgt

SEQ ID NO: 345000 - DNA, 26 bp, Artificial Sequence
  Description of Artificial Sequence: Synthetic oligonucleotide
tgatcaaccgccacattcgcggcgtg

SEQ ID NO: 345001 - DNA, 25 bp, Artificial Sequence
  Description of Artificial Sequence: Synthetic oligonucleotide
gatcaaccgccacattcgcggcgtg

SEQ ID NO: 345002 - DNA, 26 bp, Artificial Sequence
  Description of Artificial Sequence: Synthetic oligonucleotide
atcaaccgccacattcgcggcgtgga

SEQ ID NO: 345003 - DNA, 25 bp, Artificial Sequence
  Description of Artificial Sequence: Synthetic oligonucleotide
tcaaccgccacattcgcggcgtgga

SEQ ID NO: 345004 - DNA, 24 bp, Artificial Sequence
  Description of Artificial Sequence: Synthetic oligonucleotide
caaccgccacattcgcggcgtgga

SEQ ID NO: 345005 - DNA, 24 bp, Artificial Sequence
  Description of Artificial Sequence: Synthetic oligonucleotide
aaccgccacattcgcggcgtggag

SEQ ID NO: 345006 - DNA, 23 bp, Artificial Sequence
  Description of Artificial Sequence: Synthetic oligonucleotide
accgccacattcgcggcgtggag

SEQ ID NO: 345007 - DNA, 22 bp, Artificial Sequence
  Description of Artificial Sequence: Synthetic oligonucleotide
ccgccacattcgcggcgtggag

SEQ ID NO: 345008 - DNA, 23 bp, Artificial Sequence
  Description of Artificial Sequence: Synthetic oligonucleotide
cgccacattcgcggcgtggagga

SEQ ID NO: 345009 - DNA, 23 bp, Artificial Sequence
  Description of Artificial Sequence: Synthetic oligonucleotide
gccacattcgcggcgtggaggag

SEQ ID NO: 345010 - DNA, 24 bp, Artificial Sequence
  Description of Artificial Sequence: Synthetic oligonucleotide
ccacattcgcggcgtggaggaggt

SEQ ID NO: 345011 - DNA, 24 bp, Artificial Sequence
  Description of Artificial Sequence: Synthetic oligonucleotide
cacattcgcggcgtggaggaggtg

SEQ ID NO: 345012 - DNA, 25 bp, Artificial Sequence
  Description of Artificial Sequence: Synthetic oligonucleotide
acattcgcggcgtggaggaggtgct

SEQ ID NO: 345013 - DNA, 24 bp, Artificial Sequence
  Description of Artificial Sequence: Synthetic oligonucleotide
cattcgcggcgtggaggaggtgct

SEQ ID NO: 345014 - DNA, 24 bp, Artificial Sequence
  Description of Artificial Sequence: Synthetic oligonucleotide
attcgcggcgtggaggaggtgctg

SEQ ID NO: 345015 - DNA, 23 bp, Artificial Sequence
  Description of Artificial Sequence: Synthetic oligonucleotide
ttcgcggcgtggaggaggtgctg

SEQ ID NO: 345016 - DNA, 22 bp, Artificial Sequence
  Description of Artificial Sequence: Synthetic oligonucleotide
tcgcggcgtggaggaggtgctg

SEQ ID NO: 345017 - DNA, 21 bp, Artificial Sequence
  Description of Artificial Sequence: Synthetic oligonucleotide
cgcggcgtggaggaggtgctg

SEQ ID NO: 345018 - DNA, 22 bp, Artificial Sequence
  Description of Artificial Sequence: Synthetic oligonucleotide
gcggcgtggaggaggtgctgca

SEQ ID NO: 345019 - DNA, 26 bp, Artificial Sequence
  Description of Artificial Sequence: Synthetic oligonucleotide
cggcgtggaggaggtgctgcagttat

SEQ ID NO: 345020 - DNA, 26 bp, Artificial Sequence
  Description of Artificial Sequence: Synthetic oligonucleotide
ggcgtggaggaggtgctgcagttatc

SEQ ID NO: 345021 - DNA, 27 bp, Artificial Sequence
  Description of Artificial Sequence: Synthetic oligonucleotide
gcgtggaggaggtgctgcagttatcct

SEQ ID NO: 345022 - DNA, 28 bp, Artificial Sequence
  Description of Artificial Sequence: Synthetic oligonucleotide
cgtggaggaggtgctgcagttatccttg

SEQ ID NO: 345023 - DNA, 28 bp, Artificial Sequence
  Description of Artificial Sequence: Synthetic oligonucleotide
gtggaggaggtgctgcagttatccttgg

SEQ ID NO: 345024 - DNA, 28 bp, Artificial Sequence
  Description of Artificial Sequence: Synthetic oligonucleotide
tggaggaggtgctgcagttatccttggg

SEQ ID NO: 345025 - DNA, 27 bp, Artificial Sequence
  Description of Artificial Sequence: Synthetic oligonucleotide
ggaggaggtgctgcagttatccttggg

SEQ ID NO: 345026 - DNA, 27 bp, Artificial Sequence
  Description of Artificial Sequence: Synthetic oligonucleotide
gaggaggtgctgcagttatccttgggc

SEQ ID NO: 345027 - DNA, 28 bp, Artificial Sequence
  Description of Artificial Sequence: Synthetic oligonucleotide
aggaggtgctgcagttatccttgggctg

SEQ ID NO: 345028 - DNA, 27 bp, Artificial Sequence
  Description of Artificial Sequence: Synthetic oligonucleotide
ggaggtgctgcagttatccttgggctg

SEQ ID NO: 345029 - DNA, 27 bp, Artificial Sequence
  Description of Artificial Sequence: Synthetic oligonucleotide
gaggtgctgcagttatccttgggctgc

SEQ ID NO: 345030 - DNA, 29 bp, Artificial Sequence
  Description of Artificial Sequence: Synthetic oligonucleotide
aggtgctgcagttatccttgggctgcaag

SEQ ID NO: 345031 - DNA, 28 bp, Artificial Sequence
  Description of Artificial Sequence: Synthetic oligonucleotide
ggtgctgcagttatccttgggctgcaag

SEQ ID NO: 345032 - DNA, 30 bp, Artificial Sequence
  Description of Artificial Sequence: Synthetic oligonucleotide
gtgctgcagttatccttgggctgcaagatc

SEQ ID NO: 345033 - DNA, 33 bp, Artificial Sequence
  Description of Artificial Sequence: Synthetic oligonucleotide
tgctgcagttatccttgggctgcaagatcattg

SEQ ID NO: 345034 - DNA, 32 bp, Artificial Sequence
  Description of Artificial Sequence: Synthetic oligonucleotide
gctgcagttatccttgggctgcaagatcattg

SEQ ID NO: 345035 - DNA, 33 bp, Artificial Sequence
  Description of Artificial Sequence: Synthetic oligonucleotide
ctgcagttatccttgggctgcaagatcattgtg

SEQ ID NO: 345036 - DNA, 35 bp, Artificial Sequence
  Description of Artificial Sequence: Synthetic oligonucleotide
tgcagttatccttgggctgcaagatcattgtgaag

SEQ ID NO: 345037 - DNA, 34 bp, Artificial Sequence
  Description of Artificial Sequence: Synthetic oligonucleotide
gcagttatccttgggctgcaagatcattgtgaag

SEQ ID NO: 345038 - DNA, 34 bp, Artificial Sequence
  Description of Artificial Sequence: Synthetic oligonucleotide
cagttatccttgggctgcaagatcattgtgaagg

SEQ ID NO: 345039 - DNA, 35 bp, Artificial Sequence
  Description of Artificial Sequence: Synthetic oligonucleotide
agttatccttgggctgcaagatcattgtgaaggtc

SEQ ID NO: 345040 - DNA, 34 bp, Artificial Sequence
  Description of Artificial Sequence: Synthetic oligonucleotide
gttatccttgggctgcaagatcattgtgaaggtc

SEQ ID NO: 345041 - DNA, 34 bp, Artificial Sequence
  Description of Artificial Sequence: Synthetic oligonucleotide
ttatccttgggctgcaagatcattgtgaaggtcg

SEQ ID NO: 345042 - DNA, 33 bp, Artificial Sequence
  Description of Artificial Sequence: Synthetic oligonucleotide
tatccttgggctgcaagatcattgtgaaggtcg

SEQ ID NO: 345043 - DNA, 32 bp, Artificial Sequence
  Description of Artificial Sequence: Synthetic oligonucleotide
atccttgggctgcaagatcattgtgaaggtcg

SEQ ID NO: 345044 - DNA, 31 bp, Artificial Sequence
  Description of Artificial Sequence: Synthetic oligonucleotide
tccttgggctgcaagatcattgtgaaggtcg

SEQ ID NO: 345045 - DNA, 30 bp, Artificial Sequence
  Description of Artificial Sequence: Synthetic oligonucleotide
ccttgggctgcaagatcattgtgaaggtcg

SEQ ID NO: 345046 - DNA, 30 bp, Artificial Sequence
  Description of Artificial Sequence: Synthetic oligonucleotide
cttgggctgcaagatcattgtgaaggtcgg

SEQ ID NO: 345047 - DNA, 31 bp, Artificial Sequence
  Description of Artificial Sequence: Synthetic oligonucleotide
ttgggctgcaagatcattgtgaaggtcggag

SEQ ID NO: 345048 - DNA, 30 bp, Artificial Sequence
  Description of Artificial Sequence: Synthetic oligonucleotide
tgggctgcaagatcattgtgaaggtcggag

SEQ ID NO: 345049 - DNA, 29 bp, Artificial Sequence
  Description of Artificial Sequence: Synthetic oligonucleotide
gggctgcaagatcattgtgaaggtcggag

SEQ ID NO: 345050 - DNA, 29 bp, Artificial Sequence
  Description of Artificial Sequence: Synthetic oligonucleotide
ggctgcaagatcattgtgaaggtcggagg

SEQ ID NO: 345051 - DNA, 32 bp, Artificial Sequence
  Description of Artificial Sequence: Synthetic oligonucleotide
gctgcaagatcattgtgaaggtcggaggaaac

SEQ ID NO: 345052 - DNA, 33 bp, Artificial Sequence
  Description of Artificial Sequence: Synthetic oligonucleotide
ctgcaagatcattgtgaaggtcggaggaaactg

SEQ ID NO: 345053 - DNA, 33 bp, Artificial Sequence
  Description of Artificial Sequence: Synthetic oligonucleotide
tgcaagatcattgtgaaggtcggaggaaactgc

SEQ ID NO: 345054 - DNA, 32 bp, Artificial Sequence
  Description of Artificial Sequence: Synthetic oligonucleotide
gcaagatcattgtgaaggtcggaggaaactgc

SEQ ID NO: 345055 - DNA, 35 bp, Artificial Sequence
  Description of Artificial Sequence: Synthetic oligonucleotide
caagatcattgtgaaggtcggaggaaactgcaaag

SEQ ID NO: 345056 - DNA, 35 bp, Artificial Sequence
  Description of Artificial Sequence: Synthetic oligonucleotide
aagatcattgtgaaggtcggaggaaactgcaaagg

SEQ ID NO: 345057 - DNA, 34 bp, Artificial Sequence
  Description of Artificial Sequence: Synthetic oligonucleotide
agatcattgtgaaggtcggaggaaactgcaaagg

SEQ ID NO: 345058 - DNA, 33 bp, Artificial Sequence
  Description of Artificial Sequence: Synthetic oligonucleotide
gatcattgtgaaggtcggaggaaactgcaaagg

SEQ ID NO: 345059 - DNA, 35 bp, Artificial Sequence
  Description of Artificial Sequence: Synthetic oligonucleotide
atcattgtgaaggtcggaggaaactgcaaaggaag

SEQ ID NO: 345060 - DNA, 34 bp, Artificial Sequence
  Description of Artificial Sequence: Synthetic oligonucleotide
tcattgtgaaggtcggaggaaactgcaaaggaag

SEQ ID NO: 345061 - DNA, 33 bp, Artificial Sequence
  Description of Artificial Sequence: Synthetic oligonucleotide
cattgtgaaggtcggaggaaactgcaaaggaag

SEQ ID NO: 345062 - DNA, 33 bp, Artificial Sequence
  Description of Artificial Sequence: Synthetic oligonucleotide
attgtgaaggtcggaggaaactgcaaaggaagc

SEQ ID NO: 345063 - DNA, 32 bp, Artificial Sequence
  Description of Artificial Sequence: Synthetic oligonucleotide
ttgtgaaggtcggaggaaactgcaaaggaagc

SEQ ID NO: 345064 - DNA, 31 bp, Artificial Sequence
  Description of Artificial Sequence: Synthetic oligonucleotide
tgtgaaggtcggaggaaactgcaaaggaagc

SEQ ID NO: 345065 - DNA, 30 bp, Artificial Sequence
  Description of Artificial Sequence: Synthetic oligonucleotide
gtgaaggtcggaggaaactgcaaaggaagc

SEQ ID NO: 345066 - DNA, 30 bp, Artificial Sequence
  Description of Artificial Sequence: Synthetic oligonucleotide
tgaaggtcggaggaaactgcaaaggaagcc

SEQ ID NO: 345067 - DNA, 29 bp, Artificial Sequence
  Description of Artificial Sequence: Synthetic oligonucleotide
gaaggtcggaggaaactgcaaaggaagcc

SEQ ID NO: 345068 - DNA, 30 bp, Artificial Sequence
  Description of Artificial Sequence: Synthetic oligonucleotide
aaggtcggaggaaactgcaaaggaagcctg

SEQ ID NO: 345069 - DNA, 29 bp, Artificial Sequence
  Description of Artificial Sequence: Synthetic oligonucleotide
aggtcggaggaaactgcaaaggaagcctg

SEQ ID NO: 345070 - DNA, 28 bp, Artificial Sequence
  Description of Artificial Sequence: Synthetic oligonucleotide
ggtcggaggaaactgcaaaggaagcctg

SEQ ID NO: 345071 - DNA, 30 bp, Artificial Sequence
  Description of Artificial Sequence: Synthetic oligonucleotide
gtcggaggaaactgcaaaggaagcctgaag

SEQ ID NO: 345072 - DNA, 30 bp, Artificial Sequence
  Description of Artificial Sequence: Synthetic oligonucleotide
tcggaggaaactgcaaaggaagcctgaagg

SEQ ID NO: 345073 - DNA, 29 bp, Artificial Sequence
  Description of Artificial Sequence: Synthetic oligonucleotide
cggaggaaactgcaaaggaagcctgaagg

SEQ ID NO: 345074 - DNA, 30 bp, Artificial Sequence
  Description of Artificial Sequence: Synthetic oligonucleotide
ggaggaaactgcaaaggaagcctgaaggtg

SEQ ID NO: 345075 - DNA, 30 bp, Artificial Sequence
  Description of Artificial Sequence: Synthetic oligonucleotide
gaggaaactgcaaaggaagcctgaaggtgc

SEQ ID NO: 345076 - DNA, 32 bp, Artificial Sequence
  Description of Artificial Sequence: Synthetic oligonucleotide
aggaaactgcaaaggaagcctgaaggtgcttc

SEQ ID NO: 345077 - DNA, 31 bp, Artificial Sequence
  Description of Artificial Sequence: Synthetic oligonucleotide
ggaaactgcaaaggaagcctgaaggtgcttc

SEQ ID NO: 345078 - DNA, 31 bp, Artificial Sequence
  Description of Artificial Sequence: Synthetic oligonucleotide
gaaactgcaaaggaagcctgaaggtgcttcg

SEQ ID NO: 345079 - DNA, 33 bp, Artificial Sequence
  Description of Artificial Sequence: Synthetic oligonucleotide
aaactgcaaaggaagcctgaaggtgcttcgtac

SEQ ID NO: 345080 - DNA, 32 bp, Artificial Sequence
  Description of Artificial Sequence: Synthetic oligonucleotide
aactgcaaaggaagcctgaaggtgcttcgtac

SEQ ID NO: 345081 - DNA, 31 bp, Artificial Sequence
  Description of Artificial Sequence: Synthetic oligonucleotide
actgcaaaggaagcctgaaggtgcttcgtac

SEQ ID NO: 345082 - DNA, 30 bp, Artificial Sequence
  Description of Artificial Sequence: Synthetic oligonucleotide
ctgcaaaggaagcctgaaggtgcttcgtac

SEQ ID NO: 345083 - DNA, 30 bp, Artificial Sequence
  Description of Artificial Sequence: Synthetic oligonucleotide
tgcaaaggaagcctgaaggtgcttcgtacc

SEQ ID NO: 345084 - DNA, 29 bp, Artificial Sequence
  Description of Artificial Sequence: Synthetic oligonucleotide
gcaaaggaagcctgaaggtgcttcgtacc

SEQ ID NO: 345085 - DNA, 31 bp, Artificial Sequence
  Description of Artificial Sequence: Synthetic oligonucleotide
caaaggaagcctgaaggtgcttcgtaccaac

SEQ ID NO: 345086 - DNA, 34 bp, Artificial Sequence
  Description of Artificial Sequence: Synthetic oligonucleotide
aaaggaagcctgaaggtgcttcgtaccaacaatg

SEQ ID NO: 345087 - DNA, 33 bp, Artificial Sequence
  Description of Artificial Sequence: Synthetic oligonucleotide
aaggaagcctgaaggtgcttcgtaccaacaatg

SEQ ID NO: 345088 - DNA, 32 bp, Artificial Sequence
  Description of Artificial Sequence: Synthetic oligonucleotide
aggaagcctgaaggtgcttcgtaccaacaatg

SEQ ID NO: 345089 - DNA, 31 bp, Artificial Sequence
  Description of Artificial Sequence: Synthetic oligonucleotide
ggaagcctgaaggtgcttcgtaccaacaatg

SEQ ID NO: 345090 - DNA, 32 bp, Artificial Sequence
  Description of Artificial Sequence: Synthetic oligonucleotide
gaagcctgaaggtgcttcgtaccaacaatgtc

SEQ ID NO: 345091 - DNA, 32 bp, Artificial Sequence
  Description of Artificial Sequence: Synthetic oligonucleotide
aagcctgaaggtgcttcgtaccaacaatgtcc

SEQ ID NO: 345092 - DNA, 31 bp, Artificial Sequence
  Description of Artificial Sequence: Synthetic oligonucleotide
agcctgaaggtgcttcgtaccaacaatgtcc

SEQ ID NO: 345093 - DNA, 30 bp, Artificial Sequence
  Description of Artificial Sequence: Synthetic oligonucleotide
gcctgaaggtgcttcgtaccaacaatgtcc

SEQ ID NO: 345094 - DNA, 31 bp, Artificial Sequence
  Description of Artificial Sequence: Synthetic oligonucleotide
cctgaaggtgcttcgtaccaacaatgtccag

SEQ ID NO: 345095 - DNA, 31 bp, Artificial Sequence
  Description of Artificial Sequence: Synthetic oligonucleotide
ctgaaggtgcttcgtaccaacaatgtccagg

SEQ ID NO: 345096 - DNA, 32 bp, Artificial Sequence
  Description of Artificial Sequence: Synthetic oligonucleotide
tgaaggtgcttcgtaccaacaatgtccaggac

SEQ ID NO: 345097 - DNA, 31 bp, Artificial Sequence
  Description of Artificial Sequence: Synthetic oligonucleotide
gaaggtgcttcgtaccaacaatgtccaggac

SEQ ID NO: 345098 - DNA, 33 bp, Artificial Sequence
  Description of Artificial Sequence: Synthetic oligonucleotide
aaggtgcttcgtaccaacaatgtccaggacatg

SEQ ID NO: 345099 - DNA, 32 bp, Artificial Sequence
  Description of Artificial Sequence: Synthetic oligonucleotide
aggtgcttcgtaccaacaatgtccaggacatg

SEQ ID NO: 345100 - DNA, 31 bp, Artificial Sequence
  Description of Artificial Sequence: Synthetic oligonucleotide
ggtgcttcgtaccaacaatgtccaggacatg

SEQ ID NO: 345101 - DNA, 33 bp, Artificial Sequence
  Description of Artificial Sequence: Synthetic oligonucleotide
gtgcttcgtaccaacaatgtccaggacatgaac

SEQ ID NO: 345102 - DNA, 35 bp, Artificial Sequence
  Description of Artificial Sequence: Synthetic oligonucleotide
tgcttcgtaccaacaatgtccaggacatgaacaac

SEQ ID NO: 345103 - DNA, 34 bp, Artificial Sequence
  Description of Artificial Sequence: Synthetic oligonucleotide
gcttcgtaccaacaatgtccaggacatgaacaac

SEQ ID NO: 345104 - DNA, 35 bp, Artificial Sequence
  Description of Artificial Sequence: Synthetic oligonucleotide
cttcgtaccaacaatgtccaggacatgaacaacac

SEQ ID NO: 345105 - DNA, 35 bp, Artificial Sequence
  Description of Artificial Sequence: Synthetic oligonucleotide
ttcgtaccaacaatgtccaggacatgaacaacacg

SEQ ID NO: 345106 - DNA, 34 bp, Artificial Sequence
  Description of Artificial Sequence: Synthetic oligonucleotide
tcgtaccaacaatgtccaggacatgaacaacacg

SEQ ID NO: 345107 - DNA, 33 bp, Artificial Sequence
  Description of Artificial Sequence: Synthetic oligonucleotide
cgtaccaacaatgtccaggacatgaacaacacg

SEQ ID NO: 345108 - DNA, 34 bp, Artificial Sequence
  Description of Artificial Sequence: Synthetic oligonucleotide
gtaccaacaatgtccaggacatgaacaacacgac

SEQ ID NO: 345109 - DNA, 34 bp, Artificial Sequence
  Description of Artificial Sequence: Synthetic oligonucleotide
taccaacaatgtccaggacatgaacaacacgacc

SEQ ID NO: 345110 - DNA, 33 bp, Artificial Sequence
  Description of Artificial Sequence: Synthetic oligonucleotide
accaacaatgtccaggacatgaacaacacgacc

SEQ ID NO: 345111 - DNA, 32 bp, Artificial Sequence
  Description of Artificial Sequence: Synthetic oligonucleotide
ccaacaatgtccaggacatgaacaacacgacc

SEQ ID NO: 345112 - DNA, 33 bp, Artificial Sequence
  Description of Artificial Sequence: Synthetic oligonucleotide
caacaatgtccaggacatgaacaacacgaccag

SEQ ID NO: 345113 - DNA, 33 bp, Artificial Sequence
  Description of Artificial Sequence: Synthetic oligonucleotide
aacaatgtccaggacatgaacaacacgaccagc

SEQ ID NO: 345114 - DNA, 32 bp, Artificial Sequence
  Description of Artificial Sequence: Synthetic oligonucleotide
acaatgtccaggacatgaacaacacgaccagc

SEQ ID NO: 345115 - DNA, 31 bp, Artificial Sequence
  Description of Artificial Sequence: Synthetic oligonucleotide
caatgtccaggacatgaacaacacgaccagc

SEQ ID NO: 345116 - DNA, 31 bp, Artificial Sequence
  Description of Artificial Sequence: Synthetic oligonucleotide
aatgtccaggacatgaacaacacgaccagcc

SEQ ID NO: 345117 - DNA, 30 bp, Artificial Sequence
  Description of Artificial Sequence: Synthetic oligonucleotide
atgtccaggacatgaacaacacgaccagcc

SEQ ID NO: 345118 - DNA, 29 bp, Artificial Sequence
  Description of Artificial Sequence: Synthetic oligonucleotide
tgtccaggacatgaacaacacgaccagcc

SEQ ID NO: 345119 - DNA, 28 bp, Artificial Sequence
  Description of Artificial Sequence: Synthetic oligonucleotide
gtccaggacatgaacaacacgaccagcc

SEQ ID NO: 345120 - DNA, 29 bp, Artificial Sequence
  Description of Artificial Sequence: Synthetic oligonucleotide
tccaggacatgaacaacacgaccagccag

SEQ ID NO: 345121 - DNA, 28 bp, Artificial Sequence
  Description of Artificial Sequence: Synthetic oligonucleotide
ccaggacatgaacaacacgaccagccag

SEQ ID NO: 345122 - DNA, 28 bp, Artificial Sequence
  Description of Artificial Sequence: Synthetic oligonucleotide
caggacatgaacaacacgaccagccagg

SEQ ID NO: 345123 - DNA, 29 bp, Artificial Sequence
  Description of Artificial Sequence: Synthetic oligonucleotide
aggacatgaacaacacgaccagccaggac

SEQ ID NO: 345124 - DNA, 28 bp, Artificial Sequence
  Description of Artificial Sequence: Synthetic oligonucleotide
ggacatgaacaacacgaccagccaggac

SEQ ID NO: 345125 - DNA, 28 bp, Artificial Sequence
  Description of Artificial Sequence: Synthetic oligonucleotide
gacatgaacaacacgaccagccaggacc

SEQ ID NO: 345126 - DNA, 30 bp, Artificial Sequence
  Description of Artificial Sequence: Synthetic oligonucleotide
acatgaacaacacgaccagccaggaccaac

SEQ ID NO: 345127 - DNA, 29 bp, Artificial Sequence
  Description of Artificial Sequence: Synthetic oligonucleotide
catgaacaacacgaccagccaggaccaac

SEQ ID NO: 345128 - DNA, 30 bp, Artificial Sequence
  Description of Artificial Sequence: Synthetic oligonucleotide
atgaacaacacgaccagccaggaccaacag

SEQ ID NO: 345129 - DNA, 29 bp, Artificial Sequence
  Description of Artificial Sequence: Synthetic oligonucleotide
tgaacaacacgaccagccaggaccaacag

SEQ ID NO: 345130 - DNA, 28 bp, Artificial Sequence
  Description of Artificial Sequence: Synthetic oligonucleotide
gaacaacacgaccagccaggaccaacag

SEQ ID NO: 345131 - DNA, 31 bp, Artificial Sequence
  Description of Artificial Sequence: Synthetic oligonucleotide
aacaacacgaccagccaggaccaacagatag

SEQ ID NO: 345132 - DNA, 30 bp, Artificial Sequence
  Description of Artificial Sequence: Synthetic oligonucleotide
acaacacgaccagccaggaccaacagatag

SEQ ID NO: 345133 - DNA, 29 bp, Artificial Sequence
  Description of Artificial Sequence: Synthetic oligonucleotide
caacacgaccagccaggaccaacagatag

SEQ ID NO: 345134 - DNA, 31 bp, Artificial Sequence
  Description of Artificial Sequence: Synthetic oligonucleotide
aacacgaccagccaggaccaacagatagatg

SEQ ID NO: 345135 - DNA, 30 bp, Artificial Sequence
  Description of Artificial Sequence: Synthetic oligonucleotide
acacgaccagccaggaccaacagatagatg

SEQ ID NO: 345136 - DNA, 29 bp, Artificial Sequence
  Description of Artificial Sequence: Synthetic oligonucleotide
cacgaccagccaggaccaacagatagatg

SEQ ID NO: 345137 - DNA, 30 bp, Artificial Sequence
  Description of Artificial Sequence: Synthetic oligonucleotide
acgaccagccaggaccaacagatagatgtg

SEQ ID NO: 345138 - DNA, 29 bp, Artificial Sequence
  Description of Artificial Sequence: Synthetic oligonucleotide
cgaccagccaggaccaacagatagatgtg

SEQ ID NO: 345139 - DNA, 30 bp, Artificial Sequence
  Description of Artificial Sequence: Synthetic oligonucleotide
gaccagccaggaccaacagatagatgtgac

SEQ ID NO: 345140 - DNA, 31 bp, Artificial Sequence
  Description of Artificial Sequence: Synthetic oligonucleotide
accagccaggaccaacagatagatgtgacag

SEQ ID NO: 345141 - DNA, 30 bp, Artificial Sequence
  Description of Artificial Sequence: Synthetic oligonucleotide
ccagccaggaccaacagatagatgtgacag

SEQ ID NO: 345142 - DNA, 31 bp, Artificial Sequence
  Description of Artificial Sequence: Synthetic oligonucleotide
cagccaggaccaacagatagatgtgacagtc

SEQ ID NO: 345143 - DNA, 34 bp, Artificial Sequence
  Description of Artificial Sequence: Synthetic oligonucleotide
agccaggaccaacagatagatgtgacagtctaag

SEQ ID NO: 345144 - DNA, 33 bp, Artificial Sequence
  Description of Artificial Sequence: Synthetic oligonucleotide
gccaggaccaacagatagatgtgacagtctaag

SEQ ID NO: 345145 - DNA, 33 bp, Artificial Sequence
  Description of Artificial Sequence: Synthetic oligonucleotide
ccaggaccaacagatagatgtgacagtctaagg

SEQ ID NO: 345146 - DNA, 33 bp, Artificial Sequence
  Description of Artificial Sequence: Synthetic oligonucleotide
caggaccaacagatagatgtgacagtctaaggc

SEQ ID NO: 345147 - DNA, 33 bp, Artificial Sequence
  Description of Artificial Sequence: Synthetic oligonucleotide
aggaccaacagatagatgtgacagtctaaggcc

SEQ ID NO: 345148 - DNA, 32 bp, Artificial Sequence
  Description of Artificial Sequence: Synthetic oligonucleotide
ggaccaacagatagatgtgacagtctaaggcc

SEQ ID NO: 345149 - DNA, 33 bp, Artificial Sequence
  Description of Artificial Sequence: Synthetic oligonucleotide
gaccaacagatagatgtgacagtctaaggccac

SEQ ID NO: 345150 - DNA, 33 bp, Artificial Sequence
  Description of Artificial Sequence: Synthetic oligonucleotide
accaacagatagatgtgacagtctaaggccacg

SEQ ID NO: 345151 - DNA, 32 bp, Artificial Sequence
  Description of Artificial Sequence: Synthetic oligonucleotide
ccaacagatagatgtgacagtctaaggccacg

SEQ ID NO: 345152 - DNA, 33 bp, Artificial Sequence
  Description of Artificial Sequence: Synthetic oligonucleotide
caacagatagatgtgacagtctaaggccacgac

SEQ ID NO: 345153 - DNA, 33 bp, Artificial Sequence
  Description of Artificial Sequence: Synthetic oligonucleotide
aacagatagatgtgacagtctaaggccacgacg

SEQ ID NO: 345154 - DNA, 32 bp, Artificial Sequence
  Description of Artificial Sequence: Synthetic oligonucleotide
acagatagatgtgacagtctaaggccacgacg

SEQ ID NO: 345155 - DNA, 31 bp, Artificial Sequence
  Description of Artificial Sequence: Synthetic oligonucleotide
cagatagatgtgacagtctaaggccacgacg

SEQ ID NO: 345156 - DNA, 32 bp, Artificial Sequence
  Description of Artificial Sequence: Synthetic oligonucleotide
agatagatgtgacagtctaaggccacgacgag

SEQ ID NO: 345157 - DNA, 31 bp, Artificial Sequence
  Description of Artificial Sequence: Synthetic oligonucleotide
gatagatgtgacagtctaaggccacgacgag

SEQ ID NO: 345158 - DNA, 33 bp, Artificial Sequence
  Description of Artificial Sequence: Synthetic oligonucleotide
atagatgtgacagtctaaggccacgacgagtac

SEQ ID NO: 345159 - DNA, 32 bp, Artificial Sequence
  Description of Artificial Sequence: Synthetic oligonucleotide
tagatgtgacagtctaaggccacgacgagtac

SEQ ID NO: 345160 - DNA, 31 bp, Artificial Sequence
  Description of Artificial Sequence: Synthetic oligonucleotide
agatgtgacagtctaaggccacgacgagtac

SEQ ID NO: 345161 - DNA, 30 bp, Artificial Sequence
  Description of Artificial Sequence: Synthetic oligonucleotide
gatgtgacagtctaaggccacgacgagtac

SEQ ID NO: 345162 - DNA, 31 bp, Artificial Sequence
  Description of Artificial Sequence: Synthetic oligonucleotide
atgtgacagtctaaggccacgacgagtacac

SEQ ID NO: 345163 - DNA, 30 bp, Artificial Sequence
  Description of Artificial Sequence: Synthetic oligonucleotide
tgtgacagtctaaggccacgacgagtacac

SEQ ID NO: 345164 - DNA, 29 bp, Artificial Sequence
  Description of Artificial Sequence: Synthetic oligonucleotide
gtgacagtctaaggccacgacgagtacac

SEQ ID NO: 345165 - DNA, 29 bp, Artificial Sequence
  Description of Artificial Sequence: Synthetic oligonucleotide
tgacagtctaaggccacgacgagtacacc

SEQ ID NO: 345166 - DNA, 28 bp, Artificial Sequence
  Description of Artificial Sequence: Synthetic oligonucleotide
gacagtctaaggccacgacgagtacacc

SEQ ID NO: 345167 - DNA, 30 bp, Artificial Sequence
  Description of Artificial Sequence: Synthetic oligonucleotide
acagtctaaggccacgacgagtacaccatg

SEQ ID NO: 345168 - DNA, 29 bp, Artificial Sequence
  Description of Artificial Sequence: Synthetic oligonucleotide
cagtctaaggccacgacgagtacaccatg

SEQ ID NO: 345169 - DNA, 29 bp, Artificial Sequence
  Description of Artificial Sequence: Synthetic oligonucleotide
agtctaaggccacgacgagtacaccatgg

SEQ ID NO: 345170 - DNA, 28 bp, Artificial Sequence
  Description of Artificial Sequence: Synthetic oligonucleotide
gtctaaggccacgacgagtacaccatgg

SEQ ID NO: 345171 - DNA, 30 bp, Artificial Sequence
  Description of Artificial Sequence: Synthetic oligonucleotide
tctaaggccacgacgagtacaccatggaag

SEQ ID NO: 345172 - DNA, 29 bp, Artificial Sequence
  Description of Artificial Sequence: Synthetic oligonucleotide
ctaaggccacgacgagtacaccatggaag

SEQ ID NO: 345173 - DNA, 29 bp, Artificial Sequence
  Description of Artificial Sequence: Synthetic oligonucleotide
taaggccacgacgagtacaccatggaagc

SEQ ID NO: 345174 - DNA, 28 bp, Artificial Sequence
  Description of Artificial Sequence: Synthetic oligonucleotide
aaggccacgacgagtacaccatggaagc

SEQ ID NO: 345175 - DNA, 27 bp, Artificial Sequence
  Description of Artificial Sequence: Synthetic oligonucleotide
aggccacgacgagtacaccatggaagc

SEQ ID NO: 345176 - DNA, 27 bp, Artificial Sequence
  Description of Artificial Sequence: Synthetic oligonucleotide
ggccacgacgagtacaccatggaagca

SEQ ID NO: 345177 - DNA, 29 bp, Artificial Sequence
  Description of Artificial Sequence: Synthetic oligonucleotide
gccacgacgagtacaccatggaagcatac

SEQ ID NO: 345178 - DNA, 29 bp, Artificial Sequence
  Description of Artificial Sequence: Synthetic oligonucleotide
ccacgacgagtacaccatggaagcatacg

SEQ ID NO: 345179 - DNA, 30 bp, Artificial Sequence
  Description of Artificial Sequence: Synthetic oligonucleotide
cacgacgagtacaccatggaagcatacgag

SEQ ID NO: 345180 - DNA, 30 bp, Artificial Sequence
  Description of Artificial Sequence: Synthetic oligonucleotide
acgacgagtacaccatggaagcatacgagg

SEQ ID NO: 345181 - DNA, 29 bp, Artificial Sequence
  Description of Artificial Sequence: Synthetic oligonucleotide
cgacgagtacaccatggaagcatacgagg

SEQ ID NO: 345182 - DNA, 30 bp, Artificial Sequence
  Description of Artificial Sequence: Synthetic oligonucleotide
gacgagtacaccatggaagcatacgaggac

SEQ ID NO: 345183 - DNA, 33 bp, Artificial Sequence
  Description of Artificial Sequence: Synthetic oligonucleotide
acgagtacaccatggaagcatacgaggactttg

SEQ ID NO: 345184 - DNA, 32 bp, Artificial Sequence
  Description of Artificial Sequence: Synthetic oligonucleotide
cgagtacaccatggaagcatacgaggactttg

SEQ ID NO: 345185 - DNA, 33 bp, Artificial Sequence
  Description of Artificial Sequence: Synthetic oligonucleotide
gagtacaccatggaagcatacgaggactttgag

SEQ ID NO: 345186 - DNA, 33 bp, Artificial Sequence
  Description of Artificial Sequence: Synthetic oligonucleotide
agtacaccatggaagcatacgaggactttgagg

SEQ ID NO: 345187 - DNA, 32 bp, Artificial Sequence
  Description of Artificial Sequence: Synthetic oligonucleotide
gtacaccatggaagcatacgaggactttgagg

SEQ ID NO: 345188 - DNA, 33 bp, Artificial Sequence
  Description of Artificial Sequence: Synthetic oligonucleotide
tacaccatggaagcatacgaggactttgaggac

SEQ ID NO: 345189 - DNA, 32 bp, Artificial Sequence
  Description of Artificial Sequence: Synthetic oligonucleotide
acaccatggaagcatacgaggactttgaggac

SEQ ID NO: 345190 - DNA, 31 bp, Artificial Sequence
  Description of Artificial Sequence: Synthetic oligonucleotide
caccatggaagcatacgaggactttgaggac

SEQ ID NO: 345191 - DNA, 34 bp, Artificial Sequence
  Description of Artificial Sequence: Synthetic oligonucleotide
accatggaagcatacgaggactttgaggactaag

SEQ ID NO: 345192 - DNA, 33 bp, Artificial Sequence
  Description of Artificial Sequence: Synthetic oligonucleotide
ccatggaagcatacgaggactttgaggactaag

SEQ ID NO: 345193 - DNA, 34 bp, Artificial Sequence
  Description of Artificial Sequence: Synthetic oligonucleotide
catggaagcatacgaggactttgaggactaagag

SEQ ID NO: 345194 - DNA, 36 bp, Artificial Sequence
  Description of Artificial Sequence: Synthetic oligonucleotide
atggaagcatacgaggactttgaggactaagagtac

SEQ ID NO: 345195 - DNA, 35 bp, Artificial Sequence
  Description of Artificial Sequence: Synthetic oligonucleotide
tggaagcatacgaggactttgaggactaagagtac

SEQ ID NO: 345196 - DNA, 34 bp, Artificial Sequence
  Description of Artificial Sequence: Synthetic oligonucleotide
ggaagcatacgaggactttgaggactaagagtac

SEQ ID NO: 345197 - DNA, 34 bp, Artificial Sequence
  Description of Artificial Sequence: Synthetic oligonucleotide
gaagcatacgaggactttgaggactaagagtacg

SEQ ID NO: 345198 - DNA, 36 bp, Artificial Sequence
  Description of Artificial Sequence: Synthetic oligonucleotide
aagcatacgaggactttgaggactaagagtacgatc

SEQ ID NO: 345199 - DNA, 35 bp, Artificial Sequence
  Description of Artificial Sequence: Synthetic oligonucleotide
agcatacgaggactttgaggactaagagtacgatc

SEQ ID NO: 345200 - DNA, 34 bp, Artificial Sequence
  Description of Artificial Sequence: Synthetic oligonucleotide
gcatacgaggactttgaggactaagagtacgatc

SEQ ID NO: 345201 - DNA, 35 bp, Artificial Sequence
  Description of Artificial Sequence: Synthetic oligonucleotide
catacgaggactttgaggactaagagtacgatcag

SEQ ID NO: 345202 - DNA, 35 bp, Artificial Sequence
  Description of Artificial Sequence: Synthetic oligonucleotide
atacgaggactttgaggactaagagtacgatcagc

SEQ ID NO: 345203 - DNA, 34 bp, Artificial Sequence
  Description of Artificial Sequence: Synthetic oligonucleotide
tacgaggactttgaggactaagagtacgatcagc

SEQ ID NO: 345204 - DNA, 33 bp, Artificial Sequence
  Description of Artificial Sequence: Synthetic oligonucleotide
acgaggactttgaggactaagagtacgatcagc

SEQ ID NO: 345205 - DNA, 32 bp, Artificial Sequence
  Description of Artificial Sequence: Synthetic oligonucleotide
cgaggactttgaggactaagagtacgatcagc

SEQ ID NO: 345206 - DNA, 34 bp, Artificial Sequence
  Description of Artificial Sequence: Synthetic oligonucleotide
gaggactttgaggactaagagtacgatcagcttc

SEQ ID NO: 345207 - DNA, 34 bp, Artificial Sequence
  Description of Artificial Sequence: Synthetic oligonucleotide
aggactttgaggactaagagtacgatcagcttcc

SEQ ID NO: 345208 - DNA, 33 bp, Artificial Sequence
  Description of Artificial Sequence: Synthetic oligonucleotide
ggactttgaggactaagagtacgatcagcttcc

SEQ ID NO: 345209 - DNA, 34 bp, Artificial Sequence
  Description of Artificial Sequence: Synthetic oligonucleotide
gactttgaggactaagagtacgatcagcttccag

SEQ ID NO: 345210 - DNA, 34 bp, Artificial Sequence
  Description of Artificial Sequence: Synthetic oligonucleotide
actttgaggactaagagtacgatcagcttccagg

SEQ ID NO: 345211 - DNA, 33 bp, Artificial Sequence
  Description of Artificial Sequence: Synthetic oligonucleotide
ctttgaggactaagagtacgatcagcttccagg

SEQ ID NO: 345212 - DNA, 33 bp, Artificial Sequence
  Description of Artificial Sequence: Synthetic oligonucleotide
tttgaggactaagagtacgatcagcttccaggc

SEQ ID NO: 345213 - DNA, 32 bp, Artificial Sequence
  Description of Artificial Sequence: Synthetic oligonucleotide
ttgaggactaagagtacgatcagcttccaggc

SEQ ID NO: 345214 - DNA, 31 bp, Artificial Sequence
  Description of Artificial Sequence: Synthetic oligonucleotide
tgaggactaagagtacgatcagcttccaggc

SEQ ID NO: 345215 - DNA, 30 bp, Artificial Sequence
  Description of Artificial Sequence: Synthetic oligonucleotide
gaggactaagagtacgatcagcttccaggc

SEQ ID NO: 345216 - DNA, 32 bp, Artificial Sequence
  Description of Artificial Sequence: Synthetic oligonucleotide
aggactaagagtacgatcagcttccaggcaag

SEQ ID NO: 345217 - DNA, 31 bp, Artificial Sequence
  Description of Artificial Sequence: Synthetic oligonucleotide
ggactaagagtacgatcagcttccaggcaag

SEQ ID NO: 345218 - DNA, 31 bp, Artificial Sequence
  Description of Artificial Sequence: Synthetic oligonucleotide
gactaagagtacgatcagcttccaggcaagg

SEQ ID NO: 345219 - DNA, 33 bp, Artificial Sequence
  Description of Artificial Sequence: Synthetic oligonucleotide
actaagagtacgatcagcttccaggcaaggatg

SEQ ID NO: 345220 - DNA, 32 bp, Artificial Sequence
  Description of Artificial Sequence: Synthetic oligonucleotide
ctaagagtacgatcagcttccaggcaaggatg

SEQ ID NO: 345221 - DNA, 33 bp, Artificial Sequence
  Description of Artificial Sequence: Synthetic oligonucleotide
taagagtacgatcagcttccaggcaaggatgag

SEQ ID NO: 345222 - DNA, 32 bp, Artificial Sequence
  Description of Artificial Sequence: Synthetic oligonucleotide
aagagtacgatcagcttccaggcaaggatgag

SEQ ID NO: 345223 - DNA, 31 bp, Artificial Sequence
  Description of Artificial Sequence: Synthetic oligonucleotide
agagtacgatcagcttccaggcaaggatgag

SEQ ID NO: 345224 - DNA, 30 bp, Artificial Sequence
  Description of Artificial Sequence: Synthetic oligonucleotide
gagtacgatcagcttccaggcaaggatgag

SEQ ID NO: 345225 - DNA, 30 bp, Artificial Sequence
  Description of Artificial Sequence: Synthetic oligonucleotide
agtacgatcagcttccaggcaaggatgagc

SEQ ID NO: 345226 - DNA, 29 bp, Artificial Sequence
  Description of Artificial Sequence: Synthetic oligonucleotide
gtacgatcagcttccaggcaaggatgagc

SEQ ID NO: 345227 - DNA, 29 bp, Artificial Sequence
  Description of Artificial Sequence: Synthetic oligonucleotide
tacgatcagcttccaggcaaggatgagcc

SEQ ID NO: 345228 - DNA, 28 bp, Artificial Sequence
  Description of Artificial Sequence: Synthetic oligonucleotide
acgatcagcttccaggcaaggatgagcc

SEQ ID NO: 345229 - DNA, 27 bp, Artificial Sequence
  Description of Artificial Sequence: Synthetic oligonucleotide
cgatcagcttccaggcaaggatgagcc

SEQ ID NO: 345230 - DNA, 28 bp, Artificial Sequence
  Description of Artificial Sequence: Synthetic oligonucleotide
gatcagcttccaggcaaggatgagccag

SEQ ID NO: 345231 - DNA, 30 bp, Artificial Sequence
  Description of Artificial Sequence: Synthetic oligonucleotide
atcagcttccaggcaaggatgagccagatg

SEQ ID NO: 345232 - DNA, 29 bp, Artificial Sequence
  Description of Artificial Sequence: Synthetic oligonucleotide
tcagcttccaggcaaggatgagccagatg

SEQ ID NO: 345233 - DNA, 28 bp, Artificial Sequence
  Description of Artificial Sequence: Synthetic oligonucleotide
cagcttccaggcaaggatgagccagatg

SEQ ID NO: 345234 - DNA, 28 bp, Artificial Sequence
  Description of Artificial Sequence: Synthetic oligonucleotide
agcttccaggcaaggatgagccagatgc

SEQ ID NO: 345235 - DNA, 27 bp, Artificial Sequence
  Description of Artificial Sequence: Synthetic oligonucleotide
gcttccaggcaaggatgagccagatgc

SEQ ID NO: 345236 - DNA, 27 bp, Artificial Sequence
  Description of Artificial Sequence: Synthetic oligonucleotide
cttccaggcaaggatgagccagatgcc

SEQ ID NO: 345237 - DNA, 27 bp, Artificial Sequence
  Description of Artificial Sequence: Synthetic oligonucleotide
ttccaggcaaggatgagccagatgccg

SEQ ID NO: 345238 - DNA, 26 bp, Artificial Sequence
  Description of Artificial Sequence: Synthetic oligonucleotide
tccaggcaaggatgagccagatgccg

SEQ ID NO: 345239 - DNA, 25 bp, Artificial Sequence
  Description of Artificial Sequence: Synthetic oligonucleotide
ccaggcaaggatgagccagatgccg

SEQ ID NO: 345240 - DNA, 26 bp, Artificial Sequence
  Description of Artificial Sequence: Synthetic oligonucleotide
caggcaaggatgagccagatgccgct

SEQ ID NO: 345241 - DNA, 27 bp, Artificial Sequence
  Description of Artificial Sequence: Synthetic oligonucleotide
aggcaaggatgagccagatgccgctct

SEQ ID NO: 345242 - DNA, 26 bp, Artificial Sequence
  Description of Artificial Sequence: Synthetic oligonucleotide
ggcaaggatgagccagatgccgctct

SEQ ID NO: 345243 - DNA, 26 bp, Artificial Sequence
  Description of Artificial Sequence: Synthetic oligonucleotide
gcaaggatgagccagatgccgctctg

SEQ ID NO: 345244 - DNA, 27 bp, Artificial Sequence
  Description of Artificial Sequence: Synthetic oligonucleotide
caaggatgagccagatgccgctctgca

SEQ ID NO: 345245 - DNA, 27 bp, Artificial Sequence
  Description of Artificial Sequence: Synthetic oligonucleotide
aaggatgagccagatgccgctctgcag

SEQ ID NO: 345246 - DNA, 26 bp, Artificial Sequence
  Description of Artificial Sequence: Synthetic oligonucleotide
aggatgagccagatgccgctctgcag

SEQ ID NO: 345247 - DNA, 25 bp, Artificial Sequence
  Description of Artificial Sequence: Synthetic oligonucleotide
ggatgagccagatgccgctctgcag

SEQ ID NO: 345248 - DNA, 25 bp, Artificial Sequence
  Description of Artificial Sequence: Synthetic oligonucleotide
gatgagccagatgccgctctgcagc

SEQ ID NO: 345249 - DNA, 25 bp, Artificial Sequence
  Description of Artificial Sequence: Synthetic oligonucleotide
atgagccagatgccgctctgcagcg

SEQ ID NO: 345250 - DNA, 24 bp, Artificial Sequence
  Description of Artificial Sequence: Synthetic oligonucleotide
tgagccagatgccgctctgcagcg

SEQ ID NO: 345251 - DNA, 23 bp, Artificial Sequence
  Description of Artificial Sequence: Synthetic oligonucleotide
gagccagatgccgctctgcagcg

SEQ ID NO: 345252 - DNA, 23 bp, Artificial Sequence
  Description of Artificial Sequence: Synthetic oligonucleotide
agccagatgccgctctgcagcgc

SEQ ID NO: 345253 - DNA, 22 bp, Artificial Sequence
  Description of Artificial Sequence: Synthetic oligonucleotide
gccagatgccgctctgcagcgc

SEQ ID NO: 345254 - DNA, 23 bp, Artificial Sequence
  Description of Artificial Sequence: Synthetic oligonucleotide
ccagatgccgctctgcagcgcgt

SEQ ID NO: 345255 - DNA, 24 bp, Artificial Sequence
  Description of Artificial Sequence: Synthetic oligonucleotide
cagatgccgctctgcagcgcgtga

SEQ ID NO: 345256 - DNA, 25 bp, Artificial Sequence
  Description of Artificial Sequence: Synthetic oligonucleotide
agatgccgctctgcagcgcgtgaca

SEQ ID NO: 345257 - DNA, 24 bp, Artificial Sequence
  Description of Artificial Sequence: Synthetic oligonucleotide
gatgccgctctgcagcgcgtgaca

SEQ ID NO: 345258 - DNA, 24 bp, Artificial Sequence
  Description of Artificial Sequence: Synthetic oligonucleotide
atgccgctctgcagcgcgtgacac

SEQ ID NO: 345259 - DNA, 23 bp, Artificial Sequence
  Description of Artificial Sequence: Synthetic oligonucleotide
tgccgctctgcagcgcgtgacac

SEQ ID NO: 345260 - DNA, 22 bp, Artificial Sequence
  Description of Artificial Sequence: Synthetic oligonucleotide
gccgctctgcagcgcgtgacac

SEQ ID NO: 345261 - DNA, 22 bp, Artificial Sequence
  Description of Artificial Sequence: Synthetic oligonucleotide
ccgctctgcagcgcgtgacacc

SEQ ID NO: 345262 - DNA, 22 bp, Artificial Sequence
  Description of Artificial Sequence: Synthetic oligonucleotide
cgctctgcagcgcgtgacaccg

SEQ ID NO: 345263 - DNA, 23 bp, Artificial Sequence
  Description of Artificial Sequence: Synthetic oligonucleotide
gctctgcagcgcgtgacaccgct

SEQ ID NO: 345264 - DNA, 23 bp, Artificial Sequence
  Description of Artificial Sequence: Synthetic oligonucleotide
ctctgcagcgcgtgacaccgctg

SEQ ID NO: 345265 - DNA, 24 bp, Artificial Sequence
  Description of Artificial Sequence: Synthetic oligonucleotide
tctgcagcgcgtgacaccgctgca

SEQ ID NO: 345266 - DNA, 23 bp, Artificial Sequence
  Description of Artificial Sequence: Synthetic oligonucleotide
ctgcagcgcgtgacaccgctgca

SEQ ID NO: 345267 - DNA, 23 bp, Artificial Sequence
  Description of Artificial Sequence: Synthetic oligonucleotide
tgcagcgcgtgacaccgctgcag

SEQ ID NO: 345268 - DNA, 22 bp, Artificial Sequence
  Description of Artificial Sequence: Synthetic oligonucleotide
gcagcgcgtgacaccgctgcag

SEQ ID NO: 345269 - DNA, 23 bp, Artificial Sequence
  Description of Artificial Sequence: Synthetic oligonucleotide
cagcgcgtgacaccgctgcagct

SEQ ID NO: 345270 - DNA, 26 bp, Artificial Sequence
  Description of Artificial Sequence: Synthetic oligonucleotide
agcgcgtgacaccgctgcagctgatt

SEQ ID NO: 345271 - DNA, 25 bp, Artificial Sequence
  Description of Artificial Sequence: Synthetic oligonucleotide
gcgcgtgacaccgctgcagctgatt

SEQ ID NO: 345272 - DNA, 26 bp, Artificial Sequence
  Description of Artificial Sequence: Synthetic oligonucleotide
cgcgtgacaccgctgcagctgattga

SEQ ID NO: 345273 - DNA, 26 bp, Artificial Sequence
  Description of Artificial Sequence: Synthetic oligonucleotide
gcgtgacaccgctgcagctgattgag

SEQ ID NO: 345274 - DNA, 26 bp, Artificial Sequence
  Description of Artificial Sequence: Synthetic oligonucleotide
cgtgacaccgctgcagctgattgagg

SEQ ID NO: 345275 - DNA, 27 bp, Artificial Sequence
  Description of Artificial Sequence: Synthetic oligonucleotide
gtgacaccgctgcagctgattgagggt

SEQ ID NO: 345276 - DNA, 27 bp, Artificial Sequence
  Description of Artificial Sequence: Synthetic oligonucleotide
tgacaccgctgcagctgattgagggtc

SEQ ID NO: 345277 - DNA, 26 bp, Artificial Sequence
  Description of Artificial Sequence: Synthetic oligonucleotide
gacaccgctgcagctgattgagggtc

SEQ ID NO: 345278 - DNA, 26 bp, Artificial Sequence
  Description of Artificial Sequence: Synthetic oligonucleotide
acaccgctgcagctgattgagggtcc

SEQ ID NO: 345279 - DNA, 25 bp, Artificial Sequence
  Description of Artificial Sequence: Synthetic oligonucleotide
caccgctgcagctgattgagggtcc

SEQ ID NO: 345280 - DNA, 26 bp, Artificial Sequence
  Description of Artificial Sequence: Synthetic oligonucleotide
accgctgcagctgattgagggtccga

SEQ ID NO: 345281 - DNA, 25 bp, Artificial Sequence
  Description of Artificial Sequence: Synthetic oligonucleotide
ccgctgcagctgattgagggtccga

SEQ ID NO: 345282 - DNA, 25 bp, Artificial Sequence
  Description of Artificial Sequence: Synthetic oligonucleotide
cgctgcagctgattgagggtccgag

SEQ ID NO: 345283 - DNA, 27 bp, Artificial Sequence
  Description of Artificial Sequence: Synthetic oligonucleotide
gctgcagctgattgagggtccgaggaa

SEQ ID NO: 345284 - DNA, 27 bp, Artificial Sequence
  Description of Artificial Sequence: Synthetic oligonucleotide
ctgcagctgattgagggtccgaggaac

SEQ ID NO: 345285 - DNA, 27 bp, Artificial Sequence
  Description of Artificial Sequence: Synthetic oligonucleotide
tgcagctgattgagggtccgaggaacc

SEQ ID NO: 345286 - DNA, 26 bp, Artificial Sequence
  Description of Artificial Sequence: Synthetic oligonucleotide
gcagctgattgagggtccgaggaacc

SEQ ID NO: 345287 - DNA, 26 bp, Artificial Sequence
  Description of Artificial Sequence: Synthetic oligonucleotide
cagctgattgagggtccgaggaaccg

SEQ ID NO: 345288 - DNA, 26 bp, Artificial Sequence
  Description of Artificial Sequence: Synthetic oligonucleotide
agctgattgagggtccgaggaaccgg

SEQ ID NO: 345289 - DNA, 25 bp, Artificial Sequence
  Description of Artificial Sequence: Synthetic oligonucleotide
gctgattgagggtccgaggaaccgg

SEQ ID NO: 345290 - DNA, 25 bp, Artificial Sequence
  Description of Artificial Sequence: Synthetic oligonucleotide
ctgattgagggtccgaggaaccggc

SEQ ID NO: 345291 - DNA, 25 bp, Artificial Sequence
  Description of Artificial Sequence: Synthetic oligonucleotide
tgattgagggtccgaggaaccggcg

SEQ ID NO: 345292 - DNA, 24 bp, Artificial Sequence
  Description of Artificial Sequence: Synthetic oligonucleotide
gattgagggtccgaggaaccggcg

SEQ ID NO: 345293 - DNA, 25 bp, Artificial Sequence
  Description of Artificial Sequence: Synthetic oligonucleotide
attgagggtccgaggaaccggcgca

SEQ ID NO: 345294 - DNA, 24 bp, Artificial Sequence
  Description of Artificial Sequence: Synthetic oligonucleotide
ttgagggtccgaggaaccggcgca

SEQ ID NO: 345295 - DNA, 23 bp, Artificial Sequence
  Description of Artificial Sequence: Synthetic oligonucleotide
tgagggtccgaggaaccggcgca

SEQ ID NO: 345296 - DNA, 22 bp, Artificial Sequence
  Description of Artificial Sequence: Synthetic oligonucleotide
gagggtccgaggaaccggcgca

SEQ ID NO: 345297 - DNA, 22 bp, Artificial Sequence
  Description of Artificial Sequence: Synthetic oligonucleotide
agggtccgaggaaccggcgcag

SEQ ID NO: 345298 - DNA, 21 bp, Artificial Sequence
  Description of Artificial Sequence: Synthetic oligonucleotide
gggtccgaggaaccggcgcag

SEQ ID NO: 345299 - DNA, 22 bp, Artificial Sequence
  Description of Artificial Sequence: Synthetic oligonucleotide
ggtccgaggaaccggcgcagga

SEQ ID NO: 345300 - DNA, 22 bp, Artificial Sequence
  Description of Artificial Sequence: Synthetic oligonucleotide
gtccgaggaaccggcgcaggag

SEQ ID NO: 345301 - DNA, 22 bp, Artificial Sequence
  Description of Artificial Sequence: Synthetic oligonucleotide
tccgaggaaccggcgcaggagg

SEQ ID NO: 345302 - DNA, 21 bp, Artificial Sequence
  Description of Artificial Sequence: Synthetic oligonucleotide
ccgaggaaccggcgcaggagg

SEQ ID NO: 345303 - DNA, 22 bp, Artificial Sequence
  Description of Artificial Sequence: Synthetic oligonucleotide
cgaggaaccggcgcaggaggca

SEQ ID NO: 345304 - DNA, 22 bp, Artificial Sequence
  Description of Artificial Sequence: Synthetic oligonucleotide
gaggaaccggcgcaggaggcag

SEQ ID NO: 345305 - DNA, 22 bp, Artificial Sequence
  Description of Artificial Sequence: Synthetic oligonucleotide
aggaaccggcgcaggaggcagg

SEQ ID NO: 345306 - DNA, 21 bp, Artificial Sequence
  Description of Artificial Sequence: Synthetic oligonucleotide
ggaaccggcgcaggaggcagg

SEQ ID NO: 345307 - DNA, 21 bp, Artificial Sequence
  Description of Artificial Sequence: Synthetic oligonucleotide
gaaccggcgcaggaggcaggc

SEQ ID NO: 345308 - DNA, 21 bp, Artificial Sequence
  Description of Artificial Sequence: Synthetic oligonucleotide
aaccggcgcaggaggcaggcg

SEQ ID NO: 345309 - DNA, 20 bp, Artificial Sequence
  Description of Artificial Sequence: Synthetic oligonucleotide
accggcgcaggaggcaggcg

SEQ ID NO: 345310 - DNA, 20 bp, Artificial Sequence
  Description of Artificial Sequence: Synthetic oligonucleotide
ccggcgcaggaggcaggcgt

SEQ ID NO: 345311 - DNA, 20 bp, Artificial Sequence
  Description of Artificial Sequence: Synthetic oligonucleotide
cggcgcaggaggcaggcgct

SEQ ID NO: 345312 - DNA, 20 bp, Artificial Sequence
  Description of Artificial Sequence: Synthetic oligonucleotide
ggcgcaggaggcaggcgcct

SEQ ID NO: 345313 - DNA, 21 bp, Artificial Sequence
  Description of Artificial Sequence: Synthetic oligonucleotide
gcgcaggaggcaggcgcccat

SEQ ID NO: 345314 - DNA, 21 bp, Artificial Sequence
  Description of Artificial Sequence: Synthetic oligonucleotide
cgcaggaggcaggcgcccatg

SEQ ID NO: 345315 - DNA, 22 bp, Artificial Sequence
  Description of Artificial Sequence: Synthetic oligonucleotide
gcaggaggcaggcgcccatggt

SEQ ID NO: 345316 - DNA, 22 bp, Artificial Sequence
  Description of Artificial Sequence: Synthetic oligonucleotide
caggaggcaggcgcccatggtg

SEQ ID NO: 345317 - DNA, 23 bp, Artificial Sequence
  Description of Artificial Sequence: Synthetic oligonucleotide
aggaggcaggcgcccatggtggt

SEQ ID NO: 345318 - DNA, 22 bp, Artificial Sequence
  Description of Artificial Sequence: Synthetic oligonucleotide
ggaggcaggcgcccatggtggt

SEQ ID NO: 345319 - DNA, 22 bp, Artificial Sequence
  Description of Artificial Sequence: Synthetic oligonucleotide
gaggcaggcgcccatggtggtg

SEQ ID NO: 345320 - DNA, 23 bp, Artificial Sequence
  Description of Artificial Sequence: Synthetic oligonucleotide
aggcaggcgcccatggtggtgga

SEQ ID NO: 345321 - DNA, 22 bp, Artificial Sequence
  Description of Artificial Sequence: Synthetic oligonucleotide
ggcaggcgcccatggtggtgga

SEQ ID NO: 345322 - DNA, 22 bp, Artificial Sequence
  Description of Artificial Sequence: Synthetic oligonucleotide
gcaggcgcccatggtggtggac

SEQ ID NO: 345323 - DNA, 23 bp, Artificial Sequence
  Description of Artificial Sequence: Synthetic oligonucleotide
caggcgcccatggtggtggacga

SEQ ID NO: 345324 - DNA, 23 bp, Artificial Sequence
  Description of Artificial Sequence: Synthetic oligonucleotide
aggcgcccatggtggtggacgag

SEQ ID NO: 345325 - DNA, 22 bp, Artificial Sequence
  Description of Artificial Sequence: Synthetic oligonucleotide
ggcgcccatggtggtggacgag

SEQ ID NO: 345326 - DNA, 23 bp, Artificial Sequence
  Description of Artificial Sequence: Synthetic oligonucleotide
gcgcccatggtggtggacgagca

SEQ ID NO: 345327 - DNA, 23 bp, Artificial Sequence
  Description of Artificial Sequence: Synthetic oligonucleotide
cgcccatggtggtggacgagcag

SEQ ID NO: 345328 - DNA, 24 bp, Artificial Sequence
  Description of Artificial Sequence: Synthetic oligonucleotide
gcccatggtggtggacgagcagga

SEQ ID NO: 345329 - DNA, 25 bp, Artificial Sequence
  Description of Artificial Sequence: Synthetic oligonucleotide
cccatggtggtggacgagcaggaga

SEQ ID NO: 345330 - DNA, 25 bp, Artificial Sequence
  Description of Artificial Sequence: Synthetic oligonucleotide
ccatggtggtggacgagcaggagac

SEQ ID NO: 345331 - DNA, 26 bp, Artificial Sequence
  Description of Artificial Sequence: Synthetic oligonucleotide
catggtggtggacgagcaggagacca

SEQ ID NO: 345332 - DNA, 26 bp, Artificial Sequence
  Description of Artificial Sequence: Synthetic oligonucleotide
atggtggtggacgagcaggagaccag

SEQ ID NO: 345333 - DNA, 25 bp, Artificial Sequence
  Description of Artificial Sequence: Synthetic oligonucleotide
tggtggtggacgagcaggagaccag

SEQ ID NO: 345334 - DNA, 24 bp, Artificial Sequence
  Description of Artificial Sequence: Synthetic oligonucleotide
ggtggtggacgagcaggagaccag

SEQ ID NO: 345335 - DNA, 24 bp, Artificial Sequence
  Description of Artificial Sequence: Synthetic oligonucleotide
gtggtggacgagcaggagaccagg

SEQ ID NO: 345336 - DNA, 25 bp, Artificial Sequence
  Description of Artificial Sequence: Synthetic oligonucleotide
tggtggacgagcaggagaccagggt

SEQ ID NO: 345337 - DNA, 24 bp, Artificial Sequence
  Description of Artificial Sequence: Synthetic oligonucleotide
ggtggacgagcaggagaccagggt

SEQ ID NO: 345338 - DNA, 24 bp, Artificial Sequence
  Description of Artificial Sequence: Synthetic oligonucleotide
gtggacgagcaggagaccagggtg

SEQ ID NO: 345339 - DNA, 25 bp, Artificial Sequence
  Description of Artificial Sequence: Synthetic oligonucleotide
tggacgagcaggagaccagggtgct

SEQ ID NO: 345340 - DNA, 24 bp, Artificial Sequence
  Description of Artificial Sequence: Synthetic oligonucleotide
ggacgagcaggagaccagggtgct

SEQ ID NO: 345341 - DNA, 26 bp, Artificial Sequence
  Description of Artificial Sequence: Synthetic oligonucleotide
gacgagcaggagaccagggtgctcta

SEQ ID NO: 345342 - DNA, 27 bp, Artificial Sequence
  Description of Artificial Sequence: Synthetic oligonucleotide
acgagcaggagaccagggtgctctaca

SEQ ID NO: 345343 - DNA, 26 bp, Artificial Sequence
  Description of Artificial Sequence: Synthetic oligonucleotide
cgagcaggagaccagggtgctctaca

SEQ ID NO: 345344 - DNA, 26 bp, Artificial Sequence
  Description of Artificial Sequence: Synthetic oligonucleotide
gagcaggagaccagggtgctctacac

SEQ ID NO: 345345 - DNA, 26 bp, Artificial Sequence
  Description of Artificial Sequence: Synthetic oligonucleotide
agcaggagaccagggtgctctacacc

SEQ ID NO: 345346 - DNA, 25 bp, Artificial Sequence
  Description of Artificial Sequence: Synthetic oligonucleotide
gcaggagaccagggtgctctacacc

SEQ ID NO: 345347 - DNA, 26 bp, Artificial Sequence
  Description of Artificial Sequence: Synthetic oligonucleotide
caggagaccagggtgctctacaccgt

SEQ ID NO: 345348 - DNA, 27 bp, Artificial Sequence
  Description of Artificial Sequence: Synthetic oligonucleotide
aggagaccagggtgctctacaccgtct

SEQ ID NO: 345349 - DNA, 26 bp, Artificial Sequence
  Description of Artificial Sequence: Synthetic oligonucleotide
ggagaccagggtgctctacaccgtct

SEQ ID NO: 345350 - DNA, 26 bp, Artificial Sequence
  Description of Artificial Sequence: Synthetic oligonucleotide
gagaccagggtgctctacaccgtctg

SEQ ID NO: 345351 - DNA, 27 bp, Artificial Sequence
  Description of Artificial Sequence: Synthetic oligonucleotide
agaccagggtgctctacaccgtctgca

SEQ ID NO: 345352 - DNA, 27 bp, Artificial Sequence
  Description of Artificial Sequence: Synthetic oligonucleotide
gaccagggtgctctacaccgtctgcat

SEQ ID NO: 345353 - DNA, 27 bp, Artificial Sequence
  Description of Artificial Sequence: Synthetic oligonucleotide
accagggtgctctacaccgtctgcatc

SEQ ID NO: 345354 - DNA, 27 bp, Artificial Sequence
  Description of Artificial Sequence: Synthetic oligonucleotide
ccagggtgctctacaccgtctgcatct

SEQ ID NO: 345355 - DNA, 27 bp, Artificial Sequence
  Description of Artificial Sequence: Synthetic oligonucleotide
cagggtgctctacaccgtctgcatctg

SEQ ID NO: 345356 - DNA, 27 bp, Artificial Sequence
  Description of Artificial Sequence: Synthetic oligonucleotide
agggtgctctacaccgtctgcatctgg

SEQ ID NO: 345357 - DNA, 26 bp, Artificial Sequence
  Description of Artificial Sequence: Synthetic oligonucleotide
gggtgctctacaccgtctgcatctgg

SEQ ID NO: 345358 - DNA, 26 bp, Artificial Sequence
  Description of Artificial Sequence: Synthetic oligonucleotide
ggtgctctacaccgtctgcatctggg

SEQ ID NO: 345359 - DNA, 26 bp, Artificial Sequence
  Description of Artificial Sequence: Synthetic oligonucleotide
gtgctctacaccgtctgcatctgggg

SEQ ID NO: 345360 - DNA, 27 bp, Artificial Sequence
  Description of Artificial Sequence: Synthetic oligonucleotide
tgctctacaccgtctgcatctggggga

SEQ ID NO: 345361 - DNA, 27 bp, Artificial Sequence
  Description of Artificial Sequence: Synthetic oligonucleotide
gctctacaccgtctgcatctgggggaa

SEQ ID NO: 345362 - DNA, 27 bp, Artificial Sequence
  Description of Artificial Sequence: Synthetic oligonucleotide
ctctacaccgtctgcatctgggggaac

SEQ ID NO: 345363 - DNA, 27 bp, Artificial Sequence
  Description of Artificial Sequence: Synthetic oligonucleotide
tctacaccgtctgcatctgggggaacg

SEQ ID NO: 345364 - DNA, 26 bp, Artificial Sequence
  Description of Artificial Sequence: Synthetic oligonucleotide
ctacaccgtctgcatctgggggaacg

SEQ ID NO: 345365 - DNA, 26 bp, Artificial Sequence
  Description of Artificial Sequence: Synthetic oligonucleotide
tacaccgtctgcatctgggggaacgg

SEQ ID NO: 345366 - DNA, 25 bp, Artificial Sequence
  Description of Artificial Sequence: Synthetic oligonucleotide
acaccgtctgcatctgggggaacgg

SEQ ID NO: 345367 - DNA, 24 bp, Artificial Sequence
  Description of Artificial Sequence: Synthetic oligonucleotide
caccgtctgcatctgggggaacgg

SEQ ID NO: 345368 - DNA, 26 bp, Artificial Sequence
  Description of Artificial Sequence: Synthetic oligonucleotide
accgtctgcatctgggggaacggcat

SEQ ID NO: 345369 - DNA, 25 bp, Artificial Sequence
  Description of Artificial Sequence: Synthetic oligonucleotide
ccgtctgcatctgggggaacggcat

SEQ ID NO: 345370 - DNA, 25 bp, Artificial Sequence
  Description of Artificial Sequence: Synthetic oligonucleotide
cgtctgcatctgggggaacggcatg

SEQ ID NO: 345371 - DNA, 26 bp, Artificial Sequence
  Description of Artificial Sequence: Synthetic oligonucleotide
gtctgcatctgggggaacggcatggt

SEQ ID NO: 345372 - DNA, 26 bp, Artificial Sequence
  Description of Artificial Sequence: Synthetic oligonucleotide
tctgcatctgggggaacggcatggtg

SEQ ID NO: 345373 - DNA, 25 bp, Artificial Sequence
  Description of Artificial Sequence: Synthetic oligonucleotide
ctgcatctgggggaacggcatggtg

SEQ ID NO: 345374 - DNA, 25 bp, Artificial Sequence
  Description of Artificial Sequence: Synthetic oligonucleotide
tgcatctgggggaacggcatggtgg

SEQ ID NO: 345375 - DNA, 24 bp, Artificial Sequence
  Description of Artificial Sequence: Synthetic oligonucleotide
gcatctgggggaacggcatggtgg

SEQ ID NO: 345376 - DNA, 24 bp, Artificial Sequence
  Description of Artificial Sequence: Synthetic oligonucleotide
catctgggggaacggcatggtggg

SEQ ID NO: 345377 - DNA, 24 bp, Artificial Sequence
  Description of Artificial Sequence: Synthetic oligonucleotide
atctgggggaacggcatggtgggg

SEQ ID NO: 345378 - DNA, 23 bp, Artificial Sequence
  Description of Artificial Sequence: Synthetic oligonucleotide
tctgggggaacggcatggtgggg

SEQ ID NO: 345379 - DNA, 22 bp, Artificial Sequence
  Description of Artificial Sequence: Synthetic oligonucleotide
ctgggggaacggcatggtgggg

SEQ ID NO: 345380 - DNA, 23 bp, Artificial Sequence
  Description of Artificial Sequence: Synthetic oligonucleotide
tgggggaacggcatggtggggct

SEQ ID NO: 345381 - DNA, 22 bp, Artificial Sequence
  Description of Artificial Sequence: Synthetic oligonucleotide
gggggaacggcatggtggggct

SEQ ID NO: 345382 - DNA, 23 bp, Artificial Sequence
  Description of Artificial Sequence: Synthetic oligonucleotide
ggggaacggcatggtggggctct

SEQ ID NO: 345383 - DNA, 24 bp, Artificial Sequence
  Description of Artificial Sequence: Synthetic oligonucleotide
gggaacggcatggtggggctctct

SEQ ID NO: 345384 - DNA, 24 bp, Artificial Sequence
  Description of Artificial Sequence: Synthetic oligonucleotide
ggaacggcatggtggggctctctg

SEQ ID NO: 345385 - DNA, 24 bp, Artificial Sequence
  Description of Artificial Sequence: Synthetic oligonucleotide
gaacggcatggtggggctctctgg

SEQ ID NO: 345386 - DNA, 26 bp, Artificial Sequence
  Description of Artificial Sequence: Synthetic oligonucleotide
aacggcatggtggggctctctggcat

SEQ ID NO: 345387 - DNA, 25 bp, Artificial Sequence
  Description of Artificial Sequence: Synthetic oligonucleotide
acggcatggtggggctctctggcat

SEQ ID NO: 345388 - DNA, 24 bp, Artificial Sequence
  Description of Artificial Sequence: Synthetic oligonucleotide
cggcatggtggggctctctggcat

SEQ ID NO: 345389 - DNA, 24 bp, Artificial Sequence
  Description of Artificial Sequence: Synthetic oligonucleotide
ggcatggtggggctctctggcatg

SEQ ID NO: 345390 - DNA, 24 bp, Artificial Sequence
  Description of Artificial Sequence: Synthetic oligonucleotide
gcatggtggggctctctggcatgc

SEQ ID NO: 345391 - DNA, 24 bp, Artificial Sequence
  Description of Artificial Sequence: Synthetic oligonucleotide
catggtggggctctctggcatgcc

SEQ ID NO: 345392 - DNA, 26 bp, Artificial Sequence
  Description of Artificial Sequence: Synthetic oligonucleotide
atggtggggctctctggcatgcccat

SEQ ID NO: 345393 - DNA, 25 bp, Artificial Sequence
  Description of Artificial Sequence: Synthetic oligonucleotide
tggtggggctctctggcatgcccat

SEQ ID NO: 345394 - DNA, 24 bp, Artificial Sequence
  Description of Artificial Sequence: Synthetic oligonucleotide
ggtggggctctctggcatgcccat

SEQ ID NO: 345395 - DNA, 24 bp, Artificial Sequence
  Description of Artificial Sequence: Synthetic oligonucleotide
gtggggctctctggcatgcccatc

SEQ ID NO: 345396 - DNA, 24 bp, Artificial Sequence
  Description of Artificial Sequence: Synthetic oligonucleotide
tggggctctctggcatgcccatcg

SEQ ID NO: 345397 - DNA, 23 bp, Artificial Sequence
  Description of Artificial Sequence: Synthetic oligonucleotide
ggggctctctggcatgcccatcg

SEQ ID NO: 345398 - DNA, 23 bp, Artificial Sequence
  Description of Artificial Sequence: Synthetic oligonucleotide
gggctctctggcatgcccatcgc

SEQ ID NO: 345399 - DNA, 23 bp, Artificial Sequence
  Description of Artificial Sequence: Synthetic oligonucleotide
ggctctctggcatgcccatcgcg

SEQ ID NO: 345400 - DNA, 24 bp, Artificial Sequence
  Description of Artificial Sequence: Synthetic oligonucleotide
gctctctggcatgcccatcgcggt

SEQ ID NO: 345401 - DNA, 24 bp, Artificial Sequence
  Description of Artificial Sequence: Synthetic oligonucleotide
ctctctggcatgcccatcgcggtc

SEQ ID NO: 345402 - DNA, 25 bp, Artificial Sequence
  Description of Artificial Sequence: Synthetic oligonucleotide
tctctggcatgcccatcgcggtcgt

SEQ ID NO: 345403 - DNA, 24 bp, Artificial Sequence
  Description of Artificial Sequence: Synthetic oligonucleotide
ctctggcatgcccatcgcggtcgt

SEQ ID NO: 345404 - DNA, 25 bp, Artificial Sequence
  Description of Artificial Sequence: Synthetic oligonucleotide
tctggcatgcccatcgcggtcgtca

SEQ ID NO: 345405 - DNA, 24 bp, Artificial Sequence
  Description of Artificial Sequence: Synthetic oligonucleotide
ctggcatgcccatcgcggtcgtca

SEQ ID NO: 345406 - DNA, 24 bp, Artificial Sequence
  Description of Artificial Sequence: Synthetic oligonucleotide
tggcatgcccatcgcggtcgtcac

SEQ ID NO: 345407 - DNA, 23 bp, Artificial Sequence
  Description of Artificial Sequence: Synthetic oligonucleotide
ggcatgcccatcgcggtcgtcac

SEQ ID NO: 345408 - DNA, 23 bp, Artificial Sequence
  Description of Artificial Sequence: Synthetic oligonucleotide
gcatgcccatcgcggtcgtcacc

SEQ ID NO: 345409 - DNA, 24 bp, Artificial Sequence
  Description of Artificial Sequence: Synthetic oligonucleotide
catgcccatcgcggtcgtcaccct

SEQ ID NO: 345410 - DNA, 24 bp, Artificial Sequence
  Description of Artificial Sequence: Synthetic oligonucleotide
atgcccatcgcggtcgtcaccctg

SEQ ID NO: 345411 - DNA, 23 bp, Artificial Sequence
  Description of Artificial Sequence: Synthetic oligonucleotide
tgcccatcgcggtcgtcaccctg

SEQ ID NO: 345412 - DNA, 22 bp, Artificial Sequence
  Description of Artificial Sequence: Synthetic oligonucleotide
gcccatcgcggtcgtcaccctg

SEQ ID NO: 345413 - DNA, 23 bp, Artificial Sequence
  Description of Artificial Sequence: Synthetic oligonucleotide
cccatcgcggtcgtcaccctgct

SEQ ID NO: 345414 - DNA, 24 bp, Artificial Sequence
  Description of Artificial Sequence: Synthetic oligonucleotide
ccatcgcggtcgtcaccctgctga

SEQ ID NO: 345415 - DNA, 25 bp, Artificial Sequence
  Description of Artificial Sequence: Synthetic oligonucleotide
catcgcggtcgtcaccctgctgagt

SEQ ID NO: 345416 - DNA, 25 bp, Artificial Sequence
  Description of Artificial Sequence: Synthetic oligonucleotide
atcgcggtcgtcaccctgctgagtg

SEQ ID NO: 345417 - DNA, 24 bp, Artificial Sequence
  Description of Artificial Sequence: Synthetic oligonucleotide
tcgcggtcgtcaccctgctgagtg

SEQ ID NO: 345418 - DNA, 23 bp, Artificial Sequence
  Description of Artificial Sequence: Synthetic oligonucleotide
cgcggtcgtcaccctgctgagtg

SEQ ID NO: 345419 - DNA, 26 bp, Artificial Sequence
  Description of Artificial Sequence: Synthetic oligonucleotide
gcggtcgtcaccctgctgagtggaat

SEQ ID NO: 345420 - DNA, 26 bp, Artificial Sequence
  Description of Artificial Sequence: Synthetic oligonucleotide
cggtcgtcaccctgctgagtggaatc

SEQ ID NO: 345421 - DNA, 27 bp, Artificial Sequence
  Description of Artificial Sequence: Synthetic oligonucleotide
ggtcgtcaccctgctgagtggaatcca

SEQ ID NO: 345422 - DNA, 27 bp, Artificial Sequence
  Description of Artificial Sequence: Synthetic oligonucleotide
gtcgtcaccctgctgagtggaatccac

SEQ ID NO: 345423 - DNA, 27 bp, Artificial Sequence
  Description of Artificial Sequence: Synthetic oligonucleotide
tcgtcaccctgctgagtggaatccacg

SEQ ID NO: 345424 - DNA, 26 bp, Artificial Sequence
  Description of Artificial Sequence: Synthetic oligonucleotide
cgtcaccctgctgagtggaatccacg

SEQ ID NO: 345425 - DNA, 26 bp, Artificial Sequence
  Description of Artificial Sequence: Synthetic oligonucleotide
gtcaccctgctgagtggaatccacgc

SEQ ID NO: 345426 - DNA, 26 bp, Artificial Sequence
  Description of Artificial Sequence: Synthetic oligonucleotide
tcaccctgctgagtggaatccacgcc

SEQ ID NO: 345427 - DNA, 25 bp, Artificial Sequence
  Description of Artificial Sequence: Synthetic oligonucleotide
caccctgctgagtggaatccacgcc

SEQ ID NO: 345428 - DNA, 26 bp, Artificial Sequence
  Description of Artificial Sequence: Synthetic oligonucleotide
accctgctgagtggaatccacgccca

SEQ ID NO: 345429 - DNA, 25 bp, Artificial Sequence
  Description of Artificial Sequence: Synthetic oligonucleotide
ccctgctgagtggaatccacgccca

SEQ ID NO: 345430 - DNA, 25 bp, Artificial Sequence
  Description of Artificial Sequence: Synthetic oligonucleotide
cctgctgagtggaatccacgcccag

SEQ ID NO: 345431 - DNA, 25 bp, Artificial Sequence
  Description of Artificial Sequence: Synthetic oligonucleotide
ctgctgagtggaatccacgcccagc

SEQ ID NO: 345432 - DNA, 26 bp, Artificial Sequence
  Description of Artificial Sequence: Synthetic oligonucleotide
tgctgagtggaatccacgcccagcgt

SEQ ID NO: 345433 - DNA, 25 bp, Artificial Sequence
  Description of Artificial Sequence: Synthetic oligonucleotide
gctgagtggaatccacgcccagcgt

SEQ ID NO: 345434 - DNA, 25 bp, Artificial Sequence
  Description of Artificial Sequence: Synthetic oligonucleotide
ctgagtggaatccacgcccagcgtg

SEQ ID NO: 345435 - DNA, 26 bp, Artificial Sequence
  Description of Artificial Sequence: Synthetic oligonucleotide
tgagtggaatccacgcccagcgtgct

SEQ ID NO: 345436 - DNA, 25 bp, Artificial Sequence
  Description of Artificial Sequence: Synthetic oligonucleotide
gagtggaatccacgcccagcgtgct

SEQ ID NO: 345437 - DNA, 26 bp, Artificial Sequence
  Description of Artificial Sequence: Synthetic oligonucleotide
agtggaatccacgcccagcgtgctga

SEQ ID NO: 345438 - DNA, 25 bp, Artificial Sequence
  Description of Artificial Sequence: Synthetic oligonucleotide
gtggaatccacgcccagcgtgctga

SEQ ID NO: 345439 - DNA, 25 bp, Artificial Sequence
  Description of Artificial Sequence: Synthetic oligonucleotide
tggaatccacgcccagcgtgctgag

SEQ ID NO: 345440 - DNA, 24 bp, Artificial Sequence
  Description of Artificial Sequence: Synthetic oligonucleotide
ggaatccacgcccagcgtgctgag

SEQ ID NO: 345441 - DNA, 25 bp, Artificial Sequence
  Description of Artificial Sequence: Synthetic oligonucleotide
gaatccacgcccagcgtgctgagct

SEQ ID NO: 345442 - DNA, 25 bp, Artificial Sequence
  Description of Artificial Sequence: Synthetic oligonucleotide
aatccacgcccagcgtgctgagctg

SEQ ID NO: 345443 - DNA, 24 bp, Artificial Sequence
  Description of Artificial Sequence: Synthetic oligonucleotide
atccacgcccagcgtgctgagctg

SEQ ID NO: 345444 - DNA, 23 bp, Artificial Sequence
  Description of Artificial Sequence: Synthetic oligonucleotide
tccacgcccagcgtgctgagctg

SEQ ID NO: 345445 - DNA, 22 bp, Artificial Sequence
  Description of Artificial Sequence: Synthetic oligonucleotide
ccacgcccagcgtgctgagctg

SEQ ID NO: 345446 - DNA, 23 bp, Artificial Sequence
  Description of Artificial Sequence: Synthetic oligonucleotide
cacgcccagcgtgctgagctgga

SEQ ID NO: 345447 - DNA, 25 bp, Artificial Sequence
  Description of Artificial Sequence: Synthetic oligonucleotide
acgcccagcgtgctgagctggagaa

SEQ ID NO: 345448 - DNA, 24 bp, Artificial Sequence
  Description of Artificial Sequence: Synthetic oligonucleotide
cgcccagcgtgctgagctggagaa

SEQ ID NO: 345449 - DNA, 24 bp, Artificial Sequence
  Description of Artificial Sequence: Synthetic oligonucleotide
gcccagcgtgctgagctggagaag

SEQ ID NO: 345450 - DNA, 25 bp, Artificial Sequence
  Description of Artificial Sequence: Synthetic oligonucleotide
cccagcgtgctgagctggagaaggt

SEQ ID NO: 345451 - DNA, 26 bp, Artificial Sequence
  Description of Artificial Sequence: Synthetic oligonucleotide
ccagcgtgctgagctggagaaggtga

SEQ ID NO: 345452 - DNA, 26 bp, Artificial Sequence
  Description of Artificial Sequence: Synthetic oligonucleotide
cagcgtgctgagctggagaaggtgac

SEQ ID NO: 345453 - DNA, 27 bp, Artificial Sequence
  Description of Artificial Sequence: Synthetic oligonucleotide
agcgtgctgagctggagaaggtgacct

SEQ ID NO: 345454 - DNA, 26 bp, Artificial Sequence
  Description of Artificial Sequence: Synthetic oligonucleotide
gcgtgctgagctggagaaggtgacct

SEQ ID NO: 345455 - DNA, 26 bp, Artificial Sequence
  Description of Artificial Sequence: Synthetic oligonucleotide
cgtgctgagctggagaaggtgacctc

SEQ ID NO: 345456 - DNA, 26 bp, Artificial Sequence
  Description of Artificial Sequence: Synthetic oligonucleotide
gtgctgagctggagaaggtgacctcc

SEQ ID NO: 345457 - DNA, 27 bp, Artificial Sequence
  Description of Artificial Sequence: Synthetic oligonucleotide
tgctgagctggagaaggtgacctccca

SEQ ID NO: 345458 - DNA, 26 bp, Artificial Sequence
  Description of Artificial Sequence: Synthetic oligonucleotide
gctgagctggagaaggtgacctccca

SEQ ID NO: 345459 - DNA, 27 bp, Artificial Sequence
  Description of Artificial Sequence: Synthetic oligonucleotide
ctgagctggagaaggtgacctcccact

SEQ ID NO: 345460 - DNA, 27 bp, Artificial Sequence
  Description of Artificial Sequence: Synthetic oligonucleotide
tgagctggagaaggtgacctcccactc

SEQ ID NO: 345461 - DNA, 27 bp, Artificial Sequence
  Description of Artificial Sequence: Synthetic oligonucleotide
gagctggagaaggtgacctcccactct

SEQ ID NO: 345462 - DNA, 27 bp, Artificial Sequence
  Description of Artificial Sequence: Synthetic oligonucleotide
agctggagaaggtgacctcccactctg

SEQ ID NO: 345463 - DNA, 27 bp, Artificial Sequence
  Description of Artificial Sequence: Synthetic oligonucleotide
gctggagaaggtgacctcccactctga

SEQ ID NO: 345464 - DNA, 27 bp, Artificial Sequence
  Description of Artificial Sequence: Synthetic oligonucleotide
ctggagaaggtgacctcccactctgac

SEQ ID NO: 345465 - DNA, 27 bp, Artificial Sequence
  Description of Artificial Sequence: Synthetic oligonucleotide
tggagaaggtgacctcccactctgacc

SEQ ID NO: 345466 - DNA, 26 bp, Artificial Sequence
  Description of Artificial Sequence: Synthetic oligonucleotide
ggagaaggtgacctcccactctgacc

SEQ ID NO: 345467 - DNA, 27 bp, Artificial Sequence
  Description of Artificial Sequence: Synthetic oligonucleotide
gagaaggtgacctcccactctgaccga

SEQ ID NO: 345468 - DNA, 29 bp, Artificial Sequence
  Description of Artificial Sequence: Synthetic oligonucleotide
agaaggtgacctcccactctgaccgatac

SEQ ID NO: 345469 - DNA, 28 bp, Artificial Sequence
  Description of Artificial Sequence: Synthetic oligonucleotide
gaaggtgacctcccactctgaccgatac

SEQ ID NO: 345470 - DNA, 28 bp, Artificial Sequence
  Description of Artificial Sequence: Synthetic oligonucleotide
aaggtgacctcccactctgaccgatacg

SEQ ID NO: 345471 - DNA, 27 bp, Artificial Sequence
  Description of Artificial Sequence: Synthetic oligonucleotide
aggtgacctcccactctgaccgatacg

SEQ ID NO: 345472 - DNA, 27 bp, Artificial Sequence
  Description of Artificial Sequence: Synthetic oligonucleotide
ggtgacctcccactctgaccgatacgt

SEQ ID NO: 345473 - DNA, 27 bp, Artificial Sequence
  Description of Artificial Sequence: Synthetic oligonucleotide
gtgacctcccactctgaccgatacgtg

SEQ ID NO: 345474 - DNA, 28 bp, Artificial Sequence
  Description of Artificial Sequence: Synthetic oligonucleotide
tgacctcccactctgaccgatacgtgag

SEQ ID NO: 345475 - DNA, 27 bp, Artificial Sequence
  Description of Artificial Sequence: Synthetic oligonucleotide
gacctcccactctgaccgatacgtgag

SEQ ID NO: 345476 - DNA, 28 bp, Artificial Sequence
  Description of Artificial Sequence: Synthetic oligonucleotide
acctcccactctgaccgatacgtgagtg

SEQ ID NO: 345477 - DNA, 27 bp, Artificial Sequence
  Description of Artificial Sequence: Synthetic oligonucleotide
cctcccactctgaccgatacgtgagtg

SEQ ID NO: 345478 - DNA, 28 bp, Artificial Sequence
  Description of Artificial Sequence: Synthetic oligonucleotide
ctcccactctgaccgatacgtgagtgac

SEQ ID NO: 345479 - DNA, 31 bp, Artificial Sequence
  Description of Artificial Sequence: Synthetic oligonucleotide
tcccactctgaccgatacgtgagtgactttg

SEQ ID NO: 345480 - DNA, 30 bp, Artificial Sequence
  Description of Artificial Sequence: Synthetic oligonucleotide
cccactctgaccgatacgtgagtgactttg

SEQ ID NO: 345481 - DNA, 31 bp, Artificial Sequence
  Description of Artificial Sequence: Synthetic oligonucleotide
ccactctgaccgatacgtgagtgactttgag

SEQ ID NO: 345482 - DNA, 32 bp, Artificial Sequence
  Description of Artificial Sequence: Synthetic oligonucleotide
cactctgaccgatacgtgagtgactttgagag

SEQ ID NO: 345483 - DNA, 32 bp, Artificial Sequence
  Description of Artificial Sequence: Synthetic oligonucleotide
actctgaccgatacgtgagtgactttgagagc

SEQ ID NO: 345484 - DNA, 31 bp, Artificial Sequence
  Description of Artificial Sequence: Synthetic oligonucleotide
ctctgaccgatacgtgagtgactttgagagc

SEQ ID NO: 345485 - DNA, 31 bp, Artificial Sequence
  Description of Artificial Sequence: Synthetic oligonucleotide
tctgaccgatacgtgagtgactttgagagcg

SEQ ID NO: 345486 - DNA, 30 bp, Artificial Sequence
  Description of Artificial Sequence: Synthetic oligonucleotide
ctgaccgatacgtgagtgactttgagagcg

SEQ ID NO: 345487 - DNA, 31 bp, Artificial Sequence
  Description of Artificial Sequence: Synthetic oligonucleotide
tgaccgatacgtgagtgactttgagagcgag

SEQ ID NO: 345488 - DNA, 30 bp, Artificial Sequence
  Description of Artificial Sequence: Synthetic oligonucleotide
gaccgatacgtgagtgactttgagagcgag

SEQ ID NO: 345489 - DNA, 30 bp, Artificial Sequence
  Description of Artificial Sequence: Synthetic oligonucleotide
accgatacgtgagtgactttgagagcgagg

SEQ ID NO: 345490 - DNA, 29 bp, Artificial Sequence
  Description of Artificial Sequence: Synthetic oligonucleotide
ccgatacgtgagtgactttgagagcgagg

SEQ ID NO: 345491 - DNA, 29 bp, Artificial Sequence
  Description of Artificial Sequence: Synthetic oligonucleotide
cgatacgtgagtgactttgagagcgaggg

SEQ ID NO: 345492 - DNA, 29 bp, Artificial Sequence
  Description of Artificial Sequence: Synthetic oligonucleotide
gatacgtgagtgactttgagagcgagggg

SEQ ID NO: 345493 - DNA, 29 bp, Artificial Sequence
  Description of Artificial Sequence: Synthetic oligonucleotide
atacgtgagtgactttgagagcgaggggc

SEQ ID NO: 345494 - DNA, 28 bp, Artificial Sequence
  Description of Artificial Sequence: Synthetic oligonucleotide
tacgtgagtgactttgagagcgaggggc

SEQ ID NO: 345495 - DNA, 27 bp, Artificial Sequence
  Description of Artificial Sequence: Synthetic oligonucleotide
acgtgagtgactttgagagcgaggggc

SEQ ID NO: 345496 - DNA, 26 bp, Artificial Sequence
  Description of Artificial Sequence: Synthetic oligonucleotide
cgtgagtgactttgagagcgaggggc

SEQ ID NO: 345497 - DNA, 26 bp, Artificial Sequence
  Description of Artificial Sequence: Synthetic oligonucleotide
gtgagtgactttgagagcgaggggcc

SEQ ID NO: 345498 - DNA, 26 bp, Artificial Sequence
  Description of Artificial Sequence: Synthetic oligonucleotide
tgagtgactttgagagcgaggggccg

SEQ ID NO: 345499 - DNA, 25 bp, Artificial Sequence
  Description of Artificial Sequence: Synthetic oligonucleotide
gagtgactttgagagcgaggggccg

SEQ ID NO: 345500 - DNA, 26 bp, Artificial Sequence
  Description of Artificial Sequence: Synthetic oligonucleotide
agtgactttgagagcgaggggccgca

SEQ ID NO: 345501 - DNA, 25 bp, Artificial Sequence
  Description of Artificial Sequence: Synthetic oligonucleotide
gtgactttgagagcgaggggccgca

SEQ ID NO: 345502 - DNA, 25 bp, Artificial Sequence
  Description of Artificial Sequence: Synthetic oligonucleotide
tgactttgagagcgaggggccgcac

SEQ ID NO: 345503 - DNA, 24 bp, Artificial Sequence
  Description of Artificial Sequence: Synthetic oligonucleotide
gactttgagagcgaggggccgcac

SEQ ID NO: 345504 - DNA, 25 bp, Artificial Sequence
  Description of Artificial Sequence: Synthetic oligonucleotide
actttgagagcgaggggccgcacgt

SEQ ID NO: 345505 - DNA, 24 bp, Artificial Sequence
  Description of Artificial Sequence: Synthetic oligonucleotide
ctttgagagcgaggggccgcacgt

SEQ ID NO: 345506 - DNA, 24 bp, Artificial Sequence
  Description of Artificial Sequence: Synthetic oligonucleotide
tttgagagcgaggggccgcacgtc

SEQ ID NO: 345507 - DNA, 23 bp, Artificial Sequence
  Description of Artificial Sequence: Synthetic oligonucleotide
ttgagagcgaggggccgcacgtc

SEQ ID NO: 345508 - DNA, 22 bp, Artificial Sequence
  Description of Artificial Sequence: Synthetic oligonucleotide
tgagagcgaggggccgcacgtc

SEQ ID NO: 345509 - DNA, 21 bp, Artificial Sequence
  Description of Artificial Sequence: Synthetic oligonucleotide
gagagcgaggggccgcacgtc

SEQ ID NO: 345510 - DNA, 22 bp, Artificial Sequence
  Description of Artificial Sequence: Synthetic oligonucleotide
agagcgaggggccgcacgtcct

SEQ ID NO: 345511 - DNA, 21 bp, Artificial Sequence
  Description of Artificial Sequence: Synthetic oligonucleotide
gagcgaggggccgcacgtcct

SEQ ID NO: 345512 - DNA, 21 bp, Artificial Sequence
  Description of Artificial Sequence: Synthetic oligonucleotide
agcgaggggccgcacgtcctg

SEQ ID NO: 345513 - DNA, 20 bp, Artificial Sequence
  Description of Artificial Sequence: Synthetic oligonucleotide
gcgaggggccgcacgtcctg

SEQ ID NO: 345514 - DNA, 21 bp, Artificial Sequence
  Description of Artificial Sequence: Synthetic oligonucleotide
cgaggggccgcacgtcctggt

SEQ ID NO: 345515 - DNA, 27 bp, Artificial Sequence
  Description of Artificial Sequence: Synthetic oligonucleotide
gaggggccgcacgtcctggtgtatttt

SEQ ID NO: 345516 - DNA, 27 bp, Artificial Sequence
  Description of Artificial Sequence: Synthetic oligonucleotide
aggggccgcacgtcctggtgtattttg

SEQ ID NO: 345517 - DNA, 27 bp, Artificial Sequence
  Description of Artificial Sequence: Synthetic oligonucleotide
ggggccgcacgtcctggtgtattttgt

SEQ ID NO: 345518 - DNA, 27 bp, Artificial Sequence
  Description of Artificial Sequence: Synthetic oligonucleotide
gggccgcacgtcctggtgtattttgtc

SEQ ID NO: 345519 - DNA, 28 bp, Artificial Sequence
  Description of Artificial Sequence: Synthetic oligonucleotide
ggccgcacgtcctggtgtattttgtctc

SEQ ID NO: 345520 - DNA, 28 bp, Artificial Sequence
  Description of Artificial Sequence: Synthetic oligonucleotide
gccgcacgtcctggtgtattttgtctcg

SEQ ID NO: 345521 - DNA, 28 bp, Artificial Sequence
  Description of Artificial Sequence: Synthetic oligonucleotide
ccgcacgtcctggtgtattttgtctcgg

SEQ ID NO: 345522 - DNA, 29 bp, Artificial Sequence
  Description of Artificial Sequence: Synthetic oligonucleotide
cgcacgtcctggtgtattttgtctcggtc

SEQ ID NO: 345523 - DNA, 29 bp, Artificial Sequence
  Description of Artificial Sequence: Synthetic oligonucleotide
gcacgtcctggtgtattttgtctcggtcc

SEQ ID NO: 345524 - DNA, 29 bp, Artificial Sequence
  Description of Artificial Sequence: Synthetic oligonucleotide
cacgtcctggtgtattttgtctcggtccc

SEQ ID NO: 345525 - DNA, 29 bp, Artificial Sequence
  Description of Artificial Sequence: Synthetic oligonucleotide
acgtcctggtgtattttgtctcggtcccg

SEQ ID NO: 345526 - DNA, 28 bp, Artificial Sequence
  Description of Artificial Sequence: Synthetic oligonucleotide
cgtcctggtgtattttgtctcggtcccg

SEQ ID NO: 345527 - DNA, 29 bp, Artificial Sequence
  Description of Artificial Sequence: Synthetic oligonucleotide
gtcctggtgtattttgtctcggtcccgac

SEQ ID NO: 345528 - DNA, 29 bp, Artificial Sequence
  Description of Artificial Sequence: Synthetic oligonucleotide
tcctggtgtattttgtctcggtcccgacc

SEQ ID NO: 345529 - DNA, 28 bp, Artificial Sequence
  Description of Artificial Sequence: Synthetic oligonucleotide
cctggtgtattttgtctcggtcccgacc

SEQ ID NO: 345530 - DNA, 29 bp, Artificial Sequence
  Description of Artificial Sequence: Synthetic oligonucleotide
ctggtgtattttgtctcggtcccgacctc

SEQ ID NO: 345531 - DNA, 29 bp, Artificial Sequence
  Description of Artificial Sequence: Synthetic oligonucleotide
tggtgtattttgtctcggtcccgacctcc

SEQ ID NO: 345532 - DNA, 28 bp, Artificial Sequence
  Description of Artificial Sequence: Synthetic oligonucleotide
ggtgtattttgtctcggtcccgacctcc

SEQ ID NO: 345533 - DNA, 28 bp, Artificial Sequence
  Description of Artificial Sequence: Synthetic oligonucleotide
gtgtattttgtctcggtcccgacctccc

SEQ ID NO: 345534 - DNA, 28 bp, Artificial Sequence
  Description of Artificial Sequence: Synthetic oligonucleotide
tgtattttgtctcggtcccgacctcccg

SEQ ID NO: 345535 - DNA, 27 bp, Artificial Sequence
  Description of Artificial Sequence: Synthetic oligonucleotide
gtattttgtctcggtcccgacctcccg

SEQ ID NO: 345536 - DNA, 27 bp, Artificial Sequence
  Description of Artificial Sequence: Synthetic oligonucleotide
tattttgtctcggtcccgacctcccgg

SEQ ID NO: 345537 - DNA, 26 bp, Artificial Sequence
  Description of Artificial Sequence: Synthetic oligonucleotide
attttgtctcggtcccgacctcccgg

SEQ ID NO: 345538 - DNA, 25 bp, Artificial Sequence
  Description of Artificial Sequence: Synthetic oligonucleotide
ttttgtctcggtcccgacctcccgg

SEQ ID NO: 345539 - DNA, 24 bp, Artificial Sequence
  Description of Artificial Sequence: Synthetic oligonucleotide
tttgtctcggtcccgacctcccgg

SEQ ID NO: 345540 - DNA, 23 bp, Artificial Sequence
  Description of Artificial Sequence: Synthetic oligonucleotide
ttgtctcggtcccgacctcccgg

SEQ ID NO: 345541 - DNA, 22 bp, Artificial Sequence
  Description of Artificial Sequence: Synthetic oligonucleotide
tgtctcggtcccgacctcccgg

SEQ ID NO: 345542 - DNA, 21 bp, Artificial Sequence
  Description of Artificial Sequence: Synthetic oligonucleotide
gtctcggtcccgacctcccgg

SEQ ID NO: 345543 - DNA, 22 bp, Artificial Sequence
  Description of Artificial Sequence: Synthetic oligonucleotide
tctcggtcccgacctcccggca

SEQ ID NO: 345544 - DNA, 21 bp, Artificial Sequence
  Description of Artificial Sequence: Synthetic oligonucleotide
ctcggtcccgacctcccggca

SEQ ID NO: 345545 - DNA, 22 bp, Artificial Sequence
  Description of Artificial Sequence: Synthetic oligonucleotide
tcggtcccgacctcccggcagt

SEQ ID NO: 345546 - DNA, 21 bp, Artificial Sequence
  Description of Artificial Sequence: Synthetic oligonucleotide
cggtcccgacctcccggcagt

SEQ ID NO: 345547 - DNA, 21 bp, Artificial Sequence
  Description of Artificial Sequence: Synthetic oligonucleotide
ggtcccgacctcccggcagtg

SEQ ID NO: 345548 - DNA, 21 bp, Artificial Sequence
  Description of Artificial Sequence: Synthetic oligonucleotide
gtcccgacctcccggcagtgc

SEQ ID NO: 345549 - DNA, 22 bp, Artificial Sequence
  Description of Artificial Sequence: Synthetic oligonucleotide
tcccgacctcccggcagtgcgt

SEQ ID NO: 345550 - DNA, 21 bp, Artificial Sequence
  Description of Artificial Sequence: Synthetic oligonucleotide
cccgacctcccggcagtgcgt

SEQ ID NO: 345551 - DNA, 21 bp, Artificial Sequence
  Description of Artificial Sequence: Synthetic oligonucleotide
ccgacctcccggcagtgcgtg

SEQ ID NO: 345552 - DNA, 21 bp, Artificial Sequence
  Description of Artificial Sequence: Synthetic oligonucleotide
cgacctcccggcagtgcgtgg

SEQ ID NO: 345553 - DNA, 21 bp, Artificial Sequence
  Description of Artificial Sequence: Synthetic oligonucleotide
gacctcccggcagtgcgtggc

SEQ ID NO: 345554 - DNA, 24 bp, Artificial Sequence
  Description of Artificial Sequence: Synthetic oligonucleotide
acctcccggcagtgcgtggccttt

SEQ ID NO: 345555 - DNA, 23 bp, Artificial Sequence
  Description of Artificial Sequence: Synthetic oligonucleotide
cctcccggcagtgcgtggccttt

SEQ ID NO: 345556 - DNA, 24 bp, Artificial Sequence
  Description of Artificial Sequence: Synthetic oligonucleotide
ctcccggcagtgcgtggcctttga

SEQ ID NO: 345557 - DNA, 24 bp, Artificial Sequence
  Description of Artificial Sequence: Synthetic oligonucleotide
tcccggcagtgcgtggcctttgag

SEQ ID NO: 345558 - DNA, 23 bp, Artificial Sequence
  Description of Artificial Sequence: Synthetic oligonucleotide
cccggcagtgcgtggcctttgag

SEQ ID NO: 345559 - DNA, 23 bp, Artificial Sequence
  Description of Artificial Sequence: Synthetic oligonucleotide
ccggcagtgcgtggcctttgagg

SEQ ID NO: 345560 - DNA, 24 bp, Artificial Sequence
  Description of Artificial Sequence: Synthetic oligonucleotide
cggcagtgcgtggcctttgaggca

SEQ ID NO: 345561 - DNA, 25 bp, Artificial Sequence
  Description of Artificial Sequence: Synthetic oligonucleotide
ggcagtgcgtggcctttgaggcagt

SEQ ID NO: 345562 - DNA, 25 bp, Artificial Sequence
  Description of Artificial Sequence: Synthetic oligonucleotide
gcagtgcgtggcctttgaggcagtg

SEQ ID NO: 345563 - DNA, 26 bp, Artificial Sequence
  Description of Artificial Sequence: Synthetic oligonucleotide
cagtgcgtggcctttgaggcagtgca

SEQ ID NO: 345564 - DNA, 26 bp, Artificial Sequence
  Description of Artificial Sequence: Synthetic oligonucleotide
agtgcgtggcctttgaggcagtgcag

SEQ ID NO: 345565 - DNA, 25 bp, Artificial Sequence
  Description of Artificial Sequence: Synthetic oligonucleotide
gtgcgtggcctttgaggcagtgcag

SEQ ID NO: 345566 - DNA, 27 bp, Artificial Sequence
  Description of Artificial Sequence: Synthetic oligonucleotide
tgcgtggcctttgaggcagtgcaggaa

SEQ ID NO: 345567 - DNA, 26 bp, Artificial Sequence
  Description of Artificial Sequence: Synthetic oligonucleotide
gcgtggcctttgaggcagtgcaggaa

SEQ ID NO: 345568 - DNA, 27 bp, Artificial Sequence
  Description of Artificial Sequence: Synthetic oligonucleotide
cgtggcctttgaggcagtgcaggaact

SEQ ID NO: 345569 - DNA, 27 bp, Artificial Sequence
  Description of Artificial Sequence: Synthetic oligonucleotide
gtggcctttgaggcagtgcaggaactg

SEQ ID NO: 345570 - DNA, 27 bp, Artificial Sequence
  Description of Artificial Sequence: Synthetic oligonucleotide
tggcctttgaggcagtgcaggaactgc

SEQ ID NO: 345571 - DNA, 26 bp, Artificial Sequence
  Description of Artificial Sequence: Synthetic oligonucleotide
ggcctttgaggcagtgcaggaactgc

SEQ ID NO: 345572 - DNA, 26 bp, Artificial Sequence
  Description of Artificial Sequence: Synthetic oligonucleotide
gcctttgaggcagtgcaggaactgcc

SEQ ID NO: 345573 - DNA, 26 bp, Artificial Sequence
  Description of Artificial Sequence: Synthetic oligonucleotide
cctttgaggcagtgcaggaactgccg

SEQ ID NO: 345574 - DNA, 27 bp, Artificial Sequence
  Description of Artificial Sequence: Synthetic oligonucleotide
ctttgaggcagtgcaggaactgccggt

SEQ ID NO: 345575 - DNA, 27 bp, Artificial Sequence
  Description of Artificial Sequence: Synthetic oligonucleotide
tttgaggcagtgcaggaactgccggtg

SEQ ID NO: 345576 - DNA, 26 bp, Artificial Sequence
  Description of Artificial Sequence: Synthetic oligonucleotide
ttgaggcagtgcaggaactgccggtg

SEQ ID NO: 345577 - DNA, 25 bp, Artificial Sequence
  Description of Artificial Sequence: Synthetic oligonucleotide
tgaggcagtgcaggaactgccggtg

SEQ ID NO: 345578 - DNA, 24 bp, Artificial Sequence
  Description of Artificial Sequence: Synthetic oligonucleotide
gaggcagtgcaggaactgccggtg

SEQ ID NO: 345579 - DNA, 24 bp, Artificial Sequence
  Description of Artificial Sequence: Synthetic oligonucleotide
aggcagtgcaggaactgccggtgg

SEQ ID NO: 345580 - DNA, 23 bp, Artificial Sequence
  Description of Artificial Sequence: Synthetic oligonucleotide
ggcagtgcaggaactgccggtgg

SEQ ID NO: 345581 - DNA, 23 bp, Artificial Sequence
  Description of Artificial Sequence: Synthetic oligonucleotide
gcagtgcaggaactgccggtggc

SEQ ID NO: 345582 - DNA, 23 bp, Artificial Sequence
  Description of Artificial Sequence: Synthetic oligonucleotide
cagtgcaggaactgccggtggcg

SEQ ID NO: 345583 - DNA, 24 bp, Artificial Sequence
  Description of Artificial Sequence: Synthetic oligonucleotide
agtgcaggaactgccggtggcgct

SEQ ID NO: 345584 - DNA, 23 bp, Artificial Sequence
  Description of Artificial Sequence: Synthetic oligonucleotide
gtgcaggaactgccggtggcgct

SEQ ID NO: 345585 - DNA, 23 bp, Artificial Sequence
  Description of Artificial Sequence: Synthetic oligonucleotide
tgcaggaactgccggtggcgctg

SEQ ID NO: 345586 - DNA, 22 bp, Artificial Sequence
  Description of Artificial Sequence: Synthetic oligonucleotide
gcaggaactgccggtggcgctg

SEQ ID NO: 345587 - DNA, 23 bp, Artificial Sequence
  Description of Artificial Sequence: Synthetic oligonucleotide
caggaactgccggtggcgctggt

SEQ ID NO: 345588 - DNA, 23 bp, Artificial Sequence
  Description of Artificial Sequence: Synthetic oligonucleotide
aggaactgccggtggcgctggtg

SEQ ID NO: 345589 - DNA, 22 bp, Artificial Sequence
  Description of Artificial Sequence: Synthetic oligonucleotide
ggaactgccggtggcgctggtg

SEQ ID NO: 345590 - DNA, 23 bp, Artificial Sequence
  Description of Artificial Sequence: Synthetic oligonucleotide
gaactgccggtggcgctggtgca

SEQ ID NO: 345591 - DNA, 23 bp, Artificial Sequence
  Description of Artificial Sequence: Synthetic oligonucleotide
aactgccggtggcgctggtgcac

SEQ ID NO: 345592 - DNA, 22 bp, Artificial Sequence
  Description of Artificial Sequence: Synthetic oligonucleotide
actgccggtggcgctggtgcac

SEQ ID NO: 345593 - DNA, 21 bp, Artificial Sequence
  Description of Artificial Sequence: Synthetic oligonucleotide
ctgccggtggcgctggtgcac

SEQ ID NO: 345594 - DNA, 21 bp, Artificial Sequence
  Description of Artificial Sequence: Synthetic oligonucleotide
tgccggtggcgctggtgcacc

SEQ ID NO: 345595 - DNA, 20 bp, Artificial Sequence
  Description of Artificial Sequence: Synthetic oligonucleotide
gccggtggcgctggtgcacc

SEQ ID NO: 345596 - DNA, 20 bp, Artificial Sequence
  Description of Artificial Sequence: Synthetic oligonucleotide
ccggtggcgctggtgcaccc

SEQ ID NO: 345597 - DNA, 20 bp, Artificial Sequence
  Description of Artificial Sequence: Synthetic oligonucleotide
cggtggcgctggtgcacccg

SEQ ID NO: 345598 - DNA, 20 bp, Artificial Sequence
  Description of Artificial Sequence: Synthetic oligonucleotide
ggtggcgctggtgcacccgg

SEQ ID NO: 345599 - DNA, 20 bp, Artificial Sequence
  Description of Artificial Sequence: Synthetic oligonucleotide
gtggcgctggtgcacccggc

SEQ ID NO: 345600 - DNA, 21 bp, Artificial Sequence
  Description of Artificial Sequence: Synthetic oligonucleotide
tggcgctggtgcacccggcca

SEQ ID NO: 345601 - DNA, 20 bp, Artificial Sequence
  Description of Artificial Sequence: Synthetic oligonucleotide
ggcgctggtgcacccggcca

SEQ ID NO: 345602 - DNA, 20 bp, Artificial Sequence
  Description of Artificial Sequence: Synthetic oligonucleotide
gcgctggtgcacccggccag

SEQ ID NO: 345603 - DNA, 20 bp, Artificial Sequence
  Description of Artificial Sequence: Synthetic oligonucleotide
cgctggtgcacccggccagc

SEQ ID NO: 345604 - DNA, 20 bp, Artificial Sequence
  Description of Artificial Sequence: Synthetic oligonucleotide
gctggtgcacccggccagcc

SEQ ID NO: 345605 - DNA, 22 bp, Artificial Sequence
  Description of Artificial Sequence: Synthetic oligonucleotide
ctggtgcacccggccagcccaa

SEQ ID NO: 345606 - DNA, 22 bp, Artificial Sequence
  Description of Artificial Sequence: Synthetic oligonucleotide
tggtgcacccggccagcccaac

SEQ ID NO: 345607 - DNA, 21 bp, Artificial Sequence
  Description of Artificial Sequence: Synthetic oligonucleotide
ggtgcacccggccagcccaac

SEQ ID NO: 345608 - DNA, 21 bp, Artificial Sequence
  Description of Artificial Sequence: Synthetic oligonucleotide
gtgcacccggccagcccaacc

SEQ ID NO: 345609 - DNA, 22 bp, Artificial Sequence
  Description of Artificial Sequence: Synthetic oligonucleotide
tgcacccggccagcccaaccct

SEQ ID NO: 345610 - DNA, 21 bp, Artificial Sequence
  Description of Artificial Sequence: Synthetic oligonucleotide
gcacccggccagcccaaccct

SEQ ID NO: 345611 - DNA, 23 bp, Artificial Sequence
  Description of Artificial Sequence: Synthetic oligonucleotide
cacccggccagcccaaccctgtt

SEQ ID NO: 345612 - DNA, 23 bp, Artificial Sequence
  Description of Artificial Sequence: Synthetic oligonucleotide
acccggccagcccaaccctgttc

SEQ ID NO: 345613 - DNA, 22 bp, Artificial Sequence
  Description of Artificial Sequence: Synthetic oligonucleotide
cccggccagcccaaccctgttc

SEQ ID NO: 345614 - DNA, 23 bp, Artificial Sequence
  Description of Artificial Sequence: Synthetic oligonucleotide
ccggccagcccaaccctgttcga

SEQ ID NO: 345615 - DNA, 25 bp, Artificial Sequence
  Description of Artificial Sequence: Synthetic oligonucleotide
cggccagcccaaccctgttcgacta

SEQ ID NO: 345616 - DNA, 27 bp, Artificial Sequence
  Description of Artificial Sequence: Synthetic oligonucleotide
ggccagcccaaccctgttcgactacta

SEQ ID NO: 345617 - DNA, 27 bp, Artificial Sequence
  Description of Artificial Sequence: Synthetic oligonucleotide
gccagcccaaccctgttcgactactag

SEQ ID NO: 345618 - DNA, 29 bp, Artificial Sequence
  Description of Artificial Sequence: Synthetic oligonucleotide
ccagcccaaccctgttcgactactagaac

SEQ ID NO: 345619 - DNA, 29 bp, Artificial Sequence
  Description of Artificial Sequence: Synthetic oligonucleotide
cagcccaaccctgttcgactactagaacc

SEQ ID NO: 345620 - DNA, 29 bp, Artificial Sequence
  Description of Artificial Sequence: Synthetic oligonucleotide
agcccaaccctgttcgactactagaaccc

SEQ ID NO: 345621 - DNA, 28 bp, Artificial Sequence
  Description of Artificial Sequence: Synthetic oligonucleotide
gcccaaccctgttcgactactagaaccc

SEQ ID NO: 345622 - DNA, 28 bp, Artificial Sequence
  Description of Artificial Sequence: Synthetic oligonucleotide
cccaaccctgttcgactactagaacccc

SEQ ID NO: 345623 - DNA, 28 bp, Artificial Sequence
  Description of Artificial Sequence: Synthetic oligonucleotide
ccaaccctgttcgactactagaaccccg

SEQ ID NO: 345624 - DNA, 29 bp, Artificial Sequence
  Description of Artificial Sequence: Synthetic oligonucleotide
caaccctgttcgactactagaaccccgag

SEQ ID NO: 345625 - DNA, 29 bp, Artificial Sequence
  Description of Artificial Sequence: Synthetic oligonucleotide
aaccctgttcgactactagaaccccgagg

SEQ ID NO: 345626 - DNA, 28 bp, Artificial Sequence
  Description of Artificial Sequence: Synthetic oligonucleotide
accctgttcgactactagaaccccgagg

SEQ ID NO: 345627 - DNA, 27 bp, Artificial Sequence
  Description of Artificial Sequence: Synthetic oligonucleotide
ccctgttcgactactagaaccccgagg

SEQ ID NO: 345628 - DNA, 27 bp, Artificial Sequence
  Description of Artificial Sequence: Synthetic oligonucleotide
cctgttcgactactagaaccccgaggg

SEQ ID NO: 345629 - DNA, 27 bp, Artificial Sequence
  Description of Artificial Sequence: Synthetic oligonucleotide
ctgttcgactactagaaccccgagggc

SEQ ID NO: 345630 - DNA, 28 bp, Artificial Sequence
  Description of Artificial Sequence: Synthetic oligonucleotide
tgttcgactactagaaccccgagggcag

SEQ ID NO: 345631 - DNA, 27 bp, Artificial Sequence
  Description of Artificial Sequence: Synthetic oligonucleotide
gttcgactactagaaccccgagggcag

SEQ ID NO: 345632 - DNA, 29 bp, Artificial Sequence
  Description of Artificial Sequence: Synthetic oligonucleotide
ttcgactactagaaccccgagggcagatg

SEQ ID NO: 345633 - DNA, 28 bp, Artificial Sequence
  Description of Artificial Sequence: Synthetic oligonucleotide
tcgactactagaaccccgagggcagatg

SEQ ID NO: 345634 - DNA, 27 bp, Artificial Sequence
  Description of Artificial Sequence: Synthetic oligonucleotide
cgactactagaaccccgagggcagatg

SEQ ID NO: 345635 - DNA, 29 bp, Artificial Sequence
  Description of Artificial Sequence: Synthetic oligonucleotide
gactactagaaccccgagggcagatgttg

SEQ ID NO: 345636 - DNA, 30 bp, Artificial Sequence
  Description of Artificial Sequence: Synthetic oligonucleotide
actactagaaccccgagggcagatgttgtg

SEQ ID NO: 345637 - DNA, 29 bp, Artificial Sequence
  Description of Artificial Sequence: Synthetic oligonucleotide
ctactagaaccccgagggcagatgttgtg

SEQ ID NO: 345638 - DNA, 30 bp, Artificial Sequence
  Description of Artificial Sequence: Synthetic oligonucleotide
tactagaaccccgagggcagatgttgtgtg

SEQ ID NO: 345639 - DNA, 29 bp, Artificial Sequence
  Description of Artificial Sequence: Synthetic oligonucleotide
actagaaccccgagggcagatgttgtgtg

SEQ ID NO: 345640 - DNA, 28 bp, Artificial Sequence
  Description of Artificial Sequence: Synthetic oligonucleotide
ctagaaccccgagggcagatgttgtgtg

SEQ ID NO: 345641 - DNA, 33 bp, Artificial Sequence
  Description of Artificial Sequence: Synthetic oligonucleotide
tagaaccccgagggcagatgttgtgtgttttag

SEQ ID NO: 345642 - DNA, 32 bp, Artificial Sequence
  Description of Artificial Sequence: Synthetic oligonucleotide
agaaccccgagggcagatgttgtgtgttttag

SEQ ID NO: 345643 - DNA, 31 bp, Artificial Sequence
  Description of Artificial Sequence: Synthetic oligonucleotide
gaaccccgagggcagatgttgtgtgttttag

SEQ ID NO: 345644 - DNA, 31 bp, Artificial Sequence
  Description of Artificial Sequence: Synthetic oligonucleotide
aaccccgagggcagatgttgtgtgttttagg

SEQ ID NO: 345645 - DNA, 30 bp, Artificial Sequence
  Description of Artificial Sequence: Synthetic oligonucleotide
accccgagggcagatgttgtgtgttttagg

SEQ ID NO: 345646 - DNA, 29 bp, Artificial Sequence
  Description of Artificial Sequence: Synthetic oligonucleotide
ccccgagggcagatgttgtgtgttttagg

SEQ ID NO: 345647 - DNA, 29 bp, Artificial Sequence
  Description of Artificial Sequence: Synthetic oligonucleotide
cccgagggcagatgttgtgtgttttaggg

SEQ ID NO: 345648 - DNA, 29 bp, Artificial Sequence
  Description of Artificial Sequence: Synthetic oligonucleotide
ccgagggcagatgttgtgtgttttagggg

SEQ ID NO: 345649 - DNA, 29 bp, Artificial Sequence
  Description of Artificial Sequence: Synthetic oligonucleotide
cgagggcagatgttgtgtgttttaggggg

SEQ ID NO: 345650 - DNA, 29 bp, Artificial Sequence
  Description of Artificial Sequence: Synthetic oligonucleotide
gagggcagatgttgtgtgttttagggggc

SEQ ID NO: 345651 - DNA, 30 bp, Artificial Sequence
  Description of Artificial Sequence: Synthetic oligonucleotide
agggcagatgttgtgtgttttagggggcac

SEQ ID NO: 345652 - DNA, 29 bp, Artificial Sequence
  Description of Artificial Sequence: Synthetic oligonucleotide
gggcagatgttgtgtgttttagggggcac

SEQ ID NO: 345653 - DNA, 29 bp, Artificial Sequence
  Description of Artificial Sequence: Synthetic oligonucleotide
ggcagatgttgtgtgttttagggggcacc

SEQ ID NO: 345654 - DNA, 31 bp, Artificial Sequence
  Description of Artificial Sequence: Synthetic oligonucleotide
gcagatgttgtgtgttttagggggcaccatg

SEQ ID NO: 345655 - DNA, 34 bp, Artificial Sequence
  Description of Artificial Sequence: Synthetic oligonucleotide
cagatgttgtgtgttttagggggcaccatgtaag

SEQ ID NO: 345656 - DNA, 35 bp, Artificial Sequence
  Description of Artificial Sequence: Synthetic oligonucleotide
agatgttgtgtgttttagggggcaccatgtaagag

SEQ ID NO: 345657 - DNA, 34 bp, Artificial Sequence
  Description of Artificial Sequence: Synthetic oligonucleotide
gatgttgtgtgttttagggggcaccatgtaagag

SEQ ID NO: 345658 - DNA, 34 bp, Artificial Sequence
  Description of Artificial Sequence: Synthetic oligonucleotide
atgttgtgtgttttagggggcaccatgtaagagc

SEQ ID NO: 345659 - DNA, 33 bp, Artificial Sequence
  Description of Artificial Sequence: Synthetic oligonucleotide
tgttgtgtgttttagggggcaccatgtaagagc

SEQ ID NO: 345660 - DNA, 32 bp, Artificial Sequence
  Description of Artificial Sequence: Synthetic oligonucleotide
gttgtgtgttttagggggcaccatgtaagagc

SEQ ID NO: 345661 - DNA, 33 bp, Artificial Sequence
  Description of Artificial Sequence: Synthetic oligonucleotide
ttgtgtgttttagggggcaccatgtaagagcac

SEQ ID NO: 345662 - DNA, 32 bp, Artificial Sequence
  Description of Artificial Sequence: Synthetic oligonucleotide
tgtgtgttttagggggcaccatgtaagagcac

SEQ ID NO: 345663 - DNA, 31 bp, Artificial Sequence
  Description of Artificial Sequence: Synthetic oligonucleotide
gtgtgttttagggggcaccatgtaagagcac

SEQ ID NO: 345664 - DNA, 32 bp, Artificial Sequence
  Description of Artificial Sequence: Synthetic oligonucleotide
tgtgttttagggggcaccatgtaagagcacac

SEQ ID NO: 345665 - DNA, 31 bp, Artificial Sequence
  Description of Artificial Sequence: Synthetic oligonucleotide
gtgttttagggggcaccatgtaagagcacac

SEQ ID NO: 345666 - DNA, 32 bp, Artificial Sequence
  Description of Artificial Sequence: Synthetic oligonucleotide
tgttttagggggcaccatgtaagagcacactc

SEQ ID NO: 345667 - DNA, 31 bp, Artificial Sequence
  Description of Artificial Sequence: Synthetic oligonucleotide
gttttagggggcaccatgtaagagcacactc

SEQ ID NO: 345668 - DNA, 33 bp, Artificial Sequence
  Description of Artificial Sequence: Synthetic oligonucleotide
ttttagggggcaccatgtaagagcacactcttg

SEQ ID NO: 345669 - DNA, 32 bp, Artificial Sequence
  Description of Artificial Sequence: Synthetic oligonucleotide
tttagggggcaccatgtaagagcacactcttg

SEQ ID NO: 345670 - DNA, 31 bp, Artificial Sequence
  Description of Artificial Sequence: Synthetic oligonucleotide
ttagggggcaccatgtaagagcacactcttg

SEQ ID NO: 345671 - DNA, 30 bp, Artificial Sequence
  Description of Artificial Sequence: Synthetic oligonucleotide
tagggggcaccatgtaagagcacactcttg

SEQ ID NO: 345672 - DNA, 29 bp, Artificial Sequence
  Description of Artificial Sequence: Synthetic oligonucleotide
agggggcaccatgtaagagcacactcttg

SEQ ID NO: 345673 - DNA, 28 bp, Artificial Sequence
  Description of Artificial Sequence: Synthetic oligonucleotide
gggggcaccatgtaagagcacactcttg

SEQ ID NO: 345674 - DNA, 28 bp, Artificial Sequence
  Description of Artificial Sequence: Synthetic oligonucleotide
ggggcaccatgtaagagcacactcttgg

SEQ ID NO: 345675 - DNA, 28 bp, Artificial Sequence
  Description of Artificial Sequence: Synthetic oligonucleotide
gggcaccatgtaagagcacactcttggc

SEQ ID NO: 345676 - DNA, 28 bp, Artificial Sequence
  Description of Artificial Sequence: Synthetic oligonucleotide
ggcaccatgtaagagcacactcttggcg

SEQ ID NO: 345677 - DNA, 29 bp, Artificial Sequence
  Description of Artificial Sequence: Synthetic oligonucleotide
gcaccatgtaagagcacactcttggcgac

SEQ ID NO: 345678 - DNA, 29 bp, Artificial Sequence
  Description of Artificial Sequence: Synthetic oligonucleotide
caccatgtaagagcacactcttggcgacc

SEQ ID NO: 345679 - DNA, 31 bp, Artificial Sequence
  Description of Artificial Sequence: Synthetic oligonucleotide
accatgtaagagcacactcttggcgaccttg

SEQ ID NO: 345680 - DNA, 30 bp, Artificial Sequence
  Description of Artificial Sequence: Synthetic oligonucleotide
ccatgtaagagcacactcttggcgaccttg

SEQ ID NO: 345681 - DNA, 31 bp, Artificial Sequence
  Description of Artificial Sequence: Synthetic oligonucleotide
catgtaagagcacactcttggcgaccttgtg

SEQ ID NO: 345682 - DNA, 33 bp, Artificial Sequence
  Description of Artificial Sequence: Synthetic oligonucleotide
atgtaagagcacactcttggcgaccttgtgtac

SEQ ID NO: 345683 - DNA, 32 bp, Artificial Sequence
  Description of Artificial Sequence: Synthetic oligonucleotide
tgtaagagcacactcttggcgaccttgtgtac

SEQ ID NO: 345684 - DNA, 31 bp, Artificial Sequence
  Description of Artificial Sequence: Synthetic oligonucleotide
gtaagagcacactcttggcgaccttgtgtac

SEQ ID NO: 345685 - DNA, 32 bp, Artificial Sequence
  Description of Artificial Sequence: Synthetic oligonucleotide
taagagcacactcttggcgaccttgtgtactg

SEQ ID NO: 345686 - DNA, 31 bp, Artificial Sequence
  Description of Artificial Sequence: Synthetic oligonucleotide
aagagcacactcttggcgaccttgtgtactg

SEQ ID NO: 345687 - DNA, 30 bp, Artificial Sequence
  Description of Artificial Sequence: Synthetic oligonucleotide
agagcacactcttggcgaccttgtgtactg

SEQ ID NO: 345688 - DNA, 29 bp, Artificial Sequence
  Description of Artificial Sequence: Synthetic oligonucleotide
gagcacactcttggcgaccttgtgtactg

SEQ ID NO: 345689 - DNA, 29 bp, Artificial Sequence
  Description of Artificial Sequence: Synthetic oligonucleotide
agcacactcttggcgaccttgtgtactgc

SEQ ID NO: 345690 - DNA, 28 bp, Artificial Sequence
  Description of Artificial Sequence: Synthetic oligonucleotide
gcacactcttggcgaccttgtgtactgc

SEQ ID NO: 345691 - DNA, 29 bp, Artificial Sequence
  Description of Artificial Sequence: Synthetic oligonucleotide
cacactcttggcgaccttgtgtactgctg

SEQ ID NO: 345692 - DNA, 31 bp, Artificial Sequence
  Description of Artificial Sequence: Synthetic oligonucleotide
acactcttggcgaccttgtgtactgctgaag

SEQ ID NO: 345693 - DNA, 30 bp, Artificial Sequence
  Description of Artificial Sequence: Synthetic oligonucleotide
cactcttggcgaccttgtgtactgctgaag

SEQ ID NO: 345694 - DNA, 31 bp, Artificial Sequence
  Description of Artificial Sequence: Synthetic oligonucleotide
actcttggcgaccttgtgtactgctgaagac

SEQ ID NO: 345695 - DNA, 30 bp, Artificial Sequence
  Description of Artificial Sequence: Synthetic oligonucleotide
ctcttggcgaccttgtgtactgctgaagac

SEQ ID NO: 345696 - DNA, 31 bp, Artificial Sequence
  Description of Artificial Sequence: Synthetic oligonucleotide
tcttggcgaccttgtgtactgctgaagactg

SEQ ID NO: 345697 - DNA, 30 bp, Artificial Sequence
  Description of Artificial Sequence: Synthetic oligonucleotide
cttggcgaccttgtgtactgctgaagactg

SEQ ID NO: 345698 - DNA, 30 bp, Artificial Sequence
  Description of Artificial Sequence: Synthetic oligonucleotide
ttggcgaccttgtgtactgctgaagactgc

SEQ ID NO: 345699 - DNA, 29 bp, Artificial Sequence
  Description of Artificial Sequence: Synthetic oligonucleotide
tggcgaccttgtgtactgctgaagactgc

SEQ ID NO: 345700 - DNA, 28 bp, Artificial Sequence
  Description of Artificial Sequence: Synthetic oligonucleotide
ggcgaccttgtgtactgctgaagactgc

SEQ ID NO: 345701 - DNA, 28 bp, Artificial Sequence
  Description of Artificial Sequence: Synthetic oligonucleotide
gcgaccttgtgtactgctgaagactgcc

SEQ ID NO: 345702 - DNA, 29 bp, Artificial Sequence
  Description of Artificial Sequence: Synthetic oligonucleotide
cgaccttgtgtactgctgaagactgccag

SEQ ID NO: 345703 - DNA, 30 bp, Artificial Sequence
  Description of Artificial Sequence: Synthetic oligonucleotide
gaccttgtgtactgctgaagactgccagtg

SEQ ID NO: 345704 - DNA, 31 bp, Artificial Sequence
  Description of Artificial Sequence: Synthetic oligonucleotide
accttgtgtactgctgaagactgccagtgag

SEQ ID NO: 345705 - DNA, 30 bp, Artificial Sequence
  Description of Artificial Sequence: Synthetic oligonucleotide
ccttgtgtactgctgaagactgccagtgag

SEQ ID NO: 345706 - DNA, 30 bp, Artificial Sequence
  Description of Artificial Sequence: Synthetic oligonucleotide
cttgtgtactgctgaagactgccagtgagc

SEQ ID NO: 345707 - DNA, 31 bp, Artificial Sequence
  Description of Artificial Sequence: Synthetic oligonucleotide
ttgtgtactgctgaagactgccagtgagctg

SEQ ID NO: 345708 - DNA, 30 bp, Artificial Sequence
  Description of Artificial Sequence: Synthetic oligonucleotide
tgtgtactgctgaagactgccagtgagctg

SEQ ID NO: 345709 - DNA, 29 bp, Artificial Sequence
  Description of Artificial Sequence: Synthetic oligonucleotide
gtgtactgctgaagactgccagtgagctg

SEQ ID NO: 345710 - DNA, 30 bp, Artificial Sequence
  Description of Artificial Sequence: Synthetic oligonucleotide
tgtactgctgaagactgccagtgagctgag

SEQ ID NO: 345711 - DNA, 29 bp, Artificial Sequence
  Description of Artificial Sequence: Synthetic oligonucleotide
gtactgctgaagactgccagtgagctgag

SEQ ID NO: 345712 - DNA, 29 bp, Artificial Sequence
  Description of Artificial Sequence: Synthetic oligonucleotide
tactgctgaagactgccagtgagctgagg

SEQ ID NO: 345713 - DNA, 28 bp, Artificial Sequence
  Description of Artificial Sequence: Synthetic oligonucleotide
actgctgaagactgccagtgagctgagg

SEQ ID NO: 345714 - DNA, 27 bp, Artificial Sequence
  Description of Artificial Sequence: Synthetic oligonucleotide
ctgctgaagactgccagtgagctgagg

SEQ ID NO: 345715 - DNA, 27 bp, Artificial Sequence
  Description of Artificial Sequence: Synthetic oligonucleotide
tgctgaagactgccagtgagctgaggg

SEQ ID NO: 345716 - DNA, 26 bp, Artificial Sequence
  Description of Artificial Sequence: Synthetic oligonucleotide
gctgaagactgccagtgagctgaggg

SEQ ID NO: 345717 - DNA, 27 bp, Artificial Sequence
  Description of Artificial Sequence: Synthetic oligonucleotide
ctgaagactgccagtgagctgaggggt

SEQ ID NO: 345718 - DNA, 28 bp, Artificial Sequence
  Description of Artificial Sequence: Synthetic oligonucleotide
tgaagactgccagtgagctgaggggtag

SEQ ID NO: 345719 - DNA, 27 bp, Artificial Sequence
  Description of Artificial Sequence: Synthetic oligonucleotide
gaagactgccagtgagctgaggggtag

SEQ ID NO: 345720 - DNA, 28 bp, Artificial Sequence
  Description of Artificial Sequence: Synthetic oligonucleotide
aagactgccagtgagctgaggggtagtg

SEQ ID NO: 345721 - DNA, 27 bp, Artificial Sequence
  Description of Artificial Sequence: Synthetic oligonucleotide
agactgccagtgagctgaggggtagtg

SEQ ID NO: 345722 - DNA, 26 bp, Artificial Sequence
  Description of Artificial Sequence: Synthetic oligonucleotide
gactgccagtgagctgaggggtagtg

SEQ ID NO: 345723 - DNA, 26 bp, Artificial Sequence
  Description of Artificial Sequence: Synthetic oligonucleotide
actgccagtgagctgaggggtagtgc

SEQ ID NO: 345724 - DNA, 25 bp, Artificial Sequence
  Description of Artificial Sequence: Synthetic oligonucleotide
ctgccagtgagctgaggggtagtgc

SEQ ID NO: 345725 - DNA, 25 bp, Artificial Sequence
  Description of Artificial Sequence: Synthetic oligonucleotide
tgccagtgagctgaggggtagtgcc

SEQ ID NO: 345726 - DNA, 24 bp, Artificial Sequence
  Description of Artificial Sequence: Synthetic oligonucleotide
gccagtgagctgaggggtagtgcc

SEQ ID NO: 345727 - DNA, 25 bp, Artificial Sequence
  Description of Artificial Sequence: Synthetic oligonucleotide
ccagtgagctgaggggtagtgccct

SEQ ID NO: 345728 - DNA, 25 bp, Artificial Sequence
  Description of Artificial Sequence: Synthetic oligonucleotide
cagtgagctgaggggtagtgccctc

SEQ ID NO: 345729 - DNA, 25 bp, Artificial Sequence
  Description of Artificial Sequence: Synthetic oligonucleotide
agtgagctgaggggtagtgccctcc

SEQ ID NO: 345730 - DNA, 24 bp, Artificial Sequence
  Description of Artificial Sequence: Synthetic oligonucleotide
gtgagctgaggggtagtgccctcc

SEQ ID NO: 345731 - DNA, 24 bp, Artificial Sequence
  Description of Artificial Sequence: Synthetic oligonucleotide
tgagctgaggggtagtgccctccc

SEQ ID NO: 345732 - DNA, 23 bp, Artificial Sequence
  Description of Artificial Sequence: Synthetic oligonucleotide
gagctgaggggtagtgccctccc

SEQ ID NO: 345733 - DNA, 24 bp, Artificial Sequence
  Description of Artificial Sequence: Synthetic oligonucleotide
agctgaggggtagtgccctcccca

SEQ ID NO: 345734 - DNA, 23 bp, Artificial Sequence
  Description of Artificial Sequence: Synthetic oligonucleotide
gctgaggggtagtgccctcccca

SEQ ID NO: 345735 - DNA, 23 bp, Artificial Sequence
  Description of Artificial Sequence: Synthetic oligonucleotide
ctgaggggtagtgccctccccag

SEQ ID NO: 345736 - DNA, 23 bp, Artificial Sequence
  Description of Artificial Sequence: Synthetic oligonucleotide
tgaggggtagtgccctccccagc

SEQ ID NO: 345737 - DNA, 22 bp, Artificial Sequence
  Description of Artificial Sequence: Synthetic oligonucleotide
gaggggtagtgccctccccagc

SEQ ID NO: 345738 - DNA, 23 bp, Artificial Sequence
  Description of Artificial Sequence: Synthetic oligonucleotide
aggggtagtgccctccccagcgt

SEQ ID NO: 345739 - DNA, 22 bp, Artificial Sequence
  Description of Artificial Sequence: Synthetic oligonucleotide
ggggtagtgccctccccagcgt

SEQ ID NO: 345740 - DNA, 22 bp, Artificial Sequence
  Description of Artificial Sequence: Synthetic oligonucleotide
gggtagtgccctccccagcgtc

SEQ ID NO: 345741 - DNA, 22 bp, Artificial Sequence
  Description of Artificial Sequence: Synthetic oligonucleotide
ggtagtgccctccccagcgtcg

SEQ ID NO: 345742 - DNA, 22 bp, Artificial Sequence
  Description of Artificial Sequence: Synthetic oligonucleotide
gtagtgccctccccagcgtcgg

SEQ ID NO: 345743 - DNA, 22 bp, Artificial Sequence
  Description of Artificial Sequence: Synthetic oligonucleotide
tagtgccctccccagcgtcggg

SEQ ID NO: 345744 - DNA, 21 bp, Artificial Sequence
  Description of Artificial Sequence: Synthetic oligonucleotide
agtgccctccccagcgtcggg

SEQ ID NO: 345745 - DNA, 20 bp, Artificial Sequence
  Description of Artificial Sequence: Synthetic oligonucleotide
gtgccctccccagcgtcggg

SEQ ID NO: 345746 - DNA, 20 bp, Artificial Sequence
  Description of Artificial Sequence: Synthetic oligonucleotide
tgccctccccagcgtcgggc

SEQ ID NO: 345747 - DNA, 20 bp, Artificial Sequence
  Description of Artificial Sequence: Synthetic oligonucleotide
gccctccccagcgtcgggct

SEQ ID NO: 345748 - DNA, 20 bp, Artificial Sequence
  Description of Artificial Sequence: Synthetic oligonucleotide
ccctccccagcgtcgggcct

SEQ ID NO: 345749 - DNA, 20 bp, Artificial Sequence
  Description of Artificial Sequence: Synthetic oligonucleotide
cctccccagcgtcgggccct

SEQ ID NO: 345750 - DNA, 20 bp, Artificial Sequence
  Description of Artificial Sequence: Synthetic oligonucleotide
ctccccagcgtcgggccctg

SEQ ID NO: 345751 - DNA, 21 bp, Artificial Sequence
  Description of Artificial Sequence: Synthetic oligonucleotide
tccccagcgtcgggccctgga

SEQ ID NO: 345752 - DNA, 20 bp, Artificial Sequence
  Description of Artificial Sequence: Synthetic oligonucleotide
ccccagcgtcgggccctgga

SEQ ID NO: 345753 - DNA, 20 bp, Artificial Sequence
  Description of Artificial Sequence: Synthetic oligonucleotide
cccagcgtcgggccctggag

SEQ ID NO: 345754 - DNA, 20 bp, Artificial Sequence
  Description of Artificial Sequence: Synthetic oligonucleotide
ccagcgtcgggccctggagg

SEQ ID NO: 345755 - DNA, 20 bp, Artificial Sequence
  Description of Artificial Sequence: Synthetic oligonucleotide
cagcgtcgggccctggaggg

SEQ ID NO: 345756 - DNA, 20 bp, Artificial Sequence
  Description of Artificial Sequence: Synthetic oligonucleotide
agcgtcgggccctggagggg

SEQ ID NO: 345757 - DNA, 20 bp, Artificial Sequence
  Description of Artificial Sequence: Synthetic oligonucleotide
gcgtcgggccctggaggggt

SEQ ID NO: 345758 - DNA, 20 bp, Artificial Sequence
  Description of Artificial Sequence: Synthetic oligonucleotide
cgtcgggccctggagggggt

SEQ ID NO: 345759 - DNA, 20 bp, Artificial Sequence
  Description of Artificial Sequence: Synthetic oligonucleotide
gtcgggccctggaggggggt

SEQ ID NO: 345760 - DNA, 21 bp, Artificial Sequence
  Description of Artificial Sequence: Synthetic oligonucleotide
tcgggccctggaggggggtct

SEQ ID NO: 345761 - DNA, 20 bp, Artificial Sequence
  Description of Artificial Sequence: Synthetic oligonucleotide
cgggccctggaggggggtct

SEQ ID NO: 345762 - DNA, 20 bp, Artificial Sequence
  Description of Artificial Sequence: Synthetic oligonucleotide
gggccctggaggggggtctg

SEQ ID NO: 345763 - DNA, 21 bp, Artificial Sequence
  Description of Artificial Sequence: Synthetic oligonucleotide
ggccctggaggggggtctgct

SEQ ID NO: 345764 - DNA, 21 bp, Artificial Sequence
  Description of Artificial Sequence: Synthetic oligonucleotide
gccctggaggggggtctgctg

SEQ ID NO: 345765 - DNA, 22 bp, Artificial Sequence
  Description of Artificial Sequence: Synthetic oligonucleotide
ccctggaggggggtctgctgga

SEQ ID NO: 345766 - DNA, 22 bp, Artificial Sequence
  Description of Artificial Sequence: Synthetic oligonucleotide
cctggaggggggtctgctggac

SEQ ID NO: 345767 - DNA, 23 bp, Artificial Sequence
  Description of Artificial Sequence: Synthetic oligonucleotide
ctggaggggggtctgctggacga

SEQ ID NO: 345768 - DNA, 23 bp, Artificial Sequence
  Description of Artificial Sequence: Synthetic oligonucleotide
tggaggggggtctgctggacgag

SEQ ID NO: 345769 - DNA, 22 bp, Artificial Sequence
  Description of Artificial Sequence: Synthetic oligonucleotide
ggaggggggtctgctggacgag

SEQ ID NO: 345770 - DNA, 24 bp, Artificial Sequence
  Description of Artificial Sequence: Synthetic oligonucleotide
gaggggggtctgctggacgaggaa

SEQ ID NO: 345771 - DNA, 24 bp, Artificial Sequence
  Description of Artificial Sequence: Synthetic oligonucleotide
aggggggtctgctggacgaggaag

SEQ ID NO: 345772 - DNA, 23 bp, Artificial Sequence
  Description of Artificial Sequence: Synthetic oligonucleotide
ggggggtctgctggacgaggaag

SEQ ID NO: 345773 - DNA, 23 bp, Artificial Sequence
  Description of Artificial Sequence: Synthetic oligonucleotide
gggggtctgctggacgaggaagg

SEQ ID NO: 345774 - DNA, 25 bp, Artificial Sequence
  Description of Artificial Sequence: Synthetic oligonucleotide
ggggtctgctggacgaggaaggcta

SEQ ID NO: 345775 - DNA, 26 bp, Artificial Sequence
  Description of Artificial Sequence: Synthetic oligonucleotide
gggtctgctggacgaggaaggctaca

SEQ ID NO: 345776 - DNA, 26 bp, Artificial Sequence
  Description of Artificial Sequence: Synthetic oligonucleotide
ggtctgctggacgaggaaggctacag

SEQ ID NO: 345777 - DNA, 27 bp, Artificial Sequence
  Description of Artificial Sequence: Synthetic oligonucleotide
gtctgctggacgaggaaggctacaggt

SEQ ID NO: 345778 - DNA, 28 bp, Artificial Sequence
  Description of Artificial Sequence: Synthetic oligonucleotide
tctgctggacgaggaaggctacaggttg

SEQ ID NO: 345779 - DNA, 27 bp, Artificial Sequence
  Description of Artificial Sequence: Synthetic oligonucleotide
ctgctggacgaggaaggctacaggttg

SEQ ID NO: 345780 - DNA, 29 bp, Artificial Sequence
  Description of Artificial Sequence: Synthetic oligonucleotide
tgctggacgaggaaggctacaggttgaag

SEQ ID NO: 345781 - DNA, 28 bp, Artificial Sequence
  Description of Artificial Sequence: Synthetic oligonucleotide
gctggacgaggaaggctacaggttgaag

SEQ ID NO: 345782 - DNA, 31 bp, Artificial Sequence
  Description of Artificial Sequence: Synthetic oligonucleotide
ctggacgaggaaggctacaggttgaagtttg

SEQ ID NO: 345783 - DNA, 31 bp, Artificial Sequence
  Description of Artificial Sequence: Synthetic oligonucleotide
tggacgaggaaggctacaggttgaagtttgg

SEQ ID NO: 345784 - DNA, 30 bp, Artificial Sequence
  Description of Artificial Sequence: Synthetic oligonucleotide
ggacgaggaaggctacaggttgaagtttgg

SEQ ID NO: 345785 - DNA, 30 bp, Artificial Sequence
  Description of Artificial Sequence: Synthetic oligonucleotide
gacgaggaaggctacaggttgaagtttggc

SEQ ID NO: 345786 - DNA, 31 bp, Artificial Sequence
  Description of Artificial Sequence: Synthetic oligonucleotide
acgaggaaggctacaggttgaagtttggctg

SEQ ID NO: 345787 - DNA, 30 bp, Artificial Sequence
  Description of Artificial Sequence: Synthetic oligonucleotide
cgaggaaggctacaggttgaagtttggctg

SEQ ID NO: 345788 - DNA, 30 bp, Artificial Sequence
  Description of Artificial Sequence: Synthetic oligonucleotide
gaggaaggctacaggttgaagtttggctgc

SEQ ID NO: 345789 - DNA, 32 bp, Artificial Sequence
  Description of Artificial Sequence: Synthetic oligonucleotide
aggaaggctacaggttgaagtttggctgctac

SEQ ID NO: 345790 - DNA, 31 bp, Artificial Sequence
  Description of Artificial Sequence: Synthetic oligonucleotide
ggaaggctacaggttgaagtttggctgctac

SEQ ID NO: 345791 - DNA, 33 bp, Artificial Sequence
  Description of Artificial Sequence: Synthetic oligonucleotide
gaaggctacaggttgaagtttggctgctactag

SEQ ID NO: 345792 - DNA, 33 bp, Artificial Sequence
  Description of Artificial Sequence: Synthetic oligonucleotide
aaggctacaggttgaagtttggctgctactagc

SEQ ID NO: 345793 - DNA, 32 bp, Artificial Sequence
  Description of Artificial Sequence: Synthetic oligonucleotide
aggctacaggttgaagtttggctgctactagc

SEQ ID NO: 345794 - DNA, 31 bp, Artificial Sequence
  Description of Artificial Sequence: Synthetic oligonucleotide
ggctacaggttgaagtttggctgctactagc

SEQ ID NO: 345795 - DNA, 31 bp, Artificial Sequence
  Description of Artificial Sequence: Synthetic oligonucleotide
gctacaggttgaagtttggctgctactagcc

SEQ ID NO: 345796 - DNA, 31 bp, Artificial Sequence
  Description of Artificial Sequence: Synthetic oligonucleotide
ctacaggttgaagtttggctgctactagccc

SEQ ID NO: 345797 - DNA, 31 bp, Artificial Sequence
  Description of Artificial Sequence: Synthetic oligonucleotide
tacaggttgaagtttggctgctactagcccc

SEQ ID NO: 345798 - DNA, 30 bp, Artificial Sequence
  Description of Artificial Sequence: Synthetic oligonucleotide
acaggttgaagtttggctgctactagcccc

SEQ ID NO: 345799 - DNA, 29 bp, Artificial Sequence
  Description of Artificial Sequence: Synthetic oligonucleotide
caggttgaagtttggctgctactagcccc

SEQ ID NO: 345800 - DNA, 29 bp, Artificial Sequence
  Description of Artificial Sequence: Synthetic oligonucleotide
aggttgaagtttggctgctactagccccg

SEQ ID NO: 345801 - DNA, 28 bp, Artificial Sequence
  Description of Artificial Sequence: Synthetic oligonucleotide
ggttgaagtttggctgctactagccccg

SEQ ID NO: 345802 - DNA, 29 bp, Artificial Sequence
  Description of Artificial Sequence: Synthetic oligonucleotide
gttgaagtttggctgctactagccccgtg

SEQ ID NO: 345803 - DNA, 30 bp, Artificial Sequence
  Description of Artificial Sequence: Synthetic oligonucleotide
ttgaagtttggctgctactagccccgtgtg

SEQ ID NO: 345804 - DNA, 29 bp, Artificial Sequence
  Description of Artificial Sequence: Synthetic oligonucleotide
tgaagtttggctgctactagccccgtgtg

SEQ ID NO: 345805 - DNA, 28 bp, Artificial Sequence
  Description of Artificial Sequence: Synthetic oligonucleotide
gaagtttggctgctactagccccgtgtg

SEQ ID NO: 345806 - DNA, 28 bp, Artificial Sequence
  Description of Artificial Sequence: Synthetic oligonucleotide
aagtttggctgctactagccccgtgtgc

SEQ ID NO: 345807 - DNA, 27 bp, Artificial Sequence
  Description of Artificial Sequence: Synthetic oligonucleotide
agtttggctgctactagccccgtgtgc

SEQ ID NO: 345808 - DNA, 27 bp, Artificial Sequence
  Description of Artificial Sequence: Synthetic oligonucleotide
gtttggctgctactagccccgtgtgca

SEQ ID NO: 345809 - DNA, 27 bp, Artificial Sequence
  Description of Artificial Sequence: Synthetic oligonucleotide
tttggctgctactagccccgtgtgcag

SEQ ID NO: 345810 - DNA, 27 bp, Artificial Sequence
  Description of Artificial Sequence: Synthetic oligonucleotide
ttggctgctactagccccgtgtgcagt

SEQ ID NO: 345811 - DNA, 27 bp, Artificial Sequence
  Description of Artificial Sequence: Synthetic oligonucleotide
tggctgctactagccccgtgtgcagta

SEQ ID NO: 345812 - DNA, 26 bp, Artificial Sequence
  Description of Artificial Sequence: Synthetic oligonucleotide
ggctgctactagccccgtgtgcagta

SEQ ID NO: 345813 - DNA, 26 bp, Artificial Sequence
  Description of Artificial Sequence: Synthetic oligonucleotide
gctgctactagccccgtgtgcagtac

SEQ ID NO: 345814 - DNA, 26 bp, Artificial Sequence
  Description of Artificial Sequence: Synthetic oligonucleotide
ctgctactagccccgtgtgcagtacg

SEQ ID NO: 345815 - DNA, 26 bp, Artificial Sequence
  Description of Artificial Sequence: Synthetic oligonucleotide
tgctactagccccgtgtgcagtacgg

SEQ ID NO: 345816 - DNA, 25 bp, Artificial Sequence
  Description of Artificial Sequence: Synthetic oligonucleotide
gctactagccccgtgtgcagtacgg

SEQ ID NO: 345817 - DNA, 27 bp, Artificial Sequence
  Description of Artificial Sequence: Synthetic oligonucleotide
ctactagccccgtgtgcagtacggcta

SEQ ID NO: 345818 - DNA, 27 bp, Artificial Sequence
  Description of Artificial Sequence: Synthetic oligonucleotide
tactagccccgtgtgcagtacggctac

SEQ ID NO: 345819 - DNA, 26 bp, Artificial Sequence
  Description of Artificial Sequence: Synthetic oligonucleotide
actagccccgtgtgcagtacggctac

SEQ ID NO: 345820 - DNA, 25 bp, Artificial Sequence
  Description of Artificial Sequence: Synthetic oligonucleotide
ctagccccgtgtgcagtacggctac

SEQ ID NO: 345821 - DNA, 26 bp, Artificial Sequence
  Description of Artificial Sequence: Synthetic oligonucleotide
tagccccgtgtgcagtacggctacca

SEQ ID NO: 345822 - DNA, 25 bp, Artificial Sequence
  Description of Artificial Sequence: Synthetic oligonucleotide
agccccgtgtgcagtacggctacca

SEQ ID NO: 345823 - DNA, 24 bp, Artificial Sequence
  Description of Artificial Sequence: Synthetic oligonucleotide
gccccgtgtgcagtacggctacca

SEQ ID NO: 345824 - DNA, 24 bp, Artificial Sequence
  Description of Artificial Sequence: Synthetic oligonucleotide
ccccgtgtgcagtacggctaccag

SEQ ID NO: 345825 - DNA, 27 bp, Artificial Sequence
  Description of Artificial Sequence: Synthetic oligonucleotide
cccgtgtgcagtacggctaccaggtta

SEQ ID NO: 345826 - DNA, 28 bp, Artificial Sequence
  Description of Artificial Sequence: Synthetic oligonucleotide
ccgtgtgcagtacggctaccaggttaac

SEQ ID NO: 345827 - DNA, 28 bp, Artificial Sequence
  Description of Artificial Sequence: Synthetic oligonucleotide
cgtgtgcagtacggctaccaggttaacg

SEQ ID NO: 345828 - DNA, 30 bp, Artificial Sequence
  Description of Artificial Sequence: Synthetic oligonucleotide
gtgtgcagtacggctaccaggttaacgttc

SEQ ID NO: 345829 - DNA, 31 bp, Artificial Sequence
  Description of Artificial Sequence: Synthetic oligonucleotide
tgtgcagtacggctaccaggttaacgttctc

SEQ ID NO: 345830 - DNA, 30 bp, Artificial Sequence
  Description of Artificial Sequence: Synthetic oligonucleotide
gtgcagtacggctaccaggttaacgttctc

SEQ ID NO: 345831 - DNA, 30 bp, Artificial Sequence
  Description of Artificial Sequence: Synthetic oligonucleotide
tgcagtacggctaccaggttaacgttctcc

SEQ ID NO: 345832 - DNA, 29 bp, Artificial Sequence
  Description of Artificial Sequence: Synthetic oligonucleotide
gcagtacggctaccaggttaacgttctcc

SEQ ID NO: 345833 - DNA, 29 bp, Artificial Sequence
  Description of Artificial Sequence: Synthetic oligonucleotide
cagtacggctaccaggttaacgttctccg

SEQ ID NO: 345834 - DNA, 30 bp, Artificial Sequence
  Description of Artificial Sequence: Synthetic oligonucleotide
agtacggctaccaggttaacgttctccgac

SEQ ID NO: 345835 - DNA, 29 bp, Artificial Sequence
  Description of Artificial Sequence: Synthetic oligonucleotide
gtacggctaccaggttaacgttctccgac

SEQ ID NO: 345836 - DNA, 31 bp, Artificial Sequence
  Description of Artificial Sequence: Synthetic oligonucleotide
tacggctaccaggttaacgttctccgacaag

SEQ ID NO: 345837 - DNA, 30 bp, Artificial Sequence
  Description of Artificial Sequence: Synthetic oligonucleotide
acggctaccaggttaacgttctccgacaag

SEQ ID NO: 345838 - DNA, 29 bp, Artificial Sequence
  Description of Artificial Sequence: Synthetic oligonucleotide
cggctaccaggttaacgttctccgacaag

SEQ ID NO: 345839 - DNA, 30 bp, Artificial Sequence
  Description of Artificial Sequence: Synthetic oligonucleotide
ggctaccaggttaacgttctccgacaagac

SEQ ID NO: 345840 - DNA, 31 bp, Artificial Sequence
  Description of Artificial Sequence: Synthetic oligonucleotide
gctaccaggttaacgttctccgacaagacag

SEQ ID NO: 345841 - DNA, 31 bp, Artificial Sequence
  Description of Artificial Sequence: Synthetic oligonucleotide
ctaccaggttaacgttctccgacaagacagc

SEQ ID NO: 345842 - DNA, 32 bp, Artificial Sequence
  Description of Artificial Sequence: Synthetic oligonucleotide
taccaggttaacgttctccgacaagacagcac

SEQ ID NO: 345843 - DNA, 31 bp, Artificial Sequence
  Description of Artificial Sequence: Synthetic oligonucleotide
accaggttaacgttctccgacaagacagcac

SEQ ID NO: 345844 - DNA, 30 bp, Artificial Sequence
  Description of Artificial Sequence: Synthetic oligonucleotide
ccaggttaacgttctccgacaagacagcac

SEQ ID NO: 345845 - DNA, 31 bp, Artificial Sequence
  Description of Artificial Sequence: Synthetic oligonucleotide
caggttaacgttctccgacaagacagcacag

SEQ ID NO: 345846 - DNA, 31 bp, Artificial Sequence
  Description of Artificial Sequence: Synthetic oligonucleotide
aggttaacgttctccgacaagacagcacagc

SEQ ID NO: 345847 - DNA, 30 bp, Artificial Sequence
  Description of Artificial Sequence: Synthetic oligonucleotide
ggttaacgttctccgacaagacagcacagc

SEQ ID NO: 345848 - DNA, 31 bp, Artificial Sequence
  Description of Artificial Sequence: Synthetic oligonucleotide
gttaacgttctccgacaagacagcacagctg

SEQ ID NO: 345849 - DNA, 31 bp, Artificial Sequence
  Description of Artificial Sequence: Synthetic oligonucleotide
ttaacgttctccgacaagacagcacagctgc

SEQ ID NO: 345850 - DNA, 30 bp, Artificial Sequence
  Description of Artificial Sequence: Synthetic oligonucleotide
taacgttctccgacaagacagcacagctgc

SEQ ID NO: 345851 - DNA, 29 bp, Artificial Sequence
  Description of Artificial Sequence: Synthetic oligonucleotide
aacgttctccgacaagacagcacagctgc

SEQ ID NO: 345852 - DNA, 28 bp, Artificial Sequence
  Description of Artificial Sequence: Synthetic oligonucleotide
acgttctccgacaagacagcacagctgc

SEQ ID NO: 345853 - DNA, 27 bp, Artificial Sequence
  Description of Artificial Sequence: Synthetic oligonucleotide
cgttctccgacaagacagcacagctgc

SEQ ID NO: 345854 - DNA, 30 bp, Artificial Sequence
  Description of Artificial Sequence: Synthetic oligonucleotide
gttctccgacaagacagcacagctgctttg

SEQ ID NO: 345855 - DNA, 30 bp, Artificial Sequence
  Description of Artificial Sequence: Synthetic oligonucleotide
ttctccgacaagacagcacagctgctttgc

SEQ ID NO: 345856 - DNA, 29 bp, Artificial Sequence
  Description of Artificial Sequence: Synthetic oligonucleotide
tctccgacaagacagcacagctgctttgc

SEQ ID NO: 345857 - DNA, 28 bp, Artificial Sequence
  Description of Artificial Sequence: Synthetic oligonucleotide
ctccgacaagacagcacagctgctttgc

SEQ ID NO: 345858 - DNA, 28 bp, Artificial Sequence
  Description of Artificial Sequence: Synthetic oligonucleotide
tccgacaagacagcacagctgctttgcg

SEQ ID NO: 345859 - DNA, 27 bp, Artificial Sequence
  Description of Artificial Sequence: Synthetic oligonucleotide
ccgacaagacagcacagctgctttgcg

SEQ ID NO: 345860 - DNA, 27 bp, Artificial Sequence
  Description of Artificial Sequence: Synthetic oligonucleotide
cgacaagacagcacagctgctttgcgc

SEQ ID NO: 345861 - DNA, 27 bp, Artificial Sequence
  Description of Artificial Sequence: Synthetic oligonucleotide
gacaagacagcacagctgctttgcgcc

SEQ ID NO: 345862 - DNA, 28 bp, Artificial Sequence
  Description of Artificial Sequence: Synthetic oligonucleotide
acaagacagcacagctgctttgcgcctc

SEQ ID NO: 345863 - DNA, 27 bp, Artificial Sequence
  Description of Artificial Sequence: Synthetic oligonucleotide
caagacagcacagctgctttgcgcctc

SEQ ID NO: 345864 - DNA, 30 bp, Artificial Sequence
  Description of Artificial Sequence: Synthetic oligonucleotide
aagacagcacagctgctttgcgcctctttc

SEQ ID NO: 345865 - DNA, 29 bp, Artificial Sequence
  Description of Artificial Sequence: Synthetic oligonucleotide
agacagcacagctgctttgcgcctctttc

SEQ ID NO: 345866 - DNA, 28 bp, Artificial Sequence
  Description of Artificial Sequence: Synthetic oligonucleotide
gacagcacagctgctttgcgcctctttc

SEQ ID NO: 345867 - DNA, 29 bp, Artificial Sequence
  Description of Artificial Sequence: Synthetic oligonucleotide
acagcacagctgctttgcgcctctttcag

SEQ ID NO: 345868 - DNA, 28 bp, Artificial Sequence
  Description of Artificial Sequence: Synthetic oligonucleotide
cagcacagctgctttgcgcctctttcag

SEQ ID NO: 345869 - DNA, 29 bp, Artificial Sequence
  Description of Artificial Sequence: Synthetic oligonucleotide
agcacagctgctttgcgcctctttcagac

SEQ ID NO: 345870 - DNA, 28 bp, Artificial Sequence
  Description of Artificial Sequence: Synthetic oligonucleotide
gcacagctgctttgcgcctctttcagac

SEQ ID NO: 345871 - DNA, 28 bp, Artificial Sequence
  Description of Artificial Sequence: Synthetic oligonucleotide
cacagctgctttgcgcctctttcagacc

SEQ ID NO: 345872 - DNA, 30 bp, Artificial Sequence
  Description of Artificial Sequence: Synthetic oligonucleotide
acagctgctttgcgcctctttcagaccaag

SEQ ID NO: 345873 - DNA, 29 bp, Artificial Sequence
  Description of Artificial Sequence: Synthetic oligonucleotide
cagctgctttgcgcctctttcagaccaag

SEQ ID NO: 345874 - DNA, 31 bp, Artificial Sequence
  Description of Artificial Sequence: Synthetic oligonucleotide
agctgctttgcgcctctttcagaccaagaac

SEQ ID NO: 345875 - DNA, 30 bp, Artificial Sequence
  Description of Artificial Sequence: Synthetic oligonucleotide
gctgctttgcgcctctttcagaccaagaac

SEQ ID NO: 345876 - DNA, 31 bp, Artificial Sequence
  Description of Artificial Sequence: Synthetic oligonucleotide
ctgctttgcgcctctttcagaccaagaacac

SEQ ID NO: 345877 - DNA, 31 bp, Artificial Sequence
  Description of Artificial Sequence: Synthetic oligonucleotide
tgctttgcgcctctttcagaccaagaacacc

SEQ ID NO: 345878 - DNA, 30 bp, Artificial Sequence
  Description of Artificial Sequence: Synthetic oligonucleotide
gctttgcgcctctttcagaccaagaacacc

SEQ ID NO: 345879 - DNA, 30 bp, Artificial Sequence
  Description of Artificial Sequence: Synthetic oligonucleotide
ctttgcgcctctttcagaccaagaacaccc

SEQ ID NO: 345880 - DNA, 32 bp, Artificial Sequence
  Description of Artificial Sequence: Synthetic oligonucleotide
tttgcgcctctttcagaccaagaacacccaag

SEQ ID NO: 345881 - DNA, 31 bp, Artificial Sequence
  Description of Artificial Sequence: Synthetic oligonucleotide
ttgcgcctctttcagaccaagaacacccaag

SEQ ID NO: 345882 - DNA, 30 bp, Artificial Sequence
  Description of Artificial Sequence: Synthetic oligonucleotide
tgcgcctctttcagaccaagaacacccaag

SEQ ID NO: 345883 - DNA, 29 bp, Artificial Sequence
  Description of Artificial Sequence: Synthetic oligonucleotide
gcgcctctttcagaccaagaacacccaag

SEQ ID NO: 345884 - DNA, 30 bp, Artificial Sequence
  Description of Artificial Sequence: Synthetic oligonucleotide
cgcctctttcagaccaagaacacccaagtg

SEQ ID NO: 345885 - DNA, 30 bp, Artificial Sequence
  Description of Artificial Sequence: Synthetic oligonucleotide
gcctctttcagaccaagaacacccaagtgc

SEQ ID NO: 345886 - DNA, 31 bp, Artificial Sequence
  Description of Artificial Sequence: Synthetic oligonucleotide
cctctttcagaccaagaacacccaagtgctg

SEQ ID NO: 345887 - DNA, 31 bp, Artificial Sequence
  Description of Artificial Sequence: Synthetic oligonucleotide
ctctttcagaccaagaacacccaagtgctgc

SEQ ID NO: 345888 - DNA, 32 bp, Artificial Sequence
  Description of Artificial Sequence: Synthetic oligonucleotide
tctttcagaccaagaacacccaagtgctgcac

SEQ ID NO: 345889 - DNA, 31 bp, Artificial Sequence
  Description of Artificial Sequence: Synthetic oligonucleotide
ctttcagaccaagaacacccaagtgctgcac

SEQ ID NO: 345890 - DNA, 33 bp, Artificial Sequence
  Description of Artificial Sequence: Synthetic oligonucleotide
tttcagaccaagaacacccaagtgctgcacttc

SEQ ID NO: 345891 - DNA, 32 bp, Artificial Sequence
  Description of Artificial Sequence: Synthetic oligonucleotide
ttcagaccaagaacacccaagtgctgcacttc

SEQ ID NO: 345892 - DNA, 31 bp, Artificial Sequence
  Description of Artificial Sequence: Synthetic oligonucleotide
tcagaccaagaacacccaagtgctgcacttc

SEQ ID NO: 345893 - DNA, 30 bp, Artificial Sequence
  Description of Artificial Sequence: Synthetic oligonucleotide
cagaccaagaacacccaagtgctgcacttc

SEQ ID NO: 345894 - DNA, 31 bp, Artificial Sequence
  Description of Artificial Sequence: Synthetic oligonucleotide
agaccaagaacacccaagtgctgcacttctc

SEQ ID NO: 345895 - DNA, 30 bp, Artificial Sequence
  Description of Artificial Sequence: Synthetic oligonucleotide
gaccaagaacacccaagtgctgcacttctc

SEQ ID NO: 345896 - DNA, 30 bp, Artificial Sequence
  Description of Artificial Sequence: Synthetic oligonucleotide
accaagaacacccaagtgctgcacttctcc

SEQ ID NO: 345897 - DNA, 29 bp, Artificial Sequence
  Description of Artificial Sequence: Synthetic oligonucleotide
ccaagaacacccaagtgctgcacttctcc

SEQ ID NO: 345898 - DNA, 31 bp, Artificial Sequence
  Description of Artificial Sequence: Synthetic oligonucleotide
caagaacacccaagtgctgcacttctccaag

SEQ ID NO: 345899 - DNA, 31 bp, Artificial Sequence
  Description of Artificial Sequence: Synthetic oligonucleotide
aagaacacccaagtgctgcacttctccaagg

SEQ ID NO: 345900 - DNA, 30 bp, Artificial Sequence
  Description of Artificial Sequence: Synthetic oligonucleotide
agaacacccaagtgctgcacttctccaagg

SEQ ID NO: 345901 - DNA, 29 bp, Artificial Sequence
  Description of Artificial Sequence: Synthetic oligonucleotide
gaacacccaagtgctgcacttctccaagg

SEQ ID NO: 345902 - DNA, 31 bp, Artificial Sequence
  Description of Artificial Sequence: Synthetic oligonucleotide
aacacccaagtgctgcacttctccaaggatg

SEQ ID NO: 345903 - DNA, 30 bp, Artificial Sequence
  Description of Artificial Sequence: Synthetic oligonucleotide
acacccaagtgctgcacttctccaaggatg

SEQ ID NO: 345904 - DNA, 29 bp, Artificial Sequence
  Description of Artificial Sequence: Synthetic oligonucleotide
cacccaagtgctgcacttctccaaggatg

SEQ ID NO: 345905 - DNA, 30 bp, Artificial Sequence
  Description of Artificial Sequence: Synthetic oligonucleotide
acccaagtgctgcacttctccaaggatgac

SEQ ID NO: 345906 - DNA, 29 bp, Artificial Sequence
  Description of Artificial Sequence: Synthetic oligonucleotide
cccaagtgctgcacttctccaaggatgac

SEQ ID NO: 345907 - DNA, 31 bp, Artificial Sequence
  Description of Artificial Sequence: Synthetic oligonucleotide
ccaagtgctgcacttctccaaggatgacaag

SEQ ID NO: 345908 - DNA, 31 bp, Artificial Sequence
  Description of Artificial Sequence: Synthetic oligonucleotide
caagtgctgcacttctccaaggatgacaagg

SEQ ID NO: 345909 - DNA, 31 bp, Artificial Sequence
  Description of Artificial Sequence: Synthetic oligonucleotide
aagtgctgcacttctccaaggatgacaaggc

SEQ ID NO: 345910 - DNA, 30 bp, Artificial Sequence
  Description of Artificial Sequence: Synthetic oligonucleotide
agtgctgcacttctccaaggatgacaaggc

SEQ ID NO: 345911 - DNA, 29 bp, Artificial Sequence
  Description of Artificial Sequence: Synthetic oligonucleotide
gtgctgcacttctccaaggatgacaaggc

SEQ ID NO: 345912 - DNA, 29 bp, Artificial Sequence
  Description of Artificial Sequence: Synthetic oligonucleotide
tgctgcacttctccaaggatgacaaggcc

SEQ ID NO: 345913 - DNA, 28 bp, Artificial Sequence
  Description of Artificial Sequence: Synthetic oligonucleotide
gctgcacttctccaaggatgacaaggcc

SEQ ID NO: 345914 - DNA, 28 bp, Artificial Sequence
  Description of Artificial Sequence: Synthetic oligonucleotide
ctgcacttctccaaggatgacaaggccg

SEQ ID NO: 345915 - DNA, 28 bp, Artificial Sequence
  Description of Artificial Sequence: Synthetic oligonucleotide
tgcacttctccaaggatgacaaggccgc

SEQ ID NO: 345916 - DNA, 27 bp, Artificial Sequence
  Description of Artificial Sequence: Synthetic oligonucleotide
gcacttctccaaggatgacaaggccgc

SEQ ID NO: 345917 - DNA, 28 bp, Artificial Sequence
  Description of Artificial Sequence: Synthetic oligonucleotide
cacttctccaaggatgacaaggccgcag

SEQ ID NO: 345918 - DNA, 28 bp, Artificial Sequence
  Description of Artificial Sequence: Synthetic oligonucleotide
acttctccaaggatgacaaggccgcagc

SEQ ID NO: 345919 - DNA, 27 bp, Artificial Sequence
  Description of Artificial Sequence: Synthetic oligonucleotide
cttctccaaggatgacaaggccgcagc

SEQ ID NO: 345920 - DNA, 31 bp, Artificial Sequence
  Description of Artificial Sequence: Synthetic oligonucleotide
ttctccaaggatgacaaggccgcagctaatc

SEQ ID NO: 345921 - DNA, 30 bp, Artificial Sequence
  Description of Artificial Sequence: Synthetic oligonucleotide
tctccaaggatgacaaggccgcagctaatc

SEQ ID NO: 345922 - DNA, 29 bp, Artificial Sequence
  Description of Artificial Sequence: Synthetic oligonucleotide
ctccaaggatgacaaggccgcagctaatc

SEQ ID NO: 345923 - DNA, 30 bp, Artificial Sequence
  Description of Artificial Sequence: Synthetic oligonucleotide
tccaaggatgacaaggccgcagctaatcag

SEQ ID NO: 345924 - DNA, 29 bp, Artificial Sequence
  Description of Artificial Sequence: Synthetic oligonucleotide
ccaaggatgacaaggccgcagctaatcag

SEQ ID NO: 345925 - DNA, 31 bp, Artificial Sequence
  Description of Artificial Sequence: Synthetic oligonucleotide
caaggatgacaaggccgcagctaatcagttg

SEQ ID NO: 345926 - DNA, 31 bp, Artificial Sequence
  Description of Artificial Sequence: Synthetic oligonucleotide
aaggatgacaaggccgcagctaatcagttgc

SEQ ID NO: 345927 - DNA, 30 bp, Artificial Sequence
  Description of Artificial Sequence: Synthetic oligonucleotide
aggatgacaaggccgcagctaatcagttgc

SEQ ID NO: 345928 - DNA, 29 bp, Artificial Sequence
  Description of Artificial Sequence: Synthetic oligonucleotide
ggatgacaaggccgcagctaatcagttgc

SEQ ID NO: 345929 - DNA, 29 bp, Artificial Sequence
  Description of Artificial Sequence: Synthetic oligonucleotide
gatgacaaggccgcagctaatcagttgcg

SEQ ID NO: 345930 - DNA, 29 bp, Artificial Sequence
  Description of Artificial Sequence: Synthetic oligonucleotide
atgacaaggccgcagctaatcagttgcgc

SEQ ID NO: 345931 - DNA, 28 bp, Artificial Sequence
  Description of Artificial Sequence: Synthetic oligonucleotide
tgacaaggccgcagctaatcagttgcgc

SEQ ID NO: 345932 - DNA, 27 bp, Artificial Sequence
  Description of Artificial Sequence: Synthetic oligonucleotide
gacaaggccgcagctaatcagttgcgc

SEQ ID NO: 345933 - DNA, 29 bp, Artificial Sequence
  Description of Artificial Sequence: Synthetic oligonucleotide
acaaggccgcagctaatcagttgcgcaac

SEQ ID NO: 345934 - DNA, 28 bp, Artificial Sequence
  Description of Artificial Sequence: Synthetic oligonucleotide
caaggccgcagctaatcagttgcgcaac

SEQ ID NO: 345935 - DNA, 30 bp, Artificial Sequence
  Description of Artificial Sequence: Synthetic oligonucleotide
aaggccgcagctaatcagttgcgcaactac

SEQ ID NO: 345936 - DNA, 29 bp, Artificial Sequence
  Description of Artificial Sequence: Synthetic oligonucleotide
aggccgcagctaatcagttgcgcaactac

SEQ ID NO: 345937 - DNA, 28 bp, Artificial Sequence
  Description of Artificial Sequence: Synthetic oligonucleotide
ggccgcagctaatcagttgcgcaactac

SEQ ID NO: 345938 - DNA, 28 bp, Artificial Sequence
  Description of Artificial Sequence: Synthetic oligonucleotide
gccgcagctaatcagttgcgcaactacc

SEQ ID NO: 345939 - DNA, 29 bp, Artificial Sequence
  Description of Artificial Sequence: Synthetic oligonucleotide
ccgcagctaatcagttgcgcaactacctg

SEQ ID NO: 345940 - DNA, 29 bp, Artificial Sequence
  Description of Artificial Sequence: Synthetic oligonucleotide
cgcagctaatcagttgcgcaactacctgg

SEQ ID NO: 345941 - DNA, 31 bp, Artificial Sequence
  Description of Artificial Sequence: Synthetic oligonucleotide
gcagctaatcagttgcgcaactacctggttc

SEQ ID NO: 345942 - DNA, 31 bp, Artificial Sequence
  Description of Artificial Sequence: Synthetic oligonucleotide
cagctaatcagttgcgcaactacctggttcg

SEQ ID NO: 345943 - DNA, 32 bp, Artificial Sequence
  Description of Artificial Sequence: Synthetic oligonucleotide
agctaatcagttgcgcaactacctggttcgtg

SEQ ID NO: 345944 - DNA, 31 bp, Artificial Sequence
  Description of Artificial Sequence: Synthetic oligonucleotide
gctaatcagttgcgcaactacctggttcgtg

SEQ ID NO: 345945 - DNA, 31 bp, Artificial Sequence
  Description of Artificial Sequence: Synthetic oligonucleotide
ctaatcagttgcgcaactacctggttcgtgc

SEQ ID NO: 345946 - DNA, 31 bp, Artificial Sequence
  Description of Artificial Sequence: Synthetic oligonucleotide
taatcagttgcgcaactacctggttcgtgcc

SEQ ID NO: 345947 - DNA, 30 bp, Artificial Sequence
  Description of Artificial Sequence: Synthetic oligonucleotide
aatcagttgcgcaactacctggttcgtgcc

SEQ ID NO: 345948 - DNA, 29 bp, Artificial Sequence
  Description of Artificial Sequence: Synthetic oligonucleotide
atcagttgcgcaactacctggttcgtgcc

SEQ ID NO: 345949 - DNA, 28 bp, Artificial Sequence
  Description of Artificial Sequence: Synthetic oligonucleotide
tcagttgcgcaactacctggttcgtgcc

SEQ ID NO: 345950 - DNA, 27 bp, Artificial Sequence
  Description of Artificial Sequence: Synthetic oligonucleotide
cagttgcgcaactacctggttcgtgcc

SEQ ID NO: 345951 - DNA, 28 bp, Artificial Sequence
  Description of Artificial Sequence: Synthetic oligonucleotide
agttgcgcaactacctggttcgtgcctc

SEQ ID NO: 345952 - DNA, 27 bp, Artificial Sequence
  Description of Artificial Sequence: Synthetic oligonucleotide
gttgcgcaactacctggttcgtgcctc

SEQ ID NO: 345953 - DNA, 27 bp, Artificial Sequence
  Description of Artificial Sequence: Synthetic oligonucleotide
ttgcgcaactacctggttcgtgcctcc

SEQ ID NO: 345954 - DNA, 27 bp, Artificial Sequence
  Description of Artificial Sequence: Synthetic oligonucleotide
tgcgcaactacctggttcgtgcctcct

SEQ ID NO: 345955 - DNA, 26 bp, Artificial Sequence
  Description of Artificial Sequence: Synthetic oligonucleotide
gcgcaactacctggttcgtgcctcct

SEQ ID NO: 345956 - DNA, 26 bp, Artificial Sequence
  Description of Artificial Sequence: Synthetic oligonucleotide
cgcaactacctggttcgtgcctcctg

SEQ ID NO: 345957 - DNA, 26 bp, Artificial Sequence
  Description of Artificial Sequence: Synthetic oligonucleotide
gcaactacctggttcgtgcctcctgc

SEQ ID NO: 345958 - DNA, 26 bp, Artificial Sequence
  Description of Artificial Sequence: Synthetic oligonucleotide
caactacctggttcgtgcctcctgcg

SEQ ID NO: 345959 - DNA, 26 bp, Artificial Sequence
  Description of Artificial Sequence: Synthetic oligonucleotide
aactacctggttcgtgcctcctgcgg

SEQ ID NO: 345960 - DNA, 25 bp, Artificial Sequence
  Description of Artificial Sequence: Synthetic oligonucleotide
actacctggttcgtgcctcctgcgg

SEQ ID NO: 345961 - DNA, 24 bp, Artificial Sequence
  Description of Artificial Sequence: Synthetic oligonucleotide
ctacctggttcgtgcctcctgcgg

SEQ ID NO: 345962 - DNA, 24 bp, Artificial Sequence
  Description of Artificial Sequence: Synthetic oligonucleotide
tacctggttcgtgcctcctgcggc

SEQ ID NO: 345963 - DNA, 23 bp, Artificial Sequence
  Description of Artificial Sequence: Synthetic oligonucleotide
acctggttcgtgcctcctgcggc

SEQ ID NO: 345964 - DNA, 22 bp, Artificial Sequence
  Description of Artificial Sequence: Synthetic oligonucleotide
cctggttcgtgcctcctgcggc

SEQ ID NO: 345965 - DNA, 24 bp, Artificial Sequence
  Description of Artificial Sequence: Synthetic oligonucleotide
ctggttcgtgcctcctgcggcctt

SEQ ID NO: 345966 - DNA, 24 bp, Artificial Sequence
  Description of Artificial Sequence: Synthetic oligonucleotide
tggttcgtgcctcctgcggccttc

SEQ ID NO: 345967 - DNA, 23 bp, Artificial Sequence
  Description of Artificial Sequence: Synthetic oligonucleotide
ggttcgtgcctcctgcggccttc

SEQ ID NO: 345968 - DNA, 23 bp, Artificial Sequence
  Description of Artificial Sequence: Synthetic oligonucleotide
gttcgtgcctcctgcggccttcg

SEQ ID NO: 345969 - DNA, 25 bp, Artificial Sequence
  Description of Artificial Sequence: Synthetic oligonucleotide
ttcgtgcctcctgcggccttcgcta

SEQ ID NO: 345970 - DNA, 24 bp, Artificial Sequence
  Description of Artificial Sequence: Synthetic oligonucleotide
tcgtgcctcctgcggccttcgcta

SEQ ID NO: 345971 - DNA, 23 bp, Artificial Sequence
  Description of Artificial Sequence: Synthetic oligonucleotide
cgtgcctcctgcggccttcgcta

SEQ ID NO: 345972 - DNA, 23 bp, Artificial Sequence
  Description of Artificial Sequence: Synthetic oligonucleotide
gtgcctcctgcggccttcgctag

SEQ ID NO: 345973 - DNA, 25 bp, Artificial Sequence
  Description of Artificial Sequence: Synthetic oligonucleotide
tgcctcctgcggccttcgctaggaa

SEQ ID NO: 345974 - DNA, 24 bp, Artificial Sequence
  Description of Artificial Sequence: Synthetic oligonucleotide
gcctcctgcggccttcgctaggaa

SEQ ID NO: 345975 - DNA, 24 bp, Artificial Sequence
  Description of Artificial Sequence: Synthetic oligonucleotide
cctcctgcggccttcgctaggaac

SEQ ID NO: 345976 - DNA, 25 bp, Artificial Sequence
  Description of Artificial Sequence: Synthetic oligonucleotide
ctcctgcggccttcgctaggaacct

SEQ ID NO: 345977 - DNA, 25 bp, Artificial Sequence
  Description of Artificial Sequence: Synthetic oligonucleotide
tcctgcggccttcgctaggaacctg

SEQ ID NO: 345978 - DNA, 24 bp, Artificial Sequence
  Description of Artificial Sequence: Synthetic oligonucleotide
cctgcggccttcgctaggaacctg

SEQ ID NO: 345979 - DNA, 24 bp, Artificial Sequence
  Description of Artificial Sequence: Synthetic oligonucleotide
ctgcggccttcgctaggaacctgg

SEQ ID NO: 345980 - DNA, 27 bp, Artificial Sequence
  Description of Artificial Sequence: Synthetic oligonucleotide
tgcggccttcgctaggaacctggcaaa

SEQ ID NO: 345981 - DNA, 26 bp, Artificial Sequence
  Description of Artificial Sequence: Synthetic oligonucleotide
gcggccttcgctaggaacctggcaaa

SEQ ID NO: 345982 - DNA, 27 bp, Artificial Sequence
  Description of Artificial Sequence: Synthetic oligonucleotide
cggccttcgctaggaacctggcaaaga

SEQ ID NO: 345983 - DNA, 33 bp, Artificial Sequence
  Description of Artificial Sequence: Synthetic oligonucleotide
ggccttcgctaggaacctggcaaagaatatatg

SEQ ID NO: 345984 - DNA, 35 bp, Artificial Sequence
  Description of Artificial Sequence: Synthetic oligonucleotide
gccttcgctaggaacctggcaaagaatatatgatc

SEQ ID NO: 345985 - DNA, 37 bp, Artificial Sequence
  Description of Artificial Sequence: Synthetic oligonucleotide
ccttcgctaggaacctggcaaagaatatatgatcatg

SEQ ID NO: 345986 - DNA, 37 bp, Artificial Sequence
  Description of Artificial Sequence: Synthetic oligonucleotide
cttcgctaggaacctggcaaagaatatatgatcatgg

SEQ ID NO: 345987 - DNA, 37 bp, Artificial Sequence
  Description of Artificial Sequence: Synthetic oligonucleotide
ttcgctaggaacctggcaaagaatatatgatcatggc

SEQ ID NO: 345988 - DNA, 36 bp, Artificial Sequence
  Description of Artificial Sequence: Synthetic oligonucleotide
tcgctaggaacctggcaaagaatatatgatcatggc

SEQ ID NO: 345989 - DNA, 35 bp, Artificial Sequence
  Description of Artificial Sequence: Synthetic oligonucleotide
cgctaggaacctggcaaagaatatatgatcatggc

SEQ ID NO: 345990 - DNA, 36 bp, Artificial Sequence
  Description of Artificial Sequence: Synthetic oligonucleotide
gctaggaacctggcaaagaatatatgatcatggctc

SEQ ID NO: 345991 - DNA, 37 bp, Artificial Sequence
  Description of Artificial Sequence: Synthetic oligonucleotide
ctaggaacctggcaaagaatatatgatcatggctctg

SEQ ID NO: 345992 - DNA, 37 bp, Artificial Sequence
  Description of Artificial Sequence: Synthetic oligonucleotide
taggaacctggcaaagaatatatgatcatggctctgg

SEQ ID NO: 345993 - DNA, 36 bp, Artificial Sequence
  Description of Artificial Sequence: Synthetic oligonucleotide
aggaacctggcaaagaatatatgatcatggctctgg

SEQ ID NO: 345994 - DNA, 35 bp, Artificial Sequence
  Description of Artificial Sequence: Synthetic oligonucleotide
ggaacctggcaaagaatatatgatcatggctctgg

SEQ ID NO: 345995 - DNA, 37 bp, Artificial Sequence
  Description of Artificial Sequence: Synthetic oligonucleotide
gaacctggcaaagaatatatgatcatggctctggatg

SEQ ID NO: 345996 - DNA, 37 bp, Artificial Sequence
  Description of Artificial Sequence: Synthetic oligonucleotide
aacctggcaaagaatatatgatcatggctctggatgg

SEQ ID NO: 345997 - DNA, 36 bp, Artificial Sequence
  Description of Artificial Sequence: Synthetic oligonucleotide
acctggcaaagaatatatgatcatggctctggatgg

SEQ ID NO: 345998 - DNA, 35 bp, Artificial Sequence
  Description of Artificial Sequence: Synthetic oligonucleotide
cctggcaaagaatatatgatcatggctctggatgg

SEQ ID NO: 345999 - DNA, 35 bp, Artificial Sequence
  Description of Artificial Sequence: Synthetic oligonucleotide
ctggcaaagaatatatgatcatggctctggatggc

SEQ ID NO: 346000 - DNA, 35 bp, Artificial Sequence
  Description of Artificial Sequence: Synthetic oligonucleotide
tggcaaagaatatatgatcatggctctggatggcg

SEQ ID NO: 346001 - DNA, 34 bp, Artificial Sequence
  Description of Artificial Sequence: Synthetic oligonucleotide
ggcaaagaatatatgatcatggctctggatggcg

SEQ ID NO: 346002 - DNA, 34 bp, Artificial Sequence
  Description of Artificial Sequence: Synthetic oligonucleotide
gcaaagaatatatgatcatggctctggatggcgc

SEQ ID NO: 346003 - DNA, 34 bp, Artificial Sequence
  Description of Artificial Sequence: Synthetic oligonucleotide
caaagaatatatgatcatggctctggatggcgcc

SEQ ID NO: 346004 - DNA, 35 bp, Artificial Sequence
  Description of Artificial Sequence: Synthetic oligonucleotide
aaagaatatatgatcatggctctggatggcgccac

SEQ ID NO: 346005 - DNA, 34 bp, Artificial Sequence
  Description of Artificial Sequence: Synthetic oligonucleotide
aagaatatatgatcatggctctggatggcgccac

SEQ ID NO: 346006 - DNA, 33 bp, Artificial Sequence
  Description of Artificial Sequence: Synthetic oligonucleotide
agaatatatgatcatggctctggatggcgccac

SEQ ID NO: 346007 - DNA, 32 bp, Artificial Sequence
  Description of Artificial Sequence: Synthetic oligonucleotide
gaatatatgatcatggctctggatggcgccac

SEQ ID NO: 346008 - DNA, 32 bp, Artificial Sequence
  Description of Artificial Sequence: Synthetic oligonucleotide
aatatatgatcatggctctggatggcgccacc

SEQ ID NO: 346009 - DNA, 31 bp, Artificial Sequence
  Description of Artificial Sequence: Synthetic oligonucleotide
atatatgatcatggctctggatggcgccacc

SEQ ID NO: 346010 - DNA, 30 bp, Artificial Sequence
  Description of Artificial Sequence: Synthetic oligonucleotide
tatatgatcatggctctggatggcgccacc

SEQ ID NO: 346011 - DNA, 29 bp, Artificial Sequence
  Description of Artificial Sequence: Synthetic oligonucleotide
atatgatcatggctctggatggcgccacc

SEQ ID NO: 346012 - DNA, 28 bp, Artificial Sequence
  Description of Artificial Sequence: Synthetic oligonucleotide
tatgatcatggctctggatggcgccacc

SEQ ID NO: 346013 - DNA, 27 bp, Artificial Sequence
  Description of Artificial Sequence: Synthetic oligonucleotide
atgatcatggctctggatggcgccacc

SEQ ID NO: 346014 - DNA, 27 bp, Artificial Sequence
  Description of Artificial Sequence: Synthetic oligonucleotide
tgatcatggctctggatggcgccacct

SEQ ID NO: 346015 - DNA, 27 bp, Artificial Sequence
  Description of Artificial Sequence: Synthetic oligonucleotide
gatcatggctctggatggcgccaccta

SEQ ID NO: 346016 - DNA, 28 bp, Artificial Sequence
  Description of Artificial Sequence: Synthetic oligonucleotide
atcatggctctggatggcgccacctatc

SEQ ID NO: 346017 - DNA, 27 bp, Artificial Sequence
  Description of Artificial Sequence: Synthetic oligonucleotide
tcatggctctggatggcgccacctatc

SEQ ID NO: 346018 - DNA, 27 bp, Artificial Sequence
  Description of Artificial Sequence: Synthetic oligonucleotide
catggctctggatggcgccacctatca

SEQ ID NO: 346019 - DNA, 27 bp, Artificial Sequence
  Description of Artificial Sequence: Synthetic oligonucleotide
atggctctggatggcgccacctatcac

SEQ ID NO: 346020 - DNA, 26 bp, Artificial Sequence
  Description of Artificial Sequence: Synthetic oligonucleotide
tggctctggatggcgccacctatcac

SEQ ID NO: 346021 - DNA, 25 bp, Artificial Sequence
  Description of Artificial Sequence: Synthetic oligonucleotide
ggctctggatggcgccacctatcac

SEQ ID NO: 346022 - DNA, 26 bp, Artificial Sequence
  Description of Artificial Sequence: Synthetic oligonucleotide
gctctggatggcgccacctatcacct

SEQ ID NO: 346023 - DNA, 26 bp, Artificial Sequence
  Description of Artificial Sequence: Synthetic oligonucleotide
ctctggatggcgccacctatcacctc

SEQ ID NO: 346024 - DNA, 27 bp, Artificial Sequence
  Description of Artificial Sequence: Synthetic oligonucleotide
tctggatggcgccacctatcacctcga

SEQ ID NO: 346025 - DNA, 26 bp, Artificial Sequence
  Description of Artificial Sequence: Synthetic oligonucleotide
ctggatggcgccacctatcacctcga

SEQ ID NO: 346026 - DNA, 26 bp, Artificial Sequence
  Description of Artificial Sequence: Synthetic oligonucleotide
tggatggcgccacctatcacctcgag

SEQ ID NO: 346027 - DNA, 25 bp, Artificial Sequence
  Description of Artificial Sequence: Synthetic oligonucleotide
ggatggcgccacctatcacctcgag

SEQ ID NO: 346028 - DNA, 25 bp, Artificial Sequence
  Description of Artificial Sequence: Synthetic oligonucleotide
gatggcgccacctatcacctcgagg

SEQ ID NO: 346029 - DNA, 26 bp, Artificial Sequence
  Description of Artificial Sequence: Synthetic oligonucleotide
atggcgccacctatcacctcgaggca

SEQ ID NO: 346030 - DNA, 25 bp, Artificial Sequence
  Description of Artificial Sequence: Synthetic oligonucleotide
tggcgccacctatcacctcgaggca

SEQ ID NO: 346031 - DNA, 24 bp, Artificial Sequence
  Description of Artificial Sequence: Synthetic oligonucleotide
ggcgccacctatcacctcgaggca

SEQ ID NO: 346032 - DNA, 25 bp, Artificial Sequence
  Description of Artificial Sequence: Synthetic oligonucleotide
gcgccacctatcacctcgaggcaca

SEQ ID NO: 346033 - DNA, 25 bp, Artificial Sequence
  Description of Artificial Sequence: Synthetic oligonucleotide
cgccacctatcacctcgaggcacac

SEQ ID NO: 346034 - DNA, 25 bp, Artificial Sequence
  Description of Artificial Sequence: Synthetic oligonucleotide
gccacctatcacctcgaggcacacc

SEQ ID NO: 346035 - DNA, 25 bp, Artificial Sequence
  Description of Artificial Sequence: Synthetic oligonucleotide
ccacctatcacctcgaggcacaccc

SEQ ID NO: 346036 - DNA, 25 bp, Artificial Sequence
  Description of Artificial Sequence: Synthetic oligonucleotide
cacctatcacctcgaggcacacccc

SEQ ID NO: 346037 - DNA, 26 bp, Artificial Sequence
  Description of Artificial Sequence: Synthetic oligonucleotide
acctatcacctcgaggcacaccccca

SEQ ID NO: 346038 - DNA, 25 bp, Artificial Sequence
  Description of Artificial Sequence: Synthetic oligonucleotide
cctatcacctcgaggcacaccccca

SEQ ID NO: 346039 - DNA, 27 bp, Artificial Sequence
  Description of Artificial Sequence: Synthetic oligonucleotide
ctatcacctcgaggcacacccccacta

SEQ ID NO: 346040 - DNA, 27 bp, Artificial Sequence
  Description of Artificial Sequence: Synthetic oligonucleotide
tatcacctcgaggcacacccccactac

SEQ ID NO: 346041 - DNA, 26 bp, Artificial Sequence
  Description of Artificial Sequence: Synthetic oligonucleotide
atcacctcgaggcacacccccactac

SEQ ID NO: 346042 - DNA, 25 bp, Artificial Sequence
  Description of Artificial Sequence: Synthetic oligonucleotide
tcacctcgaggcacacccccactac

SEQ ID NO: 346043 - DNA, 24 bp, Artificial Sequence
  Description of Artificial Sequence: Synthetic oligonucleotide
cacctcgaggcacacccccactac

SEQ ID NO: 346044 - DNA, 25 bp, Artificial Sequence
  Description of Artificial Sequence: Synthetic oligonucleotide
acctcgaggcacacccccactacct

SEQ ID NO: 346045 - DNA, 24 bp, Artificial Sequence
  Description of Artificial Sequence: Synthetic oligonucleotide
cctcgaggcacacccccactacct

SEQ ID NO: 346046 - DNA, 24 bp, Artificial Sequence
  Description of Artificial Sequence: Synthetic oligonucleotide
ctcgaggcacacccccactacctg

SEQ ID NO: 346047 - DNA, 25 bp, Artificial Sequence
  Description of Artificial Sequence: Synthetic oligonucleotide
tcgaggcacacccccactacctgct

SEQ ID NO: 346048 - DNA, 24 bp, Artificial Sequence
  Description of Artificial Sequence: Synthetic oligonucleotide
cgaggcacacccccactacctgct

SEQ ID NO: 346049 - DNA, 24 bp, Artificial Sequence
  Description of Artificial Sequence: Synthetic oligonucleotide
gaggcacacccccactacctgctg

SEQ ID NO: 346050 - DNA, 25 bp, Artificial Sequence
  Description of Artificial Sequence: Synthetic oligonucleotide
aggcacacccccactacctgctgca

SEQ ID NO: 346051 - DNA, 24 bp, Artificial Sequence
  Description of Artificial Sequence: Synthetic oligonucleotide
ggcacacccccactacctgctgca

SEQ ID NO: 346052 - DNA, 25 bp, Artificial Sequence
  Description of Artificial Sequence: Synthetic oligonucleotide
gcacacccccactacctgctgcact

SEQ ID NO: 346053 - DNA, 25 bp, Artificial Sequence
  Description of Artificial Sequence: Synthetic oligonucleotide
cacacccccactacctgctgcactc

SEQ ID NO: 346054 - DNA, 27 bp, Artificial Sequence
  Description of Artificial Sequence: Synthetic oligonucleotide
acacccccactacctgctgcactcgaa

SEQ ID NO: 346055 - DNA, 27 bp, Artificial Sequence
  Description of Artificial Sequence: Synthetic oligonucleotide
cacccccactacctgctgcactcgaat

SEQ ID NO: 346056 - DNA, 28 bp, Artificial Sequence
  Description of Artificial Sequence: Synthetic oligonucleotide
acccccactacctgctgcactcgaatac

SEQ ID NO: 346057 - DNA, 27 bp, Artificial Sequence
  Description of Artificial Sequence: Synthetic oligonucleotide
cccccactacctgctgcactcgaatac

SEQ ID NO: 346058 - DNA, 27 bp, Artificial Sequence
  Description of Artificial Sequence: Synthetic oligonucleotide
ccccactacctgctgcactcgaatacc

SEQ ID NO: 346059 - DNA, 28 bp, Artificial Sequence
  Description of Artificial Sequence: Synthetic oligonucleotide
cccactacctgctgcactcgaatacctg

SEQ ID NO: 346060 - DNA, 28 bp, Artificial Sequence
  Description of Artificial Sequence: Synthetic oligonucleotide
ccactacctgctgcactcgaatacctgg

SEQ ID NO: 346061 - DNA, 30 bp, Artificial Sequence
  Description of Artificial Sequence: Synthetic oligonucleotide
cactacctgctgcactcgaatacctggatc

SEQ ID NO: 346062 - DNA, 30 bp, Artificial Sequence
  Description of Artificial Sequence: Synthetic oligonucleotide
actacctgctgcactcgaatacctggatcg

SEQ ID NO: 346063 - DNA, 29 bp, Artificial Sequence
  Description of Artificial Sequence: Synthetic oligonucleotide
ctacctgctgcactcgaatacctggatcg

SEQ ID NO: 346064 - DNA, 30 bp, Artificial Sequence
  Description of Artificial Sequence: Synthetic oligonucleotide
tacctgctgcactcgaatacctggatcgac

SEQ ID NO: 346065 - DNA, 29 bp, Artificial Sequence
  Description of Artificial Sequence: Synthetic oligonucleotide
acctgctgcactcgaatacctggatcgac

SEQ ID NO: 346066 - DNA, 28 bp, Artificial Sequence
  Description of Artificial Sequence: Synthetic oligonucleotide
cctgctgcactcgaatacctggatcgac

SEQ ID NO: 346067 - DNA, 28 bp, Artificial Sequence
  Description of Artificial Sequence: Synthetic oligonucleotide
ctgctgcactcgaatacctggatcgacg

SEQ ID NO: 346068 - DNA, 29 bp, Artificial Sequence
  Description of Artificial Sequence: Synthetic oligonucleotide
tgctgcactcgaatacctggatcgacgag

SEQ ID NO: 346069 - DNA, 28 bp, Artificial Sequence
  Description of Artificial Sequence: Synthetic oligonucleotide
gctgcactcgaatacctggatcgacgag

SEQ ID NO: 346070 - DNA, 30 bp, Artificial Sequence
  Description of Artificial Sequence: Synthetic oligonucleotide
ctgcactcgaatacctggatcgacgagatg

SEQ ID NO: 346071 - DNA, 30 bp, Artificial Sequence
  Description of Artificial Sequence: Synthetic oligonucleotide
tgcactcgaatacctggatcgacgagatgc

SEQ ID NO: 346072 - DNA, 29 bp, Artificial Sequence
  Description of Artificial Sequence: Synthetic oligonucleotide
gcactcgaatacctggatcgacgagatgc

SEQ ID NO: 346073 - DNA, 29 bp, Artificial Sequence
  Description of Artificial Sequence: Synthetic oligonucleotide
cactcgaatacctggatcgacgagatgcc

SEQ ID NO: 346074 - DNA, 29 bp, Artificial Sequence
  Description of Artificial Sequence: Synthetic oligonucleotide
actcgaatacctggatcgacgagatgccc

SEQ ID NO: 346075 - DNA, 28 bp, Artificial Sequence
  Description of Artificial Sequence: Synthetic oligonucleotide
ctcgaatacctggatcgacgagatgccc

SEQ ID NO: 346076 - DNA, 29 bp, Artificial Sequence
  Description of Artificial Sequence: Synthetic oligonucleotide
tcgaatacctggatcgacgagatgcccac

SEQ ID NO: 346077 - DNA, 28 bp, Artificial Sequence
  Description of Artificial Sequence: Synthetic oligonucleotide
cgaatacctggatcgacgagatgcccac

SEQ ID NO: 346078 - DNA, 29 bp, Artificial Sequence
  Description of Artificial Sequence: Synthetic oligonucleotide
gaatacctggatcgacgagatgcccactg

SEQ ID NO: 346079 - DNA, 31 bp, Artificial Sequence
  Description of Artificial Sequence: Synthetic oligonucleotide
aatacctggatcgacgagatgcccactgaac

SEQ ID NO: 346080 - DNA, 30 bp, Artificial Sequence
  Description of Artificial Sequence: Synthetic oligonucleotide
atacctggatcgacgagatgcccactgaac

SEQ ID NO: 346081 - DNA, 29 bp, Artificial Sequence
  Description of Artificial Sequence: Synthetic oligonucleotide
tacctggatcgacgagatgcccactgaac

SEQ ID NO: 346082 - DNA, 28 bp, Artificial Sequence
  Description of Artificial Sequence: Synthetic oligonucleotide
acctggatcgacgagatgcccactgaac

SEQ ID NO: 346083 - DNA, 27 bp, Artificial Sequence
  Description of Artificial Sequence: Synthetic oligonucleotide
cctggatcgacgagatgcccactgaac

SEQ ID NO: 346084 - DNA, 27 bp, Artificial Sequence
  Description of Artificial Sequence: Synthetic oligonucleotide
ctggatcgacgagatgcccactgaacg

SEQ ID NO: 346085 - DNA, 27 bp, Artificial Sequence
  Description of Artificial Sequence: Synthetic oligonucleotide
tggatcgacgagatgcccactgaacgc

SEQ ID NO: 346086 - DNA, 26 bp, Artificial Sequence
  Description of Artificial Sequence: Synthetic oligonucleotide
ggatcgacgagatgcccactgaacgc

SEQ ID NO: 346087 - DNA, 27 bp, Artificial Sequence
  Description of Artificial Sequence: Synthetic oligonucleotide
gatcgacgagatgcccactgaacgcca

SEQ ID NO: 346088 - DNA, 27 bp, Artificial Sequence
  Description of Artificial Sequence: Synthetic oligonucleotide
atcgacgagatgcccactgaacgccag

SEQ ID NO: 346089 - DNA, 27 bp, Artificial Sequence
  Description of Artificial Sequence: Synthetic oligonucleotide
tcgacgagatgcccactgaacgccagt

SEQ ID NO: 346090 - DNA, 26 bp, Artificial Sequence
  Description of Artificial Sequence: Synthetic oligonucleotide
cgacgagatgcccactgaacgccagt

SEQ ID NO: 346091 - DNA, 26 bp, Artificial Sequence
  Description of Artificial Sequence: Synthetic oligonucleotide
gacgagatgcccactgaacgccagtg

SEQ ID NO: 346092 - DNA, 26 bp, Artificial Sequence
  Description of Artificial Sequence: Synthetic oligonucleotide
acgagatgcccactgaacgccagtgc

SEQ ID NO: 346093 - DNA, 25 bp, Artificial Sequence
  Description of Artificial Sequence: Synthetic oligonucleotide
cgagatgcccactgaacgccagtgc

SEQ ID NO: 346094 - DNA, 25 bp, Artificial Sequence
  Description of Artificial Sequence: Synthetic oligonucleotide
gagatgcccactgaacgccagtgcc

SEQ ID NO: 346095 - DNA, 25 bp, Artificial Sequence
  Description of Artificial Sequence: Synthetic oligonucleotide
agatgcccactgaacgccagtgccg

SEQ ID NO: 346096 - DNA, 24 bp, Artificial Sequence
  Description of Artificial Sequence: Synthetic oligonucleotide
gatgcccactgaacgccagtgccg

SEQ ID NO: 346097 - DNA, 25 bp, Artificial Sequence
  Description of Artificial Sequence: Synthetic oligonucleotide
atgcccactgaacgccagtgccgga

SEQ ID NO: 346098 - DNA, 24 bp, Artificial Sequence
  Description of Artificial Sequence: Synthetic oligonucleotide
tgcccactgaacgccagtgccgga

SEQ ID NO: 346099 - DNA, 23 bp, Artificial Sequence
  Description of Artificial Sequence: Synthetic oligonucleotide
gcccactgaacgccagtgccgga

SEQ ID NO: 346100 - DNA, 23 bp, Artificial Sequence
  Description of Artificial Sequence: Synthetic oligonucleotide
cccactgaacgccagtgccggag

SEQ ID NO: 346101 - DNA, 24 bp, Artificial Sequence
  Description of Artificial Sequence: Synthetic oligonucleotide
ccactgaacgccagtgccggagga

SEQ ID NO: 346102 - DNA, 24 bp, Artificial Sequence
  Description of Artificial Sequence: Synthetic oligonucleotide
cactgaacgccagtgccggaggac

SEQ ID NO: 346103 - DNA, 24 bp, Artificial Sequence
  Description of Artificial Sequence: Synthetic oligonucleotide
actgaacgccagtgccggaggacc

SEQ ID NO: 346104 - DNA, 23 bp, Artificial Sequence
  Description of Artificial Sequence: Synthetic oligonucleotide
ctgaacgccagtgccggaggacc

SEQ ID NO: 346105 - DNA, 23 bp, Artificial Sequence
  Description of Artificial Sequence: Synthetic oligonucleotide
tgaacgccagtgccggaggaccc

SEQ ID NO: 346106 - DNA, 22 bp, Artificial Sequence
  Description of Artificial Sequence: Synthetic oligonucleotide
gaacgccagtgccggaggaccc

SEQ ID NO: 346107 - DNA, 22 bp, Artificial Sequence
  Description of Artificial Sequence: Synthetic oligonucleotide
aacgccagtgccggaggacccg

SEQ ID NO: 346108 - DNA, 21 bp, Artificial Sequence
  Description of Artificial Sequence: Synthetic oligonucleotide
acgccagtgccggaggacccg

SEQ ID NO: 346109 - DNA, 20 bp, Artificial Sequence
  Description of Artificial Sequence: Synthetic oligonucleotide
cgccagtgccggaggacccg

SEQ ID NO: 346110 - DNA, 20 bp, Artificial Sequence
  Description of Artificial Sequence: Synthetic oligonucleotide
gccagtgccggaggacccgc

SEQ ID NO: 346111 - DNA, 21 bp, Artificial Sequence
  Description of Artificial Sequence: Synthetic oligonucleotide
ccagtgccggaggacccgcca

SEQ ID NO: 346112 - DNA, 21 bp, Artificial Sequence
  Description of Artificial Sequence: Synthetic oligonucleotide
cagtgccggaggacccgccag

SEQ ID NO: 346113 - DNA, 21 bp, Artificial Sequence
  Description of Artificial Sequence: Synthetic oligonucleotide
agtgccggaggacccgccagg

SEQ ID NO: 346114 - DNA, 20 bp, Artificial Sequence
  Description of Artificial Sequence: Synthetic oligonucleotide
gtgccggaggacccgccagg

SEQ ID NO: 346115 - DNA, 20 bp, Artificial Sequence
  Description of Artificial Sequence: Synthetic oligonucleotide
tgccggaggacccgccaggg

SEQ ID NO: 346116 - DNA, 20 bp, Artificial Sequence
  Description of Artificial Sequence: Synthetic oligonucleotide
gccggaggacccgccagggt

SEQ ID NO: 346117 - DNA, 20 bp, Artificial Sequence
  Description of Artificial Sequence: Synthetic oligonucleotide
ccggaggacccgccaggggt

SEQ ID NO: 346118 - DNA, 20 bp, Artificial Sequence
  Description of Artificial Sequence: Synthetic oligonucleotide
cggaggacccgccagggggt

SEQ ID NO: 346119 - DNA, 20 bp, Artificial Sequence
  Description of Artificial Sequence: Synthetic oligonucleotide
ggaggacccgccagggggca

SEQ ID NO: 346120 - DNA, 20 bp, Artificial Sequence
  Description of Artificial Sequence: Synthetic oligonucleotide
gaggacccgccagggggcag

SEQ ID NO: 346121 - DNA, 20 bp, Artificial Sequence
  Description of Artificial Sequence: Synthetic oligonucleotide
aggacccgccagggggcagc

SEQ ID NO: 346122 - DNA, 20 bp, Artificial Sequence
  Description of Artificial Sequence: Synthetic oligonucleotide
ggacccgccagggggcagct

SEQ ID NO: 346123 - DNA, 20 bp, Artificial Sequence
  Description of Artificial Sequence: Synthetic oligonucleotide
gacccgccagggggcagcct

SEQ ID NO: 346124 - DNA, 21 bp, Artificial Sequence
  Description of Artificial Sequence: Synthetic oligonucleotide
acccgccagggggcagcctct

SEQ ID NO: 346125 - DNA, 20 bp, Artificial Sequence
  Description of Artificial Sequence: Synthetic oligonucleotide
cccgccagggggcagcctct

SEQ ID NO: 346126 - DNA, 20 bp, Artificial Sequence
  Description of Artificial Sequence: Synthetic oligonucleotide
ccgccagggggcagcctctg

SEQ ID NO: 346127 - DNA, 20 bp, Artificial Sequence
  Description of Artificial Sequence: Synthetic oligonucleotide
cgccagggggcagcctctgc

SEQ ID NO: 346128 - DNA, 20 bp, Artificial Sequence
  Description of Artificial Sequence: Synthetic oligonucleotide
gccagggggcagcctctgcc

SEQ ID NO: 346129 - DNA, 21 bp, Artificial Sequence
  Description of Artificial Sequence: Synthetic oligonucleotide
ccagggggcagcctctgccca

SEQ ID NO: 346130 - DNA, 21 bp, Artificial Sequence
  Description of Artificial Sequence: Synthetic oligonucleotide
cagggggcagcctctgcccag

SEQ ID NO: 346131 - DNA, 22 bp, Artificial Sequence
  Description of Artificial Sequence: Synthetic oligonucleotide
agggggcagcctctgcccagct

SEQ ID NO: 346132 - DNA, 21 bp, Artificial Sequence
  Description of Artificial Sequence: Synthetic oligonucleotide
gggggcagcctctgcccagct

SEQ ID NO: 346133 - DNA, 23 bp, Artificial Sequence
  Description of Artificial Sequence: Synthetic oligonucleotide
ggggcagcctctgcccagctgaa

SEQ ID NO: 346134 - DNA, 23 bp, Artificial Sequence
  Description of Artificial Sequence: Synthetic oligonucleotide
gggcagcctctgcccagctgaac

SEQ ID NO: 346135 - DNA, 24 bp, Artificial Sequence
  Description of Artificial Sequence: Synthetic oligonucleotide
ggcagcctctgcccagctgaacga

SEQ ID NO: 346136 - DNA, 26 bp, Artificial Sequence
  Description of Artificial Sequence: Synthetic oligonucleotide
gcagcctctgcccagctgaacgactt

SEQ ID NO: 346137 - DNA, 26 bp, Artificial Sequence
  Description of Artificial Sequence: Synthetic oligonucleotide
cagcctctgcccagctgaacgacttc

SEQ ID NO: 346138 - DNA, 27 bp, Artificial Sequence
  Description of Artificial Sequence: Synthetic oligonucleotide
agcctctgcccagctgaacgacttcgt

SEQ ID NO: 346139 - DNA, 26 bp, Artificial Sequence
  Description of Artificial Sequence: Synthetic oligonucleotide
gcctctgcccagctgaacgacttcgt

SEQ ID NO: 346140 - DNA, 26 bp, Artificial Sequence
  Description of Artificial Sequence: Synthetic oligonucleotide
cctctgcccagctgaacgacttcgtc

SEQ ID NO: 346141 - DNA, 27 bp, Artificial Sequence
  Description of Artificial Sequence: Synthetic oligonucleotide
ctctgcccagctgaacgacttcgtcca

SEQ ID NO: 346142 - DNA, 27 bp, Artificial Sequence
  Description of Artificial Sequence: Synthetic oligonucleotide
tctgcccagctgaacgacttcgtccag

SEQ ID NO: 346143 - DNA, 26 bp, Artificial Sequence
  Description of Artificial Sequence: Synthetic oligonucleotide
ctgcccagctgaacgacttcgtccag

SEQ ID NO: 346144 - DNA, 27 bp, Artificial Sequence
  Description of Artificial Sequence: Synthetic oligonucleotide
tgcccagctgaacgacttcgtccagga

SEQ ID NO: 346145 - DNA, 26 bp, Artificial Sequence
  Description of Artificial Sequence: Synthetic oligonucleotide
gcccagctgaacgacttcgtccagga

SEQ ID NO: 346146 - DNA, 27 bp, Artificial Sequence
  Description of Artificial Sequence: Synthetic oligonucleotide
cccagctgaacgacttcgtccaggagt

SEQ ID NO: 346147 - DNA, 29 bp, Artificial Sequence
  Description of Artificial Sequence: Synthetic oligonucleotide
ccagctgaacgacttcgtccaggagtttg

SEQ ID NO: 346148 - DNA, 29 bp, Artificial Sequence
  Description of Artificial Sequence: Synthetic oligonucleotide
cagctgaacgacttcgtccaggagtttgg

SEQ ID NO: 346149 - DNA, 29 bp, Artificial Sequence
  Description of Artificial Sequence: Synthetic oligonucleotide
agctgaacgacttcgtccaggagtttggc

SEQ ID NO: 346150 - DNA, 28 bp, Artificial Sequence
  Description of Artificial Sequence: Synthetic oligonucleotide
gctgaacgacttcgtccaggagtttggc

SEQ ID NO: 346151 - DNA, 29 bp, Artificial Sequence
  Description of Artificial Sequence: Synthetic oligonucleotide
ctgaacgacttcgtccaggagtttggcac

SEQ ID NO: 346152 - DNA, 30 bp, Artificial Sequence
  Description of Artificial Sequence: Synthetic oligonucleotide
tgaacgacttcgtccaggagtttggcactc

SEQ ID NO: 346153 - DNA, 29 bp, Artificial Sequence
  Description of Artificial Sequence: Synthetic oligonucleotide
gaacgacttcgtccaggagtttggcactc

SEQ ID NO: 346154 - DNA, 30 bp, Artificial Sequence
  Description of Artificial Sequence: Synthetic oligonucleotide
aacgacttcgtccaggagtttggcactcac

SEQ ID NO: 346155 - DNA, 29 bp, Artificial Sequence
  Description of Artificial Sequence: Synthetic oligonucleotide
acgacttcgtccaggagtttggcactcac

SEQ ID NO: 346156 - DNA, 28 bp, Artificial Sequence
  Description of Artificial Sequence: Synthetic oligonucleotide
cgacttcgtccaggagtttggcactcac

SEQ ID NO: 346157 - DNA, 28 bp, Artificial Sequence
  Description of Artificial Sequence: Synthetic oligonucleotide
gacttcgtccaggagtttggcactcacg

SEQ ID NO: 346158 - DNA, 28 bp, Artificial Sequence
  Description of Artificial Sequence: Synthetic oligonucleotide
acttcgtccaggagtttggcactcacgg

SEQ ID NO: 346159 - DNA, 27 bp, Artificial Sequence
  Description of Artificial Sequence: Synthetic oligonucleotide
cttcgtccaggagtttggcactcacgg

SEQ ID NO: 346160 - DNA, 27 bp, Artificial Sequence
  Description of Artificial Sequence: Synthetic oligonucleotide
ttcgtccaggagtttggcactcacggg

SEQ ID NO: 346161 - DNA, 27 bp, Artificial Sequence
  Description of Artificial Sequence: Synthetic oligonucleotide
tcgtccaggagtttggcactcacgggt

SEQ ID NO: 346162 - DNA, 26 bp, Artificial Sequence
  Description of Artificial Sequence: Synthetic oligonucleotide
cgtccaggagtttggcactcacgggt

SEQ ID NO: 346163 - DNA, 26 bp, Artificial Sequence
  Description of Artificial Sequence: Synthetic oligonucleotide
gtccaggagtttggcactcacgggtg

SEQ ID NO: 346164 - DNA, 26 bp, Artificial Sequence
  Description of Artificial Sequence: Synthetic oligonucleotide
tccaggagtttggcactcacgggtgc

SEQ ID NO: 346165 - DNA, 25 bp, Artificial Sequence
  Description of Artificial Sequence: Synthetic oligonucleotide
ccaggagtttggcactcacgggtgc

SEQ ID NO: 346166 - DNA, 26 bp, Artificial Sequence
  Description of Artificial Sequence: Synthetic oligonucleotide
caggagtttggcactcacgggtgcca

SEQ ID NO: 346167 - DNA, 26 bp, Artificial Sequence
  Description of Artificial Sequence: Synthetic oligonucleotide
aggagtttggcactcacgggtgccag

SEQ ID NO: 346168 - DNA, 25 bp, Artificial Sequence
  Description of Artificial Sequence: Synthetic oligonucleotide
ggagtttggcactcacgggtgccag

SEQ ID NO: 346169 - DNA, 26 bp, Artificial Sequence
  Description of Artificial Sequence: Synthetic oligonucleotide
gagtttggcactcacgggtgccagct

SEQ ID NO: 346170 - DNA, 27 bp, Artificial Sequence
  Description of Artificial Sequence: Synthetic oligonucleotide
agtttggcactcacgggtgccagctgt

SEQ ID NO: 346171 - DNA, 26 bp, Artificial Sequence
  Description of Artificial Sequence: Synthetic oligonucleotide
gtttggcactcacgggtgccagctgt

SEQ ID NO: 346172 - DNA, 27 bp, Artificial Sequence
  Description of Artificial Sequence: Synthetic oligonucleotide
tttggcactcacgggtgccagctgtga

SEQ ID NO: 346173 - DNA, 28 bp, Artificial Sequence
  Description of Artificial Sequence: Synthetic oligonucleotide
atgagctcttagtacccgccgtctgtcc

SEQ ID NO: 346174 - DNA, 27 bp, Artificial Sequence
  Description of Artificial Sequence: Synthetic oligonucleotide
tgagctcttagtacccgccgtctgtcc

SEQ ID NO: 346175 - DNA, 26 bp, Artificial Sequence
  Description of Artificial Sequence: Synthetic oligonucleotide
gagctcttagtacccgccgtctgtcc

SEQ ID NO: 346176 - DNA, 26 bp, Artificial Sequence
  Description of Artificial Sequence: Synthetic oligonucleotide
agctcttagtacccgccgtctgtccg

SEQ ID NO: 346177 - DNA, 25 bp, Artificial Sequence
  Description of Artificial Sequence: Synthetic oligonucleotide
gctcttagtacccgccgtctgtccg

SEQ ID NO: 346178 - DNA, 25 bp, Artificial Sequence
  Description of Artificial Sequence: Synthetic oligonucleotide
ctcttagtacccgccgtctgtccgc

SEQ ID NO: 346179 - DNA, 25 bp, Artificial Sequence
  Description of Artificial Sequence: Synthetic oligonucleotide
tcttagtacccgccgtctgtccgcc

SEQ ID NO: 346180 - DNA, 24 bp, Artificial Sequence
  Description of Artificial Sequence: Synthetic oligonucleotide
cttagtacccgccgtctgtccgcc

SEQ ID NO: 346181 - DNA, 24 bp, Artificial Sequence
  Description of Artificial Sequence: Synthetic oligonucleotide
ttagtacccgccgtctgtccgccg

SEQ ID NO: 346182 - DNA, 23 bp, Artificial Sequence
  Description of Artificial Sequence: Synthetic oligonucleotide
tagtacccgccgtctgtccgccg

SEQ ID NO: 346183 - DNA, 22 bp, Artificial Sequence
  Description of Artificial Sequence: Synthetic oligonucleotide
agtacccgccgtctgtccgccg

SEQ ID NO: 346184 - DNA, 21 bp, Artificial Sequence
  Description of Artificial Sequence: Synthetic oligonucleotide
gtacccgccgtctgtccgccg

SEQ ID NO: 346185 - DNA, 22 bp, Artificial Sequence
  Description of Artificial Sequence: Synthetic oligonucleotide
tacccgccgtctgtccgccgct

SEQ ID NO: 346186 - DNA, 21 bp, Artificial Sequence
  Description of Artificial Sequence: Synthetic oligonucleotide
acccgccgtctgtccgccgct

SEQ ID NO: 346187 - DNA, 20 bp, Artificial Sequence
  Description of Artificial Sequence: Synthetic oligonucleotide
cccgccgtctgtccgccgct

SEQ ID NO: 346188 - DNA, 20 bp, Artificial Sequence
  Description of Artificial Sequence: Synthetic oligonucleotide
ccgccgtctgtccgccgctg

SEQ ID NO: 346189 - DNA, 20 bp, Artificial Sequence
  Description of Artificial Sequence: Synthetic oligonucleotide
cgccgtctgtccgccgctgc

SEQ ID NO: 346190 - DNA, 21 bp, Artificial Sequence
  Description of Artificial Sequence: Synthetic oligonucleotide
gccgtctgtccgccgctgcct

SEQ ID NO: 346191 - DNA, 21 bp, Artificial Sequence
  Description of Artificial Sequence: Synthetic oligonucleotide
ccgtctgtccgccgctgcctg

SEQ ID NO: 346192 - DNA, 21 bp, Artificial Sequence
  Description of Artificial Sequence: Synthetic oligonucleotide
cgtctgtccgccgctgcctgg

SEQ ID NO: 346193 - DNA, 21 bp, Artificial Sequence
  Description of Artificial Sequence: Synthetic oligonucleotide
gtctgtccgccgctgcctggc

SEQ ID NO: 346194 - DNA, 21 bp, Artificial Sequence
  Description of Artificial Sequence: Synthetic oligonucleotide
tctgtccgccgctgcctggcc

SEQ ID NO: 346195 - DNA, 20 bp, Artificial Sequence
  Description of Artificial Sequence: Synthetic oligonucleotide
ctgtccgccgctgcctggcc

SEQ ID NO: 346196 - DNA, 21 bp, Artificial Sequence
  Description of Artificial Sequence: Synthetic oligonucleotide
tgtccgccgctgcctggccct

SEQ ID NO: 346197 - DNA, 20 bp, Artificial Sequence
  Description of Artificial Sequence: Synthetic oligonucleotide
gtccgccgctgcctggccct

SEQ ID NO: 346198 - DNA, 21 bp, Artificial Sequence
  Description of Artificial Sequence: Synthetic oligonucleotide
tccgccgctgcctggccctct

SEQ ID NO: 346199 - DNA, 20 bp, Artificial Sequence
  Description of Artificial Sequence: Synthetic oligonucleotide
ccgccgctgcctggccctct

SEQ ID NO: 346200 - DNA, 20 bp, Artificial Sequence
  Description of Artificial Sequence: Synthetic oligonucleotide
cgccgctgcctggccctctg

SEQ ID NO: 346201 - DNA, 20 bp, Artificial Sequence
  Description of Artificial Sequence: Synthetic oligonucleotide
gccgctgcctggccctctgc

SEQ ID NO: 346202 - DNA, 20 bp, Artificial Sequence
  Description of Artificial Sequence: Synthetic oligonucleotide
ccgctgcctggccctctgcg

SEQ ID NO: 346203 - DNA, 20 bp, Artificial Sequence
  Description of Artificial Sequence: Synthetic oligonucleotide
cgctgcctggccctctgcgg

SEQ ID NO: 346204 - DNA, 20 bp, Artificial Sequence
  Description of Artificial Sequence: Synthetic oligonucleotide
gctgcctggccctctgcggc

SEQ ID NO: 346205 - DNA, 23 bp, Artificial Sequence
  Description of Artificial Sequence: Synthetic oligonucleotide
ctgcctggccctctgcggcctaa

SEQ ID NO: 346206 - DNA, 24 bp, Artificial Sequence
  Description of Artificial Sequence: Synthetic oligonucleotide
tgcctggccctctgcggcctaaca

SEQ ID NO: 346207 - DNA, 23 bp, Artificial Sequence
  Description of Artificial Sequence: Synthetic oligonucleotide
gcctggccctctgcggcctaaca

SEQ ID NO: 346208 - DNA, 24 bp, Artificial Sequence
  Description of Artificial Sequence: Synthetic oligonucleotide
cctggccctctgcggcctaacact

SEQ ID NO: 346209 - DNA, 24 bp, Artificial Sequence
  Description of Artificial Sequence: Synthetic oligonucleotide
ctggccctctgcggcctaacactc

SEQ ID NO: 346210 - DNA, 26 bp, Artificial Sequence
  Description of Artificial Sequence: Synthetic oligonucleotide
tggccctctgcggcctaacactcgaa

SEQ ID NO: 346211 - DNA, 25 bp, Artificial Sequence
  Description of Artificial Sequence: Synthetic oligonucleotide
ggccctctgcggcctaacactcgaa

SEQ ID NO: 346212 - DNA, 25 bp, Artificial Sequence
  Description of Artificial Sequence: Synthetic oligonucleotide
gccctctgcggcctaacactcgaag

SEQ ID NO: 346213 - DNA, 26 bp, Artificial Sequence
  Description of Artificial Sequence: Synthetic oligonucleotide
ccctctgcggcctaacactcgaagca

SEQ ID NO: 346214 - DNA, 26 bp, Artificial Sequence
  Description of Artificial Sequence: Synthetic oligonucleotide
cctctgcggcctaacactcgaagcag

SEQ ID NO: 346215 - DNA, 27 bp, Artificial Sequence
  Description of Artificial Sequence: Synthetic oligonucleotide
ctctgcggcctaacactcgaagcagct

SEQ ID NO: 346216 - DNA, 27 bp, Artificial Sequence
  Description of Artificial Sequence: Synthetic oligonucleotide
tctgcggcctaacactcgaagcagctg

SEQ ID NO: 346217 - DNA, 27 bp, Artificial Sequence
  Description of Artificial Sequence: Synthetic oligonucleotide
ctgcggcctaacactcgaagcagctgt

SEQ ID NO: 346218 - DNA, 27 bp, Artificial Sequence
  Description of Artificial Sequence: Synthetic oligonucleotide
tgcggcctaacactcgaagcagctgtc

SEQ ID NO: 346219 - DNA, 27 bp, Artificial Sequence
  Description of Artificial Sequence: Synthetic oligonucleotide
gcggcctaacactcgaagcagctgtca

SEQ ID NO: 346220 - DNA, 29 bp, Artificial Sequence
  Description of Artificial Sequence: Synthetic oligonucleotide
cggcctaacactcgaagcagctgtcattc

SEQ ID NO: 346221 - DNA, 30 bp, Artificial Sequence
  Description of Artificial Sequence: Synthetic oligonucleotide
ggcctaacactcgaagcagctgtcattctc

SEQ ID NO: 346222 - DNA, 30 bp, Artificial Sequence
  Description of Artificial Sequence: Synthetic oligonucleotide
gcctaacactcgaagcagctgtcattctcc

SEQ ID NO: 346223 - DNA, 31 bp, Artificial Sequence
  Description of Artificial Sequence: Synthetic oligonucleotide
cctaacactcgaagcagctgtcattctccac

SEQ ID NO: 346224 - DNA, 33 bp, Artificial Sequence
  Description of Artificial Sequence: Synthetic oligonucleotide
ctaacactcgaagcagctgtcattctccacttc

SEQ ID NO: 346225 - DNA, 43 bp, Artificial Sequence
  Description of Artificial Sequence: Synthetic oligonucleotide
taacactcgaagcagctgtcattctccacttctatttatttac

SEQ ID NO: 346226 - DNA, 42 bp, Artificial Sequence
  Description of Artificial Sequence: Synthetic oligonucleotide
aacactcgaagcagctgtcattctccacttctatttatttac

SEQ ID NO: 346227 - DNA, 41 bp, Artificial Sequence
  Description of Artificial Sequence: Synthetic oligonucleotide
acactcgaagcagctgtcattctccacttctatttatttac

SEQ ID NO: 346228 - DNA, 40 bp, Artificial Sequence
  Description of Artificial Sequence: Synthetic oligonucleotide
cactcgaagcagctgtcattctccacttctatttatttac

SEQ ID NO: 346229 - DNA, 40 bp, Artificial Sequence
  Description of Artificial Sequence: Synthetic oligonucleotide
actcgaagcagctgtcattctccacttctatttatttacc

SEQ ID NO: 346230 - DNA, 39 bp, Artificial Sequence
  Description of Artificial Sequence: Synthetic oligonucleotide
ctcgaagcagctgtcattctccacttctatttatttacc

SEQ ID NO: 346231 - DNA, 39 bp, Artificial Sequence
  Description of Artificial Sequence: Synthetic oligonucleotide
tcgaagcagctgtcattctccacttctatttatttaccc

SEQ ID NO: 346232 - DNA, 38 bp, Artificial Sequence
  Description of Artificial Sequence: Synthetic oligonucleotide
cgaagcagctgtcattctccacttctatttatttaccc

SEQ ID NO: 346233 - DNA, 39 bp, Artificial Sequence
  Description of Artificial Sequence: Synthetic oligonucleotide
gaagcagctgtcattctccacttctatttatttacccac

SEQ ID NO: 346234 - DNA, 42 bp, Artificial Sequence
  Description of Artificial Sequence: Synthetic oligonucleotide
aagcagctgtcattctccacttctatttatttacccacaatg

SEQ ID NO: 346235 - DNA, 41 bp, Artificial Sequence
  Description of Artificial Sequence: Synthetic oligonucleotide
agcagctgtcattctccacttctatttatttacccacaatg

SEQ ID NO: 346236 - DNA, 40 bp, Artificial Sequence
  Description of Artificial Sequence: Synthetic oligonucleotide
gcagctgtcattctccacttctatttatttacccacaatg

SEQ ID NO: 346237 - DNA, 41 bp, Artificial Sequence
  Description of Artificial Sequence: Synthetic oligonucleotide
cagctgtcattctccacttctatttatttacccacaatgac

SEQ ID NO: 346238 - DNA, 41 bp, Artificial Sequence
  Description of Artificial Sequence: Synthetic oligonucleotide
agctgtcattctccacttctatttatttacccacaatgacg

SEQ ID NO: 346239 - DNA, 40 bp, Artificial Sequence
  Description of Artificial Sequence: Synthetic oligonucleotide
gctgtcattctccacttctatttatttacccacaatgacg

SEQ ID NO: 346240 - DNA, 40 bp, Artificial Sequence
  Description of Artificial Sequence: Synthetic oligonucleotide
ctgtcattctccacttctatttatttacccacaatgacgc

SEQ ID NO: 346241 - DNA, 42 bp, Artificial Sequence
  Description of Artificial Sequence: Synthetic oligonucleotide
tgtcattctccacttctatttatttacccacaatgacgcttg

SEQ ID NO: 346242 - DNA, 41 bp, Artificial Sequence
  Description of Artificial Sequence: Synthetic oligonucleotide
gtcattctccacttctatttatttacccacaatgacgcttg

SEQ ID NO: 346243 - DNA, 41 bp, Artificial Sequence
  Description of Artificial Sequence: Synthetic oligonucleotide
tcattctccacttctatttatttacccacaatgacgcttgc

SEQ ID NO: 346244 - DNA, 40 bp, Artificial Sequence
  Description of Artificial Sequence: Synthetic oligonucleotide
cattctccacttctatttatttacccacaatgacgcttgc

SEQ ID NO: 346245 - DNA, 43 bp, Artificial Sequence
  Description of Artificial Sequence: Synthetic oligonucleotide
attctccacttctatttatttacccacaatgacgcttgcttag

SEQ ID NO: 346246 - DNA, 42 bp, Artificial Sequence
  Description of Artificial Sequence: Synthetic oligonucleotide
ttctccacttctatttatttacccacaatgacgcttgcttag

SEQ ID NO: 346247 - DNA, 41 bp, Artificial Sequence
  Description of Artificial Sequence: Synthetic oligonucleotide
tctccacttctatttatttacccacaatgacgcttgcttag

SEQ ID NO: 346248 - DNA, 40 bp, Artificial Sequence
  Description of Artificial Sequence: Synthetic oligonucleotide
ctccacttctatttatttacccacaatgacgcttgcttag

SEQ ID NO: 346249 - DNA, 41 bp, Artificial Sequence
  Description of Artificial Sequence: Synthetic oligonucleotide
tccacttctatttatttacccacaatgacgcttgcttagag

SEQ ID NO: 346250 - DNA, 40 bp, Artificial Sequence
  Description of Artificial Sequence: Synthetic oligonucleotide
ccacttctatttatttacccacaatgacgcttgcttagag

SEQ ID NO: 346251 - DNA, 40 bp, Artificial Sequence
  Description of Artificial Sequence: Synthetic oligonucleotide
cacttctatttatttacccacaatgacgcttgcttagagg

SEQ ID NO: 346252 - DNA, 42 bp, Artificial Sequence
  Description of Artificial Sequence: Synthetic oligonucleotide
acttctatttatttacccacaatgacgcttgcttagaggaac

SEQ ID NO: 346253 - DNA, 41 bp, Artificial Sequence
  Description of Artificial Sequence: Synthetic oligonucleotide
cttctatttatttacccacaatgacgcttgcttagaggaac

SEQ ID NO: 346254 - DNA, 45 bp, Artificial Sequence
  Description of Artificial Sequence: Synthetic oligonucleotide
ttctatttatttacccacaatgacgcttgcttagaggaacaaaag

SEQ ID NO: 346255 - DNA, 44 bp, Artificial Sequence
  Description of Artificial Sequence: Synthetic oligonucleotide
tctatttatttacccacaatgacgcttgcttagaggaacaaaag

SEQ ID NO: 346256 - DNA, 43 bp, Artificial Sequence
  Description of Artificial Sequence: Synthetic oligonucleotide
ctatttatttacccacaatgacgcttgcttagaggaacaaaag

SEQ ID NO: 346257 - DNA, 43 bp, Artificial Sequence
  Description of Artificial Sequence: Synthetic oligonucleotide
tatttatttacccacaatgacgcttgcttagaggaacaaaagg

SEQ ID NO: 346258 - DNA, 42 bp, Artificial Sequence
  Description of Artificial Sequence: Synthetic oligonucleotide
atttatttacccacaatgacgcttgcttagaggaacaaaagg

SEQ ID NO: 346259 - DNA, 41 bp, Artificial Sequence
  Description of Artificial Sequence: Synthetic oligonucleotide
tttatttacccacaatgacgcttgcttagaggaacaaaagg

SEQ ID NO: 346260 - DNA, 40 bp, Artificial Sequence
  Description of Artificial Sequence: Synthetic oligonucleotide
ttatttacccacaatgacgcttgcttagaggaacaaaagg

SEQ ID NO: 346261 - DNA, 39 bp, Artificial Sequence
  Description of Artificial Sequence: Synthetic oligonucleotide
tatttacccacaatgacgcttgcttagaggaacaaaagg

SEQ ID NO: 346262 - DNA, 38 bp, Artificial Sequence
  Description of Artificial Sequence: Synthetic oligonucleotide
atttacccacaatgacgcttgcttagaggaacaaaagg

SEQ ID NO: 346263 - DNA, 37 bp, Artificial Sequence
  Description of Artificial Sequence: Synthetic oligonucleotide
tttacccacaatgacgcttgcttagaggaacaaaagg

SEQ ID NO: 346264 - DNA, 36 bp, Artificial Sequence
  Description of Artificial Sequence: Synthetic oligonucleotide
ttacccacaatgacgcttgcttagaggaacaaaagg

SEQ ID NO: 346265 - DNA, 35 bp, Artificial Sequence
  Description of Artificial Sequence: Synthetic oligonucleotide
tacccacaatgacgcttgcttagaggaacaaaagg

SEQ ID NO: 346266 - DNA, 34 bp, Artificial Sequence
  Description of Artificial Sequence: Synthetic oligonucleotide
acccacaatgacgcttgcttagaggaacaaaagg

SEQ ID NO: 346267 - DNA, 33 bp, Artificial Sequence
  Description of Artificial Sequence: Synthetic oligonucleotide
cccacaatgacgcttgcttagaggaacaaaagg

SEQ ID NO: 346268 - DNA, 33 bp, Artificial Sequence
  Description of Artificial Sequence: Synthetic oligonucleotide
ccacaatgacgcttgcttagaggaacaaaaggg

SEQ ID NO: 346269 - DNA, 33 bp, Artificial Sequence
  Description of Artificial Sequence: Synthetic oligonucleotide
cacaatgacgcttgcttagaggaacaaaagggg

SEQ ID NO: 346270 - DNA, 33 bp, Artificial Sequence
  Description of Artificial Sequence: Synthetic oligonucleotide
acaatgacgcttgcttagaggaacaaaaggggg

SEQ ID NO: 346271 - DNA, 32 bp, Artificial Sequence
  Description of Artificial Sequence: Synthetic oligonucleotide
caatgacgcttgcttagaggaacaaaaggggg

SEQ ID NO: 346272 - DNA, 33 bp, Artificial Sequence
  Description of Artificial Sequence: Synthetic oligonucleotide
aatgacgcttgcttagaggaacaaaagggggtc

SEQ ID NO: 346273 - DNA, 32 bp, Artificial Sequence
  Description of Artificial Sequence: Synthetic oligonucleotide
atgacgcttgcttagaggaacaaaagggggtc

SEQ ID NO: 346274 - DNA, 31 bp, Artificial Sequence
  Description of Artificial Sequence: Synthetic oligonucleotide
tgacgcttgcttagaggaacaaaagggggtc

SEQ ID NO: 346275 - DNA, 30 bp, Artificial Sequence
  Description of Artificial Sequence: Synthetic oligonucleotide
gacgcttgcttagaggaacaaaagggggtc

SEQ ID NO: 346276 - DNA, 30 bp, Artificial Sequence
  Description of Artificial Sequence: Synthetic oligonucleotide
acgcttgcttagaggaacaaaagggggtcg

SEQ ID NO: 346277 - DNA, 29 bp, Artificial Sequence
  Description of Artificial Sequence: Synthetic oligonucleotide
cgcttgcttagaggaacaaaagggggtcg

SEQ ID NO: 346278 - DNA, 30 bp, Artificial Sequence
  Description of Artificial Sequence: Synthetic oligonucleotide
gcttgcttagaggaacaaaagggggtcgtg

SEQ ID NO: 346279 - DNA, 30 bp, Artificial Sequence
  Description of Artificial Sequence: Synthetic oligonucleotide
cttgcttagaggaacaaaagggggtcgtgg

SEQ ID NO: 346280 - DNA, 30 bp, Artificial Sequence
  Description of Artificial Sequence: Synthetic oligonucleotide
ttgcttagaggaacaaaagggggtcgtggc

SEQ ID NO: 346281 - DNA, 29 bp, Artificial Sequence
  Description of Artificial Sequence: Synthetic oligonucleotide
tgcttagaggaacaaaagggggtcgtggc

SEQ ID NO: 346282 - DNA, 28 bp, Artificial Sequence
  Description of Artificial Sequence: Synthetic oligonucleotide
gcttagaggaacaaaagggggtcgtggc

SEQ ID NO: 346283 - DNA, 30 bp, Artificial Sequence
  Description of Artificial Sequence: Synthetic oligonucleotide
cttagaggaacaaaagggggtcgtggcatg

SEQ ID NO: 346284 - DNA, 30 bp, Artificial Sequence
  Description of Artificial Sequence: Synthetic oligonucleotide
ttagaggaacaaaagggggtcgtggcatgc

SEQ ID NO: 346285 - DNA, 29 bp, Artificial Sequence
  Description of Artificial Sequence: Synthetic oligonucleotide
tagaggaacaaaagggggtcgtggcatgc

SEQ ID NO: 346286 - DNA, 28 bp, Artificial Sequence
  Description of Artificial Sequence: Synthetic oligonucleotide
agaggaacaaaagggggtcgtggcatgc

SEQ ID NO: 346287 - DNA, 27 bp, Artificial Sequence
  Description of Artificial Sequence: Synthetic oligonucleotide
gaggaacaaaagggggtcgtggcatgc

SEQ ID NO: 346288 - DNA, 30 bp, Artificial Sequence
  Description of Artificial Sequence: Synthetic oligonucleotide
aggaacaaaagggggtcgtggcatgctatc

SEQ ID NO: 346289 - DNA, 29 bp, Artificial Sequence
  Description of Artificial Sequence: Synthetic oligonucleotide
ggaacaaaagggggtcgtggcatgctatc

SEQ ID NO: 346290 - DNA, 31 bp, Artificial Sequence
  Description of Artificial Sequence: Synthetic oligonucleotide
gaacaaaagggggtcgtggcatgctatcaag

SEQ ID NO: 346291 - DNA, 32 bp, Artificial Sequence
  Description of Artificial Sequence: Synthetic oligonucleotide
aacaaaagggggtcgtggcatgctatcaagtg

SEQ ID NO: 346292 - DNA, 31 bp, Artificial Sequence
  Description of Artificial Sequence: Synthetic oligonucleotide
acaaaagggggtcgtggcatgctatcaagtg

SEQ ID NO: 346293 - DNA, 30 bp, Artificial Sequence
  Description of Artificial Sequence: Synthetic oligonucleotide
caaaagggggtcgtggcatgctatcaagtg

SEQ ID NO: 346294 - DNA, 30 bp, Artificial Sequence
  Description of Artificial Sequence: Synthetic oligonucleotide
aaaagggggtcgtggcatgctatcaagtgg

SEQ ID NO: 346295 - DNA, 29 bp, Artificial Sequence
  Description of Artificial Sequence: Synthetic oligonucleotide
aaagggggtcgtggcatgctatcaagtgg

SEQ ID NO: 346296 - DNA, 28 bp, Artificial Sequence
  Description of Artificial Sequence: Synthetic oligonucleotide
aagggggtcgtggcatgctatcaagtgg

SEQ ID NO: 346297 - DNA, 27 bp, Artificial Sequence
  Description of Artificial Sequence: Synthetic oligonucleotide
agggggtcgtggcatgctatcaagtgg

SEQ ID NO: 346298 - DNA, 26 bp, Artificial Sequence
  Description of Artificial Sequence: Synthetic oligonucleotide
gggggtcgtggcatgctatcaagtgg

SEQ ID NO: 346299 - DNA, 26 bp, Artificial Sequence
  Description of Artificial Sequence: Synthetic oligonucleotide
ggggtcgtggcatgctatcaagtggg

SEQ ID NO: 346300 - DNA, 26 bp, Artificial Sequence
  Description of Artificial Sequence: Synthetic oligonucleotide
gggtcgtggcatgctatcaagtgggc

SEQ ID NO: 346301 - DNA, 27 bp, Artificial Sequence
  Description of Artificial Sequence: Synthetic oligonucleotide
ggtcgtggcatgctatcaagtgggcca

SEQ ID NO: 346302 - DNA, 28 bp, Artificial Sequence
  Description of Artificial Sequence: Synthetic oligonucleotide
gtcgtggcatgctatcaagtgggccaag

SEQ ID NO: 346303 - DNA, 30 bp, Artificial Sequence
  Description of Artificial Sequence: Synthetic oligonucleotide
tcgtggcatgctatcaagtgggccaagatg

SEQ ID NO: 346304 - DNA, 29 bp, Artificial Sequence
  Description of Artificial Sequence: Synthetic oligonucleotide
cgtggcatgctatcaagtgggccaagatg

SEQ ID NO: 346305 - DNA, 30 bp, Artificial Sequence
  Description of Artificial Sequence: Synthetic oligonucleotide
gtggcatgctatcaagtgggccaagatgtg

SEQ ID NO: 346306 - DNA, 31 bp, Artificial Sequence
  Description of Artificial Sequence: Synthetic oligonucleotide
tggcatgctatcaagtgggccaagatgtgac

SEQ ID NO: 346307 - DNA, 30 bp, Artificial Sequence
  Description of Artificial Sequence: Synthetic oligonucleotide
ggcatgctatcaagtgggccaagatgtgac

SEQ ID NO: 346308 - DNA, 30 bp, Artificial Sequence
  Description of Artificial Sequence: Synthetic oligonucleotide
gcatgctatcaagtgggccaagatgtgacc

SEQ ID NO: 346309 - DNA, 30 bp, Artificial Sequence
  Description of Artificial Sequence: Synthetic oligonucleotide
catgctatcaagtgggccaagatgtgaccg

SEQ ID NO: 346310 - DNA, 31 bp, Artificial Sequence
  Description of Artificial Sequence: Synthetic oligonucleotide
atgctatcaagtgggccaagatgtgaccgtg

SEQ ID NO: 346311 - DNA, 30 bp, Artificial Sequence
  Description of Artificial Sequence: Synthetic oligonucleotide
tgctatcaagtgggccaagatgtgaccgtg

SEQ ID NO: 346312 - DNA, 29 bp, Artificial Sequence
  Description of Artificial Sequence: Synthetic oligonucleotide
gctatcaagtgggccaagatgtgaccgtg

SEQ ID NO: 346313 - DNA, 31 bp, Artificial Sequence
  Description of Artificial Sequence: Synthetic oligonucleotide
ctatcaagtgggccaagatgtgaccgtgaag

SEQ ID NO: 346314 - DNA, 31 bp, Artificial Sequence
  Description of Artificial Sequence: Synthetic oligonucleotide
tatcaagtgggccaagatgtgaccgtgaagg

SEQ ID NO: 346315 - DNA, 30 bp, Artificial Sequence
  Description of Artificial Sequence: Synthetic oligonucleotide
atcaagtgggccaagatgtgaccgtgaagg

SEQ ID NO: 346316 - DNA, 29 bp, Artificial Sequence
  Description of Artificial Sequence: Synthetic oligonucleotide
tcaagtgggccaagatgtgaccgtgaagg

SEQ ID NO: 346317 - DNA, 28 bp, Artificial Sequence
  Description of Artificial Sequence: Synthetic oligonucleotide
caagtgggccaagatgtgaccgtgaagg

SEQ ID NO: 346318 - DNA, 28 bp, Artificial Sequence
  Description of Artificial Sequence: Synthetic oligonucleotide
aagtgggccaagatgtgaccgtgaaggc

SEQ ID NO: 346319 - DNA, 27 bp, Artificial Sequence
  Description of Artificial Sequence: Synthetic oligonucleotide
agtgggccaagatgtgaccgtgaaggc

SEQ ID NO: 346320 - DNA, 26 bp, Artificial Sequence
  Description of Artificial Sequence: Synthetic oligonucleotide
gtgggccaagatgtgaccgtgaaggc

SEQ ID NO: 346321 - DNA, 26 bp, Artificial Sequence
  Description of Artificial Sequence: Synthetic oligonucleotide
tgggccaagatgtgaccgtgaaggcg

SEQ ID NO: 346322 - DNA, 25 bp, Artificial Sequence
  Description of Artificial Sequence: Synthetic oligonucleotide
gggccaagatgtgaccgtgaaggcg

SEQ ID NO: 346323 - DNA, 25 bp, Artificial Sequence
  Description of Artificial Sequence: Synthetic oligonucleotide
ggccaagatgtgaccgtgaaggcgg

SEQ ID NO: 346324 - DNA, 25 bp, Artificial Sequence
  Description of Artificial Sequence: Synthetic oligonucleotide
gccaagatgtgaccgtgaaggcggc

SEQ ID NO: 346325 - DNA, 25 bp, Artificial Sequence
  Description of Artificial Sequence: Synthetic oligonucleotide
ccaagatgtgaccgtgaaggcggcc

SEQ ID NO: 346326 - DNA, 27 bp, Artificial Sequence
  Description of Artificial Sequence: Synthetic oligonucleotide
caagatgtgaccgtgaaggcggcccta

SEQ ID NO: 346327 - DNA, 27 bp, Artificial Sequence
  Description of Artificial Sequence: Synthetic oligonucleotide
aagatgtgaccgtgaaggcggccctag

SEQ ID NO: 346328 - DNA, 26 bp, Artificial Sequence
  Description of Artificial Sequence: Synthetic oligonucleotide
agatgtgaccgtgaaggcggccctag

SEQ ID NO: 346329 - DNA, 25 bp, Artificial Sequence
  Description of Artificial Sequence: Synthetic oligonucleotide
gatgtgaccgtgaaggcggccctag

SEQ ID NO: 346330 - DNA, 25 bp, Artificial Sequence
  Description of Artificial Sequence: Synthetic oligonucleotide
atgtgaccgtgaaggcggccctagg

SEQ ID NO: 346331 - DNA, 24 bp, Artificial Sequence
  Description of Artificial Sequence: Synthetic oligonucleotide
tgtgaccgtgaaggcggccctagg

SEQ ID NO: 346332 - DNA, 23 bp, Artificial Sequence
  Description of Artificial Sequence: Synthetic oligonucleotide
gtgaccgtgaaggcggccctagg

SEQ ID NO: 346333 - DNA, 25 bp, Artificial Sequence
  Description of Artificial Sequence: Synthetic oligonucleotide
tgaccgtgaaggcggccctaggctt

SEQ ID NO: 346334 - DNA, 24 bp, Artificial Sequence
  Description of Artificial Sequence: Synthetic oligonucleotide
gaccgtgaaggcggccctaggctt

SEQ ID NO: 346335 - DNA, 24 bp, Artificial Sequence
  Description of Artificial Sequence: Synthetic oligonucleotide
accgtgaaggcggccctaggcttg

SEQ ID NO: 346336 - DNA, 23 bp, Artificial Sequence
  Description of Artificial Sequence: Synthetic oligonucleotide
ccgtgaaggcggccctaggcttg

SEQ ID NO: 346337 - DNA, 23 bp, Artificial Sequence
  Description of Artificial Sequence: Synthetic oligonucleotide
cgtgaaggcggccctaggcttgg

SEQ ID NO: 346338 - DNA, 23 bp, Artificial Sequence
  Description of Artificial Sequence: Synthetic oligonucleotide
gtgaaggcggccctaggcttggg

SEQ ID NO: 346339 - DNA, 25 bp, Artificial Sequence
  Description of Artificial Sequence: Synthetic oligonucleotide
tgaaggcggccctaggcttgggcat

SEQ ID NO: 346340 - DNA, 24 bp, Artificial Sequence
  Description of Artificial Sequence: Synthetic oligonucleotide
gaaggcggccctaggcttgggcat

SEQ ID NO: 346341 - DNA, 24 bp, Artificial Sequence
  Description of Artificial Sequence: Synthetic oligonucleotide
aaggcggccctaggcttgggcatc

SEQ ID NO: 346342 - DNA, 23 bp, Artificial Sequence
  Description of Artificial Sequence: Synthetic oligonucleotide
aggcggccctaggcttgggcatc

SEQ ID NO: 346343 - DNA, 22 bp, Artificial Sequence
  Description of Artificial Sequence: Synthetic oligonucleotide
ggcggccctaggcttgggcatc

SEQ ID NO: 346344 - DNA, 23 bp, Artificial Sequence
  Description of Artificial Sequence: Synthetic oligonucleotide
gcggccctaggcttgggcatcct

SEQ ID NO: 346345 - DNA, 24 bp, Artificial Sequence
  Description of Artificial Sequence: Synthetic oligonucleotide
cggccctaggcttgggcatcctca

SEQ ID NO: 346346 - DNA, 24 bp, Artificial Sequence
  Description of Artificial Sequence: Synthetic oligonucleotide
ggccctaggcttgggcatcctcac

SEQ ID NO: 346347 - DNA, 25 bp, Artificial Sequence
  Description of Artificial Sequence: Synthetic oligonucleotide
gccctaggcttgggcatcctcacct

SEQ ID NO: 346348 - DNA, 27 bp, Artificial Sequence
  Description of Artificial Sequence: Synthetic oligonucleotide
ccctaggcttgggcatcctcacctgaa

SEQ ID NO: 346349 - DNA, 31 bp, Artificial Sequence
  Description of Artificial Sequence: Synthetic oligonucleotide
cctaggcttgggcatcctcacctgaaatttc

SEQ ID NO: 346350 - DNA, 31 bp, Artificial Sequence
  Description of Artificial Sequence: Synthetic oligonucleotide
ctaggcttgggcatcctcacctgaaatttcc

SEQ ID NO: 346351 - DNA, 31 bp, Artificial Sequence
  Description of Artificial Sequence: Synthetic oligonucleotide
taggcttgggcatcctcacctgaaatttccg

SEQ ID NO: 346352 - DNA, 30 bp, Artificial Sequence
  Description of Artificial Sequence: Synthetic oligonucleotide
aggcttgggcatcctcacctgaaatttccg

SEQ ID NO: 346353 - DNA, 29 bp, Artificial Sequence
  Description of Artificial Sequence: Synthetic oligonucleotide
ggcttgggcatcctcacctgaaatttccg

SEQ ID NO: 346354 - DNA, 29 bp, Artificial Sequence
  Description of Artificial Sequence: Synthetic oligonucleotide
gcttgggcatcctcacctgaaatttccgc

SEQ ID NO: 346355 - DNA, 30 bp, Artificial Sequence
  Description of Artificial Sequence: Synthetic oligonucleotide
cttgggcatcctcacctgaaatttccgcag

SEQ ID NO: 346356 - DNA, 31 bp, Artificial Sequence
  Description of Artificial Sequence: Synthetic oligonucleotide
ttgggcatcctcacctgaaatttccgcagac

SEQ ID NO: 346357 - DNA, 30 bp, Artificial Sequence
  Description of Artificial Sequence: Synthetic oligonucleotide
tgggcatcctcacctgaaatttccgcagac

SEQ ID NO: 346358 - DNA, 29 bp, Artificial Sequence
  Description of Artificial Sequence: Synthetic oligonucleotide
gggcatcctcacctgaaatttccgcagac

SEQ ID NO: 346359 - DNA, 30 bp, Artificial Sequence
  Description of Artificial Sequence: Synthetic oligonucleotide
ggcatcctcacctgaaatttccgcagacac

SEQ ID NO: 346360 - DNA, 31 bp, Artificial Sequence
  Description of Artificial Sequence: Synthetic oligonucleotide
gcatcctcacctgaaatttccgcagacacag

SEQ ID NO: 346361 - DNA, 31 bp, Artificial Sequence
  Description of Artificial Sequence: Synthetic oligonucleotide
catcctcacctgaaatttccgcagacacagc

SEQ ID NO: 346362 - DNA, 32 bp, Artificial Sequence
  Description of Artificial Sequence: Synthetic oligonucleotide
atcctcacctgaaatttccgcagacacagcag

SEQ ID NO: 346363 - DNA, 31 bp, Artificial Sequence
  Description of Artificial Sequence: Synthetic oligonucleotide
tcctcacctgaaatttccgcagacacagcag

SEQ ID NO: 346364 - DNA, 30 bp, Artificial Sequence
  Description of Artificial Sequence: Synthetic oligonucleotide
cctcacctgaaatttccgcagacacagcag

SEQ ID NO: 346365 - DNA, 30 bp, Artificial Sequence
  Description of Artificial Sequence: Synthetic oligonucleotide
ctcacctgaaatttccgcagacacagcagg

SEQ ID NO: 346366 - DNA, 31 bp, Artificial Sequence
  Description of Artificial Sequence: Synthetic oligonucleotide
tcacctgaaatttccgcagacacagcaggag

SEQ ID NO: 346367 - DNA, 30 bp, Artificial Sequence
  Description of Artificial Sequence: Synthetic oligonucleotide
cacctgaaatttccgcagacacagcaggag

SEQ ID NO: 346368 - DNA, 30 bp, Artificial Sequence
  Description of Artificial Sequence: Synthetic oligonucleotide
acctgaaatttccgcagacacagcaggagc

SEQ ID NO: 346369 - DNA, 29 bp, Artificial Sequence
  Description of Artificial Sequence: Synthetic oligonucleotide
cctgaaatttccgcagacacagcaggagc

SEQ ID NO: 346370 - DNA, 30 bp, Artificial Sequence
  Description of Artificial Sequence: Synthetic oligonucleotide
ctgaaatttccgcagacacagcaggagcag

SEQ ID NO: 346371 - DNA, 31 bp, Artificial Sequence
  Description of Artificial Sequence: Synthetic oligonucleotide
tgaaatttccgcagacacagcaggagcagtg

SEQ ID NO: 346372 - DNA, 30 bp, Artificial Sequence
  Description of Artificial Sequence: Synthetic oligonucleotide
gaaatttccgcagacacagcaggagcagtg

SEQ ID NO: 346373 - DNA, 31 bp, Artificial Sequence
  Description of Artificial Sequence: Synthetic oligonucleotide
aaatttccgcagacacagcaggagcagtgag

SEQ ID NO: 346374 - DNA, 30 bp, Artificial Sequence
  Description of Artificial Sequence: Synthetic oligonucleotide
aatttccgcagacacagcaggagcagtgag

SEQ ID NO: 346375 - DNA, 29 bp, Artificial Sequence
  Description of Artificial Sequence: Synthetic oligonucleotide
atttccgcagacacagcaggagcagtgag

SEQ ID NO: 346376 - DNA, 28 bp, Artificial Sequence
  Description of Artificial Sequence: Synthetic oligonucleotide
tttccgcagacacagcaggagcagtgag

SEQ ID NO: 346377 - DNA, 27 bp, Artificial Sequence
  Description of Artificial Sequence: Synthetic oligonucleotide
ttccgcagacacagcaggagcagtgag

SEQ ID NO: 346378 - DNA, 26 bp, Artificial Sequence
  Description of Artificial Sequence: Synthetic oligonucleotide
tccgcagacacagcaggagcagtgag

SEQ ID NO: 346379 - DNA, 25 bp, Artificial Sequence
  Description of Artificial Sequence: Synthetic oligonucleotide
ccgcagacacagcaggagcagtgag

SEQ ID NO: 346380 - DNA, 25 bp, Artificial Sequence
  Description of Artificial Sequence: Synthetic oligonucleotide
cgcagacacagcaggagcagtgagg

SEQ ID NO: 346381 - DNA, 25 bp, Artificial Sequence
  Description of Artificial Sequence: Synthetic oligonucleotide
gcagacacagcaggagcagtgaggc

SEQ ID NO: 346382 - DNA, 27 bp, Artificial Sequence
  Description of Artificial Sequence: Synthetic oligonucleotide
cagacacagcaggagcagtgaggcctt

SEQ ID NO: 346383 - DNA, 27 bp, Artificial Sequence
  Description of Artificial Sequence: Synthetic oligonucleotide
agacacagcaggagcagtgaggccttc

SEQ ID NO: 346384 - DNA, 27 bp, Artificial Sequence
  Description of Artificial Sequence: Synthetic oligonucleotide
gacacagcaggagcagtgaggccttca

SEQ ID NO: 346385 - DNA, 28 bp, Artificial Sequence
  Description of Artificial Sequence: Synthetic oligonucleotide
acacagcaggagcagtgaggccttcaag

SEQ ID NO: 346386 - DNA, 27 bp, Artificial Sequence
  Description of Artificial Sequence: Synthetic oligonucleotide
cacagcaggagcagtgaggccttcaag

SEQ ID NO: 346387 - DNA, 27 bp, Artificial Sequence
  Description of Artificial Sequence: Synthetic oligonucleotide
acagcaggagcagtgaggccttcaagc

SEQ ID NO: 346388 - DNA, 27 bp, Artificial Sequence
  Description of Artificial Sequence: Synthetic oligonucleotide
cagcaggagcagtgaggccttcaagct

SEQ ID NO: 346389 - DNA, 27 bp, Artificial Sequence
  Description of Artificial Sequence: Synthetic oligonucleotide
agcaggagcagtgaggccttcaagctc

SEQ ID NO: 346390 - DNA, 27 bp, Artificial Sequence
  Description of Artificial Sequence: Synthetic oligonucleotide
gcaggagcagtgaggccttcaagctct

SEQ ID NO: 346391 - DNA, 28 bp, Artificial Sequence
  Description of Artificial Sequence: Synthetic oligonucleotide
caggagcagtgaggccttcaagctcttc

SEQ ID NO: 346392 - DNA, 30 bp, Artificial Sequence
  Description of Artificial Sequence: Synthetic oligonucleotide
aggagcagtgaggccttcaagctcttcatg

SEQ ID NO: 346393 - DNA, 29 bp, Artificial Sequence
  Description of Artificial Sequence: Synthetic oligonucleotide
ggagcagtgaggccttcaagctcttcatg

SEQ ID NO: 346394 - DNA, 29 bp, Artificial Sequence
  Description of Artificial Sequence: Synthetic oligonucleotide
gagcagtgaggccttcaagctcttcatgg

SEQ ID NO: 346395 - DNA, 30 bp, Artificial Sequence
  Description of Artificial Sequence: Synthetic oligonucleotide
agcagtgaggccttcaagctcttcatggtg

SEQ ID NO: 346396 - DNA, 29 bp, Artificial Sequence
  Description of Artificial Sequence: Synthetic oligonucleotide
gcagtgaggccttcaagctcttcatggtg

SEQ ID NO: 346397 - DNA, 29 bp, Artificial Sequence
  Description of Artificial Sequence: Synthetic oligonucleotide
cagtgaggccttcaagctcttcatggtgg

SEQ ID NO: 346398 - DNA, 29 bp, Artificial Sequence
  Description of Artificial Sequence: Synthetic oligonucleotide
agtgaggccttcaagctcttcatggtggc

SEQ ID NO: 346399 - DNA, 28 bp, Artificial Sequence
  Description of Artificial Sequence: Synthetic oligonucleotide
gtgaggccttcaagctcttcatggtggc

SEQ ID NO: 346400 - DNA, 28 bp, Artificial Sequence
  Description of Artificial Sequence: Synthetic oligonucleotide
tgaggccttcaagctcttcatggtggcg

SEQ ID NO: 346401 - DNA, 27 bp, Artificial Sequence
  Description of Artificial Sequence: Synthetic oligonucleotide
gaggccttcaagctcttcatggtggcg

SEQ ID NO: 346402 - DNA, 27 bp, Artificial Sequence
  Description of Artificial Sequence: Synthetic oligonucleotide
aggccttcaagctcttcatggtggcgc

SEQ ID NO: 346403 - DNA, 27 bp, Artificial Sequence
  Description of Artificial Sequence: Synthetic oligonucleotide
ggccttcaagctcttcatggtggcgct

SEQ ID NO: 346404 - DNA, 28 bp, Artificial Sequence
  Description of Artificial Sequence: Synthetic oligonucleotide
gccttcaagctcttcatggtggcgcttg

SEQ ID NO: 346405 - DNA, 28 bp, Artificial Sequence
  Description of Artificial Sequence: Synthetic oligonucleotide
ccttcaagctcttcatggtggcgcttgc

SEQ ID NO: 346406 - DNA, 29 bp, Artificial Sequence
  Description of Artificial Sequence: Synthetic oligonucleotide
cttcaagctcttcatggtggcgcttgctg

SEQ ID NO: 346407 - DNA, 30 bp, Artificial Sequence
  Description of Artificial Sequence: Synthetic oligonucleotide
ttcaagctcttcatggtggcgcttgctgtg

SEQ ID NO: 346408 - DNA, 29 bp, Artificial Sequence
  Description of Artificial Sequence: Synthetic oligonucleotide
tcaagctcttcatggtggcgcttgctgtg

SEQ ID NO: 346409 - DNA, 28 bp, Artificial Sequence
  Description of Artificial Sequence: Synthetic oligonucleotide
caagctcttcatggtggcgcttgctgtg

SEQ ID NO: 346410 - DNA, 28 bp, Artificial Sequence
  Description of Artificial Sequence: Synthetic oligonucleotide
aagctcttcatggtggcgcttgctgtgc

SEQ ID NO: 346411 - DNA, 27 bp, Artificial Sequence
  Description of Artificial Sequence: Synthetic oligonucleotide
agctcttcatggtggcgcttgctgtgc

SEQ ID NO: 346412 - DNA, 27 bp, Artificial Sequence
  Description of Artificial Sequence: Synthetic oligonucleotide
gctcttcatggtggcgcttgctgtgca

SEQ ID NO: 346413 - DNA, 27 bp, Artificial Sequence
  Description of Artificial Sequence: Synthetic oligonucleotide
ctcttcatggtggcgcttgctgtgcag

SEQ ID NO: 346414 - DNA, 28 bp, Artificial Sequence
  Description of Artificial Sequence: Synthetic oligonucleotide
tcttcatggtggcgcttgctgtgcagtg

SEQ ID NO: 346415 - DNA, 27 bp, Artificial Sequence
  Description of Artificial Sequence: Synthetic oligonucleotide
cttcatggtggcgcttgctgtgcagtg

SEQ ID NO: 346416 - DNA, 27 bp, Artificial Sequence
  Description of Artificial Sequence: Synthetic oligonucleotide
ttcatggtggcgcttgctgtgcagtgc

SEQ ID NO: 346417 - DNA, 26 bp, Artificial Sequence
  Description of Artificial Sequence: Synthetic oligonucleotide
tcatggtggcgcttgctgtgcagtgc

SEQ ID NO: 346418 - DNA, 25 bp, Artificial Sequence
  Description of Artificial Sequence: Synthetic oligonucleotide
catggtggcgcttgctgtgcagtgc

SEQ ID NO: 346419 - DNA, 25 bp, Artificial Sequence
  Description of Artificial Sequence: Synthetic oligonucleotide
atggtggcgcttgctgtgcagtgcg

SEQ ID NO: 346420 - DNA, 24 bp, Artificial Sequence
  Description of Artificial Sequence: Synthetic oligonucleotide
tggtggcgcttgctgtgcagtgcg

SEQ ID NO: 346421 - DNA, 23 bp, Artificial Sequence
  Description of Artificial Sequence: Synthetic oligonucleotide
ggtggcgcttgctgtgcagtgcg

SEQ ID NO: 346422 - DNA, 26 bp, Artificial Sequence
  Description of Artificial Sequence: Synthetic oligonucleotide
gtggcgcttgctgtgcagtgcgcaat

SEQ ID NO: 346423 - DNA, 26 bp, Artificial Sequence
  Description of Artificial Sequence: Synthetic oligonucleotide
tggcgcttgctgtgcagtgcgcaatc

SEQ ID NO: 346424 - DNA, 25 bp, Artificial Sequence
  Description of Artificial Sequence: Synthetic oligonucleotide
ggcgcttgctgtgcagtgcgcaatc

SEQ ID NO: 346425 - DNA, 26 bp, Artificial Sequence
  Description of Artificial Sequence: Synthetic oligonucleotide
gcgcttgctgtgcagtgcgcaatcct

SEQ ID NO: 346426 - DNA, 26 bp, Artificial Sequence
  Description of Artificial Sequence: Synthetic oligonucleotide
cgcttgctgtgcagtgcgcaatcctg

SEQ ID NO: 346427 - DNA, 27 bp, Artificial Sequence
  Description of Artificial Sequence: Synthetic oligonucleotide
gcttgctgtgcagtgcgcaatcctggt

SEQ ID NO: 346428 - DNA, 27 bp, Artificial Sequence
  Description of Artificial Sequence: Synthetic oligonucleotide
cttgctgtgcagtgcgcaatcctggtg

SEQ ID NO: 346429 - DNA, 27 bp, Artificial Sequence
  Description of Artificial Sequence: Synthetic oligonucleotide
ttgctgtgcagtgcgcaatcctggtgg

SEQ ID NO: 346430 - DNA, 27 bp, Artificial Sequence
  Description of Artificial Sequence: Synthetic oligonucleotide
tgctgtgcagtgcgcaatcctggtgga

SEQ ID NO: 346431 - DNA, 26 bp, Artificial Sequence
  Description of Artificial Sequence: Synthetic oligonucleotide
gctgtgcagtgcgcaatcctggtgga

SEQ ID NO: 346432 - DNA, 26 bp, Artificial Sequence
  Description of Artificial Sequence: Synthetic oligonucleotide
ctgtgcagtgcgcaatcctggtggac

SEQ ID NO: 346433 - DNA, 26 bp, Artificial Sequence
  Description of Artificial Sequence: Synthetic oligonucleotide
tgtgcagtgcgcaatcctggtggacg

SEQ ID NO: 346434 - DNA, 25 bp, Artificial Sequence
  Description of Artificial Sequence: Synthetic oligonucleotide
gtgcagtgcgcaatcctggtggacg

SEQ ID NO: 346435 - DNA, 25 bp, Artificial Sequence
  Description of Artificial Sequence: Synthetic oligonucleotide
tgcagtgcgcaatcctggtggacgg

SEQ ID NO: 346436 - DNA, 24 bp, Artificial Sequence
  Description of Artificial Sequence: Synthetic oligonucleotide
gcagtgcgcaatcctggtggacgg

SEQ ID NO: 346437 - DNA, 26 bp, Artificial Sequence
  Description of Artificial Sequence: Synthetic oligonucleotide
cagtgcgcaatcctggtggacggcta

SEQ ID NO: 346438 - DNA, 26 bp, Artificial Sequence
  Description of Artificial Sequence: Synthetic oligonucleotide
agtgcgcaatcctggtggacggctac

SEQ ID NO: 346439 - DNA, 25 bp, Artificial Sequence
  Description of Artificial Sequence: Synthetic oligonucleotide
gtgcgcaatcctggtggacggctac

SEQ ID NO: 346440 - DNA, 26 bp, Artificial Sequence
  Description of Artificial Sequence: Synthetic oligonucleotide
tgcgcaatcctggtggacggctacct

SEQ ID NO: 346441 - DNA, 25 bp, Artificial Sequence
  Description of Artificial Sequence: Synthetic oligonucleotide
gcgcaatcctggtggacggctacct

SEQ ID NO: 346442 - DNA, 26 bp, Artificial Sequence
  Description of Artificial Sequence: Synthetic oligonucleotide
cgcaatcctggtggacggctacctga

SEQ ID NO: 346443 - DNA, 26 bp, Artificial Sequence
  Description of Artificial Sequence: Synthetic oligonucleotide
gcaatcctggtggacggctacctgag

SEQ ID NO: 346444 - DNA, 26 bp, Artificial Sequence
  Description of Artificial Sequence: Synthetic oligonucleotide
caatcctggtggacggctacctgagc

SEQ ID NO: 346445 - DNA, 27 bp, Artificial Sequence
  Description of Artificial Sequence: Synthetic oligonucleotide
aatcctggtggacggctacctgagcca

SEQ ID NO: 346446 - DNA, 26 bp, Artificial Sequence
  Description of Artificial Sequence: Synthetic oligonucleotide
atcctggtggacggctacctgagcca

SEQ ID NO: 346447 - DNA, 25 bp, Artificial Sequence
  Description of Artificial Sequence: Synthetic oligonucleotide
tcctggtggacggctacctgagcca

SEQ ID NO: 346448 - DNA, 24 bp, Artificial Sequence
  Description of Artificial Sequence: Synthetic oligonucleotide
cctggtggacggctacctgagcca

SEQ ID NO: 346449 - DNA, 26 bp, Artificial Sequence
  Description of Artificial Sequence: Synthetic oligonucleotide
ctggtggacggctacctgagccactt

SEQ ID NO: 346450 - DNA, 26 bp, Artificial Sequence
  Description of Artificial Sequence: Synthetic oligonucleotide
tggtggacggctacctgagccacttc

SEQ ID NO: 346451 - DNA, 25 bp, Artificial Sequence
  Description of Artificial Sequence: Synthetic oligonucleotide
ggtggacggctacctgagccacttc

SEQ ID NO: 346452 - DNA, 25 bp, Artificial Sequence
  Description of Artificial Sequence: Synthetic oligonucleotide
gtggacggctacctgagccacttcc

SEQ ID NO: 346453 - DNA, 26 bp, Artificial Sequence
  Description of Artificial Sequence: Synthetic oligonucleotide
tggacggctacctgagccacttccct

SEQ ID NO: 346454 - DNA, 25 bp, Artificial Sequence
  Description of Artificial Sequence: Synthetic oligonucleotide
ggacggctacctgagccacttccct

SEQ ID NO: 346455 - DNA, 25 bp, Artificial Sequence
  Description of Artificial Sequence: Synthetic oligonucleotide
gacggctacctgagccacttccctc

SEQ ID NO: 346456 - DNA, 26 bp, Artificial Sequence
  Description of Artificial Sequence: Synthetic oligonucleotide
acggctacctgagccacttccctcct

SEQ ID NO: 346457 - DNA, 25 bp, Artificial Sequence
  Description of Artificial Sequence: Synthetic oligonucleotide
cggctacctgagccacttccctcct

SEQ ID NO: 346458 - DNA, 25 bp, Artificial Sequence
  Description of Artificial Sequence: Synthetic oligonucleotide
ggctacctgagccacttccctcctc

SEQ ID NO: 346459 - DNA, 25 bp, Artificial Sequence
  Description of Artificial Sequence: Synthetic oligonucleotide
gctacctgagccacttccctcctcg

SEQ ID NO: 346460 - DNA, 27 bp, Artificial Sequence
  Description of Artificial Sequence: Synthetic oligonucleotide
ctacctgagccacttccctcctcggaa

SEQ ID NO: 346461 - DNA, 27 bp, Artificial Sequence
  Description of Artificial Sequence: Synthetic oligonucleotide
tacctgagccacttccctcctcggaag

SEQ ID NO: 346462 - DNA, 26 bp, Artificial Sequence
  Description of Artificial Sequence: Synthetic oligonucleotide
acctgagccacttccctcctcggaag

SEQ ID NO: 346463 - DNA, 25 bp, Artificial Sequence
  Description of Artificial Sequence: Synthetic oligonucleotide
cctgagccacttccctcctcggaag

SEQ ID NO: 346464 - DNA, 26 bp, Artificial Sequence
  Description of Artificial Sequence: Synthetic oligonucleotide
ctgagccacttccctcctcggaaggt

SEQ ID NO: 346465 - DNA, 26 bp, Artificial Sequence
  Description of Artificial Sequence: Synthetic oligonucleotide
tgagccacttccctcctcggaaggtg

SEQ ID NO: 346466 - DNA, 25 bp, Artificial Sequence
  Description of Artificial Sequence: Synthetic oligonucleotide
gagccacttccctcctcggaaggtg

SEQ ID NO: 346467 - DNA, 26 bp, Artificial Sequence
  Description of Artificial Sequence: Synthetic oligonucleotide
agccacttccctcctcggaaggtgga

SEQ ID NO: 346468 - DNA, 25 bp, Artificial Sequence
  Description of Artificial Sequence: Synthetic oligonucleotide
gccacttccctcctcggaaggtgga

SEQ ID NO: 346469 - DNA, 27 bp, Artificial Sequence
  Description of Artificial Sequence: Synthetic oligonucleotide
ccacttccctcctcggaaggtggacat

SEQ ID NO: 346470 - DNA, 27 bp, Artificial Sequence
  Description of Artificial Sequence: Synthetic oligonucleotide
cacttccctcctcggaaggtggacatc

SEQ ID NO: 346471 - DNA, 28 bp, Artificial Sequence
  Description of Artificial Sequence: Synthetic oligonucleotide
acttccctcctcggaaggtggacatcac

SEQ ID NO: 346472 - DNA, 27 bp, Artificial Sequence
  Description of Artificial Sequence: Synthetic oligonucleotide
cttccctcctcggaaggtggacatcac

SEQ ID NO: 346473 - DNA, 28 bp, Artificial Sequence
  Description of Artificial Sequence: Synthetic oligonucleotide
ttccctcctcggaaggtggacatcacac

SEQ ID NO: 346474 - DNA, 27 bp, Artificial Sequence
  Description of Artificial Sequence: Synthetic oligonucleotide
tccctcctcggaaggtggacatcacac

SEQ ID NO: 346475 - DNA, 27 bp, Artificial Sequence
  Description of Artificial Sequence: Synthetic oligonucleotide
ccctcctcggaaggtggacatcacact

SEQ ID NO: 346476 - DNA, 27 bp, Artificial Sequence
  Description of Artificial Sequence: Synthetic oligonucleotide
cctcctcggaaggtggacatcacactc

SEQ ID NO: 346477 - DNA, 29 bp, Artificial Sequence
  Description of Artificial Sequence: Synthetic oligonucleotide
ctcctcggaaggtggacatcacactcttc

SEQ ID NO: 346478 - DNA, 30 bp, Artificial Sequence
  Description of Artificial Sequence: Synthetic oligonucleotide
tcctcggaaggtggacatcacactcttcag

SEQ ID NO: 346479 - DNA, 29 bp, Artificial Sequence
  Description of Artificial Sequence: Synthetic oligonucleotide
cctcggaaggtggacatcacactcttcag

SEQ ID NO: 346480 - DNA, 33 bp, Artificial Sequence
  Description of Artificial Sequence: Synthetic oligonucleotide
ctcggaaggtggacatcacactcttcagtattg

SEQ ID NO: 346481 - DNA, 33 bp, Artificial Sequence
  Description of Artificial Sequence: Synthetic oligonucleotide
tcggaaggtggacatcacactcttcagtattgg

SEQ ID NO: 346482 - DNA, 32 bp, Artificial Sequence
  Description of Artificial Sequence: Synthetic oligonucleotide
cggaaggtggacatcacactcttcagtattgg

SEQ ID NO: 346483 - DNA, 32 bp, Artificial Sequence
  Description of Artificial Sequence: Synthetic oligonucleotide
ggaaggtggacatcacactcttcagtattggg

SEQ ID NO: 346484 - DNA, 32 bp, Artificial Sequence
  Description of Artificial Sequence: Synthetic oligonucleotide
gaaggtggacatcacactcttcagtattgggc

SEQ ID NO: 346485 - DNA, 33 bp, Artificial Sequence
  Description of Artificial Sequence: Synthetic oligonucleotide
aaggtggacatcacactcttcagtattgggctg

SEQ ID NO: 346486 - DNA, 32 bp, Artificial Sequence
  Description of Artificial Sequence: Synthetic oligonucleotide
aggtggacatcacactcttcagtattgggctg

SEQ ID NO: 346487 - DNA, 31 bp, Artificial Sequence
  Description of Artificial Sequence: Synthetic oligonucleotide
ggtggacatcacactcttcagtattgggctg

SEQ ID NO: 346488 - DNA, 31 bp, Artificial Sequence
  Description of Artificial Sequence: Synthetic oligonucleotide
gtggacatcacactcttcagtattgggctgg

SEQ ID NO: 346489 - DNA, 31 bp, Artificial Sequence
  Description of Artificial Sequence: Synthetic oligonucleotide
tggacatcacactcttcagtattgggctggc

SEQ ID NO: 346490 - DNA, 30 bp, Artificial Sequence
  Description of Artificial Sequence: Synthetic oligonucleotide
ggacatcacactcttcagtattgggctggc

SEQ ID NO: 346491 - DNA, 30 bp, Artificial Sequence
  Description of Artificial Sequence: Synthetic oligonucleotide
gacatcacactcttcagtattgggctggcc

SEQ ID NO: 346492 - DNA, 31 bp, Artificial Sequence
  Description of Artificial Sequence: Synthetic oligonucleotide
acatcacactcttcagtattgggctggccag

SEQ ID NO: 346493 - DNA, 30 bp, Artificial Sequence
  Description of Artificial Sequence: Synthetic oligonucleotide
catcacactcttcagtattgggctggccag

SEQ ID NO: 346494 - DNA, 30 bp, Artificial Sequence
  Description of Artificial Sequence: Synthetic oligonucleotide
atcacactcttcagtattgggctggccagc

SEQ ID NO: 346495 - DNA, 29 bp, Artificial Sequence
  Description of Artificial Sequence: Synthetic oligonucleotide
tcacactcttcagtattgggctggccagc

SEQ ID NO: 346496 - DNA, 28 bp, Artificial Sequence
  Description of Artificial Sequence: Synthetic oligonucleotide
cacactcttcagtattgggctggccagc

SEQ ID NO: 346497 - DNA, 30 bp, Artificial Sequence
  Description of Artificial Sequence: Synthetic oligonucleotide
acactcttcagtattgggctggccagcatg

SEQ ID NO: 346498 - DNA, 29 bp, Artificial Sequence
  Description of Artificial Sequence: Synthetic oligonucleotide
cactcttcagtattgggctggccagcatg

SEQ ID NO: 346499 - DNA, 30 bp, Artificial Sequence
  Description of Artificial Sequence: Synthetic oligonucleotide
actcttcagtattgggctggccagcatgag

SEQ ID NO: 346500 - DNA, 29 bp, Artificial Sequence
  Description of Artificial Sequence: Synthetic oligonucleotide
ctcttcagtattgggctggccagcatgag

SEQ ID NO: 346501 - DNA, 30 bp, Artificial Sequence
  Description of Artificial Sequence: Synthetic oligonucleotide
tcttcagtattgggctggccagcatgagtg

SEQ ID NO: 346502 - DNA, 29 bp, Artificial Sequence
  Description of Artificial Sequence: Synthetic oligonucleotide
cttcagtattgggctggccagcatgagtg

SEQ ID NO: 346503 - DNA, 29 bp, Artificial Sequence
  Description of Artificial Sequence: Synthetic oligonucleotide
ttcagtattgggctggccagcatgagtgc

SEQ ID NO: 346504 - DNA, 28 bp, Artificial Sequence
  Description of Artificial Sequence: Synthetic oligonucleotide
tcagtattgggctggccagcatgagtgc

SEQ ID NO: 346505 - DNA, 27 bp, Artificial Sequence
  Description of Artificial Sequence: Synthetic oligonucleotide
cagtattgggctggccagcatgagtgc

SEQ ID NO: 346506 - DNA, 30 bp, Artificial Sequence
  Description of Artificial Sequence: Synthetic oligonucleotide
agtattgggctggccagcatgagtgcaatg

SEQ ID NO: 346507 - DNA, 29 bp, Artificial Sequence
  Description of Artificial Sequence: Synthetic oligonucleotide
gtattgggctggccagcatgagtgcaatg

SEQ ID NO: 346508 - DNA, 30 bp, Artificial Sequence
  Description of Artificial Sequence: Synthetic oligonucleotide
tattgggctggccagcatgagtgcaatgtc

SEQ ID NO: 346509 - DNA, 29 bp, Artificial Sequence
  Description of Artificial Sequence: Synthetic oligonucleotide
attgggctggccagcatgagtgcaatgtc

SEQ ID NO: 346510 - DNA, 28 bp, Artificial Sequence
  Description of Artificial Sequence: Synthetic oligonucleotide
ttgggctggccagcatgagtgcaatgtc

SEQ ID NO: 346511 - DNA, 27 bp, Artificial Sequence
  Description of Artificial Sequence: Synthetic oligonucleotide
tgggctggccagcatgagtgcaatgtc

SEQ ID NO: 346512 - DNA, 26 bp, Artificial Sequence
  Description of Artificial Sequence: Synthetic oligonucleotide
gggctggccagcatgagtgcaatgtc

SEQ ID NO: 346513 - DNA, 26 bp, Artificial Sequence
  Description of Artificial Sequence: Synthetic oligonucleotide
ggctggccagcatgagtgcaatgtcg

SEQ ID NO: 346514 - DNA, 27 bp, Artificial Sequence
  Description of Artificial Sequence: Synthetic oligonucleotide
gctggccagcatgagtgcaatgtcggt

SEQ ID NO: 346515 - DNA, 27 bp, Artificial Sequence
  Description of Artificial Sequence: Synthetic oligonucleotide
ctggccagcatgagtgcaatgtcggtg

SEQ ID NO: 346516 - DNA, 27 bp, Artificial Sequence
  Description of Artificial Sequence: Synthetic oligonucleotide
tggccagcatgagtgcaatgtcggtgg

SEQ ID NO: 346517 - DNA, 27 bp, Artificial Sequence
  Description of Artificial Sequence: Synthetic oligonucleotide
ggccagcatgagtgcaatgtcggtggt

SEQ ID NO: 346518 - DNA, 27 bp, Artificial Sequence
  Description of Artificial Sequence: Synthetic oligonucleotide
gccagcatgagtgcaatgtcggtggtg

SEQ ID NO: 346519 - DNA, 29 bp, Artificial Sequence
  Description of Artificial Sequence: Synthetic oligonucleotide
ccagcatgagtgcaatgtcggtggtgatc

SEQ ID NO: 346520 - DNA, 30 bp, Artificial Sequence
  Description of Artificial Sequence: Synthetic oligonucleotide
cagcatgagtgcaatgtcggtggtgatctc

SEQ ID NO: 346521 - DNA, 31 bp, Artificial Sequence
  Description of Artificial Sequence: Synthetic oligonucleotide
agcatgagtgcaatgtcggtggtgatctcag

SEQ ID NO: 346522 - DNA, 30 bp, Artificial Sequence
  Description of Artificial Sequence: Synthetic oligonucleotide
gcatgagtgcaatgtcggtggtgatctcag

SEQ ID NO: 346523 - DNA, 30 bp, Artificial Sequence
  Description of Artificial Sequence: Synthetic oligonucleotide
catgagtgcaatgtcggtggtgatctcagg

SEQ ID NO: 346524 - DNA, 30 bp, Artificial Sequence
  Description of Artificial Sequence: Synthetic oligonucleotide
atgagtgcaatgtcggtggtgatctcaggg

SEQ ID NO: 346525 - DNA, 29 bp, Artificial Sequence
  Description of Artificial Sequence: Synthetic oligonucleotide
tgagtgcaatgtcggtggtgatctcaggg

SEQ ID NO: 346526 - DNA, 28 bp, Artificial Sequence
  Description of Artificial Sequence: Synthetic oligonucleotide
gagtgcaatgtcggtggtgatctcaggg

SEQ ID NO: 346527 - DNA, 28 bp, Artificial Sequence
  Description of Artificial Sequence: Synthetic oligonucleotide
agtgcaatgtcggtggtgatctcagggg

SEQ ID NO: 346528 - DNA, 27 bp, Artificial Sequence
  Description of Artificial Sequence: Synthetic oligonucleotide
gtgcaatgtcggtggtgatctcagggg

SEQ ID NO: 346529 - DNA, 27 bp, Artificial Sequence
  Description of Artificial Sequence: Synthetic oligonucleotide
tgcaatgtcggtggtgatctcaggggg

SEQ ID NO: 346530 - DNA, 27 bp, Artificial Sequence
  Description of Artificial Sequence: Synthetic oligonucleotide
gcaatgtcggtggtgatctcagggggt

SEQ ID NO: 346531 - DNA, 27 bp, Artificial Sequence
  Description of Artificial Sequence: Synthetic oligonucleotide
caatgtcggtggtgatctcagggggtg

SEQ ID NO: 346532 - DNA, 27 bp, Artificial Sequence
  Description of Artificial Sequence: Synthetic oligonucleotide
aatgtcggtggtgatctcagggggtgc

SEQ ID NO: 346533 - DNA, 27 bp, Artificial Sequence
  Description of Artificial Sequence: Synthetic oligonucleotide
atgtcggtggtgatctcagggggtgct

SEQ ID NO: 346534 - DNA, 26 bp, Artificial Sequence
  Description of Artificial Sequence: Synthetic oligonucleotide
tgtcggtggtgatctcagggggtgct

SEQ ID NO: 346535 - DNA, 25 bp, Artificial Sequence
  Description of Artificial Sequence: Synthetic oligonucleotide
gtcggtggtgatctcagggggtgct

SEQ ID NO: 346536 - DNA, 26 bp, Artificial Sequence
  Description of Artificial Sequence: Synthetic oligonucleotide
tcggtggtgatctcagggggtgctgt

SEQ ID NO: 346537 - DNA, 25 bp, Artificial Sequence
  Description of Artificial Sequence: Synthetic oligonucleotide
cggtggtgatctcagggggtgctgt

SEQ ID NO: 346538 - DNA, 27 bp, Artificial Sequence
  Description of Artificial Sequence: Synthetic oligonucleotide
ggtggtgatctcagggggtgctgtgtt

SEQ ID NO: 346539 - DNA, 27 bp, Artificial Sequence
  Description of Artificial Sequence: Synthetic oligonucleotide
gtggtgatctcagggggtgctgtgttg

SEQ ID NO: 346540 - DNA, 27 bp, Artificial Sequence
  Description of Artificial Sequence: Synthetic oligonucleotide
tggtgatctcagggggtgctgtgttgg

SEQ ID NO: 346541 - DNA, 26 bp, Artificial Sequence
  Description of Artificial Sequence: Synthetic oligonucleotide
ggtgatctcagggggtgctgtgttgg

SEQ ID NO: 346542 - DNA, 26 bp, Artificial Sequence
  Description of Artificial Sequence: Synthetic oligonucleotide
gtgatctcagggggtgctgtgttggg

SEQ ID NO: 346543 - DNA, 27 bp, Artificial Sequence
  Description of Artificial Sequence: Synthetic oligonucleotide
tgatctcagggggtgctgtgttgggga

SEQ ID NO: 346544 - DNA, 27 bp, Artificial Sequence
  Description of Artificial Sequence: Synthetic oligonucleotide
gatctcagggggtgctgtgttggggaa

SEQ ID NO: 346545 - DNA, 27 bp, Artificial Sequence
  Description of Artificial Sequence: Synthetic oligonucleotide
atctcagggggtgctgtgttggggaag

SEQ ID NO: 346546 - DNA, 26 bp, Artificial Sequence
  Description of Artificial Sequence: Synthetic oligonucleotide
tctcagggggtgctgtgttggggaag

SEQ ID NO: 346547 - DNA, 25 bp, Artificial Sequence
  Description of Artificial Sequence: Synthetic oligonucleotide
ctcagggggtgctgtgttggggaag

SEQ ID NO: 346548 - DNA, 26 bp, Artificial Sequence
  Description of Artificial Sequence: Synthetic oligonucleotide
tcagggggtgctgtgttggggaagct

SEQ ID NO: 346549 - DNA, 25 bp, Artificial Sequence
  Description of Artificial Sequence: Synthetic oligonucleotide
cagggggtgctgtgttggggaagct

SEQ ID NO: 346550 - DNA, 27 bp, Artificial Sequence
  Description of Artificial Sequence: Synthetic oligonucleotide
agggggtgctgtgttggggaagctcaa

SEQ ID NO: 346551 - DNA, 26 bp, Artificial Sequence
  Description of Artificial Sequence: Synthetic oligonucleotide
gggggtgctgtgttggggaagctcaa

SEQ ID NO: 346552 - DNA, 27 bp, Artificial Sequence
  Description of Artificial Sequence: Synthetic oligonucleotide
ggggtgctgtgttggggaagctcaact

SEQ ID NO: 346553 - DNA, 28 bp, Artificial Sequence
  Description of Artificial Sequence: Synthetic oligonucleotide
gggtgctgtgttggggaagctcaacttg

SEQ ID NO: 346554 - DNA, 28 bp, Artificial Sequence
  Description of Artificial Sequence: Synthetic oligonucleotide
ggtgctgtgttggggaagctcaacttgg

SEQ ID NO: 346555 - DNA, 28 bp, Artificial Sequence
  Description of Artificial Sequence: Synthetic oligonucleotide
gtgctgtgttggggaagctcaacttggg

SEQ ID NO: 346556 - DNA, 28 bp, Artificial Sequence
  Description of Artificial Sequence: Synthetic oligonucleotide
tgctgtgttggggaagctcaacttgggg

SEQ ID NO: 346557 - DNA, 27 bp, Artificial Sequence
  Description of Artificial Sequence: Synthetic oligonucleotide
gctgtgttggggaagctcaacttgggg

SEQ ID NO: 346558 - DNA, 27 bp, Artificial Sequence
  Description of Artificial Sequence: Synthetic oligonucleotide
ctgtgttggggaagctcaacttggggc

SEQ ID NO: 346559 - DNA, 28 bp, Artificial Sequence
  Description of Artificial Sequence: Synthetic oligonucleotide
tgtgttggggaagctcaacttggggcag

SEQ ID NO: 346560 - DNA, 27 bp, Artificial Sequence
  Description of Artificial Sequence: Synthetic oligonucleotide
gtgttggggaagctcaacttggggcag

SEQ ID NO: 346561 - DNA, 29 bp, Artificial Sequence
  Description of Artificial Sequence: Synthetic oligonucleotide
tgttggggaagctcaacttggggcagttg

SEQ ID NO: 346562 - DNA, 28 bp, Artificial Sequence
  Description of Artificial Sequence: Synthetic oligonucleotide
gttggggaagctcaacttggggcagttg

SEQ ID NO: 346563 - DNA, 28 bp, Artificial Sequence
  Description of Artificial Sequence: Synthetic oligonucleotide
ttggggaagctcaacttggggcagttgg

SEQ ID NO: 346564 - DNA, 27 bp, Artificial Sequence
  Description of Artificial Sequence: Synthetic oligonucleotide
tggggaagctcaacttggggcagttgg

SEQ ID NO: 346565 - DNA, 27 bp, Artificial Sequence
  Description of Artificial Sequence: Synthetic oligonucleotide
ggggaagctcaacttggggcagttggt

SEQ ID NO: 346566 - DNA, 27 bp, Artificial Sequence
  Description of Artificial Sequence: Synthetic oligonucleotide
gggaagctcaacttggggcagttggtc

SEQ ID NO: 346567 - DNA, 27 bp, Artificial Sequence
  Description of Artificial Sequence: Synthetic oligonucleotide
ggaagctcaacttggggcagttggtcg

SEQ ID NO: 346568 - DNA, 28 bp, Artificial Sequence
  Description of Artificial Sequence: Synthetic oligonucleotide
gaagctcaacttggggcagttggtcgtg

SEQ ID NO: 346569 - DNA, 30 bp, Artificial Sequence
  Description of Artificial Sequence: Synthetic oligonucleotide
aagctcaacttggggcagttggtcgtgatg

SEQ ID NO: 346570 - DNA, 29 bp, Artificial Sequence
  Description of Artificial Sequence: Synthetic oligonucleotide
agctcaacttggggcagttggtcgtgatg

SEQ ID NO: 346571 - DNA, 28 bp, Artificial Sequence
  Description of Artificial Sequence: Synthetic oligonucleotide
gctcaacttggggcagttggtcgtgatg

SEQ ID NO: 346572 - DNA, 28 bp, Artificial Sequence
  Description of Artificial Sequence: Synthetic oligonucleotide
ctcaacttggggcagttggtcgtgatgg

SEQ ID NO: 346573 - DNA, 29 bp, Artificial Sequence
  Description of Artificial Sequence: Synthetic oligonucleotide
tcaacttggggcagttggtcgtgatggtg

SEQ ID NO: 346574 - DNA, 28 bp, Artificial Sequence
  Description of Artificial Sequence: Synthetic oligonucleotide
caacttggggcagttggtcgtgatggtg

SEQ ID NO: 346575 - DNA, 28 bp, Artificial Sequence
  Description of Artificial Sequence: Synthetic oligonucleotide
aacttggggcagttggtcgtgatggtgg

SEQ ID NO: 346576 - DNA, 27 bp, Artificial Sequence
  Description of Artificial Sequence: Synthetic oligonucleotide
acttggggcagttggtcgtgatggtgg

SEQ ID NO: 346577 - DNA, 27 bp, Artificial Sequence
  Description of Artificial Sequence: Synthetic oligonucleotide
cttggggcagttggtcgtgatggtggt

SEQ ID NO: 346578 - DNA, 27 bp, Artificial Sequence
  Description of Artificial Sequence: Synthetic oligonucleotide
ttggggcagttggtcgtgatggtggtg

SEQ ID NO: 346579 - DNA, 26 bp, Artificial Sequence
  Description of Artificial Sequence: Synthetic oligonucleotide
tggggcagttggtcgtgatggtggtg

SEQ ID NO: 346580 - DNA, 25 bp, Artificial Sequence
  Description of Artificial Sequence: Synthetic oligonucleotide
ggggcagttggtcgtgatggtggtg

SEQ ID NO: 346581 - DNA, 26 bp, Artificial Sequence
  Description of Artificial Sequence: Synthetic oligonucleotide
gggcagttggtcgtgatggtggtggt

SEQ ID NO: 346582 - DNA, 26 bp, Artificial Sequence
  Description of Artificial Sequence: Synthetic oligonucleotide
ggcagttggtcgtgatggtggtggtg

SEQ ID NO: 346583 - DNA, 27 bp, Artificial Sequence
  Description of Artificial Sequence: Synthetic oligonucleotide
gcagttggtcgtgatggtggtggtgga

SEQ ID NO: 346584 - DNA, 27 bp, Artificial Sequence
  Description of Artificial Sequence: Synthetic oligonucleotide
cagttggtcgtgatggtggtggtggag

SEQ ID NO: 346585 - DNA, 27 bp, Artificial Sequence
  Description of Artificial Sequence: Synthetic oligonucleotide
agttggtcgtgatggtggtggtggagg

SEQ ID NO: 346586 - DNA, 27 bp, Artificial Sequence
  Description of Artificial Sequence: Synthetic oligonucleotide
gttggtcgtgatggtggtggtggagga

SEQ ID NO: 346587 - DNA, 27 bp, Artificial Sequence
  Description of Artificial Sequence: Synthetic oligonucleotide
ttggtcgtgatggtggtggtggaggag

SEQ ID NO: 346588 - DNA, 27 bp, Artificial Sequence
  Description of Artificial Sequence: Synthetic oligonucleotide
tggtcgtgatggtggtggtggaggaga

SEQ ID NO: 346589 - DNA, 26 bp, Artificial Sequence
  Description of Artificial Sequence: Synthetic oligonucleotide
ggtcgtgatggtggtggtggaggaga

SEQ ID NO: 346590 - DNA, 27 bp, Artificial Sequence
  Description of Artificial Sequence: Synthetic oligonucleotide
gtcgtgatggtggtggtggaggagaca

SEQ ID NO: 346591 - DNA, 27 bp, Artificial Sequence
  Description of Artificial Sequence: Synthetic oligonucleotide
tcgtgatggtggtggtggaggagacag

SEQ ID NO: 346592 - DNA, 26 bp, Artificial Sequence
  Description of Artificial Sequence: Synthetic oligonucleotide
cgtgatggtggtggtggaggagacag

SEQ ID NO: 346593 - DNA, 27 bp, Artificial Sequence
  Description of Artificial Sequence: Synthetic oligonucleotide
gtgatggtggtggtggaggagacagct

SEQ ID NO: 346594 - DNA, 30 bp, Artificial Sequence
  Description of Artificial Sequence: Synthetic oligonucleotide
tgatggtggtggtggaggagacagcttttg

SEQ ID NO: 346595 - DNA, 29 bp, Artificial Sequence
  Description of Artificial Sequence: Synthetic oligonucleotide
gatggtggtggtggaggagacagcttttg

SEQ ID NO: 346596 - DNA, 29 bp, Artificial Sequence
  Description of Artificial Sequence: Synthetic oligonucleotide
atggtggtggtggaggagacagcttttgg

SEQ ID NO: 346597 - DNA, 28 bp, Artificial Sequence
  Description of Artificial Sequence: Synthetic oligonucleotide
tggtggtggtggaggagacagcttttgg

SEQ ID NO: 346598 - DNA, 27 bp, Artificial Sequence
  Description of Artificial Sequence: Synthetic oligonucleotide
ggtggtggtggaggagacagcttttgg

SEQ ID NO: 346599 - DNA, 27 bp, Artificial Sequence
  Description of Artificial Sequence: Synthetic oligonucleotide
gtggtggtggaggagacagcttttggc

SEQ ID NO: 346600 - DNA, 28 bp, Artificial Sequence
  Description of Artificial Sequence: Synthetic oligonucleotide
tggtggtggaggagacagcttttggcac

SEQ ID NO: 346601 - DNA, 27 bp, Artificial Sequence
  Description of Artificial Sequence: Synthetic oligonucleotide
ggtggtggaggagacagcttttggcac

SEQ ID NO: 346602 - DNA, 27 bp, Artificial Sequence
  Description of Artificial Sequence: Synthetic oligonucleotide
gtggtggaggagacagcttttggcacc

SEQ ID NO: 346603 - DNA, 27 bp, Artificial Sequence
  Description of Artificial Sequence: Synthetic oligonucleotide
tggtggaggagacagcttttggcaccc

SEQ ID NO: 346604 - DNA, 27 bp, Artificial Sequence
  Description of Artificial Sequence: Synthetic oligonucleotide
ggtggaggagacagcttttggcaccct

SEQ ID NO: 346605 - DNA, 27 bp, Artificial Sequence
  Description of Artificial Sequence: Synthetic oligonucleotide
gtggaggagacagcttttggcaccctg

SEQ ID NO: 346606 - DNA, 28 bp, Artificial Sequence
  Description of Artificial Sequence: Synthetic oligonucleotide
tggaggagacagcttttggcaccctgtg

SEQ ID NO: 346607 - DNA, 27 bp, Artificial Sequence
  Description of Artificial Sequence: Synthetic oligonucleotide
ggaggagacagcttttggcaccctgtg

SEQ ID NO: 346608 - DNA, 27 bp, Artificial Sequence
  Description of Artificial Sequence: Synthetic oligonucleotide
gaggagacagcttttggcaccctgtgg

SEQ ID NO: 346609 - DNA, 29 bp, Artificial Sequence
  Description of Artificial Sequence: Synthetic oligonucleotide
aggagacagcttttggcaccctgtggatg

SEQ ID NO: 346610 - DNA, 28 bp, Artificial Sequence
  Description of Artificial Sequence: Synthetic oligonucleotide
ggagacagcttttggcaccctgtggatg

SEQ ID NO: 346611 - DNA, 28 bp, Artificial Sequence
  Description of Artificial Sequence: Synthetic oligonucleotide
gagacagcttttggcaccctgtggatgg

SEQ ID NO: 346612 - DNA, 29 bp, Artificial Sequence
  Description of Artificial Sequence: Synthetic oligonucleotide
agacagcttttggcaccctgtggatggtc

SEQ ID NO: 346613 - DNA, 28 bp, Artificial Sequence
  Description of Artificial Sequence: Synthetic oligonucleotide
gacagcttttggcaccctgtggatggtc

SEQ ID NO: 346614 - DNA, 30 bp, Artificial Sequence
  Description of Artificial Sequence: Synthetic oligonucleotide
acagcttttggcaccctgtggatggtcaac

SEQ ID NO: 346615 - DNA, 29 bp, Artificial Sequence
  Description of Artificial Sequence: Synthetic oligonucleotide
cagcttttggcaccctgtggatggtcaac

SEQ ID NO: 346616 - DNA, 30 bp, Artificial Sequence
  Description of Artificial Sequence: Synthetic oligonucleotide
agcttttggcaccctgtggatggtcaacag

SEQ ID NO: 346617 - DNA, 29 bp, Artificial Sequence
  Description of Artificial Sequence: Synthetic oligonucleotide
gcttttggcaccctgtggatggtcaacag

SEQ ID NO: 346618 - DNA, 35 bp, Artificial Sequence
  Description of Artificial Sequence: Synthetic oligonucleotide
cttttggcaccctgtggatggtcaacagtaatatg

SEQ ID NO: 346619 - DNA, 37 bp, Artificial Sequence
  Description of Artificial Sequence: Synthetic oligonucleotide
ttttggcaccctgtggatggtcaacagtaatatgttc

SEQ ID NO: 346620 - DNA, 36 bp, Artificial Sequence
  Description of Artificial Sequence: Synthetic oligonucleotide
tttggcaccctgtggatggtcaacagtaatatgttc

SEQ ID NO: 346621 - DNA, 35 bp, Artificial Sequence
  Description of Artificial Sequence: Synthetic oligonucleotide
ttggcaccctgtggatggtcaacagtaatatgttc

SEQ ID NO: 346622 - DNA, 34 bp, Artificial Sequence
  Description of Artificial Sequence: Synthetic oligonucleotide
tggcaccctgtggatggtcaacagtaatatgttc

SEQ ID NO: 346623 - DNA, 33 bp, Artificial Sequence
  Description of Artificial Sequence: Synthetic oligonucleotide
ggcaccctgtggatggtcaacagtaatatgttc

SEQ ID NO: 346624 - DNA, 35 bp, Artificial Sequence
  Description of Artificial Sequence: Synthetic oligonucleotide
gcaccctgtggatggtcaacagtaatatgttcaac

SEQ ID NO: 346625 - DNA, 36 bp, Artificial Sequence
  Description of Artificial Sequence: Synthetic oligonucleotide
caccctgtggatggtcaacagtaatatgttcaacac

SEQ ID NO: 346626 - DNA, 37 bp, Artificial Sequence
  Description of Artificial Sequence: Synthetic oligonucleotide
accctgtggatggtcaacagtaatatgttcaacacac

SEQ ID NO: 346627 - DNA, 36 bp, Artificial Sequence
  Description of Artificial Sequence: Synthetic oligonucleotide
ccctgtggatggtcaacagtaatatgttcaacacac

SEQ ID NO: 346628 - DNA, 37 bp, Artificial Sequence
  Description of Artificial Sequence: Synthetic oligonucleotide
cctgtggatggtcaacagtaatatgttcaacacacac

SEQ ID NO: 346629 - DNA, 39 bp, Artificial Sequence
  Description of Artificial Sequence: Synthetic oligonucleotide
ctgtggatggtcaacagtaatatgttcaacacacactac

SEQ ID NO: 346630 - DNA, 39 bp, Artificial Sequence
  Description of Artificial Sequence: Synthetic oligonucleotide
tgtggatggtcaacagtaatatgttcaacacacactacc

SEQ ID NO: 346631 - DNA, 38 bp, Artificial Sequence
  Description of Artificial Sequence: Synthetic oligonucleotide
gtggatggtcaacagtaatatgttcaacacacactacc

SEQ ID NO: 346632 - DNA, 39 bp, Artificial Sequence
  Description of Artificial Sequence: Synthetic oligonucleotide
tggatggtcaacagtaatatgttcaacacacactaccac

SEQ ID NO: 346633 - DNA, 38 bp, Artificial Sequence
  Description of Artificial Sequence: Synthetic oligonucleotide
ggatggtcaacagtaatatgttcaacacacactaccac

SEQ ID NO: 346634 - DNA, 40 bp, Artificial Sequence
  Description of Artificial Sequence: Synthetic oligonucleotide
gatggtcaacagtaatatgttcaacacacactaccacaag

SEQ ID NO: 346635 - DNA, 42 bp, Artificial Sequence
  Description of Artificial Sequence: Synthetic oligonucleotide
atggtcaacagtaatatgttcaacacacactaccacaagaac

SEQ ID NO: 346636 - DNA, 41 bp, Artificial Sequence
  Description of Artificial Sequence: Synthetic oligonucleotide
tggtcaacagtaatatgttcaacacacactaccacaagaac

SEQ ID NO: 346637 - DNA, 40 bp, Artificial Sequence
  Description of Artificial Sequence: Synthetic oligonucleotide
ggtcaacagtaatatgttcaacacacactaccacaagaac

SEQ ID NO: 346638 - DNA, 40 bp, Artificial Sequence
  Description of Artificial Sequence: Synthetic oligonucleotide
gtcaacagtaatatgttcaacacacactaccacaagaacc

SEQ ID NO: 346639 - DNA, 41 bp, Artificial Sequence
  Description of Artificial Sequence: Synthetic oligonucleotide
tcaacagtaatatgttcaacacacactaccacaagaacctg

SEQ ID NO: 346640 - DNA, 40 bp, Artificial Sequence
  Description of Artificial Sequence: Synthetic oligonucleotide
caacagtaatatgttcaacacacactaccacaagaacctg

SEQ ID NO: 346641 - DNA, 41 bp, Artificial Sequence
  Description of Artificial Sequence: Synthetic oligonucleotide
aacagtaatatgttcaacacacactaccacaagaacctgag

SEQ ID NO: 346642 - DNA, 40 bp, Artificial Sequence
  Description of Artificial Sequence: Synthetic oligonucleotide
acagtaatatgttcaacacacactaccacaagaacctgag

SEQ ID NO: 346643 - DNA, 39 bp, Artificial Sequence
  Description of Artificial Sequence: Synthetic oligonucleotide
cagtaatatgttcaacacacactaccacaagaacctgag

SEQ ID NO: 346644 - DNA, 39 bp, Artificial Sequence
  Description of Artificial Sequence: Synthetic oligonucleotide
agtaatatgttcaacacacactaccacaagaacctgagc

SEQ ID NO: 346645 - DNA, 38 bp, Artificial Sequence
  Description of Artificial Sequence: Synthetic oligonucleotide
gtaatatgttcaacacacactaccacaagaacctgagc

SEQ ID NO: 346646 - DNA, 38 bp, Artificial Sequence
  Description of Artificial Sequence: Synthetic oligonucleotide
taatatgttcaacacacactaccacaagaacctgagcc

SEQ ID NO: 346647 - DNA, 37 bp, Artificial Sequence
  Description of Artificial Sequence: Synthetic oligonucleotide
aatatgttcaacacacactaccacaagaacctgagcc

SEQ ID NO: 346648 - DNA, 36 bp, Artificial Sequence
  Description of Artificial Sequence: Synthetic oligonucleotide
atatgttcaacacacactaccacaagaacctgagcc

SEQ ID NO: 346649 - DNA, 35 bp, Artificial Sequence
  Description of Artificial Sequence: Synthetic oligonucleotide
tatgttcaacacacactaccacaagaacctgagcc

SEQ ID NO: 346650 - DNA, 34 bp, Artificial Sequence
  Description of Artificial Sequence: Synthetic oligonucleotide
atgttcaacacacactaccacaagaacctgagcc

SEQ ID NO: 346651 - DNA, 33 bp, Artificial Sequence
  Description of Artificial Sequence: Synthetic oligonucleotide
tgttcaacacacactaccacaagaacctgagcc

SEQ ID NO: 346652 - DNA, 32 bp, Artificial Sequence
  Description of Artificial Sequence: Synthetic oligonucleotide
gttcaacacacactaccacaagaacctgagcc

SEQ ID NO: 346653 - DNA, 33 bp, Artificial Sequence
  Description of Artificial Sequence: Synthetic oligonucleotide
ttcaacacacactaccacaagaacctgagccac

SEQ ID NO: 346654 - DNA, 32 bp, Artificial Sequence
  Description of Artificial Sequence: Synthetic oligonucleotide
tcaacacacactaccacaagaacctgagccac

SEQ ID NO: 346655 - DNA, 31 bp, Artificial Sequence
  Description of Artificial Sequence: Synthetic oligonucleotide
caacacacactaccacaagaacctgagccac

SEQ ID NO: 346656 - DNA, 33 bp, Artificial Sequence
  Description of Artificial Sequence: Synthetic oligonucleotide
aacacacactaccacaagaacctgagccacttc

SEQ ID NO: 346657 - DNA, 32 bp, Artificial Sequence
  Description of Artificial Sequence: Synthetic oligonucleotide
acacacactaccacaagaacctgagccacttc

SEQ ID NO: 346658 - DNA, 31 bp, Artificial Sequence
  Description of Artificial Sequence: Synthetic oligonucleotide
cacacactaccacaagaacctgagccacttc

SEQ ID NO: 346659 - DNA, 33 bp, Artificial Sequence
  Description of Artificial Sequence: Synthetic oligonucleotide
acacactaccacaagaacctgagccacttctac

SEQ ID NO: 346660 - DNA, 32 bp, Artificial Sequence
  Description of Artificial Sequence: Synthetic oligonucleotide
cacactaccacaagaacctgagccacttctac

SEQ ID NO: 346661 - DNA, 32 bp, Artificial Sequence
  Description of Artificial Sequence: Synthetic oligonucleotide
acactaccacaagaacctgagccacttctacc

SEQ ID NO: 346662 - DNA, 31 bp, Artificial Sequence
  Description of Artificial Sequence: Synthetic oligonucleotide
cactaccacaagaacctgagccacttctacc

SEQ ID NO: 346663 - DNA, 32 bp, Artificial Sequence
  Description of Artificial Sequence: Synthetic oligonucleotide
actaccacaagaacctgagccacttctacctg

SEQ ID NO: 346664 - DNA, 31 bp, Artificial Sequence
  Description of Artificial Sequence: Synthetic oligonucleotide
ctaccacaagaacctgagccacttctacctg

SEQ ID NO: 346665 - DNA, 33 bp, Artificial Sequence
  Description of Artificial Sequence: Synthetic oligonucleotide
taccacaagaacctgagccacttctacctgttc

SEQ ID NO: 346666 - DNA, 32 bp, Artificial Sequence
  Description of Artificial Sequence: Synthetic oligonucleotide
accacaagaacctgagccacttctacctgttc

SEQ ID NO: 346667 - DNA, 31 bp, Artificial Sequence
  Description of Artificial Sequence: Synthetic oligonucleotide
ccacaagaacctgagccacttctacctgttc

SEQ ID NO: 346668 - DNA, 31 bp, Artificial Sequence
  Description of Artificial Sequence: Synthetic oligonucleotide
cacaagaacctgagccacttctacctgttcg

SEQ ID NO: 346669 - DNA, 31 bp, Artificial Sequence
  Description of Artificial Sequence: Synthetic oligonucleotide
acaagaacctgagccacttctacctgttcgc

SEQ ID NO: 346670 - DNA, 30 bp, Artificial Sequence
  Description of Artificial Sequence: Synthetic oligonucleotide
caagaacctgagccacttctacctgttcgc

SEQ ID NO: 346671 - DNA, 31 bp, Artificial Sequence
  Description of Artificial Sequence: Synthetic oligonucleotide
aagaacctgagccacttctacctgttcgcag

SEQ ID NO: 346672 - DNA, 30 bp, Artificial Sequence
  Description of Artificial Sequence: Synthetic oligonucleotide
agaacctgagccacttctacctgttcgcag

SEQ ID NO: 346673 - DNA, 29 bp, Artificial Sequence
  Description of Artificial Sequence: Synthetic oligonucleotide
gaacctgagccacttctacctgttcgcag

SEQ ID NO: 346674 - DNA, 29 bp, Artificial Sequence
  Description of Artificial Sequence: Synthetic oligonucleotide
aacctgagccacttctacctgttcgcagg

SEQ ID NO: 346675 - DNA, 28 bp, Artificial Sequence
  Description of Artificial Sequence: Synthetic oligonucleotide
acctgagccacttctacctgttcgcagg

SEQ ID NO: 346676 - DNA, 27 bp, Artificial Sequence
  Description of Artificial Sequence: Synthetic oligonucleotide
cctgagccacttctacctgttcgcagg

SEQ ID NO: 346677 - DNA, 27 bp, Artificial Sequence
  Description of Artificial Sequence: Synthetic oligonucleotide
ctgagccacttctacctgttcgcaggc

SEQ ID NO: 346678 - DNA, 33 bp, Artificial Sequence
  Description of Artificial Sequence: Synthetic oligonucleotide
tgagccacttctacctgttcgcaggctattttg

SEQ ID NO: 346679 - DNA, 32 bp, Artificial Sequence
  Description of Artificial Sequence: Synthetic oligonucleotide
gagccacttctacctgttcgcaggctattttg

SEQ ID NO: 346680 - DNA, 32 bp, Artificial Sequence
  Description of Artificial Sequence: Synthetic oligonucleotide
agccacttctacctgttcgcaggctattttgg

SEQ ID NO: 346681 - DNA, 31 bp, Artificial Sequence
  Description of Artificial Sequence: Synthetic oligonucleotide
gccacttctacctgttcgcaggctattttgg

SEQ ID NO: 346682 - DNA, 31 bp, Artificial Sequence
  Description of Artificial Sequence: Synthetic oligonucleotide
ccacttctacctgttcgcaggctattttggc

SEQ ID NO: 346683 - DNA, 31 bp, Artificial Sequence
  Description of Artificial Sequence: Synthetic oligonucleotide
cacttctacctgttcgcaggctattttggcc

SEQ ID NO: 346684 - DNA, 32 bp, Artificial Sequence
  Description of Artificial Sequence: Synthetic oligonucleotide
acttctacctgttcgcaggctattttggcctg

SEQ ID NO: 346685 - DNA, 31 bp, Artificial Sequence
  Description of Artificial Sequence: Synthetic oligonucleotide
cttctacctgttcgcaggctattttggcctg

SEQ ID NO: 346686 - DNA, 32 bp, Artificial Sequence
  Description of Artificial Sequence: Synthetic oligonucleotide
ttctacctgttcgcaggctattttggcctgac

SEQ ID NO: 346687 - DNA, 31 bp, Artificial Sequence
  Description of Artificial Sequence: Synthetic oligonucleotide
tctacctgttcgcaggctattttggcctgac

SEQ ID NO: 346688 - DNA, 30 bp, Artificial Sequence
  Description of Artificial Sequence: Synthetic oligonucleotide
ctacctgttcgcaggctattttggcctgac

SEQ ID NO: 346689 - DNA, 31 bp, Artificial Sequence
  Description of Artificial Sequence: Synthetic oligonucleotide
tacctgttcgcaggctattttggcctgactg

SEQ ID NO: 346690 - DNA, 30 bp, Artificial Sequence
  Description of Artificial Sequence: Synthetic oligonucleotide
acctgttcgcaggctattttggcctgactg

SEQ ID NO: 346691 - DNA, 29 bp, Artificial Sequence
  Description of Artificial Sequence: Synthetic oligonucleotide
cctgttcgcaggctattttggcctgactg

SEQ ID NO: 346692 - DNA, 30 bp, Artificial Sequence
  Description of Artificial Sequence: Synthetic oligonucleotide
ctgttcgcaggctattttggcctgactgtg

SEQ ID NO: 346693 - DNA, 30 bp, Artificial Sequence
  Description of Artificial Sequence: Synthetic oligonucleotide
tgttcgcaggctattttggcctgactgtgc

SEQ ID NO: 346694 - DNA, 29 bp, Artificial Sequence
  Description of Artificial Sequence: Synthetic oligonucleotide
gttcgcaggctattttggcctgactgtgc

SEQ ID NO: 346695 - DNA, 29 bp, Artificial Sequence
  Description of Artificial Sequence: Synthetic oligonucleotide
ttcgcaggctattttggcctgactgtgcc

SEQ ID NO: 346696 - DNA, 28 bp, Artificial Sequence
  Description of Artificial Sequence: Synthetic oligonucleotide
tcgcaggctattttggcctgactgtgcc

SEQ ID NO: 346697 - DNA, 27 bp, Artificial Sequence
  Description of Artificial Sequence: Synthetic oligonucleotide
cgcaggctattttggcctgactgtgcc

SEQ ID NO: 346698 - DNA, 27 bp, Artificial Sequence
  Description of Artificial Sequence: Synthetic oligonucleotide
gcaggctattttggcctgactgtgccc

SEQ ID NO: 346699 - DNA, 28 bp, Artificial Sequence
  Description of Artificial Sequence: Synthetic oligonucleotide
caggctattttggcctgactgtgccctg

SEQ ID NO: 346700 - DNA, 28 bp, Artificial Sequence
  Description of Artificial Sequence: Synthetic oligonucleotide
aggctattttggcctgactgtgccctgg

SEQ ID NO: 346701 - DNA, 27 bp, Artificial Sequence
  Description of Artificial Sequence: Synthetic oligonucleotide
ggctattttggcctgactgtgccctgg

SEQ ID NO: 346702 - DNA, 28 bp, Artificial Sequence
  Description of Artificial Sequence: Synthetic oligonucleotide
gctattttggcctgactgtgccctggtg

SEQ ID NO: 346703 - DNA, 28 bp, Artificial Sequence
  Description of Artificial Sequence: Synthetic oligonucleotide
ctattttggcctgactgtgccctggtgc

SEQ ID NO: 346704 - DNA, 28 bp, Artificial Sequence
  Description of Artificial Sequence: Synthetic oligonucleotide
tattttggcctgactgtgccctggtgcc

SEQ ID NO: 346705 - DNA, 27 bp, Artificial Sequence
  Description of Artificial Sequence: Synthetic oligonucleotide
attttggcctgactgtgccctggtgcc

SEQ ID NO: 346706 - DNA, 27 bp, Artificial Sequence
  Description of Artificial Sequence: Synthetic oligonucleotide
ttttggcctgactgtgccctggtgcca

SEQ ID NO: 346707 - DNA, 26 bp, Artificial Sequence
  Description of Artificial Sequence: Synthetic oligonucleotide
tttggcctgactgtgccctggtgcca

SEQ ID NO: 346708 - DNA, 25 bp, Artificial Sequence
  Description of Artificial Sequence: Synthetic oligonucleotide
ttggcctgactgtgccctggtgcca

SEQ ID NO: 346709 - DNA, 24 bp, Artificial Sequence
  Description of Artificial Sequence: Synthetic oligonucleotide
tggcctgactgtgccctggtgcca

SEQ ID NO: 346710 - DNA, 23 bp, Artificial Sequence
  Description of Artificial Sequence: Synthetic oligonucleotide
ggcctgactgtgccctggtgcca

SEQ ID NO: 346711 - DNA, 23 bp, Artificial Sequence
  Description of Artificial Sequence: Synthetic oligonucleotide
gcctgactgtgccctggtgccag

SEQ ID NO: 346712 - DNA, 23 bp, Artificial Sequence
  Description of Artificial Sequence: Synthetic oligonucleotide
cctgactgtgccctggtgccagc

SEQ ID NO: 346713 - DNA, 26 bp, Artificial Sequence
  Description of Artificial Sequence: Synthetic oligonucleotide
ctgactgtgccctggtgccagccaaa

SEQ ID NO: 346714 - DNA, 26 bp, Artificial Sequence
  Description of Artificial Sequence: Synthetic oligonucleotide
tgactgtgccctggtgccagccaaag

SEQ ID NO: 346715 - DNA, 25 bp, Artificial Sequence
  Description of Artificial Sequence: Synthetic oligonucleotide
gactgtgccctggtgccagccaaag

SEQ ID NO: 346716 - DNA, 25 bp, Artificial Sequence
  Description of Artificial Sequence: Synthetic oligonucleotide
actgtgccctggtgccagccaaagc

SEQ ID NO: 346717 - DNA, 24 bp, Artificial Sequence
  Description of Artificial Sequence: Synthetic oligonucleotide
ctgtgccctggtgccagccaaagc

SEQ ID NO: 346718 - DNA, 25 bp, Artificial Sequence
  Description of Artificial Sequence: Synthetic oligonucleotide
tgtgccctggtgccagccaaagcca

SEQ ID NO: 346719 - DNA, 24 bp, Artificial Sequence
  Description of Artificial Sequence: Synthetic oligonucleotide
gtgccctggtgccagccaaagcca

SEQ ID NO: 346720 - DNA, 26 bp, Artificial Sequence
  Description of Artificial Sequence: Synthetic oligonucleotide
tgccctggtgccagccaaagccacta

SEQ ID NO: 346721 - DNA, 25 bp, Artificial Sequence
  Description of Artificial Sequence: Synthetic oligonucleotide
gccctggtgccagccaaagccacta

SEQ ID NO: 346722 - DNA, 25 bp, Artificial Sequence
  Description of Artificial Sequence: Synthetic oligonucleotide
ccctggtgccagccaaagccactac

SEQ ID NO: 346723 - DNA, 25 bp, Artificial Sequence
  Description of Artificial Sequence: Synthetic oligonucleotide
cctggtgccagccaaagccactacc

SEQ ID NO: 346724 - DNA, 27 bp, Artificial Sequence
  Description of Artificial Sequence: Synthetic oligonucleotide
ctggtgccagccaaagccactacccaa

SEQ ID NO: 346725 - DNA, 27 bp, Artificial Sequence
  Description of Artificial Sequence: Synthetic oligonucleotide
tggtgccagccaaagccactacccaag

SEQ ID NO: 346726 - DNA, 26 bp, Artificial Sequence
  Description of Artificial Sequence: Synthetic oligonucleotide
ggtgccagccaaagccactacccaag

SEQ ID NO: 346727 - DNA, 26 bp, Artificial Sequence
  Description of Artificial Sequence: Synthetic oligonucleotide
gtgccagccaaagccactacccaagc

SEQ ID NO: 346728 - DNA, 27 bp, Artificial Sequence
  Description of Artificial Sequence: Synthetic oligonucleotide
tgccagccaaagccactacccaagcga

SEQ ID NO: 346729 - DNA, 27 bp, Artificial Sequence
  Description of Artificial Sequence: Synthetic oligonucleotide
gccagccaaagccactacccaagcgaa

SEQ ID NO: 346730 - DNA, 27 bp, Artificial Sequence
  Description of Artificial Sequence: Synthetic oligonucleotide
ccagccaaagccactacccaagcgaac

SEQ ID NO: 346731 - DNA, 27 bp, Artificial Sequence
  Description of Artificial Sequence: Synthetic oligonucleotide
cagccaaagccactacccaagcgaacg

SEQ ID NO: 346732 - DNA, 27 bp, Artificial Sequence
  Description of Artificial Sequence: Synthetic oligonucleotide
agccaaagccactacccaagcgaacgg

SEQ ID NO: 346733 - DNA, 27 bp, Artificial Sequence
  Description of Artificial Sequence: Synthetic oligonucleotide
gccaaagccactacccaagcgaacgga

SEQ ID NO: 346734 - DNA, 27 bp, Artificial Sequence
  Description of Artificial Sequence: Synthetic oligonucleotide
ccaaagccactacccaagcgaacggag

SEQ ID NO: 346735 - DNA, 27 bp, Artificial Sequence
  Description of Artificial Sequence: Synthetic oligonucleotide
caaagccactacccaagcgaacggagg

SEQ ID NO: 346736 - DNA, 32 bp, Artificial Sequence
  Description of Artificial Sequence: Synthetic oligonucleotide
aaagccactacccaagcgaacggaggttaatg

SEQ ID NO: 346737 - DNA, 31 bp, Artificial Sequence
  Description of Artificial Sequence: Synthetic oligonucleotide
aagccactacccaagcgaacggaggttaatg

SEQ ID NO: 346738 - DNA, 30 bp, Artificial Sequence
  Description of Artificial Sequence: Synthetic oligonucleotide
agccactacccaagcgaacggaggttaatg

SEQ ID NO: 346739 - DNA, 29 bp, Artificial Sequence
  Description of Artificial Sequence: Synthetic oligonucleotide
gccactacccaagcgaacggaggttaatg

SEQ ID NO: 346740 - DNA, 31 bp, Artificial Sequence
  Description of Artificial Sequence: Synthetic oligonucleotide
ccactacccaagcgaacggaggttaatgatc

SEQ ID NO: 346741 - DNA, 32 bp, Artificial Sequence
  Description of Artificial Sequence: Synthetic oligonucleotide
cactacccaagcgaacggaggttaatgatcac

SEQ ID NO: 346742 - DNA, 33 bp, Artificial Sequence
  Description of Artificial Sequence: Synthetic oligonucleotide
actacccaagcgaacggaggttaatgatcacag

SEQ ID NO: 346743 - DNA, 32 bp, Artificial Sequence
  Description of Artificial Sequence: Synthetic oligonucleotide
ctacccaagcgaacggaggttaatgatcacag

SEQ ID NO: 346744 - DNA, 33 bp, Artificial Sequence
  Description of Artificial Sequence: Synthetic oligonucleotide
tacccaagcgaacggaggttaatgatcacagag

SEQ ID NO: 346745 - DNA, 32 bp, Artificial Sequence
  Description of Artificial Sequence: Synthetic oligonucleotide
acccaagcgaacggaggttaatgatcacagag

SEQ ID NO: 346746 - DNA, 31 bp, Artificial Sequence
  Description of Artificial Sequence: Synthetic oligonucleotide
cccaagcgaacggaggttaatgatcacagag

SEQ ID NO: 346747 - DNA, 31 bp, Artificial Sequence
  Description of Artificial Sequence: Synthetic oligonucleotide
ccaagcgaacggaggttaatgatcacagagc

SEQ ID NO: 346748 - DNA, 33 bp, Artificial Sequence
  Description of Artificial Sequence: Synthetic oligonucleotide
caagcgaacggaggttaatgatcacagagcaac

SEQ ID NO: 346749 - DNA, 33 bp, Artificial Sequence
  Description of Artificial Sequence: Synthetic oligonucleotide
aagcgaacggaggttaatgatcacagagcaacg

SEQ ID NO: 346750 - DNA, 32 bp, Artificial Sequence
  Description of Artificial Sequence: Synthetic oligonucleotide
agcgaacggaggttaatgatcacagagcaacg

SEQ ID NO: 346751 - DNA, 31 bp, Artificial Sequence
  Description of Artificial Sequence: Synthetic oligonucleotide
gcgaacggaggttaatgatcacagagcaacg

SEQ ID NO: 346752 - DNA, 34 bp, Artificial Sequence
  Description of Artificial Sequence: Synthetic oligonucleotide
cgaacggaggttaatgatcacagagcaacgttac

SEQ ID NO: 346753 - DNA, 34 bp, Artificial Sequence
  Description of Artificial Sequence: Synthetic oligonucleotide
gaacggaggttaatgatcacagagcaacgttacc

SEQ ID NO: 346754 - DNA, 34 bp, Artificial Sequence
  Description of Artificial Sequence: Synthetic oligonucleotide
aacggaggttaatgatcacagagcaacgttaccc

SEQ ID NO: 346755 - DNA, 33 bp, Artificial Sequence
  Description of Artificial Sequence: Synthetic oligonucleotide
acggaggttaatgatcacagagcaacgttaccc

SEQ ID NO: 346756 - DNA, 32 bp, Artificial Sequence
  Description of Artificial Sequence: Synthetic oligonucleotide
cggaggttaatgatcacagagcaacgttaccc

SEQ ID NO: 346757 - DNA, 33 bp, Artificial Sequence
  Description of Artificial Sequence: Synthetic oligonucleotide
ggaggttaatgatcacagagcaacgttacccag

SEQ ID NO: 346758 - DNA, 36 bp, Artificial Sequence
  Description of Artificial Sequence: Synthetic oligonucleotide
gaggttaatgatcacagagcaacgttacccagttag

SEQ ID NO: 346759 - DNA, 37 bp, Artificial Sequence
  Description of Artificial Sequence: Synthetic oligonucleotide
aggttaatgatcacagagcaacgttacccagttagtc

SEQ ID NO: 346760 - DNA, 36 bp, Artificial Sequence
  Description of Artificial Sequence: Synthetic oligonucleotide
ggttaatgatcacagagcaacgttacccagttagtc

SEQ ID NO: 346761 - DNA, 37 bp, Artificial Sequence
  Description of Artificial Sequence: Synthetic oligonucleotide
gttaatgatcacagagcaacgttacccagttagtctg

SEQ ID NO: 346762 - DNA, 37 bp, Artificial Sequence
  Description of Artificial Sequence: Synthetic oligonucleotide
ttaatgatcacagagcaacgttacccagttagtctgc

SEQ ID NO: 346763 - DNA, 36 bp, Artificial Sequence
  Description of Artificial Sequence: Synthetic oligonucleotide
taatgatcacagagcaacgttacccagttagtctgc

SEQ ID NO: 346764 - DNA, 35 bp, Artificial Sequence
  Description of Artificial Sequence: Synthetic oligonucleotide
aatgatcacagagcaacgttacccagttagtctgc

SEQ ID NO: 346765 - DNA, 34 bp, Artificial Sequence
  Description of Artificial Sequence: Synthetic oligonucleotide
atgatcacagagcaacgttacccagttagtctgc

SEQ ID NO: 346766 - DNA, 33 bp, Artificial Sequence
  Description of Artificial Sequence: Synthetic oligonucleotide
tgatcacagagcaacgttacccagttagtctgc

SEQ ID NO: 346767 - DNA, 32 bp, Artificial Sequence
  Description of Artificial Sequence: Synthetic oligonucleotide
gatcacagagcaacgttacccagttagtctgc

SEQ ID NO: 346768 - DNA, 32 bp, Artificial Sequence
  Description of Artificial Sequence: Synthetic oligonucleotide
atcacagagcaacgttacccagttagtctgcc

SEQ ID NO: 346769 - DNA, 31 bp, Artificial Sequence
  Description of Artificial Sequence: Synthetic oligonucleotide
tcacagagcaacgttacccagttagtctgcc

SEQ ID NO: 346770 - DNA, 30 bp, Artificial Sequence
  Description of Artificial Sequence: Synthetic oligonucleotide
cacagagcaacgttacccagttagtctgcc

SEQ ID NO: 346771 - DNA, 32 bp, Artificial Sequence
  Description of Artificial Sequence: Synthetic oligonucleotide
acagagcaacgttacccagttagtctgccatc

SEQ ID NO: 346772 - DNA, 31 bp, Artificial Sequence
  Description of Artificial Sequence: Synthetic oligonucleotide
cagagcaacgttacccagttagtctgccatc

SEQ ID NO: 346773 - DNA, 31 bp, Artificial Sequence
  Description of Artificial Sequence: Synthetic oligonucleotide
agagcaacgttacccagttagtctgccatcc

SEQ ID NO: 346774 - DNA, 30 bp, Artificial Sequence
  Description of Artificial Sequence: Synthetic oligonucleotide
gagcaacgttacccagttagtctgccatcc

SEQ ID NO: 346775 - DNA, 31 bp, Artificial Sequence
  Description of Artificial Sequence: Synthetic oligonucleotide
agcaacgttacccagttagtctgccatcctg

SEQ ID NO: 346776 - DNA, 30 bp, Artificial Sequence
  Description of Artificial Sequence: Synthetic oligonucleotide
gcaacgttacccagttagtctgccatcctg

SEQ ID NO: 346777 - DNA, 30 bp, Artificial Sequence
  Description of Artificial Sequence: Synthetic oligonucleotide
caacgttacccagttagtctgccatcctgg

SEQ ID NO: 346778 - DNA, 30 bp, Artificial Sequence
  Description of Artificial Sequence: Synthetic oligonucleotide
aacgttacccagttagtctgccatcctggg

SEQ ID NO: 346779 - DNA, 29 bp, Artificial Sequence
  Description of Artificial Sequence: Synthetic oligonucleotide
acgttacccagttagtctgccatcctggg

SEQ ID NO: 346780 - DNA, 28 bp, Artificial Sequence
  Description of Artificial Sequence: Synthetic oligonucleotide
cgttacccagttagtctgccatcctggg

SEQ ID NO: 346781 - DNA, 28 bp, Artificial Sequence
  Description of Artificial Sequence: Synthetic oligonucleotide
gttacccagttagtctgccatcctgggc

SEQ ID NO: 346782 - DNA, 28 bp, Artificial Sequence
  Description of Artificial Sequence: Synthetic oligonucleotide
ttacccagttagtctgccatcctgggcg

SEQ ID NO: 346783 - DNA, 27 bp, Artificial Sequence
  Description of Artificial Sequence: Synthetic oligonucleotide
tacccagttagtctgccatcctgggcg

SEQ ID NO: 346784 - DNA, 26 bp, Artificial Sequence
  Description of Artificial Sequence: Synthetic oligonucleotide
acccagttagtctgccatcctgggcg

SEQ ID NO: 346785 - DNA, 25 bp, Artificial Sequence
  Description of Artificial Sequence: Synthetic oligonucleotide
cccagttagtctgccatcctgggcg

SEQ ID NO: 346786 - DNA, 25 bp, Artificial Sequence
  Description of Artificial Sequence: Synthetic oligonucleotide
ccagttagtctgccatcctgggcgc

SEQ ID NO: 346787 - DNA, 25 bp, Artificial Sequence
  Description of Artificial Sequence: Synthetic oligonucleotide
cagttagtctgccatcctgggcgcc

SEQ ID NO: 346788 - DNA, 26 bp, Artificial Sequence
  Description of Artificial Sequence: Synthetic oligonucleotide
agttagtctgccatcctgggcgccgt

SEQ ID NO: 346789 - DNA, 25 bp, Artificial Sequence
  Description of Artificial Sequence: Synthetic oligonucleotide
gttagtctgccatcctgggcgccgt

SEQ ID NO: 346790 - DNA, 27 bp, Artificial Sequence
  Description of Artificial Sequence: Synthetic oligonucleotide
ttagtctgccatcctgggcgccgtctt

SEQ ID NO: 346791 - DNA, 26 bp, Artificial Sequence
  Description of Artificial Sequence: Synthetic oligonucleotide
tagtctgccatcctgggcgccgtctt

SEQ ID NO: 346792 - DNA, 25 bp, Artificial Sequence
  Description of Artificial Sequence: Synthetic oligonucleotide
agtctgccatcctgggcgccgtctt

SEQ ID NO: 346793 - DNA, 24 bp, Artificial Sequence
  Description of Artificial Sequence: Synthetic oligonucleotide
gtctgccatcctgggcgccgtctt

SEQ ID NO: 346794 - DNA, 26 bp, Artificial Sequence
  Description of Artificial Sequence: Synthetic oligonucleotide
tctgccatcctgggcgccgtcttctt

SEQ ID NO: 346795 - DNA, 25 bp, Artificial Sequence
  Description of Artificial Sequence: Synthetic oligonucleotide
ctgccatcctgggcgccgtcttctt

SEQ ID NO: 346796 - DNA, 26 bp, Artificial Sequence
  Description of Artificial Sequence: Synthetic oligonucleotide
tgccatcctgggcgccgtcttcttgt

SEQ ID NO: 346797 - DNA, 25 bp, Artificial Sequence
  Description of Artificial Sequence: Synthetic oligonucleotide
gccatcctgggcgccgtcttcttgt

SEQ ID NO: 346798 - DNA, 25 bp, Artificial Sequence
  Description of Artificial Sequence: Synthetic oligonucleotide
ccatcctgggcgccgtcttcttgtc

SEQ ID NO: 346799 - DNA, 27 bp, Artificial Sequence
  Description of Artificial Sequence: Synthetic oligonucleotide
catcctgggcgccgtcttcttgtcgat

SEQ ID NO: 346800 - DNA, 27 bp, Artificial Sequence
  Description of Artificial Sequence: Synthetic oligonucleotide
atcctgggcgccgtcttcttgtcgatg

SEQ ID NO: 346801 - DNA, 27 bp, Artificial Sequence
  Description of Artificial Sequence: Synthetic oligonucleotide
tcctgggcgccgtcttcttgtcgatgt

SEQ ID NO: 346802 - DNA, 27 bp, Artificial Sequence
  Description of Artificial Sequence: Synthetic oligonucleotide
cctgggcgccgtcttcttgtcgatgtt

SEQ ID NO: 346803 - DNA, 27 bp, Artificial Sequence
  Description of Artificial Sequence: Synthetic oligonucleotide
ctgggcgccgtcttcttgtcgatgttc

SEQ ID NO: 346804 - DNA, 28 bp, Artificial Sequence
  Description of Artificial Sequence: Synthetic oligonucleotide
tgggcgccgtcttcttgtcgatgttctg

SEQ ID NO: 346805 - DNA, 27 bp, Artificial Sequence
  Description of Artificial Sequence: Synthetic oligonucleotide
gggcgccgtcttcttgtcgatgttctg

SEQ ID NO: 346806 - DNA, 27 bp, Artificial Sequence
  Description of Artificial Sequence: Synthetic oligonucleotide
ggcgccgtcttcttgtcgatgttctgc

SEQ ID NO: 346807 - DNA, 27 bp, Artificial Sequence
  Description of Artificial Sequence: Synthetic oligonucleotide
gcgccgtcttcttgtcgatgttctgcc

SEQ ID NO: 346808 - DNA, 27 bp, Artificial Sequence
  Description of Artificial Sequence: Synthetic oligonucleotide
cgccgtcttcttgtcgatgttctgccc

SEQ ID NO: 346809 - DNA, 29 bp, Artificial Sequence
  Description of Artificial Sequence: Synthetic oligonucleotide
gccgtcttcttgtcgatgttctgcccaag

SEQ ID NO: 346810 - DNA, 30 bp, Artificial Sequence
  Description of Artificial Sequence: Synthetic oligonucleotide
ccgtcttcttgtcgatgttctgcccaagtg

SEQ ID NO: 346811 - DNA, 31 bp, Artificial Sequence
  Description of Artificial Sequence: Synthetic oligonucleotide
cgtcttcttgtcgatgttctgcccaagtgtc

SEQ ID NO: 346812 - DNA, 33 bp, Artificial Sequence
  Description of Artificial Sequence: Synthetic oligonucleotide
gtcttcttgtcgatgttctgcccaagtgtctac

SEQ ID NO: 346813 - DNA, 34 bp, Artificial Sequence
  Description of Artificial Sequence: Synthetic oligonucleotide
tcttcttgtcgatgttctgcccaagtgtctactc

SEQ ID NO: 346814 - DNA, 33 bp, Artificial Sequence
  Description of Artificial Sequence: Synthetic oligonucleotide
cttcttgtcgatgttctgcccaagtgtctactc

SEQ ID NO: 346815 - DNA, 34 bp, Artificial Sequence
  Description of Artificial Sequence: Synthetic oligonucleotide
ttcttgtcgatgttctgcccaagtgtctactctg

SEQ ID NO: 346816 - DNA, 33 bp, Artificial Sequence
  Description of Artificial Sequence: Synthetic oligonucleotide
tcttgtcgatgttctgcccaagtgtctactctg

SEQ ID NO: 346817 - DNA, 32 bp, Artificial Sequence
  Description of Artificial Sequence: Synthetic oligonucleotide
cttgtcgatgttctgcccaagtgtctactctg

SEQ ID NO: 346818 - DNA, 32 bp, Artificial Sequence
  Description of Artificial Sequence: Synthetic oligonucleotide
ttgtcgatgttctgcccaagtgtctactctgc

SEQ ID NO: 346819 - DNA, 31 bp, Artificial Sequence
  Description of Artificial Sequence: Synthetic oligonucleotide
tgtcgatgttctgcccaagtgtctactctgc

SEQ ID NO: 346820 - DNA, 30 bp, Artificial Sequence
  Description of Artificial Sequence: Synthetic oligonucleotide
gtcgatgttctgcccaagtgtctactctgc

SEQ ID NO: 346821 - DNA, 31 bp, Artificial Sequence
  Description of Artificial Sequence: Synthetic oligonucleotide
tcgatgttctgcccaagtgtctactctgctc

SEQ ID NO: 346822 - DNA, 30 bp, Artificial Sequence
  Description of Artificial Sequence: Synthetic oligonucleotide
cgatgttctgcccaagtgtctactctgctc

SEQ ID NO: 346823 - DNA, 31 bp, Artificial Sequence
  Description of Artificial Sequence: Synthetic oligonucleotide
gatgttctgcccaagtgtctactctgctcag

SEQ ID NO: 346824 - DNA, 31 bp, Artificial Sequence
  Description of Artificial Sequence: Synthetic oligonucleotide
atgttctgcccaagtgtctactctgctcagc

SEQ ID NO: 346825 - DNA, 30 bp, Artificial Sequence
  Description of Artificial Sequence: Synthetic oligonucleotide
tgttctgcccaagtgtctactctgctcagc

SEQ ID NO: 346826 - DNA, 29 bp, Artificial Sequence
  Description of Artificial Sequence: Synthetic oligonucleotide
gttctgcccaagtgtctactctgctcagc

SEQ ID NO: 346827 - DNA, 30 bp, Artificial Sequence
  Description of Artificial Sequence: Synthetic oligonucleotide
ttctgcccaagtgtctactctgctcagctg

SEQ ID NO: 346828 - DNA, 29 bp, Artificial Sequence
  Description of Artificial Sequence: Synthetic oligonucleotide
tctgcccaagtgtctactctgctcagctg

SEQ ID NO: 346829 - DNA, 28 bp, Artificial Sequence
  Description of Artificial Sequence: Synthetic oligonucleotide
ctgcccaagtgtctactctgctcagctg

SEQ ID NO: 346830 - DNA, 29 bp, Artificial Sequence
  Description of Artificial Sequence: Synthetic oligonucleotide
tgcccaagtgtctactctgctcagctgag

SEQ ID NO: 346831 - DNA, 28 bp, Artificial Sequence
  Description of Artificial Sequence: Synthetic oligonucleotide
gcccaagtgtctactctgctcagctgag

SEQ ID NO: 346832 - DNA, 30 bp, Artificial Sequence
  Description of Artificial Sequence: Synthetic oligonucleotide
cccaagtgtctactctgctcagctgagaag

SEQ ID NO: 346833 - DNA, 31 bp, Artificial Sequence
  Description of Artificial Sequence: Synthetic oligonucleotide
ccaagtgtctactctgctcagctgagaagac

SEQ ID NO: 346834 - DNA, 31 bp, Artificial Sequence
  Description of Artificial Sequence: Synthetic oligonucleotide
caagtgtctactctgctcagctgagaagacc

SEQ ID NO: 346835 - DNA, 34 bp, Artificial Sequence
  Description of Artificial Sequence: Synthetic oligonucleotide
aagtgtctactctgctcagctgagaagaccaatc

SEQ ID NO: 346836 - DNA, 33 bp, Artificial Sequence
  Description of Artificial Sequence: Synthetic oligonucleotide
agtgtctactctgctcagctgagaagaccaatc

SEQ ID NO: 346837 - DNA, 32 bp, Artificial Sequence
  Description of Artificial Sequence: Synthetic oligonucleotide
gtgtctactctgctcagctgagaagaccaatc

SEQ ID NO: 346838 - DNA, 32 bp, Artificial Sequence
  Description of Artificial Sequence: Synthetic oligonucleotide
tgtctactctgctcagctgagaagaccaatcc

SEQ ID NO: 346839 - DNA, 31 bp, Artificial Sequence
  Description of Artificial Sequence: Synthetic oligonucleotide
gtctactctgctcagctgagaagaccaatcc

SEQ ID NO: 346840 - DNA, 34 bp, Artificial Sequence
  Description of Artificial Sequence: Synthetic oligonucleotide
tctactctgctcagctgagaagaccaatccaatg

SEQ ID NO: 346841 - DNA, 33 bp, Artificial Sequence
  Description of Artificial Sequence: Synthetic oligonucleotide
ctactctgctcagctgagaagaccaatccaatg

SEQ ID NO: 346842 - DNA, 33 bp, Artificial Sequence
  Description of Artificial Sequence: Synthetic oligonucleotide
tactctgctcagctgagaagaccaatccaatgg

SEQ ID NO: 346843 - DNA, 32 bp, Artificial Sequence
  Description of Artificial Sequence: Synthetic oligonucleotide
actctgctcagctgagaagaccaatccaatgg

SEQ ID NO: 346844 - DNA, 31 bp, Artificial Sequence
  Description of Artificial Sequence: Synthetic oligonucleotide
ctctgctcagctgagaagaccaatccaatgg

SEQ ID NO: 346845 - DNA, 33 bp, Artificial Sequence
  Description of Artificial Sequence: Synthetic oligonucleotide
tctgctcagctgagaagaccaatccaatggaag

SEQ ID NO: 346846 - DNA, 32 bp, Artificial Sequence
  Description of Artificial Sequence: Synthetic oligonucleotide
ctgctcagctgagaagaccaatccaatggaag

SEQ ID NO: 346847 - DNA, 35 bp, Artificial Sequence
  Description of Artificial Sequence: Synthetic oligonucleotide
tgctcagctgagaagaccaatccaatggaagaatg

SEQ ID NO: 346848 - DNA, 34 bp, Artificial Sequence
  Description of Artificial Sequence: Synthetic oligonucleotide
gctcagctgagaagaccaatccaatggaagaatg

SEQ ID NO: 346849 - DNA, 34 bp, Artificial Sequence
  Description of Artificial Sequence: Synthetic oligonucleotide
ctcagctgagaagaccaatccaatggaagaatgg

SEQ ID NO: 346850 - DNA, 34 bp, Artificial Sequence
  Description of Artificial Sequence: Synthetic oligonucleotide
tcagctgagaagaccaatccaatggaagaatggc

SEQ ID NO: 346851 - DNA, 33 bp, Artificial Sequence
  Description of Artificial Sequence: Synthetic oligonucleotide
cagctgagaagaccaatccaatggaagaatggc

SEQ ID NO: 346852 - DNA, 35 bp, Artificial Sequence
  Description of Artificial Sequence: Synthetic oligonucleotide
agctgagaagaccaatccaatggaagaatggcatg

SEQ ID NO: 346853 - DNA, 34 bp, Artificial Sequence
  Description of Artificial Sequence: Synthetic oligonucleotide
gctgagaagaccaatccaatggaagaatggcatg

SEQ ID NO: 346854 - DNA, 36 bp, Artificial Sequence
  Description of Artificial Sequence: Synthetic oligonucleotide
ctgagaagaccaatccaatggaagaatggcatgttc

SEQ ID NO: 346855 - DNA, 38 bp, Artificial Sequence
  Description of Artificial Sequence: Synthetic oligonucleotide
tgagaagaccaatccaatggaagaatggcatgttcaag

SEQ ID NO: 346856 - DNA, 37 bp, Artificial Sequence
  Description of Artificial Sequence: Synthetic oligonucleotide
gagaagaccaatccaatggaagaatggcatgttcaag

SEQ ID NO: 346857 - DNA, 38 bp, Artificial Sequence
  Description of Artificial Sequence: Synthetic oligonucleotide
agaagaccaatccaatggaagaatggcatgttcaagac

SEQ ID NO: 346858 - DNA, 37 bp, Artificial Sequence
  Description of Artificial Sequence: Synthetic oligonucleotide
gaagaccaatccaatggaagaatggcatgttcaagac

SEQ ID NO: 346859 - DNA, 37 bp, Artificial Sequence
  Description of Artificial Sequence: Synthetic oligonucleotide
aagaccaatccaatggaagaatggcatgttcaagacc

SEQ ID NO: 346860 - DNA, 36 bp, Artificial Sequence
  Description of Artificial Sequence: Synthetic oligonucleotide
agaccaatccaatggaagaatggcatgttcaagacc

SEQ ID NO: 346861 - DNA, 35 bp, Artificial Sequence
  Description of Artificial Sequence: Synthetic oligonucleotide
gaccaatccaatggaagaatggcatgttcaagacc

SEQ ID NO: 346862 - DNA, 37 bp, Artificial Sequence
  Description of Artificial Sequence: Synthetic oligonucleotide
accaatccaatggaagaatggcatgttcaagacctac

SEQ ID NO: 346863 - DNA, 36 bp, Artificial Sequence
  Description of Artificial Sequence: Synthetic oligonucleotide
ccaatccaatggaagaatggcatgttcaagacctac

SEQ ID NO: 346864 - DNA, 39 bp, Artificial Sequence
  Description of Artificial Sequence: Synthetic oligonucleotide
caatccaatggaagaatggcatgttcaagacctactatc

SEQ ID NO: 346865 - DNA, 39 bp, Artificial Sequence
  Description of Artificial Sequence: Synthetic oligonucleotide
aatccaatggaagaatggcatgttcaagacctactatcc

SEQ ID NO: 346866 - DNA, 38 bp, Artificial Sequence
  Description of Artificial Sequence: Synthetic oligonucleotide
atccaatggaagaatggcatgttcaagacctactatcc

SEQ ID NO: 346867 - DNA, 37 bp, Artificial Sequence
  Description of Artificial Sequence: Synthetic oligonucleotide
tccaatggaagaatggcatgttcaagacctactatcc

SEQ ID NO: 346868 - DNA, 36 bp, Artificial Sequence
  Description of Artificial Sequence: Synthetic oligonucleotide
ccaatggaagaatggcatgttcaagacctactatcc

SEQ ID NO: 346869 - DNA, 37 bp, Artificial Sequence
  Description of Artificial Sequence: Synthetic oligonucleotide
caatggaagaatggcatgttcaagacctactatcctc

SEQ ID NO: 346870 - DNA, 39 bp, Artificial Sequence
  Description of Artificial Sequence: Synthetic oligonucleotide
aatggaagaatggcatgttcaagacctactatcctctag

SEQ ID NO: 346871 - DNA, 38 bp, Artificial Sequence
  Description of Artificial Sequence: Synthetic oligonucleotide
atggaagaatggcatgttcaagacctactatcctctag

SEQ ID NO: 346872 - DNA, 37 bp, Artificial Sequence
  Description of Artificial Sequence: Synthetic oligonucleotide
tggaagaatggcatgttcaagacctactatcctctag

SEQ ID NO: 346873 - DNA, 36 bp, Artificial Sequence
  Description of Artificial Sequence: Synthetic oligonucleotide
ggaagaatggcatgttcaagacctactatcctctag

SEQ ID NO: 346874 - DNA, 36 bp, Artificial Sequence
  Description of Artificial Sequence: Synthetic oligonucleotide
gaagaatggcatgttcaagacctactatcctctagc

SEQ ID NO: 346875 - DNA, 37 bp, Artificial Sequence
  Description of Artificial Sequence: Synthetic oligonucleotide
aagaatggcatgttcaagacctactatcctctagcag

SEQ ID NO: 346876 - DNA, 36 bp, Artificial Sequence
  Description of Artificial Sequence: Synthetic oligonucleotide
agaatggcatgttcaagacctactatcctctagcag

SEQ ID NO: 346877 - DNA, 35 bp, Artificial Sequence
  Description of Artificial Sequence: Synthetic oligonucleotide
gaatggcatgttcaagacctactatcctctagcag

SEQ ID NO: 346878 - DNA, 36 bp, Artificial Sequence
  Description of Artificial Sequence: Synthetic oligonucleotide
aatggcatgttcaagacctactatcctctagcagac

SEQ ID NO: 346879 - DNA, 35 bp, Artificial Sequence
  Description of Artificial Sequence: Synthetic oligonucleotide
atggcatgttcaagacctactatcctctagcagac

SEQ ID NO: 346880 - DNA, 34 bp, Artificial Sequence
  Description of Artificial Sequence: Synthetic oligonucleotide
tggcatgttcaagacctactatcctctagcagac

SEQ ID NO: 346881 - DNA, 33 bp, Artificial Sequence
  Description of Artificial Sequence: Synthetic oligonucleotide
ggcatgttcaagacctactatcctctagcagac

SEQ ID NO: 346882 - DNA, 34 bp, Artificial Sequence
  Description of Artificial Sequence: Synthetic oligonucleotide
gcatgttcaagacctactatcctctagcagacag

SEQ ID NO: 346883 - DNA, 35 bp, Artificial Sequence
  Description of Artificial Sequence: Synthetic oligonucleotide
catgttcaagacctactatcctctagcagacagtg

SEQ ID NO: 346884 - DNA, 36 bp, Artificial Sequence
  Description of Artificial Sequence: Synthetic oligonucleotide
atgttcaagacctactatcctctagcagacagtgtg

SEQ ID NO: 346885 - DNA, 35 bp, Artificial Sequence
  Description of Artificial Sequence: Synthetic oligonucleotide
tgttcaagacctactatcctctagcagacagtgtg

SEQ ID NO: 346886 - DNA, 34 bp, Artificial Sequence
  Description of Artificial Sequence: Synthetic oligonucleotide
gttcaagacctactatcctctagcagacagtgtg

SEQ ID NO: 346887 - DNA, 34 bp, Artificial Sequence
  Description of Artificial Sequence: Synthetic oligonucleotide
ttcaagacctactatcctctagcagacagtgtgg

SEQ ID NO: 346888 - DNA, 33 bp, Artificial Sequence
  Description of Artificial Sequence: Synthetic oligonucleotide
tcaagacctactatcctctagcagacagtgtgg

SEQ ID NO: 346889 - DNA, 32 bp, Artificial Sequence
  Description of Artificial Sequence: Synthetic oligonucleotide
caagacctactatcctctagcagacagtgtgg

SEQ ID NO: 346890 - DNA, 33 bp, Artificial Sequence
  Description of Artificial Sequence: Synthetic oligonucleotide
aagacctactatcctctagcagacagtgtggtc

SEQ ID NO: 346891 - DNA, 32 bp, Artificial Sequence
  Description of Artificial Sequence: Synthetic oligonucleotide
agacctactatcctctagcagacagtgtggtc

SEQ ID NO: 346892 - DNA, 31 bp, Artificial Sequence
  Description of Artificial Sequence: Synthetic oligonucleotide
gacctactatcctctagcagacagtgtggtc

SEQ ID NO: 346893 - DNA, 32 bp, Artificial Sequence
  Description of Artificial Sequence: Synthetic oligonucleotide
acctactatcctctagcagacagtgtggtcac

SEQ ID NO: 346894 - DNA, 31 bp, Artificial Sequence
  Description of Artificial Sequence: Synthetic oligonucleotide
cctactatcctctagcagacagtgtggtcac

SEQ ID NO: 346895 - DNA, 32 bp, Artificial Sequence
  Description of Artificial Sequence: Synthetic oligonucleotide
ctactatcctctagcagacagtgtggtcacag

SEQ ID NO: 346896 - DNA, 32 bp, Artificial Sequence
  Description of Artificial Sequence: Synthetic oligonucleotide
tactatcctctagcagacagtgtggtcacagc

SEQ ID NO: 346897 - DNA, 31 bp, Artificial Sequence
  Description of Artificial Sequence: Synthetic oligonucleotide
actatcctctagcagacagtgtggtcacagc

SEQ ID NO: 346898 - DNA, 30 bp, Artificial Sequence
  Description of Artificial Sequence: Synthetic oligonucleotide
ctatcctctagcagacagtgtggtcacagc

SEQ ID NO: 346899 - DNA, 30 bp, Artificial Sequence
  Description of Artificial Sequence: Synthetic oligonucleotide
tatcctctagcagacagtgtggtcacagcc

SEQ ID NO: 346900 - DNA, 29 bp, Artificial Sequence
  Description of Artificial Sequence: Synthetic oligonucleotide
atcctctagcagacagtgtggtcacagcc

SEQ ID NO: 346901 - DNA, 28 bp, Artificial Sequence
  Description of Artificial Sequence: Synthetic oligonucleotide
tcctctagcagacagtgtggtcacagcc

SEQ ID NO: 346902 - DNA, 27 bp, Artificial Sequence
  Description of Artificial Sequence: Synthetic oligonucleotide
cctctagcagacagtgtggtcacagcc

SEQ ID NO: 346903 - DNA, 29 bp, Artificial Sequence
  Description of Artificial Sequence: Synthetic oligonucleotide
ctctagcagacagtgtggtcacagccatc

SEQ ID NO: 346904 - DNA, 30 bp, Artificial Sequence
  Description of Artificial Sequence: Synthetic oligonucleotide
tctagcagacagtgtggtcacagccatcac

SEQ ID NO: 346905 - DNA, 29 bp, Artificial Sequence
  Description of Artificial Sequence: Synthetic oligonucleotide
ctagcagacagtgtggtcacagccatcac

SEQ ID NO: 346906 - DNA, 30 bp, Artificial Sequence
  Description of Artificial Sequence: Synthetic oligonucleotide
tagcagacagtgtggtcacagccatcacag

SEQ ID NO: 346907 - DNA, 29 bp, Artificial Sequence
  Description of Artificial Sequence: Synthetic oligonucleotide
agcagacagtgtggtcacagccatcacag

SEQ ID NO: 346908 - DNA, 28 bp, Artificial Sequence
  Description of Artificial Sequence: Synthetic oligonucleotide
gcagacagtgtggtcacagccatcacag

SEQ ID NO: 346909 - DNA, 28 bp, Artificial Sequence
  Description of Artificial Sequence: Synthetic oligonucleotide
cagacagtgtggtcacagccatcacagg

SEQ ID NO: 346910 - DNA, 28 bp, Artificial Sequence
  Description of Artificial Sequence: Synthetic oligonucleotide
agacagtgtggtcacagccatcacaggg

SEQ ID NO: 346911 - DNA, 27 bp, Artificial Sequence
  Description of Artificial Sequence: Synthetic oligonucleotide
gacagtgtggtcacagccatcacaggg

SEQ ID NO: 346912 - DNA, 28 bp, Artificial Sequence
  Description of Artificial Sequence: Synthetic oligonucleotide
acagtgtggtcacagccatcacagggtc

SEQ ID NO: 346913 - DNA, 27 bp, Artificial Sequence
  Description of Artificial Sequence: Synthetic oligonucleotide
cagtgtggtcacagccatcacagggtc

SEQ ID NO: 346914 - DNA, 29 bp, Artificial Sequence
  Description of Artificial Sequence: Synthetic oligonucleotide
agtgtggtcacagccatcacagggtcatg

SEQ ID NO: 346915 - DNA, 28 bp, Artificial Sequence
  Description of Artificial Sequence: Synthetic oligonucleotide
gtgtggtcacagccatcacagggtcatg

SEQ ID NO: 346916 - DNA, 28 bp, Artificial Sequence
  Description of Artificial Sequence: Synthetic oligonucleotide
tgtggtcacagccatcacagggtcatgc

SEQ ID NO: 346917 - DNA, 27 bp, Artificial Sequence
  Description of Artificial Sequence: Synthetic oligonucleotide
gtggtcacagccatcacagggtcatgc

SEQ ID NO: 346918 - DNA, 29 bp, Artificial Sequence
  Description of Artificial Sequence: Synthetic oligonucleotide
tggtcacagccatcacagggtcatgcttg

SEQ ID NO: 346919 - DNA, 28 bp, Artificial Sequence
  Description of Artificial Sequence: Synthetic oligonucleotide
ggtcacagccatcacagggtcatgcttg

SEQ ID NO: 346920 - DNA, 28 bp, Artificial Sequence
  Description of Artificial Sequence: Synthetic oligonucleotide
gtcacagccatcacagggtcatgcttgg

SEQ ID NO: 346921 - DNA, 28 bp, Artificial Sequence
  Description of Artificial Sequence: Synthetic oligonucleotide
tcacagccatcacagggtcatgcttggc

SEQ ID NO: 346922 - DNA, 27 bp, Artificial Sequence
  Description of Artificial Sequence: Synthetic oligonucleotide
cacagccatcacagggtcatgcttggc

SEQ ID NO: 346923 - DNA, 28 bp, Artificial Sequence
  Description of Artificial Sequence: Synthetic oligonucleotide
acagccatcacagggtcatgcttggctc

SEQ ID NO: 346924 - DNA, 27 bp, Artificial Sequence
  Description of Artificial Sequence: Synthetic oligonucleotide
cagccatcacagggtcatgcttggctc

SEQ ID NO: 346925 - DNA, 28 bp, Artificial Sequence
  Description of Artificial Sequence: Synthetic oligonucleotide
agccatcacagggtcatgcttggctcag

SEQ ID NO: 346926 - DNA, 27 bp, Artificial Sequence
  Description of Artificial Sequence: Synthetic oligonucleotide
gccatcacagggtcatgcttggctcag

SEQ ID NO: 346927 - DNA, 27 bp, Artificial Sequence
  Description of Artificial Sequence: Synthetic oligonucleotide
ccatcacagggtcatgcttggctcagc

SEQ ID NO: 346928 - DNA, 27 bp, Artificial Sequence
  Description of Artificial Sequence: Synthetic oligonucleotide
catcacagggtcatgcttggctcagcc

SEQ ID NO: 346929 - DNA, 27 bp, Artificial Sequence
  Description of Artificial Sequence: Synthetic oligonucleotide
atcacagggtcatgcttggctcagccc

SEQ ID NO: 346930 - DNA, 26 bp, Artificial Sequence
  Description of Artificial Sequence: Synthetic oligonucleotide
tcacagggtcatgcttggctcagccc

SEQ ID NO: 346931 - DNA, 25 bp, Artificial Sequence
  Description of Artificial Sequence: Synthetic oligonucleotide
cacagggtcatgcttggctcagccc

SEQ ID NO: 346932 - DNA, 27 bp, Artificial Sequence
  Description of Artificial Sequence: Synthetic oligonucleotide
acagggtcatgcttggctcagccccaa

SEQ ID NO: 346933 - DNA, 27 bp, Artificial Sequence
  Description of Artificial Sequence: Synthetic oligonucleotide
cagggtcatgcttggctcagccccaaa

SEQ ID NO: 346934 - DNA, 27 bp, Artificial Sequence
  Description of Artificial Sequence: Synthetic oligonucleotide
agggtcatgcttggctcagccccaaag

SEQ ID NO: 346935 - DNA, 26 bp, Artificial Sequence
  Description of Artificial Sequence: Synthetic oligonucleotide
gggtcatgcttggctcagccccaaag

SEQ ID NO: 346936 - DNA, 27 bp, Artificial Sequence
  Description of Artificial Sequence: Synthetic oligonucleotide
ggtcatgcttggctcagccccaaaggt

SEQ ID NO: 346937 - DNA, 28 bp, Artificial Sequence
  Description of Artificial Sequence: Synthetic oligonucleotide
gtcatgcttggctcagccccaaaggtag

SEQ ID NO: 346938 - DNA, 30 bp, Artificial Sequence
  Description of Artificial Sequence: Synthetic oligonucleotide
tcatgcttggctcagccccaaaggtagatc

SEQ ID NO: 346939 - DNA, 29 bp, Artificial Sequence
  Description of Artificial Sequence: Synthetic oligonucleotide
catgcttggctcagccccaaaggtagatc

SEQ ID NO: 346940 - DNA, 30 bp, Artificial Sequence
  Description of Artificial Sequence: Synthetic oligonucleotide
atgcttggctcagccccaaaggtagatcag

SEQ ID NO: 346941 - DNA, 29 bp, Artificial Sequence
  Description of Artificial Sequence: Synthetic oligonucleotide
tgcttggctcagccccaaaggtagatcag

SEQ ID NO: 346942 - DNA, 28 bp, Artificial Sequence
  Description of Artificial Sequence: Synthetic oligonucleotide
gcttggctcagccccaaaggtagatcag

SEQ ID NO: 346943 - DNA, 28 bp, Artificial Sequence
  Description of Artificial Sequence: Synthetic oligonucleotide
cttggctcagccccaaaggtagatcagc

SEQ ID NO: 346944 - DNA, 30 bp, Artificial Sequence
  Description of Artificial Sequence: Synthetic oligonucleotide
ttggctcagccccaaaggtagatcagcaag

SEQ ID NO: 346945 - DNA, 29 bp, Artificial Sequence
  Description of Artificial Sequence: Synthetic oligonucleotide
tggctcagccccaaaggtagatcagcaag

SEQ ID NO: 346946 - DNA, 28 bp, Artificial Sequence
  Description of Artificial Sequence: Synthetic oligonucleotide
ggctcagccccaaaggtagatcagcaag

SEQ ID NO: 346947 - DNA, 29 bp, Artificial Sequence
  Description of Artificial Sequence: Synthetic oligonucleotide
gctcagccccaaaggtagatcagcaagac

SEQ ID NO: 346948 - DNA, 33 bp, Artificial Sequence
  Description of Artificial Sequence: Synthetic oligonucleotide
ctcagccccaaaggtagatcagcaagacttatg

SEQ ID NO: 346949 - DNA, 34 bp, Artificial Sequence
  Description of Artificial Sequence: Synthetic oligonucleotide
tcagccccaaaggtagatcagcaagacttatgtc

SEQ ID NO: 346950 - DNA, 33 bp, Artificial Sequence
  Description of Artificial Sequence: Synthetic oligonucleotide
cagccccaaaggtagatcagcaagacttatgtc

SEQ ID NO: 346951 - DNA, 33 bp, Artificial Sequence
  Description of Artificial Sequence: Synthetic oligonucleotide
agccccaaaggtagatcagcaagacttatgtcc

SEQ ID NO: 346952 - DNA, 32 bp, Artificial Sequence
  Description of Artificial Sequence: Synthetic oligonucleotide
gccccaaaggtagatcagcaagacttatgtcc

SEQ ID NO: 346953 - DNA, 33 bp, Artificial Sequence
  Description of Artificial Sequence: Synthetic oligonucleotide
ccccaaaggtagatcagcaagacttatgtccac

SEQ ID NO: 346954 - DNA, 34 bp, Artificial Sequence
  Description of Artificial Sequence: Synthetic oligonucleotide
cccaaaggtagatcagcaagacttatgtccacag

SEQ ID NO: 346955 - DNA, 35 bp, Artificial Sequence
  Description of Artificial Sequence: Synthetic oligonucleotide
ccaaaggtagatcagcaagacttatgtccacagtg

SEQ ID NO: 346956 - DNA, 35 bp, Artificial Sequence
  Description of Artificial Sequence: Synthetic oligonucleotide
caaaggtagatcagcaagacttatgtccacagtgc

SEQ ID NO: 346957 - DNA, 35 bp, Artificial Sequence
  Description of Artificial Sequence: Synthetic oligonucleotide
aaaggtagatcagcaagacttatgtccacagtgcg

SEQ ID NO: 346958 - DNA, 34 bp, Artificial Sequence
  Description of Artificial Sequence: Synthetic oligonucleotide
aaggtagatcagcaagacttatgtccacagtgcg

SEQ ID NO: 346959 - DNA, 33 bp, Artificial Sequence
  Description of Artificial Sequence: Synthetic oligonucleotide
aggtagatcagcaagacttatgtccacagtgcg

SEQ ID NO: 346960 - DNA, 32 bp, Artificial Sequence
  Description of Artificial Sequence: Synthetic oligonucleotide
ggtagatcagcaagacttatgtccacagtgcg

SEQ ID NO: 346961 - DNA, 32 bp, Artificial Sequence
  Description of Artificial Sequence: Synthetic oligonucleotide
gtagatcagcaagacttatgtccacagtgcgc

SEQ ID NO: 346962 - DNA, 33 bp, Artificial Sequence
  Description of Artificial Sequence: Synthetic oligonucleotide
tagatcagcaagacttatgtccacagtgcgctg

SEQ ID NO: 346963 - DNA, 32 bp, Artificial Sequence
  Description of Artificial Sequence: Synthetic oligonucleotide
agatcagcaagacttatgtccacagtgcgctg

SEQ ID NO: 346964 - DNA, 31 bp, Artificial Sequence
  Description of Artificial Sequence: Synthetic oligonucleotide
gatcagcaagacttatgtccacagtgcgctg

SEQ ID NO: 346965 - DNA, 33 bp, Artificial Sequence
  Description of Artificial Sequence: Synthetic oligonucleotide
atcagcaagacttatgtccacagtgcgctgttg

SEQ ID NO: 346966 - DNA, 32 bp, Artificial Sequence
  Description of Artificial Sequence: Synthetic oligonucleotide
tcagcaagacttatgtccacagtgcgctgttg

SEQ ID NO: 346967 - DNA, 31 bp, Artificial Sequence
  Description of Artificial Sequence: Synthetic oligonucleotide
cagcaagacttatgtccacagtgcgctgttg

SEQ ID NO: 346968 - DNA, 31 bp, Artificial Sequence
  Description of Artificial Sequence: Synthetic oligonucleotide
agcaagacttatgtccacagtgcgctgttgg

SEQ ID NO: 346969 - DNA, 30 bp, Artificial Sequence
  Description of Artificial Sequence: Synthetic oligonucleotide
gcaagacttatgtccacagtgcgctgttgg

SEQ ID NO: 346970 - DNA, 30 bp, Artificial Sequence
  Description of Artificial Sequence: Synthetic oligonucleotide
caagacttatgtccacagtgcgctgttggc

SEQ ID NO: 346971 - DNA, 31 bp, Artificial Sequence
  Description of Artificial Sequence: Synthetic oligonucleotide
aagacttatgtccacagtgcgctgttggcag

SEQ ID NO: 346972 - DNA, 30 bp, Artificial Sequence
  Description of Artificial Sequence: Synthetic oligonucleotide
agacttatgtccacagtgcgctgttggcag

SEQ ID NO: 346973 - DNA, 29 bp, Artificial Sequence
  Description of Artificial Sequence: Synthetic oligonucleotide
gacttatgtccacagtgcgctgttggcag

SEQ ID NO: 346974 - DNA, 29 bp, Artificial Sequence
  Description of Artificial Sequence: Synthetic oligonucleotide
acttatgtccacagtgcgctgttggcagc

SEQ ID NO: 346975 - DNA, 28 bp, Artificial Sequence
  Description of Artificial Sequence: Synthetic oligonucleotide
cttatgtccacagtgcgctgttggcagc

SEQ ID NO: 346976 - DNA, 29 bp, Artificial Sequence
  Description of Artificial Sequence: Synthetic oligonucleotide
ttatgtccacagtgcgctgttggcagcag

SEQ ID NO: 346977 - DNA, 28 bp, Artificial Sequence
  Description of Artificial Sequence: Synthetic oligonucleotide
tatgtccacagtgcgctgttggcagcag

SEQ ID NO: 346978 - DNA, 27 bp, Artificial Sequence
  Description of Artificial Sequence: Synthetic oligonucleotide
atgtccacagtgcgctgttggcagcag

SEQ ID NO: 346979 - DNA, 26 bp, Artificial Sequence
  Description of Artificial Sequence: Synthetic oligonucleotide
tgtccacagtgcgctgttggcagcag

SEQ ID NO: 346980 - DNA, 25 bp, Artificial Sequence
  Description of Artificial Sequence: Synthetic oligonucleotide
gtccacagtgcgctgttggcagcag

SEQ ID NO: 346981 - DNA, 25 bp, Artificial Sequence
  Description of Artificial Sequence: Synthetic oligonucleotide
tccacagtgcgctgttggcagcagg

SEQ ID NO: 346982 - DNA, 24 bp, Artificial Sequence
  Description of Artificial Sequence: Synthetic oligonucleotide
ccacagtgcgctgttggcagcagg

SEQ ID NO: 346983 - DNA, 24 bp, Artificial Sequence
  Description of Artificial Sequence: Synthetic oligonucleotide
cacagtgcgctgttggcagcaggc

SEQ ID NO: 346984 - DNA, 25 bp, Artificial Sequence
  Description of Artificial Sequence: Synthetic oligonucleotide
acagtgcgctgttggcagcaggcgt

SEQ ID NO: 346985 - DNA, 24 bp, Artificial Sequence
  Description of Artificial Sequence: Synthetic oligonucleotide
cagtgcgctgttggcagcaggcgt

SEQ ID NO: 346986 - DNA, 24 bp, Artificial Sequence
  Description of Artificial Sequence: Synthetic oligonucleotide
agtgcgctgttggcagcaggcgtg

SEQ ID NO: 346987 - DNA, 23 bp, Artificial Sequence
  Description of Artificial Sequence: Synthetic oligonucleotide
gtgcgctgttggcagcaggcgtg

SEQ ID NO: 346988 - DNA, 23 bp, Artificial Sequence
  Description of Artificial Sequence: Synthetic oligonucleotide
tgcgctgttggcagcaggcgtgg

SEQ ID NO: 346989 - DNA, 22 bp, Artificial Sequence
  Description of Artificial Sequence: Synthetic oligonucleotide
gcgctgttggcagcaggcgtgg

SEQ ID NO: 346990 - DNA, 23 bp, Artificial Sequence
  Description of Artificial Sequence: Synthetic oligonucleotide
cgctgttggcagcaggcgtggca

SEQ ID NO: 346991 - DNA, 24 bp, Artificial Sequence
  Description of Artificial Sequence: Synthetic oligonucleotide
gctgttggcagcaggcgtggcagt

SEQ ID NO: 346992 - DNA, 24 bp, Artificial Sequence
  Description of Artificial Sequence: Synthetic oligonucleotide
ctgttggcagcaggcgtggcagtg

SEQ ID NO: 346993 - DNA, 24 bp, Artificial Sequence
  Description of Artificial Sequence: Synthetic oligonucleotide
tgttggcagcaggcgtggcagtgg

SEQ ID NO: 346994 - DNA, 23 bp, Artificial Sequence
  Description of Artificial Sequence: Synthetic oligonucleotide
gttggcagcaggcgtggcagtgg

SEQ ID NO: 346995 - DNA, 25 bp, Artificial Sequence
  Description of Artificial Sequence: Synthetic oligonucleotide
ttggcagcaggcgtggcagtgggta

SEQ ID NO: 346996 - DNA, 24 bp, Artificial Sequence
  Description of Artificial Sequence: Synthetic oligonucleotide
tggcagcaggcgtggcagtgggta

SEQ ID NO: 346997 - DNA, 23 bp, Artificial Sequence
  Description of Artificial Sequence: Synthetic oligonucleotide
ggcagcaggcgtggcagtgggta

SEQ ID NO: 346998 - DNA, 23 bp, Artificial Sequence
  Description of Artificial Sequence: Synthetic oligonucleotide
gcagcaggcgtggcagtgggtac

SEQ ID NO: 346999 - DNA, 24 bp, Artificial Sequence
  Description of Artificial Sequence: Synthetic oligonucleotide
cagcaggcgtggcagtgggtacca

SEQ ID NO: 347000 - DNA, 24 bp, Artificial Sequence
  Description of Artificial Sequence: Synthetic oligonucleotide
agcaggcgtggcagtgggtaccac

SEQ ID NO: 347001 - DNA, 23 bp, Artificial Sequence
  Description of Artificial Sequence: Synthetic oligonucleotide
gcaggcgtggcagtgggtaccac

SEQ ID NO: 347002 - DNA, 24 bp, Artificial Sequence
  Description of Artificial Sequence: Synthetic oligonucleotide
caggcgtggcagtgggtaccacgt

SEQ ID NO: 347003 - DNA, 25 bp, Artificial Sequence
  Description of Artificial Sequence: Synthetic oligonucleotide
aggcgtggcagtgggtaccacgtgt

SEQ ID NO: 347004 - DNA, 24 bp, Artificial Sequence
  Description of Artificial Sequence: Synthetic oligonucleotide
ggcgtggcagtgggtaccacgtgt

SEQ ID NO: 347005 - DNA, 25 bp, Artificial Sequence
  Description of Artificial Sequence: Synthetic oligonucleotide
gcgtggcagtgggtaccacgtgtca

SEQ ID NO: 347006 - DNA, 25 bp, Artificial Sequence
  Description of Artificial Sequence: Synthetic oligonucleotide
cgtggcagtgggtaccacgtgtcac

SEQ ID NO: 347007 - DNA, 26 bp, Artificial Sequence
  Description of Artificial Sequence: Synthetic oligonucleotide
gtggcagtgggtaccacgtgtcacca

SEQ ID NO: 347008 - DNA, 27 bp, Artificial Sequence
  Description of Artificial Sequence: Synthetic oligonucleotide
tggcagtgggtaccacgtgtcaccaga

SEQ ID NO: 347009 - DNA, 27 bp, Artificial Sequence
  Description of Artificial Sequence: Synthetic oligonucleotide
ggcagtgggtaccacgtgtcaccagat

SEQ ID NO: 347010 - DNA, 27 bp, Artificial Sequence
  Description of Artificial Sequence: Synthetic oligonucleotide
gcagtgggtaccacgtgtcaccagatc

SEQ ID NO: 347011 - DNA, 27 bp, Artificial Sequence
  Description of Artificial Sequence: Synthetic oligonucleotide
cagtgggtaccacgtgtcaccagatcc

SEQ ID NO: 347012 - DNA, 27 bp, Artificial Sequence
  Description of Artificial Sequence: Synthetic oligonucleotide
agtgggtaccacgtgtcaccagatccc

SEQ ID NO: 347013 - DNA, 27 bp, Artificial Sequence
  Description of Artificial Sequence: Synthetic oligonucleotide
gtgggtaccacgtgtcaccagatccct

SEQ ID NO: 347014 - DNA, 28 bp, Artificial Sequence
  Description of Artificial Sequence: Synthetic oligonucleotide
tgggtaccacgtgtcaccagatcccttc

SEQ ID NO: 347015 - DNA, 27 bp, Artificial Sequence
  Description of Artificial Sequence: Synthetic oligonucleotide
gggtaccacgtgtcaccagatcccttc

SEQ ID NO: 347016 - DNA, 28 bp, Artificial Sequence
  Description of Artificial Sequence: Synthetic oligonucleotide
ggtaccacgtgtcaccagatcccttcac

SEQ ID NO: 347017 - DNA, 28 bp, Artificial Sequence
  Description of Artificial Sequence: Synthetic oligonucleotide
gtaccacgtgtcaccagatcccttcacc

SEQ ID NO: 347018 - DNA, 28 bp, Artificial Sequence
  Description of Artificial Sequence: Synthetic oligonucleotide
taccacgtgtcaccagatcccttcaccg

SEQ ID NO: 347019 - DNA, 27 bp, Artificial Sequence
  Description of Artificial Sequence: Synthetic oligonucleotide
accacgtgtcaccagatcccttcaccg

SEQ ID NO: 347020 - DNA, 27 bp, Artificial Sequence
  Description of Artificial Sequence: Synthetic oligonucleotide
ccacgtgtcaccagatcccttcaccgt

SEQ ID NO: 347021 - DNA, 27 bp, Artificial Sequence
  Description of Artificial Sequence: Synthetic oligonucleotide
cacgtgtcaccagatcccttcaccgtg

SEQ ID NO: 347022 - DNA, 27 bp, Artificial Sequence
  Description of Artificial Sequence: Synthetic oligonucleotide
acgtgtcaccagatcccttcaccgtgg

SEQ ID NO: 347023 - DNA, 26 bp, Artificial Sequence
  Description of Artificial Sequence: Synthetic oligonucleotide
cgtgtcaccagatcccttcaccgtgg

SEQ ID NO: 347024 - DNA, 27 bp, Artificial Sequence
  Description of Artificial Sequence: Synthetic oligonucleotide
gtgtcaccagatcccttcaccgtggct

SEQ ID NO: 347025 - DNA, 28 bp, Artificial Sequence
  Description of Artificial Sequence: Synthetic oligonucleotide
tgtcaccagatcccttcaccgtggcttc

SEQ ID NO: 347026 - DNA, 27 bp, Artificial Sequence
  Description of Artificial Sequence: Synthetic oligonucleotide
gtcaccagatcccttcaccgtggcttc

SEQ ID NO: 347027 - DNA, 27 bp, Artificial Sequence
  Description of Artificial Sequence: Synthetic oligonucleotide
tcaccagatcccttcaccgtggcttcc

SEQ ID NO: 347028 - DNA, 26 bp, Artificial Sequence
  Description of Artificial Sequence: Synthetic oligonucleotide
caccagatcccttcaccgtggcttcc

SEQ ID NO: 347029 - DNA, 27 bp, Artificial Sequence
  Description of Artificial Sequence: Synthetic oligonucleotide
accagatcccttcaccgtggcttccca

SEQ ID NO: 347030 - DNA, 27 bp, Artificial Sequence
  Description of Artificial Sequence: Synthetic oligonucleotide
ccagatcccttcaccgtggcttcccat

SEQ ID NO: 347031 - DNA, 27 bp, Artificial Sequence
  Description of Artificial Sequence: Synthetic oligonucleotide
cagatcccttcaccgtggcttcccatg

SEQ ID NO: 347032 - DNA, 27 bp, Artificial Sequence
  Description of Artificial Sequence: Synthetic oligonucleotide
agatcccttcaccgtggcttcccatgg

SEQ ID NO: 347033 - DNA, 27 bp, Artificial Sequence
  Description of Artificial Sequence: Synthetic oligonucleotide
gatcccttcaccgtggcttcccatggt

SEQ ID NO: 347034 - DNA, 27 bp, Artificial Sequence
  Description of Artificial Sequence: Synthetic oligonucleotide
atcccttcaccgtggcttcccatggtg

SEQ ID NO: 347035 - DNA, 26 bp, Artificial Sequence
  Description of Artificial Sequence: Synthetic oligonucleotide
tcccttcaccgtggcttcccatggtg

SEQ ID NO: 347036 - DNA, 25 bp, Artificial Sequence
  Description of Artificial Sequence: Synthetic oligonucleotide
cccttcaccgtggcttcccatggtg

SEQ ID NO: 347037 - DNA, 26 bp, Artificial Sequence
  Description of Artificial Sequence: Synthetic oligonucleotide
ccttcaccgtggcttcccatggtgca

SEQ ID NO: 347038 - DNA, 26 bp, Artificial Sequence
  Description of Artificial Sequence: Synthetic oligonucleotide
cttcaccgtggcttcccatggtgcag

SEQ ID NO: 347039 - DNA, 26 bp, Artificial Sequence
  Description of Artificial Sequence: Synthetic oligonucleotide
ttcaccgtggcttcccatggtgcagg

SEQ ID NO: 347040 - DNA, 25 bp, Artificial Sequence
  Description of Artificial Sequence: Synthetic oligonucleotide
tcaccgtggcttcccatggtgcagg

SEQ ID NO: 347041 - DNA, 24 bp, Artificial Sequence
  Description of Artificial Sequence: Synthetic oligonucleotide
caccgtggcttcccatggtgcagg

SEQ ID NO: 347042 - DNA, 25 bp, Artificial Sequence
  Description of Artificial Sequence: Synthetic oligonucleotide
accgtggcttcccatggtgcagggt

SEQ ID NO: 347043 - DNA, 24 bp, Artificial Sequence
  Description of Artificial Sequence: Synthetic oligonucleotide
ccgtggcttcccatggtgcagggt

SEQ ID NO: 347044 - DNA, 26 bp, Artificial Sequence
  Description of Artificial Sequence: Synthetic oligonucleotide
cgtggcttcccatggtgcagggtctt

SEQ ID NO: 347045 - DNA, 27 bp, Artificial Sequence
  Description of Artificial Sequence: Synthetic oligonucleotide
gtggcttcccatggtgcagggtcttgt

SEQ ID NO: 347046 - DNA, 27 bp, Artificial Sequence
  Description of Artificial Sequence: Synthetic oligonucleotide
tggcttcccatggtgcagggtcttgtc

SEQ ID NO: 347047 - DNA, 26 bp, Artificial Sequence
  Description of Artificial Sequence: Synthetic oligonucleotide
ggcttcccatggtgcagggtcttgtc

SEQ ID NO: 347048 - DNA, 26 bp, Artificial Sequence
  Description of Artificial Sequence: Synthetic oligonucleotide
gcttcccatggtgcagggtcttgtcg

SEQ ID NO: 347049 - DNA, 27 bp, Artificial Sequence
  Description of Artificial Sequence: Synthetic oligonucleotide
cttcccatggtgcagggtcttgtcgct

SEQ ID NO: 347050 - DNA, 27 bp, Artificial Sequence
  Description of Artificial Sequence: Synthetic oligonucleotide
ttcccatggtgcagggtcttgtcgctg

SEQ ID NO: 347051 - DNA, 26 bp, Artificial Sequence
  Description of Artificial Sequence: Synthetic oligonucleotide
tcccatggtgcagggtcttgtcgctg

SEQ ID NO: 347052 - DNA, 25 bp, Artificial Sequence
  Description of Artificial Sequence: Synthetic oligonucleotide
cccatggtgcagggtcttgtcgctg

SEQ ID NO: 347053 - DNA, 25 bp, Artificial Sequence
  Description of Artificial Sequence: Synthetic oligonucleotide
ccatggtgcagggtcttgtcgctgg

SEQ ID NO: 347054 - DNA, 25 bp, Artificial Sequence
  Description of Artificial Sequence: Synthetic oligonucleotide
catggtgcagggtcttgtcgctggg

SEQ ID NO: 347055 - DNA, 26 bp, Artificial Sequence
  Description of Artificial Sequence: Synthetic oligonucleotide
atggtgcagggtcttgtcgctgggct

SEQ ID NO: 347056 - DNA, 25 bp, Artificial Sequence
  Description of Artificial Sequence: Synthetic oligonucleotide
tggtgcagggtcttgtcgctgggct

SEQ ID NO: 347057 - DNA, 24 bp, Artificial Sequence
  Description of Artificial Sequence: Synthetic oligonucleotide
ggtgcagggtcttgtcgctgggct

SEQ ID NO: 347058 - DNA, 26 bp, Artificial Sequence
  Description of Artificial Sequence: Synthetic oligonucleotide
gtgcagggtcttgtcgctgggctgtt

SEQ ID NO: 347059 - DNA, 27 bp, Artificial Sequence
  Description of Artificial Sequence: Synthetic oligonucleotide
tgcagggtcttgtcgctgggctgttct

SEQ ID NO: 347060 - DNA, 26 bp, Artificial Sequence
  Description of Artificial Sequence: Synthetic oligonucleotide
gcagggtcttgtcgctgggctgttct

SEQ ID NO: 347061 - DNA, 26 bp, Artificial Sequence
  Description of Artificial Sequence: Synthetic oligonucleotide
cagggtcttgtcgctgggctgttctc

SEQ ID NO: 347062 - DNA, 27 bp, Artificial Sequence
  Description of Artificial Sequence: Synthetic oligonucleotide
agggtcttgtcgctgggctgttctcca

SEQ ID NO: 347063 - DNA, 27 bp, Artificial Sequence
  Description of Artificial Sequence: Synthetic oligonucleotide
gggtcttgtcgctgggctgttctccat

SEQ ID NO: 347064 - DNA, 27 bp, Artificial Sequence
  Description of Artificial Sequence: Synthetic oligonucleotide
ggtcttgtcgctgggctgttctccatc

SEQ ID NO: 347065 - DNA, 27 bp, Artificial Sequence
  Description of Artificial Sequence: Synthetic oligonucleotide
gtcttgtcgctgggctgttctccatcg

SEQ ID NO: 347066 - DNA, 27 bp, Artificial Sequence
  Description of Artificial Sequence: Synthetic oligonucleotide
tcttgtcgctgggctgttctccatcgc

SEQ ID NO: 347067 - DNA, 26 bp, Artificial Sequence
  Description of Artificial Sequence: Synthetic oligonucleotide
cttgtcgctgggctgttctccatcgc

SEQ ID NO: 347068 - DNA, 26 bp, Artificial Sequence
  Description of Artificial Sequence: Synthetic oligonucleotide
ttgtcgctgggctgttctccatcgcg

SEQ ID NO: 347069 - DNA, 25 bp, Artificial Sequence
  Description of Artificial Sequence: Synthetic oligonucleotide
tgtcgctgggctgttctccatcgcg

SEQ ID NO: 347070 - DNA, 24 bp, Artificial Sequence
  Description of Artificial Sequence: Synthetic oligonucleotide
gtcgctgggctgttctccatcgcg

SEQ ID NO: 347071 - DNA, 24 bp, Artificial Sequence
  Description of Artificial Sequence: Synthetic oligonucleotide
tcgctgggctgttctccatcgcgg

SEQ ID NO: 347072 - DNA, 23 bp, Artificial Sequence
  Description of Artificial Sequence: Synthetic oligonucleotide
cgctgggctgttctccatcgcgg

SEQ ID NO: 347073 - DNA, 24 bp, Artificial Sequence
  Description of Artificial Sequence: Synthetic oligonucleotide
gctgggctgttctccatcgcggga

SEQ ID NO: 347074 - DNA, 24 bp, Artificial Sequence
  Description of Artificial Sequence: Synthetic oligonucleotide
ctgggctgttctccatcgcgggag

SEQ ID NO: 347075 - DNA, 24 bp, Artificial Sequence
  Description of Artificial Sequence: Synthetic oligonucleotide
tgggctgttctccatcgcgggagc

SEQ ID NO: 347076 - DNA, 23 bp, Artificial Sequence
  Description of Artificial Sequence: Synthetic oligonucleotide
gggctgttctccatcgcgggagc

SEQ ID NO: 347077 - DNA, 25 bp, Artificial Sequence
  Description of Artificial Sequence: Synthetic oligonucleotide
ggctgttctccatcgcgggagccaa

SEQ ID NO: 347078 - DNA, 26 bp, Artificial Sequence
  Description of Artificial Sequence: Synthetic oligonucleotide
gctgttctccatcgcgggagccaact

SEQ ID NO: 347079 - DNA, 26 bp, Artificial Sequence
  Description of Artificial Sequence: Synthetic oligonucleotide
ctgttctccatcgcgggagccaactg

SEQ ID NO: 347080 - DNA, 26 bp, Artificial Sequence
  Description of Artificial Sequence: Synthetic oligonucleotide
tgttctccatcgcgggagccaactgc

SEQ ID NO: 347081 - DNA, 25 bp, Artificial Sequence
  Description of Artificial Sequence: Synthetic oligonucleotide
gttctccatcgcgggagccaactgc

SEQ ID NO: 347082 - DNA, 26 bp, Artificial Sequence
  Description of Artificial Sequence: Synthetic oligonucleotide
ttctccatcgcgggagccaactgcct

SEQ ID NO: 347083 - DNA, 25 bp, Artificial Sequence
  Description of Artificial Sequence: Synthetic oligonucleotide
tctccatcgcgggagccaactgcct

SEQ ID NO: 347084 - DNA, 24 bp, Artificial Sequence
  Description of Artificial Sequence: Synthetic oligonucleotide
ctccatcgcgggagccaactgcct

SEQ ID NO: 347085 - DNA, 24 bp, Artificial Sequence
  Description of Artificial Sequence: Synthetic oligonucleotide
tccatcgcgggagccaactgcctg

SEQ ID NO: 347086 - DNA, 23 bp, Artificial Sequence
  Description of Artificial Sequence: Synthetic oligonucleotide
ccatcgcgggagccaactgcctg

SEQ ID NO: 347087 - DNA, 23 bp, Artificial Sequence
  Description of Artificial Sequence: Synthetic oligonucleotide
catcgcgggagccaactgcctgc

SEQ ID NO: 347088 - DNA, 23 bp, Artificial Sequence
  Description of Artificial Sequence: Synthetic oligonucleotide
atcgcgggagccaactgcctgcc

SEQ ID NO: 347089 - DNA, 22 bp, Artificial Sequence
  Description of Artificial Sequence: Synthetic oligonucleotide
tcgcgggagccaactgcctgcc

SEQ ID NO: 347090 - DNA, 21 bp, Artificial Sequence
  Description of Artificial Sequence: Synthetic oligonucleotide
cgcgggagccaactgcctgcc

SEQ ID NO: 347091 - DNA, 21 bp, Artificial Sequence
  Description of Artificial Sequence: Synthetic oligonucleotide
gcgggagccaactgcctgccg

SEQ ID NO: 347092 - DNA, 22 bp, Artificial Sequence
  Description of Artificial Sequence: Synthetic oligonucleotide
cgggagccaactgcctgccgct

SEQ ID NO: 347093 - DNA, 23 bp, Artificial Sequence
  Description of Artificial Sequence: Synthetic oligonucleotide
gggagccaactgcctgccgctgt

SEQ ID NO: 347094 - DNA, 25 bp, Artificial Sequence
  Description of Artificial Sequence: Synthetic oligonucleotide
ggagccaactgcctgccgctgtgtt

SEQ ID NO: 347095 - DNA, 27 bp, Artificial Sequence
  Description of Artificial Sequence: Synthetic oligonucleotide
gagccaactgcctgccgctgtgttgta

SEQ ID NO: 347096 - DNA, 28 bp, Artificial Sequence
  Description of Artificial Sequence: Synthetic oligonucleotide
agccaactgcctgccgctgtgttgtatc

SEQ ID NO: 347097 - DNA, 27 bp, Artificial Sequence
  Description of Artificial Sequence: Synthetic oligonucleotide
gccaactgcctgccgctgtgttgtatc

SEQ ID NO: 347098 - DNA, 27 bp, Artificial Sequence
  Description of Artificial Sequence: Synthetic oligonucleotide
ccaactgcctgccgctgtgttgtatcc

SEQ ID NO: 347099 - DNA, 27 bp, Artificial Sequence
  Description of Artificial Sequence: Synthetic oligonucleotide
caactgcctgccgctgtgttgtatccg

SEQ ID NO: 347100 - DNA, 28 bp, Artificial Sequence
  Description of Artificial Sequence: Synthetic oligonucleotide
aactgcctgccgctgtgttgtatccgag

SEQ ID NO: 347101 - DNA, 27 bp, Artificial Sequence
  Description of Artificial Sequence: Synthetic oligonucleotide
actgcctgccgctgtgttgtatccgag

SEQ ID NO: 347102 - DNA, 27 bp, Artificial Sequence
  Description of Artificial Sequence: Synthetic oligonucleotide
ctgcctgccgctgtgttgtatccgagt

SEQ ID NO: 347103 - DNA, 27 bp, Artificial Sequence
  Description of Artificial Sequence: Synthetic oligonucleotide
tgcctgccgctgtgttgtatccgagtg

SEQ ID NO: 347104 - DNA, 26 bp, Artificial Sequence
  Description of Artificial Sequence: Synthetic oligonucleotide
gcctgccgctgtgttgtatccgagtg

SEQ ID NO: 347105 - DNA, 27 bp, Artificial Sequence
  Description of Artificial Sequence: Synthetic oligonucleotide
cctgccgctgtgttgtatccgagtgct

SEQ ID NO: 347106 - DNA, 27 bp, Artificial Sequence
  Description of Artificial Sequence: Synthetic oligonucleotide
ctgccgctgtgttgtatccgagtgctc

SEQ ID NO: 347107 - DNA, 27 bp, Artificial Sequence
  Description of Artificial Sequence: Synthetic oligonucleotide
tgccgctgtgttgtatccgagtgctcg

SEQ ID NO: 347108 - DNA, 26 bp, Artificial Sequence
  Description of Artificial Sequence: Synthetic oligonucleotide
gccgctgtgttgtatccgagtgctcg

SEQ ID NO: 347109 - DNA, 26 bp, Artificial Sequence
  Description of Artificial Sequence: Synthetic oligonucleotide
ccgctgtgttgtatccgagtgctcgg

SEQ ID NO: 347110 - DNA, 27 bp, Artificial Sequence
  Description of Artificial Sequence: Synthetic oligonucleotide
cgctgtgttgtatccgagtgctcggga

SEQ ID NO: 347111 - DNA, 29 bp, Artificial Sequence
  Description of Artificial Sequence: Synthetic oligonucleotide
gctgtgttgtatccgagtgctcgggattc

SEQ ID NO: 347112 - DNA, 30 bp, Artificial Sequence
  Description of Artificial Sequence: Synthetic oligonucleotide
ctgtgttgtatccgagtgctcgggattcac

SEQ ID NO: 347113 - DNA, 30 bp, Artificial Sequence
  Description of Artificial Sequence: Synthetic oligonucleotide
tgtgttgtatccgagtgctcgggattcacg

SEQ ID NO: 347114 - DNA, 29 bp, Artificial Sequence
  Description of Artificial Sequence: Synthetic oligonucleotide
gtgttgtatccgagtgctcgggattcacg

SEQ ID NO: 347115 - DNA, 30 bp, Artificial Sequence
  Description of Artificial Sequence: Synthetic oligonucleotide
tgttgtatccgagtgctcgggattcacgac

SEQ ID NO: 347116 - DNA, 29 bp, Artificial Sequence
  Description of Artificial Sequence: Synthetic oligonucleotide
gttgtatccgagtgctcgggattcacgac

SEQ ID NO: 347117 - DNA, 31 bp, Artificial Sequence
  Description of Artificial Sequence: Synthetic oligonucleotide
ttgtatccgagtgctcgggattcacgacatc

SEQ ID NO: 347118 - DNA, 30 bp, Artificial Sequence
  Description of Artificial Sequence: Synthetic oligonucleotide
tgtatccgagtgctcgggattcacgacatc

SEQ ID NO: 347119 - DNA, 29 bp, Artificial Sequence
  Description of Artificial Sequence: Synthetic oligonucleotide
gtatccgagtgctcgggattcacgacatc

SEQ ID NO: 347120 - DNA, 30 bp, Artificial Sequence
  Description of Artificial Sequence: Synthetic oligonucleotide
tatccgagtgctcgggattcacgacatctc

SEQ ID NO: 347121 - DNA, 29 bp, Artificial Sequence
  Description of Artificial Sequence: Synthetic oligonucleotide
atccgagtgctcgggattcacgacatctc

SEQ ID NO: 347122 - DNA, 28 bp, Artificial Sequence
  Description of Artificial Sequence: Synthetic oligonucleotide
tccgagtgctcgggattcacgacatctc

SEQ ID NO: 347123 - DNA, 27 bp, Artificial Sequence
  Description of Artificial Sequence: Synthetic oligonucleotide
ccgagtgctcgggattcacgacatctc

SEQ ID NO: 347124 - DNA, 27 bp, Artificial Sequence
  Description of Artificial Sequence: Synthetic oligonucleotide
cgagtgctcgggattcacgacatctcc

SEQ ID NO: 347125 - DNA, 27 bp, Artificial Sequence
  Description of Artificial Sequence: Synthetic oligonucleotide
gagtgctcgggattcacgacatctccg

SEQ ID NO: 347126 - DNA, 28 bp, Artificial Sequence
  Description of Artificial Sequence: Synthetic oligonucleotide
agtgctcgggattcacgacatctccgac

SEQ ID NO: 347127 - DNA, 27 bp, Artificial Sequence
  Description of Artificial Sequence: Synthetic oligonucleotide
gtgctcgggattcacgacatctccgac

SEQ ID NO: 347128 - DNA, 29 bp, Artificial Sequence
  Description of Artificial Sequence: Synthetic oligonucleotide
tgctcgggattcacgacatctccgacatg

SEQ ID NO: 347129 - DNA, 28 bp, Artificial Sequence
  Description of Artificial Sequence: Synthetic oligonucleotide
gctcgggattcacgacatctccgacatg

SEQ ID NO: 347130 - DNA, 28 bp, Artificial Sequence
  Description of Artificial Sequence: Synthetic oligonucleotide
ctcgggattcacgacatctccgacatgc

SEQ ID NO: 347131 - DNA, 29 bp, Artificial Sequence
  Description of Artificial Sequence: Synthetic oligonucleotide
tcgggattcacgacatctccgacatgcac

SEQ ID NO: 347132 - DNA, 28 bp, Artificial Sequence
  Description of Artificial Sequence: Synthetic oligonucleotide
cgggattcacgacatctccgacatgcac

SEQ ID NO: 347133 - DNA, 29 bp, Artificial Sequence
  Description of Artificial Sequence: Synthetic oligonucleotide
gggattcacgacatctccgacatgcactc

SEQ ID NO: 347134 - DNA, 29 bp, Artificial Sequence
  Description of Artificial Sequence: Synthetic oligonucleotide
ggattcacgacatctccgacatgcactcg

SEQ ID NO: 347135 - DNA, 31 bp, Artificial Sequence
  Description of Artificial Sequence: Synthetic oligonucleotide
gattcacgacatctccgacatgcactcgatc

SEQ ID NO: 347136 - DNA, 33 bp, Artificial Sequence
  Description of Artificial Sequence: Synthetic oligonucleotide
attcacgacatctccgacatgcactcgatcttc

SEQ ID NO: 347137 - DNA, 32 bp, Artificial Sequence
  Description of Artificial Sequence: Synthetic oligonucleotide
ttcacgacatctccgacatgcactcgatcttc

SEQ ID NO: 347138 - DNA, 31 bp, Artificial Sequence
  Description of Artificial Sequence: Synthetic oligonucleotide
tcacgacatctccgacatgcactcgatcttc

SEQ ID NO: 347139 - DNA, 30 bp, Artificial Sequence
  Description of Artificial Sequence: Synthetic oligonucleotide
cacgacatctccgacatgcactcgatcttc

SEQ ID NO: 347140 - DNA, 31 bp, Artificial Sequence
  Description of Artificial Sequence: Synthetic oligonucleotide
acgacatctccgacatgcactcgatcttcag

SEQ ID NO: 347141 - DNA, 30 bp, Artificial Sequence
  Description of Artificial Sequence: Synthetic oligonucleotide
cgacatctccgacatgcactcgatcttcag

SEQ ID NO: 347142 - DNA, 30 bp, Artificial Sequence
  Description of Artificial Sequence: Synthetic oligonucleotide
gacatctccgacatgcactcgatcttcagc

SEQ ID NO: 347143 - DNA, 32 bp, Artificial Sequence
  Description of Artificial Sequence: Synthetic oligonucleotide
acatctccgacatgcactcgatcttcagcatg

SEQ ID NO: 347144 - DNA, 31 bp, Artificial Sequence
  Description of Artificial Sequence: Synthetic oligonucleotide
catctccgacatgcactcgatcttcagcatg

SEQ ID NO: 347145 - DNA, 31 bp, Artificial Sequence
  Description of Artificial Sequence: Synthetic oligonucleotide
atctccgacatgcactcgatcttcagcatgc

SEQ ID NO: 347146 - DNA, 30 bp, Artificial Sequence
  Description of Artificial Sequence: Synthetic oligonucleotide
tctccgacatgcactcgatcttcagcatgc

SEQ ID NO: 347147 - DNA, 29 bp, Artificial Sequence
  Description of Artificial Sequence: Synthetic oligonucleotide
ctccgacatgcactcgatcttcagcatgc

SEQ ID NO: 347148 - DNA, 30 bp, Artificial Sequence
  Description of Artificial Sequence: Synthetic oligonucleotide
tccgacatgcactcgatcttcagcatgctg

SEQ ID NO: 347149 - DNA, 29 bp, Artificial Sequence
  Description of Artificial Sequence: Synthetic oligonucleotide
ccgacatgcactcgatcttcagcatgctg

SEQ ID NO: 347150 - DNA, 29 bp, Artificial Sequence
  Description of Artificial Sequence: Synthetic oligonucleotide
cgacatgcactcgatcttcagcatgctgg

SEQ ID NO: 347151 - DNA, 29 bp, Artificial Sequence
  Description of Artificial Sequence: Synthetic oligonucleotide
gacatgcactcgatcttcagcatgctggg

SEQ ID NO: 347152 - DNA, 30 bp, Artificial Sequence
  Description of Artificial Sequence: Synthetic oligonucleotide
acatgcactcgatcttcagcatgctgggtc

SEQ ID NO: 347153 - DNA, 29 bp, Artificial Sequence
  Description of Artificial Sequence: Synthetic oligonucleotide
catgcactcgatcttcagcatgctgggtc

SEQ ID NO: 347154 - DNA, 30 bp, Artificial Sequence
  Description of Artificial Sequence: Synthetic oligonucleotide
atgcactcgatcttcagcatgctgggtcag

SEQ ID NO: 347155 - DNA, 29 bp, Artificial Sequence
  Description of Artificial Sequence: Synthetic oligonucleotide
tgcactcgatcttcagcatgctgggtcag

SEQ ID NO: 347156 - DNA, 28 bp, Artificial Sequence
  Description of Artificial Sequence: Synthetic oligonucleotide
gcactcgatcttcagcatgctgggtcag

SEQ ID NO: 347157 - DNA, 28 bp, Artificial Sequence
  Description of Artificial Sequence: Synthetic oligonucleotide
cactcgatcttcagcatgctgggtcagc

SEQ ID NO: 347158 - DNA, 30 bp, Artificial Sequence
  Description of Artificial Sequence: Synthetic oligonucleotide
actcgatcttcagcatgctgggtcagcttg

SEQ ID NO: 347159 - DNA, 29 bp, Artificial Sequence
  Description of Artificial Sequence: Synthetic oligonucleotide
ctcgatcttcagcatgctgggtcagcttg

SEQ ID NO: 347160 - DNA, 29 bp, Artificial Sequence
  Description of Artificial Sequence: Synthetic oligonucleotide
tcgatcttcagcatgctgggtcagcttgg

SEQ ID NO: 347161 - DNA, 28 bp, Artificial Sequence
  Description of Artificial Sequence: Synthetic oligonucleotide
cgatcttcagcatgctgggtcagcttgg

SEQ ID NO: 347162 - DNA, 29 bp, Artificial Sequence
  Description of Artificial Sequence: Synthetic oligonucleotide
gatcttcagcatgctgggtcagcttggag

SEQ ID NO: 347163 - DNA, 30 bp, Artificial Sequence
  Description of Artificial Sequence: Synthetic oligonucleotide
atcttcagcatgctgggtcagcttggagac

SEQ ID NO: 347164 - DNA, 29 bp, Artificial Sequence
  Description of Artificial Sequence: Synthetic oligonucleotide
tcttcagcatgctgggtcagcttggagac

SEQ ID NO: 347165 - DNA, 28 bp, Artificial Sequence
  Description of Artificial Sequence: Synthetic oligonucleotide
cttcagcatgctgggtcagcttggagac

SEQ ID NO: 347166 - DNA, 30 bp, Artificial Sequence
  Description of Artificial Sequence: Synthetic oligonucleotide
ttcagcatgctgggtcagcttggagacatc

SEQ ID NO: 347167 - DNA, 29 bp, Artificial Sequence
  Description of Artificial Sequence: Synthetic oligonucleotide
tcagcatgctgggtcagcttggagacatc

SEQ ID NO: 347168 - DNA, 28 bp, Artificial Sequence
  Description of Artificial Sequence: Synthetic oligonucleotide
cagcatgctgggtcagcttggagacatc

SEQ ID NO: 347169 - DNA, 29 bp, Artificial Sequence
  Description of Artificial Sequence: Synthetic oligonucleotide
agcatgctgggtcagcttggagacatcac

SEQ ID NO: 347170 - DNA, 28 bp, Artificial Sequence
  Description of Artificial Sequence: Synthetic oligonucleotide
gcatgctgggtcagcttggagacatcac

SEQ ID NO: 347171 - DNA, 28 bp, Artificial Sequence
  Description of Artificial Sequence: Synthetic oligonucleotide
catgctgggtcagcttggagacatcacc

SEQ ID NO: 347172 - DNA, 30 bp, Artificial Sequence
  Description of Artificial Sequence: Synthetic oligonucleotide
atgctgggtcagcttggagacatcacctac

SEQ ID NO: 347173 - DNA, 29 bp, Artificial Sequence
  Description of Artificial Sequence: Synthetic oligonucleotide
tgctgggtcagcttggagacatcacctac

SEQ ID NO: 347174 - DNA, 28 bp, Artificial Sequence
  Description of Artificial Sequence: Synthetic oligonucleotide
gctgggtcagcttggagacatcacctac

SEQ ID NO: 347175 - DNA, 31 bp, Artificial Sequence
  Description of Artificial Sequence: Synthetic oligonucleotide
ctgggtcagcttggagacatcacctactttg

SEQ ID NO: 347176 - DNA, 32 bp, Artificial Sequence
  Description of Artificial Sequence: Synthetic oligonucleotide
tgggtcagcttggagacatcacctactttgtg

SEQ ID NO: 347177 - DNA, 31 bp, Artificial Sequence
  Description of Artificial Sequence: Synthetic oligonucleotide
gggtcagcttggagacatcacctactttgtg

SEQ ID NO: 347178 - DNA, 31 bp, Artificial Sequence
  Description of Artificial Sequence: Synthetic oligonucleotide
ggtcagcttggagacatcacctactttgtgc

SEQ ID NO: 347179 - DNA, 32 bp, Artificial Sequence
  Description of Artificial Sequence: Synthetic oligonucleotide
gtcagcttggagacatcacctactttgtgctg

SEQ ID NO: 347180 - DNA, 32 bp, Artificial Sequence
  Description of Artificial Sequence: Synthetic oligonucleotide
tcagcttggagacatcacctactttgtgctgc

SEQ ID NO: 347181 - DNA, 31 bp, Artificial Sequence
  Description of Artificial Sequence: Synthetic oligonucleotide
cagcttggagacatcacctactttgtgctgc

SEQ ID NO: 347182 - DNA, 32 bp, Artificial Sequence
  Description of Artificial Sequence: Synthetic oligonucleotide
agcttggagacatcacctactttgtgctgcag

SEQ ID NO: 347183 - DNA, 31 bp, Artificial Sequence
  Description of Artificial Sequence: Synthetic oligonucleotide
gcttggagacatcacctactttgtgctgcag

SEQ ID NO: 347184 - DNA, 31 bp, Artificial Sequence
  Description of Artificial Sequence: Synthetic oligonucleotide
cttggagacatcacctactttgtgctgcagg

SEQ ID NO: 347185 - DNA, 32 bp, Artificial Sequence
  Description of Artificial Sequence: Synthetic oligonucleotide
ttggagacatcacctactttgtgctgcaggtg

SEQ ID NO: 347186 - DNA, 31 bp, Artificial Sequence
  Description of Artificial Sequence: Synthetic oligonucleotide
tggagacatcacctactttgtgctgcaggtg

SEQ ID NO: 347187 - DNA, 30 bp, Artificial Sequence
  Description of Artificial Sequence: Synthetic oligonucleotide
ggagacatcacctactttgtgctgcaggtg

SEQ ID NO: 347188 - DNA, 30 bp, Artificial Sequence
  Description of Artificial Sequence: Synthetic oligonucleotide
gagacatcacctactttgtgctgcaggtgc

SEQ ID NO: 347189 - DNA, 32 bp, Artificial Sequence
  Description of Artificial Sequence: Synthetic oligonucleotide
agacatcacctactttgtgctgcaggtgcttc

SEQ ID NO: 347190 - DNA, 31 bp, Artificial Sequence
  Description of Artificial Sequence: Synthetic oligonucleotide
gacatcacctactttgtgctgcaggtgcttc

SEQ ID NO: 347191 - DNA, 34 bp, Artificial Sequence
  Description of Artificial Sequence: Synthetic oligonucleotide
acatcacctactttgtgctgcaggtgcttcaaac

SEQ ID NO: 347192 - DNA, 33 bp, Artificial Sequence
  Description of Artificial Sequence: Synthetic oligonucleotide
catcacctactttgtgctgcaggtgcttcaaac

SEQ ID NO: 347193 - DNA, 34 bp, Artificial Sequence
  Description of Artificial Sequence: Synthetic oligonucleotide
atcacctactttgtgctgcaggtgcttcaaactg

SEQ ID NO: 347194 - DNA, 33 bp, Artificial Sequence
  Description of Artificial Sequence: Synthetic oligonucleotide
tcacctactttgtgctgcaggtgcttcaaactg

SEQ ID NO: 347195 - DNA, 32 bp, Artificial Sequence
  Description of Artificial Sequence: Synthetic oligonucleotide
cacctactttgtgctgcaggtgcttcaaactg

SEQ ID NO: 347196 - DNA, 33 bp, Artificial Sequence
  Description of Artificial Sequence: Synthetic oligonucleotide
acctactttgtgctgcaggtgcttcaaactgtc

SEQ ID NO: 347197 - DNA, 32 bp, Artificial Sequence
  Description of Artificial Sequence: Synthetic oligonucleotide
cctactttgtgctgcaggtgcttcaaactgtc

SEQ ID NO: 347198 - DNA, 33 bp, Artificial Sequence
  Description of Artificial Sequence: Synthetic oligonucleotide
ctactttgtgctgcaggtgcttcaaactgtctg

SEQ ID NO: 347199 - DNA, 33 bp, Artificial Sequence
  Description of Artificial Sequence: Synthetic oligonucleotide
tactttgtgctgcaggtgcttcaaactgtctgg

SEQ ID NO: 347200 - DNA, 32 bp, Artificial Sequence
  Description of Artificial Sequence: Synthetic oligonucleotide
actttgtgctgcaggtgcttcaaactgtctgg

SEQ ID NO: 347201 - DNA, 31 bp, Artificial Sequence
  Description of Artificial Sequence: Synthetic oligonucleotide
ctttgtgctgcaggtgcttcaaactgtctgg

SEQ ID NO: 347202 - DNA, 33 bp, Artificial Sequence
  Description of Artificial Sequence: Synthetic oligonucleotide
tttgtgctgcaggtgcttcaaactgtctggtac

SEQ ID NO: 347203 - DNA, 32 bp, Artificial Sequence
  Description of Artificial Sequence: Synthetic oligonucleotide
ttgtgctgcaggtgcttcaaactgtctggtac

SEQ ID NO: 347204 - DNA, 31 bp, Artificial Sequence
  Description of Artificial Sequence: Synthetic oligonucleotide
tgtgctgcaggtgcttcaaactgtctggtac

SEQ ID NO: 347205 - DNA, 30 bp, Artificial Sequence
  Description of Artificial Sequence: Synthetic oligonucleotide
gtgctgcaggtgcttcaaactgtctggtac

SEQ ID NO: 347206 - DNA, 30 bp, Artificial Sequence
  Description of Artificial Sequence: Synthetic oligonucleotide
tgctgcaggtgcttcaaactgtctggtacg

SEQ ID NO: 347207 - DNA, 29 bp, Artificial Sequence
  Description of Artificial Sequence: Synthetic oligonucleotide
gctgcaggtgcttcaaactgtctggtacg

SEQ ID NO: 347208 - DNA, 29 bp, Artificial Sequence
  Description of Artificial Sequence: Synthetic oligonucleotide
ctgcaggtgcttcaaactgtctggtacgg

SEQ ID NO: 347209 - DNA, 29 bp, Artificial Sequence
  Description of Artificial Sequence: Synthetic oligonucleotide
tgcaggtgcttcaaactgtctggtacggc

SEQ ID NO: 347210 - DNA, 28 bp, Artificial Sequence
  Description of Artificial Sequence: Synthetic oligonucleotide
gcaggtgcttcaaactgtctggtacggc

SEQ ID NO: 347211 - DNA, 31 bp, Artificial Sequence
  Description of Artificial Sequence: Synthetic oligonucleotide
caggtgcttcaaactgtctggtacggcaatg

SEQ ID NO: 347212 - DNA, 31 bp, Artificial Sequence
  Description of Artificial Sequence: Synthetic oligonucleotide
aggtgcttcaaactgtctggtacggcaatgc

SEQ ID NO: 347213 - DNA, 30 bp, Artificial Sequence
  Description of Artificial Sequence: Synthetic oligonucleotide
ggtgcttcaaactgtctggtacggcaatgc

SEQ ID NO: 347214 - DNA, 30 bp, Artificial Sequence
  Description of Artificial Sequence: Synthetic oligonucleotide
gtgcttcaaactgtctggtacggcaatgcc

SEQ ID NO: 347215 - DNA, 32 bp, Artificial Sequence
  Description of Artificial Sequence: Synthetic oligonucleotide
tgcttcaaactgtctggtacggcaatgccatg

SEQ ID NO: 347216 - DNA, 31 bp, Artificial Sequence
  Description of Artificial Sequence: Synthetic oligonucleotide
gcttcaaactgtctggtacggcaatgccatg

SEQ ID NO: 347217 - DNA, 34 bp, Artificial Sequence
  Description of Artificial Sequence: Synthetic oligonucleotide
cttcaaactgtctggtacggcaatgccatgattg

SEQ ID NO: 347218 - DNA, 34 bp, Artificial Sequence
  Description of Artificial Sequence: Synthetic oligonucleotide
ttcaaactgtctggtacggcaatgccatgattgg

SEQ ID NO: 347219 - DNA, 33 bp, Artificial Sequence
  Description of Artificial Sequence: Synthetic oligonucleotide
tcaaactgtctggtacggcaatgccatgattgg

SEQ ID NO: 347220 - DNA, 32 bp, Artificial Sequence
  Description of Artificial Sequence: Synthetic oligonucleotide
caaactgtctggtacggcaatgccatgattgg

SEQ ID NO: 347221 - DNA, 32 bp, Artificial Sequence
  Description of Artificial Sequence: Synthetic oligonucleotide
aaactgtctggtacggcaatgccatgattggg

SEQ ID NO: 347222 - DNA, 31 bp, Artificial Sequence
  Description of Artificial Sequence: Synthetic oligonucleotide
aactgtctggtacggcaatgccatgattggg

SEQ ID NO: 347223 - DNA, 30 bp, Artificial Sequence
  Description of Artificial Sequence: Synthetic oligonucleotide
actgtctggtacggcaatgccatgattggg

SEQ ID NO: 347224 - DNA, 29 bp, Artificial Sequence
  Description of Artificial Sequence: Synthetic oligonucleotide
ctgtctggtacggcaatgccatgattggg

SEQ ID NO: 347225 - DNA, 31 bp, Artificial Sequence
  Description of Artificial Sequence: Synthetic oligonucleotide
tgtctggtacggcaatgccatgattgggttc

SEQ ID NO: 347226 - DNA, 30 bp, Artificial Sequence
  Description of Artificial Sequence: Synthetic oligonucleotide
gtctggtacggcaatgccatgattgggttc

SEQ ID NO: 347227 - DNA, 30 bp, Artificial Sequence
  Description of Artificial Sequence: Synthetic oligonucleotide
tctggtacggcaatgccatgattgggttcc

SEQ ID NO: 347228 - DNA, 29 bp, Artificial Sequence
  Description of Artificial Sequence: Synthetic oligonucleotide
ctggtacggcaatgccatgattgggttcc

SEQ ID NO: 347229 - DNA, 30 bp, Artificial Sequence
  Description of Artificial Sequence: Synthetic oligonucleotide
tggtacggcaatgccatgattgggttccag

SEQ ID NO: 347230 - DNA, 29 bp, Artificial Sequence
  Description of Artificial Sequence: Synthetic oligonucleotide
ggtacggcaatgccatgattgggttccag

SEQ ID NO: 347231 - DNA, 29 bp, Artificial Sequence
  Description of Artificial Sequence: Synthetic oligonucleotide
gtacggcaatgccatgattgggttccagg

SEQ ID NO: 347232 - DNA, 30 bp, Artificial Sequence
  Description of Artificial Sequence: Synthetic oligonucleotide
tacggcaatgccatgattgggttccaggtc

SEQ ID NO: 347233 - DNA, 29 bp, Artificial Sequence
  Description of Artificial Sequence: Synthetic oligonucleotide
acggcaatgccatgattgggttccaggtc

SEQ ID NO: 347234 - DNA, 28 bp, Artificial Sequence
  Description of Artificial Sequence: Synthetic oligonucleotide
cggcaatgccatgattgggttccaggtc

SEQ ID NO: 347235 - DNA, 28 bp, Artificial Sequence
  Description of Artificial Sequence: Synthetic oligonucleotide
ggcaatgccatgattgggttccaggtcg

SEQ ID NO: 347236 - DNA, 29 bp, Artificial Sequence
  Description of Artificial Sequence: Synthetic oligonucleotide
gcaatgccatgattgggttccaggtcgtc

SEQ ID NO: 347237 - DNA, 29 bp, Artificial Sequence
  Description of Artificial Sequence: Synthetic oligonucleotide
caatgccatgattgggttccaggtcgtcc

SEQ ID NO: 347238 - DNA, 30 bp, Artificial Sequence
  Description of Artificial Sequence: Synthetic oligonucleotide
aatgccatgattgggttccaggtcgtcctc

SEQ ID NO: 347239 - DNA, 29 bp, Artificial Sequence
  Description of Artificial Sequence: Synthetic oligonucleotide
atgccatgattgggttccaggtcgtcctc

SEQ ID NO: 347240 - DNA, 28 bp, Artificial Sequence
  Description of Artificial Sequence: Synthetic oligonucleotide
tgccatgattgggttccaggtcgtcctc

SEQ ID NO: 347241 - DNA, 27 bp, Artificial Sequence
  Description of Artificial Sequence: Synthetic oligonucleotide
gccatgattgggttccaggtcgtcctc

SEQ ID NO: 347242 - DNA, 28 bp, Artificial Sequence
  Description of Artificial Sequence: Synthetic oligonucleotide
ccatgattgggttccaggtcgtcctcag

SEQ ID NO: 347243 - DNA, 28 bp, Artificial Sequence
  Description of Artificial Sequence: Synthetic oligonucleotide
catgattgggttccaggtcgtcctcagc

SEQ ID NO: 347244 - DNA, 31 bp, Artificial Sequence
  Description of Artificial Sequence: Synthetic oligonucleotide
atgattgggttccaggtcgtcctcagcaatg

SEQ ID NO: 347245 - DNA, 30 bp, Artificial Sequence
  Description of Artificial Sequence: Synthetic oligonucleotide
tgattgggttccaggtcgtcctcagcaatg

SEQ ID NO: 347246 - DNA, 29 bp, Artificial Sequence
  Description of Artificial Sequence: Synthetic oligonucleotide
gattgggttccaggtcgtcctcagcaatg

SEQ ID NO: 347247 - DNA, 29 bp, Artificial Sequence
  Description of Artificial Sequence: Synthetic oligonucleotide
attgggttccaggtcgtcctcagcaatgg

SEQ ID NO: 347248 - DNA, 28 bp, Artificial Sequence
  Description of Artificial Sequence: Synthetic oligonucleotide
ttgggttccaggtcgtcctcagcaatgg

SEQ ID NO: 347249 - DNA, 27 bp, Artificial Sequence
  Description of Artificial Sequence: Synthetic oligonucleotide
tgggttccaggtcgtcctcagcaatgg

SEQ ID NO: 347250 - DNA, 26 bp, Artificial Sequence
  Description of Artificial Sequence: Synthetic oligonucleotide
gggttccaggtcgtcctcagcaatgg

SEQ ID NO: 347251 - DNA, 26 bp, Artificial Sequence
  Description of Artificial Sequence: Synthetic oligonucleotide
ggttccaggtcgtcctcagcaatggg

SEQ ID NO: 347252 - DNA, 27 bp, Artificial Sequence
  Description of Artificial Sequence: Synthetic oligonucleotide
gttccaggtcgtcctcagcaatgggga

SEQ ID NO: 347253 - DNA, 28 bp, Artificial Sequence
  Description of Artificial Sequence: Synthetic oligonucleotide
ttccaggtcgtcctcagcaatggggaac

SEQ ID NO: 347254 - DNA, 27 bp, Artificial Sequence
  Description of Artificial Sequence: Synthetic oligonucleotide
tccaggtcgtcctcagcaatggggaac

SEQ ID NO: 347255 - DNA, 27 bp, Artificial Sequence
  Description of Artificial Sequence: Synthetic oligonucleotide
ccaggtcgtcctcagcaatggggaact

SEQ ID NO: 347256 - DNA, 27 bp, Artificial Sequence
  Description of Artificial Sequence: Synthetic oligonucleotide
caggtcgtcctcagcaatggggaactg

SEQ ID NO: 347257 - DNA, 28 bp, Artificial Sequence
  Description of Artificial Sequence: Synthetic oligonucleotide
aggtcgtcctcagcaatggggaactgag

SEQ ID NO: 347258 - DNA, 27 bp, Artificial Sequence
  Description of Artificial Sequence: Synthetic oligonucleotide
ggtcgtcctcagcaatggggaactgag

SEQ ID NO: 347259 - DNA, 27 bp, Artificial Sequence
  Description of Artificial Sequence: Synthetic oligonucleotide
gtcgtcctcagcaatggggaactgagc

SEQ ID NO: 347260 - DNA, 29 bp, Artificial Sequence
  Description of Artificial Sequence: Synthetic oligonucleotide
tcgtcctcagcaatggggaactgagcttg

SEQ ID NO: 347261 - DNA, 28 bp, Artificial Sequence
  Description of Artificial Sequence: Synthetic oligonucleotide
cgtcctcagcaatggggaactgagcttg

SEQ ID NO: 347262 - DNA, 28 bp, Artificial Sequence
  Description of Artificial Sequence: Synthetic oligonucleotide
gtcctcagcaatggggaactgagcttgg

SEQ ID NO: 347263 - DNA, 28 bp, Artificial Sequence
  Description of Artificial Sequence: Synthetic oligonucleotide
tcctcagcaatggggaactgagcttggc

SEQ ID NO: 347264 - DNA, 27 bp, Artificial Sequence
  Description of Artificial Sequence: Synthetic oligonucleotide
cctcagcaatggggaactgagcttggc

SEQ ID NO: 347265 - DNA, 27 bp, Artificial Sequence
  Description of Artificial Sequence: Synthetic oligonucleotide
ctcagcaatggggaactgagcttggcc

SEQ ID NO: 347266 - DNA, 29 bp, Artificial Sequence
  Description of Artificial Sequence: Synthetic oligonucleotide
tcagcaatggggaactgagcttggccttc

SEQ ID NO: 347267 - DNA, 28 bp, Artificial Sequence
  Description of Artificial Sequence: Synthetic oligonucleotide
cagcaatggggaactgagcttggccttc

SEQ ID NO: 347268 - DNA, 28 bp, Artificial Sequence
  Description of Artificial Sequence: Synthetic oligonucleotide
agcaatggggaactgagcttggccttcg

SEQ ID NO: 347269 - DNA, 27 bp, Artificial Sequence
  Description of Artificial Sequence: Synthetic oligonucleotide
gcaatggggaactgagcttggccttcg

SEQ ID NO: 347270 - DNA, 28 bp, Artificial Sequence
  Description of Artificial Sequence: Synthetic oligonucleotide
caatggggaactgagcttggccttcgtg

SEQ ID NO: 347271 - DNA, 31 bp, Artificial Sequence
  Description of Artificial Sequence: Synthetic oligonucleotide
aatggggaactgagcttggccttcgtgatag

SEQ ID NO: 347272 - DNA, 30 bp, Artificial Sequence
  Description of Artificial Sequence: Synthetic oligonucleotide
atggggaactgagcttggccttcgtgatag

SEQ ID NO: 347273 - DNA, 29 bp, Artificial Sequence
  Description of Artificial Sequence: Synthetic oligonucleotide
tggggaactgagcttggccttcgtgatag

SEQ ID NO: 347274 - DNA, 28 bp, Artificial Sequence
  Description of Artificial Sequence: Synthetic oligonucleotide
ggggaactgagcttggccttcgtgatag

SEQ ID NO: 347275 - DNA, 28 bp, Artificial Sequence
  Description of Artificial Sequence: Synthetic oligonucleotide
gggaactgagcttggccttcgtgatagg

SEQ ID NO: 347276 - DNA, 29 bp, Artificial Sequence
  Description of Artificial Sequence: Synthetic oligonucleotide
ggaactgagcttggccttcgtgataggtc

SEQ ID NO: 347277 - DNA, 30 bp, Artificial Sequence
  Description of Artificial Sequence: Synthetic oligonucleotide
gaactgagcttggccttcgtgataggtctc

SEQ ID NO: 347278 - DNA, 31 bp, Artificial Sequence
  Description of Artificial Sequence: Synthetic oligonucleotide
aactgagcttggccttcgtgataggtctcac

SEQ ID NO: 347279 - DNA, 30 bp, Artificial Sequence
  Description of Artificial Sequence: Synthetic oligonucleotide
actgagcttggccttcgtgataggtctcac

SEQ ID NO: 347280 - DNA, 29 bp, Artificial Sequence
  Description of Artificial Sequence: Synthetic oligonucleotide
ctgagcttggccttcgtgataggtctcac

SEQ ID NO: 347281 - DNA, 29 bp, Artificial Sequence
  Description of Artificial Sequence: Synthetic oligonucleotide
tgagcttggccttcgtgataggtctcacg

SEQ ID NO: 347282 - DNA, 28 bp, Artificial Sequence
  Description of Artificial Sequence: Synthetic oligonucleotide
gagcttggccttcgtgataggtctcacg

SEQ ID NO: 347283 - DNA, 29 bp, Artificial Sequence
  Description of Artificial Sequence: Synthetic oligonucleotide
agcttggccttcgtgataggtctcacgtc

SEQ ID NO: 347284 - DNA, 28 bp, Artificial Sequence
  Description of Artificial Sequence: Synthetic oligonucleotide
gcttggccttcgtgataggtctcacgtc

SEQ ID NO: 347285 - DNA, 29 bp, Artificial Sequence
  Description of Artificial Sequence: Synthetic oligonucleotide
cttggccttcgtgataggtctcacgtcag

SEQ ID NO: 347286 - DNA, 29 bp, Artificial Sequence
  Description of Artificial Sequence: Synthetic oligonucleotide
ttggccttcgtgataggtctcacgtcagg

SEQ ID NO: 347287 - DNA, 28 bp, Artificial Sequence
  Description of Artificial Sequence: Synthetic oligonucleotide
tggccttcgtgataggtctcacgtcagg

SEQ ID NO: 347288 - DNA, 27 bp, Artificial Sequence
  Description of Artificial Sequence: Synthetic oligonucleotide
ggccttcgtgataggtctcacgtcagg

SEQ ID NO: 347289 - DNA, 28 bp, Artificial Sequence
  Description of Artificial Sequence: Synthetic oligonucleotide
gccttcgtgataggtctcacgtcaggtc

SEQ ID NO: 347290 - DNA, 29 bp, Artificial Sequence
  Description of Artificial Sequence: Synthetic oligonucleotide
ccttcgtgataggtctcacgtcaggtctc

SEQ ID NO: 347291 - DNA, 29 bp, Artificial Sequence
  Description of Artificial Sequence: Synthetic oligonucleotide
cttcgtgataggtctcacgtcaggtctcc

SEQ ID NO: 347292 - DNA, 30 bp, Artificial Sequence
  Description of Artificial Sequence: Synthetic oligonucleotide
ttcgtgataggtctcacgtcaggtctcctg

SEQ ID NO: 347293 - DNA, 29 bp, Artificial Sequence
  Description of Artificial Sequence: Synthetic oligonucleotide
tcgtgataggtctcacgtcaggtctcctg

SEQ ID NO: 347294 - DNA, 28 bp, Artificial Sequence
  Description of Artificial Sequence: Synthetic oligonucleotide
cgtgataggtctcacgtcaggtctcctg

SEQ ID NO: 347295 - DNA, 29 bp, Artificial Sequence
  Description of Artificial Sequence: Synthetic oligonucleotide
gtgataggtctcacgtcaggtctcctgtc

SEQ ID NO: 347296 - DNA, 30 bp, Artificial Sequence
  Description of Artificial Sequence: Synthetic oligonucleotide
tgataggtctcacgtcaggtctcctgtcag

SEQ ID NO: 347297 - DNA, 29 bp, Artificial Sequence
  Description of Artificial Sequence: Synthetic oligonucleotide
gataggtctcacgtcaggtctcctgtcag

SEQ ID NO: 347298 - DNA, 29 bp, Artificial Sequence
  Description of Artificial Sequence: Synthetic oligonucleotide
ataggtctcacgtcaggtctcctgtcagg

SEQ ID NO: 347299 - DNA, 28 bp, Artificial Sequence
  Description of Artificial Sequence: Synthetic oligonucleotide
taggtctcacgtcaggtctcctgtcagg

SEQ ID NO: 347300 - DNA, 27 bp, Artificial Sequence
  Description of Artificial Sequence: Synthetic oligonucleotide
aggtctcacgtcaggtctcctgtcagg

SEQ ID NO: 347301 - DNA, 27 bp, Artificial Sequence
  Description of Artificial Sequence: Synthetic oligonucleotide
ggtctcacgtcaggtctcctgtcaggt

SEQ ID NO: 347302 - DNA, 29 bp, Artificial Sequence
  Description of Artificial Sequence: Synthetic oligonucleotide
gtctcacgtcaggtctcctgtcaggtttg

SEQ ID NO: 347303 - DNA, 29 bp, Artificial Sequence
  Description of Artificial Sequence: Synthetic oligonucleotide
tctcacgtcaggtctcctgtcaggtttgc

SEQ ID NO: 347304 - DNA, 28 bp, Artificial Sequence
  Description of Artificial Sequence: Synthetic oligonucleotide
ctcacgtcaggtctcctgtcaggtttgc

SEQ ID NO: 347305 - DNA, 29 bp, Artificial Sequence
  Description of Artificial Sequence: Synthetic oligonucleotide
tcacgtcaggtctcctgtcaggtttgcac

SEQ ID NO: 347306 - DNA, 28 bp, Artificial Sequence
  Description of Artificial Sequence: Synthetic oligonucleotide
cacgtcaggtctcctgtcaggtttgcac

SEQ ID NO: 347307 - DNA, 28 bp, Artificial Sequence
  Description of Artificial Sequence: Synthetic oligonucleotide
acgtcaggtctcctgtcaggtttgcacc

SEQ ID NO: 347308 - DNA, 27 bp, Artificial Sequence
  Description of Artificial Sequence: Synthetic oligonucleotide
cgtcaggtctcctgtcaggtttgcacc

SEQ ID NO: 347309 - DNA, 32 bp, Artificial Sequence
  Description of Artificial Sequence: Synthetic oligonucleotide
gtcaggtctcctgtcaggtttgcacctaaatc

SEQ ID NO: 347310 - DNA, 33 bp, Artificial Sequence
  Description of Artificial Sequence: Synthetic oligonucleotide
tcaggtctcctgtcaggtttgcacctaaatctg

SEQ ID NO: 347311 - DNA, 32 bp, Artificial Sequence
  Description of Artificial Sequence: Synthetic oligonucleotide
caggtctcctgtcaggtttgcacctaaatctg

SEQ ID NO: 347312 - DNA, 39 bp, Artificial Sequence
  Description of Artificial Sequence: Synthetic oligonucleotide
aggtctcctgtcaggtttgcacctaaatctgaaaatatg

SEQ ID NO: 347313 - DNA, 38 bp, Artificial Sequence
  Description of Artificial Sequence: Synthetic oligonucleotide
ggtctcctgtcaggtttgcacctaaatctgaaaatatg

SEQ ID NO: 347314 - DNA, 38 bp, Artificial Sequence
  Description of Artificial Sequence: Synthetic oligonucleotide
gtctcctgtcaggtttgcacctaaatctgaaaatatgg

SEQ ID NO: 347315 - DNA, 41 bp, Artificial Sequence
  Description of Artificial Sequence: Synthetic oligonucleotide
tctcctgtcaggtttgcacctaaatctgaaaatatggtaag

SEQ ID NO: 347316 - DNA, 40 bp, Artificial Sequence
  Description of Artificial Sequence: Synthetic oligonucleotide
ctcctgtcaggtttgcacctaaatctgaaaatatggtaag

SEQ ID NO: 347317 - DNA, 40 bp, Artificial Sequence
  Description of Artificial Sequence: Synthetic oligonucleotide
tcctgtcaggtttgcacctaaatctgaaaatatggtaagc

SEQ ID NO: 347318 - DNA, 39 bp, Artificial Sequence
  Description of Artificial Sequence: Synthetic oligonucleotide
cctgtcaggtttgcacctaaatctgaaaatatggtaagc

SEQ ID NO: 347319 - DNA, 40 bp, Artificial Sequence
  Description of Artificial Sequence: Synthetic oligonucleotide
ctgtcaggtttgcacctaaatctgaaaatatggtaagcac

SEQ ID NO: 347320 - DNA, 40 bp, Artificial Sequence
  Description of Artificial Sequence: Synthetic oligonucleotide
tgtcaggtttgcacctaaatctgaaaatatggtaagcacc

SEQ ID NO: 347321 - DNA, 39 bp, Artificial Sequence
  Description of Artificial Sequence: Synthetic oligonucleotide
gtcaggtttgcacctaaatctgaaaatatggtaagcacc

SEQ ID NO: 347322 - DNA, 40 bp, Artificial Sequence
  Description of Artificial Sequence: Synthetic oligonucleotide
tcaggtttgcacctaaatctgaaaatatggtaagcacctc

SEQ ID NO: 347323 - DNA, 39 bp, Artificial Sequence
  Description of Artificial Sequence: Synthetic oligonucleotide
caggtttgcacctaaatctgaaaatatggtaagcacctc

SEQ ID NO: 347324 - DNA, 41 bp, Artificial Sequence
  Description of Artificial Sequence: Synthetic oligonucleotide
aggtttgcacctaaatctgaaaatatggtaagcacctcttg

SEQ ID NO: 347325 - DNA, 40 bp, Artificial Sequence
  Description of Artificial Sequence: Synthetic oligonucleotide
ggtttgcacctaaatctgaaaatatggtaagcacctcttg

SEQ ID NO: 347326 - DNA, 41 bp, Artificial Sequence
  Description of Artificial Sequence: Synthetic oligonucleotide
gtttgcacctaaatctgaaaatatggtaagcacctcttgtg

SEQ ID NO: 347327 - DNA, 41 bp, Artificial Sequence
  Description of Artificial Sequence: Synthetic oligonucleotide
tttgcacctaaatctgaaaatatggtaagcacctcttgtgg

SEQ ID NO: 347328 - DNA, 40 bp, Artificial Sequence
  Description of Artificial Sequence: Synthetic oligonucleotide
ttgcacctaaatctgaaaatatggtaagcacctcttgtgg

SEQ ID NO: 347329 - DNA, 39 bp, Artificial Sequence
  Description of Artificial Sequence: Synthetic oligonucleotide
tgcacctaaatctgaaaatatggtaagcacctcttgtgg

SEQ ID NO: 347330 - DNA, 38 bp, Artificial Sequence
  Description of Artificial Sequence: Synthetic oligonucleotide
gcacctaaatctgaaaatatggtaagcacctcttgtgg

SEQ ID NO: 347331 - DNA, 38 bp, Artificial Sequence
  Description of Artificial Sequence: Synthetic oligonucleotide
cacctaaatctgaaaatatggtaagcacctcttgtggc

SEQ ID NO: 347332 - DNA, 48 bp, Artificial Sequence
  Description of Artificial Sequence: Synthetic oligonucleotide
acctaaatctgaaaatatggtaagcacctcttgtggctaattattttg

SEQ ID NO: 347333 - DNA, 47 bp, Artificial Sequence
  Description of Artificial Sequence: Synthetic oligonucleotide
cctaaatctgaaaatatggtaagcacctcttgtggctaattattttg

SEQ ID NO: 347334 - DNA, 49 bp, Artificial Sequence
  Description of Artificial Sequence: Synthetic oligonucleotide
ctaaatctgaaaatatggtaagcacctcttgtggctaattattttgatc

SEQ ID NO: 347335 - DNA, 50 bp, Artificial Sequence
  Description of Artificial Sequence: Synthetic oligonucleotide
taaatctgaaaatatggtaagcacctcttgtggctaattattttgatcac

SEQ ID NO: 347336 - DNA, 49 bp, Artificial Sequence
  Description of Artificial Sequence: Synthetic oligonucleotide
aaatctgaaaatatggtaagcacctcttgtggctaattattttgatcac

SEQ ID NO: 347337 - DNA, 48 bp, Artificial Sequence
  Description of Artificial Sequence: Synthetic oligonucleotide
aatctgaaaatatggtaagcacctcttgtggctaattattttgatcac

SEQ ID NO: 347338 - DNA, 47 bp, Artificial Sequence
  Description of Artificial Sequence: Synthetic oligonucleotide
atctgaaaatatggtaagcacctcttgtggctaattattttgatcac

SEQ ID NO: 347339 - DNA, 46 bp, Artificial Sequence
  Description of Artificial Sequence: Synthetic oligonucleotide
tctgaaaatatggtaagcacctcttgtggctaattattttgatcac

SEQ ID NO: 347340 - DNA, 45 bp, Artificial Sequence
  Description of Artificial Sequence: Synthetic oligonucleotide
ctgaaaatatggtaagcacctcttgtggctaattattttgatcac

SEQ ID NO: 347341 - DNA, 45 bp, Artificial Sequence
  Description of Artificial Sequence: Synthetic oligonucleotide
tgaaaatatggtaagcacctcttgtggctaattattttgatcacc

SEQ ID NO: 347342 - DNA, 44 bp, Artificial Sequence
  Description of Artificial Sequence: Synthetic oligonucleotide
gaaaatatggtaagcacctcttgtggctaattattttgatcacc

SEQ ID NO: 347343 - DNA, 46 bp, Artificial Sequence
  Description of Artificial Sequence: Synthetic oligonucleotide
aaaatatggtaagcacctcttgtggctaattattttgatcaccaag

SEQ ID NO: 347344 - DNA, 45 bp, Artificial Sequence
  Description of Artificial Sequence: Synthetic oligonucleotide
aaatatggtaagcacctcttgtggctaattattttgatcaccaag

SEQ ID NO: 347345 - DNA, 44 bp, Artificial Sequence
  Description of Artificial Sequence: Synthetic oligonucleotide
aatatggtaagcacctcttgtggctaattattttgatcaccaag

SEQ ID NO: 347346 - DNA, 43 bp, Artificial Sequence
  Description of Artificial Sequence: Synthetic oligonucleotide
atatggtaagcacctcttgtggctaattattttgatcaccaag

SEQ ID NO: 347347 - DNA, 42 bp, Artificial Sequence
  Description of Artificial Sequence: Synthetic oligonucleotide
tatggtaagcacctcttgtggctaattattttgatcaccaag

SEQ ID NO: 347348 - DNA, 41 bp, Artificial Sequence
  Description of Artificial Sequence: Synthetic oligonucleotide
atggtaagcacctcttgtggctaattattttgatcaccaag

SEQ ID NO: 347349 - DNA, 40 bp, Artificial Sequence
  Description of Artificial Sequence: Synthetic oligonucleotide
tggtaagcacctcttgtggctaattattttgatcaccaag

SEQ ID NO: 347350 - DNA, 39 bp, Artificial Sequence
  Description of Artificial Sequence: Synthetic oligonucleotide
ggtaagcacctcttgtggctaattattttgatcaccaag

SEQ ID NO: 347351 - DNA, 43 bp, Artificial Sequence
  Description of Artificial Sequence: Synthetic oligonucleotide
gtaagcacctcttgtggctaattattttgatcaccaagtttac

SEQ ID NO: 347352 - DNA, 44 bp, Artificial Sequence
  Description of Artificial Sequence: Synthetic oligonucleotide
taagcacctcttgtggctaattattttgatcaccaagtttactg

SEQ ID NO: 347353 - DNA, 43 bp, Artificial Sequence
  Description of Artificial Sequence: Synthetic oligonucleotide
aagcacctcttgtggctaattattttgatcaccaagtttactg

SEQ ID NO: 347354 - DNA, 42 bp, Artificial Sequence
  Description of Artificial Sequence: Synthetic oligonucleotide
agcacctcttgtggctaattattttgatcaccaagtttactg

SEQ ID NO: 347355 - DNA, 41 bp, Artificial Sequence
  Description of Artificial Sequence: Synthetic oligonucleotide
gcacctcttgtggctaattattttgatcaccaagtttactg

SEQ ID NO: 347356 - DNA, 41 bp, Artificial Sequence
  Description of Artificial Sequence: Synthetic oligonucleotide
cacctcttgtggctaattattttgatcaccaagtttactgg

SEQ ID NO: 347357 - DNA, 43 bp, Artificial Sequence
  Description of Artificial Sequence: Synthetic oligonucleotide
acctcttgtggctaattattttgatcaccaagtttactggaag

SEQ ID NO: 347358 - DNA, 42 bp, Artificial Sequence
  Description of Artificial Sequence: Synthetic oligonucleotide
cctcttgtggctaattattttgatcaccaagtttactggaag

SEQ ID NO: 347359 - DNA, 45 bp, Artificial Sequence
  Description of Artificial Sequence: Synthetic oligonucleotide
ctcttgtggctaattattttgatcaccaagtttactggaagttac

SEQ ID NO: 347360 - DNA, 45 bp, Artificial Sequence
  Description of Artificial Sequence: Synthetic oligonucleotide
tcttgtggctaattattttgatcaccaagtttactggaagttacc

SEQ ID NO: 347361 - DNA, 44 bp, Artificial Sequence
  Description of Artificial Sequence: Synthetic oligonucleotide
cttgtggctaattattttgatcaccaagtttactggaagttacc

SEQ ID NO: 347362 - DNA, 45 bp, Artificial Sequence
  Description of Artificial Sequence: Synthetic oligonucleotide
ttgtggctaattattttgatcaccaagtttactggaagttacctc

SEQ ID NO: 347363 - DNA, 44 bp, Artificial Sequence
  Description of Artificial Sequence: Synthetic oligonucleotide
tgtggctaattattttgatcaccaagtttactggaagttacctc

SEQ ID NO: 347364 - DNA, 43 bp, Artificial Sequence
  Description of Artificial Sequence: Synthetic oligonucleotide
gtggctaattattttgatcaccaagtttactggaagttacctc

SEQ ID NO: 347365 - DNA, 47 bp, Artificial Sequence
  Description of Artificial Sequence: Synthetic oligonucleotide
tggctaattattttgatcaccaagtttactggaagttacctcatttg

SEQ ID NO: 347366 - DNA, 46 bp, Artificial Sequence
  Description of Artificial Sequence: Synthetic oligonucleotide
ggctaattattttgatcaccaagtttactggaagttacctcatttg

SEQ ID NO: 347367 - DNA, 46 bp, Artificial Sequence
  Description of Artificial Sequence: Synthetic oligonucleotide
gctaattattttgatcaccaagtttactggaagttacctcatttgc

SEQ ID NO: 347368 - DNA, 46 bp, Artificial Sequence
  Description of Artificial Sequence: Synthetic oligonucleotide
ctaattattttgatcaccaagtttactggaagttacctcatttgcc

SEQ ID NO: 347369 - DNA, 47 bp, Artificial Sequence
  Description of Artificial Sequence: Synthetic oligonucleotide
taattattttgatcaccaagtttactggaagttacctcatttgcctg

SEQ ID NO: 347370 - DNA, 46 bp, Artificial Sequence
  Description of Artificial Sequence: Synthetic oligonucleotide
aattattttgatcaccaagtttactggaagttacctcatttgcctg

SEQ ID NO: 347371 - DNA, 45 bp, Artificial Sequence
  Description of Artificial Sequence: Synthetic oligonucleotide
attattttgatcaccaagtttactggaagttacctcatttgcctg

SEQ ID NO: 347372 - DNA, 44 bp, Artificial Sequence
  Description of Artificial Sequence: Synthetic oligonucleotide
ttattttgatcaccaagtttactggaagttacctcatttgcctg

SEQ ID NO: 347373 - DNA, 43 bp, Artificial Sequence
  Description of Artificial Sequence: Synthetic oligonucleotide
tattttgatcaccaagtttactggaagttacctcatttgcctg

SEQ ID NO: 347374 - DNA, 42 bp, Artificial Sequence
  Description of Artificial Sequence: Synthetic oligonucleotide
attttgatcaccaagtttactggaagttacctcatttgcctg

SEQ ID NO: 347375 - DNA, 41 bp, Artificial Sequence
  Description of Artificial Sequence: Synthetic oligonucleotide
ttttgatcaccaagtttactggaagttacctcatttgcctg

SEQ ID NO: 347376 - DNA, 40 bp, Artificial Sequence
  Description of Artificial Sequence: Synthetic oligonucleotide
tttgatcaccaagtttactggaagttacctcatttgcctg

SEQ ID NO: 347377 - DNA, 39 bp, Artificial Sequence
  Description of Artificial Sequence: Synthetic oligonucleotide
ttgatcaccaagtttactggaagttacctcatttgcctg

SEQ ID NO: 347378 - DNA, 38 bp, Artificial Sequence
  Description of Artificial Sequence: Synthetic oligonucleotide
tgatcaccaagtttactggaagttacctcatttgcctg

SEQ ID NO: 347379 - DNA, 37 bp, Artificial Sequence
  Description of Artificial Sequence: Synthetic oligonucleotide
gatcaccaagtttactggaagttacctcatttgcctg

SEQ ID NO: 347380 - DNA, 39 bp, Artificial Sequence
  Description of Artificial Sequence: Synthetic oligonucleotide
atcaccaagtttactggaagttacctcatttgcctgttg

SEQ ID NO: 347381 - DNA, 38 bp, Artificial Sequence
  Description of Artificial Sequence: Synthetic oligonucleotide
tcaccaagtttactggaagttacctcatttgcctgttg

SEQ ID NO: 347382 - DNA, 37 bp, Artificial Sequence
  Description of Artificial Sequence: Synthetic oligonucleotide
caccaagtttactggaagttacctcatttgcctgttg

SEQ ID NO: 347383 - DNA, 37 bp, Artificial Sequence
  Description of Artificial Sequence: Synthetic oligonucleotide
accaagtttactggaagttacctcatttgcctgttgg

SEQ ID NO: 347384 - DNA, 36 bp, Artificial Sequence
  Description of Artificial Sequence: Synthetic oligonucleotide
ccaagtttactggaagttacctcatttgcctgttgg

SEQ ID NO: 347385 - DNA, 27 bp, Artificial Sequence
  Description of Artificial Sequence: Synthetic oligonucleotide
atggagatgccgagttctggtggctcc

SEQ ID NO: 347386 - DNA, 27 bp, Artificial Sequence
  Description of Artificial Sequence: Synthetic oligonucleotide
tggagatgccgagttctggtggctcct

SEQ ID NO: 347387 - DNA, 26 bp, Artificial Sequence
  Description of Artificial Sequence: Synthetic oligonucleotide
ggagatgccgagttctggtggctcct

SEQ ID NO: 347388 - DNA, 26 bp, Artificial Sequence
  Description of Artificial Sequence: Synthetic oligonucleotide
gagatgccgagttctggtggctcctg

SEQ ID NO: 347389 - DNA, 26 bp, Artificial Sequence
  Description of Artificial Sequence: Synthetic oligonucleotide
agatgccgagttctggtggctcctgc

SEQ ID NO: 347390 - DNA, 25 bp, Artificial Sequence
  Description of Artificial Sequence: Synthetic oligonucleotide
gatgccgagttctggtggctcctgc

SEQ ID NO: 347391 - DNA, 26 bp, Artificial Sequence
  Description of Artificial Sequence: Synthetic oligonucleotide
atgccgagttctggtggctcctgcct

SEQ ID NO: 347392 - DNA, 25 bp, Artificial Sequence
  Description of Artificial Sequence: Synthetic oligonucleotide
tgccgagttctggtggctcctgcct

SEQ ID NO: 347393 - DNA, 24 bp, Artificial Sequence
  Description of Artificial Sequence: Synthetic oligonucleotide
gccgagttctggtggctcctgcct

SEQ ID NO: 347394 - DNA, 25 bp, Artificial Sequence
  Description of Artificial Sequence: Synthetic oligonucleotide
ccgagttctggtggctcctgcctct

SEQ ID NO: 347395 - DNA, 26 bp, Artificial Sequence
  Description of Artificial Sequence: Synthetic oligonucleotide
cgagttctggtggctcctgcctctct

SEQ ID NO: 347396 - DNA, 26 bp, Artificial Sequence
  Description of Artificial Sequence: Synthetic oligonucleotide
gagttctggtggctcctgcctctctg

SEQ ID NO: 347397 - DNA, 26 bp, Artificial Sequence
  Description of Artificial Sequence: Synthetic oligonucleotide
agttctggtggctcctgcctctctgg

SEQ ID NO: 347398 - DNA, 25 bp, Artificial Sequence
  Description of Artificial Sequence: Synthetic oligonucleotide
gttctggtggctcctgcctctctgg

SEQ ID NO: 347399 - DNA, 26 bp, Artificial Sequence
  Description of Artificial Sequence: Synthetic oligonucleotide
ttctggtggctcctgcctctctggca

SEQ ID NO: 347400 - DNA, 25 bp, Artificial Sequence
  Description of Artificial Sequence: Synthetic oligonucleotide
tctggtggctcctgcctctctggca

SEQ ID NO: 347401 - DNA, 24 bp, Artificial Sequence
  Description of Artificial Sequence: Synthetic oligonucleotide
ctggtggctcctgcctctctggca

SEQ ID NO: 347402 - DNA, 24 bp, Artificial Sequence
  Description of Artificial Sequence: Synthetic oligonucleotide
tggtggctcctgcctctctggcag

SEQ ID NO: 347403 - DNA, 23 bp, Artificial Sequence
  Description of Artificial Sequence: Synthetic oligonucleotide
ggtggctcctgcctctctggcag

SEQ ID NO: 347404 - DNA, 23 bp, Artificial Sequence
  Description of Artificial Sequence: Synthetic oligonucleotide
gtggctcctgcctctctggcagc

SEQ ID NO: 347405 - DNA, 24 bp, Artificial Sequence
  Description of Artificial Sequence: Synthetic oligonucleotide
tggctcctgcctctctggcagcct

SEQ ID NO: 347406 - DNA, 23 bp, Artificial Sequence
  Description of Artificial Sequence: Synthetic oligonucleotide
ggctcctgcctctctggcagcct

SEQ ID NO: 347407 - DNA, 25 bp, Artificial Sequence
  Description of Artificial Sequence: Synthetic oligonucleotide
gctcctgcctctctggcagcctcat

SEQ ID NO: 347408 - DNA, 25 bp, Artificial Sequence
  Description of Artificial Sequence: Synthetic oligonucleotide
ctcctgcctctctggcagcctcatc

SEQ ID NO: 347409 - DNA, 25 bp, Artificial Sequence
  Description of Artificial Sequence: Synthetic oligonucleotide
tcctgcctctctggcagcctcatcc

SEQ ID NO: 347410 - DNA, 24 bp, Artificial Sequence
  Description of Artificial Sequence: Synthetic oligonucleotide
cctgcctctctggcagcctcatcc

SEQ ID NO: 347411 - DNA, 25 bp, Artificial Sequence
  Description of Artificial Sequence: Synthetic oligonucleotide
ctgcctctctggcagcctcatccgt

SEQ ID NO: 347412 - DNA, 26 bp, Artificial Sequence
  Description of Artificial Sequence: Synthetic oligonucleotide
tgcctctctggcagcctcatccgtct

SEQ ID NO: 347413 - DNA, 25 bp, Artificial Sequence
  Description of Artificial Sequence: Synthetic oligonucleotide
gcctctctggcagcctcatccgtct

SEQ ID NO: 347414 - DNA, 25 bp, Artificial Sequence
  Description of Artificial Sequence: Synthetic oligonucleotide
cctctctggcagcctcatccgtctc

SEQ ID NO: 347415 - DNA, 26 bp, Artificial Sequence
  Description of Artificial Sequence: Synthetic oligonucleotide
ctctctggcagcctcatccgtctcgt

SEQ ID NO: 347416 - DNA, 27 bp, Artificial Sequence
  Description of Artificial Sequence: Synthetic oligonucleotide
tctctggcagcctcatccgtctcgtct

SEQ ID NO: 347417 - DNA, 27 bp, Artificial Sequence
  Description of Artificial Sequence: Synthetic oligonucleotide
ctctggcagcctcatccgtctcgtctt

SEQ ID NO: 347418 - DNA, 27 bp, Artificial Sequence
  Description of Artificial Sequence: Synthetic oligonucleotide
tctggcagcctcatccgtctcgtcttg

SEQ ID NO: 347419 - DNA, 26 bp, Artificial Sequence
  Description of Artificial Sequence: Synthetic oligonucleotide
ctggcagcctcatccgtctcgtcttg

SEQ ID NO: 347420 - DNA, 27 bp, Artificial Sequence
  Description of Artificial Sequence: Synthetic oligonucleotide
tggcagcctcatccgtctcgtcttgct

SEQ ID NO: 347421 - DNA, 26 bp, Artificial Sequence
  Description of Artificial Sequence: Synthetic oligonucleotide
ggcagcctcatccgtctcgtcttgct

SEQ ID NO: 347422 - DNA, 26 bp, Artificial Sequence
  Description of Artificial Sequence: Synthetic oligonucleotide
gcagcctcatccgtctcgtcttgctc

SEQ ID NO: 347423 - DNA, 26 bp, Artificial Sequence
  Description of Artificial Sequence: Synthetic oligonucleotide
cagcctcatccgtctcgtcttgctcc

SEQ ID NO: 347424 - DNA, 26 bp, Artificial Sequence
  Description of Artificial Sequence: Synthetic oligonucleotide
agcctcatccgtctcgtcttgctccg

SEQ ID NO: 347425 - DNA, 25 bp, Artificial Sequence
  Description of Artificial Sequence: Synthetic oligonucleotide
gcctcatccgtctcgtcttgctccg

SEQ ID NO: 347426 - DNA, 25 bp, Artificial Sequence
  Description of Artificial Sequence: Synthetic oligonucleotide
cctcatccgtctcgtcttgctccgg

SEQ ID NO: 347427 - DNA, 26 bp, Artificial Sequence
  Description of Artificial Sequence: Synthetic oligonucleotide
ctcatccgtctcgtcttgctccggct

SEQ ID NO: 347428 - DNA, 27 bp, Artificial Sequence
  Description of Artificial Sequence: Synthetic oligonucleotide
tcatccgtctcgtcttgctccggctga

SEQ ID NO: 347429 - DNA, 26 bp, Artificial Sequence
  Description of Artificial Sequence: Synthetic oligonucleotide
catccgtctcgtcttgctccggctga

SEQ ID NO: 347430 - DNA, 27 bp, Artificial Sequence
  Description of Artificial Sequence: Synthetic oligonucleotide
atccgtctcgtcttgctccggctgact

SEQ ID NO: 347431 - DNA, 26 bp, Artificial Sequence
  Description of Artificial Sequence: Synthetic oligonucleotide
tccgtctcgtcttgctccggctgact

SEQ ID NO: 347432 - DNA, 25 bp, Artificial Sequence
  Description of Artificial Sequence: Synthetic oligonucleotide
ccgtctcgtcttgctccggctgact

SEQ ID NO: 347433 - DNA, 26 bp, Artificial Sequence
  Description of Artificial Sequence: Synthetic oligonucleotide
cgtctcgtcttgctccggctgactgt

SEQ ID NO: 347434 - DNA, 26 bp, Artificial Sequence
  Description of Artificial Sequence: Synthetic oligonucleotide
gtctcgtcttgctccggctgactgtg

SEQ ID NO: 347435 - DNA, 27 bp, Artificial Sequence
  Description of Artificial Sequence: Synthetic oligonucleotide
tctcgtcttgctccggctgactgtgca

SEQ ID NO: 347436 - DNA, 27 bp, Artificial Sequence
  Description of Artificial Sequence: Synthetic oligonucleotide
ctcgtcttgctccggctgactgtgcat

SEQ ID NO: 347437 - DNA, 27 bp, Artificial Sequence
  Description of Artificial Sequence: Synthetic oligonucleotide
tcgtcttgctccggctgactgtgcatg

SEQ ID NO: 347438 - DNA, 27 bp, Artificial Sequence
  Description of Artificial Sequence: Synthetic oligonucleotide
cgtcttgctccggctgactgtgcatga

SEQ ID NO: 347439 - DNA, 27 bp, Artificial Sequence
  Description of Artificial Sequence: Synthetic oligonucleotide
gtcttgctccggctgactgtgcatgag

SEQ ID NO: 347440 - DNA, 28 bp, Artificial Sequence
  Description of Artificial Sequence: Synthetic oligonucleotide
tcttgctccggctgactgtgcatgagtc

SEQ ID NO: 347441 - DNA, 27 bp, Artificial Sequence
  Description of Artificial Sequence: Synthetic oligonucleotide
cttgctccggctgactgtgcatgagtc

SEQ ID NO: 347442 - DNA, 28 bp, Artificial Sequence
  Description of Artificial Sequence: Synthetic oligonucleotide
ttgctccggctgactgtgcatgagtcag

SEQ ID NO: 347443 - DNA, 27 bp, Artificial Sequence
  Description of Artificial Sequence: Synthetic oligonucleotide
tgctccggctgactgtgcatgagtcag

SEQ ID NO: 347444 - DNA, 26 bp, Artificial Sequence
  Description of Artificial Sequence: Synthetic oligonucleotide
gctccggctgactgtgcatgagtcag

SEQ ID NO: 347445 - DNA, 26 bp, Artificial Sequence
  Description of Artificial Sequence: Synthetic oligonucleotide
ctccggctgactgtgcatgagtcagg

SEQ ID NO: 347446 - DNA, 26 bp, Artificial Sequence
  Description of Artificial Sequence: Synthetic oligonucleotide
tccggctgactgtgcatgagtcaggc

SEQ ID NO: 347447 - DNA, 25 bp, Artificial Sequence
  Description of Artificial Sequence: Synthetic oligonucleotide
ccggctgactgtgcatgagtcaggc

SEQ ID NO: 347448 - DNA, 26 bp, Artificial Sequence
  Description of Artificial Sequence: Synthetic oligonucleotide
cggctgactgtgcatgagtcaggcca

SEQ ID NO: 347449 - DNA, 26 bp, Artificial Sequence
  Description of Artificial Sequence: Synthetic oligonucleotide
ggctgactgtgcatgagtcaggccag

SEQ ID NO: 347450 - DNA, 26 bp, Artificial Sequence
  Description of Artificial Sequence: Synthetic oligonucleotide
gctgactgtgcatgagtcaggccagg

SEQ ID NO: 347451 - DNA, 27 bp, Artificial Sequence
  Description of Artificial Sequence: Synthetic oligonucleotide
ctgactgtgcatgagtcaggccaggca

SEQ ID NO: 347452 - DNA, 27 bp, Artificial Sequence
  Description of Artificial Sequence: Synthetic oligonucleotide
tgactgtgcatgagtcaggccaggcag

SEQ ID NO: 347453 - DNA, 26 bp, Artificial Sequence
  Description of Artificial Sequence: Synthetic oligonucleotide
gactgtgcatgagtcaggccaggcag

SEQ ID NO: 347454 - DNA, 26 bp, Artificial Sequence
  Description of Artificial Sequence: Synthetic oligonucleotide
actgtgcatgagtcaggccaggcagg

SEQ ID NO: 347455 - DNA, 25 bp, Artificial Sequence
  Description of Artificial Sequence: Synthetic oligonucleotide
ctgtgcatgagtcaggccaggcagg

SEQ ID NO: 347456 - DNA, 25 bp, Artificial Sequence
  Description of Artificial Sequence: Synthetic oligonucleotide
tgtgcatgagtcaggccaggcaggg

SEQ ID NO: 347457 - DNA, 24 bp, Artificial Sequence
  Description of Artificial Sequence: Synthetic oligonucleotide
gtgcatgagtcaggccaggcaggg

SEQ ID NO: 347458 - DNA, 26 bp, Artificial Sequence
  Description of Artificial Sequence: Synthetic oligonucleotide
tgcatgagtcaggccaggcaggggat

SEQ ID NO: 347459 - DNA, 25 bp, Artificial Sequence
  Description of Artificial Sequence: Synthetic oligonucleotide
gcatgagtcaggccaggcaggggat

SEQ ID NO: 347460 - DNA, 25 bp, Artificial Sequence
  Description of Artificial Sequence: Synthetic oligonucleotide
catgagtcaggccaggcaggggatc

SEQ ID NO: 347461 - DNA, 25 bp, Artificial Sequence
  Description of Artificial Sequence: Synthetic oligonucleotide
atgagtcaggccaggcaggggatcc

SEQ ID NO: 347462 - DNA, 24 bp, Artificial Sequence
  Description of Artificial Sequence: Synthetic oligonucleotide
tgagtcaggccaggcaggggatcc

SEQ ID NO: 347463 - DNA, 23 bp, Artificial Sequence
  Description of Artificial Sequence: Synthetic oligonucleotide
gagtcaggccaggcaggggatcc

SEQ ID NO: 347464 - DNA, 23 bp, Artificial Sequence
  Description of Artificial Sequence: Synthetic oligonucleotide
agtcaggccaggcaggggatccc

SEQ ID NO: 347465 - DNA, 22 bp, Artificial Sequence
  Description of Artificial Sequence: Synthetic oligonucleotide
gtcaggccaggcaggggatccc

SEQ ID NO: 347466 - DNA, 22 bp, Artificial Sequence
  Description of Artificial Sequence: Synthetic oligonucleotide
tcaggccaggcaggggatcccg

SEQ ID NO: 347467 - DNA, 21 bp, Artificial Sequence
  Description of Artificial Sequence: Synthetic oligonucleotide
caggccaggcaggggatcccg

SEQ ID NO: 347468 - DNA, 21 bp, Artificial Sequence
  Description of Artificial Sequence: Synthetic oligonucleotide
aggccaggcaggggatcccgg

SEQ ID NO: 347469 - DNA, 20 bp, Artificial Sequence
  Description of Artificial Sequence: Synthetic oligonucleotide
ggccaggcaggggatcccgg

SEQ ID NO: 347470 - DNA, 22 bp, Artificial Sequence
  Description of Artificial Sequence: Synthetic oligonucleotide
gccaggcaggggatcccggcaa

SEQ ID NO: 347471 - DNA, 24 bp, Artificial Sequence
  Description of Artificial Sequence: Synthetic oligonucleotide
ccaggcaggggatcccggcaagta

SEQ ID NO: 347472 - DNA, 24 bp, Artificial Sequence
  Description of Artificial Sequence: Synthetic oligonucleotide
caggcaggggatcccggcaagtac

SEQ ID NO: 347473 - DNA, 25 bp, Artificial Sequence
  Description of Artificial Sequence: Synthetic oligonucleotide
aggcaggggatcccggcaagtacca

SEQ ID NO: 347474 - DNA, 24 bp, Artificial Sequence
  Description of Artificial Sequence: Synthetic oligonucleotide
ggcaggggatcccggcaagtacca

SEQ ID NO: 347475 - DNA, 24 bp, Artificial Sequence
  Description of Artificial Sequence: Synthetic oligonucleotide
gcaggggatcccggcaagtaccac

SEQ ID NO: 347476 - DNA, 25 bp, Artificial Sequence
  Description of Artificial Sequence: Synthetic oligonucleotide
caggggatcccggcaagtaccacgt

SEQ ID NO: 347477 - DNA, 25 bp, Artificial Sequence
  Description of Artificial Sequence: Synthetic oligonucleotide
aggggatcccggcaagtaccacgtg

SEQ ID NO: 347478 - DNA, 24 bp, Artificial Sequence
  Description of Artificial Sequence: Synthetic oligonucleotide
ggggatcccggcaagtaccacgtg

SEQ ID NO: 347479 - DNA, 24 bp, Artificial Sequence
  Description of Artificial Sequence: Synthetic oligonucleotide
gggatcccggcaagtaccacgtgg

SEQ ID NO: 347480 - DNA, 24 bp, Artificial Sequence
  Description of Artificial Sequence: Synthetic oligonucleotide
ggatcccggcaagtaccacgtggc

SEQ ID NO: 347481 - DNA, 24 bp, Artificial Sequence
  Description of Artificial Sequence: Synthetic oligonucleotide
gatcccggcaagtaccacgtggcg

SEQ ID NO: 347482 - DNA, 26 bp, Artificial Sequence
  Description of Artificial Sequence: Synthetic oligonucleotide
atcccggcaagtaccacgtggcgcta

SEQ ID NO: 347483 - DNA, 25 bp, Artificial Sequence
  Description of Artificial Sequence: Synthetic oligonucleotide
tcccggcaagtaccacgtggcgcta

SEQ ID NO: 347484 - DNA, 24 bp, Artificial Sequence
  Description of Artificial Sequence: Synthetic oligonucleotide
cccggcaagtaccacgtggcgcta

SEQ ID NO: 347485 - DNA, 26 bp, Artificial Sequence
  Description of Artificial Sequence: Synthetic oligonucleotide
ccggcaagtaccacgtggcgctacta

SEQ ID NO: 347486 - DNA, 26 bp, Artificial Sequence
  Description of Artificial Sequence: Synthetic oligonucleotide
cggcaagtaccacgtggcgctactag

SEQ ID NO: 347487 - DNA, 26 bp, Artificial Sequence
  Description of Artificial Sequence: Synthetic oligonucleotide
ggcaagtaccacgtggcgctactagg

SEQ ID NO: 347488 - DNA, 26 bp, Artificial Sequence
  Description of Artificial Sequence: Synthetic oligonucleotide
gcaagtaccacgtggcgctactaggg

SEQ ID NO: 347489 - DNA, 26 bp, Artificial Sequence
  Description of Artificial Sequence: Synthetic oligonucleotide
caagtaccacgtggcgctactagggc

SEQ ID NO: 347490 - DNA, 26 bp, Artificial Sequence
  Description of Artificial Sequence: Synthetic oligonucleotide
aagtaccacgtggcgctactagggcg

SEQ ID NO: 347491 - DNA, 25 bp, Artificial Sequence
  Description of Artificial Sequence: Synthetic oligonucleotide
agtaccacgtggcgctactagggcg

SEQ ID NO: 347492 - DNA, 24 bp, Artificial Sequence
  Description of Artificial Sequence: Synthetic oligonucleotide
gtaccacgtggcgctactagggcg

SEQ ID NO: 347493 - DNA, 25 bp, Artificial Sequence
  Description of Artificial Sequence: Synthetic oligonucleotide
taccacgtggcgctactagggcgca

SEQ ID NO: 347494 - DNA, 24 bp, Artificial Sequence
  Description of Artificial Sequence: Synthetic oligonucleotide
accacgtggcgctactagggcgca

SEQ ID NO: 347495 - DNA, 23 bp, Artificial Sequence
  Description of Artificial Sequence: Synthetic oligonucleotide
ccacgtggcgctactagggcgca

SEQ ID NO: 347496 - DNA, 24 bp, Artificial Sequence
  Description of Artificial Sequence: Synthetic oligonucleotide
cacgtggcgctactagggcgcaca

SEQ ID NO: 347497 - DNA, 24 bp, Artificial Sequence
  Description of Artificial Sequence: Synthetic oligonucleotide
acgtggcgctactagggcgcacag

SEQ ID NO: 347498 - DNA, 23 bp, Artificial Sequence
  Description of Artificial Sequence: Synthetic oligonucleotide
cgtggcgctactagggcgcacag

SEQ ID NO: 347499 - DNA, 23 bp, Artificial Sequence
  Description of Artificial Sequence: Synthetic oligonucleotide
gtggcgctactagggcgcacagc

SEQ ID NO: 347500 - DNA, 23 bp, Artificial Sequence
  Description of Artificial Sequence: Synthetic oligonucleotide
tggcgctactagggcgcacagcc

SEQ ID NO: 347501 - DNA, 22 bp, Artificial Sequence
  Description of Artificial Sequence: Synthetic oligonucleotide
ggcgctactagggcgcacagcc

SEQ ID NO: 347502 - DNA, 23 bp, Artificial Sequence
  Description of Artificial Sequence: Synthetic oligonucleotide
gcgctactagggcgcacagccgt

SEQ ID NO: 347503 - DNA, 23 bp, Artificial Sequence
  Description of Artificial Sequence: Synthetic oligonucleotide
cgctactagggcgcacagccgtg

SEQ ID NO: 347504 - DNA, 24 bp, Artificial Sequence
  Description of Artificial Sequence: Synthetic oligonucleotide
gctactagggcgcacagccgtgct

SEQ ID NO: 347505 - DNA, 24 bp, Artificial Sequence
  Description of Artificial Sequence: Synthetic oligonucleotide
ctactagggcgcacagccgtgctg

SEQ ID NO: 347506 - DNA, 25 bp, Artificial Sequence
  Description of Artificial Sequence: Synthetic oligonucleotide
tactagggcgcacagccgtgctgct

SEQ ID NO: 347507 - DNA, 24 bp, Artificial Sequence
  Description of Artificial Sequence: Synthetic oligonucleotide
actagggcgcacagccgtgctgct

SEQ ID NO: 347508 - DNA, 23 bp, Artificial Sequence
  Description of Artificial Sequence: Synthetic oligonucleotide
ctagggcgcacagccgtgctgct

SEQ ID NO: 347509 - DNA, 24 bp, Artificial Sequence
  Description of Artificial Sequence: Synthetic oligonucleotide
tagggcgcacagccgtgctgctct

SEQ ID NO: 347510 - DNA, 23 bp, Artificial Sequence
  Description of Artificial Sequence: Synthetic oligonucleotide
agggcgcacagccgtgctgctct

SEQ ID NO: 347511 - DNA, 22 bp, Artificial Sequence
  Description of Artificial Sequence: Synthetic oligonucleotide
gggcgcacagccgtgctgctct

SEQ ID NO: 347512 - DNA, 22 bp, Artificial Sequence
  Description of Artificial Sequence: Synthetic oligonucleotide
ggcgcacagccgtgctgctctg

SEQ ID NO: 347513 - DNA, 22 bp, Artificial Sequence
  Description of Artificial Sequence: Synthetic oligonucleotide
gcgcacagccgtgctgctctgg

SEQ ID NO: 347514 - DNA, 22 bp, Artificial Sequence
  Description of Artificial Sequence: Synthetic oligonucleotide
cgcacagccgtgctgctctggc

SEQ ID NO: 347515 - DNA, 23 bp, Artificial Sequence
  Description of Artificial Sequence: Synthetic oligonucleotide
gcacagccgtgctgctctggcct

SEQ ID NO: 347516 - DNA, 24 bp, Artificial Sequence
  Description of Artificial Sequence: Synthetic oligonucleotide
cacagccgtgctgctctggcctct

SEQ ID NO: 347517 - DNA, 25 bp, Artificial Sequence
  Description of Artificial Sequence: Synthetic oligonucleotide
acagccgtgctgctctggcctctct

SEQ ID NO: 347518 - DNA, 24 bp, Artificial Sequence
  Description of Artificial Sequence: Synthetic oligonucleotide
cagccgtgctgctctggcctctct

SEQ ID NO: 347519 - DNA, 24 bp, Artificial Sequence
  Description of Artificial Sequence: Synthetic oligonucleotide
agccgtgctgctctggcctctctc

SEQ ID NO: 347520 - DNA, 23 bp, Artificial Sequence
  Description of Artificial Sequence: Synthetic oligonucleotide
gccgtgctgctctggcctctctc

SEQ ID NO: 347521 - DNA, 23 bp, Artificial Sequence
  Description of Artificial Sequence: Synthetic oligonucleotide
ccgtgctgctctggcctctctcc

SEQ ID NO: 347522 - DNA, 24 bp, Artificial Sequence
  Description of Artificial Sequence: Synthetic oligonucleotide
cgtgctgctctggcctctctccgt

SEQ ID NO: 347523 - DNA, 25 bp, Artificial Sequence
  Description of Artificial Sequence: Synthetic oligonucleotide
gtgctgctctggcctctctccgtct

SEQ ID NO: 347524 - DNA, 25 bp, Artificial Sequence
  Description of Artificial Sequence: Synthetic oligonucleotide
tgctgctctggcctctctccgtctg

SEQ ID NO: 347525 - DNA, 24 bp, Artificial Sequence
  Description of Artificial Sequence: Synthetic oligonucleotide
gctgctctggcctctctccgtctg

SEQ ID NO: 347526 - DNA, 24 bp, Artificial Sequence
  Description of Artificial Sequence: Synthetic oligonucleotide
ctgctctggcctctctccgtctgg

SEQ ID NO: 347527 - DNA, 24 bp, Artificial Sequence
  Description of Artificial Sequence: Synthetic oligonucleotide
tgctctggcctctctccgtctggc

SEQ ID NO: 347528 - DNA, 23 bp, Artificial Sequence
  Description of Artificial Sequence: Synthetic oligonucleotide
gctctggcctctctccgtctggc

SEQ ID NO: 347529 - DNA, 23 bp, Artificial Sequence
  Description of Artificial Sequence: Synthetic oligonucleotide
ctctggcctctctccgtctggcc

SEQ ID NO: 347530 - DNA, 23 bp, Artificial Sequence
  Description of Artificial Sequence: Synthetic oligonucleotide
tctggcctctctccgtctggccc

SEQ ID NO: 347531 - DNA, 22 bp, Artificial Sequence
  Description of Artificial Sequence: Synthetic oligonucleotide
ctggcctctctccgtctggccc

SEQ ID NO: 347532 - DNA, 22 bp, Artificial Sequence
  Description of Artificial Sequence: Synthetic oligonucleotide
tggcctctctccgtctggcccg

SEQ ID NO: 347533 - DNA, 21 bp, Artificial Sequence
  Description of Artificial Sequence: Synthetic oligonucleotide
ggcctctctccgtctggcccg

SEQ ID NO: 347534 - DNA, 21 bp, Artificial Sequence
  Description of Artificial Sequence: Synthetic oligonucleotide
gcctctctccgtctggcccgc

SEQ ID NO: 347535 - DNA, 22 bp, Artificial Sequence
  Description of Artificial Sequence: Synthetic oligonucleotide
cctctctccgtctggcccgcga

SEQ ID NO: 347536 - DNA, 22 bp, Artificial Sequence
  Description of Artificial Sequence: Synthetic oligonucleotide
ctctctccgtctggcccgcgac

SEQ ID NO: 347537 - DNA, 22 bp, Artificial Sequence
  Description of Artificial Sequence: Synthetic oligonucleotide
tctctccgtctggcccgcgacg

SEQ ID NO: 347538 - DNA, 21 bp, Artificial Sequence
  Description of Artificial Sequence: Synthetic oligonucleotide
ctctccgtctggcccgcgacg

SEQ ID NO: 347539 - DNA, 23 bp, Artificial Sequence
  Description of Artificial Sequence: Synthetic oligonucleotide
tctccgtctggcccgcgacggta

SEQ ID NO: 347540 - DNA, 22 bp, Artificial Sequence
  Description of Artificial Sequence: Synthetic oligonucleotide
ctccgtctggcccgcgacggta

SEQ ID NO: 347541 - DNA, 22 bp, Artificial Sequence
  Description of Artificial Sequence: Synthetic oligonucleotide
tccgtctggcccgcgacggtac

SEQ ID NO: 347542 - DNA, 21 bp, Artificial Sequence
  Description of Artificial Sequence: Synthetic oligonucleotide
ccgtctggcccgcgacggtac

SEQ ID NO: 347543 - DNA, 21 bp, Artificial Sequence
  Description of Artificial Sequence: Synthetic oligonucleotide
cgtctggcccgcgacggtacc

SEQ ID NO: 347544 - DNA, 23 bp, Artificial Sequence
  Description of Artificial Sequence: Synthetic oligonucleotide
gtctggcccgcgacggtaccgaa

SEQ ID NO: 347545 - DNA, 23 bp, Artificial Sequence
  Description of Artificial Sequence: Synthetic oligonucleotide
tctggcccgcgacggtaccgaag

SEQ ID NO: 347546 - DNA, 22 bp, Artificial Sequence
  Description of Artificial Sequence: Synthetic oligonucleotide
ctggcccgcgacggtaccgaag

SEQ ID NO: 347547 - DNA, 23 bp, Artificial Sequence
  Description of Artificial Sequence: Synthetic oligonucleotide
tggcccgcgacggtaccgaagga

SEQ ID NO: 347548 - DNA, 22 bp, Artificial Sequence
  Description of Artificial Sequence: Synthetic oligonucleotide
ggcccgcgacggtaccgaagga

SEQ ID NO: 347549 - DNA, 22 bp, Artificial Sequence
  Description of Artificial Sequence: Synthetic oligonucleotide
gcccgcgacggtaccgaaggag

SEQ ID NO: 347550 - DNA, 23 bp, Artificial Sequence
  Description of Artificial Sequence: Synthetic oligonucleotide
cccgcgacggtaccgaaggaggt

SEQ ID NO: 347551 - DNA, 24 bp, Artificial Sequence
  Description of Artificial Sequence: Synthetic oligonucleotide
ccgcgacggtaccgaaggaggtgt

SEQ ID NO: 347552 - DNA, 24 bp, Artificial Sequence
  Description of Artificial Sequence: Synthetic oligonucleotide
cgcgacggtaccgaaggaggtgtg

SEQ ID NO: 347553 - DNA, 25 bp, Artificial Sequence
  Description of Artificial Sequence: Synthetic oligonucleotide
gcgacggtaccgaaggaggtgtggt

SEQ ID NO: 347554 - DNA, 25 bp, Artificial Sequence
  Description of Artificial Sequence: Synthetic oligonucleotide
cgacggtaccgaaggaggtgtggtg

SEQ ID NO: 347555 - DNA, 25 bp, Artificial Sequence
  Description of Artificial Sequence: Synthetic oligonucleotide
gacggtaccgaaggaggtgtggtgg

SEQ ID NO: 347556 - DNA, 26 bp, Artificial Sequence
  Description of Artificial Sequence: Synthetic oligonucleotide
acggtaccgaaggaggtgtggtggct

SEQ ID NO: 347557 - DNA, 25 bp, Artificial Sequence
  Description of Artificial Sequence: Synthetic oligonucleotide
cggtaccgaaggaggtgtggtggct

SEQ ID NO: 347558 - DNA, 25 bp, Artificial Sequence
  Description of Artificial Sequence: Synthetic oligonucleotide
ggtaccgaaggaggtgtggtggctg

SEQ ID NO: 347559 - DNA, 25 bp, Artificial Sequence
  Description of Artificial Sequence: Synthetic oligonucleotide
gtaccgaaggaggtgtggtggctgc

SEQ ID NO: 347560 - DNA, 25 bp, Artificial Sequence
  Description of Artificial Sequence: Synthetic oligonucleotide
taccgaaggaggtgtggtggctgcc

SEQ ID NO: 347561 - DNA, 24 bp, Artificial Sequence
  Description of Artificial Sequence: Synthetic oligonucleotide
accgaaggaggtgtggtggctgcc

SEQ ID NO: 347562 - DNA, 23 bp, Artificial Sequence
  Description of Artificial Sequence: Synthetic oligonucleotide
ccgaaggaggtgtggtggctgcc

SEQ ID NO: 347563 - DNA, 24 bp, Artificial Sequence
  Description of Artificial Sequence: Synthetic oligonucleotide
cgaaggaggtgtggtggctgccgt

SEQ ID NO: 347564 - DNA, 24 bp, Artificial Sequence
  Description of Artificial Sequence: Synthetic oligonucleotide
gaaggaggtgtggtggctgccgtc

SEQ ID NO: 347565 - DNA, 24 bp, Artificial Sequence
  Description of Artificial Sequence: Synthetic oligonucleotide
aaggaggtgtggtggctgccgtcc

SEQ ID NO: 347566 - DNA, 23 bp, Artificial Sequence
  Description of Artificial Sequence: Synthetic oligonucleotide
aggaggtgtggtggctgccgtcc

SEQ ID NO: 347567 - DNA, 22 bp, Artificial Sequence
  Description of Artificial Sequence: Synthetic oligonucleotide
ggaggtgtggtggctgccgtcc

SEQ ID NO: 347568 - DNA, 22 bp, Artificial Sequence
  Description of Artificial Sequence: Synthetic oligonucleotide
gaggtgtggtggctgccgtccc

SEQ ID NO: 347569 - DNA, 25 bp, Artificial Sequence
  Description of Artificial Sequence: Synthetic oligonucleotide
aggtgtggtggctgccgtccccatt

SEQ ID NO: 347570 - DNA, 24 bp, Artificial Sequence
  Description of Artificial Sequence: Synthetic oligonucleotide
ggtgtggtggctgccgtccccatt

SEQ ID NO: 347571 - DNA, 24 bp, Artificial Sequence
  Description of Artificial Sequence: Synthetic oligonucleotide
gtgtggtggctgccgtccccattg

SEQ ID NO: 347572 - DNA, 24 bp, Artificial Sequence
  Description of Artificial Sequence: Synthetic oligonucleotide
tgtggtggctgccgtccccattgc

SEQ ID NO: 347573 - DNA, 23 bp, Artificial Sequence
  Description of Artificial Sequence: Synthetic oligonucleotide
gtggtggctgccgtccccattgc

SEQ ID NO: 347574 - DNA, 23 bp, Artificial Sequence
  Description of Artificial Sequence: Synthetic oligonucleotide
tggtggctgccgtccccattgcc

SEQ ID NO: 347575 - DNA, 22 bp, Artificial Sequence
  Description of Artificial Sequence: Synthetic oligonucleotide
ggtggctgccgtccccattgcc

SEQ ID NO: 347576 - DNA, 22 bp, Artificial Sequence
  Description of Artificial Sequence: Synthetic oligonucleotide
gtggctgccgtccccattgccg

SEQ ID NO: 347577 - DNA, 23 bp, Artificial Sequence
  Description of Artificial Sequence: Synthetic oligonucleotide
tggctgccgtccccattgccgca

SEQ ID NO: 347578 - DNA, 22 bp, Artificial Sequence
  Description of Artificial Sequence: Synthetic oligonucleotide
ggctgccgtccccattgccgca

SEQ ID NO: 347579 - DNA, 22 bp, Artificial Sequence
  Description of Artificial Sequence: Synthetic oligonucleotide
gctgccgtccccattgccgcag

SEQ ID NO: 347580 - DNA, 22 bp, Artificial Sequence
  Description of Artificial Sequence: Synthetic oligonucleotide
ctgccgtccccattgccgcagc

SEQ ID NO: 347581 - DNA, 22 bp, Artificial Sequence
  Description of Artificial Sequence: Synthetic oligonucleotide
tgccgtccccattgccgcagcg

SEQ ID NO: 347582 - DNA, 21 bp, Artificial Sequence
  Description of Artificial Sequence: Synthetic oligonucleotide
gccgtccccattgccgcagcg

SEQ ID NO: 347583 - DNA, 22 bp, Artificial Sequence
  Description of Artificial Sequence: Synthetic oligonucleotide
ccgtccccattgccgcagcgca

SEQ ID NO: 347584 - DNA, 22 bp, Artificial Sequence
  Description of Artificial Sequence: Synthetic oligonucleotide
cgtccccattgccgcagcgcac

SEQ ID NO: 347585 - DNA, 22 bp, Artificial Sequence
  Description of Artificial Sequence: Synthetic oligonucleotide
gtccccattgccgcagcgcacc

SEQ ID NO: 347586 - DNA, 23 bp, Artificial Sequence
  Description of Artificial Sequence: Synthetic oligonucleotide
tccccattgccgcagcgcaccca

SEQ ID NO: 347587 - DNA, 22 bp, Artificial Sequence
  Description of Artificial Sequence: Synthetic oligonucleotide
ccccattgccgcagcgcaccca

SEQ ID NO: 347588 - DNA, 22 bp, Artificial Sequence
  Description of Artificial Sequence: Synthetic oligonucleotide
cccattgccgcagcgcacccag

SEQ ID NO: 347589 - DNA, 22 bp, Artificial Sequence
  Description of Artificial Sequence: Synthetic oligonucleotide
ccattgccgcagcgcacccagg

SEQ ID NO: 347590 - DNA, 23 bp, Artificial Sequence
  Description of Artificial Sequence: Synthetic oligonucleotide
cattgccgcagcgcacccaggct

SEQ ID NO: 347591 - DNA, 25 bp, Artificial Sequence
  Description of Artificial Sequence: Synthetic oligonucleotide
attgccgcagcgcacccaggctgat

SEQ ID NO: 347592 - DNA, 24 bp, Artificial Sequence
  Description of Artificial Sequence: Synthetic oligonucleotide
ttgccgcagcgcacccaggctgat

SEQ ID NO: 347593 - DNA, 23 bp, Artificial Sequence
  Description of Artificial Sequence: Synthetic oligonucleotide
tgccgcagcgcacccaggctgat

SEQ ID NO: 347594 - DNA, 22 bp, Artificial Sequence
  Description of Artificial Sequence: Synthetic oligonucleotide
gccgcagcgcacccaggctgat

SEQ ID NO: 347595 - DNA, 23 bp, Artificial Sequence
  Description of Artificial Sequence: Synthetic oligonucleotide
ccgcagcgcacccaggctgatca

SEQ ID NO: 347596 - DNA, 27 bp, Artificial Sequence
  Description of Artificial Sequence: Synthetic oligonucleotide
cgcagcgcacccaggctgatcacatat

SEQ ID NO: 347597 - DNA, 28 bp, Artificial Sequence
  Description of Artificial Sequence: Synthetic oligonucleotide
gcagcgcacccaggctgatcacatattg

SEQ ID NO: 347598 - DNA, 28 bp, Artificial Sequence
  Description of Artificial Sequence: Synthetic oligonucleotide
cagcgcacccaggctgatcacatattgc

SEQ ID NO: 347599 - DNA, 28 bp, Artificial Sequence
  Description of Artificial Sequence: Synthetic oligonucleotide
agcgcacccaggctgatcacatattgcg

SEQ ID NO: 347600 - DNA, 27 bp, Artificial Sequence
  Description of Artificial Sequence: Synthetic oligonucleotide
gcgcacccaggctgatcacatattgcg

SEQ ID NO: 347601 - DNA, 27 bp, Artificial Sequence
  Description of Artificial Sequence: Synthetic oligonucleotide
cgcacccaggctgatcacatattgcgg

SEQ ID NO: 347602 - DNA, 27 bp, Artificial Sequence
  Description of Artificial Sequence: Synthetic oligonucleotide
gcacccaggctgatcacatattgcggg

SEQ ID NO: 347603 - DNA, 29 bp, Artificial Sequence
  Description of Artificial Sequence: Synthetic oligonucleotide
cacccaggctgatcacatattgcgggatg

SEQ ID NO: 347604 - DNA, 29 bp, Artificial Sequence
  Description of Artificial Sequence: Synthetic oligonucleotide
acccaggctgatcacatattgcgggatgg

SEQ ID NO: 347605 - DNA, 28 bp, Artificial Sequence
  Description of Artificial Sequence: Synthetic oligonucleotide
cccaggctgatcacatattgcgggatgg

SEQ ID NO: 347606 - DNA, 28 bp, Artificial Sequence
  Description of Artificial Sequence: Synthetic oligonucleotide
ccaggctgatcacatattgcgggatggg

SEQ ID NO: 347607 - DNA, 30 bp, Artificial Sequence
  Description of Artificial Sequence: Synthetic oligonucleotide
caggctgatcacatattgcgggatgggtag

SEQ ID NO: 347608 - DNA, 30 bp, Artificial Sequence
  Description of Artificial Sequence: Synthetic oligonucleotide
aggctgatcacatattgcgggatgggtagg

SEQ ID NO: 347609 - DNA, 29 bp, Artificial Sequence
  Description of Artificial Sequence: Synthetic oligonucleotide
ggctgatcacatattgcgggatgggtagg

SEQ ID NO: 347610 - DNA, 30 bp, Artificial Sequence
  Description of Artificial Sequence: Synthetic oligonucleotide
gctgatcacatattgcgggatgggtaggac

SEQ ID NO: 347611 - DNA, 30 bp, Artificial Sequence
  Description of Artificial Sequence: Synthetic oligonucleotide
ctgatcacatattgcgggatgggtaggacc

SEQ ID NO: 347612 - DNA, 31 bp, Artificial Sequence
  Description of Artificial Sequence: Synthetic oligonucleotide
tgatcacatattgcgggatgggtaggaccag

SEQ ID NO: 347613 - DNA, 30 bp, Artificial Sequence
  Description of Artificial Sequence: Synthetic oligonucleotide
gatcacatattgcgggatgggtaggaccag

SEQ ID NO: 347614 - DNA, 30 bp, Artificial Sequence
  Description of Artificial Sequence: Synthetic oligonucleotide
atcacatattgcgggatgggtaggaccagg

SEQ ID NO: 347615 - DNA, 29 bp, Artificial Sequence
  Description of Artificial Sequence: Synthetic oligonucleotide
tcacatattgcgggatgggtaggaccagg

SEQ ID NO: 347616 - DNA, 28 bp, Artificial Sequence
  Description of Artificial Sequence: Synthetic oligonucleotide
cacatattgcgggatgggtaggaccagg

SEQ ID NO: 347617 - DNA, 30 bp, Artificial Sequence
  Description of Artificial Sequence: Synthetic oligonucleotide
acatattgcgggatgggtaggaccaggttg

SEQ ID NO: 347618 - DNA, 29 bp, Artificial Sequence
  Description of Artificial Sequence: Synthetic oligonucleotide
catattgcgggatgggtaggaccaggttg

SEQ ID NO: 347619 - DNA, 31 bp, Artificial Sequence
  Description of Artificial Sequence: Synthetic oligonucleotide
atattgcgggatgggtaggaccaggttgaag

SEQ ID NO: 347620 - DNA, 30 bp, Artificial Sequence
  Description of Artificial Sequence: Synthetic oligonucleotide
tattgcgggatgggtaggaccaggttgaag

SEQ ID NO: 347621 - DNA, 29 bp, Artificial Sequence
  Description of Artificial Sequence: Synthetic oligonucleotide
attgcgggatgggtaggaccaggttgaag

SEQ ID NO: 347622 - DNA, 28 bp, Artificial Sequence
  Description of Artificial Sequence: Synthetic oligonucleotide
ttgcgggatgggtaggaccaggttgaag

SEQ ID NO: 347623 - DNA, 27 bp, Artificial Sequence
  Description of Artificial Sequence: Synthetic oligonucleotide
tgcgggatgggtaggaccaggttgaag

SEQ ID NO: 347624 - DNA, 27 bp, Artificial Sequence
  Description of Artificial Sequence: Synthetic oligonucleotide
gcgggatgggtaggaccaggttgaaga

SEQ ID NO: 347625 - DNA, 28 bp, Artificial Sequence
  Description of Artificial Sequence: Synthetic oligonucleotide
cgggatgggtaggaccaggttgaagatc

SEQ ID NO: 347626 - DNA, 29 bp, Artificial Sequence
  Description of Artificial Sequence: Synthetic oligonucleotide
gggatgggtaggaccaggttgaagatctc

SEQ ID NO: 347627 - DNA, 31 bp, Artificial Sequence
  Description of Artificial Sequence: Synthetic oligonucleotide
ggatgggtaggaccaggttgaagatctcatg

SEQ ID NO: 347628 - DNA, 31 bp, Artificial Sequence
  Description of Artificial Sequence: Synthetic oligonucleotide
gatgggtaggaccaggttgaagatctcatgc

SEQ ID NO: 347629 - DNA, 31 bp, Artificial Sequence
  Description of Artificial Sequence: Synthetic oligonucleotide
atgggtaggaccaggttgaagatctcatgcc

SEQ ID NO: 347630 - DNA, 30 bp, Artificial Sequence
  Description of Artificial Sequence: Synthetic oligonucleotide
tgggtaggaccaggttgaagatctcatgcc

SEQ ID NO: 347631 - DNA, 29 bp, Artificial Sequence
  Description of Artificial Sequence: Synthetic oligonucleotide
gggtaggaccaggttgaagatctcatgcc

SEQ ID NO: 347632 - DNA, 29 bp, Artificial Sequence
  Description of Artificial Sequence: Synthetic oligonucleotide
ggtaggaccaggttgaagatctcatgccg

SEQ ID NO: 347633 - DNA, 29 bp, Artificial Sequence
  Description of Artificial Sequence: Synthetic oligonucleotide
gtaggaccaggttgaagatctcatgccgg

SEQ ID NO: 347634 - DNA, 36 bp, Artificial Sequence
  Description of Artificial Sequence: Synthetic oligonucleotide
taggaccaggttgaagatctcatgccggaaaataag

SEQ ID NO: 347635 - DNA, 35 bp, Artificial Sequence
  Description of Artificial Sequence: Synthetic oligonucleotide
aggaccaggttgaagatctcatgccggaaaataag

SEQ ID NO: 347636 - DNA, 34 bp, Artificial Sequence
  Description of Artificial Sequence: Synthetic oligonucleotide
ggaccaggttgaagatctcatgccggaaaataag

SEQ ID NO: 347637 - DNA, 34 bp, Artificial Sequence
  Description of Artificial Sequence: Synthetic oligonucleotide
gaccaggttgaagatctcatgccggaaaataagg

SEQ ID NO: 347638 - DNA, 34 bp, Artificial Sequence
  Description of Artificial Sequence: Synthetic oligonucleotide
accaggttgaagatctcatgccggaaaataaggg

SEQ ID NO: 347639 - DNA, 33 bp, Artificial Sequence
  Description of Artificial Sequence: Synthetic oligonucleotide
ccaggttgaagatctcatgccggaaaataaggg

SEQ ID NO: 347640 - DNA, 33 bp, Artificial Sequence
  Description of Artificial Sequence: Synthetic oligonucleotide
caggttgaagatctcatgccggaaaataagggg

SEQ ID NO: 347641 - DNA, 34 bp, Artificial Sequence
  Description of Artificial Sequence: Synthetic oligonucleotide
aggttgaagatctcatgccggaaaataaggggac

SEQ ID NO: 347642 - DNA, 33 bp, Artificial Sequence
  Description of Artificial Sequence: Synthetic oligonucleotide
ggttgaagatctcatgccggaaaataaggggac

SEQ ID NO: 347643 - DNA, 33 bp, Artificial Sequence
  Description of Artificial Sequence: Synthetic oligonucleotide
gttgaagatctcatgccggaaaataaggggacg

SEQ ID NO: 347644 - DNA, 34 bp, Artificial Sequence
  Description of Artificial Sequence: Synthetic oligonucleotide
ttgaagatctcatgccggaaaataaggggacgac

SEQ ID NO: 347645 - DNA, 33 bp, Artificial Sequence
  Description of Artificial Sequence: Synthetic oligonucleotide
tgaagatctcatgccggaaaataaggggacgac

SEQ ID NO: 347646 - DNA, 32 bp, Artificial Sequence
  Description of Artificial Sequence: Synthetic oligonucleotide
gaagatctcatgccggaaaataaggggacgac

SEQ ID NO: 347647 - DNA, 32 bp, Artificial Sequence
  Description of Artificial Sequence: Synthetic oligonucleotide
aagatctcatgccggaaaataaggggacgacg

SEQ ID NO: 347648 - DNA, 31 bp, Artificial Sequence
  Description of Artificial Sequence: Synthetic oligonucleotide
agatctcatgccggaaaataaggggacgacg

SEQ ID NO: 347649 - DNA, 30 bp, Artificial Sequence
  Description of Artificial Sequence: Synthetic oligonucleotide
gatctcatgccggaaaataaggggacgacg

SEQ ID NO: 347650 - DNA, 30 bp, Artificial Sequence
  Description of Artificial Sequence: Synthetic oligonucleotide
atctcatgccggaaaataaggggacgacgg

SEQ ID NO: 347651 - DNA, 29 bp, Artificial Sequence
  Description of Artificial Sequence: Synthetic oligonucleotide
tctcatgccggaaaataaggggacgacgg

SEQ ID NO: 347652 - DNA, 28 bp, Artificial Sequence
  Description of Artificial Sequence: Synthetic oligonucleotide
ctcatgccggaaaataaggggacgacgg

SEQ ID NO: 347653 - DNA, 29 bp, Artificial Sequence
  Description of Artificial Sequence: Synthetic oligonucleotide
tcatgccggaaaataaggggacgacggtg

SEQ ID NO: 347654 - DNA, 28 bp, Artificial Sequence
  Description of Artificial Sequence: Synthetic oligonucleotide
catgccggaaaataaggggacgacggtg

SEQ ID NO: 347655 - DNA, 28 bp, Artificial Sequence
  Description of Artificial Sequence: Synthetic oligonucleotide
atgccggaaaataaggggacgacggtgc

SEQ ID NO: 347656 - DNA, 27 bp, Artificial Sequence
  Description of Artificial Sequence: Synthetic oligonucleotide
tgccggaaaataaggggacgacggtgc

SEQ ID NO: 347657 - DNA, 27 bp, Artificial Sequence
  Description of Artificial Sequence: Synthetic oligonucleotide
gccggaaaataaggggacgacggtgct

SEQ ID NO: 347658 - DNA, 28 bp, Artificial Sequence
  Description of Artificial Sequence: Synthetic oligonucleotide
ccggaaaataaggggacgacggtgcttg

SEQ ID NO: 347659 - DNA, 29 bp, Artificial Sequence
  Description of Artificial Sequence: Synthetic oligonucleotide
cggaaaataaggggacgacggtgcttgtg

SEQ ID NO: 347660 - DNA, 30 bp, Artificial Sequence
  Description of Artificial Sequence: Synthetic oligonucleotide
ggaaaataaggggacgacggtgcttgtgag

SEQ ID NO: 347661 - DNA, 31 bp, Artificial Sequence
  Description of Artificial Sequence: Synthetic oligonucleotide
gaaaataaggggacgacggtgcttgtgagag

SEQ ID NO: 347662 - DNA, 33 bp, Artificial Sequence
  Description of Artificial Sequence: Synthetic oligonucleotide
aaaataaggggacgacggtgcttgtgagagatc

SEQ ID NO: 347663 - DNA, 32 bp, Artificial Sequence
  Description of Artificial Sequence: Synthetic oligonucleotide
aaataaggggacgacggtgcttgtgagagatc

SEQ ID NO: 347664 - DNA, 31 bp, Artificial Sequence
  Description of Artificial Sequence: Synthetic oligonucleotide
aataaggggacgacggtgcttgtgagagatc

SEQ ID NO: 347665 - DNA, 30 bp, Artificial Sequence
  Description of Artificial Sequence: Synthetic oligonucleotide
ataaggggacgacggtgcttgtgagagatc

SEQ ID NO: 347666 - DNA, 29 bp, Artificial Sequence
  Description of Artificial Sequence: Synthetic oligonucleotide
taaggggacgacggtgcttgtgagagatc

SEQ ID NO: 347667 - DNA, 28 bp, Artificial Sequence
  Description of Artificial Sequence: Synthetic oligonucleotide
aaggggacgacggtgcttgtgagagatc

SEQ ID NO: 347668 - DNA, 27 bp, Artificial Sequence
  Description of Artificial Sequence: Synthetic oligonucleotide
aggggacgacggtgcttgtgagagatc

SEQ ID NO: 347669 - DNA, 26 bp, Artificial Sequence
  Description of Artificial Sequence: Synthetic oligonucleotide
ggggacgacggtgcttgtgagagatc

SEQ ID NO: 347670 - DNA, 26 bp, Artificial Sequence
  Description of Artificial Sequence: Synthetic oligonucleotide
gggacgacggtgcttgtgagagatcc

SEQ ID NO: 347671 - DNA, 26 bp, Artificial Sequence
  Description of Artificial Sequence: Synthetic oligonucleotide
ggacgacggtgcttgtgagagatccc

SEQ ID NO: 347672 - DNA, 27 bp, Artificial Sequence
  Description of Artificial Sequence: Synthetic oligonucleotide
gacgacggtgcttgtgagagatcccca

SEQ ID NO: 347673 - DNA, 28 bp, Artificial Sequence
  Description of Artificial Sequence: Synthetic oligonucleotide
acgacggtgcttgtgagagatccccaag

SEQ ID NO: 347674 - DNA, 27 bp, Artificial Sequence
  Description of Artificial Sequence: Synthetic oligonucleotide
cgacggtgcttgtgagagatccccaag

SEQ ID NO: 347675 - DNA, 28 bp, Artificial Sequence
  Description of Artificial Sequence: Synthetic oligonucleotide
gacggtgcttgtgagagatccccaagag

SEQ ID NO: 347676 - DNA, 28 bp, Artificial Sequence
  Description of Artificial Sequence: Synthetic oligonucleotide
acggtgcttgtgagagatccccaagagg

SEQ ID NO: 347677 - DNA, 27 bp, Artificial Sequence
  Description of Artificial Sequence: Synthetic oligonucleotide
cggtgcttgtgagagatccccaagagg

SEQ ID NO: 347678 - DNA, 27 bp, Artificial Sequence
  Description of Artificial Sequence: Synthetic oligonucleotide
ggtgcttgtgagagatccccaagaggc

SEQ ID NO: 347679 - DNA, 29 bp, Artificial Sequence
  Description of Artificial Sequence: Synthetic oligonucleotide
gtgcttgtgagagatccccaagaggcaag

SEQ ID NO: 347680 - DNA, 30 bp, Artificial Sequence
  Description of Artificial Sequence: Synthetic oligonucleotide
tgcttgtgagagatccccaagaggcaagtg

SEQ ID NO: 347681 - DNA, 29 bp, Artificial Sequence
  Description of Artificial Sequence: Synthetic oligonucleotide
gcttgtgagagatccccaagaggcaagtg

SEQ ID NO: 347682 - DNA, 30 bp, Artificial Sequence
  Description of Artificial Sequence: Synthetic oligonucleotide
cttgtgagagatccccaagaggcaagtgtc

SEQ ID NO: 347683 - DNA, 31 bp, Artificial Sequence
  Description of Artificial Sequence: Synthetic oligonucleotide
ttgtgagagatccccaagaggcaagtgtcac

SEQ ID NO: 347684 - DNA, 30 bp, Artificial Sequence
  Description of Artificial Sequence: Synthetic oligonucleotide
tgtgagagatccccaagaggcaagtgtcac

SEQ ID NO: 347685 - DNA, 29 bp, Artificial Sequence
  Description of Artificial Sequence: Synthetic oligonucleotide
gtgagagatccccaagaggcaagtgtcac

SEQ ID NO: 347686 - DNA, 30 bp, Artificial Sequence
  Description of Artificial Sequence: Synthetic oligonucleotide
tgagagatccccaagaggcaagtgtcacac

SEQ ID NO: 347687 - DNA, 29 bp, Artificial Sequence
  Description of Artificial Sequence: Synthetic oligonucleotide
gagagatccccaagaggcaagtgtcacac

SEQ ID NO: 347688 - DNA, 30 bp, Artificial Sequence
  Description of Artificial Sequence: Synthetic oligonucleotide
agagatccccaagaggcaagtgtcacactg

SEQ ID NO: 347689 - DNA, 29 bp, Artificial Sequence
  Description of Artificial Sequence: Synthetic oligonucleotide
gagatccccaagaggcaagtgtcacactg

SEQ ID NO: 347690 - DNA, 29 bp, Artificial Sequence
  Description of Artificial Sequence: Synthetic oligonucleotide
agatccccaagaggcaagtgtcacactgc

SEQ ID NO: 347691 - DNA, 28 bp, Artificial Sequence
  Description of Artificial Sequence: Synthetic oligonucleotide
gatccccaagaggcaagtgtcacactgc

SEQ ID NO: 347692 - DNA, 29 bp, Artificial Sequence
  Description of Artificial Sequence: Synthetic oligonucleotide
atccccaagaggcaagtgtcacactgcag

SEQ ID NO: 347693 - DNA, 28 bp, Artificial Sequence
  Description of Artificial Sequence: Synthetic oligonucleotide
tccccaagaggcaagtgtcacactgcag

SEQ ID NO: 347694 - DNA, 27 bp, Artificial Sequence
  Description of Artificial Sequence: Synthetic oligonucleotide
ccccaagaggcaagtgtcacactgcag

SEQ ID NO: 347695 - DNA, 29 bp, Artificial Sequence
  Description of Artificial Sequence: Synthetic oligonucleotide
cccaagaggcaagtgtcacactgcagatc

SEQ ID NO: 347696 - DNA, 29 bp, Artificial Sequence
  Description of Artificial Sequence: Synthetic oligonucleotide
ccaagaggcaagtgtcacactgcagatcg

SEQ ID NO: 347697 - DNA, 31 bp, Artificial Sequence
  Description of Artificial Sequence: Synthetic oligonucleotide
caagaggcaagtgtcacactgcagatcgttg

SEQ ID NO: 347698 - DNA, 32 bp, Artificial Sequence
  Description of Artificial Sequence: Synthetic oligonucleotide
aagaggcaagtgtcacactgcagatcgttgac

SEQ ID NO: 347699 - DNA, 31 bp, Artificial Sequence
  Description of Artificial Sequence: Synthetic oligonucleotide
agaggcaagtgtcacactgcagatcgttgac

SEQ ID NO: 347700 - DNA, 30 bp, Artificial Sequence
  Description of Artificial Sequence: Synthetic oligonucleotide
gaggcaagtgtcacactgcagatcgttgac

SEQ ID NO: 347701 - DNA, 30 bp, Artificial Sequence
  Description of Artificial Sequence: Synthetic oligonucleotide
aggcaagtgtcacactgcagatcgttgacg

SEQ ID NO: 347702 - DNA, 29 bp, Artificial Sequence
  Description of Artificial Sequence: Synthetic oligonucleotide
ggcaagtgtcacactgcagatcgttgacg

SEQ ID NO: 347703 - DNA, 30 bp, Artificial Sequence
  Description of Artificial Sequence: Synthetic oligonucleotide
gcaagtgtcacactgcagatcgttgacgtg

SEQ ID NO: 347704 - DNA, 30 bp, Artificial Sequence
  Description of Artificial Sequence: Synthetic oligonucleotide
caagtgtcacactgcagatcgttgacgtgc

SEQ ID NO: 347705 - DNA, 30 bp, Artificial Sequence
  Description of Artificial Sequence: Synthetic oligonucleotide
aagtgtcacactgcagatcgttgacgtgcc

SEQ ID NO: 347706 - DNA, 29 bp, Artificial Sequence
  Description of Artificial Sequence: Synthetic oligonucleotide
agtgtcacactgcagatcgttgacgtgcc

SEQ ID NO: 347707 - DNA, 28 bp, Artificial Sequence
  Description of Artificial Sequence: Synthetic oligonucleotide
gtgtcacactgcagatcgttgacgtgcc

SEQ ID NO: 347708 - DNA, 28 bp, Artificial Sequence
  Description of Artificial Sequence: Synthetic oligonucleotide
tgtcacactgcagatcgttgacgtgccc

SEQ ID NO: 347709 - DNA, 27 bp, Artificial Sequence
  Description of Artificial Sequence: Synthetic oligonucleotide
gtcacactgcagatcgttgacgtgccc

SEQ ID NO: 347710 - DNA, 27 bp, Artificial Sequence
  Description of Artificial Sequence: Synthetic oligonucleotide
tcacactgcagatcgttgacgtgcccc

SEQ ID NO: 347711 - DNA, 27 bp, Artificial Sequence
  Description of Artificial Sequence: Synthetic oligonucleotide
cacactgcagatcgttgacgtgcccct

SEQ ID NO: 347712 - DNA, 28 bp, Artificial Sequence
  Description of Artificial Sequence: Synthetic oligonucleotide
acactgcagatcgttgacgtgccccttg

SEQ ID NO: 347713 - DNA, 27 bp, Artificial Sequence
  Description of Artificial Sequence: Synthetic oligonucleotide
cactgcagatcgttgacgtgccccttg

SEQ ID NO: 347714 - DNA, 28 bp, Artificial Sequence
  Description of Artificial Sequence: Synthetic oligonucleotide
actgcagatcgttgacgtgccccttgag

SEQ ID NO: 347715 - DNA, 27 bp, Artificial Sequence
  Description of Artificial Sequence: Synthetic oligonucleotide
ctgcagatcgttgacgtgccccttgag

SEQ ID NO: 347716 - DNA, 27 bp, Artificial Sequence
  Description of Artificial Sequence: Synthetic oligonucleotide
tgcagatcgttgacgtgccccttgagg

SEQ ID NO: 347717 - DNA, 27 bp, Artificial Sequence
  Description of Artificial Sequence: Synthetic oligonucleotide
gcagatcgttgacgtgccccttgagga

SEQ ID NO: 347718 - DNA, 27 bp, Artificial Sequence
  Description of Artificial Sequence: Synthetic oligonucleotide
cagatcgttgacgtgccccttgaggag

SEQ ID NO: 347719 - DNA, 27 bp, Artificial Sequence
  Description of Artificial Sequence: Synthetic oligonucleotide
agatcgttgacgtgccccttgaggagc

SEQ ID NO: 347720 - DNA, 27 bp, Artificial Sequence
  Description of Artificial Sequence: Synthetic oligonucleotide
gatcgttgacgtgccccttgaggagca

SEQ ID NO: 347721 - DNA, 28 bp, Artificial Sequence
  Description of Artificial Sequence: Synthetic oligonucleotide
atcgttgacgtgccccttgaggagcaag

SEQ ID NO: 347722 - DNA, 27 bp, Artificial Sequence
  Description of Artificial Sequence: Synthetic oligonucleotide
tcgttgacgtgccccttgaggagcaag

SEQ ID NO: 347723 - DNA, 26 bp, Artificial Sequence
  Description of Artificial Sequence: Synthetic oligonucleotide
cgttgacgtgccccttgaggagcaag

SEQ ID NO: 347724 - DNA, 26 bp, Artificial Sequence
  Description of Artificial Sequence: Synthetic oligonucleotide
gttgacgtgccccttgaggagcaagg

SEQ ID NO: 347725 - DNA, 27 bp, Artificial Sequence
  Description of Artificial Sequence: Synthetic oligonucleotide
ttgacgtgccccttgaggagcaagggt

SEQ ID NO: 347726 - DNA, 26 bp, Artificial Sequence
  Description of Artificial Sequence: Synthetic oligonucleotide
tgacgtgccccttgaggagcaagggt

SEQ ID NO: 347727 - DNA, 25 bp, Artificial Sequence
  Description of Artificial Sequence: Synthetic oligonucleotide
gacgtgccccttgaggagcaagggt

SEQ ID NO: 347728 - DNA, 27 bp, Artificial Sequence
  Description of Artificial Sequence: Synthetic oligonucleotide
acgtgccccttgaggagcaagggtcta

SEQ ID NO: 347729 - DNA, 27 bp, Artificial Sequence
  Description of Artificial Sequence: Synthetic oligonucleotide
cgtgccccttgaggagcaagggtctaa

SEQ ID NO: 347730 - DNA, 27 bp, Artificial Sequence
  Description of Artificial Sequence: Synthetic oligonucleotide
gtgccccttgaggagcaagggtctaac

SEQ ID NO: 347731 - DNA, 27 bp, Artificial Sequence
  Description of Artificial Sequence: Synthetic oligonucleotide
tgccccttgaggagcaagggtctaacc

SEQ ID NO: 347732 - DNA, 26 bp, Artificial Sequence
  Description of Artificial Sequence: Synthetic oligonucleotide
gccccttgaggagcaagggtctaacc

SEQ ID NO: 347733 - DNA, 27 bp, Artificial Sequence
  Description of Artificial Sequence: Synthetic oligonucleotide
ccccttgaggagcaagggtctaaccga

SEQ ID NO: 347734 - DNA, 28 bp, Artificial Sequence
  Description of Artificial Sequence: Synthetic oligonucleotide
cccttgaggagcaagggtctaaccgatg

SEQ ID NO: 347735 - DNA, 29 bp, Artificial Sequence
  Description of Artificial Sequence: Synthetic oligonucleotide
ccttgaggagcaagggtctaaccgatgtc

SEQ ID NO: 347736 - DNA, 30 bp, Artificial Sequence
  Description of Artificial Sequence: Synthetic oligonucleotide
cttgaggagcaagggtctaaccgatgtcag

SEQ ID NO: 347737 - DNA, 32 bp, Artificial Sequence
  Description of Artificial Sequence: Synthetic oligonucleotide
ttgaggagcaagggtctaaccgatgtcagatc

SEQ ID NO: 347738 - DNA, 31 bp, Artificial Sequence
  Description of Artificial Sequence: Synthetic oligonucleotide
tgaggagcaagggtctaaccgatgtcagatc

SEQ ID NO: 347739 - DNA, 30 bp, Artificial Sequence
  Description of Artificial Sequence: Synthetic oligonucleotide
gaggagcaagggtctaaccgatgtcagatc

SEQ ID NO: 347740 - DNA, 30 bp, Artificial Sequence
  Description of Artificial Sequence: Synthetic oligonucleotide
aggagcaagggtctaaccgatgtcagatcc

SEQ ID NO: 347741 - DNA, 29 bp, Artificial Sequence
  Description of Artificial Sequence: Synthetic oligonucleotide
ggagcaagggtctaaccgatgtcagatcc

SEQ ID NO: 347742 - DNA, 31 bp, Artificial Sequence
  Description of Artificial Sequence: Synthetic oligonucleotide
gagcaagggtctaaccgatgtcagatccaag

SEQ ID NO: 347743 - DNA, 33 bp, Artificial Sequence
  Description of Artificial Sequence: Synthetic oligonucleotide
agcaagggtctaaccgatgtcagatccaagtag

SEQ ID NO: 347744 - DNA, 32 bp, Artificial Sequence
  Description of Artificial Sequence: Synthetic oligonucleotide
gcaagggtctaaccgatgtcagatccaagtag

SEQ ID NO: 347745 - DNA, 32 bp, Artificial Sequence
  Description of Artificial Sequence: Synthetic oligonucleotide
caagggtctaaccgatgtcagatccaagtagg

SEQ ID NO: 347746 - DNA, 36 bp, Artificial Sequence
  Description of Artificial Sequence: Synthetic oligonucleotide
aagggtctaaccgatgtcagatccaagtaggaaatc

SEQ ID NO: 347747 - DNA, 35 bp, Artificial Sequence
  Description of Artificial Sequence: Synthetic oligonucleotide
agggtctaaccgatgtcagatccaagtaggaaatc

SEQ ID NO: 347748 - DNA, 34 bp, Artificial Sequence
  Description of Artificial Sequence: Synthetic oligonucleotide
gggtctaaccgatgtcagatccaagtaggaaatc

SEQ ID NO: 347749 - DNA, 35 bp, Artificial Sequence
  Description of Artificial Sequence: Synthetic oligonucleotide
ggtctaaccgatgtcagatccaagtaggaaatctg

SEQ ID NO: 347750 - DNA, 36 bp, Artificial Sequence
  Description of Artificial Sequence: Synthetic oligonucleotide
gtctaaccgatgtcagatccaagtaggaaatctgtg

SEQ ID NO: 347751 - DNA, 40 bp, Artificial Sequence
  Description of Artificial Sequence: Synthetic oligonucleotide
tctaaccgatgtcagatccaagtaggaaatctgtgtaaag

SEQ ID NO: 347752 - DNA, 39 bp, Artificial Sequence
  Description of Artificial Sequence: Synthetic oligonucleotide
ctaaccgatgtcagatccaagtaggaaatctgtgtaaag

SEQ ID NO: 347753 - DNA, 40 bp, Artificial Sequence
  Description of Artificial Sequence: Synthetic oligonucleotide
taaccgatgtcagatccaagtaggaaatctgtgtaaagag

SEQ ID NO: 347754 - DNA, 39 bp, Artificial Sequence
  Description of Artificial Sequence: Synthetic oligonucleotide
aaccgatgtcagatccaagtaggaaatctgtgtaaagag

SEQ ID NO: 347755 - DNA, 38 bp, Artificial Sequence
  Description of Artificial Sequence: Synthetic oligonucleotide
accgatgtcagatccaagtaggaaatctgtgtaaagag

SEQ ID NO: 347756 - DNA, 37 bp, Artificial Sequence
  Description of Artificial Sequence: Synthetic oligonucleotide
ccgatgtcagatccaagtaggaaatctgtgtaaagag

SEQ ID NO: 347757 - DNA, 37 bp, Artificial Sequence
  Description of Artificial Sequence: Synthetic oligonucleotide
cgatgtcagatccaagtaggaaatctgtgtaaagagg

SEQ ID NO: 347758 - DNA, 38 bp, Artificial Sequence
  Description of Artificial Sequence: Synthetic oligonucleotide
gatgtcagatccaagtaggaaatctgtgtaaagaggtc

SEQ ID NO: 347759 - DNA, 39 bp, Artificial Sequence
  Description of Artificial Sequence: Synthetic oligonucleotide
atgtcagatccaagtaggaaatctgtgtaaagaggtcac

SEQ ID NO: 347760 - DNA, 38 bp, Artificial Sequence
  Description of Artificial Sequence: Synthetic oligonucleotide
tgtcagatccaagtaggaaatctgtgtaaagaggtcac

SEQ ID NO: 347761 - DNA, 37 bp, Artificial Sequence
  Description of Artificial Sequence: Synthetic oligonucleotide
gtcagatccaagtaggaaatctgtgtaaagaggtcac

SEQ ID NO: 347762 - DNA, 37 bp, Artificial Sequence
  Description of Artificial Sequence: Synthetic oligonucleotide
tcagatccaagtaggaaatctgtgtaaagaggtcacc

SEQ ID NO: 347763 - DNA, 36 bp, Artificial Sequence
  Description of Artificial Sequence: Synthetic oligonucleotide
cagatccaagtaggaaatctgtgtaaagaggtcacc

SEQ ID NO: 347764 - DNA, 36 bp, Artificial Sequence
  Description of Artificial Sequence: Synthetic oligonucleotide
agatccaagtaggaaatctgtgtaaagaggtcaccg

SEQ ID NO: 347765 - DNA, 35 bp, Artificial Sequence
  Description of Artificial Sequence: Synthetic oligonucleotide
gatccaagtaggaaatctgtgtaaagaggtcaccg

SEQ ID NO: 347766 - DNA, 36 bp, Artificial Sequence
  Description of Artificial Sequence: Synthetic oligonucleotide
atccaagtaggaaatctgtgtaaagaggtcaccgtg

SEQ ID NO: 347767 - DNA, 35 bp, Artificial Sequence
  Description of Artificial Sequence: Synthetic oligonucleotide
tccaagtaggaaatctgtgtaaagaggtcaccgtg

SEQ ID NO: 347768 - DNA, 34 bp, Artificial Sequence
  Description of Artificial Sequence: Synthetic oligonucleotide
ccaagtaggaaatctgtgtaaagaggtcaccgtg

SEQ ID NO: 347769 - DNA, 36 bp, Artificial Sequence
  Description of Artificial Sequence: Synthetic oligonucleotide
caagtaggaaatctgtgtaaagaggtcaccgtgatg

SEQ ID NO: 347770 - DNA, 36 bp, Artificial Sequence
  Description of Artificial Sequence: Synthetic oligonucleotide
aagtaggaaatctgtgtaaagaggtcaccgtgatgc

SEQ ID NO: 347771 - DNA, 35 bp, Artificial Sequence
  Description of Artificial Sequence: Synthetic oligonucleotide
agtaggaaatctgtgtaaagaggtcaccgtgatgc

SEQ ID NO: 347772 - DNA, 34 bp, Artificial Sequence
  Description of Artificial Sequence: Synthetic oligonucleotide
gtaggaaatctgtgtaaagaggtcaccgtgatgc

SEQ ID NO: 347773 - DNA, 35 bp, Artificial Sequence
  Description of Artificial Sequence: Synthetic oligonucleotide
taggaaatctgtgtaaagaggtcaccgtgatgctg

SEQ ID NO: 347774 - DNA, 34 bp, Artificial Sequence
  Description of Artificial Sequence: Synthetic oligonucleotide
aggaaatctgtgtaaagaggtcaccgtgatgctg

SEQ ID NO: 347775 - DNA, 33 bp, Artificial Sequence
  Description of Artificial Sequence: Synthetic oligonucleotide
ggaaatctgtgtaaagaggtcaccgtgatgctg

SEQ ID NO: 347776 - DNA, 33 bp, Artificial Sequence
  Description of Artificial Sequence: Synthetic oligonucleotide
gaaatctgtgtaaagaggtcaccgtgatgctgc

SEQ ID NO: 347777 - DNA, 34 bp, Artificial Sequence
  Description of Artificial Sequence: Synthetic oligonucleotide
aaatctgtgtaaagaggtcaccgtgatgctgcag

SEQ ID NO: 347778 - DNA, 33 bp, Artificial Sequence
  Description of Artificial Sequence: Synthetic oligonucleotide
aatctgtgtaaagaggtcaccgtgatgctgcag

SEQ ID NO: 347779 - DNA, 32 bp, Artificial Sequence
  Description of Artificial Sequence: Synthetic oligonucleotide
atctgtgtaaagaggtcaccgtgatgctgcag

SEQ ID NO: 347780 - DNA, 31 bp, Artificial Sequence
  Description of Artificial Sequence: Synthetic oligonucleotide
tctgtgtaaagaggtcaccgtgatgctgcag

SEQ ID NO: 347781 - DNA, 30 bp, Artificial Sequence
  Description of Artificial Sequence: Synthetic oligonucleotide
ctgtgtaaagaggtcaccgtgatgctgcag

SEQ ID NO: 347782 - DNA, 30 bp, Artificial Sequence
  Description of Artificial Sequence: Synthetic oligonucleotide
tgtgtaaagaggtcaccgtgatgctgcagg

SEQ ID NO: 347783 - DNA, 29 bp, Artificial Sequence
  Description of Artificial Sequence: Synthetic oligonucleotide
gtgtaaagaggtcaccgtgatgctgcagg

SEQ ID NO: 347784 - DNA, 31 bp, Artificial Sequence
  Description of Artificial Sequence: Synthetic oligonucleotide
tgtaaagaggtcaccgtgatgctgcaggttc

SEQ ID NO: 347785 - DNA, 30 bp, Artificial Sequence
  Description of Artificial Sequence: Synthetic oligonucleotide
gtaaagaggtcaccgtgatgctgcaggttc

SEQ ID NO: 347786 - DNA, 30 bp, Artificial Sequence
  Description of Artificial Sequence: Synthetic oligonucleotide
taaagaggtcaccgtgatgctgcaggttcc

SEQ ID NO: 347787 - DNA, 29 bp, Artificial Sequence
  Description of Artificial Sequence: Synthetic oligonucleotide
aaagaggtcaccgtgatgctgcaggttcc

SEQ ID NO: 347788 - DNA, 28 bp, Artificial Sequence
  Description of Artificial Sequence: Synthetic oligonucleotide
aagaggtcaccgtgatgctgcaggttcc

SEQ ID NO: 347789 - DNA, 27 bp, Artificial Sequence
  Description of Artificial Sequence: Synthetic oligonucleotide
agaggtcaccgtgatgctgcaggttcc

SEQ ID NO: 347790 - DNA, 27 bp, Artificial Sequence
  Description of Artificial Sequence: Synthetic oligonucleotide
gaggtcaccgtgatgctgcaggttcca

SEQ ID NO: 347791 - DNA, 27 bp, Artificial Sequence
  Description of Artificial Sequence: Synthetic oligonucleotide
aggtcaccgtgatgctgcaggttccag

SEQ ID NO: 347792 - DNA, 26 bp, Artificial Sequence
  Description of Artificial Sequence: Synthetic oligonucleotide
ggtcaccgtgatgctgcaggttccag

SEQ ID NO: 347793 - DNA, 26 bp, Artificial Sequence
  Description of Artificial Sequence: Synthetic oligonucleotide
gtcaccgtgatgctgcaggttccagc

SEQ ID NO: 347794 - DNA, 26 bp, Artificial Sequence
  Description of Artificial Sequence: Synthetic oligonucleotide
tcaccgtgatgctgcaggttccagcc

SEQ ID NO: 347795 - DNA, 25 bp, Artificial Sequence
  Description of Artificial Sequence: Synthetic oligonucleotide
caccgtgatgctgcaggttccagcc

SEQ ID NO: 347796 - DNA, 25 bp, Artificial Sequence
  Description of Artificial Sequence: Synthetic oligonucleotide
accgtgatgctgcaggttccagccc

SEQ ID NO: 347797 - DNA, 24 bp, Artificial Sequence
  Description of Artificial Sequence: Synthetic oligonucleotide
ccgtgatgctgcaggttccagccc

SEQ ID NO: 347798 - DNA, 26 bp, Artificial Sequence
  Description of Artificial Sequence: Synthetic oligonucleotide
cgtgatgctgcaggttccagccccat

SEQ ID NO: 347799 - DNA, 27 bp, Artificial Sequence
  Description of Artificial Sequence: Synthetic oligonucleotide
gtgatgctgcaggttccagccccatgt

SEQ ID NO: 347800 - DNA, 27 bp, Artificial Sequence
  Description of Artificial Sequence: Synthetic oligonucleotide
tgatgctgcaggttccagccccatgtg

SEQ ID NO: 347801 - DNA, 27 bp, Artificial Sequence
  Description of Artificial Sequence: Synthetic oligonucleotide
gatgctgcaggttccagccccatgtgt

SEQ ID NO: 347802 - DNA, 27 bp, Artificial Sequence
  Description of Artificial Sequence: Synthetic oligonucleotide
atgctgcaggttccagccccatgtgtg

SEQ ID NO: 347803 - DNA, 26 bp, Artificial Sequence
  Description of Artificial Sequence: Synthetic oligonucleotide
tgctgcaggttccagccccatgtgtg

SEQ ID NO: 347804 - DNA, 25 bp, Artificial Sequence
  Description of Artificial Sequence: Synthetic oligonucleotide
gctgcaggttccagccccatgtgtg

SEQ ID NO: 347805 - DNA, 25 bp, Artificial Sequence
  Description of Artificial Sequence: Synthetic oligonucleotide
ctgcaggttccagccccatgtgtgg

SEQ ID NO: 347806 - DNA, 25 bp, Artificial Sequence
  Description of Artificial Sequence: Synthetic oligonucleotide
tgcaggttccagccccatgtgtggg

SEQ ID NO: 347807 - DNA, 24 bp, Artificial Sequence
  Description of Artificial Sequence: Synthetic oligonucleotide
gcaggttccagccccatgtgtggg

SEQ ID NO: 347808 - DNA, 25 bp, Artificial Sequence
  Description of Artificial Sequence: Synthetic oligonucleotide
caggttccagccccatgtgtgggga

SEQ ID NO: 347809 - DNA, 26 bp, Artificial Sequence
  Description of Artificial Sequence: Synthetic oligonucleotide
aggttccagccccatgtgtggggaga

SEQ ID NO: 347810 - DNA, 25 bp, Artificial Sequence
  Description of Artificial Sequence: Synthetic oligonucleotide
ggttccagccccatgtgtggggaga

SEQ ID NO: 347811 - DNA, 26 bp, Artificial Sequence
  Description of Artificial Sequence: Synthetic oligonucleotide
gttccagccccatgtgtggggagact

SEQ ID NO: 347812 - DNA, 27 bp, Artificial Sequence
  Description of Artificial Sequence: Synthetic oligonucleotide
ttccagccccatgtgtggggagactct

SEQ ID NO: 347813 - DNA, 26 bp, Artificial Sequence
  Description of Artificial Sequence: Synthetic oligonucleotide
tccagccccatgtgtggggagactct

SEQ ID NO: 347814 - DNA, 25 bp, Artificial Sequence
  Description of Artificial Sequence: Synthetic oligonucleotide
ccagccccatgtgtggggagactct

SEQ ID NO: 347815 - DNA, 25 bp, Artificial Sequence
  Description of Artificial Sequence: Synthetic oligonucleotide
cagccccatgtgtggggagactctc

SEQ ID NO: 347816 - DNA, 25 bp, Artificial Sequence
  Description of Artificial Sequence: Synthetic oligonucleotide
agccccatgtgtggggagactctcc

SEQ ID NO: 347817 - DNA, 24 bp, Artificial Sequence
  Description of Artificial Sequence: Synthetic oligonucleotide
gccccatgtgtggggagactctcc

SEQ ID NO: 347818 - DNA, 24 bp, Artificial Sequence
  Description of Artificial Sequence: Synthetic oligonucleotide
ccccatgtgtggggagactctccc

SEQ ID NO: 347819 - DNA, 24 bp, Artificial Sequence
  Description of Artificial Sequence: Synthetic oligonucleotide
cccatgtgtggggagactctcccc

SEQ ID NO: 347820 - DNA, 25 bp, Artificial Sequence
  Description of Artificial Sequence: Synthetic oligonucleotide
ccatgtgtggggagactctccccca

SEQ ID NO: 347821 - DNA, 26 bp, Artificial Sequence
  Description of Artificial Sequence: Synthetic oligonucleotide
catgtgtggggagactctcccccaca

SEQ ID NO: 347822 - DNA, 26 bp, Artificial Sequence
  Description of Artificial Sequence: Synthetic oligonucleotide
atgtgtggggagactctcccccacag

SEQ ID NO: 347823 - DNA, 25 bp, Artificial Sequence
  Description of Artificial Sequence: Synthetic oligonucleotide
tgtgtggggagactctcccccacag

SEQ ID NO: 347824 - DNA, 24 bp, Artificial Sequence
  Description of Artificial Sequence: Synthetic oligonucleotide
gtgtggggagactctcccccacag

SEQ ID NO: 347825 - DNA, 25 bp, Artificial Sequence
  Description of Artificial Sequence: Synthetic oligonucleotide
tgtggggagactctcccccacagca

SEQ ID NO: 347826 - DNA, 24 bp, Artificial Sequence
  Description of Artificial Sequence: Synthetic oligonucleotide
gtggggagactctcccccacagca

SEQ ID NO: 347827 - DNA, 25 bp, Artificial Sequence
  Description of Artificial Sequence: Synthetic oligonucleotide
tggggagactctcccccacagcagt

SEQ ID NO: 347828 - DNA, 24 bp, Artificial Sequence
  Description of Artificial Sequence: Synthetic oligonucleotide
ggggagactctcccccacagcagt

SEQ ID NO: 347829 - DNA, 24 bp, Artificial Sequence
  Description of Artificial Sequence: Synthetic oligonucleotide
gggagactctcccccacagcagtg

SEQ ID NO: 347830 - DNA, 24 bp, Artificial Sequence
  Description of Artificial Sequence: Synthetic oligonucleotide
ggagactctcccccacagcagtgg

SEQ ID NO: 347831 - DNA, 25 bp, Artificial Sequence
  Description of Artificial Sequence: Synthetic oligonucleotide
gagactctcccccacagcagtgggt

SEQ ID NO: 347832 - DNA, 26 bp, Artificial Sequence
  Description of Artificial Sequence: Synthetic oligonucleotide
agactctcccccacagcagtgggtct

SEQ ID NO: 347833 - DNA, 25 bp, Artificial Sequence
  Description of Artificial Sequence: Synthetic oligonucleotide
gactctcccccacagcagtgggtct

SEQ ID NO: 347834 - DNA, 25 bp, Artificial Sequence
  Description of Artificial Sequence: Synthetic oligonucleotide
actctcccccacagcagtgggtctg

SEQ ID NO: 347835 - DNA, 24 bp, Artificial Sequence
  Description of Artificial Sequence: Synthetic oligonucleotide
ctctcccccacagcagtgggtctg

SEQ ID NO: 347836 - DNA, 24 bp, Artificial Sequence
  Description of Artificial Sequence: Synthetic oligonucleotide
tctcccccacagcagtgggtctgg

SEQ ID NO: 347837 - DNA, 23 bp, Artificial Sequence
  Description of Artificial Sequence: Synthetic oligonucleotide
ctcccccacagcagtgggtctgg

SEQ ID NO: 347838 - DNA, 24 bp, Artificial Sequence
  Description of Artificial Sequence: Synthetic oligonucleotide
tcccccacagcagtgggtctggct

SEQ ID NO: 347839 - DNA, 23 bp, Artificial Sequence
  Description of Artificial Sequence: Synthetic oligonucleotide
cccccacagcagtgggtctggct

SEQ ID NO: 347840 - DNA, 24 bp, Artificial Sequence
  Description of Artificial Sequence: Synthetic oligonucleotide
ccccacagcagtgggtctggctgt

SEQ ID NO: 347841 - DNA, 26 bp, Artificial Sequence
  Description of Artificial Sequence: Synthetic oligonucleotide
cccacagcagtgggtctggctgtcat

SEQ ID NO: 347842 - DNA, 26 bp, Artificial Sequence
  Description of Artificial Sequence: Synthetic oligonucleotide
ccacagcagtgggtctggctgtcatc

SEQ ID NO: 347843 - DNA, 27 bp, Artificial Sequence
  Description of Artificial Sequence: Synthetic oligonucleotide
cacagcagtgggtctggctgtcatcct

SEQ ID NO: 347844 - DNA, 27 bp, Artificial Sequence
  Description of Artificial Sequence: Synthetic oligonucleotide
acagcagtgggtctggctgtcatcctg

SEQ ID NO: 347845 - DNA, 26 bp, Artificial Sequence
  Description of Artificial Sequence: Synthetic oligonucleotide
cagcagtgggtctggctgtcatcctg

SEQ ID NO: 347846 - DNA, 26 bp, Artificial Sequence
  Description of Artificial Sequence: Synthetic oligonucleotide
agcagtgggtctggctgtcatcctgc

SEQ ID NO: 347847 - DNA, 25 bp, Artificial Sequence
  Description of Artificial Sequence: Synthetic oligonucleotide
gcagtgggtctggctgtcatcctgc

SEQ ID NO: 347848 - DNA, 26 bp, Artificial Sequence
  Description of Artificial Sequence: Synthetic oligonucleotide
cagtgggtctggctgtcatcctgcct

SEQ ID NO: 347849 - DNA, 27 bp, Artificial Sequence
  Description of Artificial Sequence: Synthetic oligonucleotide
agtgggtctggctgtcatcctgcctct

SEQ ID NO: 347850 - DNA, 26 bp, Artificial Sequence
  Description of Artificial Sequence: Synthetic oligonucleotide
gtgggtctggctgtcatcctgcctct

SEQ ID NO: 347851 - DNA, 26 bp, Artificial Sequence
  Description of Artificial Sequence: Synthetic oligonucleotide
tgggtctggctgtcatcctgcctctc

SEQ ID NO: 347852 - DNA, 25 bp, Artificial Sequence
  Description of Artificial Sequence: Synthetic oligonucleotide
gggtctggctgtcatcctgcctctc

SEQ ID NO: 347853 - DNA, 26 bp, Artificial Sequence
  Description of Artificial Sequence: Synthetic oligonucleotide
ggtctggctgtcatcctgcctctcct

SEQ ID NO: 347854 - DNA, 26 bp, Artificial Sequence
  Description of Artificial Sequence: Synthetic oligonucleotide
gtctggctgtcatcctgcctctcctg

SEQ ID NO: 347855 - DNA, 27 bp, Artificial Sequence
  Description of Artificial Sequence: Synthetic oligonucleotide
tctggctgtcatcctgcctctcctggt

SEQ ID NO: 347856 - DNA, 27 bp, Artificial Sequence
  Description of Artificial Sequence: Synthetic oligonucleotide
ctggctgtcatcctgcctctcctggta

SEQ ID NO: 347857 - DNA, 27 bp, Artificial Sequence
  Description of Artificial Sequence: Synthetic oligonucleotide
tggctgtcatcctgcctctcctggtac

SEQ ID NO: 347858 - DNA, 27 bp, Artificial Sequence
  Description of Artificial Sequence: Synthetic oligonucleotide
ggctgtcatcctgcctctcctggtaca

SEQ ID NO: 347859 - DNA, 28 bp, Artificial Sequence
  Description of Artificial Sequence: Synthetic oligonucleotide
gctgtcatcctgcctctcctggtacatc

SEQ ID NO: 347860 - DNA, 29 bp, Artificial Sequence
  Description of Artificial Sequence: Synthetic oligonucleotide
ctgtcatcctgcctctcctggtacatctc

SEQ ID NO: 347861 - DNA, 31 bp, Artificial Sequence
  Description of Artificial Sequence: Synthetic oligonucleotide
tgtcatcctgcctctcctggtacatctcatc

SEQ ID NO: 347862 - DNA, 30 bp, Artificial Sequence
  Description of Artificial Sequence: Synthetic oligonucleotide
gtcatcctgcctctcctggtacatctcatc

SEQ ID NO: 347863 - DNA, 32 bp, Artificial Sequence
  Description of Artificial Sequence: Synthetic oligonucleotide
tcatcctgcctctcctggtacatctcatcatc

SEQ ID NO: 347864 - DNA, 31 bp, Artificial Sequence
  Description of Artificial Sequence: Synthetic oligonucleotide
catcctgcctctcctggtacatctcatcatc

SEQ ID NO: 347865 - DNA, 31 bp, Artificial Sequence
  Description of Artificial Sequence: Synthetic oligonucleotide
atcctgcctctcctggtacatctcatcatcg

SEQ ID NO: 347866 - DNA, 30 bp, Artificial Sequence
  Description of Artificial Sequence: Synthetic oligonucleotide
tcctgcctctcctggtacatctcatcatcg

SEQ ID NO: 347867 - DNA, 29 bp, Artificial Sequence
  Description of Artificial Sequence: Synthetic oligonucleotide
cctgcctctcctggtacatctcatcatcg

SEQ ID NO: 347868 - DNA, 30 bp, Artificial Sequence
  Description of Artificial Sequence: Synthetic oligonucleotide
ctgcctctcctggtacatctcatcatcgtg

SEQ ID NO: 347869 - DNA, 31 bp, Artificial Sequence
  Description of Artificial Sequence: Synthetic oligonucleotide
tgcctctcctggtacatctcatcatcgtgtg

SEQ ID NO: 347870 - DNA, 30 bp, Artificial Sequence
  Description of Artificial Sequence: Synthetic oligonucleotide
gcctctcctggtacatctcatcatcgtgtg

SEQ ID NO: 347871 - DNA, 30 bp, Artificial Sequence
  Description of Artificial Sequence: Synthetic oligonucleotide
cctctcctggtacatctcatcatcgtgtgc

SEQ ID NO: 347872 - DNA, 30 bp, Artificial Sequence
  Description of Artificial Sequence: Synthetic oligonucleotide
ctctcctggtacatctcatcatcgtgtgcc

SEQ ID NO: 347873 - DNA, 33 bp, Artificial Sequence
  Description of Artificial Sequence: Synthetic oligonucleotide
tctcctggtacatctcatcatcgtgtgccttag

SEQ ID NO: 347874 - DNA, 32 bp, Artificial Sequence
  Description of Artificial Sequence: Synthetic oligonucleotide
ctcctggtacatctcatcatcgtgtgccttag

SEQ ID NO: 347875 - DNA, 32 bp, Artificial Sequence
  Description of Artificial Sequence: Synthetic oligonucleotide
tcctggtacatctcatcatcgtgtgccttagc

SEQ ID NO: 347876 - DNA, 31 bp, Artificial Sequence
  Description of Artificial Sequence: Synthetic oligonucleotide
cctggtacatctcatcatcgtgtgccttagc

SEQ ID NO: 347877 - DNA, 31 bp, Artificial Sequence
  Description of Artificial Sequence: Synthetic oligonucleotide
ctggtacatctcatcatcgtgtgccttagcc

SEQ ID NO: 347878 - DNA, 35 bp, Artificial Sequence
  Description of Artificial Sequence: Synthetic oligonucleotide
tggtacatctcatcatcgtgtgccttagccttatc

SEQ ID NO: 347879 - DNA, 34 bp, Artificial Sequence
  Description of Artificial Sequence: Synthetic oligonucleotide
ggtacatctcatcatcgtgtgccttagccttatc

SEQ ID NO: 347880 - DNA, 35 bp, Artificial Sequence
  Description of Artificial Sequence: Synthetic oligonucleotide
gtacatctcatcatcgtgtgccttagccttatctc

SEQ ID NO: 347881 - DNA, 35 bp, Artificial Sequence
  Description of Artificial Sequence: Synthetic oligonucleotide
tacatctcatcatcgtgtgccttagccttatctcg

SEQ ID NO: 347882 - DNA, 34 bp, Artificial Sequence
  Description of Artificial Sequence: Synthetic oligonucleotide
acatctcatcatcgtgtgccttagccttatctcg

SEQ ID NO: 347883 - DNA, 33 bp, Artificial Sequence
  Description of Artificial Sequence: Synthetic oligonucleotide
catctcatcatcgtgtgccttagccttatctcg

SEQ ID NO: 347884 - DNA, 35 bp, Artificial Sequence
  Description of Artificial Sequence: Synthetic oligonucleotide
atctcatcatcgtgtgccttagccttatctcgaag

SEQ ID NO: 347885 - DNA, 34 bp, Artificial Sequence
  Description of Artificial Sequence: Synthetic oligonucleotide
tctcatcatcgtgtgccttagccttatctcgaag

SEQ ID NO: 347886 - DNA, 33 bp, Artificial Sequence
  Description of Artificial Sequence: Synthetic oligonucleotide
ctcatcatcgtgtgccttagccttatctcgaag

SEQ ID NO: 347887 - DNA, 33 bp, Artificial Sequence
  Description of Artificial Sequence: Synthetic oligonucleotide
tcatcatcgtgtgccttagccttatctcgaagc

SEQ ID NO: 347888 - DNA, 32 bp, Artificial Sequence
  Description of Artificial Sequence: Synthetic oligonucleotide
catcatcgtgtgccttagccttatctcgaagc

SEQ ID NO: 347889 - DNA, 35 bp, Artificial Sequence
  Description of Artificial Sequence: Synthetic oligonucleotide
atcatcgtgtgccttagccttatctcgaagcaaag

SEQ ID NO: 347890 - DNA, 34 bp, Artificial Sequence
  Description of Artificial Sequence: Synthetic oligonucleotide
tcatcgtgtgccttagccttatctcgaagcaaag

SEQ ID NO: 347891 - DNA, 33 bp, Artificial Sequence
  Description of Artificial Sequence: Synthetic oligonucleotide
catcgtgtgccttagccttatctcgaagcaaag

SEQ ID NO: 347892 - DNA, 35 bp, Artificial Sequence
  Description of Artificial Sequence: Synthetic oligonucleotide
atcgtgtgccttagccttatctcgaagcaaagtag

SEQ ID NO: 347893 - DNA, 34 bp, Artificial Sequence
  Description of Artificial Sequence: Synthetic oligonucleotide
tcgtgtgccttagccttatctcgaagcaaagtag

SEQ ID NO: 347894 - DNA, 33 bp, Artificial Sequence
  Description of Artificial Sequence: Synthetic oligonucleotide
cgtgtgccttagccttatctcgaagcaaagtag

SEQ ID NO: 347895 - DNA, 34 bp, Artificial Sequence
  Description of Artificial Sequence: Synthetic oligonucleotide
gtgtgccttagccttatctcgaagcaaagtagag

SEQ ID NO: 347896 - DNA, 34 bp, Artificial Sequence
  Description of Artificial Sequence: Synthetic oligonucleotide
tgtgccttagccttatctcgaagcaaagtagagc

SEQ ID NO: 347897 - DNA, 33 bp, Artificial Sequence
  Description of Artificial Sequence: Synthetic oligonucleotide
gtgccttagccttatctcgaagcaaagtagagc

SEQ ID NO: 347898 - DNA, 37 bp, Artificial Sequence
  Description of Artificial Sequence: Synthetic oligonucleotide
tgccttagccttatctcgaagcaaagtagagcaaaac

SEQ ID NO: 347899 - DNA, 36 bp, Artificial Sequence
  Description of Artificial Sequence: Synthetic oligonucleotide
gccttagccttatctcgaagcaaagtagagcaaaac

SEQ ID NO: 347900 - DNA, 40 bp, Artificial Sequence
  Description of Artificial Sequence: Synthetic oligonucleotide
ccttagccttatctcgaagcaaagtagagcaaaacaaaag

SEQ ID NO: 347901 - DNA, 40 bp, Artificial Sequence
  Description of Artificial Sequence: Synthetic oligonucleotide
cttagccttatctcgaagcaaagtagagcaaaacaaaagc

SEQ ID NO: 347902 - DNA, 42 bp, Artificial Sequence
  Description of Artificial Sequence: Synthetic oligonucleotide
ttagccttatctcgaagcaaagtagagcaaaacaaaagcttc

SEQ ID NO: 347903 - DNA, 41 bp, Artificial Sequence
  Description of Artificial Sequence: Synthetic oligonucleotide
tagccttatctcgaagcaaagtagagcaaaacaaaagcttc

SEQ ID NO: 347904 - DNA, 40 bp, Artificial Sequence
  Description of Artificial Sequence: Synthetic oligonucleotide
agccttatctcgaagcaaagtagagcaaaacaaaagcttc

SEQ ID NO: 347905 - DNA, 39 bp, Artificial Sequence
  Description of Artificial Sequence: Synthetic oligonucleotide
gccttatctcgaagcaaagtagagcaaaacaaaagcttc

SEQ ID NO: 347906 - DNA, 40 bp, Artificial Sequence
  Description of Artificial Sequence: Synthetic oligonucleotide
ccttatctcgaagcaaagtagagcaaaacaaaagcttcac

SEQ ID NO: 347907 - DNA, 43 bp, Artificial Sequence
  Description of Artificial Sequence: Synthetic oligonucleotide
cttatctcgaagcaaagtagagcaaaacaaaagcttcactatg

SEQ ID NO: 347908 - DNA, 45 bp, Artificial Sequence
  Description of Artificial Sequence: Synthetic oligonucleotide
ttatctcgaagcaaagtagagcaaaacaaaagcttcactatgaac

SEQ ID NO: 347909 - DNA, 44 bp, Artificial Sequence
  Description of Artificial Sequence: Synthetic oligonucleotide
tatctcgaagcaaagtagagcaaaacaaaagcttcactatgaac

SEQ ID NO: 347910 - DNA, 43 bp, Artificial Sequence
  Description of Artificial Sequence: Synthetic oligonucleotide
atctcgaagcaaagtagagcaaaacaaaagcttcactatgaac

SEQ ID NO: 347911 - DNA, 42 bp, Artificial Sequence
  Description of Artificial Sequence: Synthetic oligonucleotide
tctcgaagcaaagtagagcaaaacaaaagcttcactatgaac

SEQ ID NO: 347912 - DNA, 41 bp, Artificial Sequence
  Description of Artificial Sequence: Synthetic oligonucleotide
ctcgaagcaaagtagagcaaaacaaaagcttcactatgaac

SEQ ID NO: 347913 - DNA, 43 bp, Artificial Sequence
  Description of Artificial Sequence: Synthetic oligonucleotide
tcgaagcaaagtagagcaaaacaaaagcttcactatgaacaag

SEQ ID NO: 347914 - DNA, 42 bp, Artificial Sequence
  Description of Artificial Sequence: Synthetic oligonucleotide
cgaagcaaagtagagcaaaacaaaagcttcactatgaacaag

SEQ ID NO: 347915 - DNA, 43 bp, Artificial Sequence
  Description of Artificial Sequence: Synthetic oligonucleotide
gaagcaaagtagagcaaaacaaaagcttcactatgaacaagtg

SEQ ID NO: 347916 - DNA, 44 bp, Artificial Sequence
  Description of Artificial Sequence: Synthetic oligonucleotide
aagcaaagtagagcaaaacaaaagcttcactatgaacaagtgac

SEQ ID NO: 347917 - DNA, 43 bp, Artificial Sequence
  Description of Artificial Sequence: Synthetic oligonucleotide
agcaaagtagagcaaaacaaaagcttcactatgaacaagtgac

SEQ ID NO: 347918 - DNA, 42 bp, Artificial Sequence
  Description of Artificial Sequence: Synthetic oligonucleotide
gcaaagtagagcaaaacaaaagcttcactatgaacaagtgac

SEQ ID NO: 347919 - DNA, 42 bp, Artificial Sequence
  Description of Artificial Sequence: Synthetic oligonucleotide
caaagtagagcaaaacaaaagcttcactatgaacaagtgacg

SEQ ID NO: 347920 - DNA, 42 bp, Artificial Sequence
  Description of Artificial Sequence: Synthetic oligonucleotide
aaagtagagcaaaacaaaagcttcactatgaacaagtgacgg

SEQ ID NO: 347921 - DNA, 41 bp, Artificial Sequence
  Description of Artificial Sequence: Synthetic oligonucleotide
aagtagagcaaaacaaaagcttcactatgaacaagtgacgg

SEQ ID NO: 347922 - DNA, 40 bp, Artificial Sequence
  Description of Artificial Sequence: Synthetic oligonucleotide
agtagagcaaaacaaaagcttcactatgaacaagtgacgg

SEQ ID NO: 347923 - DNA, 39 bp, Artificial Sequence
  Description of Artificial Sequence: Synthetic oligonucleotide
gtagagcaaaacaaaagcttcactatgaacaagtgacgg

SEQ ID NO: 347924 - DNA, 40 bp, Artificial Sequence
  Description of Artificial Sequence: Synthetic oligonucleotide
tagagcaaaacaaaagcttcactatgaacaagtgacggag

SEQ ID NO: 347925 - DNA, 39 bp, Artificial Sequence
  Description of Artificial Sequence: Synthetic oligonucleotide
agagcaaaacaaaagcttcactatgaacaagtgacggag

SEQ ID NO: 347926 - DNA, 38 bp, Artificial Sequence
  Description of Artificial Sequence: Synthetic oligonucleotide
gagcaaaacaaaagcttcactatgaacaagtgacggag

SEQ ID NO: 347927 - DNA, 38 bp, Artificial Sequence
  Description of Artificial Sequence: Synthetic oligonucleotide
agcaaaacaaaagcttcactatgaacaagtgacggagc

SEQ ID NO: 347928 - DNA, 37 bp, Artificial Sequence
  Description of Artificial Sequence: Synthetic oligonucleotide
gcaaaacaaaagcttcactatgaacaagtgacggagc

SEQ ID NO: 347929 - DNA, 38 bp, Artificial Sequence
  Description of Artificial Sequence: Synthetic oligonucleotide
caaaacaaaagcttcactatgaacaagtgacggagctg

SEQ ID NO: 347930 - DNA, 38 bp, Artificial Sequence
  Description of Artificial Sequence: Synthetic oligonucleotide
aaaacaaaagcttcactatgaacaagtgacggagctgg

SEQ ID NO: 347931 - DNA, 37 bp, Artificial Sequence
  Description of Artificial Sequence: Synthetic oligonucleotide
aaacaaaagcttcactatgaacaagtgacggagctgg

SEQ ID NO: 347932 - DNA, 36 bp, Artificial Sequence
  Description of Artificial Sequence: Synthetic oligonucleotide
aacaaaagcttcactatgaacaagtgacggagctgg

SEQ ID NO: 347933 - DNA, 35 bp, Artificial Sequence
  Description of Artificial Sequence: Synthetic oligonucleotide
acaaaagcttcactatgaacaagtgacggagctgg

SEQ ID NO: 347934 - DNA, 34 bp, Artificial Sequence
  Description of Artificial Sequence: Synthetic oligonucleotide
caaaagcttcactatgaacaagtgacggagctgg

SEQ ID NO: 347935 - DNA, 35 bp, Artificial Sequence
  Description of Artificial Sequence: Synthetic oligonucleotide
aaaagcttcactatgaacaagtgacggagctggac

SEQ ID NO: 347936 - DNA, 34 bp, Artificial Sequence
  Description of Artificial Sequence: Synthetic oligonucleotide
aaagcttcactatgaacaagtgacggagctggac

SEQ ID NO: 347937 - DNA, 33 bp, Artificial Sequence
  Description of Artificial Sequence: Synthetic oligonucleotide
aagcttcactatgaacaagtgacggagctggac

SEQ ID NO: 347938 - DNA, 32 bp, Artificial Sequence
  Description of Artificial Sequence: Synthetic oligonucleotide
agcttcactatgaacaagtgacggagctggac

SEQ ID NO: 347939 - DNA, 31 bp, Artificial Sequence
  Description of Artificial Sequence: Synthetic oligonucleotide
gcttcactatgaacaagtgacggagctggac

SEQ ID NO: 347940 - DNA, 34 bp, Artificial Sequence
  Description of Artificial Sequence: Synthetic oligonucleotide
cttcactatgaacaagtgacggagctggacaatc

SEQ ID NO: 347941 - DNA, 36 bp, Artificial Sequence
  Description of Artificial Sequence: Synthetic oligonucleotide
ttcactatgaacaagtgacggagctggacaatcatc

SEQ ID NO: 347942 - DNA, 35 bp, Artificial Sequence
  Description of Artificial Sequence: Synthetic oligonucleotide
tcactatgaacaagtgacggagctggacaatcatc

SEQ ID NO: 347943 - DNA, 34 bp, Artificial Sequence
  Description of Artificial Sequence: Synthetic oligonucleotide
cactatgaacaagtgacggagctggacaatcatc

SEQ ID NO: 347944 - DNA, 37 bp, Artificial Sequence
  Description of Artificial Sequence: Synthetic oligonucleotide
actatgaacaagtgacggagctggacaatcatctttc

SEQ ID NO: 347945 - DNA, 36 bp, Artificial Sequence
  Description of Artificial Sequence: Synthetic oligonucleotide
ctatgaacaagtgacggagctggacaatcatctttc

SEQ ID NO: 347946 - DNA, 37 bp, Artificial Sequence
  Description of Artificial Sequence: Synthetic oligonucleotide
tatgaacaagtgacggagctggacaatcatctttcag

SEQ ID NO: 347947 - DNA, 36 bp, Artificial Sequence
  Description of Artificial Sequence: Synthetic oligonucleotide
atgaacaagtgacggagctggacaatcatctttcag

SEQ ID NO: 347948 - DNA, 35 bp, Artificial Sequence
  Description of Artificial Sequence: Synthetic oligonucleotide
tgaacaagtgacggagctggacaatcatctttcag

SEQ ID NO: 347949 - DNA, 34 bp, Artificial Sequence
  Description of Artificial Sequence: Synthetic oligonucleotide
gaacaagtgacggagctggacaatcatctttcag

SEQ ID NO: 347950 - DNA, 35 bp, Artificial Sequence
  Description of Artificial Sequence: Synthetic oligonucleotide
aacaagtgacggagctggacaatcatctttcagag

SEQ ID NO: 347951 - DNA, 34 bp, Artificial Sequence
  Description of Artificial Sequence: Synthetic oligonucleotide
acaagtgacggagctggacaatcatctttcagag

SEQ ID NO: 347952 - DNA, 33 bp, Artificial Sequence
  Description of Artificial Sequence: Synthetic oligonucleotide
caagtgacggagctggacaatcatctttcagag

SEQ ID NO: 347953 - DNA, 33 bp, Artificial Sequence
  Description of Artificial Sequence: Synthetic oligonucleotide
aagtgacggagctggacaatcatctttcagagc

SEQ ID NO: 347954 - DNA, 32 bp, Artificial Sequence
  Description of Artificial Sequence: Synthetic oligonucleotide
agtgacggagctggacaatcatctttcagagc

SEQ ID NO: 347955 - DNA, 31 bp, Artificial Sequence
  Description of Artificial Sequence: Synthetic oligonucleotide
gtgacggagctggacaatcatctttcagagc

SEQ ID NO: 347956 - DNA, 33 bp, Artificial Sequence
  Description of Artificial Sequence: Synthetic oligonucleotide
tgacggagctggacaatcatctttcagagcatg

SEQ ID NO: 347957 - DNA, 32 bp, Artificial Sequence
  Description of Artificial Sequence: Synthetic oligonucleotide
gacggagctggacaatcatctttcagagcatg

SEQ ID NO: 347958 - DNA, 32 bp, Artificial Sequence
  Description of Artificial Sequence: Synthetic oligonucleotide
acggagctggacaatcatctttcagagcatgc

SEQ ID NO: 347959 - DNA, 31 bp, Artificial Sequence
  Description of Artificial Sequence: Synthetic oligonucleotide
cggagctggacaatcatctttcagagcatgc

SEQ ID NO: 347960 - DNA, 35 bp, Artificial Sequence
  Description of Artificial Sequence: Synthetic oligonucleotide
ggagctggacaatcatctttcagagcatgctaaac

SEQ ID NO: 347961 - DNA, 40 bp, Artificial Sequence
  Description of Artificial Sequence: Synthetic oligonucleotide
gagctggacaatcatctttcagagcatgctaaacaaaaag

SEQ ID NO: 347962 - DNA, 40 bp, Artificial Sequence
  Description of Artificial Sequence: Synthetic oligonucleotide
agctggacaatcatctttcagagcatgctaaacaaaaagg

SEQ ID NO: 347963 - DNA, 39 bp, Artificial Sequence
  Description of Artificial Sequence: Synthetic oligonucleotide
gctggacaatcatctttcagagcatgctaaacaaaaagg

SEQ ID NO: 347964 - DNA, 43 bp, Artificial Sequence
  Description of Artificial Sequence: Synthetic oligonucleotide
ctggacaatcatctttcagagcatgctaaacaaaaaggaatac

SEQ ID NO: 347965 - DNA, 44 bp, Artificial Sequence
  Description of Artificial Sequence: Synthetic oligonucleotide
tggacaatcatctttcagagcatgctaaacaaaaaggaatactc

SEQ ID NO: 347966 - DNA, 43 bp, Artificial Sequence
  Description of Artificial Sequence: Synthetic oligonucleotide
ggacaatcatctttcagagcatgctaaacaaaaaggaatactc

SEQ ID NO: 347967 - DNA, 43 bp, Artificial Sequence
  Description of Artificial Sequence: Synthetic oligonucleotide
gacaatcatctttcagagcatgctaaacaaaaaggaatactcc

SEQ ID NO: 347968 - DNA, 48 bp, Artificial Sequence
  Description of Artificial Sequence: Synthetic oligonucleotide
acaatcatctttcagagcatgctaaacaaaaaggaatactccataatg

SEQ ID NO: 347969 - DNA, 47 bp, Artificial Sequence
  Description of Artificial Sequence: Synthetic oligonucleotide
caatcatctttcagagcatgctaaacaaaaaggaatactccataatg

SEQ ID NO: 347970 - DNA, 47 bp, Artificial Sequence
  Description of Artificial Sequence: Synthetic oligonucleotide
aatcatctttcagagcatgctaaacaaaaaggaatactccataatgc

SEQ ID NO: 347971 - DNA, 46 bp, Artificial Sequence
  Description of Artificial Sequence: Synthetic oligonucleotide
atcatctttcagagcatgctaaacaaaaaggaatactccataatgc

SEQ ID NO: 347972 - DNA, 45 bp, Artificial Sequence
  Description of Artificial Sequence: Synthetic oligonucleotide
tcatctttcagagcatgctaaacaaaaaggaatactccataatgc

SEQ ID NO: 347973 - DNA, 44 bp, Artificial Sequence
  Description of Artificial Sequence: Synthetic oligonucleotide
catctttcagagcatgctaaacaaaaaggaatactccataatgc

SEQ ID NO: 347974 - DNA, 45 bp, Artificial Sequence
  Description of Artificial Sequence: Synthetic oligonucleotide
atctttcagagcatgctaaacaaaaaggaatactccataatgctg

SEQ ID NO: 347975 - DNA, 44 bp, Artificial Sequence
  Description of Artificial Sequence: Synthetic oligonucleotide
tctttcagagcatgctaaacaaaaaggaatactccataatgctg

SEQ ID NO: 347976 - DNA, 43 bp, Artificial Sequence
  Description of Artificial Sequence: Synthetic oligonucleotide
ctttcagagcatgctaaacaaaaaggaatactccataatgctg

SEQ ID NO: 347977 - DNA, 44 bp, Artificial Sequence
  Description of Artificial Sequence: Synthetic oligonucleotide
tttcagagcatgctaaacaaaaaggaatactccataatgctgtc

SEQ ID NO: 347978 - DNA, 43 bp, Artificial Sequence
  Description of Artificial Sequence: Synthetic oligonucleotide
ttcagagcatgctaaacaaaaaggaatactccataatgctgtc

SEQ ID NO: 347979 - DNA, 42 bp, Artificial Sequence
  Description of Artificial Sequence: Synthetic oligonucleotide
tcagagcatgctaaacaaaaaggaatactccataatgctgtc

SEQ ID NO: 347980 - DNA, 41 bp, Artificial Sequence
  Description of Artificial Sequence: Synthetic oligonucleotide
cagagcatgctaaacaaaaaggaatactccataatgctgtc

SEQ ID NO: 347981 - DNA, 43 bp, Artificial Sequence
  Description of Artificial Sequence: Synthetic oligonucleotide
agagcatgctaaacaaaaaggaatactccataatgctgtcaag

SEQ ID NO: 347982 - DNA, 42 bp, Artificial Sequence
  Description of Artificial Sequence: Synthetic oligonucleotide
gagcatgctaaacaaaaaggaatactccataatgctgtcaag

SEQ ID NO: 347983 - DNA, 45 bp, Artificial Sequence
  Description of Artificial Sequence: Synthetic oligonucleotide
agcatgctaaacaaaaaggaatactccataatgctgtcaagtaac

SEQ ID NO: 347984 - DNA, 44 bp, Artificial Sequence
  Description of Artificial Sequence: Synthetic oligonucleotide
gcatgctaaacaaaaaggaatactccataatgctgtcaagtaac

SEQ ID NO: 347985 - DNA, 45 bp, Artificial Sequence
  Description of Artificial Sequence: Synthetic oligonucleotide
catgctaaacaaaaaggaatactccataatgctgtcaagtaactc

SEQ ID NO: 347986 - DNA, 45 bp, Artificial Sequence
  Description of Artificial Sequence: Synthetic oligonucleotide
atgctaaacaaaaaggaatactccataatgctgtcaagtaactcc

SEQ ID NO: 347987 - DNA, 44 bp, Artificial Sequence
  Description of Artificial Sequence: Synthetic oligonucleotide
tgctaaacaaaaaggaatactccataatgctgtcaagtaactcc

SEQ ID NO: 347988 - DNA, 43 bp, Artificial Sequence
  Description of Artificial Sequence: Synthetic oligonucleotide
gctaaacaaaaaggaatactccataatgctgtcaagtaactcc

SEQ ID NO: 347989 - DNA, 43 bp, Artificial Sequence
  Description of Artificial Sequence: Synthetic oligonucleotide
ctaaacaaaaaggaatactccataatgctgtcaagtaactccg

SEQ ID NO: 347990 - DNA, 43 bp, Artificial Sequence
  Description of Artificial Sequence: Synthetic oligonucleotide
taaacaaaaaggaatactccataatgctgtcaagtaactccgg

SEQ ID NO: 347991 - DNA, 42 bp, Artificial Sequence
  Description of Artificial Sequence: Synthetic oligonucleotide
aaacaaaaaggaatactccataatgctgtcaagtaactccgg

SEQ ID NO: 347992 - DNA, 41 bp, Artificial Sequence
  Description of Artificial Sequence: Synthetic oligonucleotide
aacaaaaaggaatactccataatgctgtcaagtaactccgg

SEQ ID NO: 347993 - DNA, 40 bp, Artificial Sequence
  Description of Artificial Sequence: Synthetic oligonucleotide
acaaaaaggaatactccataatgctgtcaagtaactccgg

SEQ ID NO: 347994 - DNA, 39 bp, Artificial Sequence
  Description of Artificial Sequence: Synthetic oligonucleotide
caaaaaggaatactccataatgctgtcaagtaactccgg

SEQ ID NO: 347995 - DNA, 40 bp, Artificial Sequence
  Description of Artificial Sequence: Synthetic oligonucleotide
aaaaaggaatactccataatgctgtcaagtaactccggac

SEQ ID NO: 347996 - DNA, 39 bp, Artificial Sequence
  Description of Artificial Sequence: Synthetic oligonucleotide
aaaaggaatactccataatgctgtcaagtaactccggac

SEQ ID NO: 347997 - DNA, 38 bp, Artificial Sequence
  Description of Artificial Sequence: Synthetic oligonucleotide
aaaggaatactccataatgctgtcaagtaactccggac

SEQ ID NO: 347998 - DNA, 37 bp, Artificial Sequence
  Description of Artificial Sequence: Synthetic oligonucleotide
aaggaatactccataatgctgtcaagtaactccggac

SEQ ID NO: 347999 - DNA, 36 bp, Artificial Sequence
  Description of Artificial Sequence: Synthetic oligonucleotide
aggaatactccataatgctgtcaagtaactccggac

SEQ ID NO: 348000 - DNA, 35 bp, Artificial Sequence
  Description of Artificial Sequence: Synthetic oligonucleotide
ggaatactccataatgctgtcaagtaactccggac

SEQ ID NO: 348001 - DNA, 36 bp, Artificial Sequence
  Description of Artificial Sequence: Synthetic oligonucleotide
gaatactccataatgctgtcaagtaactccggactg

SEQ ID NO: 348002 - DNA, 38 bp, Artificial Sequence
  Description of Artificial Sequence: Synthetic oligonucleotide
aatactccataatgctgtcaagtaactccggactgaac

SEQ ID NO: 348003 - DNA, 37 bp, Artificial Sequence
  Description of Artificial Sequence: Synthetic oligonucleotide
atactccataatgctgtcaagtaactccggactgaac

SEQ ID NO: 348004 - DNA, 36 bp, Artificial Sequence
  Description of Artificial Sequence: Synthetic oligonucleotide
tactccataatgctgtcaagtaactccggactgaac

SEQ ID NO: 348005 - DNA, 35 bp, Artificial Sequence
  Description of Artificial Sequence: Synthetic oligonucleotide
actccataatgctgtcaagtaactccggactgaac

SEQ ID NO: 348006 - DNA, 34 bp, Artificial Sequence
  Description of Artificial Sequence: Synthetic oligonucleotide
ctccataatgctgtcaagtaactccggactgaac

SEQ ID NO: 348007 - DNA, 35 bp, Artificial Sequence
  Description of Artificial Sequence: Synthetic oligonucleotide
tccataatgctgtcaagtaactccggactgaactg

SEQ ID NO: 348008 - DNA, 34 bp, Artificial Sequence
  Description of Artificial Sequence: Synthetic oligonucleotide
ccataatgctgtcaagtaactccggactgaactg

SEQ ID NO: 348009 - DNA, 36 bp, Artificial Sequence
  Description of Artificial Sequence: Synthetic oligonucleotide
cataatgctgtcaagtaactccggactgaactgaac

SEQ ID NO: 348010 - DNA, 38 bp, Artificial Sequence
  Description of Artificial Sequence: Synthetic oligonucleotide
ataatgctgtcaagtaactccggactgaactgaacttg

SEQ ID NO: 348011 - DNA, 37 bp, Artificial Sequence
  Description of Artificial Sequence: Synthetic oligonucleotide
taatgctgtcaagtaactccggactgaactgaacttg

SEQ ID NO: 348012 - DNA, 36 bp, Artificial Sequence
  Description of Artificial Sequence: Synthetic oligonucleotide
aatgctgtcaagtaactccggactgaactgaacttg

SEQ ID NO: 348013 - DNA, 35 bp, Artificial Sequence
  Description of Artificial Sequence: Synthetic oligonucleotide
atgctgtcaagtaactccggactgaactgaacttg

SEQ ID NO: 348014 - DNA, 34 bp, Artificial Sequence
  Description of Artificial Sequence: Synthetic oligonucleotide
tgctgtcaagtaactccggactgaactgaacttg

SEQ ID NO: 348015 - DNA, 33 bp, Artificial Sequence
  Description of Artificial Sequence: Synthetic oligonucleotide
gctgtcaagtaactccggactgaactgaacttg

SEQ ID NO: 348016 - DNA, 37 bp, Artificial Sequence
  Description of Artificial Sequence: Synthetic oligonucleotide
ctgtcaagtaactccggactgaactgaacttgaaaag

SEQ ID NO: 348017 - DNA, 38 bp, Artificial Sequence
  Description of Artificial Sequence: Synthetic oligonucleotide
tgtcaagtaactccggactgaactgaacttgaaaagac

SEQ ID NO: 348018 - DNA, 37 bp, Artificial Sequence
  Description of Artificial Sequence: Synthetic oligonucleotide
gtcaagtaactccggactgaactgaacttgaaaagac

SEQ ID NO: 348019 - DNA, 37 bp, Artificial Sequence
  Description of Artificial Sequence: Synthetic oligonucleotide
tcaagtaactccggactgaactgaacttgaaaagacc

SEQ ID NO: 348020 - DNA, 36 bp, Artificial Sequence
  Description of Artificial Sequence: Synthetic oligonucleotide
caagtaactccggactgaactgaacttgaaaagacc

SEQ ID NO: 348021 - DNA, 37 bp, Artificial Sequence
  Description of Artificial Sequence: Synthetic oligonucleotide
aagtaactccggactgaactgaacttgaaaagacctg

SEQ ID NO: 348022 - DNA, 36 bp, Artificial Sequence
  Description of Artificial Sequence: Synthetic oligonucleotide
agtaactccggactgaactgaacttgaaaagacctg

SEQ ID NO: 348023 - DNA, 35 bp, Artificial Sequence
  Description of Artificial Sequence: Synthetic oligonucleotide
gtaactccggactgaactgaacttgaaaagacctg

SEQ ID NO: 348024 - DNA, 35 bp, Artificial Sequence
  Description of Artificial Sequence: Synthetic oligonucleotide
taactccggactgaactgaacttgaaaagacctgc

SEQ ID NO: 348025 - DNA, 34 bp, Artificial Sequence
  Description of Artificial Sequence: Synthetic oligonucleotide
aactccggactgaactgaacttgaaaagacctgc

SEQ ID NO: 348026 - DNA, 33 bp, Artificial Sequence
  Description of Artificial Sequence: Synthetic oligonucleotide
actccggactgaactgaacttgaaaagacctgc

SEQ ID NO: 348027 - DNA, 32 bp, Artificial Sequence
  Description of Artificial Sequence: Synthetic oligonucleotide
ctccggactgaactgaacttgaaaagacctgc

SEQ ID NO: 348028 - DNA, 33 bp, Artificial Sequence
  Description of Artificial Sequence: Synthetic oligonucleotide
tccggactgaactgaacttgaaaagacctgcag

SEQ ID NO: 348029 - DNA, 32 bp, Artificial Sequence
  Description of Artificial Sequence: Synthetic oligonucleotide
ccggactgaactgaacttgaaaagacctgcag

SEQ ID NO: 348030 - DNA, 32 bp, Artificial Sequence
  Description of Artificial Sequence: Synthetic oligonucleotide
cggactgaactgaacttgaaaagacctgcagc

SEQ ID NO: 348031 - DNA, 35 bp, Artificial Sequence
  Description of Artificial Sequence: Synthetic oligonucleotide
ggactgaactgaacttgaaaagacctgcagcaatc

SEQ ID NO: 348032 - DNA, 36 bp, Artificial Sequence
  Description of Artificial Sequence: Synthetic oligonucleotide
gactgaactgaacttgaaaagacctgcagcaatctc

SEQ ID NO: 348033 - DNA, 37 bp, Artificial Sequence
  Description of Artificial Sequence: Synthetic oligonucleotide
actgaactgaacttgaaaagacctgcagcaatctcag

SEQ ID NO: 348034 - DNA, 36 bp, Artificial Sequence
  Description of Artificial Sequence: Synthetic oligonucleotide
ctgaactgaacttgaaaagacctgcagcaatctcag

SEQ ID NO: 348035 - DNA, 36 bp, Artificial Sequence
  Description of Artificial Sequence: Synthetic oligonucleotide
tgaactgaacttgaaaagacctgcagcaatctcagg

SEQ ID NO: 348036 - DNA, 35 bp, Artificial Sequence
  Description of Artificial Sequence: Synthetic oligonucleotide
gaactgaacttgaaaagacctgcagcaatctcagg

SEQ ID NO: 348037 - DNA, 35 bp, Artificial Sequence
  Description of Artificial Sequence: Synthetic oligonucleotide
aactgaacttgaaaagacctgcagcaatctcaggc

SEQ ID NO: 348038 - DNA, 34 bp, Artificial Sequence
  Description of Artificial Sequence: Synthetic oligonucleotide
actgaacttgaaaagacctgcagcaatctcaggc

SEQ ID NO: 348039 - DNA, 33 bp, Artificial Sequence
  Description of Artificial Sequence: Synthetic oligonucleotide
ctgaacttgaaaagacctgcagcaatctcaggc

SEQ ID NO: 348040 - DNA, 34 bp, Artificial Sequence
  Description of Artificial Sequence: Synthetic oligonucleotide
tgaacttgaaaagacctgcagcaatctcaggctg

SEQ ID NO: 348041 - DNA, 33 bp, Artificial Sequence
  Description of Artificial Sequence: Synthetic oligonucleotide
gaacttgaaaagacctgcagcaatctcaggctg

SEQ ID NO: 348042 - DNA, 33 bp, Artificial Sequence
  Description of Artificial Sequence: Synthetic oligonucleotide
aacttgaaaagacctgcagcaatctcaggctgc

SEQ ID NO: 348043 - DNA, 32 bp, Artificial Sequence
  Description of Artificial Sequence: Synthetic oligonucleotide
acttgaaaagacctgcagcaatctcaggctgc

SEQ ID NO: 348044 - DNA, 31 bp, Artificial Sequence
  Description of Artificial Sequence: Synthetic oligonucleotide
cttgaaaagacctgcagcaatctcaggctgc

SEQ ID NO: 348045 - DNA, 32 bp, Artificial Sequence
  Description of Artificial Sequence: Synthetic oligonucleotide
ttgaaaagacctgcagcaatctcaggctgcag

SEQ ID NO: 348046 - DNA, 31 bp, Artificial Sequence
  Description of Artificial Sequence: Synthetic oligonucleotide
tgaaaagacctgcagcaatctcaggctgcag

SEQ ID NO: 348047 - DNA, 30 bp, Artificial Sequence
  Description of Artificial Sequence: Synthetic oligonucleotide
gaaaagacctgcagcaatctcaggctgcag

SEQ ID NO: 348048 - DNA, 32 bp, Artificial Sequence
  Description of Artificial Sequence: Synthetic oligonucleotide
aaaagacctgcagcaatctcaggctgcagaag

SEQ ID NO: 348049 - DNA, 31 bp, Artificial Sequence
  Description of Artificial Sequence: Synthetic oligonucleotide
aaagacctgcagcaatctcaggctgcagaag

SEQ ID NO: 348050 - DNA, 30 bp, Artificial Sequence
  Description of Artificial Sequence: Synthetic oligonucleotide
aagacctgcagcaatctcaggctgcagaag

SEQ ID NO: 348051 - DNA, 29 bp, Artificial Sequence
  Description of Artificial Sequence: Synthetic oligonucleotide
agacctgcagcaatctcaggctgcagaag

SEQ ID NO: 348052 - DNA, 28 bp, Artificial Sequence
  Description of Artificial Sequence: Synthetic oligonucleotide
gacctgcagcaatctcaggctgcagaag

SEQ ID NO: 348053 - DNA, 29 bp, Artificial Sequence
  Description of Artificial Sequence: Synthetic oligonucleotide
acctgcagcaatctcaggctgcagaagag

SEQ ID NO: 348054 - DNA, 28 bp, Artificial Sequence
  Description of Artificial Sequence: Synthetic oligonucleotide
cctgcagcaatctcaggctgcagaagag

SEQ ID NO: 348055 - DNA, 28 bp, Artificial Sequence
  Description of Artificial Sequence: Synthetic oligonucleotide
ctgcagcaatctcaggctgcagaagagc

SEQ ID NO: 348056 - DNA, 28 bp, Artificial Sequence
  Description of Artificial Sequence: Synthetic oligonucleotide
tgcagcaatctcaggctgcagaagagcc

SEQ ID NO: 348057 - DNA, 27 bp, Artificial Sequence
  Description of Artificial Sequence: Synthetic oligonucleotide
gcagcaatctcaggctgcagaagagcc

SEQ ID NO: 348058 - DNA, 27 bp, Artificial Sequence
  Description of Artificial Sequence: Synthetic oligonucleotide
cagcaatctcaggctgcagaagagccg

SEQ ID NO: 348059 - DNA, 27 bp, Artificial Sequence
  Description of Artificial Sequence: Synthetic oligonucleotide
agcaatctcaggctgcagaagagccgg

SEQ ID NO: 348060 - DNA, 26 bp, Artificial Sequence
  Description of Artificial Sequence: Synthetic oligonucleotide
gcaatctcaggctgcagaagagccgg

SEQ ID NO: 348061 - DNA, 27 bp, Artificial Sequence
  Description of Artificial Sequence: Synthetic oligonucleotide
caatctcaggctgcagaagagccgggt

SEQ ID NO: 348062 - DNA, 28 bp, Artificial Sequence
  Description of Artificial Sequence: Synthetic oligonucleotide
aatctcaggctgcagaagagccgggttg

SEQ ID NO: 348063 - DNA, 27 bp, Artificial Sequence
  Description of Artificial Sequence: Synthetic oligonucleotide
atctcaggctgcagaagagccgggttg

SEQ ID NO: 348064 - DNA, 26 bp, Artificial Sequence
  Description of Artificial Sequence: Synthetic oligonucleotide
tctcaggctgcagaagagccgggttg

SEQ ID NO: 348065 - DNA, 25 bp, Artificial Sequence
  Description of Artificial Sequence: Synthetic oligonucleotide
ctcaggctgcagaagagccgggttg

SEQ ID NO: 348066 - DNA, 27 bp, Artificial Sequence
  Description of Artificial Sequence: Synthetic oligonucleotide
tcaggctgcagaagagccgggttgcat

SEQ ID NO: 348067 - DNA, 27 bp, Artificial Sequence
  Description of Artificial Sequence: Synthetic oligonucleotide
caggctgcagaagagccgggttgcatt

SEQ ID NO: 348068 - DNA, 29 bp, Artificial Sequence
  Description of Artificial Sequence: Synthetic oligonucleotide
aggctgcagaagagccgggttgcattatg

SEQ ID NO: 348069 - DNA, 28 bp, Artificial Sequence
  Description of Artificial Sequence: Synthetic oligonucleotide
ggctgcagaagagccgggttgcattatg

SEQ ID NO: 348070 - DNA, 29 bp, Artificial Sequence
  Description of Artificial Sequence: Synthetic oligonucleotide
gctgcagaagagccgggttgcattatgtg

SEQ ID NO: 348071 - DNA, 29 bp, Artificial Sequence
  Description of Artificial Sequence: Synthetic oligonucleotide
ctgcagaagagccgggttgcattatgtgg

SEQ ID NO: 348072 - DNA, 29 bp, Artificial Sequence
  Description of Artificial Sequence: Synthetic oligonucleotide
tgcagaagagccgggttgcattatgtggc

SEQ ID NO: 348073 - DNA, 28 bp, Artificial Sequence
  Description of Artificial Sequence: Synthetic oligonucleotide
gcagaagagccgggttgcattatgtggc

SEQ ID NO: 348074 - DNA, 29 bp, Artificial Sequence
  Description of Artificial Sequence: Synthetic oligonucleotide
cagaagagccgggttgcattatgtggcag

SEQ ID NO: 348075 - DNA, 30 bp, Artificial Sequence
  Description of Artificial Sequence: Synthetic oligonucleotide
agaagagccgggttgcattatgtggcagtc

SEQ ID NO: 348076 - DNA, 29 bp, Artificial Sequence
  Description of Artificial Sequence: Synthetic oligonucleotide
gaagagccgggttgcattatgtggcagtc

SEQ ID NO: 348077 - DNA, 30 bp, Artificial Sequence
  Description of Artificial Sequence: Synthetic oligonucleotide
aagagccgggttgcattatgtggcagtcac

SEQ ID NO: 348078 - DNA, 29 bp, Artificial Sequence
  Description of Artificial Sequence: Synthetic oligonucleotide
agagccgggttgcattatgtggcagtcac

SEQ ID NO: 348079 - DNA, 28 bp, Artificial Sequence
  Description of Artificial Sequence: Synthetic oligonucleotide
gagccgggttgcattatgtggcagtcac

SEQ ID NO: 348080 - DNA, 28 bp, Artificial Sequence
  Description of Artificial Sequence: Synthetic oligonucleotide
agccgggttgcattatgtggcagtcacc

SEQ ID NO: 348081 - DNA, 27 bp, Artificial Sequence
  Description of Artificial Sequence: Synthetic oligonucleotide
gccgggttgcattatgtggcagtcacc

SEQ ID NO: 348082 - DNA, 27 bp, Artificial Sequence
  Description of Artificial Sequence: Synthetic oligonucleotide
ccgggttgcattatgtggcagtcaccc

SEQ ID NO: 348083 - DNA, 28 bp, Artificial Sequence
  Description of Artificial Sequence: Synthetic oligonucleotide
cgggttgcattatgtggcagtcaccctg

SEQ ID NO: 348084 - DNA, 28 bp, Artificial Sequence
  Description of Artificial Sequence: Synthetic oligonucleotide
gggttgcattatgtggcagtcaccctgg

SEQ ID NO: 348085 - DNA, 29 bp, Artificial Sequence
  Description of Artificial Sequence: Synthetic oligonucleotide
ggttgcattatgtggcagtcaccctggac

SEQ ID NO: 348086 - DNA, 29 bp, Artificial Sequence
  Description of Artificial Sequence: Synthetic oligonucleotide
gttgcattatgtggcagtcaccctggacg

SEQ ID NO: 348087 - DNA, 29 bp, Artificial Sequence
  Description of Artificial Sequence: Synthetic oligonucleotide
ttgcattatgtggcagtcaccctggacgc

SEQ ID NO: 348088 - DNA, 28 bp, Artificial Sequence
  Description of Artificial Sequence: Synthetic oligonucleotide
tgcattatgtggcagtcaccctggacgc

SEQ ID NO: 348089 - DNA, 27 bp, Artificial Sequence
  Description of Artificial Sequence: Synthetic oligonucleotide
gcattatgtggcagtcaccctggacgc

SEQ ID NO: 348090 - DNA, 28 bp, Artificial Sequence
  Description of Artificial Sequence: Synthetic oligonucleotide
cattatgtggcagtcaccctggacgcag

SEQ ID NO: 348091 - DNA, 29 bp, Artificial Sequence
  Description of Artificial Sequence: Synthetic oligonucleotide
attatgtggcagtcaccctggacgcagac

SEQ ID NO: 348092 - DNA, 28 bp, Artificial Sequence
  Description of Artificial Sequence: Synthetic oligonucleotide
ttatgtggcagtcaccctggacgcagac

SEQ ID NO: 348093 - DNA, 27 bp, Artificial Sequence
  Description of Artificial Sequence: Synthetic oligonucleotide
tatgtggcagtcaccctggacgcagac

SEQ ID NO: 348094 - DNA, 27 bp, Artificial Sequence
  Description of Artificial Sequence: Synthetic oligonucleotide
atgtggcagtcaccctggacgcagaca

SEQ ID NO: 348095 - DNA, 26 bp, Artificial Sequence
  Description of Artificial Sequence: Synthetic oligonucleotide
tgtggcagtcaccctggacgcagaca

SEQ ID NO: 348096 - DNA, 25 bp, Artificial Sequence
  Description of Artificial Sequence: Synthetic oligonucleotide
gtggcagtcaccctggacgcagaca

SEQ ID NO: 348097 - DNA, 26 bp, Artificial Sequence
  Description of Artificial Sequence: Synthetic oligonucleotide
tggcagtcaccctggacgcagacaca

SEQ ID NO: 348098 - DNA, 25 bp, Artificial Sequence
  Description of Artificial Sequence: Synthetic oligonucleotide
ggcagtcaccctggacgcagacaca

SEQ ID NO: 348099 - DNA, 25 bp, Artificial Sequence
  Description of Artificial Sequence: Synthetic oligonucleotide
gcagtcaccctggacgcagacacag

SEQ ID NO: 348100 - DNA, 26 bp, Artificial Sequence
  Description of Artificial Sequence: Synthetic oligonucleotide
cagtcaccctggacgcagacacagga

SEQ ID NO: 348101 - DNA, 27 bp, Artificial Sequence
  Description of Artificial Sequence: Synthetic oligonucleotide
agtcaccctggacgcagacacaggaca

SEQ ID NO: 348102 - DNA, 27 bp, Artificial Sequence
  Description of Artificial Sequence: Synthetic oligonucleotide
gtcaccctggacgcagacacaggacat

SEQ ID NO: 348103 - DNA, 27 bp, Artificial Sequence
  Description of Artificial Sequence: Synthetic oligonucleotide
tcaccctggacgcagacacaggacatc

SEQ ID NO: 348104 - DNA, 26 bp, Artificial Sequence
  Description of Artificial Sequence: Synthetic oligonucleotide
caccctggacgcagacacaggacatc

SEQ ID NO: 348105 - DNA, 26 bp, Artificial Sequence
  Description of Artificial Sequence: Synthetic oligonucleotide
accctggacgcagacacaggacatcc

SEQ ID NO: 348106 - DNA, 25 bp, Artificial Sequence
  Description of Artificial Sequence: Synthetic oligonucleotide
ccctggacgcagacacaggacatcc

SEQ ID NO: 348107 - DNA, 27 bp, Artificial Sequence
  Description of Artificial Sequence: Synthetic oligonucleotide
cctggacgcagacacaggacatcccaa

SEQ ID NO: 348108 - DNA, 28 bp, Artificial Sequence
  Description of Artificial Sequence: Synthetic oligonucleotide
ctggacgcagacacaggacatcccaatc

SEQ ID NO: 348109 - DNA, 29 bp, Artificial Sequence
  Description of Artificial Sequence: Synthetic oligonucleotide
tggacgcagacacaggacatcccaatctc

SEQ ID NO: 348110 - DNA, 28 bp, Artificial Sequence
  Description of Artificial Sequence: Synthetic oligonucleotide
ggacgcagacacaggacatcccaatctc

SEQ ID NO: 348111 - DNA, 30 bp, Artificial Sequence
  Description of Artificial Sequence: Synthetic oligonucleotide
gacgcagacacaggacatcccaatctcatc

SEQ ID NO: 348112 - DNA, 30 bp, Artificial Sequence
  Description of Artificial Sequence: Synthetic oligonucleotide
acgcagacacaggacatcccaatctcatcc

SEQ ID NO: 348113 - DNA, 29 bp, Artificial Sequence
  Description of Artificial Sequence: Synthetic oligonucleotide
cgcagacacaggacatcccaatctcatcc

SEQ ID NO: 348114 - DNA, 32 bp, Artificial Sequence
  Description of Artificial Sequence: Synthetic oligonucleotide
gcagacacaggacatcccaatctcatccttac

SEQ ID NO: 348115 - DNA, 33 bp, Artificial Sequence
  Description of Artificial Sequence: Synthetic oligonucleotide
cagacacaggacatcccaatctcatccttactg

SEQ ID NO: 348116 - DNA, 34 bp, Artificial Sequence
  Description of Artificial Sequence: Synthetic oligonucleotide
agacacaggacatcccaatctcatccttactgag

SEQ ID NO: 348117 - DNA, 33 bp, Artificial Sequence
  Description of Artificial Sequence: Synthetic oligonucleotide
gacacaggacatcccaatctcatccttactgag

SEQ ID NO: 348118 - DNA, 33 bp, Artificial Sequence
  Description of Artificial Sequence: Synthetic oligonucleotide
acacaggacatcccaatctcatccttactgagg

SEQ ID NO: 348119 - DNA, 32 bp, Artificial Sequence
  Description of Artificial Sequence: Synthetic oligonucleotide
cacaggacatcccaatctcatccttactgagg

SEQ ID NO: 348120 - DNA, 33 bp, Artificial Sequence
  Description of Artificial Sequence: Synthetic oligonucleotide
acaggacatcccaatctcatccttactgaggac

SEQ ID NO: 348121 - DNA, 32 bp, Artificial Sequence
  Description of Artificial Sequence: Synthetic oligonucleotide
caggacatcccaatctcatccttactgaggac

SEQ ID NO: 348122 - DNA, 32 bp, Artificial Sequence
  Description of Artificial Sequence: Synthetic oligonucleotide
aggacatcccaatctcatccttactgaggacc

SEQ ID NO: 348123 - DNA, 31 bp, Artificial Sequence
  Description of Artificial Sequence: Synthetic oligonucleotide
ggacatcccaatctcatccttactgaggacc

SEQ ID NO: 348124 - DNA, 34 bp, Artificial Sequence
  Description of Artificial Sequence: Synthetic oligonucleotide
gacatcccaatctcatccttactgaggacctaag

SEQ ID NO: 348125 - DNA, 36 bp, Artificial Sequence
  Description of Artificial Sequence: Synthetic oligonucleotide
acatcccaatctcatccttactgaggacctaagatg

SEQ ID NO: 348126 - DNA, 35 bp, Artificial Sequence
  Description of Artificial Sequence: Synthetic oligonucleotide
catcccaatctcatccttactgaggacctaagatg

SEQ ID NO: 348127 - DNA, 36 bp, Artificial Sequence
  Description of Artificial Sequence: Synthetic oligonucleotide
atcccaatctcatccttactgaggacctaagatgtg

SEQ ID NO: 348128 - DNA, 35 bp, Artificial Sequence
  Description of Artificial Sequence: Synthetic oligonucleotide
tcccaatctcatccttactgaggacctaagatgtg

SEQ ID NO: 348129 - DNA, 34 bp, Artificial Sequence
  Description of Artificial Sequence: Synthetic oligonucleotide
cccaatctcatccttactgaggacctaagatgtg

SEQ ID NO: 348130 - DNA, 37 bp, Artificial Sequence
  Description of Artificial Sequence: Synthetic oligonucleotide
ccaatctcatccttactgaggacctaagatgtgttag

SEQ ID NO: 348131 - DNA, 37 bp, Artificial Sequence
  Description of Artificial Sequence: Synthetic oligonucleotide
caatctcatccttactgaggacctaagatgtgttagg

SEQ ID NO: 348132 - DNA, 37 bp, Artificial Sequence
  Description of Artificial Sequence: Synthetic oligonucleotide
aatctcatccttactgaggacctaagatgtgttaggc

SEQ ID NO: 348133 - DNA, 36 bp, Artificial Sequence
  Description of Artificial Sequence: Synthetic oligonucleotide
atctcatccttactgaggacctaagatgtgttaggc

SEQ ID NO: 348134 - DNA, 35 bp, Artificial Sequence
  Description of Artificial Sequence: Synthetic oligonucleotide
tctcatccttactgaggacctaagatgtgttaggc

SEQ ID NO: 348135 - DNA, 34 bp, Artificial Sequence
  Description of Artificial Sequence: Synthetic oligonucleotide
ctcatccttactgaggacctaagatgtgttaggc

SEQ ID NO: 348136 - DNA, 36 bp, Artificial Sequence
  Description of Artificial Sequence: Synthetic oligonucleotide
tcatccttactgaggacctaagatgtgttaggcttg

SEQ ID NO: 348137 - DNA, 35 bp, Artificial Sequence
  Description of Artificial Sequence: Synthetic oligonucleotide
catccttactgaggacctaagatgtgttaggcttg

SEQ ID NO: 348138 - DNA, 35 bp, Artificial Sequence
  Description of Artificial Sequence: Synthetic oligonucleotide
atccttactgaggacctaagatgtgttaggcttgg

SEQ ID NO: 348139 - DNA, 34 bp, Artificial Sequence
  Description of Artificial Sequence: Synthetic oligonucleotide
tccttactgaggacctaagatgtgttaggcttgg

SEQ ID NO: 348140 - DNA, 33 bp, Artificial Sequence
  Description of Artificial Sequence: Synthetic oligonucleotide
ccttactgaggacctaagatgtgttaggcttgg

SEQ ID NO: 348141 - DNA, 34 bp, Artificial Sequence
  Description of Artificial Sequence: Synthetic oligonucleotide
cttactgaggacctaagatgtgttaggcttggac

SEQ ID NO: 348142 - DNA, 35 bp, Artificial Sequence
  Description of Artificial Sequence: Synthetic oligonucleotide
ttactgaggacctaagatgtgttaggcttggacac

SEQ ID NO: 348143 - DNA, 34 bp, Artificial Sequence
  Description of Artificial Sequence: Synthetic oligonucleotide
tactgaggacctaagatgtgttaggcttggacac

SEQ ID NO: 348144 - DNA, 33 bp, Artificial Sequence
  Description of Artificial Sequence: Synthetic oligonucleotide
actgaggacctaagatgtgttaggcttggacac

SEQ ID NO: 348145 - DNA, 32 bp, Artificial Sequence
  Description of Artificial Sequence: Synthetic oligonucleotide
ctgaggacctaagatgtgttaggcttggacac

SEQ ID NO: 348146 - DNA, 33 bp, Artificial Sequence
  Description of Artificial Sequence: Synthetic oligonucleotide
tgaggacctaagatgtgttaggcttggacacag

SEQ ID NO: 348147 - DNA, 32 bp, Artificial Sequence
  Description of Artificial Sequence: Synthetic oligonucleotide
gaggacctaagatgtgttaggcttggacacag

SEQ ID NO: 348148 - DNA, 33 bp, Artificial Sequence
  Description of Artificial Sequence: Synthetic oligonucleotide
aggacctaagatgtgttaggcttggacacagac

SEQ ID NO: 348149 - DNA, 32 bp, Artificial Sequence
  Description of Artificial Sequence: Synthetic oligonucleotide
ggacctaagatgtgttaggcttggacacagac

SEQ ID NO: 348150 - DNA, 32 bp, Artificial Sequence
  Description of Artificial Sequence: Synthetic oligonucleotide
gacctaagatgtgttaggcttggacacagacg

SEQ ID NO: 348151 - DNA, 32 bp, Artificial Sequence
  Description of Artificial Sequence: Synthetic oligonucleotide
acctaagatgtgttaggcttggacacagacgg

SEQ ID NO: 348152 - DNA, 31 bp, Artificial Sequence
  Description of Artificial Sequence: Synthetic oligonucleotide
cctaagatgtgttaggcttggacacagacgg

SEQ ID NO: 348153 - DNA, 31 bp, Artificial Sequence
  Description of Artificial Sequence: Synthetic oligonucleotide
ctaagatgtgttaggcttggacacagacggc

SEQ ID NO: 348154 - DNA, 32 bp, Artificial Sequence
  Description of Artificial Sequence: Synthetic oligonucleotide
taagatgtgttaggcttggacacagacggctg

SEQ ID NO: 348155 - DNA, 31 bp, Artificial Sequence
  Description of Artificial Sequence: Synthetic oligonucleotide
aagatgtgttaggcttggacacagacggctg

SEQ ID NO: 348156 - DNA, 30 bp, Artificial Sequence
  Description of Artificial Sequence: Synthetic oligonucleotide
agatgtgttaggcttggacacagacggctg

SEQ ID NO: 348157 - DNA, 29 bp, Artificial Sequence
  Description of Artificial Sequence: Synthetic oligonucleotide
gatgtgttaggcttggacacagacggctg

SEQ ID NO: 348158 - DNA, 29 bp, Artificial Sequence
  Description of Artificial Sequence: Synthetic oligonucleotide
atgtgttaggcttggacacagacggctgc

SEQ ID NO: 348159 - DNA, 28 bp, Artificial Sequence
  Description of Artificial Sequence: Synthetic oligonucleotide
tgtgttaggcttggacacagacggctgc

SEQ ID NO: 348160 - DNA, 27 bp, Artificial Sequence
  Description of Artificial Sequence: Synthetic oligonucleotide
gtgttaggcttggacacagacggctgc

SEQ ID NO: 348161 - DNA, 27 bp, Artificial Sequence
  Description of Artificial Sequence: Synthetic oligonucleotide
tgttaggcttggacacagacggctgcc

SEQ ID NO: 348162 - DNA, 27 bp, Artificial Sequence
  Description of Artificial Sequence: Synthetic oligonucleotide
gttaggcttggacacagacggctgcct

SEQ ID NO: 348163 - DNA, 27 bp, Artificial Sequence
  Description of Artificial Sequence: Synthetic oligonucleotide
ttaggcttggacacagacggctgcctg

SEQ ID NO: 348164 - DNA, 27 bp, Artificial Sequence
  Description of Artificial Sequence: Synthetic oligonucleotide
taggcttggacacagacggctgcctgt

SEQ ID NO: 348165 - DNA, 27 bp, Artificial Sequence
  Description of Artificial Sequence: Synthetic oligonucleotide
aggcttggacacagacggctgcctgta

SEQ ID NO: 348166 - DNA, 26 bp, Artificial Sequence
  Description of Artificial Sequence: Synthetic oligonucleotide
ggcttggacacagacggctgcctgta

SEQ ID NO: 348167 - DNA, 26 bp, Artificial Sequence
  Description of Artificial Sequence: Synthetic oligonucleotide
gcttggacacagacggctgcctgtac

SEQ ID NO: 348168 - DNA, 27 bp, Artificial Sequence
  Description of Artificial Sequence: Synthetic oligonucleotide
cttggacacagacggctgcctgtacca

SEQ ID NO: 348169 - DNA, 27 bp, Artificial Sequence
  Description of Artificial Sequence: Synthetic oligonucleotide
ttggacacagacggctgcctgtaccag

SEQ ID NO: 348170 - DNA, 27 bp, Artificial Sequence
  Description of Artificial Sequence: Synthetic oligonucleotide
tggacacagacggctgcctgtaccaga

SEQ ID NO: 348171 - DNA, 26 bp, Artificial Sequence
  Description of Artificial Sequence: Synthetic oligonucleotide
ggacacagacggctgcctgtaccaga

SEQ ID NO: 348172 - DNA, 27 bp, Artificial Sequence
  Description of Artificial Sequence: Synthetic oligonucleotide
gacacagacggctgcctgtaccagaca

SEQ ID NO: 348173 - DNA, 28 bp, Artificial Sequence
  Description of Artificial Sequence: Synthetic oligonucleotide
acacagacggctgcctgtaccagacaac

SEQ ID NO: 348174 - DNA, 27 bp, Artificial Sequence
  Description of Artificial Sequence: Synthetic oligonucleotide
cacagacggctgcctgtaccagacaac

SEQ ID NO: 348175 - DNA, 27 bp, Artificial Sequence
  Description of Artificial Sequence: Synthetic oligonucleotide
acagacggctgcctgtaccagacaacc

SEQ ID NO: 348176 - DNA, 26 bp, Artificial Sequence
  Description of Artificial Sequence: Synthetic oligonucleotide
cagacggctgcctgtaccagacaacc

SEQ ID NO: 348177 - DNA, 26 bp, Artificial Sequence
  Description of Artificial Sequence: Synthetic oligonucleotide
agacggctgcctgtaccagacaaccc

SEQ ID NO: 348178 - DNA, 25 bp, Artificial Sequence
  Description of Artificial Sequence: Synthetic oligonucleotide
gacggctgcctgtaccagacaaccc

SEQ ID NO: 348179 - DNA, 25 bp, Artificial Sequence
  Description of Artificial Sequence: Synthetic oligonucleotide
acggctgcctgtaccagacaacccc

SEQ ID NO: 348180 - DNA, 24 bp, Artificial Sequence
  Description of Artificial Sequence: Synthetic oligonucleotide
cggctgcctgtaccagacaacccc

SEQ ID NO: 348181 - DNA, 25 bp, Artificial Sequence
  Description of Artificial Sequence: Synthetic oligonucleotide
ggctgcctgtaccagacaaccccga

SEQ ID NO: 348182 - DNA, 26 bp, Artificial Sequence
  Description of Artificial Sequence: Synthetic oligonucleotide
gctgcctgtaccagacaaccccgaga

SEQ ID NO: 348183 - DNA, 27 bp, Artificial Sequence
  Description of Artificial Sequence: Synthetic oligonucleotide
ctgcctgtaccagacaaccccgagaga

SEQ ID NO: 348184 - DNA, 30 bp, Artificial Sequence
  Description of Artificial Sequence: Synthetic oligonucleotide
tgcctgtaccagacaaccccgagagatttg

SEQ ID NO: 348185 - DNA, 29 bp, Artificial Sequence
  Description of Artificial Sequence: Synthetic oligonucleotide
gcctgtaccagacaaccccgagagatttg

SEQ ID NO: 348186 - DNA, 33 bp, Artificial Sequence
  Description of Artificial Sequence: Synthetic oligonucleotide
cctgtaccagacaaccccgagagatttgttttc

SEQ ID NO: 348187 - DNA, 33 bp, Artificial Sequence
  Description of Artificial Sequence: Synthetic oligonucleotide
ctgtaccagacaaccccgagagatttgttttcg

SEQ ID NO: 348188 - DNA, 35 bp, Artificial Sequence
  Description of Artificial Sequence: Synthetic oligonucleotide
tgtaccagacaaccccgagagatttgttttcgttg

SEQ ID NO: 348189 - DNA, 34 bp, Artificial Sequence
  Description of Artificial Sequence: Synthetic oligonucleotide
gtaccagacaaccccgagagatttgttttcgttg

SEQ ID NO: 348190 - DNA, 35 bp, Artificial Sequence
  Description of Artificial Sequence: Synthetic oligonucleotide
taccagacaaccccgagagatttgttttcgttgtg

SEQ ID NO: 348191 - DNA, 34 bp, Artificial Sequence
  Description of Artificial Sequence: Synthetic oligonucleotide
accagacaaccccgagagatttgttttcgttgtg

SEQ ID NO: 348192 - DNA, 33 bp, Artificial Sequence
  Description of Artificial Sequence: Synthetic oligonucleotide
ccagacaaccccgagagatttgttttcgttgtg

SEQ ID NO: 348193 - DNA, 34 bp, Artificial Sequence
  Description of Artificial Sequence: Synthetic oligonucleotide
cagacaaccccgagagatttgttttcgttgtgag

SEQ ID NO: 348194 - DNA, 34 bp, Artificial Sequence
  Description of Artificial Sequence: Synthetic oligonucleotide
agacaaccccgagagatttgttttcgttgtgagc

SEQ ID NO: 348195 - DNA, 33 bp, Artificial Sequence
  Description of Artificial Sequence: Synthetic oligonucleotide
gacaaccccgagagatttgttttcgttgtgagc

SEQ ID NO: 348196 - DNA, 35 bp, Artificial Sequence
  Description of Artificial Sequence: Synthetic oligonucleotide
acaaccccgagagatttgttttcgttgtgagcatc

SEQ ID NO: 348197 - DNA, 34 bp, Artificial Sequence
  Description of Artificial Sequence: Synthetic oligonucleotide
caaccccgagagatttgttttcgttgtgagcatc

SEQ ID NO: 348198 - DNA, 34 bp, Artificial Sequence
  Description of Artificial Sequence: Synthetic oligonucleotide
aaccccgagagatttgttttcgttgtgagcatcc

SEQ ID NO: 348199 - DNA, 33 bp, Artificial Sequence
  Description of Artificial Sequence: Synthetic oligonucleotide
accccgagagatttgttttcgttgtgagcatcc

SEQ ID NO: 348200 - DNA, 32 bp, Artificial Sequence
  Description of Artificial Sequence: Synthetic oligonucleotide
ccccgagagatttgttttcgttgtgagcatcc

SEQ ID NO: 348201 - DNA, 34 bp, Artificial Sequence
  Description of Artificial Sequence: Synthetic oligonucleotide
cccgagagatttgttttcgttgtgagcatcctac

SEQ ID NO: 348202 - DNA, 34 bp, Artificial Sequence
  Description of Artificial Sequence: Synthetic oligonucleotide
ccgagagatttgttttcgttgtgagcatcctacg

SEQ ID NO: 348203 - DNA, 34 bp, Artificial Sequence
  Description of Artificial Sequence: Synthetic oligonucleotide
cgagagatttgttttcgttgtgagcatcctacgc

SEQ ID NO: 348204 - DNA, 35 bp, Artificial Sequence
  Description of Artificial Sequence: Synthetic oligonucleotide
gagagatttgttttcgttgtgagcatcctacgctc

SEQ ID NO: 348205 - DNA, 36 bp, Artificial Sequence
  Description of Artificial Sequence: Synthetic oligonucleotide
agagatttgttttcgttgtgagcatcctacgctctg

SEQ ID NO: 348206 - DNA, 35 bp, Artificial Sequence
  Description of Artificial Sequence: Synthetic oligonucleotide
gagatttgttttcgttgtgagcatcctacgctctg

SEQ ID NO: 348207 - DNA, 36 bp, Artificial Sequence
  Description of Artificial Sequence: Synthetic oligonucleotide
agatttgttttcgttgtgagcatcctacgctctgag

SEQ ID NO: 348208 - DNA, 35 bp, Artificial Sequence
  Description of Artificial Sequence: Synthetic oligonucleotide
gatttgttttcgttgtgagcatcctacgctctgag

SEQ ID NO: 348209 - DNA, 37 bp, Artificial Sequence
  Description of Artificial Sequence: Synthetic oligonucleotide
atttgttttcgttgtgagcatcctacgctctgagttc

SEQ ID NO: 348210 - DNA, 36 bp, Artificial Sequence
  Description of Artificial Sequence: Synthetic oligonucleotide
tttgttttcgttgtgagcatcctacgctctgagttc

SEQ ID NO: 348211 - DNA, 35 bp, Artificial Sequence
  Description of Artificial Sequence: Synthetic oligonucleotide
ttgttttcgttgtgagcatcctacgctctgagttc

SEQ ID NO: 348212 - DNA, 34 bp, Artificial Sequence
  Description of Artificial Sequence: Synthetic oligonucleotide
tgttttcgttgtgagcatcctacgctctgagttc

SEQ ID NO: 348213 - DNA, 33 bp, Artificial Sequence
  Description of Artificial Sequence: Synthetic oligonucleotide
gttttcgttgtgagcatcctacgctctgagttc

SEQ ID NO: 348214 - DNA, 35 bp, Artificial Sequence
  Description of Artificial Sequence: Synthetic oligonucleotide
ttttcgttgtgagcatcctacgctctgagttcttc

SEQ ID NO: 348215 - DNA, 34 bp, Artificial Sequence
  Description of Artificial Sequence: Synthetic oligonucleotide
tttcgttgtgagcatcctacgctctgagttcttc

SEQ ID NO: 348216 - DNA, 33 bp, Artificial Sequence
  Description of Artificial Sequence: Synthetic oligonucleotide
ttcgttgtgagcatcctacgctctgagttcttc

SEQ ID NO: 348217 - DNA, 32 bp, Artificial Sequence
  Description of Artificial Sequence: Synthetic oligonucleotide
tcgttgtgagcatcctacgctctgagttcttc

SEQ ID NO: 348218 - DNA, 31 bp, Artificial Sequence
  Description of Artificial Sequence: Synthetic oligonucleotide
cgttgtgagcatcctacgctctgagttcttc

SEQ ID NO: 348219 - DNA, 32 bp, Artificial Sequence
  Description of Artificial Sequence: Synthetic oligonucleotide
gttgtgagcatcctacgctctgagttcttcac

SEQ ID NO: 348220 - DNA, 32 bp, Artificial Sequence
  Description of Artificial Sequence: Synthetic oligonucleotide
ttgtgagcatcctacgctctgagttcttcacg

SEQ ID NO: 348221 - DNA, 31 bp, Artificial Sequence
  Description of Artificial Sequence: Synthetic oligonucleotide
tgtgagcatcctacgctctgagttcttcacg

SEQ ID NO: 348222 - DNA, 30 bp, Artificial Sequence
  Description of Artificial Sequence: Synthetic oligonucleotide
gtgagcatcctacgctctgagttcttcacg

SEQ ID NO: 348223 - DNA, 31 bp, Artificial Sequence
  Description of Artificial Sequence: Synthetic oligonucleotide
tgagcatcctacgctctgagttcttcacgac

SEQ ID NO: 348224 - DNA, 30 bp, Artificial Sequence
  Description of Artificial Sequence: Synthetic oligonucleotide
gagcatcctacgctctgagttcttcacgac

SEQ ID NO: 348225 - DNA, 31 bp, Artificial Sequence
  Description of Artificial Sequence: Synthetic oligonucleotide
agcatcctacgctctgagttcttcacgacag

SEQ ID NO: 348226 - DNA, 30 bp, Artificial Sequence
  Description of Artificial Sequence: Synthetic oligonucleotide
gcatcctacgctctgagttcttcacgacag

SEQ ID NO: 348227 - DNA, 30 bp, Artificial Sequence
  Description of Artificial Sequence: Synthetic oligonucleotide
catcctacgctctgagttcttcacgacagg

SEQ ID NO: 348228 - DNA, 30 bp, Artificial Sequence
  Description of Artificial Sequence: Synthetic oligonucleotide
atcctacgctctgagttcttcacgacaggc

SEQ ID NO: 348229 - DNA, 29 bp, Artificial Sequence
  Description of Artificial Sequence: Synthetic oligonucleotide
tcctacgctctgagttcttcacgacaggc

SEQ ID NO: 348230 - DNA, 28 bp, Artificial Sequence
  Description of Artificial Sequence: Synthetic oligonucleotide
cctacgctctgagttcttcacgacaggc

SEQ ID NO: 348231 - DNA, 29 bp, Artificial Sequence
  Description of Artificial Sequence: Synthetic oligonucleotide
ctacgctctgagttcttcacgacaggctg

SEQ ID NO: 348232 - DNA, 29 bp, Artificial Sequence
  Description of Artificial Sequence: Synthetic oligonucleotide
tacgctctgagttcttcacgacaggctgc

SEQ ID NO: 348233 - DNA, 28 bp, Artificial Sequence
  Description of Artificial Sequence: Synthetic oligonucleotide
acgctctgagttcttcacgacaggctgc

SEQ ID NO: 348234 - DNA, 27 bp, Artificial Sequence
  Description of Artificial Sequence: Synthetic oligonucleotide
cgctctgagttcttcacgacaggctgc

SEQ ID NO: 348235 - DNA, 27 bp, Artificial Sequence
  Description of Artificial Sequence: Synthetic oligonucleotide
gctctgagttcttcacgacaggctgcc

SEQ ID NO: 348236 - DNA, 28 bp, Artificial Sequence
  Description of Artificial Sequence: Synthetic oligonucleotide
ctctgagttcttcacgacaggctgccac

SEQ ID NO: 348237 - DNA, 30 bp, Artificial Sequence
  Description of Artificial Sequence: Synthetic oligonucleotide
tctgagttcttcacgacaggctgccacaac

SEQ ID NO: 348238 - DNA, 29 bp, Artificial Sequence
  Description of Artificial Sequence: Synthetic oligonucleotide
ctgagttcttcacgacaggctgccacaac

SEQ ID NO: 348239 - DNA, 30 bp, Artificial Sequence
  Description of Artificial Sequence: Synthetic oligonucleotide
tgagttcttcacgacaggctgccacaactg

SEQ ID NO: 348240 - DNA, 29 bp, Artificial Sequence
  Description of Artificial Sequence: Synthetic oligonucleotide
gagttcttcacgacaggctgccacaactg

SEQ ID NO: 348241 - DNA, 29 bp, Artificial Sequence
  Description of Artificial Sequence: Synthetic oligonucleotide
agttcttcacgacaggctgccacaactgg

SEQ ID NO: 348242 - DNA, 28 bp, Artificial Sequence
  Description of Artificial Sequence: Synthetic oligonucleotide
gttcttcacgacaggctgccacaactgg

SEQ ID NO: 348243 - DNA, 28 bp, Artificial Sequence
  Description of Artificial Sequence: Synthetic oligonucleotide
ttcttcacgacaggctgccacaactggg

SEQ ID NO: 348244 - DNA, 27 bp, Artificial Sequence
  Description of Artificial Sequence: Synthetic oligonucleotide
tcttcacgacaggctgccacaactggg

SEQ ID NO: 348245 - DNA, 27 bp, Artificial Sequence
  Description of Artificial Sequence: Synthetic oligonucleotide
cttcacgacaggctgccacaactggga

SEQ ID NO: 348246 - DNA, 27 bp, Artificial Sequence
  Description of Artificial Sequence: Synthetic oligonucleotide
ttcacgacaggctgccacaactgggag

SEQ ID NO: 348247 - DNA, 26 bp, Artificial Sequence
  Description of Artificial Sequence: Synthetic oligonucleotide
tcacgacaggctgccacaactgggag

SEQ ID NO: 348248 - DNA, 25 bp, Artificial Sequence
  Description of Artificial Sequence: Synthetic oligonucleotide
cacgacaggctgccacaactgggag

SEQ ID NO: 348249 - DNA, 26 bp, Artificial Sequence
  Description of Artificial Sequence: Synthetic oligonucleotide
acgacaggctgccacaactgggagga

SEQ ID NO: 348250 - DNA, 25 bp, Artificial Sequence
  Description of Artificial Sequence: Synthetic oligonucleotide
cgacaggctgccacaactgggagga

SEQ ID NO: 348251 - DNA, 27 bp, Artificial Sequence
  Description of Artificial Sequence: Synthetic oligonucleotide
gacaggctgccacaactgggaggagta

SEQ ID NO: 348252 - DNA, 28 bp, Artificial Sequence
  Description of Artificial Sequence: Synthetic oligonucleotide
acaggctgccacaactgggaggagtatg

SEQ ID NO: 348253 - DNA, 27 bp, Artificial Sequence
  Description of Artificial Sequence: Synthetic oligonucleotide
caggctgccacaactgggaggagtatg

SEQ ID NO: 348254 - DNA, 28 bp, Artificial Sequence
  Description of Artificial Sequence: Synthetic oligonucleotide
aggctgccacaactgggaggagtatgtg

SEQ ID NO: 348255 - DNA, 27 bp, Artificial Sequence
  Description of Artificial Sequence: Synthetic oligonucleotide
ggctgccacaactgggaggagtatgtg

SEQ ID NO: 348256 - DNA, 27 bp, Artificial Sequence
  Description of Artificial Sequence: Synthetic oligonucleotide
gctgccacaactgggaggagtatgtgg

SEQ ID NO: 348257 - DNA, 27 bp, Artificial Sequence
  Description of Artificial Sequence: Synthetic oligonucleotide
ctgccacaactgggaggagtatgtggg

SEQ ID NO: 348258 - DNA, 28 bp, Artificial Sequence
  Description of Artificial Sequence: Synthetic oligonucleotide
tgccacaactgggaggagtatgtgggtg

SEQ ID NO: 348259 - DNA, 27 bp, Artificial Sequence
  Description of Artificial Sequence: Synthetic oligonucleotide
gccacaactgggaggagtatgtgggtg

SEQ ID NO: 348260 - DNA, 28 bp, Artificial Sequence
  Description of Artificial Sequence: Synthetic oligonucleotide
ccacaactgggaggagtatgtgggtgac

SEQ ID NO: 348261 - DNA, 30 bp, Artificial Sequence
  Description of Artificial Sequence: Synthetic oligonucleotide
cacaactgggaggagtatgtgggtgacaag

SEQ ID NO: 348262 - DNA, 31 bp, Artificial Sequence
  Description of Artificial Sequence: Synthetic oligonucleotide
acaactgggaggagtatgtgggtgacaagac

SEQ ID NO: 348263 - DNA, 30 bp, Artificial Sequence
  Description of Artificial Sequence: Synthetic oligonucleotide
caactgggaggagtatgtgggtgacaagac

SEQ ID NO: 348264 - DNA, 30 bp, Artificial Sequence
  Description of Artificial Sequence: Synthetic oligonucleotide
aactgggaggagtatgtgggtgacaagacc

SEQ ID NO: 348265 - DNA, 29 bp, Artificial Sequence
  Description of Artificial Sequence: Synthetic oligonucleotide
actgggaggagtatgtgggtgacaagacc

SEQ ID NO: 348266 - DNA, 28 bp, Artificial Sequence
  Description of Artificial Sequence: Synthetic oligonucleotide
ctgggaggagtatgtgggtgacaagacc

SEQ ID NO: 348267 - DNA, 32 bp, Artificial Sequence
  Description of Artificial Sequence: Synthetic oligonucleotide
tgggaggagtatgtgggtgacaagacctaatg

SEQ ID NO: 348268 - DNA, 31 bp, Artificial Sequence
  Description of Artificial Sequence: Synthetic oligonucleotide
gggaggagtatgtgggtgacaagacctaatg

SEQ ID NO: 348269 - DNA, 31 bp, Artificial Sequence
  Description of Artificial Sequence: Synthetic oligonucleotide
ggaggagtatgtgggtgacaagacctaatgg

SEQ ID NO: 348270 - DNA, 34 bp, Artificial Sequence
  Description of Artificial Sequence: Synthetic oligonucleotide
gaggagtatgtgggtgacaagacctaatggattc

SEQ ID NO: 348271 - DNA, 36 bp, Artificial Sequence
  Description of Artificial Sequence: Synthetic oligonucleotide
aggagtatgtgggtgacaagacctaatggattcatg

SEQ ID NO: 348272 - DNA, 35 bp, Artificial Sequence
  Description of Artificial Sequence: Synthetic oligonucleotide
ggagtatgtgggtgacaagacctaatggattcatg

SEQ ID NO: 348273 - DNA, 35 bp, Artificial Sequence
  Description of Artificial Sequence: Synthetic oligonucleotide
gagtatgtgggtgacaagacctaatggattcatgg

SEQ ID NO: 348274 - DNA, 36 bp, Artificial Sequence
  Description of Artificial Sequence: Synthetic oligonucleotide
agtatgtgggtgacaagacctaatggattcatggag

SEQ ID NO: 348275 - DNA, 35 bp, Artificial Sequence
  Description of Artificial Sequence: Synthetic oligonucleotide
gtatgtgggtgacaagacctaatggattcatggag

SEQ ID NO: 348276 - DNA, 38 bp, Artificial Sequence
  Description of Artificial Sequence: Synthetic oligonucleotide
tatgtgggtgacaagacctaatggattcatggagtatg

SEQ ID NO: 348277 - DNA, 37 bp, Artificial Sequence
  Description of Artificial Sequence: Synthetic oligonucleotide
atgtgggtgacaagacctaatggattcatggagtatg

SEQ ID NO: 348278 - DNA, 36 bp, Artificial Sequence
  Description of Artificial Sequence: Synthetic oligonucleotide
tgtgggtgacaagacctaatggattcatggagtatg

SEQ ID NO: 348279 - DNA, 35 bp, Artificial Sequence
  Description of Artificial Sequence: Synthetic oligonucleotide
gtgggtgacaagacctaatggattcatggagtatg

SEQ ID NO: 348280 - DNA, 37 bp, Artificial Sequence
  Description of Artificial Sequence: Synthetic oligonucleotide
tgggtgacaagacctaatggattcatggagtatgaag

SEQ ID NO: 348281 - DNA, 36 bp, Artificial Sequence
  Description of Artificial Sequence: Synthetic oligonucleotide
gggtgacaagacctaatggattcatggagtatgaag

SEQ ID NO: 348282 - DNA, 37 bp, Artificial Sequence
  Description of Artificial Sequence: Synthetic oligonucleotide
ggtgacaagacctaatggattcatggagtatgaagtg

SEQ ID NO: 348283 - DNA, 38 bp, Artificial Sequence
  Description of Artificial Sequence: Synthetic oligonucleotide
gtgacaagacctaatggattcatggagtatgaagtgag

SEQ ID NO: 348284 - DNA, 39 bp, Artificial Sequence
  Description of Artificial Sequence: Synthetic oligonucleotide
tgacaagacctaatggattcatggagtatgaagtgagtc

SEQ ID NO: 348285 - DNA, 38 bp, Artificial Sequence
  Description of Artificial Sequence: Synthetic oligonucleotide
gacaagacctaatggattcatggagtatgaagtgagtc

SEQ ID NO: 348286 - DNA, 39 bp, Artificial Sequence
  Description of Artificial Sequence: Synthetic oligonucleotide
acaagacctaatggattcatggagtatgaagtgagtcac

SEQ ID NO: 348287 - DNA, 38 bp, Artificial Sequence
  Description of Artificial Sequence: Synthetic oligonucleotide
caagacctaatggattcatggagtatgaagtgagtcac

SEQ ID NO: 348288 - DNA, 39 bp, Artificial Sequence
  Description of Artificial Sequence: Synthetic oligonucleotide
aagacctaatggattcatggagtatgaagtgagtcactg

SEQ ID NO: 348289 - DNA, 38 bp, Artificial Sequence
  Description of Artificial Sequence: Synthetic oligonucleotide
agacctaatggattcatggagtatgaagtgagtcactg

SEQ ID NO: 348290 - DNA, 37 bp, Artificial Sequence
  Description of Artificial Sequence: Synthetic oligonucleotide
gacctaatggattcatggagtatgaagtgagtcactg

SEQ ID NO: 348291 - DNA, 38 bp, Artificial Sequence
  Description of Artificial Sequence: Synthetic oligonucleotide
acctaatggattcatggagtatgaagtgagtcactgag

SEQ ID NO: 348292 - DNA, 37 bp, Artificial Sequence
  Description of Artificial Sequence: Synthetic oligonucleotide
cctaatggattcatggagtatgaagtgagtcactgag

SEQ ID NO: 348293 - DNA, 37 bp, Artificial Sequence
  Description of Artificial Sequence: Synthetic oligonucleotide
ctaatggattcatggagtatgaagtgagtcactgagc

SEQ ID NO: 348294 - DNA, 38 bp, Artificial Sequence
  Description of Artificial Sequence: Synthetic oligonucleotide
taatggattcatggagtatgaagtgagtcactgagcag

SEQ ID NO: 348295 - DNA, 37 bp, Artificial Sequence
  Description of Artificial Sequence: Synthetic oligonucleotide
aatggattcatggagtatgaagtgagtcactgagcag

SEQ ID NO: 348296 - DNA, 36 bp, Artificial Sequence
  Description of Artificial Sequence: Synthetic oligonucleotide
atggattcatggagtatgaagtgagtcactgagcag

SEQ ID NO: 348297 - DNA, 35 bp, Artificial Sequence
  Description of Artificial Sequence: Synthetic oligonucleotide
tggattcatggagtatgaagtgagtcactgagcag

SEQ ID NO: 348298 - DNA, 34 bp, Artificial Sequence
  Description of Artificial Sequence: Synthetic oligonucleotide
ggattcatggagtatgaagtgagtcactgagcag

SEQ ID NO: 348299 - DNA, 34 bp, Artificial Sequence
  Description of Artificial Sequence: Synthetic oligonucleotide
gattcatggagtatgaagtgagtcactgagcagg

SEQ ID NO: 348300 - DNA, 36 bp, Artificial Sequence
  Description of Artificial Sequence: Synthetic oligonucleotide
attcatggagtatgaagtgagtcactgagcaggatg

SEQ ID NO: 348301 - DNA, 35 bp, Artificial Sequence
  Description of Artificial Sequence: Synthetic oligonucleotide
ttcatggagtatgaagtgagtcactgagcaggatg

SEQ ID NO: 348302 - DNA, 34 bp, Artificial Sequence
  Description of Artificial Sequence: Synthetic oligonucleotide
tcatggagtatgaagtgagtcactgagcaggatg

SEQ ID NO: 348303 - DNA, 33 bp, Artificial Sequence
  Description of Artificial Sequence: Synthetic oligonucleotide
catggagtatgaagtgagtcactgagcaggatg

SEQ ID NO: 348304 - DNA, 33 bp, Artificial Sequence
  Description of Artificial Sequence: Synthetic oligonucleotide
atggagtatgaagtgagtcactgagcaggatgg

SEQ ID NO: 348305 - DNA, 32 bp, Artificial Sequence
  Description of Artificial Sequence: Synthetic oligonucleotide
tggagtatgaagtgagtcactgagcaggatgg

SEQ ID NO: 348306 - DNA, 31 bp, Artificial Sequence
  Description of Artificial Sequence: Synthetic oligonucleotide
ggagtatgaagtgagtcactgagcaggatgg

SEQ ID NO: 348307 - DNA, 31 bp, Artificial Sequence
  Description of Artificial Sequence: Synthetic oligonucleotide
gagtatgaagtgagtcactgagcaggatggg

SEQ ID NO: 348308 - DNA, 31 bp, Artificial Sequence
  Description of Artificial Sequence: Synthetic oligonucleotide
agtatgaagtgagtcactgagcaggatgggg

SEQ ID NO: 348309 - DNA, 30 bp, Artificial Sequence
  Description of Artificial Sequence: Synthetic oligonucleotide
gtatgaagtgagtcactgagcaggatgggg

SEQ ID NO: 348310 - DNA, 32 bp, Artificial Sequence
  Description of Artificial Sequence: Synthetic oligonucleotide
tatgaagtgagtcactgagcaggatggggaag

SEQ ID NO: 348311 - DNA, 31 bp, Artificial Sequence
  Description of Artificial Sequence: Synthetic oligonucleotide
atgaagtgagtcactgagcaggatggggaag

SEQ ID NO: 348312 - DNA, 30 bp, Artificial Sequence
  Description of Artificial Sequence: Synthetic oligonucleotide
tgaagtgagtcactgagcaggatggggaag

SEQ ID NO: 348313 - DNA, 29 bp, Artificial Sequence
  Description of Artificial Sequence: Synthetic oligonucleotide
gaagtgagtcactgagcaggatggggaag

SEQ ID NO: 348314 - DNA, 29 bp, Artificial Sequence
  Description of Artificial Sequence: Synthetic oligonucleotide
aagtgagtcactgagcaggatggggaagg

SEQ ID NO: 348315 - DNA, 28 bp, Artificial Sequence
  Description of Artificial Sequence: Synthetic oligonucleotide
agtgagtcactgagcaggatggggaagg

SEQ ID NO: 348316 - DNA, 27 bp, Artificial Sequence
  Description of Artificial Sequence: Synthetic oligonucleotide
gtgagtcactgagcaggatggggaagg

SEQ ID NO: 348317 - DNA, 30 bp, Artificial Sequence
  Description of Artificial Sequence: Synthetic oligonucleotide
tgagtcactgagcaggatggggaaggtaac

SEQ ID NO: 348318 - DNA, 29 bp, Artificial Sequence
  Description of Artificial Sequence: Synthetic oligonucleotide
gagtcactgagcaggatggggaaggtaac

SEQ ID NO: 348319 - DNA, 30 bp, Artificial Sequence
  Description of Artificial Sequence: Synthetic oligonucleotide
agtcactgagcaggatggggaaggtaactg

SEQ ID NO: 348320 - DNA, 29 bp, Artificial Sequence
  Description of Artificial Sequence: Synthetic oligonucleotide
gtcactgagcaggatggggaaggtaactg

SEQ ID NO: 348321 - DNA, 29 bp, Artificial Sequence
  Description of Artificial Sequence: Synthetic oligonucleotide
tcactgagcaggatggggaaggtaactgc

SEQ ID NO: 348322 - DNA, 28 bp, Artificial Sequence
  Description of Artificial Sequence: Synthetic oligonucleotide
cactgagcaggatggggaaggtaactgc

SEQ ID NO: 348323 - DNA, 28 bp, Artificial Sequence
  Description of Artificial Sequence: Synthetic oligonucleotide
actgagcaggatggggaaggtaactgcc

SEQ ID NO: 348324 - DNA, 27 bp, Artificial Sequence
  Description of Artificial Sequence: Synthetic oligonucleotide
ctgagcaggatggggaaggtaactgcc

SEQ ID NO: 348325 - DNA, 28 bp, Artificial Sequence
  Description of Artificial Sequence: Synthetic oligonucleotide
tgagcaggatggggaaggtaactgcctc

SEQ ID NO: 348326 - DNA, 27 bp, Artificial Sequence
  Description of Artificial Sequence: Synthetic oligonucleotide
gagcaggatggggaaggtaactgcctc

SEQ ID NO: 348327 - DNA, 28 bp, Artificial Sequence
  Description of Artificial Sequence: Synthetic oligonucleotide
agcaggatggggaaggtaactgcctcag

SEQ ID NO: 348328 - DNA, 27 bp, Artificial Sequence
  Description of Artificial Sequence: Synthetic oligonucleotide
gcaggatggggaaggtaactgcctcag

SEQ ID NO: 348329 - DNA, 27 bp, Artificial Sequence
  Description of Artificial Sequence: Synthetic oligonucleotide
caggatggggaaggtaactgcctcagc

SEQ ID NO: 348330 - DNA, 28 bp, Artificial Sequence
  Description of Artificial Sequence: Synthetic oligonucleotide
aggatggggaaggtaactgcctcagctg

SEQ ID NO: 348331 - DNA, 27 bp, Artificial Sequence
  Description of Artificial Sequence: Synthetic oligonucleotide
ggatggggaaggtaactgcctcagctg

SEQ ID NO: 348332 - DNA, 27 bp, Artificial Sequence
  Description of Artificial Sequence: Synthetic oligonucleotide
gatggggaaggtaactgcctcagctgc

SEQ ID NO: 348333 - DNA, 27 bp, Artificial Sequence
  Description of Artificial Sequence: Synthetic oligonucleotide
atggggaaggtaactgcctcagctgcc

SEQ ID NO: 348334 - DNA, 27 bp, Artificial Sequence
  Description of Artificial Sequence: Synthetic oligonucleotide
tggggaaggtaactgcctcagctgcca

SEQ ID NO: 348335 - DNA, 27 bp, Artificial Sequence
  Description of Artificial Sequence: Synthetic oligonucleotide
ggggaaggtaactgcctcagctgccaa

SEQ ID NO: 348336 - DNA, 28 bp, Artificial Sequence
  Description of Artificial Sequence: Synthetic oligonucleotide
gggaaggtaactgcctcagctgccaatg

SEQ ID NO: 348337 - DNA, 28 bp, Artificial Sequence
  Description of Artificial Sequence: Synthetic oligonucleotide
ggaaggtaactgcctcagctgccaatgc

SEQ ID NO: 348338 - DNA, 29 bp, Artificial Sequence
  Description of Artificial Sequence: Synthetic oligonucleotide
gaaggtaactgcctcagctgccaatgcac

SEQ ID NO: 348339 - DNA, 30 bp, Artificial Sequence
  Description of Artificial Sequence: Synthetic oligonucleotide
aaggtaactgcctcagctgccaatgcacac

SEQ ID NO: 348340 - DNA, 29 bp, Artificial Sequence
  Description of Artificial Sequence: Synthetic oligonucleotide
aggtaactgcctcagctgccaatgcacac

SEQ ID NO: 348341 - DNA, 28 bp, Artificial Sequence
  Description of Artificial Sequence: Synthetic oligonucleotide
ggtaactgcctcagctgccaatgcacac

SEQ ID NO: 348342 - DNA, 29 bp, Artificial Sequence
  Description of Artificial Sequence: Synthetic oligonucleotide
gtaactgcctcagctgccaatgcacactg

SEQ ID NO: 348343 - DNA, 29 bp, Artificial Sequence
  Description of Artificial Sequence: Synthetic oligonucleotide
taactgcctcagctgccaatgcacactgg

SEQ ID NO: 348344 - DNA, 28 bp, Artificial Sequence
  Description of Artificial Sequence: Synthetic oligonucleotide
aactgcctcagctgccaatgcacactgg

SEQ ID NO: 348345 - DNA, 27 bp, Artificial Sequence
  Description of Artificial Sequence: Synthetic oligonucleotide
actgcctcagctgccaatgcacactgg

SEQ ID NO: 348346 - DNA, 26 bp, Artificial Sequence
  Description of Artificial Sequence: Synthetic oligonucleotide
ctgcctcagctgccaatgcacactgg

SEQ ID NO: 348347 - DNA, 27 bp, Artificial Sequence
  Description of Artificial Sequence: Synthetic oligonucleotide
tgcctcagctgccaatgcacactggct

SEQ ID NO: 348348 - DNA, 27 bp, Artificial Sequence
  Description of Artificial Sequence: Synthetic oligonucleotide
gcctcagctgccaatgcacactggcta

SEQ ID NO: 348349 - DNA, 27 bp, Artificial Sequence
  Description of Artificial Sequence: Synthetic oligonucleotide
cctcagctgccaatgcacactggctac

SEQ ID NO: 348350 - DNA, 28 bp, Artificial Sequence
  Description of Artificial Sequence: Synthetic oligonucleotide
ctcagctgccaatgcacactggctactg

SEQ ID NO: 348351 - DNA, 28 bp, Artificial Sequence
  Description of Artificial Sequence: Synthetic oligonucleotide
tcagctgccaatgcacactggctactgc

SEQ ID NO: 348352 - DNA, 27 bp, Artificial Sequence
  Description of Artificial Sequence: Synthetic oligonucleotide
cagctgccaatgcacactggctactgc

SEQ ID NO: 348353 - DNA, 27 bp, Artificial Sequence
  Description of Artificial Sequence: Synthetic oligonucleotide
agctgccaatgcacactggctactgcg

SEQ ID NO: 348354 - DNA, 27 bp, Artificial Sequence
  Description of Artificial Sequence: Synthetic oligonucleotide
gctgccaatgcacactggctactgcga

SEQ ID NO: 348355 - DNA, 27 bp, Artificial Sequence
  Description of Artificial Sequence: Synthetic oligonucleotide
ctgccaatgcacactggctactgcgac

SEQ ID NO: 348356 - DNA, 28 bp, Artificial Sequence
  Description of Artificial Sequence: Synthetic oligonucleotide
tgccaatgcacactggctactgcgacag

SEQ ID NO: 348357 - DNA, 27 bp, Artificial Sequence
  Description of Artificial Sequence: Synthetic oligonucleotide
gccaatgcacactggctactgcgacag

SEQ ID NO: 348358 - DNA, 28 bp, Artificial Sequence
  Description of Artificial Sequence: Synthetic oligonucleotide
ccaatgcacactggctactgcgacagtg

SEQ ID NO: 348359 - DNA, 29 bp, Artificial Sequence
  Description of Artificial Sequence: Synthetic oligonucleotide
caatgcacactggctactgcgacagtgtc

SEQ ID NO: 348360 - DNA, 29 bp, Artificial Sequence
  Description of Artificial Sequence: Synthetic oligonucleotide
aatgcacactggctactgcgacagtgtcg

SEQ ID NO: 348361 - DNA, 28 bp, Artificial Sequence
  Description of Artificial Sequence: Synthetic oligonucleotide
atgcacactggctactgcgacagtgtcg

SEQ ID NO: 348362 - DNA, 27 bp, Artificial Sequence
  Description of Artificial Sequence: Synthetic oligonucleotide
tgcacactggctactgcgacagtgtcg

SEQ ID NO: 348363 - DNA, 27 bp, Artificial Sequence
  Description of Artificial Sequence: Synthetic oligonucleotide
gcacactggctactgcgacagtgtcgt

SEQ ID NO: 348364 - DNA, 27 bp, Artificial Sequence
  Description of Artificial Sequence: Synthetic oligonucleotide
cacactggctactgcgacagtgtcgtg

SEQ ID NO: 348365 - DNA, 27 bp, Artificial Sequence
  Description of Artificial Sequence: Synthetic oligonucleotide
acactggctactgcgacagtgtcgtgg

SEQ ID NO: 348366 - DNA, 26 bp, Artificial Sequence
  Description of Artificial Sequence: Synthetic oligonucleotide
cactggctactgcgacagtgtcgtgg

SEQ ID NO: 348367 - DNA, 27 bp, Artificial Sequence
  Description of Artificial Sequence: Synthetic oligonucleotide
actggctactgcgacagtgtcgtggga

SEQ ID NO: 348368 - DNA, 27 bp, Artificial Sequence
  Description of Artificial Sequence: Synthetic oligonucleotide
ctggctactgcgacagtgtcgtgggat

SEQ ID NO: 348369 - DNA, 28 bp, Artificial Sequence
  Description of Artificial Sequence: Synthetic oligonucleotide
tggctactgcgacagtgtcgtgggattg

SEQ ID NO: 348370 - DNA, 27 bp, Artificial Sequence
  Description of Artificial Sequence: Synthetic oligonucleotide
ggctactgcgacagtgtcgtgggattg

SEQ ID NO: 348371 - DNA, 28 bp, Artificial Sequence
  Description of Artificial Sequence: Synthetic oligonucleotide
gctactgcgacagtgtcgtgggattgag

SEQ ID NO: 348372 - DNA, 31 bp, Artificial Sequence
  Description of Artificial Sequence: Synthetic oligonucleotide
ctactgcgacagtgtcgtgggattgagtatg

SEQ ID NO: 348373 - DNA, 33 bp, Artificial Sequence
  Description of Artificial Sequence: Synthetic oligonucleotide
tactgcgacagtgtcgtgggattgagtatgatg

SEQ ID NO: 348374 - DNA, 32 bp, Artificial Sequence
  Description of Artificial Sequence: Synthetic oligonucleotide
actgcgacagtgtcgtgggattgagtatgatg

SEQ ID NO: 348375 - DNA, 31 bp, Artificial Sequence
  Description of Artificial Sequence: Synthetic oligonucleotide
ctgcgacagtgtcgtgggattgagtatgatg

SEQ ID NO: 348376 - DNA, 31 bp, Artificial Sequence
  Description of Artificial Sequence: Synthetic oligonucleotide
tgcgacagtgtcgtgggattgagtatgatgc

SEQ ID NO: 348377 - DNA, 30 bp, Artificial Sequence
  Description of Artificial Sequence: Synthetic oligonucleotide
gcgacagtgtcgtgggattgagtatgatgc

SEQ ID NO: 348378 - DNA, 31 bp, Artificial Sequence
  Description of Artificial Sequence: Synthetic oligonucleotide
cgacagtgtcgtgggattgagtatgatgctc

SEQ ID NO: 348379 - DNA, 32 bp, Artificial Sequence
  Description of Artificial Sequence: Synthetic oligonucleotide
gacagtgtcgtgggattgagtatgatgctctc

SEQ ID NO: 348380 - DNA, 33 bp, Artificial Sequence
  Description of Artificial Sequence: Synthetic oligonucleotide
acagtgtcgtgggattgagtatgatgctctcac

SEQ ID NO: 348381 - DNA, 32 bp, Artificial Sequence
  Description of Artificial Sequence: Synthetic oligonucleotide
cagtgtcgtgggattgagtatgatgctctcac

SEQ ID NO: 348382 - DNA, 34 bp, Artificial Sequence
  Description of Artificial Sequence: Synthetic oligonucleotide
agtgtcgtgggattgagtatgatgctctcacaac

SEQ ID NO: 348383 - DNA, 33 bp, Artificial Sequence
  Description of Artificial Sequence: Synthetic oligonucleotide
gtgtcgtgggattgagtatgatgctctcacaac

SEQ ID NO: 348384 - DNA, 33 bp, Artificial Sequence
  Description of Artificial Sequence: Synthetic oligonucleotide
tgtcgtgggattgagtatgatgctctcacaacc

SEQ ID NO: 348385 - DNA, 32 bp, Artificial Sequence
  Description of Artificial Sequence: Synthetic oligonucleotide
gtcgtgggattgagtatgatgctctcacaacc

SEQ ID NO: 348386 - DNA, 32 bp, Artificial Sequence
  Description of Artificial Sequence: Synthetic oligonucleotide
tcgtgggattgagtatgatgctctcacaaccc

SEQ ID NO: 348387 - DNA, 31 bp, Artificial Sequence
  Description of Artificial Sequence: Synthetic oligonucleotide
cgtgggattgagtatgatgctctcacaaccc

SEQ ID NO: 348388 - DNA, 31 bp, Artificial Sequence
  Description of Artificial Sequence: Synthetic oligonucleotide
gtgggattgagtatgatgctctcacaacccc

SEQ ID NO: 348389 - DNA, 31 bp, Artificial Sequence
  Description of Artificial Sequence: Synthetic oligonucleotide
tgggattgagtatgatgctctcacaaccccg

SEQ ID NO: 348390 - DNA, 30 bp, Artificial Sequence
  Description of Artificial Sequence: Synthetic oligonucleotide
gggattgagtatgatgctctcacaaccccg

SEQ ID NO: 348391 - DNA, 30 bp, Artificial Sequence
  Description of Artificial Sequence: Synthetic oligonucleotide
ggattgagtatgatgctctcacaaccccgc

SEQ ID NO: 348392 - DNA, 31 bp, Artificial Sequence
  Description of Artificial Sequence: Synthetic oligonucleotide
gattgagtatgatgctctcacaaccccgcag

SEQ ID NO: 348393 - DNA, 32 bp, Artificial Sequence
  Description of Artificial Sequence: Synthetic oligonucleotide
attgagtatgatgctctcacaaccccgcagag

SEQ ID NO: 348394 - DNA, 31 bp, Artificial Sequence
  Description of Artificial Sequence: Synthetic oligonucleotide
ttgagtatgatgctctcacaaccccgcagag

SEQ ID NO: 348395 - DNA, 30 bp, Artificial Sequence
  Description of Artificial Sequence: Synthetic oligonucleotide
tgagtatgatgctctcacaaccccgcagag

SEQ ID NO: 348396 - DNA, 29 bp, Artificial Sequence
  Description of Artificial Sequence: Synthetic oligonucleotide
gagtatgatgctctcacaaccccgcagag

SEQ ID NO: 348397 - DNA, 29 bp, Artificial Sequence
  Description of Artificial Sequence: Synthetic oligonucleotide
agtatgatgctctcacaaccccgcagagc

SEQ ID NO: 348398 - DNA, 28 bp, Artificial Sequence
  Description of Artificial Sequence: Synthetic oligonucleotide
gtatgatgctctcacaaccccgcagagc

SEQ ID NO: 348399 - DNA, 29 bp, Artificial Sequence
  Description of Artificial Sequence: Synthetic oligonucleotide
tatgatgctctcacaaccccgcagagctc

SEQ ID NO: 348400 - DNA, 28 bp, Artificial Sequence
  Description of Artificial Sequence: Synthetic oligonucleotide
atgatgctctcacaaccccgcagagctc

SEQ ID NO: 348401 - DNA, 27 bp, Artificial Sequence
  Description of Artificial Sequence: Synthetic oligonucleotide
tgatgctctcacaaccccgcagagctc

SEQ ID NO: 348402 - DNA, 26 bp, Artificial Sequence
  Description of Artificial Sequence: Synthetic oligonucleotide
gatgctctcacaaccccgcagagctc

SEQ ID NO: 348403 - DNA, 27 bp, Artificial Sequence
  Description of Artificial Sequence: Synthetic oligonucleotide
atgctctcacaaccccgcagagctcct

SEQ ID NO: 348404 - DNA, 27 bp, Artificial Sequence
  Description of Artificial Sequence: Synthetic oligonucleotide
tgctctcacaaccccgcagagctcctt

SEQ ID NO: 348405 - DNA, 26 bp, Artificial Sequence
  Description of Artificial Sequence: Synthetic oligonucleotide
gctctcacaaccccgcagagctcctt

SEQ ID NO: 348406 - DNA, 26 bp, Artificial Sequence
  Description of Artificial Sequence: Synthetic oligonucleotide
ctctcacaaccccgcagagctccttc

SEQ ID NO: 348407 - DNA, 26 bp, Artificial Sequence
  Description of Artificial Sequence: Synthetic oligonucleotide
tctcacaaccccgcagagctccttcc

SEQ ID NO: 348408 - DNA, 25 bp, Artificial Sequence
  Description of Artificial Sequence: Synthetic oligonucleotide
ctcacaaccccgcagagctccttcc

SEQ ID NO: 348409 - DNA, 25 bp, Artificial Sequence
  Description of Artificial Sequence: Synthetic oligonucleotide
tcacaaccccgcagagctccttccg

SEQ ID NO: 348410 - DNA, 24 bp, Artificial Sequence
  Description of Artificial Sequence: Synthetic oligonucleotide
cacaaccccgcagagctccttccg

SEQ ID NO: 348411 - DNA, 24 bp, Artificial Sequence
  Description of Artificial Sequence: Synthetic oligonucleotide
acaaccccgcagagctccttccgg

SEQ ID NO: 348412 - DNA, 23 bp, Artificial Sequence
  Description of Artificial Sequence: Synthetic oligonucleotide
caaccccgcagagctccttccgg

SEQ ID NO: 348413 - DNA, 27 bp, Artificial Sequence
  Description of Artificial Sequence: Synthetic oligonucleotide
aaccccgcagagctccttccggcttaa

SEQ ID NO: 348414 - DNA, 27 bp, Artificial Sequence
  Description of Artificial Sequence: Synthetic oligonucleotide
accccgcagagctccttccggcttaaa

SEQ ID NO: 348415 - DNA, 26 bp, Artificial Sequence
  Description of Artificial Sequence: Synthetic oligonucleotide
ccccgcagagctccttccggcttaaa

SEQ ID NO: 348416 - DNA, 27 bp, Artificial Sequence
  Description of Artificial Sequence: Synthetic oligonucleotide
cccgcagagctccttccggcttaaaga

SEQ ID NO: 348417 - DNA, 27 bp, Artificial Sequence
  Description of Artificial Sequence: Synthetic oligonucleotide
ccgcagagctccttccggcttaaagag

SEQ ID NO: 348418 - DNA, 27 bp, Artificial Sequence
  Description of Artificial Sequence: Synthetic oligonucleotide
cgcagagctccttccggcttaaagagg

SEQ ID NO: 348419 - DNA, 27 bp, Artificial Sequence
  Description of Artificial Sequence: Synthetic oligonucleotide
gcagagctccttccggcttaaagaggc

SEQ ID NO: 348420 - DNA, 28 bp, Artificial Sequence
  Description of Artificial Sequence: Synthetic oligonucleotide
cagagctccttccggcttaaagaggctc

SEQ ID NO: 348421 - DNA, 28 bp, Artificial Sequence
  Description of Artificial Sequence: Synthetic oligonucleotide
agagctccttccggcttaaagaggctcc

SEQ ID NO: 348422 - DNA, 27 bp, Artificial Sequence
  Description of Artificial Sequence: Synthetic oligonucleotide
gagctccttccggcttaaagaggctcc

SEQ ID NO: 348423 - DNA, 28 bp, Artificial Sequence
  Description of Artificial Sequence: Synthetic oligonucleotide
agctccttccggcttaaagaggctccac

SEQ ID NO: 348424 - DNA, 27 bp, Artificial Sequence
  Description of Artificial Sequence: Synthetic oligonucleotide
gctccttccggcttaaagaggctccac

SEQ ID NO: 348425 - DNA, 27 bp, Artificial Sequence
  Description of Artificial Sequence: Synthetic oligonucleotide
ctccttccggcttaaagaggctccacg

SEQ ID NO: 348426 - DNA, 27 bp, Artificial Sequence
  Description of Artificial Sequence: Synthetic oligonucleotide
tccttccggcttaaagaggctccacgg

SEQ ID NO: 348427 - DNA, 27 bp, Artificial Sequence
  Description of Artificial Sequence: Synthetic oligonucleotide
ccttccggcttaaagaggctccacggt

SEQ ID NO: 348428 - DNA, 27 bp, Artificial Sequence
  Description of Artificial Sequence: Synthetic oligonucleotide
cttccggcttaaagaggctccacggtc

SEQ ID NO: 348429 - DNA, 28 bp, Artificial Sequence
  Description of Artificial Sequence: Synthetic oligonucleotide
ttccggcttaaagaggctccacggtctg

SEQ ID NO: 348430 - DNA, 27 bp, Artificial Sequence
  Description of Artificial Sequence: Synthetic oligonucleotide
tccggcttaaagaggctccacggtctg

SEQ ID NO: 348431 - DNA, 27 bp, Artificial Sequence
  Description of Artificial Sequence: Synthetic oligonucleotide
ccggcttaaagaggctccacggtctgt

SEQ ID NO: 348432 - DNA, 27 bp, Artificial Sequence
  Description of Artificial Sequence: Synthetic oligonucleotide
cggcttaaagaggctccacggtctgtg

SEQ ID NO: 348433 - DNA, 27 bp, Artificial Sequence
  Description of Artificial Sequence: Synthetic oligonucleotide
ggcttaaagaggctccacggtctgtgg

SEQ ID NO: 348434 - DNA, 27 bp, Artificial Sequence
  Description of Artificial Sequence: Synthetic oligonucleotide
gcttaaagaggctccacggtctgtggg

SEQ ID NO: 348435 - DNA, 27 bp, Artificial Sequence
  Description of Artificial Sequence: Synthetic oligonucleotide
cttaaagaggctccacggtctgtgggg

SEQ ID NO: 348436 - DNA, 32 bp, Artificial Sequence
  Description of Artificial Sequence: Synthetic oligonucleotide
ttaaagaggctccacggtctgtggggatattc

SEQ ID NO: 348437 - DNA, 31 bp, Artificial Sequence
  Description of Artificial Sequence: Synthetic oligonucleotide
taaagaggctccacggtctgtggggatattc

SEQ ID NO: 348438 - DNA, 30 bp, Artificial Sequence
  Description of Artificial Sequence: Synthetic oligonucleotide
aaagaggctccacggtctgtggggatattc

SEQ ID NO: 348439 - DNA, 29 bp, Artificial Sequence
  Description of Artificial Sequence: Synthetic oligonucleotide
aagaggctccacggtctgtggggatattc

SEQ ID NO: 348440 - DNA, 28 bp, Artificial Sequence
  Description of Artificial Sequence: Synthetic oligonucleotide
agaggctccacggtctgtggggatattc

SEQ ID NO: 348441 - DNA, 27 bp, Artificial Sequence
  Description of Artificial Sequence: Synthetic oligonucleotide
gaggctccacggtctgtggggatattc

SEQ ID NO: 348442 - DNA, 27 bp, Artificial Sequence
  Description of Artificial Sequence: Synthetic oligonucleotide
aggctccacggtctgtggggatattcc

SEQ ID NO: 348443 - DNA, 27 bp, Artificial Sequence
  Description of Artificial Sequence: Synthetic oligonucleotide
ggctccacggtctgtggggatattcct

SEQ ID NO: 348444 - DNA, 27 bp, Artificial Sequence
  Description of Artificial Sequence: Synthetic oligonucleotide
gctccacggtctgtggggatattcctg

SEQ ID NO: 348445 - DNA, 27 bp, Artificial Sequence
  Description of Artificial Sequence: Synthetic oligonucleotide
ctccacggtctgtggggatattcctgg

SEQ ID NO: 348446 - DNA, 28 bp, Artificial Sequence
  Description of Artificial Sequence: Synthetic oligonucleotide
tccacggtctgtggggatattcctggac

SEQ ID NO: 348447 - DNA, 27 bp, Artificial Sequence
  Description of Artificial Sequence: Synthetic oligonucleotide
ccacggtctgtggggatattcctggac

SEQ ID NO: 348448 - DNA, 30 bp, Artificial Sequence
  Description of Artificial Sequence: Synthetic oligonucleotide
cacggtctgtggggatattcctggacaatg

SEQ ID NO: 348449 - DNA, 32 bp, Artificial Sequence
  Description of Artificial Sequence: Synthetic oligonucleotide
acggtctgtggggatattcctggacaatgaag

SEQ ID NO: 348450 - DNA, 31 bp, Artificial Sequence
  Description of Artificial Sequence: Synthetic oligonucleotide
cggtctgtggggatattcctggacaatgaag

SEQ ID NO: 348451 - DNA, 31 bp, Artificial Sequence
  Description of Artificial Sequence: Synthetic oligonucleotide
ggtctgtggggatattcctggacaatgaagc

SEQ ID NO: 348452 - DNA, 32 bp, Artificial Sequence
  Description of Artificial Sequence: Synthetic oligonucleotide
gtctgtggggatattcctggacaatgaagcag

SEQ ID NO: 348453 - DNA, 32 bp, Artificial Sequence
  Description of Artificial Sequence: Synthetic oligonucleotide
tctgtggggatattcctggacaatgaagcagc

SEQ ID NO: 348454 - DNA, 31 bp, Artificial Sequence
  Description of Artificial Sequence: Synthetic oligonucleotide
ctgtggggatattcctggacaatgaagcagc

SEQ ID NO: 348455 - DNA, 32 bp, Artificial Sequence
  Description of Artificial Sequence: Synthetic oligonucleotide
tgtggggatattcctggacaatgaagcagcag

SEQ ID NO: 348456 - DNA, 31 bp, Artificial Sequence
  Description of Artificial Sequence: Synthetic oligonucleotide
gtggggatattcctggacaatgaagcagcag

SEQ ID NO: 348457 - DNA, 32 bp, Artificial Sequence
  Description of Artificial Sequence: Synthetic oligonucleotide
tggggatattcctggacaatgaagcagcagtc

SEQ ID NO: 348458 - DNA, 31 bp, Artificial Sequence
  Description of Artificial Sequence: Synthetic oligonucleotide
ggggatattcctggacaatgaagcagcagtc

SEQ ID NO: 348459 - DNA, 33 bp, Artificial Sequence
  Description of Artificial Sequence: Synthetic oligonucleotide
gggatattcctggacaatgaagcagcagtcatc

SEQ ID NO: 348460 - DNA, 34 bp, Artificial Sequence
  Description of Artificial Sequence: Synthetic oligonucleotide
ggatattcctggacaatgaagcagcagtcatctc

SEQ ID NO: 348461 - DNA, 37 bp, Artificial Sequence
  Description of Artificial Sequence: Synthetic oligonucleotide
gatattcctggacaatgaagcagcagtcatctcattc

SEQ ID NO: 348462 - DNA, 39 bp, Artificial Sequence
  Description of Artificial Sequence: Synthetic oligonucleotide
atattcctggacaatgaagcagcagtcatctcattctac

SEQ ID NO: 348463 - DNA, 38 bp, Artificial Sequence
  Description of Artificial Sequence: Synthetic oligonucleotide
tattcctggacaatgaagcagcagtcatctcattctac

SEQ ID NO: 348464 - DNA, 37 bp, Artificial Sequence
  Description of Artificial Sequence: Synthetic oligonucleotide
attcctggacaatgaagcagcagtcatctcattctac

SEQ ID NO: 348465 - DNA, 36 bp, Artificial Sequence
  Description of Artificial Sequence: Synthetic oligonucleotide
ttcctggacaatgaagcagcagtcatctcattctac

SEQ ID NO: 348466 - DNA, 35 bp, Artificial Sequence
  Description of Artificial Sequence: Synthetic oligonucleotide
tcctggacaatgaagcagcagtcatctcattctac

SEQ ID NO: 348467 - DNA, 34 bp, Artificial Sequence
  Description of Artificial Sequence: Synthetic oligonucleotide
cctggacaatgaagcagcagtcatctcattctac

SEQ ID NO: 348468 - DNA, 37 bp, Artificial Sequence
  Description of Artificial Sequence: Synthetic oligonucleotide
ctggacaatgaagcagcagtcatctcattctacaatc

SEQ ID NO: 348469 - DNA, 38 bp, Artificial Sequence
  Description of Artificial Sequence: Synthetic oligonucleotide
tggacaatgaagcagcagtcatctcattctacaatctg

SEQ ID NO: 348470 - DNA, 37 bp, Artificial Sequence
  Description of Artificial Sequence: Synthetic oligonucleotide
ggacaatgaagcagcagtcatctcattctacaatctg

SEQ ID NO: 348471 - DNA, 38 bp, Artificial Sequence
  Description of Artificial Sequence: Synthetic oligonucleotide
gacaatgaagcagcagtcatctcattctacaatctgac

SEQ ID NO: 348472 - DNA, 38 bp, Artificial Sequence
  Description of Artificial Sequence: Synthetic oligonucleotide
acaatgaagcagcagtcatctcattctacaatctgacc

SEQ ID NO: 348473 - DNA, 37 bp, Artificial Sequence
  Description of Artificial Sequence: Synthetic oligonucleotide
caatgaagcagcagtcatctcattctacaatctgacc

SEQ ID NO: 348474 - DNA, 39 bp, Artificial Sequence
  Description of Artificial Sequence: Synthetic oligonucleotide
aatgaagcagcagtcatctcattctacaatctgaccaac

SEQ ID NO: 348475 - DNA, 38 bp, Artificial Sequence
  Description of Artificial Sequence: Synthetic oligonucleotide
atgaagcagcagtcatctcattctacaatctgaccaac

SEQ ID NO: 348476 - DNA, 37 bp, Artificial Sequence
  Description of Artificial Sequence: Synthetic oligonucleotide
tgaagcagcagtcatctcattctacaatctgaccaac

SEQ ID NO: 348477 - DNA, 36 bp, Artificial Sequence
  Description of Artificial Sequence: Synthetic oligonucleotide
gaagcagcagtcatctcattctacaatctgaccaac

SEQ ID NO: 348478 - DNA, 38 bp, Artificial Sequence
  Description of Artificial Sequence: Synthetic oligonucleotide
aagcagcagtcatctcattctacaatctgaccaacatg

SEQ ID NO: 348479 - DNA, 37 bp, Artificial Sequence
  Description of Artificial Sequence: Synthetic oligonucleotide
agcagcagtcatctcattctacaatctgaccaacatg

SEQ ID NO: 348480 - DNA, 36 bp, Artificial Sequence
  Description of Artificial Sequence: Synthetic oligonucleotide
gcagcagtcatctcattctacaatctgaccaacatg

SEQ ID NO: 348481 - DNA, 37 bp, Artificial Sequence
  Description of Artificial Sequence: Synthetic oligonucleotide
cagcagtcatctcattctacaatctgaccaacatgtc

SEQ ID NO: 348482 - DNA, 37 bp, Artificial Sequence
  Description of Artificial Sequence: Synthetic oligonucleotide
agcagtcatctcattctacaatctgaccaacatgtcc

SEQ ID NO: 348483 - DNA, 36 bp, Artificial Sequence
  Description of Artificial Sequence: Synthetic oligonucleotide
gcagtcatctcattctacaatctgaccaacatgtcc

SEQ ID NO: 348484 - DNA, 36 bp, Artificial Sequence
  Description of Artificial Sequence: Synthetic oligonucleotide
cagtcatctcattctacaatctgaccaacatgtccc

SEQ ID NO: 348485 - DNA, 37 bp, Artificial Sequence
  Description of Artificial Sequence: Synthetic oligonucleotide
agtcatctcattctacaatctgaccaacatgtcccac

SEQ ID NO: 348486 - DNA, 36 bp, Artificial Sequence
  Description of Artificial Sequence: Synthetic oligonucleotide
gtcatctcattctacaatctgaccaacatgtcccac

SEQ ID NO: 348487 - DNA, 38 bp, Artificial Sequence
  Description of Artificial Sequence: Synthetic oligonucleotide
tcatctcattctacaatctgaccaacatgtcccacatg

SEQ ID NO: 348488 - DNA, 37 bp, Artificial Sequence
  Description of Artificial Sequence: Synthetic oligonucleotide
catctcattctacaatctgaccaacatgtcccacatg

SEQ ID NO: 348489 - DNA, 41 bp, Artificial Sequence
  Description of Artificial Sequence: Synthetic oligonucleotide
atctcattctacaatctgaccaacatgtcccacatgtttac

SEQ ID NO: 348490 - DNA, 40 bp, Artificial Sequence
  Description of Artificial Sequence: Synthetic oligonucleotide
tctcattctacaatctgaccaacatgtcccacatgtttac

SEQ ID NO: 348491 - DNA, 39 bp, Artificial Sequence
  Description of Artificial Sequence: Synthetic oligonucleotide
ctcattctacaatctgaccaacatgtcccacatgtttac

SEQ ID NO: 348492 - DNA, 42 bp, Artificial Sequence
  Description of Artificial Sequence: Synthetic oligonucleotide
tcattctacaatctgaccaacatgtcccacatgtttactttc

SEQ ID NO: 348493 - DNA, 41 bp, Artificial Sequence
  Description of Artificial Sequence: Synthetic oligonucleotide
cattctacaatctgaccaacatgtcccacatgtttactttc

SEQ ID NO: 348494 - DNA, 42 bp, Artificial Sequence
  Description of Artificial Sequence: Synthetic oligonucleotide
attctacaatctgaccaacatgtcccacatgtttactttctc

SEQ ID NO: 348495 - DNA, 41 bp, Artificial Sequence
  Description of Artificial Sequence: Synthetic oligonucleotide
ttctacaatctgaccaacatgtcccacatgtttactttctc

SEQ ID NO: 348496 - DNA, 40 bp, Artificial Sequence
  Description of Artificial Sequence: Synthetic oligonucleotide
tctacaatctgaccaacatgtcccacatgtttactttctc

SEQ ID NO: 348497 - DNA, 39 bp, Artificial Sequence
  Description of Artificial Sequence: Synthetic oligonucleotide
ctacaatctgaccaacatgtcccacatgtttactttctc

SEQ ID NO: 348498 - DNA, 39 bp, Artificial Sequence
  Description of Artificial Sequence: Synthetic oligonucleotide
tacaatctgaccaacatgtcccacatgtttactttctcc

SEQ ID NO: 348499 - DNA, 38 bp, Artificial Sequence
  Description of Artificial Sequence: Synthetic oligonucleotide
acaatctgaccaacatgtcccacatgtttactttctcc

SEQ ID NO: 348500 - DNA, 37 bp, Artificial Sequence
  Description of Artificial Sequence: Synthetic oligonucleotide
caatctgaccaacatgtcccacatgtttactttctcc

SEQ ID NO: 348501 - DNA, 37 bp, Artificial Sequence
  Description of Artificial Sequence: Synthetic oligonucleotide
aatctgaccaacatgtcccacatgtttactttctccc

SEQ ID NO: 348502 - DNA, 36 bp, Artificial Sequence
  Description of Artificial Sequence: Synthetic oligonucleotide
atctgaccaacatgtcccacatgtttactttctccc

SEQ ID NO: 348503 - DNA, 35 bp, Artificial Sequence
  Description of Artificial Sequence: Synthetic oligonucleotide
tctgaccaacatgtcccacatgtttactttctccc

SEQ ID NO: 348504 - DNA, 34 bp, Artificial Sequence
  Description of Artificial Sequence: Synthetic oligonucleotide
ctgaccaacatgtcccacatgtttactttctccc

SEQ ID NO: 348505 - DNA, 35 bp, Artificial Sequence
  Description of Artificial Sequence: Synthetic oligonucleotide
tgaccaacatgtcccacatgtttactttctcccac

SEQ ID NO: 348506 - DNA, 34 bp, Artificial Sequence
  Description of Artificial Sequence: Synthetic oligonucleotide
gaccaacatgtcccacatgtttactttctcccac

SEQ ID NO: 348507 - DNA, 39 bp, Artificial Sequence
  Description of Artificial Sequence: Synthetic oligonucleotide
accaacatgtcccacatgtttactttctcccacaattac

SEQ ID NO: 348508 - DNA, 38 bp, Artificial Sequence
  Description of Artificial Sequence: Synthetic oligonucleotide
ccaacatgtcccacatgtttactttctcccacaattac

SEQ ID NO: 348509 - DNA, 39 bp, Artificial Sequence
  Description of Artificial Sequence: Synthetic oligonucleotide
caacatgtcccacatgtttactttctcccacaattactc

SEQ ID NO: 348510 - DNA, 40 bp, Artificial Sequence
  Description of Artificial Sequence: Synthetic oligonucleotide
aacatgtcccacatgtttactttctcccacaattactctg

SEQ ID NO: 348511 - DNA, 39 bp, Artificial Sequence
  Description of Artificial Sequence: Synthetic oligonucleotide
acatgtcccacatgtttactttctcccacaattactctg

SEQ ID NO: 348512 - DNA, 38 bp, Artificial Sequence
  Description of Artificial Sequence: Synthetic oligonucleotide
catgtcccacatgtttactttctcccacaattactctg

SEQ ID NO: 348513 - DNA, 38 bp, Artificial Sequence
  Description of Artificial Sequence: Synthetic oligonucleotide
atgtcccacatgtttactttctcccacaattactctgg

SEQ ID NO: 348514 - DNA, 37 bp, Artificial Sequence
  Description of Artificial Sequence: Synthetic oligonucleotide
tgtcccacatgtttactttctcccacaattactctgg

SEQ ID NO: 348515 - DNA, 36 bp, Artificial Sequence
  Description of Artificial Sequence: Synthetic oligonucleotide
gtcccacatgtttactttctcccacaattactctgg

SEQ ID NO: 348516 - DNA, 36 bp, Artificial Sequence
  Description of Artificial Sequence: Synthetic oligonucleotide
tcccacatgtttactttctcccacaattactctggc

SEQ ID NO: 348517 - DNA, 35 bp, Artificial Sequence
  Description of Artificial Sequence: Synthetic oligonucleotide
cccacatgtttactttctcccacaattactctggc

SEQ ID NO: 348518 - DNA, 35 bp, Artificial Sequence
  Description of Artificial Sequence: Synthetic oligonucleotide
ccacatgtttactttctcccacaattactctggcc

SEQ ID NO: 348519 - DNA, 35 bp, Artificial Sequence
  Description of Artificial Sequence: Synthetic oligonucleotide
cacatgtttactttctcccacaattactctggccc

SEQ ID NO: 348520 - DNA, 35 bp, Artificial Sequence
  Description of Artificial Sequence: Synthetic oligonucleotide
acatgtttactttctcccacaattactctggcccg

SEQ ID NO: 348521 - DNA, 34 bp, Artificial Sequence
  Description of Artificial Sequence: Synthetic oligonucleotide
catgtttactttctcccacaattactctggcccg

SEQ ID NO: 348522 - DNA, 34 bp, Artificial Sequence
  Description of Artificial Sequence: Synthetic oligonucleotide
atgtttactttctcccacaattactctggcccgc

SEQ ID NO: 348523 - DNA, 33 bp, Artificial Sequence
  Description of Artificial Sequence: Synthetic oligonucleotide
tgtttactttctcccacaattactctggcccgc

SEQ ID NO: 348524 - DNA, 32 bp, Artificial Sequence
  Description of Artificial Sequence: Synthetic oligonucleotide
gtttactttctcccacaattactctggcccgc

SEQ ID NO: 348525 - DNA, 34 bp, Artificial Sequence
  Description of Artificial Sequence: Synthetic oligonucleotide
tttactttctcccacaattactctggcccgcttc

SEQ ID NO: 348526 - DNA, 33 bp, Artificial Sequence
  Description of Artificial Sequence: Synthetic oligonucleotide
ttactttctcccacaattactctggcccgcttc

SEQ ID NO: 348527 - DNA, 32 bp, Artificial Sequence
  Description of Artificial Sequence: Synthetic oligonucleotide
tactttctcccacaattactctggcccgcttc

SEQ ID NO: 348528 - DNA, 31 bp, Artificial Sequence
  Description of Artificial Sequence: Synthetic oligonucleotide
actttctcccacaattactctggcccgcttc

SEQ ID NO: 348529 - DNA, 30 bp, Artificial Sequence
  Description of Artificial Sequence: Synthetic oligonucleotide
ctttctcccacaattactctggcccgcttc

SEQ ID NO: 348530 - DNA, 30 bp, Artificial Sequence
  Description of Artificial Sequence: Synthetic oligonucleotide
tttctcccacaattactctggcccgcttcg

SEQ ID NO: 348531 - DNA, 29 bp, Artificial Sequence
  Description of Artificial Sequence: Synthetic oligonucleotide
ttctcccacaattactctggcccgcttcg

SEQ ID NO: 348532 - DNA, 28 bp, Artificial Sequence
  Description of Artificial Sequence: Synthetic oligonucleotide
tctcccacaattactctggcccgcttcg

SEQ ID NO: 348533 - DNA, 27 bp, Artificial Sequence
  Description of Artificial Sequence: Synthetic oligonucleotide
ctcccacaattactctggcccgcttcg

SEQ ID NO: 348534 - DNA, 27 bp, Artificial Sequence
  Description of Artificial Sequence: Synthetic oligonucleotide
tcccacaattactctggcccgcttcgc

SEQ ID NO: 348535 - DNA, 26 bp, Artificial Sequence
  Description of Artificial Sequence: Synthetic oligonucleotide
cccacaattactctggcccgcttcgc

SEQ ID NO: 348536 - DNA, 26 bp, Artificial Sequence
  Description of Artificial Sequence: Synthetic oligonucleotide
ccacaattactctggcccgcttcgcc

SEQ ID NO: 348537 - DNA, 27 bp, Artificial Sequence
  Description of Artificial Sequence: Synthetic oligonucleotide
cacaattactctggcccgcttcgccct

SEQ ID NO: 348538 - DNA, 29 bp, Artificial Sequence
  Description of Artificial Sequence: Synthetic oligonucleotide
acaattactctggcccgcttcgccctatc

SEQ ID NO: 348539 - DNA, 28 bp, Artificial Sequence
  Description of Artificial Sequence: Synthetic oligonucleotide
caattactctggcccgcttcgccctatc

SEQ ID NO: 348540 - DNA, 31 bp, Artificial Sequence
  Description of Artificial Sequence: Synthetic oligonucleotide
aattactctggcccgcttcgccctatctttg

SEQ ID NO: 348541 - DNA, 30 bp, Artificial Sequence
  Description of Artificial Sequence: Synthetic oligonucleotide
attactctggcccgcttcgccctatctttg

SEQ ID NO: 348542 - DNA, 29 bp, Artificial Sequence
  Description of Artificial Sequence: Synthetic oligonucleotide
ttactctggcccgcttcgccctatctttg

SEQ ID NO: 348543 - DNA, 28 bp, Artificial Sequence
  Description of Artificial Sequence: Synthetic oligonucleotide
tactctggcccgcttcgccctatctttg

SEQ ID NO: 348544 - DNA, 27 bp, Artificial Sequence
  Description of Artificial Sequence: Synthetic oligonucleotide
actctggcccgcttcgccctatctttg

SEQ ID NO: 348545 - DNA, 27 bp, Artificial Sequence
  Description of Artificial Sequence: Synthetic oligonucleotide
ctctggcccgcttcgccctatctttga

SEQ ID NO: 348546 - DNA, 28 bp, Artificial Sequence
  Description of Artificial Sequence: Synthetic oligonucleotide
tctggcccgcttcgccctatctttgaac

SEQ ID NO: 348547 - DNA, 27 bp, Artificial Sequence
  Description of Artificial Sequence: Synthetic oligonucleotide
ctggcccgcttcgccctatctttgaac

SEQ ID NO: 348548 - DNA, 27 bp, Artificial Sequence
  Description of Artificial Sequence: Synthetic oligonucleotide
tggcccgcttcgccctatctttgaacg

SEQ ID NO: 348549 - DNA, 27 bp, Artificial Sequence
  Description of Artificial Sequence: Synthetic oligonucleotide
ggcccgcttcgccctatctttgaacgt

SEQ ID NO: 348550 - DNA, 28 bp, Artificial Sequence
  Description of Artificial Sequence: Synthetic oligonucleotide
gcccgcttcgccctatctttgaacgttg

SEQ ID NO: 348551 - DNA, 28 bp, Artificial Sequence
  Description of Artificial Sequence: Synthetic oligonucleotide
cccgcttcgccctatctttgaacgttgc

SEQ ID NO: 348552 - DNA, 28 bp, Artificial Sequence
  Description of Artificial Sequence: Synthetic oligonucleotide
ccgcttcgccctatctttgaacgttgcc

SEQ ID NO: 348553 - DNA, 30 bp, Artificial Sequence
  Description of Artificial Sequence: Synthetic oligonucleotide
cgcttcgccctatctttgaacgttgccttc

SEQ ID NO: 348554 - DNA, 32 bp, Artificial Sequence
  Description of Artificial Sequence: Synthetic oligonucleotide
gcttcgccctatctttgaacgttgccttcaag

SEQ ID NO: 348555 - DNA, 34 bp, Artificial Sequence
  Description of Artificial Sequence: Synthetic oligonucleotide
cttcgccctatctttgaacgttgccttcaagatg

SEQ ID NO: 348556 - DNA, 34 bp, Artificial Sequence
  Description of Artificial Sequence: Synthetic oligonucleotide
ttcgccctatctttgaacgttgccttcaagatgg

SEQ ID NO: 348557 - DNA, 33 bp, Artificial Sequence
  Description of Artificial Sequence: Synthetic oligonucleotide
tcgccctatctttgaacgttgccttcaagatgg

SEQ ID NO: 348558 - DNA, 32 bp, Artificial Sequence
  Description of Artificial Sequence: Synthetic oligonucleotide
cgccctatctttgaacgttgccttcaagatgg

SEQ ID NO: 348559 - DNA, 33 bp, Artificial Sequence
  Description of Artificial Sequence: Synthetic oligonucleotide
gccctatctttgaacgttgccttcaagatggag

SEQ ID NO: 348560 - DNA, 33 bp, Artificial Sequence
  Description of Artificial Sequence: Synthetic oligonucleotide
ccctatctttgaacgttgccttcaagatggagg

SEQ ID NO: 348561 - DNA, 39 bp, Artificial Sequence
  Description of Artificial Sequence: Synthetic oligonucleotide
cctatctttgaacgttgccttcaagatggaggataaaac

SEQ ID NO: 348562 - DNA, 40 bp, Artificial Sequence
  Description of Artificial Sequence: Synthetic oligonucleotide
ctatctttgaacgttgccttcaagatggaggataaaacac

SEQ ID NO: 348563 - DNA, 41 bp, Artificial Sequence
  Description of Artificial Sequence: Synthetic oligonucleotide
tatctttgaacgttgccttcaagatggaggataaaacacag

SEQ ID NO: 348564 - DNA, 40 bp, Artificial Sequence
  Description of Artificial Sequence: Synthetic oligonucleotide
atctttgaacgttgccttcaagatggaggataaaacacag

SEQ ID NO: 348565 - DNA, 39 bp, Artificial Sequence
  Description of Artificial Sequence: Synthetic oligonucleotide
tctttgaacgttgccttcaagatggaggataaaacacag

SEQ ID NO: 348566 - DNA, 38 bp, Artificial Sequence
  Description of Artificial Sequence: Synthetic oligonucleotide
ctttgaacgttgccttcaagatggaggataaaacacag

SEQ ID NO: 348567 - DNA, 38 bp, Artificial Sequence
  Description of Artificial Sequence: Synthetic oligonucleotide
tttgaacgttgccttcaagatggaggataaaacacagg

SEQ ID NO: 348568 - DNA, 37 bp, Artificial Sequence
  Description of Artificial Sequence: Synthetic oligonucleotide
ttgaacgttgccttcaagatggaggataaaacacagg

SEQ ID NO: 348569 - DNA, 36 bp, Artificial Sequence
  Description of Artificial Sequence: Synthetic oligonucleotide
tgaacgttgccttcaagatggaggataaaacacagg

SEQ ID NO: 348570 - DNA, 35 bp, Artificial Sequence
  Description of Artificial Sequence: Synthetic oligonucleotide
gaacgttgccttcaagatggaggataaaacacagg

SEQ ID NO: 348571 - DNA, 36 bp, Artificial Sequence
  Description of Artificial Sequence: Synthetic oligonucleotide
aacgttgccttcaagatggaggataaaacacaggac

SEQ ID NO: 348572 - DNA, 35 bp, Artificial Sequence
  Description of Artificial Sequence: Synthetic oligonucleotide
acgttgccttcaagatggaggataaaacacaggac

SEQ ID NO: 348573 - DNA, 34 bp, Artificial Sequence
  Description of Artificial Sequence: Synthetic oligonucleotide
cgttgccttcaagatggaggataaaacacaggac

SEQ ID NO: 348574 - DNA, 34 bp, Artificial Sequence
  Description of Artificial Sequence: Synthetic oligonucleotide
gttgccttcaagatggaggataaaacacaggacc

SEQ ID NO: 348575 - DNA, 35 bp, Artificial Sequence
  Description of Artificial Sequence: Synthetic oligonucleotide
ttgccttcaagatggaggataaaacacaggacctc

SEQ ID NO: 348576 - DNA, 34 bp, Artificial Sequence
  Description of Artificial Sequence: Synthetic oligonucleotide
tgccttcaagatggaggataaaacacaggacctc

SEQ ID NO: 348577 - DNA, 33 bp, Artificial Sequence
  Description of Artificial Sequence: Synthetic oligonucleotide
gccttcaagatggaggataaaacacaggacctc

SEQ ID NO: 348578 - DNA, 35 bp, Artificial Sequence
  Description of Artificial Sequence: Synthetic oligonucleotide
ccttcaagatggaggataaaacacaggacctctag

SEQ ID NO: 348579 - DNA, 36 bp, Artificial Sequence
  Description of Artificial Sequence: Synthetic oligonucleotide
cttcaagatggaggataaaacacaggacctctagtg

SEQ ID NO: 348580 - DNA, 40 bp, Artificial Sequence
  Description of Artificial Sequence: Synthetic oligonucleotide
ttcaagatggaggataaaacacaggacctctagtgatttg

SEQ ID NO: 348581 - DNA, 39 bp, Artificial Sequence
  Description of Artificial Sequence: Synthetic oligonucleotide
tcaagatggaggataaaacacaggacctctagtgatttg

SEQ ID NO: 348582 - DNA, 38 bp, Artificial Sequence
  Description of Artificial Sequence: Synthetic oligonucleotide
caagatggaggataaaacacaggacctctagtgatttg

SEQ ID NO: 348583 - DNA, 40 bp, Artificial Sequence
  Description of Artificial Sequence: Synthetic oligonucleotide
aagatggaggataaaacacaggacctctagtgatttgttc

SEQ ID NO: 348584 - DNA, 39 bp, Artificial Sequence
  Description of Artificial Sequence: Synthetic oligonucleotide
agatggaggataaaacacaggacctctagtgatttgttc

SEQ ID NO: 348585 - DNA, 38 bp, Artificial Sequence
  Description of Artificial Sequence: Synthetic oligonucleotide
gatggaggataaaacacaggacctctagtgatttgttc

SEQ ID NO: 348586 - DNA, 39 bp, Artificial Sequence
  Description of Artificial Sequence: Synthetic oligonucleotide
atggaggataaaacacaggacctctagtgatttgttcac

SEQ ID NO: 348587 - DNA, 38 bp, Artificial Sequence
  Description of Artificial Sequence: Synthetic oligonucleotide
tggaggataaaacacaggacctctagtgatttgttcac

SEQ ID NO: 348588 - DNA, 37 bp, Artificial Sequence
  Description of Artificial Sequence: Synthetic oligonucleotide
ggaggataaaacacaggacctctagtgatttgttcac

SEQ ID NO: 348589 - DNA, 39 bp, Artificial Sequence
  Description of Artificial Sequence: Synthetic oligonucleotide
gaggataaaacacaggacctctagtgatttgttcacaac

SEQ ID NO: 348590 - DNA, 41 bp, Artificial Sequence
  Description of Artificial Sequence: Synthetic oligonucleotide
aggataaaacacaggacctctagtgatttgttcacaactac

SEQ ID NO: 348591 - DNA, 40 bp, Artificial Sequence
  Description of Artificial Sequence: Synthetic oligonucleotide
ggataaaacacaggacctctagtgatttgttcacaactac

SEQ ID NO: 348592 - DNA, 41 bp, Artificial Sequence
  Description of Artificial Sequence: Synthetic oligonucleotide
gataaaacacaggacctctagtgatttgttcacaactacac

SEQ ID NO: 348593 - DNA, 45 bp, Artificial Sequence
  Description of Artificial Sequence: Synthetic oligonucleotide
ataaaacacaggacctctagtgatttgttcacaactacacatatc

SEQ ID NO: 348594 - DNA, 44 bp, Artificial Sequence
  Description of Artificial Sequence: Synthetic oligonucleotide
taaaacacaggacctctagtgatttgttcacaactacacatatc

SEQ ID NO: 348595 - DNA, 43 bp, Artificial Sequence
  Description of Artificial Sequence: Synthetic oligonucleotide
aaaacacaggacctctagtgatttgttcacaactacacatatc

SEQ ID NO: 348596 - DNA, 42 bp, Artificial Sequence
  Description of Artificial Sequence: Synthetic oligonucleotide
aaacacaggacctctagtgatttgttcacaactacacatatc

SEQ ID NO: 348597 - DNA, 41 bp, Artificial Sequence
  Description of Artificial Sequence: Synthetic oligonucleotide
aacacaggacctctagtgatttgttcacaactacacatatc

SEQ ID NO: 348598 - DNA, 40 bp, Artificial Sequence
  Description of Artificial Sequence: Synthetic oligonucleotide
acacaggacctctagtgatttgttcacaactacacatatc

SEQ ID NO: 348599 - DNA, 39 bp, Artificial Sequence
  Description of Artificial Sequence: Synthetic oligonucleotide
cacaggacctctagtgatttgttcacaactacacatatc

SEQ ID NO: 348600 - DNA, 40 bp, Artificial Sequence
  Description of Artificial Sequence: Synthetic oligonucleotide
acaggacctctagtgatttgttcacaactacacatatcag

SEQ ID NO: 348601 - DNA, 39 bp, Artificial Sequence
  Description of Artificial Sequence: Synthetic oligonucleotide
caggacctctagtgatttgttcacaactacacatatcag

SEQ ID NO: 348602 - DNA, 40 bp, Artificial Sequence
  Description of Artificial Sequence: Synthetic oligonucleotide
aggacctctagtgatttgttcacaactacacatatcagag

SEQ ID NO: 348603 - DNA, 39 bp, Artificial Sequence
  Description of Artificial Sequence: Synthetic oligonucleotide
ggacctctagtgatttgttcacaactacacatatcagag

SEQ ID NO: 348604 - DNA, 39 bp, Artificial Sequence
  Description of Artificial Sequence: Synthetic oligonucleotide
gacctctagtgatttgttcacaactacacatatcagagg

SEQ ID NO: 348605 - DNA, 42 bp, Artificial Sequence
  Description of Artificial Sequence: Synthetic oligonucleotide
acctctagtgatttgttcacaactacacatatcagaggattc

SEQ ID NO: 348606 - DNA, 41 bp, Artificial Sequence
  Description of Artificial Sequence: Synthetic oligonucleotide
cctctagtgatttgttcacaactacacatatcagaggattc

SEQ ID NO: 348607 - DNA, 45 bp, Artificial Sequence
  Description of Artificial Sequence: Synthetic oligonucleotide
ctctagtgatttgttcacaactacacatatcagaggattcaattg

SEQ ID NO: 348608 - DNA, 46 bp, Artificial Sequence
  Description of Artificial Sequence: Synthetic oligonucleotide
tctagtgatttgttcacaactacacatatcagaggattcaattgtc

SEQ ID NO: 348609 - DNA, 45 bp, Artificial Sequence
  Description of Artificial Sequence: Synthetic oligonucleotide
ctagtgatttgttcacaactacacatatcagaggattcaattgtc

SEQ ID NO: 348610 - DNA, 45 bp, Artificial Sequence
  Description of Artificial Sequence: Synthetic oligonucleotide
tagtgatttgttcacaactacacatatcagaggattcaattgtcg

SEQ ID NO: 348611 - DNA, 44 bp, Artificial Sequence
  Description of Artificial Sequence: Synthetic oligonucleotide
agtgatttgttcacaactacacatatcagaggattcaattgtcg

SEQ ID NO: 348612 - DNA, 43 bp, Artificial Sequence
  Description of Artificial Sequence: Synthetic oligonucleotide
gtgatttgttcacaactacacatatcagaggattcaattgtcg

SEQ ID NO: 348613 - DNA, 43 bp, Artificial Sequence
  Description of Artificial Sequence: Synthetic oligonucleotide
tgatttgttcacaactacacatatcagaggattcaattgtcgc

SEQ ID NO: 348614 - DNA, 42 bp, Artificial Sequence
  Description of Artificial Sequence: Synthetic oligonucleotide
gatttgttcacaactacacatatcagaggattcaattgtcgc

SEQ ID NO: 348615 - DNA, 42 bp, Artificial Sequence
  Description of Artificial Sequence: Synthetic oligonucleotide
atttgttcacaactacacatatcagaggattcaattgtcgcc

SEQ ID NO: 348616 - DNA, 41 bp, Artificial Sequence
  Description of Artificial Sequence: Synthetic oligonucleotide
tttgttcacaactacacatatcagaggattcaattgtcgcc

SEQ ID NO: 348617 - DNA, 40 bp, Artificial Sequence
  Description of Artificial Sequence: Synthetic oligonucleotide
ttgttcacaactacacatatcagaggattcaattgtcgcc

SEQ ID NO: 348618 - DNA, 39 bp, Artificial Sequence
  Description of Artificial Sequence: Synthetic oligonucleotide
tgttcacaactacacatatcagaggattcaattgtcgcc

SEQ ID NO: 348619 - DNA, 38 bp, Artificial Sequence
  Description of Artificial Sequence: Synthetic oligonucleotide
gttcacaactacacatatcagaggattcaattgtcgcc

SEQ ID NO: 348620 - DNA, 39 bp, Artificial Sequence
  Description of Artificial Sequence: Synthetic oligonucleotide
ttcacaactacacatatcagaggattcaattgtcgccag

SEQ ID NO: 348621 - DNA, 38 bp, Artificial Sequence
  Description of Artificial Sequence: Synthetic oligonucleotide
tcacaactacacatatcagaggattcaattgtcgccag

SEQ ID NO: 348622 - DNA, 37 bp, Artificial Sequence
  Description of Artificial Sequence: Synthetic oligonucleotide
cacaactacacatatcagaggattcaattgtcgccag

SEQ ID NO: 348623 - DNA, 37 bp, Artificial Sequence
  Description of Artificial Sequence: Synthetic oligonucleotide
acaactacacatatcagaggattcaattgtcgccagg

SEQ ID NO: 348624 - DNA, 36 bp, Artificial Sequence
  Description of Artificial Sequence: Synthetic oligonucleotide
caactacacatatcagaggattcaattgtcgccagg

SEQ ID NO: 348625 - DNA, 36 bp, Artificial Sequence
  Description of Artificial Sequence: Synthetic oligonucleotide
aactacacatatcagaggattcaattgtcgccaggc

SEQ ID NO: 348626 - DNA, 35 bp, Artificial Sequence
  Description of Artificial Sequence: Synthetic oligonucleotide
actacacatatcagaggattcaattgtcgccaggc

SEQ ID NO: 348627 - DNA, 34 bp, Artificial Sequence
  Description of Artificial Sequence: Synthetic oligonucleotide
ctacacatatcagaggattcaattgtcgccaggc

SEQ ID NO: 348628 - DNA, 34 bp, Artificial Sequence
  Description of Artificial Sequence: Synthetic oligonucleotide
tacacatatcagaggattcaattgtcgccaggcc

SEQ ID NO: 348629 - DNA, 33 bp, Artificial Sequence
  Description of Artificial Sequence: Synthetic oligonucleotide
acacatatcagaggattcaattgtcgccaggcc

SEQ ID NO: 348630 - DNA, 32 bp, Artificial Sequence
  Description of Artificial Sequence: Synthetic oligonucleotide
cacatatcagaggattcaattgtcgccaggcc

SEQ ID NO: 348631 - DNA, 33 bp, Artificial Sequence
  Description of Artificial Sequence: Synthetic oligonucleotide
acatatcagaggattcaattgtcgccaggccag

SEQ ID NO: 348632 - DNA, 32 bp, Artificial Sequence
  Description of Artificial Sequence: Synthetic oligonucleotide
catatcagaggattcaattgtcgccaggccag

SEQ ID NO: 348633 - DNA, 34 bp, Artificial Sequence
  Description of Artificial Sequence: Synthetic oligonucleotide
atatcagaggattcaattgtcgccaggccagtag

SEQ ID NO: 348634 - DNA, 33 bp, Artificial Sequence
  Description of Artificial Sequence: Synthetic oligonucleotide
tatcagaggattcaattgtcgccaggccagtag

SEQ ID NO: 348635 - DNA, 32 bp, Artificial Sequence
  Description of Artificial Sequence: Synthetic oligonucleotide
atcagaggattcaattgtcgccaggccagtag

SEQ ID NO: 348636 - DNA, 31 bp, Artificial Sequence
  Description of Artificial Sequence: Synthetic oligonucleotide
tcagaggattcaattgtcgccaggccagtag

SEQ ID NO: 348637 - DNA, 30 bp, Artificial Sequence
  Description of Artificial Sequence: Synthetic oligonucleotide
cagaggattcaattgtcgccaggccagtag

SEQ ID NO: 348638 - DNA, 30 bp, Artificial Sequence
  Description of Artificial Sequence: Synthetic oligonucleotide
agaggattcaattgtcgccaggccagtagg

SEQ ID NO: 348639 - DNA, 29 bp, Artificial Sequence
  Description of Artificial Sequence: Synthetic oligonucleotide
gaggattcaattgtcgccaggccagtagg

SEQ ID NO: 348640 - DNA, 29 bp, Artificial Sequence
  Description of Artificial Sequence: Synthetic oligonucleotide
aggattcaattgtcgccaggccagtaggg

SEQ ID NO: 348641 - DNA, 28 bp, Artificial Sequence
  Description of Artificial Sequence: Synthetic oligonucleotide
ggattcaattgtcgccaggccagtaggg

SEQ ID NO: 348642 - DNA, 31 bp, Artificial Sequence
  Description of Artificial Sequence: Synthetic oligonucleotide
gattcaattgtcgccaggccagtagggaaag

SEQ ID NO: 348643 - DNA, 31 bp, Artificial Sequence
  Description of Artificial Sequence: Synthetic oligonucleotide
attcaattgtcgccaggccagtagggaaagg

SEQ ID NO: 348644 - DNA, 30 bp, Artificial Sequence
  Description of Artificial Sequence: Synthetic oligonucleotide
ttcaattgtcgccaggccagtagggaaagg

SEQ ID NO: 348645 - DNA, 29 bp, Artificial Sequence
  Description of Artificial Sequence: Synthetic oligonucleotide
tcaattgtcgccaggccagtagggaaagg

SEQ ID NO: 348646 - DNA, 28 bp, Artificial Sequence
  Description of Artificial Sequence: Synthetic oligonucleotide
caattgtcgccaggccagtagggaaagg

SEQ ID NO: 348647 - DNA, 28 bp, Artificial Sequence
  Description of Artificial Sequence: Synthetic oligonucleotide
aattgtcgccaggccagtagggaaaggg

SEQ ID NO: 348648 - DNA, 27 bp, Artificial Sequence
  Description of Artificial Sequence: Synthetic oligonucleotide
attgtcgccaggccagtagggaaaggg

SEQ ID NO: 348649 - DNA, 26 bp, Artificial Sequence
  Description of Artificial Sequence: Synthetic oligonucleotide
ttgtcgccaggccagtagggaaaggg

SEQ ID NO: 348650 - DNA, 25 bp, Artificial Sequence
  Description of Artificial Sequence: Synthetic oligonucleotide
tgtcgccaggccagtagggaaaggg

SEQ ID NO: 348651 - DNA, 24 bp, Artificial Sequence
  Description of Artificial Sequence: Synthetic oligonucleotide
gtcgccaggccagtagggaaaggg

SEQ ID NO: 348652 - DNA, 26 bp, Artificial Sequence
  Description of Artificial Sequence: Synthetic oligonucleotide
tcgccaggccagtagggaaagggcat

SEQ ID NO: 348653 - DNA, 25 bp, Artificial Sequence
  Description of Artificial Sequence: Synthetic oligonucleotide
cgccaggccagtagggaaagggcat

SEQ ID NO: 348654 - DNA, 25 bp, Artificial Sequence
  Description of Artificial Sequence: Synthetic oligonucleotide
gccaggccagtagggaaagggcatg

SEQ ID NO: 348655 - DNA, 27 bp, Artificial Sequence
  Description of Artificial Sequence: Synthetic oligonucleotide
ccaggccagtagggaaagggcatgcta

SEQ ID NO: 348656 - DNA, 29 bp, Artificial Sequence
  Description of Artificial Sequence: Synthetic oligonucleotide
caggccagtagggaaagggcatgctaatc

SEQ ID NO: 348657 - DNA, 29 bp, Artificial Sequence
  Description of Artificial Sequence: Synthetic oligonucleotide
aggccagtagggaaagggcatgctaatcg

SEQ ID NO: 348658 - DNA, 28 bp, Artificial Sequence
  Description of Artificial Sequence: Synthetic oligonucleotide
ggccagtagggaaagggcatgctaatcg

SEQ ID NO: 348659 - DNA, 29 bp, Artificial Sequence
  Description of Artificial Sequence: Synthetic oligonucleotide
gccagtagggaaagggcatgctaatcgag

SEQ ID NO: 348660 - DNA, 31 bp, Artificial Sequence
  Description of Artificial Sequence: Synthetic oligonucleotide
ccagtagggaaagggcatgctaatcgagatg

SEQ ID NO: 348661 - DNA, 32 bp, Artificial Sequence
  Description of Artificial Sequence: Synthetic oligonucleotide
cagtagggaaagggcatgctaatcgagatgtg

SEQ ID NO: 348662 - DNA, 33 bp, Artificial Sequence
  Description of Artificial Sequence: Synthetic oligonucleotide
agtagggaaagggcatgctaatcgagatgtgtg

SEQ ID NO: 348663 - DNA, 32 bp, Artificial Sequence
  Description of Artificial Sequence: Synthetic oligonucleotide
gtagggaaagggcatgctaatcgagatgtgtg

SEQ ID NO: 348664 - DNA, 32 bp, Artificial Sequence
  Description of Artificial Sequence: Synthetic oligonucleotide
tagggaaagggcatgctaatcgagatgtgtgc

SEQ ID NO: 348665 - DNA, 31 bp, Artificial Sequence
  Description of Artificial Sequence: Synthetic oligonucleotide
agggaaagggcatgctaatcgagatgtgtgc

SEQ ID NO: 348666 - DNA, 30 bp, Artificial Sequence
  Description of Artificial Sequence: Synthetic oligonucleotide
gggaaagggcatgctaatcgagatgtgtgc

SEQ ID NO: 348667 - DNA, 30 bp, Artificial Sequence
  Description of Artificial Sequence: Synthetic oligonucleotide
ggaaagggcatgctaatcgagatgtgtgcc

SEQ ID NO: 348668 - DNA, 31 bp, Artificial Sequence
  Description of Artificial Sequence: Synthetic oligonucleotide
gaaagggcatgctaatcgagatgtgtgcctc

SEQ ID NO: 348669 - DNA, 33 bp, Artificial Sequence
  Description of Artificial Sequence: Synthetic oligonucleotide
aaagggcatgctaatcgagatgtgtgcctcaag

SEQ ID NO: 348670 - DNA, 32 bp, Artificial Sequence
  Description of Artificial Sequence: Synthetic oligonucleotide
aagggcatgctaatcgagatgtgtgcctcaag

SEQ ID NO: 348671 - DNA, 31 bp, Artificial Sequence
  Description of Artificial Sequence: Synthetic oligonucleotide
agggcatgctaatcgagatgtgtgcctcaag

SEQ ID NO: 348672 - DNA, 30 bp, Artificial Sequence
  Description of Artificial Sequence: Synthetic oligonucleotide
gggcatgctaatcgagatgtgtgcctcaag

SEQ ID NO: 348673 - DNA, 30 bp, Artificial Sequence
  Description of Artificial Sequence: Synthetic oligonucleotide
ggcatgctaatcgagatgtgtgcctcaagg

SEQ ID NO: 348674 - DNA, 31 bp, Artificial Sequence
  Description of Artificial Sequence: Synthetic oligonucleotide
gcatgctaatcgagatgtgtgcctcaaggtc

SEQ ID NO: 348675 - DNA, 33 bp, Artificial Sequence
  Description of Artificial Sequence: Synthetic oligonucleotide
catgctaatcgagatgtgtgcctcaaggtcaac

SEQ ID NO: 348676 - DNA, 34 bp, Artificial Sequence
  Description of Artificial Sequence: Synthetic oligonucleotide
atgctaatcgagatgtgtgcctcaaggtcaactc

SEQ ID NO: 348677 - DNA, 33 bp, Artificial Sequence
  Description of Artificial Sequence: Synthetic oligonucleotide
tgctaatcgagatgtgtgcctcaaggtcaactc

SEQ ID NO: 348678 - DNA, 32 bp, Artificial Sequence
  Description of Artificial Sequence: Synthetic oligonucleotide
gctaatcgagatgtgtgcctcaaggtcaactc

SEQ ID NO: 348679 - DNA, 34 bp, Artificial Sequence
  Description of Artificial Sequence: Synthetic oligonucleotide
ctaatcgagatgtgtgcctcaaggtcaactcttc

SEQ ID NO: 348680 - DNA, 38 bp, Artificial Sequence
  Description of Artificial Sequence: Synthetic oligonucleotide
taatcgagatgtgtgcctcaaggtcaactcttctatac

SEQ ID NO: 348681 - DNA, 37 bp, Artificial Sequence
  Description of Artificial Sequence: Synthetic oligonucleotide
aatcgagatgtgtgcctcaaggtcaactcttctatac

SEQ ID NO: 348682 - DNA, 36 bp, Artificial Sequence
  Description of Artificial Sequence: Synthetic oligonucleotide
atcgagatgtgtgcctcaaggtcaactcttctatac

SEQ ID NO: 348683 - DNA, 35 bp, Artificial Sequence
  Description of Artificial Sequence: Synthetic oligonucleotide
tcgagatgtgtgcctcaaggtcaactcttctatac

SEQ ID NO: 348684 - DNA, 34 bp, Artificial Sequence
  Description of Artificial Sequence: Synthetic oligonucleotide
cgagatgtgtgcctcaaggtcaactcttctatac

SEQ ID NO: 348685 - DNA, 36 bp, Artificial Sequence
  Description of Artificial Sequence: Synthetic oligonucleotide
gagatgtgtgcctcaaggtcaactcttctatactac

SEQ ID NO: 348686 - DNA, 36 bp, Artificial Sequence
  Description of Artificial Sequence: Synthetic oligonucleotide
agatgtgtgcctcaaggtcaactcttctatactacc

SEQ ID NO: 348687 - DNA, 35 bp, Artificial Sequence
  Description of Artificial Sequence: Synthetic oligonucleotide
gatgtgtgcctcaaggtcaactcttctatactacc

SEQ ID NO: 348688 - DNA, 35 bp, Artificial Sequence
  Description of Artificial Sequence: Synthetic oligonucleotide
atgtgtgcctcaaggtcaactcttctatactaccc

SEQ ID NO: 348689 - DNA, 34 bp, Artificial Sequence
  Description of Artificial Sequence: Synthetic oligonucleotide
tgtgtgcctcaaggtcaactcttctatactaccc

SEQ ID NO: 348690 - DNA, 33 bp, Artificial Sequence
  Description of Artificial Sequence: Synthetic oligonucleotide
gtgtgcctcaaggtcaactcttctatactaccc

SEQ ID NO: 348691 - DNA, 33 bp, Artificial Sequence
  Description of Artificial Sequence: Synthetic oligonucleotide
tgtgcctcaaggtcaactcttctatactacccc

SEQ ID NO: 348692 - DNA, 32 bp, Artificial Sequence
  Description of Artificial Sequence: Synthetic oligonucleotide
gtgcctcaaggtcaactcttctatactacccc

SEQ ID NO: 348693 - DNA, 32 bp, Artificial Sequence
  Description of Artificial Sequence: Synthetic oligonucleotide
tgcctcaaggtcaactcttctatactaccccg

SEQ ID NO: 348694 - DNA, 31 bp, Artificial Sequence
  Description of Artificial Sequence: Synthetic oligonucleotide
gcctcaaggtcaactcttctatactaccccg

SEQ ID NO: 348695 - DNA, 31 bp, Artificial Sequence
  Description of Artificial Sequence: Synthetic oligonucleotide
cctcaaggtcaactcttctatactaccccgg

SEQ ID NO: 348696 - DNA, 33 bp, Artificial Sequence
  Description of Artificial Sequence: Synthetic oligonucleotide
ctcaaggtcaactcttctatactaccccggaag

SEQ ID NO: 348697 - DNA, 33 bp, Artificial Sequence
  Description of Artificial Sequence: Synthetic oligonucleotide
tcaaggtcaactcttctatactaccccggaagg

SEQ ID NO: 348698 - DNA, 32 bp, Artificial Sequence
  Description of Artificial Sequence: Synthetic oligonucleotide
caaggtcaactcttctatactaccccggaagg

SEQ ID NO: 348699 - DNA, 32 bp, Artificial Sequence
  Description of Artificial Sequence: Synthetic oligonucleotide
aaggtcaactcttctatactaccccggaaggc

SEQ ID NO: 348700 - DNA, 31 bp, Artificial Sequence
  Description of Artificial Sequence: Synthetic oligonucleotide
aggtcaactcttctatactaccccggaaggc

SEQ ID NO: 348701 - DNA, 30 bp, Artificial Sequence
  Description of Artificial Sequence: Synthetic oligonucleotide
ggtcaactcttctatactaccccggaaggc

SEQ ID NO: 348702 - DNA, 30 bp, Artificial Sequence
  Description of Artificial Sequence: Synthetic oligonucleotide
gtcaactcttctatactaccccggaaggcc

SEQ ID NO: 348703 - DNA, 30 bp, Artificial Sequence
  Description of Artificial Sequence: Synthetic oligonucleotide
tcaactcttctatactaccccggaaggccc

SEQ ID NO: 348704 - DNA, 29 bp, Artificial Sequence
  Description of Artificial Sequence: Synthetic oligonucleotide
caactcttctatactaccccggaaggccc

SEQ ID NO: 348705 - DNA, 29 bp, Artificial Sequence
  Description of Artificial Sequence: Synthetic oligonucleotide
aactcttctatactaccccggaaggcccc

SEQ ID NO: 348706 - DNA, 28 bp, Artificial Sequence
  Description of Artificial Sequence: Synthetic oligonucleotide
actcttctatactaccccggaaggcccc

SEQ ID NO: 348707 - DNA, 27 bp, Artificial Sequence
  Description of Artificial Sequence: Synthetic oligonucleotide
ctcttctatactaccccggaaggcccc

SEQ ID NO: 348708 - DNA, 28 bp, Artificial Sequence
  Description of Artificial Sequence: Synthetic oligonucleotide
tcttctatactaccccggaaggcccctg

SEQ ID NO: 348709 - DNA, 27 bp, Artificial Sequence
  Description of Artificial Sequence: Synthetic oligonucleotide
cttctatactaccccggaaggcccctg

SEQ ID NO: 348710 - DNA, 28 bp, Artificial Sequence
  Description of Artificial Sequence: Synthetic oligonucleotide
ttctatactaccccggaaggcccctgag

SEQ ID NO: 348711 - DNA, 27 bp, Artificial Sequence
  Description of Artificial Sequence: Synthetic oligonucleotide
tctatactaccccggaaggcccctgag

SEQ ID NO: 348712 - DNA, 26 bp, Artificial Sequence
  Description of Artificial Sequence: Synthetic oligonucleotide
ctatactaccccggaaggcccctgag

SEQ ID NO: 348713 - DNA, 27 bp, Artificial Sequence
  Description of Artificial Sequence: Synthetic oligonucleotide
tatactaccccggaaggcccctgagct

SEQ ID NO: 348714 - DNA, 26 bp, Artificial Sequence
  Description of Artificial Sequence: Synthetic oligonucleotide
atactaccccggaaggcccctgagct

SEQ ID NO: 348715 - DNA, 25 bp, Artificial Sequence
  Description of Artificial Sequence: Synthetic oligonucleotide
tactaccccggaaggcccctgagct

SEQ ID NO: 348716 - DNA, 24 bp, Artificial Sequence
  Description of Artificial Sequence: Synthetic oligonucleotide
actaccccggaaggcccctgagct

SEQ ID NO: 348717 - DNA, 23 bp, Artificial Sequence
  Description of Artificial Sequence: Synthetic oligonucleotide
ctaccccggaaggcccctgagct

SEQ ID NO: 348718 - DNA, 25 bp, Artificial Sequence
  Description of Artificial Sequence: Synthetic oligonucleotide
taccccggaaggcccctgagctgaa

SEQ ID NO: 348719 - DNA, 24 bp, Artificial Sequence
  Description of Artificial Sequence: Synthetic oligonucleotide
accccggaaggcccctgagctgaa

SEQ ID NO: 348720 - DNA, 23 bp, Artificial Sequence
  Description of Artificial Sequence: Synthetic oligonucleotide
ccccggaaggcccctgagctgaa

SEQ ID NO: 348721 - DNA, 23 bp, Artificial Sequence
  Description of Artificial Sequence: Synthetic oligonucleotide
cccggaaggcccctgagctgaag

SEQ ID NO: 348722 - DNA, 27 bp, Artificial Sequence
  Description of Artificial Sequence: Synthetic oligonucleotide
ccggaaggcccctgagctgaagcatat

SEQ ID NO: 348723 - DNA, 30 bp, Artificial Sequence
  Description of Artificial Sequence: Synthetic oligonucleotide
cggaaggcccctgagctgaagcatataatc

SEQ ID NO: 348724 - DNA, 30 bp, Artificial Sequence
  Description of Artificial Sequence: Synthetic oligonucleotide
ggaaggcccctgagctgaagcatataatcc

SEQ ID NO: 348725 - DNA, 31 bp, Artificial Sequence
  Description of Artificial Sequence: Synthetic oligonucleotide
gaaggcccctgagctgaagcatataatccag

SEQ ID NO: 348726 - DNA, 32 bp, Artificial Sequence
  Description of Artificial Sequence: Synthetic oligonucleotide
aaggcccctgagctgaagcatataatccagtc

SEQ ID NO: 348727 - DNA, 31 bp, Artificial Sequence
  Description of Artificial Sequence: Synthetic oligonucleotide
aggcccctgagctgaagcatataatccagtc

SEQ ID NO: 348728 - DNA, 30 bp, Artificial Sequence
  Description of Artificial Sequence: Synthetic oligonucleotide
ggcccctgagctgaagcatataatccagtc

SEQ ID NO: 348729 - DNA, 30 bp, Artificial Sequence
  Description of Artificial Sequence: Synthetic oligonucleotide
gcccctgagctgaagcatataatccagtcc

SEQ ID NO: 348730 - DNA, 32 bp, Artificial Sequence
  Description of Artificial Sequence: Synthetic oligonucleotide
cccctgagctgaagcatataatccagtccttg

SEQ ID NO: 348731 - DNA, 32 bp, Artificial Sequence
  Description of Artificial Sequence: Synthetic oligonucleotide
ccctgagctgaagcatataatccagtccttgc

SEQ ID NO: 348732 - DNA, 32 bp, Artificial Sequence
  Description of Artificial Sequence: Synthetic oligonucleotide
cctgagctgaagcatataatccagtccttgcc

SEQ ID NO: 348733 - DNA, 32 bp, Artificial Sequence
  Description of Artificial Sequence: Synthetic oligonucleotide
ctgagctgaagcatataatccagtccttgccg

SEQ ID NO: 348734 - DNA, 32 bp, Artificial Sequence
  Description of Artificial Sequence: Synthetic oligonucleotide
tgagctgaagcatataatccagtccttgccgc

SEQ ID NO: 348735 - DNA, 31 bp, Artificial Sequence
  Description of Artificial Sequence: Synthetic oligonucleotide
gagctgaagcatataatccagtccttgccgc

SEQ ID NO: 348736 - DNA, 31 bp, Artificial Sequence
  Description of Artificial Sequence: Synthetic oligonucleotide
agctgaagcatataatccagtccttgccgcc

SEQ ID NO: 348737 - DNA, 30 bp, Artificial Sequence
  Description of Artificial Sequence: Synthetic oligonucleotide
gctgaagcatataatccagtccttgccgcc

SEQ ID NO: 348738 - DNA, 31 bp, Artificial Sequence
  Description of Artificial Sequence: Synthetic oligonucleotide
ctgaagcatataatccagtccttgccgcctg

SEQ ID NO: 348739 - DNA, 32 bp, Artificial Sequence
  Description of Artificial Sequence: Synthetic oligonucleotide
tgaagcatataatccagtccttgccgcctgac

SEQ ID NO: 348740 - DNA, 31 bp, Artificial Sequence
  Description of Artificial Sequence: Synthetic oligonucleotide
gaagcatataatccagtccttgccgcctgac

SEQ ID NO: 348741 - DNA, 31 bp, Artificial Sequence
  Description of Artificial Sequence: Synthetic oligonucleotide
aagcatataatccagtccttgccgcctgacc

SEQ ID NO: 348742 - DNA, 30 bp, Artificial Sequence
  Description of Artificial Sequence: Synthetic oligonucleotide
agcatataatccagtccttgccgcctgacc

SEQ ID NO: 348743 - DNA, 29 bp, Artificial Sequence
  Description of Artificial Sequence: Synthetic oligonucleotide
gcatataatccagtccttgccgcctgacc

SEQ ID NO: 348744 - DNA, 31 bp, Artificial Sequence
  Description of Artificial Sequence: Synthetic oligonucleotide
catataatccagtccttgccgcctgaccttc

SEQ ID NO: 348745 - DNA, 31 bp, Artificial Sequence
  Description of Artificial Sequence: Synthetic oligonucleotide
atataatccagtccttgccgcctgaccttcg

SEQ ID NO: 348746 - DNA, 30 bp, Artificial Sequence
  Description of Artificial Sequence: Synthetic oligonucleotide
tataatccagtccttgccgcctgaccttcg

SEQ ID NO: 348747 - DNA, 29 bp, Artificial Sequence
  Description of Artificial Sequence: Synthetic oligonucleotide
ataatccagtccttgccgcctgaccttcg

SEQ ID NO: 348748 - DNA, 28 bp, Artificial Sequence
  Description of Artificial Sequence: Synthetic oligonucleotide
taatccagtccttgccgcctgaccttcg

SEQ ID NO: 348749 - DNA, 27 bp, Artificial Sequence
  Description of Artificial Sequence: Synthetic oligonucleotide
aatccagtccttgccgcctgaccttcg

SEQ ID NO: 348750 - DNA, 26 bp, Artificial Sequence
  Description of Artificial Sequence: Synthetic oligonucleotide
atccagtccttgccgcctgaccttcg

SEQ ID NO: 348751 - DNA, 25 bp, Artificial Sequence
  Description of Artificial Sequence: Synthetic oligonucleotide
tccagtccttgccgcctgaccttcg

SEQ ID NO: 348752 - DNA, 24 bp, Artificial Sequence
  Description of Artificial Sequence: Synthetic oligonucleotide
ccagtccttgccgcctgaccttcg

SEQ ID NO: 348753 - DNA, 24 bp, Artificial Sequence
  Description of Artificial Sequence: Synthetic oligonucleotide
cagtccttgccgcctgaccttcgc

SEQ ID NO: 348754 - DNA, 24 bp, Artificial Sequence
  Description of Artificial Sequence: Synthetic oligonucleotide
agtccttgccgcctgaccttcgcc

SEQ ID NO: 348755 - DNA, 23 bp, Artificial Sequence
  Description of Artificial Sequence: Synthetic oligonucleotide
gtccttgccgcctgaccttcgcc

SEQ ID NO: 348756 - DNA, 24 bp, Artificial Sequence
  Description of Artificial Sequence: Synthetic oligonucleotide
tccttgccgcctgaccttcgccca

SEQ ID NO: 348757 - DNA, 23 bp, Artificial Sequence
  Description of Artificial Sequence: Synthetic oligonucleotide
ccttgccgcctgaccttcgccca

SEQ ID NO: 348758 - DNA, 23 bp, Artificial Sequence
  Description of Artificial Sequence: Synthetic oligonucleotide
cttgccgcctgaccttcgcccag

SEQ ID NO: 348759 - DNA, 23 bp, Artificial Sequence
  Description of Artificial Sequence: Synthetic oligonucleotide
ttgccgcctgaccttcgcccagc

SEQ ID NO: 348760 - DNA, 22 bp, Artificial Sequence
  Description of Artificial Sequence: Synthetic oligonucleotide
tgccgcctgaccttcgcccagc

SEQ ID NO: 348761 - DNA, 21 bp, Artificial Sequence
  Description of Artificial Sequence: Synthetic oligonucleotide
gccgcctgaccttcgcccagc

SEQ ID NO: 348762 - DNA, 21 bp, Artificial Sequence
  Description of Artificial Sequence: Synthetic oligonucleotide
ccgcctgaccttcgcccagcc

SEQ ID NO: 348763 - DNA, 23 bp, Artificial Sequence
  Description of Artificial Sequence: Synthetic oligonucleotide
cgcctgaccttcgcccagcccat

SEQ ID NO: 348764 - DNA, 24 bp, Artificial Sequence
  Description of Artificial Sequence: Synthetic oligonucleotide
gcctgaccttcgcccagcccatca

SEQ ID NO: 348765 - DNA, 24 bp, Artificial Sequence
  Description of Artificial Sequence: Synthetic oligonucleotide
cctgaccttcgcccagcccatcag

SEQ ID NO: 348766 - DNA, 25 bp, Artificial Sequence
  Description of Artificial Sequence: Synthetic oligonucleotide
ctgaccttcgcccagcccatcagga

SEQ ID NO: 348767 - DNA, 25 bp, Artificial Sequence
  Description of Artificial Sequence: Synthetic oligonucleotide
tgaccttcgcccagcccatcaggag

SEQ ID NO: 348768 - DNA, 24 bp, Artificial Sequence
  Description of Artificial Sequence: Synthetic oligonucleotide
gaccttcgcccagcccatcaggag

SEQ ID NO: 348769 - DNA, 25 bp, Artificial Sequence
  Description of Artificial Sequence: Synthetic oligonucleotide
accttcgcccagcccatcaggagct

SEQ ID NO: 348770 - DNA, 24 bp, Artificial Sequence
  Description of Artificial Sequence: Synthetic oligonucleotide
ccttcgcccagcccatcaggagct

SEQ ID NO: 348771 - DNA, 26 bp, Artificial Sequence
  Description of Artificial Sequence: Synthetic oligonucleotide
cttcgcccagcccatcaggagctgaa

SEQ ID NO: 348772 - DNA, 26 bp, Artificial Sequence
  Description of Artificial Sequence: Synthetic oligonucleotide
ttcgcccagcccatcaggagctgaag

SEQ ID NO: 348773 - DNA, 25 bp, Artificial Sequence
  Description of Artificial Sequence: Synthetic oligonucleotide
tcgcccagcccatcaggagctgaag

SEQ ID NO: 348774 - DNA, 24 bp, Artificial Sequence
  Description of Artificial Sequence: Synthetic oligonucleotide
cgcccagcccatcaggagctgaag

SEQ ID NO: 348775 - DNA, 24 bp, Artificial Sequence
  Description of Artificial Sequence: Synthetic oligonucleotide
gcccagcccatcaggagctgaagg

SEQ ID NO: 348776 - DNA, 25 bp, Artificial Sequence
  Description of Artificial Sequence: Synthetic oligonucleotide
cccagcccatcaggagctgaaggct

SEQ ID NO: 348777 - DNA, 25 bp, Artificial Sequence
  Description of Artificial Sequence: Synthetic oligonucleotide
ccagcccatcaggagctgaaggctc

SEQ ID NO: 348778 - DNA, 27 bp, Artificial Sequence
  Description of Artificial Sequence: Synthetic oligonucleotide
cagcccatcaggagctgaaggctccta

SEQ ID NO: 348779 - DNA, 27 bp, Artificial Sequence
  Description of Artificial Sequence: Synthetic oligonucleotide
agcccatcaggagctgaaggctcctac

SEQ ID NO: 348780 - DNA, 27 bp, Artificial Sequence
  Description of Artificial Sequence: Synthetic oligonucleotide
gcccatcaggagctgaaggctcctact

SEQ ID NO: 348781 - DNA, 32 bp, Artificial Sequence
  Description of Artificial Sequence: Synthetic oligonucleotide
cccatcaggagctgaaggctcctactttttag

SEQ ID NO: 348782 - DNA, 35 bp, Artificial Sequence
  Description of Artificial Sequence: Synthetic oligonucleotide
atggcccacatcatcctctatgtctttaccgtttc

SEQ ID NO: 348783 - DNA, 34 bp, Artificial Sequence
  Description of Artificial Sequence: Synthetic oligonucleotide
tggcccacatcatcctctatgtctttaccgtttc

SEQ ID NO: 348784 - DNA, 33 bp, Artificial Sequence
  Description of Artificial Sequence: Synthetic oligonucleotide
ggcccacatcatcctctatgtctttaccgtttc

SEQ ID NO: 348785 - DNA, 33 bp, Artificial Sequence
  Description of Artificial Sequence: Synthetic oligonucleotide
gcccacatcatcctctatgtctttaccgtttcc

SEQ ID NO: 348786 - DNA, 34 bp, Artificial Sequence
  Description of Artificial Sequence: Synthetic oligonucleotide
cccacatcatcctctatgtctttaccgtttccac

SEQ ID NO: 348787 - DNA, 41 bp, Artificial Sequence
  Description of Artificial Sequence: Synthetic oligonucleotide
ccacatcatcctctatgtctttaccgtttccactttatttc

SEQ ID NO: 348788 - DNA, 42 bp, Artificial Sequence
  Description of Artificial Sequence: Synthetic oligonucleotide
cacatcatcctctatgtctttaccgtttccactttatttcac

SEQ ID NO: 348789 - DNA, 42 bp, Artificial Sequence
  Description of Artificial Sequence: Synthetic oligonucleotide
acatcatcctctatgtctttaccgtttccactttatttcacg

SEQ ID NO: 348790 - DNA, 41 bp, Artificial Sequence
  Description of Artificial Sequence: Synthetic oligonucleotide
catcatcctctatgtctttaccgtttccactttatttcacg

SEQ ID NO: 348791 - DNA, 43 bp, Artificial Sequence
  Description of Artificial Sequence: Synthetic oligonucleotide
atcatcctctatgtctttaccgtttccactttatttcacgatc

SEQ ID NO: 348792 - DNA, 42 bp, Artificial Sequence
  Description of Artificial Sequence: Synthetic oligonucleotide
tcatcctctatgtctttaccgtttccactttatttcacgatc

SEQ ID NO: 348793 - DNA, 41 bp, Artificial Sequence
  Description of Artificial Sequence: Synthetic oligonucleotide
catcctctatgtctttaccgtttccactttatttcacgatc

SEQ ID NO: 348794 - DNA, 42 bp, Artificial Sequence
  Description of Artificial Sequence: Synthetic oligonucleotide
atcctctatgtctttaccgtttccactttatttcacgatcag

SEQ ID NO: 348795 - DNA, 41 bp, Artificial Sequence
  Description of Artificial Sequence: Synthetic oligonucleotide
tcctctatgtctttaccgtttccactttatttcacgatcag

SEQ ID NO: 348796 - DNA, 40 bp, Artificial Sequence
  Description of Artificial Sequence: Synthetic oligonucleotide
cctctatgtctttaccgtttccactttatttcacgatcag

SEQ ID NO: 348797 - DNA, 40 bp, Artificial Sequence
  Description of Artificial Sequence: Synthetic oligonucleotide
ctctatgtctttaccgtttccactttatttcacgatcagc

SEQ ID NO: 348798 - DNA, 41 bp, Artificial Sequence
  Description of Artificial Sequence: Synthetic oligonucleotide
tctatgtctttaccgtttccactttatttcacgatcagcag

SEQ ID NO: 348799 - DNA, 40 bp, Artificial Sequence
  Description of Artificial Sequence: Synthetic oligonucleotide
ctatgtctttaccgtttccactttatttcacgatcagcag

SEQ ID NO: 348800 - DNA, 40 bp, Artificial Sequence
  Description of Artificial Sequence: Synthetic oligonucleotide
tatgtctttaccgtttccactttatttcacgatcagcagc

SEQ ID NO: 348801 - DNA, 39 bp, Artificial Sequence
  Description of Artificial Sequence: Synthetic oligonucleotide
atgtctttaccgtttccactttatttcacgatcagcagc

SEQ ID NO: 348802 - DNA, 38 bp, Artificial Sequence
  Description of Artificial Sequence: Synthetic oligonucleotide
tgtctttaccgtttccactttatttcacgatcagcagc

SEQ ID NO: 348803 - DNA, 37 bp, Artificial Sequence
  Description of Artificial Sequence: Synthetic oligonucleotide
gtctttaccgtttccactttatttcacgatcagcagc

SEQ ID NO: 348804 - DNA, 37 bp, Artificial Sequence
  Description of Artificial Sequence: Synthetic oligonucleotide
tctttaccgtttccactttatttcacgatcagcagcg

SEQ ID NO: 348805 - DNA, 36 bp, Artificial Sequence
  Description of Artificial Sequence: Synthetic oligonucleotide
ctttaccgtttccactttatttcacgatcagcagcg

SEQ ID NO: 348806 - DNA, 36 bp, Artificial Sequence
  Description of Artificial Sequence: Synthetic oligonucleotide
tttaccgtttccactttatttcacgatcagcagcgc

SEQ ID NO: 348807 - DNA, 35 bp, Artificial Sequence
  Description of Artificial Sequence: Synthetic oligonucleotide
ttaccgtttccactttatttcacgatcagcagcgc

SEQ ID NO: 348808 - DNA, 34 bp, Artificial Sequence
  Description of Artificial Sequence: Synthetic oligonucleotide
taccgtttccactttatttcacgatcagcagcgc

SEQ ID NO: 348809 - DNA, 33 bp, Artificial Sequence
  Description of Artificial Sequence: Synthetic oligonucleotide
accgtttccactttatttcacgatcagcagcgc

SEQ ID NO: 348810 - DNA, 32 bp, Artificial Sequence
  Description of Artificial Sequence: Synthetic oligonucleotide
ccgtttccactttatttcacgatcagcagcgc

SEQ ID NO: 348811 - DNA, 32 bp, Artificial Sequence
  Description of Artificial Sequence: Synthetic oligonucleotide
cgtttccactttatttcacgatcagcagcgcc

SEQ ID NO: 348812 - DNA, 34 bp, Artificial Sequence
  Description of Artificial Sequence: Synthetic oligonucleotide
gtttccactttatttcacgatcagcagcgcctag

SEQ ID NO: 348813 - DNA, 34 bp, Artificial Sequence
  Description of Artificial Sequence: Synthetic oligonucleotide
tttccactttatttcacgatcagcagcgcctagc

SEQ ID NO: 348814 - DNA, 33 bp, Artificial Sequence
  Description of Artificial Sequence: Synthetic oligonucleotide
ttccactttatttcacgatcagcagcgcctagc

SEQ ID NO: 348815 - DNA, 32 bp, Artificial Sequence
  Description of Artificial Sequence: Synthetic oligonucleotide
tccactttatttcacgatcagcagcgcctagc

SEQ ID NO: 348816 - DNA, 31 bp, Artificial Sequence
  Description of Artificial Sequence: Synthetic oligonucleotide
ccactttatttcacgatcagcagcgcctagc

SEQ ID NO: 348817 - DNA, 31 bp, Artificial Sequence
  Description of Artificial Sequence: Synthetic oligonucleotide
cactttatttcacgatcagcagcgcctagcg

SEQ ID NO: 348818 - DNA, 33 bp, Artificial Sequence
  Description of Artificial Sequence: Synthetic oligonucleotide
actttatttcacgatcagcagcgcctagcgaag

SEQ ID NO: 348819 - DNA, 32 bp, Artificial Sequence
  Description of Artificial Sequence: Synthetic oligonucleotide
ctttatttcacgatcagcagcgcctagcgaag

SEQ ID NO: 348820 - DNA, 35 bp, Artificial Sequence
  Description of Artificial Sequence: Synthetic oligonucleotide
tttatttcacgatcagcagcgcctagcgaagtttc

SEQ ID NO: 348821 - DNA, 34 bp, Artificial Sequence
  Description of Artificial Sequence: Synthetic oligonucleotide
ttatttcacgatcagcagcgcctagcgaagtttc

SEQ ID NO: 348822 - DNA, 33 bp, Artificial Sequence
  Description of Artificial Sequence: Synthetic oligonucleotide
tatttcacgatcagcagcgcctagcgaagtttc

SEQ ID NO: 348823 - DNA, 32 bp, Artificial Sequence
  Description of Artificial Sequence: Synthetic oligonucleotide
atttcacgatcagcagcgcctagcgaagtttc

SEQ ID NO: 348824 - DNA, 31 bp, Artificial Sequence
  Description of Artificial Sequence: Synthetic oligonucleotide
tttcacgatcagcagcgcctagcgaagtttc

SEQ ID NO: 348825 - DNA, 30 bp, Artificial Sequence
  Description of Artificial Sequence: Synthetic oligonucleotide
ttcacgatcagcagcgcctagcgaagtttc

SEQ ID NO: 348826 - DNA, 29 bp, Artificial Sequence
  Description of Artificial Sequence: Synthetic oligonucleotide
tcacgatcagcagcgcctagcgaagtttc

SEQ ID NO: 348827 - DNA, 28 bp, Artificial Sequence
  Description of Artificial Sequence: Synthetic oligonucleotide
cacgatcagcagcgcctagcgaagtttc

SEQ ID NO: 348828 - DNA, 30 bp, Artificial Sequence
  Description of Artificial Sequence: Synthetic oligonucleotide
acgatcagcagcgcctagcgaagtttcaag

SEQ ID NO: 348829 - DNA, 29 bp, Artificial Sequence
  Description of Artificial Sequence: Synthetic oligonucleotide
cgatcagcagcgcctagcgaagtttcaag

SEQ ID NO: 348830 - DNA, 29 bp, Artificial Sequence
  Description of Artificial Sequence: Synthetic oligonucleotide
gatcagcagcgcctagcgaagtttcaagc

SEQ ID NO: 348831 - DNA, 29 bp, Artificial Sequence
  Description of Artificial Sequence: Synthetic oligonucleotide
atcagcagcgcctagcgaagtttcaagcc

SEQ ID NO: 348832 - DNA, 28 bp, Artificial Sequence
  Description of Artificial Sequence: Synthetic oligonucleotide
tcagcagcgcctagcgaagtttcaagcc

SEQ ID NO: 348833 - DNA, 27 bp, Artificial Sequence
  Description of Artificial Sequence: Synthetic oligonucleotide
cagcagcgcctagcgaagtttcaagcc

SEQ ID NO: 348834 - DNA, 29 bp, Artificial Sequence
  Description of Artificial Sequence: Synthetic oligonucleotide
agcagcgcctagcgaagtttcaagccaag

SEQ ID NO: 348835 - DNA, 28 bp, Artificial Sequence
  Description of Artificial Sequence: Synthetic oligonucleotide
gcagcgcctagcgaagtttcaagccaag

SEQ ID NO: 348836 - DNA, 29 bp, Artificial Sequence
  Description of Artificial Sequence: Synthetic oligonucleotide
cagcgcctagcgaagtttcaagccaagtg

SEQ ID NO: 348837 - DNA, 29 bp, Artificial Sequence
  Description of Artificial Sequence: Synthetic oligonucleotide
agcgcctagcgaagtttcaagccaagtgg

SEQ ID NO: 348838 - DNA, 28 bp, Artificial Sequence
  Description of Artificial Sequence: Synthetic oligonucleotide
gcgcctagcgaagtttcaagccaagtgg

SEQ ID NO: 348839 - DNA, 28 bp, Artificial Sequence
  Description of Artificial Sequence: Synthetic oligonucleotide
cgcctagcgaagtttcaagccaagtggg

SEQ ID NO: 348840 - DNA, 29 bp, Artificial Sequence
  Description of Artificial Sequence: Synthetic oligonucleotide
gcctagcgaagtttcaagccaagtgggag

SEQ ID NO: 348841 - DNA, 32 bp, Artificial Sequence
  Description of Artificial Sequence: Synthetic oligonucleotide
cctagcgaagtttcaagccaagtgggagtttc

SEQ ID NO: 348842 - DNA, 32 bp, Artificial Sequence
  Description of Artificial Sequence: Synthetic oligonucleotide
ctagcgaagtttcaagccaagtgggagtttcc

SEQ ID NO: 348843 - DNA, 32 bp, Artificial Sequence
  Description of Artificial Sequence: Synthetic oligonucleotide
tagcgaagtttcaagccaagtgggagtttccg

SEQ ID NO: 348844 - DNA, 31 bp, Artificial Sequence
  Description of Artificial Sequence: Synthetic oligonucleotide
agcgaagtttcaagccaagtgggagtttccg

SEQ ID NO: 348845 - DNA, 30 bp, Artificial Sequence
  Description of Artificial Sequence: Synthetic oligonucleotide
gcgaagtttcaagccaagtgggagtttccg

SEQ ID NO: 348846 - DNA, 30 bp, Artificial Sequence
  Description of Artificial Sequence: Synthetic oligonucleotide
cgaagtttcaagccaagtgggagtttccgg

SEQ ID NO: 348847 - DNA, 31 bp, Artificial Sequence
  Description of Artificial Sequence: Synthetic oligonucleotide
gaagtttcaagccaagtgggagtttccggtg

SEQ ID NO: 348848 - DNA, 31 bp, Artificial Sequence
  Description of Artificial Sequence: Synthetic oligonucleotide
aagtttcaagccaagtgggagtttccggtgc

SEQ ID NO: 348849 - DNA, 30 bp, Artificial Sequence
  Description of Artificial Sequence: Synthetic oligonucleotide
agtttcaagccaagtgggagtttccggtgc

SEQ ID NO: 348850 - DNA, 29 bp, Artificial Sequence
  Description of Artificial Sequence: Synthetic oligonucleotide
gtttcaagccaagtgggagtttccggtgc

SEQ ID NO: 348851 - DNA, 30 bp, Artificial Sequence
  Description of Artificial Sequence: Synthetic oligonucleotide
tttcaagccaagtgggagtttccggtgcag

SEQ ID NO: 348852 - DNA, 29 bp, Artificial Sequence
  Description of Artificial Sequence: Synthetic oligonucleotide
ttcaagccaagtgggagtttccggtgcag

SEQ ID NO: 348853 - DNA, 28 bp, Artificial Sequence
  Description of Artificial Sequence: Synthetic oligonucleotide
tcaagccaagtgggagtttccggtgcag

SEQ ID NO: 348854 - DNA, 27 bp, Artificial Sequence
  Description of Artificial Sequence: Synthetic oligonucleotide
caagccaagtgggagtttccggtgcag

SEQ ID NO: 348855 - DNA, 30 bp, Artificial Sequence
  Description of Artificial Sequence: Synthetic oligonucleotide
aagccaagtgggagtttccggtgcagttac

SEQ ID NO: 348856 - DNA, 29 bp, Artificial Sequence
  Description of Artificial Sequence: Synthetic oligonucleotide
agccaagtgggagtttccggtgcagttac

SEQ ID NO: 348857 - DNA, 28 bp, Artificial Sequence
  Description of Artificial Sequence: Synthetic oligonucleotide
gccaagtgggagtttccggtgcagttac

SEQ ID NO: 348858 - DNA, 28 bp, Artificial Sequence
  Description of Artificial Sequence: Synthetic oligonucleotide
ccaagtgggagtttccggtgcagttacc

SEQ ID NO: 348859 - DNA, 29 bp, Artificial Sequence
  Description of Artificial Sequence: Synthetic oligonucleotide
caagtgggagtttccggtgcagttaccag

SEQ ID NO: 348860 - DNA, 30 bp, Artificial Sequence
  Description of Artificial Sequence: Synthetic oligonucleotide
aagtgggagtttccggtgcagttaccagtg

SEQ ID NO: 348861 - DNA, 29 bp, Artificial Sequence
  Description of Artificial Sequence: Synthetic oligonucleotide
agtgggagtttccggtgcagttaccagtg

SEQ ID NO: 348862 - DNA, 28 bp, Artificial Sequence
  Description of Artificial Sequence: Synthetic oligonucleotide
gtgggagtttccggtgcagttaccagtg

SEQ ID NO: 348863 - DNA, 28 bp, Artificial Sequence
  Description of Artificial Sequence: Synthetic oligonucleotide
tgggagtttccggtgcagttaccagtgc

SEQ ID NO: 348864 - DNA, 27 bp, Artificial Sequence
  Description of Artificial Sequence: Synthetic oligonucleotide
gggagtttccggtgcagttaccagtgc

SEQ ID NO: 348865 - DNA, 29 bp, Artificial Sequence
  Description of Artificial Sequence: Synthetic oligonucleotide
ggagtttccggtgcagttaccagtgcaag

SEQ ID NO: 348866 - DNA, 29 bp, Artificial Sequence
  Description of Artificial Sequence: Synthetic oligonucleotide
gagtttccggtgcagttaccagtgcaagc

SEQ ID NO: 348867 - DNA, 29 bp, Artificial Sequence
  Description of Artificial Sequence: Synthetic oligonucleotide
agtttccggtgcagttaccagtgcaagcc

SEQ ID NO: 348868 - DNA, 28 bp, Artificial Sequence
  Description of Artificial Sequence: Synthetic oligonucleotide
gtttccggtgcagttaccagtgcaagcc

SEQ ID NO: 348869 - DNA, 29 bp, Artificial Sequence
  Description of Artificial Sequence: Synthetic oligonucleotide
tttccggtgcagttaccagtgcaagcctc

SEQ ID NO: 348870 - DNA, 28 bp, Artificial Sequence
  Description of Artificial Sequence: Synthetic oligonucleotide
ttccggtgcagttaccagtgcaagcctc

SEQ ID NO: 348871 - DNA, 27 bp, Artificial Sequence
  Description of Artificial Sequence: Synthetic oligonucleotide
tccggtgcagttaccagtgcaagcctc

SEQ ID NO: 348872 - DNA, 27 bp, Artificial Sequence
  Description of Artificial Sequence: Synthetic oligonucleotide
ccggtgcagttaccagtgcaagcctca

SEQ ID NO: 348873 - DNA, 28 bp, Artificial Sequence
  Description of Artificial Sequence: Synthetic oligonucleotide
cggtgcagttaccagtgcaagcctcaac

SEQ ID NO: 348874 - DNA, 30 bp, Artificial Sequence
  Description of Artificial Sequence: Synthetic oligonucleotide
ggtgcagttaccagtgcaagcctcaacttc

SEQ ID NO: 348875 - DNA, 33 bp, Artificial Sequence
  Description of Artificial Sequence: Synthetic oligonucleotide
gtgcagttaccagtgcaagcctcaacttcaaag

SEQ ID NO: 348876 - DNA, 33 bp, Artificial Sequence
  Description of Artificial Sequence: Synthetic oligonucleotide
tgcagttaccagtgcaagcctcaacttcaaagg

SEQ ID NO: 348877 - DNA, 32 bp, Artificial Sequence
  Description of Artificial Sequence: Synthetic oligonucleotide
gcagttaccagtgcaagcctcaacttcaaagg

SEQ ID NO: 348878 - DNA, 32 bp, Artificial Sequence
  Description of Artificial Sequence: Synthetic oligonucleotide
cagttaccagtgcaagcctcaacttcaaaggc

SEQ ID NO: 348879 - DNA, 33 bp, Artificial Sequence
  Description of Artificial Sequence: Synthetic oligonucleotide
agttaccagtgcaagcctcaacttcaaaggcag

SEQ ID NO: 348880 - DNA, 32 bp, Artificial Sequence
  Description of Artificial Sequence: Synthetic oligonucleotide
gttaccagtgcaagcctcaacttcaaaggcag

SEQ ID NO: 348881 - DNA, 33 bp, Artificial Sequence
  Description of Artificial Sequence: Synthetic oligonucleotide
ttaccagtgcaagcctcaacttcaaaggcagtg

SEQ ID NO: 348882 - DNA, 32 bp, Artificial Sequence
  Description of Artificial Sequence: Synthetic oligonucleotide
taccagtgcaagcctcaacttcaaaggcagtg

SEQ ID NO: 348883 - DNA, 31 bp, Artificial Sequence
  Description of Artificial Sequence: Synthetic oligonucleotide
accagtgcaagcctcaacttcaaaggcagtg

SEQ ID NO: 348884 - DNA, 30 bp, Artificial Sequence
  Description of Artificial Sequence: Synthetic oligonucleotide
ccagtgcaagcctcaacttcaaaggcagtg

SEQ ID NO: 348885 - DNA, 30 bp, Artificial Sequence
  Description of Artificial Sequence: Synthetic oligonucleotide
cagtgcaagcctcaacttcaaaggcagtgg

SEQ ID NO: 348886 - DNA, 30 bp, Artificial Sequence
  Description of Artificial Sequence: Synthetic oligonucleotide
agtgcaagcctcaacttcaaaggcagtggg

SEQ ID NO: 348887 - DNA, 29 bp, Artificial Sequence
  Description of Artificial Sequence: Synthetic oligonucleotide
gtgcaagcctcaacttcaaaggcagtggg

SEQ ID NO: 348888 - DNA, 30 bp, Artificial Sequence
  Description of Artificial Sequence: Synthetic oligonucleotide
tgcaagcctcaacttcaaaggcagtgggac

SEQ ID NO: 348889 - DNA, 29 bp, Artificial Sequence
  Description of Artificial Sequence: Synthetic oligonucleotide
gcaagcctcaacttcaaaggcagtgggac

SEQ ID NO: 348890 - DNA, 29 bp, Artificial Sequence
  Description of Artificial Sequence: Synthetic oligonucleotide
caagcctcaacttcaaaggcagtgggacc

SEQ ID NO: 348891 - DNA, 29 bp, Artificial Sequence
  Description of Artificial Sequence: Synthetic oligonucleotide
aagcctcaacttcaaaggcagtgggaccc

SEQ ID NO: 348892 - DNA, 28 bp, Artificial Sequence
  Description of Artificial Sequence: Synthetic oligonucleotide
agcctcaacttcaaaggcagtgggaccc

SEQ ID NO: 348893 - DNA, 27 bp, Artificial Sequence
  Description of Artificial Sequence: Synthetic oligonucleotide
gcctcaacttcaaaggcagtgggaccc

SEQ ID NO: 348894 - DNA, 28 bp, Artificial Sequence
  Description of Artificial Sequence: Synthetic oligonucleotide
cctcaacttcaaaggcagtgggacccac

SEQ ID NO: 348895 - DNA, 28 bp, Artificial Sequence
  Description of Artificial Sequence: Synthetic oligonucleotide
ctcaacttcaaaggcagtgggacccacc

SEQ ID NO: 348896 - DNA, 28 bp, Artificial Sequence
  Description of Artificial Sequence: Synthetic oligonucleotide
tcaacttcaaaggcagtgggacccaccc

SEQ ID NO: 348897 - DNA, 27 bp, Artificial Sequence
  Description of Artificial Sequence: Synthetic oligonucleotide
caacttcaaaggcagtgggacccaccc

SEQ ID NO: 348898 - DNA, 28 bp, Artificial Sequence
  Description of Artificial Sequence: Synthetic oligonucleotide
aacttcaaaggcagtgggacccacccag

SEQ ID NO: 348899 - DNA, 27 bp, Artificial Sequence
  Description of Artificial Sequence: Synthetic oligonucleotide
acttcaaaggcagtgggacccacccag

SEQ ID NO: 348900 - DNA, 26 bp, Artificial Sequence
  Description of Artificial Sequence: Synthetic oligonucleotide
cttcaaaggcagtgggacccacccag

SEQ ID NO: 348901 - DNA, 27 bp, Artificial Sequence
  Description of Artificial Sequence: Synthetic oligonucleotide
ttcaaaggcagtgggacccacccagct

SEQ ID NO: 348902 - DNA, 26 bp, Artificial Sequence
  Description of Artificial Sequence: Synthetic oligonucleotide
tcaaaggcagtgggacccacccagct

SEQ ID NO: 348903 - DNA, 25 bp, Artificial Sequence
  Description of Artificial Sequence: Synthetic oligonucleotide
caaaggcagtgggacccacccagct

SEQ ID NO: 348904 - DNA, 26 bp, Artificial Sequence
  Description of Artificial Sequence: Synthetic oligonucleotide
aaaggcagtgggacccacccagctca

SEQ ID NO: 348905 - DNA, 25 bp, Artificial Sequence
  Description of Artificial Sequence: Synthetic oligonucleotide
aaggcagtgggacccacccagctca

SEQ ID NO: 348906 - DNA, 24 bp, Artificial Sequence
  Description of Artificial Sequence: Synthetic oligonucleotide
aggcagtgggacccacccagctca

SEQ ID NO: 348907 - DNA, 23 bp, Artificial Sequence
  Description of Artificial Sequence: Synthetic oligonucleotide
ggcagtgggacccacccagctca

SEQ ID NO: 348908 - DNA, 23 bp, Artificial Sequence
  Description of Artificial Sequence: Synthetic oligonucleotide
gcagtgggacccacccagctcag

SEQ ID NO: 348909 - DNA, 23 bp, Artificial Sequence
  Description of Artificial Sequence: Synthetic oligonucleotide
cagtgggacccacccagctcagc

SEQ ID NO: 348910 - DNA, 23 bp, Artificial Sequence
  Description of Artificial Sequence: Synthetic oligonucleotide
agtgggacccacccagctcagcg

SEQ ID NO: 348911 - DNA, 22 bp, Artificial Sequence
  Description of Artificial Sequence: Synthetic oligonucleotide
gtgggacccacccagctcagcg

SEQ ID NO: 348912 - DNA, 22 bp, Artificial Sequence
  Description of Artificial Sequence: Synthetic oligonucleotide
tgggacccacccagctcagcgg

SEQ ID NO: 348913 - DNA, 21 bp, Artificial Sequence
  Description of Artificial Sequence: Synthetic oligonucleotide
gggacccacccagctcagcgg

SEQ ID NO: 348914 - DNA, 23 bp, Artificial Sequence
  Description of Artificial Sequence: Synthetic oligonucleotide
ggacccacccagctcagcgggat

SEQ ID NO: 348915 - DNA, 24 bp, Artificial Sequence
  Description of Artificial Sequence: Synthetic oligonucleotide
gacccacccagctcagcgggatgt

SEQ ID NO: 348916 - DNA, 24 bp, Artificial Sequence
  Description of Artificial Sequence: Synthetic oligonucleotide
acccacccagctcagcgggatgtg

SEQ ID NO: 348917 - DNA, 23 bp, Artificial Sequence
  Description of Artificial Sequence: Synthetic oligonucleotide
cccacccagctcagcgggatgtg

SEQ ID NO: 348918 - DNA, 24 bp, Artificial Sequence
  Description of Artificial Sequence: Synthetic oligonucleotide
ccacccagctcagcgggatgtggt

SEQ ID NO: 348919 - DNA, 24 bp, Artificial Sequence
  Description of Artificial Sequence: Synthetic oligonucleotide
cacccagctcagcgggatgtggtc

SEQ ID NO: 348920 - DNA, 26 bp, Artificial Sequence
  Description of Artificial Sequence: Synthetic oligonucleotide
acccagctcagcgggatgtggtcgat

SEQ ID NO: 348921 - DNA, 25 bp, Artificial Sequence
  Description of Artificial Sequence: Synthetic oligonucleotide
cccagctcagcgggatgtggtcgat

SEQ ID NO: 348922 - DNA, 27 bp, Artificial Sequence
  Description of Artificial Sequence: Synthetic oligonucleotide
ccagctcagcgggatgtggtcgatcaa

SEQ ID NO: 348923 - DNA, 28 bp, Artificial Sequence
  Description of Artificial Sequence: Synthetic oligonucleotide
cagctcagcgggatgtggtcgatcaatg

SEQ ID NO: 348924 - DNA, 28 bp, Artificial Sequence
  Description of Artificial Sequence: Synthetic oligonucleotide
agctcagcgggatgtggtcgatcaatgg

SEQ ID NO: 348925 - DNA, 27 bp, Artificial Sequence
  Description of Artificial Sequence: Synthetic oligonucleotide
gctcagcgggatgtggtcgatcaatgg

SEQ ID NO: 348926 - DNA, 31 bp, Artificial Sequence
  Description of Artificial Sequence: Synthetic oligonucleotide
ctcagcgggatgtggtcgatcaatggaatag

SEQ ID NO: 348927 - DNA, 31 bp, Artificial Sequence
  Description of Artificial Sequence: Synthetic oligonucleotide
tcagcgggatgtggtcgatcaatggaatagg

SEQ ID NO: 348928 - DNA, 30 bp, Artificial Sequence
  Description of Artificial Sequence: Synthetic oligonucleotide
cagcgggatgtggtcgatcaatggaatagg

SEQ ID NO: 348929 - DNA, 30 bp, Artificial Sequence
  Description of Artificial Sequence: Synthetic oligonucleotide
agcgggatgtggtcgatcaatggaataggc

SEQ ID NO: 348930 - DNA, 29 bp, Artificial Sequence
  Description of Artificial Sequence: Synthetic oligonucleotide
gcgggatgtggtcgatcaatggaataggc

SEQ ID NO: 348931 - DNA, 29 bp, Artificial Sequence
  Description of Artificial Sequence: Synthetic oligonucleotide
cgggatgtggtcgatcaatggaataggcc

SEQ ID NO: 348932 - DNA, 29 bp, Artificial Sequence
  Description of Artificial Sequence: Synthetic oligonucleotide
gggatgtggtcgatcaatggaataggccg

SEQ ID NO: 348933 - DNA, 29 bp, Artificial Sequence
  Description of Artificial Sequence: Synthetic oligonucleotide
ggatgtggtcgatcaatggaataggccgg

SEQ ID NO: 348934 - DNA, 29 bp, Artificial Sequence
  Description of Artificial Sequence: Synthetic oligonucleotide
gatgtggtcgatcaatggaataggccggc

SEQ ID NO: 348935 - DNA, 30 bp, Artificial Sequence
  Description of Artificial Sequence: Synthetic oligonucleotide
atgtggtcgatcaatggaataggccggctg

SEQ ID NO: 348936 - DNA, 29 bp, Artificial Sequence
  Description of Artificial Sequence: Synthetic oligonucleotide
tgtggtcgatcaatggaataggccggctg

SEQ ID NO: 348937 - DNA, 28 bp, Artificial Sequence
  Description of Artificial Sequence: Synthetic oligonucleotide
gtggtcgatcaatggaataggccggctg

SEQ ID NO: 348938 - DNA, 28 bp, Artificial Sequence
  Description of Artificial Sequence: Synthetic oligonucleotide
tggtcgatcaatggaataggccggctgg

SEQ ID NO: 348939 - DNA, 27 bp, Artificial Sequence
  Description of Artificial Sequence: Synthetic oligonucleotide
ggtcgatcaatggaataggccggctgg

SEQ ID NO: 348940 - DNA, 27 bp, Artificial Sequence
  Description of Artificial Sequence: Synthetic oligonucleotide
gtcgatcaatggaataggccggctggg

SEQ ID NO: 348941 - DNA, 27 bp, Artificial Sequence
  Description of Artificial Sequence: Synthetic oligonucleotide
tcgatcaatggaataggccggctgggg

SEQ ID NO: 348942 - DNA, 27 bp, Artificial Sequence
  Description of Artificial Sequence: Synthetic oligonucleotide
cgatcaatggaataggccggctgggga

SEQ ID NO: 348943 - DNA, 28 bp, Artificial Sequence
  Description of Artificial Sequence: Synthetic oligonucleotide
gatcaatggaataggccggctggggaac

SEQ ID NO: 348944 - DNA, 28 bp, Artificial Sequence
  Description of Artificial Sequence: Synthetic oligonucleotide
atcaatggaataggccggctggggaacg

SEQ ID NO: 348945 - DNA, 27 bp, Artificial Sequence
  Description of Artificial Sequence: Synthetic oligonucleotide
tcaatggaataggccggctggggaacg

SEQ ID NO: 348946 - DNA, 27 bp, Artificial Sequence
  Description of Artificial Sequence: Synthetic oligonucleotide
caatggaataggccggctggggaacga

SEQ ID NO: 348947 - DNA, 27 bp, Artificial Sequence
  Description of Artificial Sequence: Synthetic oligonucleotide
aatggaataggccggctggggaacgag

SEQ ID NO: 348948 - DNA, 27 bp, Artificial Sequence
  Description of Artificial Sequence: Synthetic oligonucleotide
atggaataggccggctggggaacgaga

SEQ ID NO: 348949 - DNA, 27 bp, Artificial Sequence
  Description of Artificial Sequence: Synthetic oligonucleotide
tggaataggccggctggggaacgagat

SEQ ID NO: 348950 - DNA, 26 bp, Artificial Sequence
  Description of Artificial Sequence: Synthetic oligonucleotide
ggaataggccggctggggaacgagat

SEQ ID NO: 348951 - DNA, 26 bp, Artificial Sequence
  Description of Artificial Sequence: Synthetic oligonucleotide
gaataggccggctggggaacgagatg

SEQ ID NO: 348952 - DNA, 26 bp, Artificial Sequence
  Description of Artificial Sequence: Synthetic oligonucleotide
aataggccggctggggaacgagatgg

SEQ ID NO: 348953 - DNA, 25 bp, Artificial Sequence
  Description of Artificial Sequence: Synthetic oligonucleotide
ataggccggctggggaacgagatgg

SEQ ID NO: 348954 - DNA, 24 bp, Artificial Sequence
  Description of Artificial Sequence: Synthetic oligonucleotide
taggccggctggggaacgagatgg

SEQ ID NO: 348955 - DNA, 23 bp, Artificial Sequence
  Description of Artificial Sequence: Synthetic oligonucleotide
aggccggctggggaacgagatgg

SEQ ID NO: 348956 - DNA, 22 bp, Artificial Sequence
  Description of Artificial Sequence: Synthetic oligonucleotide
ggccggctggggaacgagatgg

SEQ ID NO: 348957 - DNA, 22 bp, Artificial Sequence
  Description of Artificial Sequence: Synthetic oligonucleotide
gccggctggggaacgagatggg

SEQ ID NO: 348958 - DNA, 22 bp, Artificial Sequence
  Description of Artificial Sequence: Synthetic oligonucleotide
ccggctggggaacgagatgggc

SEQ ID NO: 348959 - DNA, 23 bp, Artificial Sequence
  Description of Artificial Sequence: Synthetic oligonucleotide
cggctggggaacgagatgggcgt

SEQ ID NO: 348960 - DNA, 25 bp, Artificial Sequence
  Description of Artificial Sequence: Synthetic oligonucleotide
ggctggggaacgagatgggcgtgta

SEQ ID NO: 348961 - DNA, 25 bp, Artificial Sequence
  Description of Artificial Sequence: Synthetic oligonucleotide
gctggggaacgagatgggcgtgtac

SEQ ID NO: 348962 - DNA, 25 bp, Artificial Sequence
  Description of Artificial Sequence: Synthetic oligonucleotide
ctggggaacgagatgggcgtgtacg

SEQ ID NO: 348963 - DNA, 25 bp, Artificial Sequence
  Description of Artificial Sequence: Synthetic oligonucleotide
tggggaacgagatgggcgtgtacgc

SEQ ID NO: 348964 - DNA, 24 bp, Artificial Sequence
  Description of Artificial Sequence: Synthetic oligonucleotide
ggggaacgagatgggcgtgtacgc

SEQ ID NO: 348965 - DNA, 25 bp, Artificial Sequence
  Description of Artificial Sequence: Synthetic oligonucleotide
gggaacgagatgggcgtgtacgcca

SEQ ID NO: 348966 - DNA, 26 bp, Artificial Sequence
  Description of Artificial Sequence: Synthetic oligonucleotide
ggaacgagatgggcgtgtacgccact

SEQ ID NO: 348967 - DNA, 27 bp, Artificial Sequence
  Description of Artificial Sequence: Synthetic oligonucleotide
gaacgagatgggcgtgtacgccactct

SEQ ID NO: 348968 - DNA, 27 bp, Artificial Sequence
  Description of Artificial Sequence: Synthetic oligonucleotide
aacgagatgggcgtgtacgccactctg

SEQ ID NO: 348969 - DNA, 27 bp, Artificial Sequence
  Description of Artificial Sequence: Synthetic oligonucleotide
acgagatgggcgtgtacgccactctgt

SEQ ID NO: 348970 - DNA, 27 bp, Artificial Sequence
  Description of Artificial Sequence: Synthetic oligonucleotide
cgagatgggcgtgtacgccactctgta

SEQ ID NO: 348971 - DNA, 27 bp, Artificial Sequence
  Description of Artificial Sequence: Synthetic oligonucleotide
gagatgggcgtgtacgccactctgtac

SEQ ID NO: 348972 - DNA, 27 bp, Artificial Sequence
  Description of Artificial Sequence: Synthetic oligonucleotide
agatgggcgtgtacgccactctgtacg

SEQ ID NO: 348973 - DNA, 26 bp, Artificial Sequence
  Description of Artificial Sequence: Synthetic oligonucleotide
gatgggcgtgtacgccactctgtacg

SEQ ID NO: 348974 - DNA, 26 bp, Artificial Sequence
  Description of Artificial Sequence: Synthetic oligonucleotide
atgggcgtgtacgccactctgtacgc

SEQ ID NO: 348975 - DNA, 25 bp, Artificial Sequence
  Description of Artificial Sequence: Synthetic oligonucleotide
tgggcgtgtacgccactctgtacgc

SEQ ID NO: 348976 - DNA, 24 bp, Artificial Sequence
  Description of Artificial Sequence: Synthetic oligonucleotide
gggcgtgtacgccactctgtacgc

SEQ ID NO: 348977 - DNA, 24 bp, Artificial Sequence
  Description of Artificial Sequence: Synthetic oligonucleotide
ggcgtgtacgccactctgtacgcc

SEQ ID NO: 348978 - DNA, 25 bp, Artificial Sequence
  Description of Artificial Sequence: Synthetic oligonucleotide
gcgtgtacgccactctgtacgccgt

SEQ ID NO: 348979 - DNA, 25 bp, Artificial Sequence
  Description of Artificial Sequence: Synthetic oligonucleotide
cgtgtacgccactctgtacgccgtg

SEQ ID NO: 348980 - DNA, 25 bp, Artificial Sequence
  Description of Artificial Sequence: Synthetic oligonucleotide
gtgtacgccactctgtacgccgtgg

SEQ ID NO: 348981 - DNA, 25 bp, Artificial Sequence
  Description of Artificial Sequence: Synthetic oligonucleotide
tgtacgccactctgtacgccgtggc

SEQ ID NO: 348982 - DNA, 24 bp, Artificial Sequence
  Description of Artificial Sequence: Synthetic oligonucleotide
gtacgccactctgtacgccgtggc

SEQ ID NO: 348983 - DNA, 26 bp, Artificial Sequence
  Description of Artificial Sequence: Synthetic oligonucleotide
tacgccactctgtacgccgtggccaa

SEQ ID NO: 348984 - DNA, 25 bp, Artificial Sequence
  Description of Artificial Sequence: Synthetic oligonucleotide
acgccactctgtacgccgtggccaa

SEQ ID NO: 348985 - DNA, 24 bp, Artificial Sequence
  Description of Artificial Sequence: Synthetic oligonucleotide
cgccactctgtacgccgtggccaa

SEQ ID NO: 348986 - DNA, 26 bp, Artificial Sequence
  Description of Artificial Sequence: Synthetic oligonucleotide
gccactctgtacgccgtggccaagaa

SEQ ID NO: 348987 - DNA, 27 bp, Artificial Sequence
  Description of Artificial Sequence: Synthetic oligonucleotide
ccactctgtacgccgtggccaagaaga

SEQ ID NO: 348988 - DNA, 28 bp, Artificial Sequence
  Description of Artificial Sequence: Synthetic oligonucleotide
cactctgtacgccgtggccaagaagaac

SEQ ID NO: 348989 - DNA, 28 bp, Artificial Sequence
  Description of Artificial Sequence: Synthetic oligonucleotide
actctgtacgccgtggccaagaagaacg

SEQ ID NO: 348990 - DNA, 27 bp, Artificial Sequence
  Description of Artificial Sequence: Synthetic oligonucleotide
ctctgtacgccgtggccaagaagaacg

SEQ ID NO: 348991 - DNA, 27 bp, Artificial Sequence
  Description of Artificial Sequence: Synthetic oligonucleotide
tctgtacgccgtggccaagaagaacgg

SEQ ID NO: 348992 - DNA, 26 bp, Artificial Sequence
  Description of Artificial Sequence: Synthetic oligonucleotide
ctgtacgccgtggccaagaagaacgg

SEQ ID NO: 348993 - DNA, 26 bp, Artificial Sequence
  Description of Artificial Sequence: Synthetic oligonucleotide
tgtacgccgtggccaagaagaacggg

SEQ ID NO: 348994 - DNA, 25 bp, Artificial Sequence
  Description of Artificial Sequence: Synthetic oligonucleotide
gtacgccgtggccaagaagaacggg

SEQ ID NO: 348995 - DNA, 25 bp, Artificial Sequence
  Description of Artificial Sequence: Synthetic oligonucleotide
tacgccgtggccaagaagaacgggc

SEQ ID NO: 348996 - DNA, 24 bp, Artificial Sequence
  Description of Artificial Sequence: Synthetic oligonucleotide
acgccgtggccaagaagaacgggc

SEQ ID NO: 348997 - DNA, 23 bp, Artificial Sequence
  Description of Artificial Sequence: Synthetic oligonucleotide
cgccgtggccaagaagaacgggc

SEQ ID NO: 348998 - DNA, 23 bp, Artificial Sequence
  Description of Artificial Sequence: Synthetic oligonucleotide
gccgtggccaagaagaacgggcg

SEQ ID NO: 348999 - DNA, 23 bp, Artificial Sequence
  Description of Artificial Sequence: Synthetic oligonucleotide
ccgtggccaagaagaacgggcgc

SEQ ID NO: 349000 - DNA, 23 bp, Artificial Sequence
  Description of Artificial Sequence: Synthetic oligonucleotide
cgtggccaagaagaacgggcgcc

SEQ ID NO: 349001 - DNA, 23 bp, Artificial Sequence
  Description of Artificial Sequence: Synthetic oligonucleotide
gtggccaagaagaacgggcgccc

SEQ ID NO: 349002 - DNA, 23 bp, Artificial Sequence
  Description of Artificial Sequence: Synthetic oligonucleotide
tggccaagaagaacgggcgcccc

SEQ ID NO: 349003 - DNA, 22 bp, Artificial Sequence
  Description of Artificial Sequence: Synthetic oligonucleotide
ggccaagaagaacgggcgcccc

SEQ ID NO: 349004 - DNA, 22 bp, Artificial Sequence
  Description of Artificial Sequence: Synthetic oligonucleotide
gccaagaagaacgggcgccccg

SEQ ID NO: 349005 - DNA, 22 bp, Artificial Sequence
  Description of Artificial Sequence: Synthetic oligonucleotide
ccaagaagaacgggcgccccgc

SEQ ID NO: 349006 - DNA, 24 bp, Artificial Sequence
  Description of Artificial Sequence: Synthetic oligonucleotide
caagaagaacgggcgccccgcctt

SEQ ID NO: 349007 - DNA, 26 bp, Artificial Sequence
  Description of Artificial Sequence: Synthetic oligonucleotide
aagaagaacgggcgccccgccttctt

SEQ ID NO: 349008 - DNA, 25 bp, Artificial Sequence
  Description of Artificial Sequence: Synthetic oligonucleotide
agaagaacgggcgccccgccttctt

SEQ ID NO: 349009 - DNA, 24 bp, Artificial Sequence
  Description of Artificial Sequence: Synthetic oligonucleotide
gaagaacgggcgccccgccttctt

SEQ ID NO: 349010 - DNA, 24 bp, Artificial Sequence
  Description of Artificial Sequence: Synthetic oligonucleotide
aagaacgggcgccccgccttcttc

SEQ ID NO: 349011 - DNA, 23 bp, Artificial Sequence
  Description of Artificial Sequence: Synthetic oligonucleotide
agaacgggcgccccgccttcttc

SEQ ID NO: 349012 - DNA, 22 bp, Artificial Sequence
  Description of Artificial Sequence: Synthetic oligonucleotide
gaacgggcgccccgccttcttc

SEQ ID NO: 349013 - DNA, 22 bp, Artificial Sequence
  Description of Artificial Sequence: Synthetic oligonucleotide
aacgggcgccccgccttcttcc

SEQ ID NO: 349014 - DNA, 21 bp, Artificial Sequence
  Description of Artificial Sequence: Synthetic oligonucleotide
acgggcgccccgccttcttcc

SEQ ID NO: 349015 - DNA, 20 bp, Artificial Sequence
  Description of Artificial Sequence: Synthetic oligonucleotide
cgggcgccccgccttcttcc

SEQ ID NO: 349016 - DNA, 20 bp, Artificial Sequence
  Description of Artificial Sequence: Synthetic oligonucleotide
gggcgccccgccttcttccc

SEQ ID NO: 349017 - DNA, 20 bp, Artificial Sequence
  Description of Artificial Sequence: Synthetic oligonucleotide
ggcgccccgccttcttcccg

SEQ ID NO: 349018 - DNA, 20 bp, Artificial Sequence
  Description of Artificial Sequence: Synthetic oligonucleotide
gcgccccgccttcttcccgg

SEQ ID NO: 349019 - DNA, 20 bp, Artificial Sequence
  Description of Artificial Sequence: Synthetic oligonucleotide
cgccccgccttcttcccggc

SEQ ID NO: 349020 - DNA, 20 bp, Artificial Sequence
  Description of Artificial Sequence: Synthetic oligonucleotide
gccccgccttcttcccggcc

SEQ ID NO: 349021 - DNA, 21 bp, Artificial Sequence
  Description of Artificial Sequence: Synthetic oligonucleotide
ccccgccttcttcccggccct

SEQ ID NO: 349022 - DNA, 23 bp, Artificial Sequence
  Description of Artificial Sequence: Synthetic oligonucleotide
cccgccttcttcccggccctgat

SEQ ID NO: 349023 - DNA, 23 bp, Artificial Sequence
  Description of Artificial Sequence: Synthetic oligonucleotide
ccgccttcttcccggccctgatg

SEQ ID NO: 349024 - DNA, 24 bp, Artificial Sequence
  Description of Artificial Sequence: Synthetic oligonucleotide
cgccttcttcccggccctgatgca

SEQ ID NO: 349025 - DNA, 25 bp, Artificial Sequence
  Description of Artificial Sequence: Synthetic oligonucleotide
gccttcttcccggccctgatgcaca

SEQ ID NO: 349026 - DNA, 25 bp, Artificial Sequence
  Description of Artificial Sequence: Synthetic oligonucleotide
ccttcttcccggccctgatgcacag

SEQ ID NO: 349027 - DNA, 26 bp, Artificial Sequence
  Description of Artificial Sequence: Synthetic oligonucleotide
cttcttcccggccctgatgcacagga

SEQ ID NO: 349028 - DNA, 26 bp, Artificial Sequence
  Description of Artificial Sequence: Synthetic oligonucleotide
ttcttcccggccctgatgcacaggac

SEQ ID NO: 349029 - DNA, 25 bp, Artificial Sequence
  Description of Artificial Sequence: Synthetic oligonucleotide
tcttcccggccctgatgcacaggac

SEQ ID NO: 349030 - DNA, 24 bp, Artificial Sequence
  Description of Artificial Sequence: Synthetic oligonucleotide
cttcccggccctgatgcacaggac

SEQ ID NO: 349031 - DNA, 24 bp, Artificial Sequence
  Description of Artificial Sequence: Synthetic oligonucleotide
ttcccggccctgatgcacaggacc

SEQ ID NO: 349032 - DNA, 23 bp, Artificial Sequence
  Description of Artificial Sequence: Synthetic oligonucleotide
tcccggccctgatgcacaggacc

SEQ ID NO: 349033 - DNA, 22 bp, Artificial Sequence
  Description of Artificial Sequence: Synthetic oligonucleotide
cccggccctgatgcacaggacc

SEQ ID NO: 349034 - DNA, 23 bp, Artificial Sequence
  Description of Artificial Sequence: Synthetic oligonucleotide
ccggccctgatgcacaggaccct

SEQ ID NO: 349035 - DNA, 23 bp, Artificial Sequence
  Description of Artificial Sequence: Synthetic oligonucleotide
cggccctgatgcacaggaccctg

SEQ ID NO: 349036 - DNA, 23 bp, Artificial Sequence
  Description of Artificial Sequence: Synthetic oligonucleotide
ggccctgatgcacaggaccctgg

SEQ ID NO: 349037 - DNA, 23 bp, Artificial Sequence
  Description of Artificial Sequence: Synthetic oligonucleotide
gccctgatgcacaggaccctggc

SEQ ID NO: 349038 - DNA, 23 bp, Artificial Sequence
  Description of Artificial Sequence: Synthetic oligonucleotide
ccctgatgcacaggaccctggcc

SEQ ID NO: 349039 - DNA, 23 bp, Artificial Sequence
  Description of Artificial Sequence: Synthetic oligonucleotide
cctgatgcacaggaccctggccg

SEQ ID NO: 349040 - DNA, 23 bp, Artificial Sequence
  Description of Artificial Sequence: Synthetic oligonucleotide
ctgatgcacaggaccctggccgc

SEQ ID NO: 349041 - DNA, 25 bp, Artificial Sequence
  Description of Artificial Sequence: Synthetic oligonucleotide
tgatgcacaggaccctggccgccat

SEQ ID NO: 349042 - DNA, 24 bp, Artificial Sequence
  Description of Artificial Sequence: Synthetic oligonucleotide
gatgcacaggaccctggccgccat

SEQ ID NO: 349043 - DNA, 26 bp, Artificial Sequence
  Description of Artificial Sequence: Synthetic oligonucleotide
atgcacaggaccctggccgccatctt

SEQ ID NO: 349044 - DNA, 25 bp, Artificial Sequence
  Description of Artificial Sequence: Synthetic oligonucleotide
tgcacaggaccctggccgccatctt

SEQ ID NO: 349045 - DNA, 24 bp, Artificial Sequence
  Description of Artificial Sequence: Synthetic oligonucleotide
gcacaggaccctggccgccatctt

SEQ ID NO: 349046 - DNA, 25 bp, Artificial Sequence
  Description of Artificial Sequence: Synthetic oligonucleotide
cacaggaccctggccgccatcttca

SEQ ID NO: 349047 - DNA, 27 bp, Artificial Sequence
  Description of Artificial Sequence: Synthetic oligonucleotide
acaggaccctggccgccatcttcacaa

SEQ ID NO: 349048 - DNA, 27 bp, Artificial Sequence
  Description of Artificial Sequence: Synthetic oligonucleotide
caggaccctggccgccatcttcacaat

SEQ ID NO: 349049 - DNA, 27 bp, Artificial Sequence
  Description of Artificial Sequence: Synthetic oligonucleotide
aggaccctggccgccatcttcacaatc

SEQ ID NO: 349050 - DNA, 27 bp, Artificial Sequence
  Description of Artificial Sequence: Synthetic oligonucleotide
ggaccctggccgccatcttcacaatca

SEQ ID NO: 349051 - DNA, 27 bp, Artificial Sequence
  Description of Artificial Sequence: Synthetic oligonucleotide
gaccctggccgccatcttcacaatcac

SEQ ID NO: 349052 - DNA, 27 bp, Artificial Sequence
  Description of Artificial Sequence: Synthetic oligonucleotide
accctggccgccatcttcacaatcacc

SEQ ID NO: 349053 - DNA, 26 bp, Artificial Sequence
  Description of Artificial Sequence: Synthetic oligonucleotide
ccctggccgccatcttcacaatcacc

SEQ ID NO: 349054 - DNA, 27 bp, Artificial Sequence
  Description of Artificial Sequence: Synthetic oligonucleotide
cctggccgccatcttcacaatcaccct

SEQ ID NO: 349055 - DNA, 27 bp, Artificial Sequence
  Description of Artificial Sequence: Synthetic oligonucleotide
ctggccgccatcttcacaatcaccctc

SEQ ID NO: 349056 - DNA, 27 bp, Artificial Sequence
  Description of Artificial Sequence: Synthetic oligonucleotide
tggccgccatcttcacaatcaccctcc

SEQ ID NO: 349057 - DNA, 26 bp, Artificial Sequence
  Description of Artificial Sequence: Synthetic oligonucleotide
ggccgccatcttcacaatcaccctcc

SEQ ID NO: 349058 - DNA, 26 bp, Artificial Sequence
  Description of Artificial Sequence: Synthetic oligonucleotide
gccgccatcttcacaatcaccctccc

SEQ ID NO: 349059 - DNA, 26 bp, Artificial Sequence
  Description of Artificial Sequence: Synthetic oligonucleotide
ccgccatcttcacaatcaccctcccg

SEQ ID NO: 349060 - DNA, 27 bp, Artificial Sequence
  Description of Artificial Sequence: Synthetic oligonucleotide
cgccatcttcacaatcaccctcccggt

SEQ ID NO: 349061 - DNA, 27 bp, Artificial Sequence
  Description of Artificial Sequence: Synthetic oligonucleotide
gccatcttcacaatcaccctcccggtg

SEQ ID NO: 349062 - DNA, 27 bp, Artificial Sequence
  Description of Artificial Sequence: Synthetic oligonucleotide
ccatcttcacaatcaccctcccggtgc

SEQ ID NO: 349063 - DNA, 28 bp, Artificial Sequence
  Description of Artificial Sequence: Synthetic oligonucleotide
catcttcacaatcaccctcccggtgctg

SEQ ID NO: 349064 - DNA, 28 bp, Artificial Sequence
  Description of Artificial Sequence: Synthetic oligonucleotide
atcttcacaatcaccctcccggtgctgg

SEQ ID NO: 349065 - DNA, 27 bp, Artificial Sequence
  Description of Artificial Sequence: Synthetic oligonucleotide
tcttcacaatcaccctcccggtgctgg

SEQ ID NO: 349066 - DNA, 27 bp, Artificial Sequence
  Description of Artificial Sequence: Synthetic oligonucleotide
cttcacaatcaccctcccggtgctgga

SEQ ID NO: 349067 - DNA, 27 bp, Artificial Sequence
  Description of Artificial Sequence: Synthetic oligonucleotide
ttcacaatcaccctcccggtgctggac

SEQ ID NO: 349068 - DNA, 27 bp, Artificial Sequence
  Description of Artificial Sequence: Synthetic oligonucleotide
tcacaatcaccctcccggtgctggaca

SEQ ID NO: 349069 - DNA, 26 bp, Artificial Sequence
  Description of Artificial Sequence: Synthetic oligonucleotide
cacaatcaccctcccggtgctggaca

SEQ ID NO: 349070 - DNA, 26 bp, Artificial Sequence
  Description of Artificial Sequence: Synthetic oligonucleotide
acaatcaccctcccggtgctggacag

SEQ ID NO: 349071 - DNA, 25 bp, Artificial Sequence
  Description of Artificial Sequence: Synthetic oligonucleotide
caatcaccctcccggtgctggacag

SEQ ID NO: 349072 - DNA, 25 bp, Artificial Sequence
  Description of Artificial Sequence: Synthetic oligonucleotide
aatcaccctcccggtgctggacagc

SEQ ID NO: 349073 - DNA, 24 bp, Artificial Sequence
  Description of Artificial Sequence: Synthetic oligonucleotide
atcaccctcccggtgctggacagc

SEQ ID NO: 349074 - DNA, 23 bp, Artificial Sequence
  Description of Artificial Sequence: Synthetic oligonucleotide
tcaccctcccggtgctggacagc

SEQ ID NO: 349075 - DNA, 22 bp, Artificial Sequence
  Description of Artificial Sequence: Synthetic oligonucleotide
caccctcccggtgctggacagc

SEQ ID NO: 349076 - DNA, 22 bp, Artificial Sequence
  Description of Artificial Sequence: Synthetic oligonucleotide
accctcccggtgctggacagcg

SEQ ID NO: 349077 - DNA, 21 bp, Artificial Sequence
  Description of Artificial Sequence: Synthetic oligonucleotide
ccctcccggtgctggacagcg

SEQ ID NO: 349078 - DNA, 21 bp, Artificial Sequence
  Description of Artificial Sequence: Synthetic oligonucleotide
cctcccggtgctggacagcgc

SEQ ID NO: 349079 - DNA, 22 bp, Artificial Sequence
  Description of Artificial Sequence: Synthetic oligonucleotide
ctcccggtgctggacagcgcca

SEQ ID NO: 349080 - DNA, 22 bp, Artificial Sequence
  Description of Artificial Sequence: Synthetic oligonucleotide
tcccggtgctggacagcgccag

SEQ ID NO: 349081 - DNA, 21 bp, Artificial Sequence
  Description of Artificial Sequence: Synthetic oligonucleotide
cccggtgctggacagcgccag

SEQ ID NO: 349082 - DNA, 21 bp, Artificial Sequence
  Description of Artificial Sequence: Synthetic oligonucleotide
ccggtgctggacagcgccagg

SEQ ID NO: 349083 - DNA, 21 bp, Artificial Sequence
  Description of Artificial Sequence: Synthetic oligonucleotide
cggtgctggacagcgccaggg

SEQ ID NO: 349084 - DNA, 21 bp, Artificial Sequence
  Description of Artificial Sequence: Synthetic oligonucleotide
ggtgctggacagcgccagggc

SEQ ID NO: 349085 - DNA, 22 bp, Artificial Sequence
  Description of Artificial Sequence: Synthetic oligonucleotide
gtgctggacagcgccagggcca

SEQ ID NO: 349086 - DNA, 22 bp, Artificial Sequence
  Description of Artificial Sequence: Synthetic oligonucleotide
tgctggacagcgccagggccag

SEQ ID NO: 349087 - DNA, 21 bp, Artificial Sequence
  Description of Artificial Sequence: Synthetic oligonucleotide
gctggacagcgccagggccag

SEQ ID NO: 349088 - DNA, 22 bp, Artificial Sequence
  Description of Artificial Sequence: Synthetic oligonucleotide
ctggacagcgccagggccagca

SEQ ID NO: 349089 - DNA, 22 bp, Artificial Sequence
  Description of Artificial Sequence: Synthetic oligonucleotide
tggacagcgccagggccagcag

SEQ ID NO: 349090 - DNA, 21 bp, Artificial Sequence
  Description of Artificial Sequence: Synthetic oligonucleotide
ggacagcgccagggccagcag

SEQ ID NO: 349091 - DNA, 23 bp, Artificial Sequence
  Description of Artificial Sequence: Synthetic oligonucleotide
gacagcgccagggccagcagcat

SEQ ID NO: 349092 - DNA, 23 bp, Artificial Sequence
  Description of Artificial Sequence: Synthetic oligonucleotide
acagcgccagggccagcagcatc

SEQ ID NO: 349093 - DNA, 22 bp, Artificial Sequence
  Description of Artificial Sequence: Synthetic oligonucleotide
cagcgccagggccagcagcatc

SEQ ID NO: 349094 - DNA, 22 bp, Artificial Sequence
  Description of Artificial Sequence: Synthetic oligonucleotide
agcgccagggccagcagcatcc

SEQ ID NO: 349095 - DNA, 21 bp, Artificial Sequence
  Description of Artificial Sequence: Synthetic oligonucleotide
gcgccagggccagcagcatcc

SEQ ID NO: 349096 - DNA, 21 bp, Artificial Sequence
  Description of Artificial Sequence: Synthetic oligonucleotide
cgccagggccagcagcatccc

SEQ ID NO: 349097 - DNA, 22 bp, Artificial Sequence
  Description of Artificial Sequence: Synthetic oligonucleotide
gccagggccagcagcatcccct

SEQ ID NO: 349098 - DNA, 22 bp, Artificial Sequence
  Description of Artificial Sequence: Synthetic oligonucleotide
ccagggccagcagcatcccctg

SEQ ID NO: 349099 - DNA, 22 bp, Artificial Sequence
  Description of Artificial Sequence: Synthetic oligonucleotide
cagggccagcagcatcccctgg

SEQ ID NO: 349100 - DNA, 23 bp, Artificial Sequence
  Description of Artificial Sequence: Synthetic oligonucleotide
agggccagcagcatcccctggga

SEQ ID NO: 349101 - DNA, 22 bp, Artificial Sequence
  Description of Artificial Sequence: Synthetic oligonucleotide
gggccagcagcatcccctggga

SEQ ID NO: 349102 - DNA, 24 bp, Artificial Sequence
  Description of Artificial Sequence: Synthetic oligonucleotide
ggccagcagcatcccctgggagaa

SEQ ID NO: 349103 - DNA, 26 bp, Artificial Sequence
  Description of Artificial Sequence: Synthetic oligonucleotide
gccagcagcatcccctgggagaacta

SEQ ID NO: 349104 - DNA, 26 bp, Artificial Sequence
  Description of Artificial Sequence: Synthetic oligonucleotide
ccagcagcatcccctgggagaactac

SEQ ID NO: 349105 - DNA, 27 bp, Artificial Sequence
  Description of Artificial Sequence: Synthetic oligonucleotide
cagcagcatcccctgggagaactacct

SEQ ID NO: 349106 - DNA, 27 bp, Artificial Sequence
  Description of Artificial Sequence: Synthetic oligonucleotide
agcagcatcccctgggagaactacctc

SEQ ID NO: 349107 - DNA, 26 bp, Artificial Sequence
  Description of Artificial Sequence: Synthetic oligonucleotide
gcagcatcccctgggagaactacctc

SEQ ID NO: 349108 - DNA, 27 bp, Artificial Sequence
  Description of Artificial Sequence: Synthetic oligonucleotide
cagcatcccctgggagaactacctcct

SEQ ID NO: 349109 - DNA, 27 bp, Artificial Sequence
  Description of Artificial Sequence: Synthetic oligonucleotide
agcatcccctgggagaactacctcctg

SEQ ID NO: 349110 - DNA, 27 bp, Artificial Sequence
  Description of Artificial Sequence: Synthetic oligonucleotide
gcatcccctgggagaactacctcctga

SEQ ID NO: 349111 - DNA, 28 bp, Artificial Sequence
  Description of Artificial Sequence: Synthetic oligonucleotide
catcccctgggagaactacctcctgaac

SEQ ID NO: 349112 - DNA, 28 bp, Artificial Sequence
  Description of Artificial Sequence: Synthetic oligonucleotide
atcccctgggagaactacctcctgaacg

SEQ ID NO: 349113 - DNA, 27 bp, Artificial Sequence
  Description of Artificial Sequence: Synthetic oligonucleotide
tcccctgggagaactacctcctgaacg

SEQ ID NO: 349114 - DNA, 27 bp, Artificial Sequence
  Description of Artificial Sequence: Synthetic oligonucleotide
cccctgggagaactacctcctgaacga

SEQ ID NO: 349115 - DNA, 27 bp, Artificial Sequence
  Description of Artificial Sequence: Synthetic oligonucleotide
ccctgggagaactacctcctgaacgag

SEQ ID NO: 349116 - DNA, 28 bp, Artificial Sequence
  Description of Artificial Sequence: Synthetic oligonucleotide
cctgggagaactacctcctgaacgagtg

SEQ ID NO: 349117 - DNA, 28 bp, Artificial Sequence
  Description of Artificial Sequence: Synthetic oligonucleotide
ctgggagaactacctcctgaacgagtgg

SEQ ID NO: 349118 - DNA, 30 bp, Artificial Sequence
  Description of Artificial Sequence: Synthetic oligonucleotide
tgggagaactacctcctgaacgagtggatg

SEQ ID NO: 349119 - DNA, 29 bp, Artificial Sequence
  Description of Artificial Sequence: Synthetic oligonucleotide
gggagaactacctcctgaacgagtggatg

SEQ ID NO: 349120 - DNA, 29 bp, Artificial Sequence
  Description of Artificial Sequence: Synthetic oligonucleotide
ggagaactacctcctgaacgagtggatgg

SEQ ID NO: 349121 - DNA, 30 bp, Artificial Sequence
  Description of Artificial Sequence: Synthetic oligonucleotide
gagaactacctcctgaacgagtggatggag

SEQ ID NO: 349122 - DNA, 30 bp, Artificial Sequence
  Description of Artificial Sequence: Synthetic oligonucleotide
agaactacctcctgaacgagtggatggagc

SEQ ID NO: 349123 - DNA, 29 bp, Artificial Sequence
  Description of Artificial Sequence: Synthetic oligonucleotide
gaactacctcctgaacgagtggatggagc

SEQ ID NO: 349124 - DNA, 30 bp, Artificial Sequence
  Description of Artificial Sequence: Synthetic oligonucleotide
aactacctcctgaacgagtggatggagcag

SEQ ID NO: 349125 - DNA, 29 bp, Artificial Sequence
  Description of Artificial Sequence: Synthetic oligonucleotide
actacctcctgaacgagtggatggagcag

SEQ ID NO: 349126 - DNA, 28 bp, Artificial Sequence
  Description of Artificial Sequence: Synthetic oligonucleotide
ctacctcctgaacgagtggatggagcag

SEQ ID NO: 349127 - DNA, 28 bp, Artificial Sequence
  Description of Artificial Sequence: Synthetic oligonucleotide
tacctcctgaacgagtggatggagcagg

SEQ ID NO: 349128 - DNA, 27 bp, Artificial Sequence
  Description of Artificial Sequence: Synthetic oligonucleotide
acctcctgaacgagtggatggagcagg

SEQ ID NO: 349129 - DNA, 27 bp, Artificial Sequence
  Description of Artificial Sequence: Synthetic oligonucleotide
cctcctgaacgagtggatggagcagga

SEQ ID NO: 349130 - DNA, 30 bp, Artificial Sequence
  Description of Artificial Sequence: Synthetic oligonucleotide
ctcctgaacgagtggatggagcaggaatac

SEQ ID NO: 349131 - DNA, 30 bp, Artificial Sequence
  Description of Artificial Sequence: Synthetic oligonucleotide
tcctgaacgagtggatggagcaggaatacc

SEQ ID NO: 349132 - DNA, 29 bp, Artificial Sequence
  Description of Artificial Sequence: Synthetic oligonucleotide
cctgaacgagtggatggagcaggaatacc

SEQ ID NO: 349133 - DNA, 29 bp, Artificial Sequence
  Description of Artificial Sequence: Synthetic oligonucleotide
ctgaacgagtggatggagcaggaataccc

SEQ ID NO: 349134 - DNA, 29 bp, Artificial Sequence
  Description of Artificial Sequence: Synthetic oligonucleotide
tgaacgagtggatggagcaggaatacccc

SEQ ID NO: 349135 - DNA, 28 bp, Artificial Sequence
  Description of Artificial Sequence: Synthetic oligonucleotide
gaacgagtggatggagcaggaatacccc

SEQ ID NO: 349136 - DNA, 28 bp, Artificial Sequence
  Description of Artificial Sequence: Synthetic oligonucleotide
aacgagtggatggagcaggaataccccc

SEQ ID NO: 349137 - DNA, 27 bp, Artificial Sequence
  Description of Artificial Sequence: Synthetic oligonucleotide
acgagtggatggagcaggaataccccc

SEQ ID NO: 349138 - DNA, 27 bp, Artificial Sequence
  Description of Artificial Sequence: Synthetic oligonucleotide
cgagtggatggagcaggaataccccca

SEQ ID NO: 349139 - DNA, 27 bp, Artificial Sequence
  Description of Artificial Sequence: Synthetic oligonucleotide
gagtggatggagcaggaatacccccac

SEQ ID NO: 349140 - DNA, 29 bp, Artificial Sequence
  Description of Artificial Sequence: Synthetic oligonucleotide
agtggatggagcaggaatacccccacatc

SEQ ID NO: 349141 - DNA, 28 bp, Artificial Sequence
  Description of Artificial Sequence: Synthetic oligonucleotide
gtggatggagcaggaatacccccacatc

SEQ ID NO: 349142 - DNA, 28 bp, Artificial Sequence
  Description of Artificial Sequence: Synthetic oligonucleotide
tggatggagcaggaatacccccacatcc

SEQ ID NO: 349143 - DNA, 27 bp, Artificial Sequence
  Description of Artificial Sequence: Synthetic oligonucleotide
ggatggagcaggaatacccccacatcc

SEQ ID NO: 349144 - DNA, 27 bp, Artificial Sequence
  Description of Artificial Sequence: Synthetic oligonucleotide
gatggagcaggaatacccccacatccc

SEQ ID NO: 349145 - DNA, 27 bp, Artificial Sequence
  Description of Artificial Sequence: Synthetic oligonucleotide
atggagcaggaatacccccacatcccc

SEQ ID NO: 349146 - DNA, 26 bp, Artificial Sequence
  Description of Artificial Sequence: Synthetic oligonucleotide
tggagcaggaatacccccacatcccc

SEQ ID NO: 349147 - DNA, 25 bp, Artificial Sequence
  Description of Artificial Sequence: Synthetic oligonucleotide
ggagcaggaatacccccacatcccc

SEQ ID NO: 349148 - DNA, 25 bp, Artificial Sequence
  Description of Artificial Sequence: Synthetic oligonucleotide
gagcaggaatacccccacatccccg

SEQ ID NO: 349149 - DNA, 25 bp, Artificial Sequence
  Description of Artificial Sequence: Synthetic oligonucleotide
agcaggaatacccccacatccccgg

SEQ ID NO: 349150 - DNA, 24 bp, Artificial Sequence
  Description of Artificial Sequence: Synthetic oligonucleotide
gcaggaatacccccacatccccgg

SEQ ID NO: 349151 - DNA, 24 bp, Artificial Sequence
  Description of Artificial Sequence: Synthetic oligonucleotide
caggaatacccccacatccccggg

SEQ ID NO: 349152 - DNA, 25 bp, Artificial Sequence
  Description of Artificial Sequence: Synthetic oligonucleotide
aggaatacccccacatccccgggga

SEQ ID NO: 349153 - DNA, 24 bp, Artificial Sequence
  Description of Artificial Sequence: Synthetic oligonucleotide
ggaatacccccacatccccgggga

SEQ ID NO: 349154 - DNA, 26 bp, Artificial Sequence
  Description of Artificial Sequence: Synthetic oligonucleotide
gaatacccccacatccccggggagta

SEQ ID NO: 349155 - DNA, 26 bp, Artificial Sequence
  Description of Artificial Sequence: Synthetic oligonucleotide
aatacccccacatccccggggagtac

SEQ ID NO: 349156 - DNA, 25 bp, Artificial Sequence
  Description of Artificial Sequence: Synthetic oligonucleotide
atacccccacatccccggggagtac

SEQ ID NO: 349157 - DNA, 24 bp, Artificial Sequence
  Description of Artificial Sequence: Synthetic oligonucleotide
tacccccacatccccggggagtac

SEQ ID NO: 349158 - DNA, 23 bp, Artificial Sequence
  Description of Artificial Sequence: Synthetic oligonucleotide
acccccacatccccggggagtac

SEQ ID NO: 349159 - DNA, 22 bp, Artificial Sequence
  Description of Artificial Sequence: Synthetic oligonucleotide
cccccacatccccggggagtac

SEQ ID NO: 349160 - DNA, 23 bp, Artificial Sequence
  Description of Artificial Sequence: Synthetic oligonucleotide
ccccacatccccggggagtacct

SEQ ID NO: 349161 - DNA, 23 bp, Artificial Sequence
  Description of Artificial Sequence: Synthetic oligonucleotide
cccacatccccggggagtacctc

SEQ ID NO: 349162 - DNA, 23 bp, Artificial Sequence
  Description of Artificial Sequence: Synthetic oligonucleotide
ccacatccccggggagtacctcc

SEQ ID NO: 349163 - DNA, 23 bp, Artificial Sequence
  Description of Artificial Sequence: Synthetic oligonucleotide
cacatccccggggagtacctccg

SEQ ID NO: 349164 - DNA, 25 bp, Artificial Sequence
  Description of Artificial Sequence: Synthetic oligonucleotide
acatccccggggagtacctccgctt

SEQ ID NO: 349165 - DNA, 24 bp, Artificial Sequence
  Description of Artificial Sequence: Synthetic oligonucleotide
catccccggggagtacctccgctt

SEQ ID NO: 349166 - DNA, 25 bp, Artificial Sequence
  Description of Artificial Sequence: Synthetic oligonucleotide
atccccggggagtacctccgcttca

SEQ ID NO: 349167 - DNA, 24 bp, Artificial Sequence
  Description of Artificial Sequence: Synthetic oligonucleotide
tccccggggagtacctccgcttca

SEQ ID NO: 349168 - DNA, 23 bp, Artificial Sequence
  Description of Artificial Sequence: Synthetic oligonucleotide
ccccggggagtacctccgcttca

SEQ ID NO: 349169 - DNA, 23 bp, Artificial Sequence
  Description of Artificial Sequence: Synthetic oligonucleotide
cccggggagtacctccgcttcag

SEQ ID NO: 349170 - DNA, 23 bp, Artificial Sequence
  Description of Artificial Sequence: Synthetic oligonucleotide
ccggggagtacctccgcttcagc

SEQ ID NO: 349171 - DNA, 23 bp, Artificial Sequence
  Description of Artificial Sequence: Synthetic oligonucleotide
cggggagtacctccgcttcagcg

SEQ ID NO: 349172 - DNA, 23 bp, Artificial Sequence
  Description of Artificial Sequence: Synthetic oligonucleotide
ggggagtacctccgcttcagcgg

SEQ ID NO: 349173 - DNA, 25 bp, Artificial Sequence
  Description of Artificial Sequence: Synthetic oligonucleotide
gggagtacctccgcttcagcggcta

SEQ ID NO: 349174 - DNA, 25 bp, Artificial Sequence
  Description of Artificial Sequence: Synthetic oligonucleotide
ggagtacctccgcttcagcggctac

SEQ ID NO: 349175 - DNA, 25 bp, Artificial Sequence
  Description of Artificial Sequence: Synthetic oligonucleotide
gagtacctccgcttcagcggctacc

SEQ ID NO: 349176 - DNA, 25 bp, Artificial Sequence
  Description of Artificial Sequence: Synthetic oligonucleotide
agtacctccgcttcagcggctaccc

SEQ ID NO: 349177 - DNA, 24 bp, Artificial Sequence
  Description of Artificial Sequence: Synthetic oligonucleotide
gtacctccgcttcagcggctaccc

SEQ ID NO: 349178 - DNA, 25 bp, Artificial Sequence
  Description of Artificial Sequence: Synthetic oligonucleotide
tacctccgcttcagcggctacccgt

SEQ ID NO: 349179 - DNA, 24 bp, Artificial Sequence
  Description of Artificial Sequence: Synthetic oligonucleotide
acctccgcttcagcggctacccgt

SEQ ID NO: 349180 - DNA, 23 bp, Artificial Sequence
  Description of Artificial Sequence: Synthetic oligonucleotide
cctccgcttcagcggctacccgt

SEQ ID NO: 349181 - DNA, 23 bp, Artificial Sequence
  Description of Artificial Sequence: Synthetic oligonucleotide
ctccgcttcagcggctacccgtg

SEQ ID NO: 349182 - DNA, 24 bp, Artificial Sequence
  Description of Artificial Sequence: Synthetic oligonucleotide
tccgcttcagcggctacccgtgct

SEQ ID NO: 349183 - DNA, 23 bp, Artificial Sequence
  Description of Artificial Sequence: Synthetic oligonucleotide
ccgcttcagcggctacccgtgct

SEQ ID NO: 349184 - DNA, 23 bp, Artificial Sequence
  Description of Artificial Sequence: Synthetic oligonucleotide
cgcttcagcggctacccgtgctc

SEQ ID NO: 349185 - DNA, 24 bp, Artificial Sequence
  Description of Artificial Sequence: Synthetic oligonucleotide
gcttcagcggctacccgtgctcct

SEQ ID NO: 349186 - DNA, 24 bp, Artificial Sequence
  Description of Artificial Sequence: Synthetic oligonucleotide
cttcagcggctacccgtgctcctg

SEQ ID NO: 349187 - DNA, 25 bp, Artificial Sequence
  Description of Artificial Sequence: Synthetic oligonucleotide
ttcagcggctacccgtgctcctggt

SEQ ID NO: 349188 - DNA, 24 bp, Artificial Sequence
  Description of Artificial Sequence: Synthetic oligonucleotide
tcagcggctacccgtgctcctggt

SEQ ID NO: 349189 - DNA, 23 bp, Artificial Sequence
  Description of Artificial Sequence: Synthetic oligonucleotide
cagcggctacccgtgctcctggt

SEQ ID NO: 349190 - DNA, 23 bp, Artificial Sequence
  Description of Artificial Sequence: Synthetic oligonucleotide
agcggctacccgtgctcctggtc

SEQ ID NO: 349191 - DNA, 22 bp, Artificial Sequence
  Description of Artificial Sequence: Synthetic oligonucleotide
gcggctacccgtgctcctggtc

SEQ ID NO: 349192 - DNA, 24 bp, Artificial Sequence
  Description of Artificial Sequence: Synthetic oligonucleotide
cggctacccgtgctcctggtcctt

SEQ ID NO: 349193 - DNA, 26 bp, Artificial Sequence
  Description of Artificial Sequence: Synthetic oligonucleotide
ggctacccgtgctcctggtccttcta

SEQ ID NO: 349194 - DNA, 26 bp, Artificial Sequence
  Description of Artificial Sequence: Synthetic oligonucleotide
gctacccgtgctcctggtccttctac

SEQ ID NO: 349195 - DNA, 27 bp, Artificial Sequence
  Description of Artificial Sequence: Synthetic oligonucleotide
ctacccgtgctcctggtccttctacct

SEQ ID NO: 349196 - DNA, 27 bp, Artificial Sequence
  Description of Artificial Sequence: Synthetic oligonucleotide
tacccgtgctcctggtccttctacctc

SEQ ID NO: 349197 - DNA, 26 bp, Artificial Sequence
  Description of Artificial Sequence: Synthetic oligonucleotide
acccgtgctcctggtccttctacctc

SEQ ID NO: 349198 - DNA, 25 bp, Artificial Sequence
  Description of Artificial Sequence: Synthetic oligonucleotide
cccgtgctcctggtccttctacctc

SEQ ID NO: 349199 - DNA, 26 bp, Artificial Sequence
  Description of Artificial Sequence: Synthetic oligonucleotide
ccgtgctcctggtccttctacctcca

SEQ ID NO: 349200 - DNA, 26 bp, Artificial Sequence
  Description of Artificial Sequence: Synthetic oligonucleotide
cgtgctcctggtccttctacctccac

SEQ ID NO: 349201 - DNA, 27 bp, Artificial Sequence
  Description of Artificial Sequence: Synthetic oligonucleotide
gtgctcctggtccttctacctccacct

SEQ ID NO: 349202 - DNA, 27 bp, Artificial Sequence
  Description of Artificial Sequence: Synthetic oligonucleotide
tgctcctggtccttctacctccacctc

SEQ ID NO: 349203 - DNA, 26 bp, Artificial Sequence
  Description of Artificial Sequence: Synthetic oligonucleotide
gctcctggtccttctacctccacctc

SEQ ID NO: 349204 - DNA, 26 bp, Artificial Sequence
  Description of Artificial Sequence: Synthetic oligonucleotide
ctcctggtccttctacctccacctcc

SEQ ID NO: 349205 - DNA, 26 bp, Artificial Sequence
  Description of Artificial Sequence: Synthetic oligonucleotide
tcctggtccttctacctccacctccg

SEQ ID NO: 349206 - DNA, 25 bp, Artificial Sequence
  Description of Artificial Sequence: Synthetic oligonucleotide
cctggtccttctacctccacctccg

SEQ ID NO: 349207 - DNA, 25 bp, Artificial Sequence
  Description of Artificial Sequence: Synthetic oligonucleotide
ctggtccttctacctccacctccgg

SEQ ID NO: 349208 - DNA, 26 bp, Artificial Sequence
  Description of Artificial Sequence: Synthetic oligonucleotide
tggtccttctacctccacctccggca

SEQ ID NO: 349209 - DNA, 25 bp, Artificial Sequence
  Description of Artificial Sequence: Synthetic oligonucleotide
ggtccttctacctccacctccggca

SEQ ID NO: 349210 - DNA, 25 bp, Artificial Sequence
  Description of Artificial Sequence: Synthetic oligonucleotide
gtccttctacctccacctccggcag

SEQ ID NO: 349211 - DNA, 26 bp, Artificial Sequence
  Description of Artificial Sequence: Synthetic oligonucleotide
tccttctacctccacctccggcagga

SEQ ID NO: 349212 - DNA, 25 bp, Artificial Sequence
  Description of Artificial Sequence: Synthetic oligonucleotide
ccttctacctccacctccggcagga

SEQ ID NO: 349213 - DNA, 27 bp, Artificial Sequence
  Description of Artificial Sequence: Synthetic oligonucleotide
cttctacctccacctccggcaggagat

SEQ ID NO: 349214 - DNA, 27 bp, Artificial Sequence
  Description of Artificial Sequence: Synthetic oligonucleotide
ttctacctccacctccggcaggagatc

SEQ ID NO: 349215 - DNA, 26 bp, Artificial Sequence
  Description of Artificial Sequence: Synthetic oligonucleotide
tctacctccacctccggcaggagatc

SEQ ID NO: 349216 - DNA, 25 bp, Artificial Sequence
  Description of Artificial Sequence: Synthetic oligonucleotide
ctacctccacctccggcaggagatc

SEQ ID NO: 349217 - DNA, 26 bp, Artificial Sequence
  Description of Artificial Sequence: Synthetic oligonucleotide
tacctccacctccggcaggagatcgt

SEQ ID NO: 349218 - DNA, 25 bp, Artificial Sequence
  Description of Artificial Sequence: Synthetic oligonucleotide
acctccacctccggcaggagatcgt

SEQ ID NO: 349219 - DNA, 24 bp, Artificial Sequence
  Description of Artificial Sequence: Synthetic oligonucleotide
cctccacctccggcaggagatcgt

SEQ ID NO: 349220 - DNA, 24 bp, Artificial Sequence
  Description of Artificial Sequence: Synthetic oligonucleotide
ctccacctccggcaggagatcgtc

SEQ ID NO: 349221 - DNA, 25 bp, Artificial Sequence
  Description of Artificial Sequence: Synthetic oligonucleotide
tccacctccggcaggagatcgtcca

SEQ ID NO: 349222 - DNA, 24 bp, Artificial Sequence
  Description of Artificial Sequence: Synthetic oligonucleotide
ccacctccggcaggagatcgtcca

SEQ ID NO: 349223 - DNA, 24 bp, Artificial Sequence
  Description of Artificial Sequence: Synthetic oligonucleotide
cacctccggcaggagatcgtccag

SEQ ID NO: 349224 - DNA, 25 bp, Artificial Sequence
  Description of Artificial Sequence: Synthetic oligonucleotide
acctccggcaggagatcgtccagga

SEQ ID NO: 349225 - DNA, 24 bp, Artificial Sequence
  Description of Artificial Sequence: Synthetic oligonucleotide
cctccggcaggagatcgtccagga

SEQ ID NO: 349226 - DNA, 26 bp, Artificial Sequence
  Description of Artificial Sequence: Synthetic oligonucleotide
ctccggcaggagatcgtccaggagta

SEQ ID NO: 349227 - DNA, 27 bp, Artificial Sequence
  Description of Artificial Sequence: Synthetic oligonucleotide
tccggcaggagatcgtccaggagtaca

SEQ ID NO: 349228 - DNA, 26 bp, Artificial Sequence
  Description of Artificial Sequence: Synthetic oligonucleotide
ccggcaggagatcgtccaggagtaca

SEQ ID NO: 349229 - DNA, 26 bp, Artificial Sequence
  Description of Artificial Sequence: Synthetic oligonucleotide
cggcaggagatcgtccaggagtacac

SEQ ID NO: 349230 - DNA, 26 bp, Artificial Sequence
  Description of Artificial Sequence: Synthetic oligonucleotide
ggcaggagatcgtccaggagtacacc

SEQ ID NO: 349231 - DNA, 27 bp, Artificial Sequence
  Description of Artificial Sequence: Synthetic oligonucleotide
gcaggagatcgtccaggagtacaccct

SEQ ID NO: 349232 - DNA, 27 bp, Artificial Sequence
  Description of Artificial Sequence: Synthetic oligonucleotide
caggagatcgtccaggagtacaccctg

SEQ ID NO: 349233 - DNA, 27 bp, Artificial Sequence
  Description of Artificial Sequence: Synthetic oligonucleotide
aggagatcgtccaggagtacaccctgc

SEQ ID NO: 349234 - DNA, 27 bp, Artificial Sequence
  Description of Artificial Sequence: Synthetic oligonucleotide
ggagatcgtccaggagtacaccctgca

SEQ ID NO: 349235 - DNA, 27 bp, Artificial Sequence
  Description of Artificial Sequence: Synthetic oligonucleotide
gagatcgtccaggagtacaccctgcag

SEQ ID NO: 349236 - DNA, 27 bp, Artificial Sequence
  Description of Artificial Sequence: Synthetic oligonucleotide
agatcgtccaggagtacaccctgcagg

SEQ ID NO: 349237 - DNA, 27 bp, Artificial Sequence
  Description of Artificial Sequence: Synthetic oligonucleotide
gatcgtccaggagtacaccctgcagga

SEQ ID NO: 349238 - DNA, 27 bp, Artificial Sequence
  Description of Artificial Sequence: Synthetic oligonucleotide
atcgtccaggagtacaccctgcaggac

SEQ ID NO: 349239 - DNA, 26 bp, Artificial Sequence
  Description of Artificial Sequence: Synthetic oligonucleotide
tcgtccaggagtacaccctgcaggac

SEQ ID NO: 349240 - DNA, 25 bp, Artificial Sequence
  Description of Artificial Sequence: Synthetic oligonucleotide
cgtccaggagtacaccctgcaggac

SEQ ID NO: 349241 - DNA, 26 bp, Artificial Sequence
  Description of Artificial Sequence: Synthetic oligonucleotide
gtccaggagtacaccctgcaggacca

SEQ ID NO: 349242 - DNA, 26 bp, Artificial Sequence
  Description of Artificial Sequence: Synthetic oligonucleotide
tccaggagtacaccctgcaggaccac

SEQ ID NO: 349243 - DNA, 25 bp, Artificial Sequence
  Description of Artificial Sequence: Synthetic oligonucleotide
ccaggagtacaccctgcaggaccac

SEQ ID NO: 349244 - DNA, 26 bp, Artificial Sequence
  Description of Artificial Sequence: Synthetic oligonucleotide
caggagtacaccctgcaggaccacgt

SEQ ID NO: 349245 - DNA, 26 bp, Artificial Sequence
  Description of Artificial Sequence: Synthetic oligonucleotide
aggagtacaccctgcaggaccacgtg

SEQ ID NO: 349246 - DNA, 25 bp, Artificial Sequence
  Description of Artificial Sequence: Synthetic oligonucleotide
ggagtacaccctgcaggaccacgtg

SEQ ID NO: 349247 - DNA, 25 bp, Artificial Sequence
  Description of Artificial Sequence: Synthetic oligonucleotide
gagtacaccctgcaggaccacgtgg

SEQ ID NO: 349248 - DNA, 25 bp, Artificial Sequence
  Description of Artificial Sequence: Synthetic oligonucleotide
agtacaccctgcaggaccacgtggg

SEQ ID NO: 349249 - DNA, 24 bp, Artificial Sequence
  Description of Artificial Sequence: Synthetic oligonucleotide
gtacaccctgcaggaccacgtggg

SEQ ID NO: 349250 - DNA, 24 bp, Artificial Sequence
  Description of Artificial Sequence: Synthetic oligonucleotide
tacaccctgcaggaccacgtgggg

SEQ ID NO: 349251 - DNA, 23 bp, Artificial Sequence
  Description of Artificial Sequence: Synthetic oligonucleotide
acaccctgcaggaccacgtgggg

SEQ ID NO: 349252 - DNA, 22 bp, Artificial Sequence
  Description of Artificial Sequence: Synthetic oligonucleotide
caccctgcaggaccacgtgggg

SEQ ID NO: 349253 - DNA, 23 bp, Artificial Sequence
  Description of Artificial Sequence: Synthetic oligonucleotide
accctgcaggaccacgtggggga

SEQ ID NO: 349254 - DNA, 22 bp, Artificial Sequence
  Description of Artificial Sequence: Synthetic oligonucleotide
ccctgcaggaccacgtggggga

SEQ ID NO: 349255 - DNA, 22 bp, Artificial Sequence
  Description of Artificial Sequence: Synthetic oligonucleotide
cctgcaggaccacgtgggggag

SEQ ID NO: 349256 - DNA, 23 bp, Artificial Sequence
  Description of Artificial Sequence: Synthetic oligonucleotide
ctgcaggaccacgtgggggagga

SEQ ID NO: 349257 - DNA, 23 bp, Artificial Sequence
  Description of Artificial Sequence: Synthetic oligonucleotide
tgcaggaccacgtgggggaggag

SEQ ID NO: 349258 - DNA, 22 bp, Artificial Sequence
  Description of Artificial Sequence: Synthetic oligonucleotide
gcaggaccacgtgggggaggag

SEQ ID NO: 349259 - DNA, 22 bp, Artificial Sequence
  Description of Artificial Sequence: Synthetic oligonucleotide
caggaccacgtgggggaggagg

SEQ ID NO: 349260 - DNA, 22 bp, Artificial Sequence
  Description of Artificial Sequence: Synthetic oligonucleotide
aggaccacgtgggggaggaggg

SEQ ID NO: 349261 - DNA, 21 bp, Artificial Sequence
  Description of Artificial Sequence: Synthetic oligonucleotide
ggaccacgtgggggaggaggg

SEQ ID NO: 349262 - DNA, 21 bp, Artificial Sequence
  Description of Artificial Sequence: Synthetic oligonucleotide
gaccacgtgggggaggagggc

SEQ ID NO: 349263 - DNA, 22 bp, Artificial Sequence
  Description of Artificial Sequence: Synthetic oligonucleotide
accacgtgggggaggagggcca

SEQ ID NO: 349264 - DNA, 21 bp, Artificial Sequence
  Description of Artificial Sequence: Synthetic oligonucleotide
ccacgtgggggaggagggcca

SEQ ID NO: 349265 - DNA, 23 bp, Artificial Sequence
  Description of Artificial Sequence: Synthetic oligonucleotide
cacgtgggggaggagggccagaa

SEQ ID NO: 349266 - DNA, 25 bp, Artificial Sequence
  Description of Artificial Sequence: Synthetic oligonucleotide
acgtgggggaggagggccagaagtt

SEQ ID NO: 349267 - DNA, 24 bp, Artificial Sequence
  Description of Artificial Sequence: Synthetic oligonucleotide
cgtgggggaggagggccagaagtt

SEQ ID NO: 349268 - DNA, 24 bp, Artificial Sequence
  Description of Artificial Sequence: Synthetic oligonucleotide
gtgggggaggagggccagaagttg

SEQ ID NO: 349269 - DNA, 25 bp, Artificial Sequence
  Description of Artificial Sequence: Synthetic oligonucleotide
tgggggaggagggccagaagttgct

SEQ ID NO: 349270 - DNA, 24 bp, Artificial Sequence
  Description of Artificial Sequence: Synthetic oligonucleotide
gggggaggagggccagaagttgct

SEQ ID NO: 349271 - DNA, 24 bp, Artificial Sequence
  Description of Artificial Sequence: Synthetic oligonucleotide
ggggaggagggccagaagttgctg

SEQ ID NO: 349272 - DNA, 24 bp, Artificial Sequence
  Description of Artificial Sequence: Synthetic oligonucleotide
gggaggagggccagaagttgctgc

SEQ ID NO: 349273 - DNA, 24 bp, Artificial Sequence
  Description of Artificial Sequence: Synthetic oligonucleotide
ggaggagggccagaagttgctgcg

SEQ ID NO: 349274 - DNA, 24 bp, Artificial Sequence
  Description of Artificial Sequence: Synthetic oligonucleotide
gaggagggccagaagttgctgcgg

SEQ ID NO: 349275 - DNA, 24 bp, Artificial Sequence
  Description of Artificial Sequence: Synthetic oligonucleotide
aggagggccagaagttgctgcggg

SEQ ID NO: 349276 - DNA, 23 bp, Artificial Sequence
  Description of Artificial Sequence: Synthetic oligonucleotide
ggagggccagaagttgctgcggg

SEQ ID NO: 349277 - DNA, 23 bp, Artificial Sequence
  Description of Artificial Sequence: Synthetic oligonucleotide
gagggccagaagttgctgcgggg

SEQ ID NO: 349278 - DNA, 23 bp, Artificial Sequence
  Description of Artificial Sequence: Synthetic oligonucleotide
agggccagaagttgctgcggggc

SEQ ID NO: 349279 - DNA, 22 bp, Artificial Sequence
  Description of Artificial Sequence: Synthetic oligonucleotide
gggccagaagttgctgcggggc

SEQ ID NO: 349280 - DNA, 23 bp, Artificial Sequence
  Description of Artificial Sequence: Synthetic oligonucleotide
ggccagaagttgctgcggggcgt

SEQ ID NO: 349281 - DNA, 23 bp, Artificial Sequence
  Description of Artificial Sequence: Synthetic oligonucleotide
gccagaagttgctgcggggcgtg

SEQ ID NO: 349282 - DNA, 24 bp, Artificial Sequence
  Description of Artificial Sequence: Synthetic oligonucleotide
ccagaagttgctgcggggcgtgca

SEQ ID NO: 349283 - DNA, 24 bp, Artificial Sequence
  Description of Artificial Sequence: Synthetic oligonucleotide
cagaagttgctgcggggcgtgcag

SEQ ID NO: 349284 - DNA, 25 bp, Artificial Sequence
  Description of Artificial Sequence: Synthetic oligonucleotide
agaagttgctgcggggcgtgcaggt

SEQ ID NO: 349285 - DNA, 24 bp, Artificial Sequence
  Description of Artificial Sequence: Synthetic oligonucleotide
gaagttgctgcggggcgtgcaggt

SEQ ID NO: 349286 - DNA, 26 bp, Artificial Sequence
  Description of Artificial Sequence: Synthetic oligonucleotide
aagttgctgcggggcgtgcaggtgat

SEQ ID NO: 349287 - DNA, 25 bp, Artificial Sequence
  Description of Artificial Sequence: Synthetic oligonucleotide
agttgctgcggggcgtgcaggtgat

SEQ ID NO: 349288 - DNA, 24 bp, Artificial Sequence
  Description of Artificial Sequence: Synthetic oligonucleotide
gttgctgcggggcgtgcaggtgat

SEQ ID NO: 349289 - DNA, 24 bp, Artificial Sequence
  Description of Artificial Sequence: Synthetic oligonucleotide
ttgctgcggggcgtgcaggtgatc

SEQ ID NO: 349290 - DNA, 23 bp, Artificial Sequence
  Description of Artificial Sequence: Synthetic oligonucleotide
tgctgcggggcgtgcaggtgatc

SEQ ID NO: 349291 - DNA, 22 bp, Artificial Sequence
  Description of Artificial Sequence: Synthetic oligonucleotide
gctgcggggcgtgcaggtgatc

SEQ ID NO: 349292 - DNA, 22 bp, Artificial Sequence
  Description of Artificial Sequence: Synthetic oligonucleotide
ctgcggggcgtgcaggtgatcg

SEQ ID NO: 349293 - DNA, 22 bp, Artificial Sequence
  Description of Artificial Sequence: Synthetic oligonucleotide
tgcggggcgtgcaggtgatcgg

SEQ ID NO: 349294 - DNA, 21 bp, Artificial Sequence
  Description of Artificial Sequence: Synthetic oligonucleotide
gcggggcgtgcaggtgatcgg

SEQ ID NO: 349295 - DNA, 22 bp, Artificial Sequence
  Description of Artificial Sequence: Synthetic oligonucleotide
cggggcgtgcaggtgatcggga

SEQ ID NO: 349296 - DNA, 22 bp, Artificial Sequence
  Description of Artificial Sequence: Synthetic oligonucleotide
ggggcgtgcaggtgatcgggag

SEQ ID NO: 349297 - DNA, 22 bp, Artificial Sequence
  Description of Artificial Sequence: Synthetic oligonucleotide
gggcgtgcaggtgatcgggagc

SEQ ID NO: 349298 - DNA, 22 bp, Artificial Sequence
  Description of Artificial Sequence: Synthetic oligonucleotide
ggcgtgcaggtgatcgggagcc

SEQ ID NO: 349299 - DNA, 22 bp, Artificial Sequence
  Description of Artificial Sequence: Synthetic oligonucleotide
gcgtgcaggtgatcgggagccg

SEQ ID NO: 349300 - DNA, 22 bp, Artificial Sequence
  Description of Artificial Sequence: Synthetic oligonucleotide
cgtgcaggtgatcgggagccgc

SEQ ID NO: 349301 - DNA, 22 bp, Artificial Sequence
  Description of Artificial Sequence: Synthetic oligonucleotide
gtgcaggtgatcgggagccgcc

SEQ ID NO: 349302 - DNA, 22 bp, Artificial Sequence
  Description of Artificial Sequence: Synthetic oligonucleotide
tgcaggtgatcgggagccgccc

SEQ ID NO: 349303 - DNA, 21 bp, Artificial Sequence
  Description of Artificial Sequence: Synthetic oligonucleotide
gcaggtgatcgggagccgccc

SEQ ID NO: 349304 - DNA, 21 bp, Artificial Sequence
  Description of Artificial Sequence: Synthetic oligonucleotide
caggtgatcgggagccgcccg

SEQ ID NO: 349305 - DNA, 21 bp, Artificial Sequence
  Description of Artificial Sequence: Synthetic oligonucleotide
aggtgatcgggagccgcccgg

SEQ ID NO: 349306 - DNA, 20 bp, Artificial Sequence
  Description of Artificial Sequence: Synthetic oligonucleotide
ggtgatcgggagccgcccgg

SEQ ID NO: 349307 - DNA, 20 bp, Artificial Sequence
  Description of Artificial Sequence: Synthetic oligonucleotide
gtgatcgggagccgcccggg

SEQ ID NO: 349308 - DNA, 21 bp, Artificial Sequence
  Description of Artificial Sequence: Synthetic oligonucleotide
tgatcgggagccgcccgggca

SEQ ID NO: 349309 - DNA, 20 bp, Artificial Sequence
  Description of Artificial Sequence: Synthetic oligonucleotide
gatcgggagccgcccgggca

SEQ ID NO: 349310 - DNA, 20 bp, Artificial Sequence
  Description of Artificial Sequence: Synthetic oligonucleotide
atcgggagccgcccgggcac

SEQ ID NO: 349311 - DNA, 20 bp, Artificial Sequence
  Description of Artificial Sequence: Synthetic oligonucleotide
tcgggagccgcccgggcact

SEQ ID NO: 349312 - DNA, 20 bp, Artificial Sequence
  Description of Artificial Sequence: Synthetic oligonucleotide
cgggagccgcccgggcactt

SEQ ID NO: 349313 - DNA, 21 bp, Artificial Sequence
  Description of Artificial Sequence: Synthetic oligonucleotide
gggagccgcccgggcaccatt

SEQ ID NO: 349314 - DNA, 23 bp, Artificial Sequence
  Description of Artificial Sequence: Synthetic oligonucleotide
ggagccgcccgggcaccattgta

SEQ ID NO: 349315 - DNA, 23 bp, Artificial Sequence
  Description of Artificial Sequence: Synthetic oligonucleotide
gagccgcccgggcaccattgtag

SEQ ID NO: 349316 - DNA, 23 bp, Artificial Sequence
  Description of Artificial Sequence: Synthetic oligonucleotide
agccgcccgggcaccattgtagg

SEQ ID NO: 349317 - DNA, 22 bp, Artificial Sequence
  Description of Artificial Sequence: Synthetic oligonucleotide
gccgcccgggcaccattgtagg

SEQ ID NO: 349318 - DNA, 22 bp, Artificial Sequence
  Description of Artificial Sequence: Synthetic oligonucleotide
ccgcccgggcaccattgtaggg

SEQ ID NO: 349319 - DNA, 23 bp, Artificial Sequence
  Description of Artificial Sequence: Synthetic oligonucleotide
cgcccgggcaccattgtagggga

SEQ ID NO: 349320 - DNA, 23 bp, Artificial Sequence
  Description of Artificial Sequence: Synthetic oligonucleotide
gcccgggcaccattgtaggggac

SEQ ID NO: 349321 - DNA, 25 bp, Artificial Sequence
  Description of Artificial Sequence: Synthetic oligonucleotide
cccgggcaccattgtaggggaccat

SEQ ID NO: 349322 - DNA, 27 bp, Artificial Sequence
  Description of Artificial Sequence: Synthetic oligonucleotide
ccgggcaccattgtaggggaccatgtt

SEQ ID NO: 349323 - DNA, 27 bp, Artificial Sequence
  Description of Artificial Sequence: Synthetic oligonucleotide
cgggcaccattgtaggggaccatgttc

SEQ ID NO: 349324 - DNA, 27 bp, Artificial Sequence
  Description of Artificial Sequence: Synthetic oligonucleotide
gggcaccattgtaggggaccatgttcg

SEQ ID NO: 349325 - DNA, 27 bp, Artificial Sequence
  Description of Artificial Sequence: Synthetic oligonucleotide
ggcaccattgtaggggaccatgttcgg

SEQ ID NO: 349326 - DNA, 27 bp, Artificial Sequence
  Description of Artificial Sequence: Synthetic oligonucleotide
gcaccattgtaggggaccatgttcggc

SEQ ID NO: 349327 - DNA, 27 bp, Artificial Sequence
  Description of Artificial Sequence: Synthetic oligonucleotide
caccattgtaggggaccatgttcggcg

SEQ ID NO: 349328 - DNA, 28 bp, Artificial Sequence
  Description of Artificial Sequence: Synthetic oligonucleotide
accattgtaggggaccatgttcggcgag

SEQ ID NO: 349329 - DNA, 27 bp, Artificial Sequence
  Description of Artificial Sequence: Synthetic oligonucleotide
ccattgtaggggaccatgttcggcgag

SEQ ID NO: 349330 - DNA, 27 bp, Artificial Sequence
  Description of Artificial Sequence: Synthetic oligonucleotide
cattgtaggggaccatgttcggcgagg

SEQ ID NO: 349331 - DNA, 27 bp, Artificial Sequence
  Description of Artificial Sequence: Synthetic oligonucleotide
attgtaggggaccatgttcggcgaggg

SEQ ID NO: 349332 - DNA, 26 bp, Artificial Sequence
  Description of Artificial Sequence: Synthetic oligonucleotide
ttgtaggggaccatgttcggcgaggg

SEQ ID NO: 349333 - DNA, 25 bp, Artificial Sequence
  Description of Artificial Sequence: Synthetic oligonucleotide
tgtaggggaccatgttcggcgaggg

SEQ ID NO: 349334 - DNA, 24 bp, Artificial Sequence
  Description of Artificial Sequence: Synthetic oligonucleotide
gtaggggaccatgttcggcgaggg

SEQ ID NO: 349335 - DNA, 25 bp, Artificial Sequence
  Description of Artificial Sequence: Synthetic oligonucleotide
taggggaccatgttcggcgagggga

SEQ ID NO: 349336 - DNA, 24 bp, Artificial Sequence
  Description of Artificial Sequence: Synthetic oligonucleotide
aggggaccatgttcggcgagggga

SEQ ID NO: 349337 - DNA, 23 bp, Artificial Sequence
  Description of Artificial Sequence: Synthetic oligonucleotide
ggggaccatgttcggcgagggga

SEQ ID NO: 349338 - DNA, 26 bp, Artificial Sequence
  Description of Artificial Sequence: Synthetic oligonucleotide
gggaccatgttcggcgaggggacaat

SEQ ID NO: 349339 - DNA, 27 bp, Artificial Sequence
  Description of Artificial Sequence: Synthetic oligonucleotide
ggaccatgttcggcgaggggacaatgt

SEQ ID NO: 349340 - DNA, 27 bp, Artificial Sequence
  Description of Artificial Sequence: Synthetic oligonucleotide
gaccatgttcggcgaggggacaatgtc

SEQ ID NO: 349341 - DNA, 27 bp, Artificial Sequence
  Description of Artificial Sequence: Synthetic oligonucleotide
accatgttcggcgaggggacaatgtcc

SEQ ID NO: 349342 - DNA, 27 bp, Artificial Sequence
  Description of Artificial Sequence: Synthetic oligonucleotide
ccatgttcggcgaggggacaatgtcca

SEQ ID NO: 349343 - DNA, 28 bp, Artificial Sequence
  Description of Artificial Sequence: Synthetic oligonucleotide
catgttcggcgaggggacaatgtccatg

SEQ ID NO: 349344 - DNA, 29 bp, Artificial Sequence
  Description of Artificial Sequence: Synthetic oligonucleotide
atgttcggcgaggggacaatgtccatgac

SEQ ID NO: 349345 - DNA, 28 bp, Artificial Sequence
  Description of Artificial Sequence: Synthetic oligonucleotide
tgttcggcgaggggacaatgtccatgac

SEQ ID NO: 349346 - DNA, 27 bp, Artificial Sequence
  Description of Artificial Sequence: Synthetic oligonucleotide
gttcggcgaggggacaatgtccatgac

SEQ ID NO: 349347 - DNA, 29 bp, Artificial Sequence
  Description of Artificial Sequence: Synthetic oligonucleotide
ttcggcgaggggacaatgtccatgacatg

SEQ ID NO: 349348 - DNA, 28 bp, Artificial Sequence
  Description of Artificial Sequence: Synthetic oligonucleotide
tcggcgaggggacaatgtccatgacatg

SEQ ID NO: 349349 - DNA, 27 bp, Artificial Sequence
  Description of Artificial Sequence: Synthetic oligonucleotide
cggcgaggggacaatgtccatgacatg

SEQ ID NO: 349350 - DNA, 27 bp, Artificial Sequence
  Description of Artificial Sequence: Synthetic oligonucleotide
ggcgaggggacaatgtccatgacatgc

SEQ ID NO: 349351 - DNA, 27 bp, Artificial Sequence
  Description of Artificial Sequence: Synthetic oligonucleotide
gcgaggggacaatgtccatgacatgcc

SEQ ID NO: 349352 - DNA, 31 bp, Artificial Sequence
  Description of Artificial Sequence: Synthetic oligonucleotide
cgaggggacaatgtccatgacatgccaaatg

SEQ ID NO: 349353 - DNA, 32 bp, Artificial Sequence
  Description of Artificial Sequence: Synthetic oligonucleotide
gaggggacaatgtccatgacatgccaaatgtg

SEQ ID NO: 349354 - DNA, 33 bp, Artificial Sequence
  Description of Artificial Sequence: Synthetic oligonucleotide
aggggacaatgtccatgacatgccaaatgtgtg

SEQ ID NO: 349355 - DNA, 32 bp, Artificial Sequence
  Description of Artificial Sequence: Synthetic oligonucleotide
ggggacaatgtccatgacatgccaaatgtgtg

SEQ ID NO: 349356 - DNA, 32 bp, Artificial Sequence
  Description of Artificial Sequence: Synthetic oligonucleotide
gggacaatgtccatgacatgccaaatgtgtgg

SEQ ID NO: 349357 - DNA, 34 bp, Artificial Sequence
  Description of Artificial Sequence: Synthetic oligonucleotide
ggacaatgtccatgacatgccaaatgtgtggaag

SEQ ID NO: 349358 - DNA, 34 bp, Artificial Sequence
  Description of Artificial Sequence: Synthetic oligonucleotide
gacaatgtccatgacatgccaaatgtgtggaagc

SEQ ID NO: 349359 - DNA, 34 bp, Artificial Sequence
  Description of Artificial Sequence: Synthetic oligonucleotide
acaatgtccatgacatgccaaatgtgtggaagcg

SEQ ID NO: 349360 - DNA, 33 bp, Artificial Sequence
  Description of Artificial Sequence: Synthetic oligonucleotide
caatgtccatgacatgccaaatgtgtggaagcg

SEQ ID NO: 349361 - DNA, 33 bp, Artificial Sequence
  Description of Artificial Sequence: Synthetic oligonucleotide
aatgtccatgacatgccaaatgtgtggaagcgg

SEQ ID NO: 349362 - DNA, 32 bp, Artificial Sequence
  Description of Artificial Sequence: Synthetic oligonucleotide
atgtccatgacatgccaaatgtgtggaagcgg

SEQ ID NO: 349363 - DNA, 31 bp, Artificial Sequence
  Description of Artificial Sequence: Synthetic oligonucleotide
tgtccatgacatgccaaatgtgtggaagcgg

SEQ ID NO: 349364 - DNA, 30 bp, Artificial Sequence
  Description of Artificial Sequence: Synthetic oligonucleotide
gtccatgacatgccaaatgtgtggaagcgg

SEQ ID NO: 349365 - DNA, 30 bp, Artificial Sequence
  Description of Artificial Sequence: Synthetic oligonucleotide
tccatgacatgccaaatgtgtggaagcggg

SEQ ID NO: 349366 - DNA, 29 bp, Artificial Sequence
  Description of Artificial Sequence: Synthetic oligonucleotide
ccatgacatgccaaatgtgtggaagcggg

SEQ ID NO: 349367 - DNA, 30 bp, Artificial Sequence
  Description of Artificial Sequence: Synthetic oligonucleotide
catgacatgccaaatgtgtggaagcgggtg

SEQ ID NO: 349368 - DNA, 30 bp, Artificial Sequence
  Description of Artificial Sequence: Synthetic oligonucleotide
atgacatgccaaatgtgtggaagcgggtgg

SEQ ID NO: 349369 - DNA, 29 bp, Artificial Sequence
  Description of Artificial Sequence: Synthetic oligonucleotide
tgacatgccaaatgtgtggaagcgggtgg

SEQ ID NO: 349370 - DNA, 28 bp, Artificial Sequence
  Description of Artificial Sequence: Synthetic oligonucleotide
gacatgccaaatgtgtggaagcgggtgg

SEQ ID NO: 349371 - DNA, 29 bp, Artificial Sequence
  Description of Artificial Sequence: Synthetic oligonucleotide
acatgccaaatgtgtggaagcgggtggtg

SEQ ID NO: 349372 - DNA, 28 bp, Artificial Sequence
  Description of Artificial Sequence: Synthetic oligonucleotide
catgccaaatgtgtggaagcgggtggtg

SEQ ID NO: 349373 - DNA, 28 bp, Artificial Sequence
  Description of Artificial Sequence: Synthetic oligonucleotide
atgccaaatgtgtggaagcgggtggtgg

SEQ ID NO: 349374 - DNA, 27 bp, Artificial Sequence
  Description of Artificial Sequence: Synthetic oligonucleotide
tgccaaatgtgtggaagcgggtggtgg

SEQ ID NO: 349375 - DNA, 26 bp, Artificial Sequence
  Description of Artificial Sequence: Synthetic oligonucleotide
gccaaatgtgtggaagcgggtggtgg

SEQ ID NO: 349376 - DNA, 26 bp, Artificial Sequence
  Description of Artificial Sequence: Synthetic oligonucleotide
ccaaatgtgtggaagcgggtggtggg

SEQ ID NO: 349377 - DNA, 26 bp, Artificial Sequence
  Description of Artificial Sequence: Synthetic oligonucleotide
caaatgtgtggaagcgggtggtgggc

SEQ ID NO: 349378 - DNA, 27 bp, Artificial Sequence
  Description of Artificial Sequence: Synthetic oligonucleotide
aaatgtgtggaagcgggtggtgggcga

SEQ ID NO: 349379 - DNA, 26 bp, Artificial Sequence
  Description of Artificial Sequence: Synthetic oligonucleotide
aatgtgtggaagcgggtggtgggcga

SEQ ID NO: 349380 - DNA, 25 bp, Artificial Sequence
  Description of Artificial Sequence: Synthetic oligonucleotide
atgtgtggaagcgggtggtgggcga

SEQ ID NO: 349381 - DNA, 24 bp, Artificial Sequence
  Description of Artificial Sequence: Synthetic oligonucleotide
tgtgtggaagcgggtggtgggcga

SEQ ID NO: 349382 - DNA, 23 bp, Artificial Sequence
  Description of Artificial Sequence: Synthetic oligonucleotide
gtgtggaagcgggtggtgggcga

SEQ ID NO: 349383 - DNA, 23 bp, Artificial Sequence
  Description of Artificial Sequence: Synthetic oligonucleotide
tgtggaagcgggtggtgggcgac

SEQ ID NO: 349384 - DNA, 22 bp, Artificial Sequence
  Description of Artificial Sequence: Synthetic oligonucleotide
gtggaagcgggtggtgggcgac

SEQ ID NO: 349385 - DNA, 22 bp, Artificial Sequence
  Description of Artificial Sequence: Synthetic oligonucleotide
tggaagcgggtggtgggcgacc

SEQ ID NO: 349386 - DNA, 21 bp, Artificial Sequence
  Description of Artificial Sequence: Synthetic oligonucleotide
ggaagcgggtggtgggcgacc

SEQ ID NO: 349387 - DNA, 21 bp, Artificial Sequence
  Description of Artificial Sequence: Synthetic oligonucleotide
gaagcgggtggtgggcgaccg

SEQ ID NO: 349388 - DNA, 21 bp, Artificial Sequence
  Description of Artificial Sequence: Synthetic oligonucleotide
aagcgggtggtgggcgaccgg

SEQ ID NO: 349389 - DNA, 20 bp, Artificial Sequence
  Description of Artificial Sequence: Synthetic oligonucleotide
agcgggtggtgggcgaccgg

SEQ ID NO: 349390 - DNA, 20 bp, Artificial Sequence
  Description of Artificial Sequence: Synthetic oligonucleotide
gcgggtggtgggcgaccggt

SEQ ID NO: 349391 - DNA, 20 bp, Artificial Sequence
  Description of Artificial Sequence: Synthetic oligonucleotide
cgggtggtgggcgaccggct

SEQ ID NO: 349392 - DNA, 22 bp, Artificial Sequence
  Description of Artificial Sequence: Synthetic oligonucleotide
gggtggtgggcgaccggcgtta

SEQ ID NO: 349393 - DNA, 22 bp, Artificial Sequence
  Description of Artificial Sequence: Synthetic oligonucleotide
ggtggtgggcgaccggcgttac

SEQ ID NO: 349394 - DNA, 24 bp, Artificial Sequence
  Description of Artificial Sequence: Synthetic oligonucleotide
gtggtgggcgaccggcgttaccta

SEQ ID NO: 349395 - DNA, 25 bp, Artificial Sequence
  Description of Artificial Sequence: Synthetic oligonucleotide
tggtgggcgaccggcgttacctaca

SEQ ID NO: 349396 - DNA, 24 bp, Artificial Sequence
  Description of Artificial Sequence: Synthetic oligonucleotide
ggtgggcgaccggcgttacctaca

SEQ ID NO: 349397 - DNA, 24 bp, Artificial Sequence
  Description of Artificial Sequence: Synthetic oligonucleotide
gtgggcgaccggcgttacctacag

SEQ ID NO: 349398 - DNA, 25 bp, Artificial Sequence
  Description of Artificial Sequence: Synthetic oligonucleotide
tgggcgaccggcgttacctacagga

SEQ ID NO: 349399 - DNA, 24 bp, Artificial Sequence
  Description of Artificial Sequence: Synthetic oligonucleotide
gggcgaccggcgttacctacagga

SEQ ID NO: 349400 - DNA, 24 bp, Artificial Sequence
  Description of Artificial Sequence: Synthetic oligonucleotide
ggcgaccggcgttacctacaggag

SEQ ID NO: 349401 - DNA, 24 bp, Artificial Sequence
  Description of Artificial Sequence: Synthetic oligonucleotide
gcgaccggcgttacctacaggagg

SEQ ID NO: 349402 - DNA, 24 bp, Artificial Sequence
  Description of Artificial Sequence: Synthetic oligonucleotide
cgaccggcgttacctacaggaggc

SEQ ID NO: 349403 - DNA, 24 bp, Artificial Sequence
  Description of Artificial Sequence: Synthetic oligonucleotide
gaccggcgttacctacaggaggcc

SEQ ID NO: 349404 - DNA, 25 bp, Artificial Sequence
  Description of Artificial Sequence: Synthetic oligonucleotide
accggcgttacctacaggaggccct

SEQ ID NO: 349405 - DNA, 24 bp, Artificial Sequence
  Description of Artificial Sequence: Synthetic oligonucleotide
ccggcgttacctacaggaggccct

SEQ ID NO: 349406 - DNA, 24 bp, Artificial Sequence
  Description of Artificial Sequence: Synthetic oligonucleotide
cggcgttacctacaggaggccctg

SEQ ID NO: 349407 - DNA, 25 bp, Artificial Sequence
  Description of Artificial Sequence: Synthetic oligonucleotide
ggcgttacctacaggaggccctggt

SEQ ID NO: 349408 - DNA, 26 bp, Artificial Sequence
  Description of Artificial Sequence: Synthetic oligonucleotide
gcgttacctacaggaggccctggtct

SEQ ID NO: 349409 - DNA, 26 bp, Artificial Sequence
  Description of Artificial Sequence: Synthetic oligonucleotide
cgttacctacaggaggccctggtctg

SEQ ID NO: 349410 - DNA, 27 bp, Artificial Sequence
  Description of Artificial Sequence: Synthetic oligonucleotide
gttacctacaggaggccctggtctggt

SEQ ID NO: 349411 - DNA, 28 bp, Artificial Sequence
  Description of Artificial Sequence: Synthetic oligonucleotide
ttacctacaggaggccctggtctggttc

SEQ ID NO: 349412 - DNA, 27 bp, Artificial Sequence
  Description of Artificial Sequence: Synthetic oligonucleotide
tacctacaggaggccctggtctggttc

SEQ ID NO: 349413 - DNA, 26 bp, Artificial Sequence
  Description of Artificial Sequence: Synthetic oligonucleotide
acctacaggaggccctggtctggttc

SEQ ID NO: 349414 - DNA, 25 bp, Artificial Sequence
  Description of Artificial Sequence: Synthetic oligonucleotide
cctacaggaggccctggtctggttc

SEQ ID NO: 349415 - DNA, 25 bp, Artificial Sequence
  Description of Artificial Sequence: Synthetic oligonucleotide
ctacaggaggccctggtctggttcc

SEQ ID NO: 349416 - DNA, 26 bp, Artificial Sequence
  Description of Artificial Sequence: Synthetic oligonucleotide
tacaggaggccctggtctggttccgt

SEQ ID NO: 349417 - DNA, 25 bp, Artificial Sequence
  Description of Artificial Sequence: Synthetic oligonucleotide
acaggaggccctggtctggttccgt

SEQ ID NO: 349418 - DNA, 24 bp, Artificial Sequence
  Description of Artificial Sequence: Synthetic oligonucleotide
caggaggccctggtctggttccgt

SEQ ID NO: 349419 - DNA, 24 bp, Artificial Sequence
  Description of Artificial Sequence: Synthetic oligonucleotide
aggaggccctggtctggttccgtg

SEQ ID NO: 349420 - DNA, 23 bp, Artificial Sequence
  Description of Artificial Sequence: Synthetic oligonucleotide
ggaggccctggtctggttccgtg

SEQ ID NO: 349421 - DNA, 24 bp, Artificial Sequence
  Description of Artificial Sequence: Synthetic oligonucleotide
gaggccctggtctggttccgtgct

SEQ ID NO: 349422 - DNA, 24 bp, Artificial Sequence
  Description of Artificial Sequence: Synthetic oligonucleotide
aggccctggtctggttccgtgctc

SEQ ID NO: 349423 - DNA, 23 bp, Artificial Sequence
  Description of Artificial Sequence: Synthetic oligonucleotide
ggccctggtctggttccgtgctc

SEQ ID NO: 349424 - DNA, 23 bp, Artificial Sequence
  Description of Artificial Sequence: Synthetic oligonucleotide
gccctggtctggttccgtgctcg

SEQ ID NO: 349425 - DNA, 25 bp, Artificial Sequence
  Description of Artificial Sequence: Synthetic oligonucleotide
ccctggtctggttccgtgctcgcta

SEQ ID NO: 349426 - DNA, 26 bp, Artificial Sequence
  Description of Artificial Sequence: Synthetic oligonucleotide
cctggtctggttccgtgctcgctact

SEQ ID NO: 349427 - DNA, 26 bp, Artificial Sequence
  Description of Artificial Sequence: Synthetic oligonucleotide
ctggtctggttccgtgctcgctactg

SEQ ID NO: 349428 - DNA, 27 bp, Artificial Sequence
  Description of Artificial Sequence: Synthetic oligonucleotide
tggtctggttccgtgctcgctactgct

SEQ ID NO: 349429 - DNA, 26 bp, Artificial Sequence
  Description of Artificial Sequence: Synthetic oligonucleotide
ggtctggttccgtgctcgctactgct

SEQ ID NO: 349430 - DNA, 26 bp, Artificial Sequence
  Description of Artificial Sequence: Synthetic oligonucleotide
gtctggttccgtgctcgctactgctc

SEQ ID NO: 349431 - DNA, 26 bp, Artificial Sequence
  Description of Artificial Sequence: Synthetic oligonucleotide
tctggttccgtgctcgctactgctcc

SEQ ID NO: 349432 - DNA, 25 bp, Artificial Sequence
  Description of Artificial Sequence: Synthetic oligonucleotide
ctggttccgtgctcgctactgctcc

SEQ ID NO: 349433 - DNA, 26 bp, Artificial Sequence
  Description of Artificial Sequence: Synthetic oligonucleotide
tggttccgtgctcgctactgctccct

SEQ ID NO: 349434 - DNA, 25 bp, Artificial Sequence
  Description of Artificial Sequence: Synthetic oligonucleotide
ggttccgtgctcgctactgctccct

SEQ ID NO: 349435 - DNA, 27 bp, Artificial Sequence
  Description of Artificial Sequence: Synthetic oligonucleotide
gttccgtgctcgctactgctccctcaa

SEQ ID NO: 349436 - DNA, 27 bp, Artificial Sequence
  Description of Artificial Sequence: Synthetic oligonucleotide
ttccgtgctcgctactgctccctcaac

SEQ ID NO: 349437 - DNA, 27 bp, Artificial Sequence
  Description of Artificial Sequence: Synthetic oligonucleotide
tccgtgctcgctactgctccctcaact

SEQ ID NO: 349438 - DNA, 27 bp, Artificial Sequence
  Description of Artificial Sequence: Synthetic oligonucleotide
ccgtgctcgctactgctccctcaactt

SEQ ID NO: 349439 - DNA, 27 bp, Artificial Sequence
  Description of Artificial Sequence: Synthetic oligonucleotide
cgtgctcgctactgctccctcaacttc

SEQ ID NO: 349440 - DNA, 27 bp, Artificial Sequence
  Description of Artificial Sequence: Synthetic oligonucleotide
gtgctcgctactgctccctcaacttcg

SEQ ID NO: 349441 - DNA, 28 bp, Artificial Sequence
  Description of Artificial Sequence: Synthetic oligonucleotide
tgctcgctactgctccctcaacttcgtg

SEQ ID NO: 349442 - DNA, 27 bp, Artificial Sequence
  Description of Artificial Sequence: Synthetic oligonucleotide
gctcgctactgctccctcaacttcgtg

SEQ ID NO: 349443 - DNA, 27 bp, Artificial Sequence
  Description of Artificial Sequence: Synthetic oligonucleotide
ctcgctactgctccctcaacttcgtgg

SEQ ID NO: 349444 - DNA, 28 bp, Artificial Sequence
  Description of Artificial Sequence: Synthetic oligonucleotide
tcgctactgctccctcaacttcgtggtg

SEQ ID NO: 349445 - DNA, 27 bp, Artificial Sequence
  Description of Artificial Sequence: Synthetic oligonucleotide
cgctactgctccctcaacttcgtggtg

SEQ ID NO: 349446 - DNA, 28 bp, Artificial Sequence
  Description of Artificial Sequence: Synthetic oligonucleotide
gctactgctccctcaacttcgtggtgac

SEQ ID NO: 349447 - DNA, 28 bp, Artificial Sequence
  Description of Artificial Sequence: Synthetic oligonucleotide
ctactgctccctcaacttcgtggtgacc

SEQ ID NO: 349448 - DNA, 29 bp, Artificial Sequence
  Description of Artificial Sequence: Synthetic oligonucleotide
tactgctccctcaacttcgtggtgaccag

SEQ ID NO: 349449 - DNA, 28 bp, Artificial Sequence
  Description of Artificial Sequence: Synthetic oligonucleotide
actgctccctcaacttcgtggtgaccag

SEQ ID NO: 349450 - DNA, 27 bp, Artificial Sequence
  Description of Artificial Sequence: Synthetic oligonucleotide
ctgctccctcaacttcgtggtgaccag

SEQ ID NO: 349451 - DNA, 31 bp, Artificial Sequence
  Description of Artificial Sequence: Synthetic oligonucleotide
tgctccctcaacttcgtggtgaccagtaatc

SEQ ID NO: 349452 - DNA, 30 bp, Artificial Sequence
  Description of Artificial Sequence: Synthetic oligonucleotide
gctccctcaacttcgtggtgaccagtaatc

SEQ ID NO: 349453 - DNA, 30 bp, Artificial Sequence
  Description of Artificial Sequence: Synthetic oligonucleotide
ctccctcaacttcgtggtgaccagtaatcg

SEQ ID NO: 349454 - DNA, 30 bp, Artificial Sequence
  Description of Artificial Sequence: Synthetic oligonucleotide
tccctcaacttcgtggtgaccagtaatcgc

SEQ ID NO: 349455 - DNA, 29 bp, Artificial Sequence
  Description of Artificial Sequence: Synthetic oligonucleotide
ccctcaacttcgtggtgaccagtaatcgc

SEQ ID NO: 349456 - DNA, 31 bp, Artificial Sequence
  Description of Artificial Sequence: Synthetic oligonucleotide
cctcaacttcgtggtgaccagtaatcgcatg

SEQ ID NO: 349457 - DNA, 31 bp, Artificial Sequence
  Description of Artificial Sequence: Synthetic oligonucleotide
ctcaacttcgtggtgaccagtaatcgcatgg

SEQ ID NO: 349458 - DNA, 31 bp, Artificial Sequence
  Description of Artificial Sequence: Synthetic oligonucleotide
tcaacttcgtggtgaccagtaatcgcatggc

SEQ ID NO: 349459 - DNA, 30 bp, Artificial Sequence
  Description of Artificial Sequence: Synthetic oligonucleotide
caacttcgtggtgaccagtaatcgcatggc

SEQ ID NO: 349460 - DNA, 30 bp, Artificial Sequence
  Description of Artificial Sequence: Synthetic oligonucleotide
aacttcgtggtgaccagtaatcgcatggcc

SEQ ID NO: 349461 - DNA, 29 bp, Artificial Sequence
  Description of Artificial Sequence: Synthetic oligonucleotide
acttcgtggtgaccagtaatcgcatggcc

SEQ ID NO: 349462 - DNA, 28 bp, Artificial Sequence
  Description of Artificial Sequence: Synthetic oligonucleotide
cttcgtggtgaccagtaatcgcatggcc

SEQ ID NO: 349463 - DNA, 29 bp, Artificial Sequence
  Description of Artificial Sequence: Synthetic oligonucleotide
ttcgtggtgaccagtaatcgcatggcctc

SEQ ID NO: 349464 - DNA, 28 bp, Artificial Sequence
  Description of Artificial Sequence: Synthetic oligonucleotide
tcgtggtgaccagtaatcgcatggcctc

SEQ ID NO: 349465 - DNA, 27 bp, Artificial Sequence
  Description of Artificial Sequence: Synthetic oligonucleotide
cgtggtgaccagtaatcgcatggcctc

SEQ ID NO: 349466 - DNA, 27 bp, Artificial Sequence
  Description of Artificial Sequence: Synthetic oligonucleotide
gtggtgaccagtaatcgcatggcctcg

SEQ ID NO: 349467 - DNA, 28 bp, Artificial Sequence
  Description of Artificial Sequence: Synthetic oligonucleotide
tggtgaccagtaatcgcatggcctcgtg

SEQ ID NO: 349468 - DNA, 27 bp, Artificial Sequence
  Description of Artificial Sequence: Synthetic oligonucleotide
ggtgaccagtaatcgcatggcctcgtg

SEQ ID NO: 349469 - DNA, 28 bp, Artificial Sequence
  Description of Artificial Sequence: Synthetic oligonucleotide
gtgaccagtaatcgcatggcctcgtgtc

SEQ ID NO: 349470 - DNA, 28 bp, Artificial Sequence
  Description of Artificial Sequence: Synthetic oligonucleotide
tgaccagtaatcgcatggcctcgtgtcg

SEQ ID NO: 349471 - DNA, 27 bp, Artificial Sequence
  Description of Artificial Sequence: Synthetic oligonucleotide
gaccagtaatcgcatggcctcgtgtcg

SEQ ID NO: 349472 - DNA, 27 bp, Artificial Sequence
  Description of Artificial Sequence: Synthetic oligonucleotide
accagtaatcgcatggcctcgtgtcgg

SEQ ID NO: 349473 - DNA, 26 bp, Artificial Sequence
  Description of Artificial Sequence: Synthetic oligonucleotide
ccagtaatcgcatggcctcgtgtcgg

SEQ ID NO: 349474 - DNA, 27 bp, Artificial Sequence
  Description of Artificial Sequence: Synthetic oligonucleotide
cagtaatcgcatggcctcgtgtcggga

SEQ ID NO: 349475 - DNA, 27 bp, Artificial Sequence
  Description of Artificial Sequence: Synthetic oligonucleotide
agtaatcgcatggcctcgtgtcgggac

SEQ ID NO: 349476 - DNA, 27 bp, Artificial Sequence
  Description of Artificial Sequence: Synthetic oligonucleotide
gtaatcgcatggcctcgtgtcgggaca

SEQ ID NO: 349477 - DNA, 28 bp, Artificial Sequence
  Description of Artificial Sequence: Synthetic oligonucleotide
taatcgcatggcctcgtgtcgggacaac

SEQ ID NO: 349478 - DNA, 27 bp, Artificial Sequence
  Description of Artificial Sequence: Synthetic oligonucleotide
aatcgcatggcctcgtgtcgggacaac

SEQ ID NO: 349479 - DNA, 27 bp, Artificial Sequence
  Description of Artificial Sequence: Synthetic oligonucleotide
atcgcatggcctcgtgtcgggacaaca

SEQ ID NO: 349480 - DNA, 27 bp, Artificial Sequence
  Description of Artificial Sequence: Synthetic oligonucleotide
tcgcatggcctcgtgtcgggacaacat

SEQ ID NO: 349481 - DNA, 27 bp, Artificial Sequence
  Description of Artificial Sequence: Synthetic oligonucleotide
cgcatggcctcgtgtcgggacaacatt

SEQ ID NO: 349482 - DNA, 27 bp, Artificial Sequence
  Description of Artificial Sequence: Synthetic oligonucleotide
gcatggcctcgtgtcgggacaacattg

SEQ ID NO: 349483 - DNA, 28 bp, Artificial Sequence
  Description of Artificial Sequence: Synthetic oligonucleotide
catggcctcgtgtcgggacaacattgac

SEQ ID NO: 349484 - DNA, 29 bp, Artificial Sequence
  Description of Artificial Sequence: Synthetic oligonucleotide
atggcctcgtgtcgggacaacattgactc

SEQ ID NO: 349485 - DNA, 28 bp, Artificial Sequence
  Description of Artificial Sequence: Synthetic oligonucleotide
tggcctcgtgtcgggacaacattgactc

SEQ ID NO: 349486 - DNA, 27 bp, Artificial Sequence
  Description of Artificial Sequence: Synthetic oligonucleotide
ggcctcgtgtcgggacaacattgactc

SEQ ID NO: 349487 - DNA, 27 bp, Artificial Sequence
  Description of Artificial Sequence: Synthetic oligonucleotide
gcctcgtgtcgggacaacattgactcc

SEQ ID NO: 349488 - DNA, 28 bp, Artificial Sequence
  Description of Artificial Sequence: Synthetic oligonucleotide
cctcgtgtcgggacaacattgactcctc

SEQ ID NO: 349489 - DNA, 28 bp, Artificial Sequence
  Description of Artificial Sequence: Synthetic oligonucleotide
ctcgtgtcgggacaacattgactcctcc

SEQ ID NO: 349490 - DNA, 28 bp, Artificial Sequence
  Description of Artificial Sequence: Synthetic oligonucleotide
tcgtgtcgggacaacattgactcctccc

SEQ ID NO: 349491 - DNA, 27 bp, Artificial Sequence
  Description of Artificial Sequence: Synthetic oligonucleotide
cgtgtcgggacaacattgactcctccc

SEQ ID NO: 349492 - DNA, 28 bp, Artificial Sequence
  Description of Artificial Sequence: Synthetic oligonucleotide
gtgtcgggacaacattgactcctcccac

SEQ ID NO: 349493 - DNA, 28 bp, Artificial Sequence
  Description of Artificial Sequence: Synthetic oligonucleotide
tgtcgggacaacattgactcctcccacg

SEQ ID NO: 349494 - DNA, 27 bp, Artificial Sequence
  Description of Artificial Sequence: Synthetic oligonucleotide
gtcgggacaacattgactcctcccacg

SEQ ID NO: 349495 - DNA, 27 bp, Artificial Sequence
  Description of Artificial Sequence: Synthetic oligonucleotide
tcgggacaacattgactcctcccacgc

SEQ ID NO: 349496 - DNA, 27 bp, Artificial Sequence
  Description of Artificial Sequence: Synthetic oligonucleotide
cgggacaacattgactcctcccacgct

SEQ ID NO: 349497 - DNA, 27 bp, Artificial Sequence
  Description of Artificial Sequence: Synthetic oligonucleotide
gggacaacattgactcctcccacgctg

SEQ ID NO: 349498 - DNA, 29 bp, Artificial Sequence
  Description of Artificial Sequence: Synthetic oligonucleotide
ggacaacattgactcctcccacgctgatg

SEQ ID NO: 349499 - DNA, 30 bp, Artificial Sequence
  Description of Artificial Sequence: Synthetic oligonucleotide
gacaacattgactcctcccacgctgatgtg

SEQ ID NO: 349500 - DNA, 30 bp, Artificial Sequence
  Description of Artificial Sequence: Synthetic oligonucleotide
acaacattgactcctcccacgctgatgtgg

SEQ ID NO: 349501 - DNA, 29 bp, Artificial Sequence
  Description of Artificial Sequence: Synthetic oligonucleotide
caacattgactcctcccacgctgatgtgg

SEQ ID NO: 349502 - DNA, 30 bp, Artificial Sequence
  Description of Artificial Sequence: Synthetic oligonucleotide
aacattgactcctcccacgctgatgtggtc

SEQ ID NO: 349503 - DNA, 29 bp, Artificial Sequence
  Description of Artificial Sequence: Synthetic oligonucleotide
acattgactcctcccacgctgatgtggtc

SEQ ID NO: 349504 - DNA, 28 bp, Artificial Sequence
  Description of Artificial Sequence: Synthetic oligonucleotide
cattgactcctcccacgctgatgtggtc

SEQ ID NO: 349505 - DNA, 31 bp, Artificial Sequence
  Description of Artificial Sequence: Synthetic oligonucleotide
attgactcctcccacgctgatgtggtctttg

SEQ ID NO: 349506 - DNA, 30 bp, Artificial Sequence
  Description of Artificial Sequence: Synthetic oligonucleotide
ttgactcctcccacgctgatgtggtctttg

SEQ ID NO: 349507 - DNA, 29 bp, Artificial Sequence
  Description of Artificial Sequence: Synthetic oligonucleotide
tgactcctcccacgctgatgtggtctttg

SEQ ID NO: 349508 - DNA, 28 bp, Artificial Sequence
  Description of Artificial Sequence: Synthetic oligonucleotide
gactcctcccacgctgatgtggtctttg

SEQ ID NO: 349509 - DNA, 28 bp, Artificial Sequence
  Description of Artificial Sequence: Synthetic oligonucleotide
actcctcccacgctgatgtggtctttgc

SEQ ID NO: 349510 - DNA, 27 bp, Artificial Sequence
  Description of Artificial Sequence: Synthetic oligonucleotide
ctcctcccacgctgatgtggtctttgc

SEQ ID NO: 349511 - DNA, 28 bp, Artificial Sequence
  Description of Artificial Sequence: Synthetic oligonucleotide
tcctcccacgctgatgtggtctttgctg

SEQ ID NO: 349512 - DNA, 27 bp, Artificial Sequence
  Description of Artificial Sequence: Synthetic oligonucleotide
cctcccacgctgatgtggtctttgctg

SEQ ID NO: 349513 - DNA, 27 bp, Artificial Sequence
  Description of Artificial Sequence: Synthetic oligonucleotide
ctcccacgctgatgtggtctttgctgg

SEQ ID NO: 349514 - DNA, 27 bp, Artificial Sequence
  Description of Artificial Sequence: Synthetic oligonucleotide
tcccacgctgatgtggtctttgctggc

SEQ ID NO: 349515 - DNA, 26 bp, Artificial Sequence
  Description of Artificial Sequence: Synthetic oligonucleotide
cccacgctgatgtggtctttgctggc

SEQ ID NO: 349516 - DNA, 27 bp, Artificial Sequence
  Description of Artificial Sequence: Synthetic oligonucleotide
ccacgctgatgtggtctttgctggcca

SEQ ID NO: 349517 - DNA, 28 bp, Artificial Sequence
  Description of Artificial Sequence: Synthetic oligonucleotide
cacgctgatgtggtctttgctggccatg

SEQ ID NO: 349518 - DNA, 28 bp, Artificial Sequence
  Description of Artificial Sequence: Synthetic oligonucleotide
acgctgatgtggtctttgctggccatgg

SEQ ID NO: 349519 - DNA, 27 bp, Artificial Sequence
  Description of Artificial Sequence: Synthetic oligonucleotide
cgctgatgtggtctttgctggccatgg

SEQ ID NO: 349520 - DNA, 27 bp, Artificial Sequence
  Description of Artificial Sequence: Synthetic oligonucleotide
gctgatgtggtctttgctggccatggc

SEQ ID NO: 349521 - DNA, 30 bp, Artificial Sequence
  Description of Artificial Sequence: Synthetic oligonucleotide
ctgatgtggtctttgctggccatggcattg

SEQ ID NO: 349522 - DNA, 31 bp, Artificial Sequence
  Description of Artificial Sequence: Synthetic oligonucleotide
tgatgtggtctttgctggccatggcattgtg

SEQ ID NO: 349523 - DNA, 30 bp, Artificial Sequence
  Description of Artificial Sequence: Synthetic oligonucleotide
gatgtggtctttgctggccatggcattgtg

SEQ ID NO: 349524 - DNA, 30 bp, Artificial Sequence
  Description of Artificial Sequence: Synthetic oligonucleotide
atgtggtctttgctggccatggcattgtgg

SEQ ID NO: 349525 - DNA, 29 bp, Artificial Sequence
  Description of Artificial Sequence: Synthetic oligonucleotide
tgtggtctttgctggccatggcattgtgg

SEQ ID NO: 349526 - DNA, 28 bp, Artificial Sequence
  Description of Artificial Sequence: Synthetic oligonucleotide
gtggtctttgctggccatggcattgtgg

SEQ ID NO: 349527 - DNA, 28 bp, Artificial Sequence
  Description of Artificial Sequence: Synthetic oligonucleotide
tggtctttgctggccatggcattgtggg

SEQ ID NO: 349528 - DNA, 27 bp, Artificial Sequence
  Description of Artificial Sequence: Synthetic oligonucleotide
ggtctttgctggccatggcattgtggg

SEQ ID NO: 349529 - DNA, 27 bp, Artificial Sequence
  Description of Artificial Sequence: Synthetic oligonucleotide
gtctttgctggccatggcattgtgggc

SEQ ID NO: 349530 - DNA, 28 bp, Artificial Sequence
  Description of Artificial Sequence: Synthetic oligonucleotide
tctttgctggccatggcattgtgggctc

SEQ ID NO: 349531 - DNA, 27 bp, Artificial Sequence
  Description of Artificial Sequence: Synthetic oligonucleotide
ctttgctggccatggcattgtgggctc

SEQ ID NO: 349532 - DNA, 28 bp, Artificial Sequence
  Description of Artificial Sequence: Synthetic oligonucleotide
tttgctggccatggcattgtgggctcac

SEQ ID NO: 349533 - DNA, 27 bp, Artificial Sequence
  Description of Artificial Sequence: Synthetic oligonucleotide
ttgctggccatggcattgtgggctcac

SEQ ID NO: 349534 - DNA, 26 bp, Artificial Sequence
  Description of Artificial Sequence: Synthetic oligonucleotide
tgctggccatggcattgtgggctcac

SEQ ID NO: 349535 - DNA, 25 bp, Artificial Sequence
  Description of Artificial Sequence: Synthetic oligonucleotide
gctggccatggcattgtgggctcac

SEQ ID NO: 349536 - DNA, 26 bp, Artificial Sequence
  Description of Artificial Sequence: Synthetic oligonucleotide
ctggccatggcattgtgggctcacca

SEQ ID NO: 349537 - DNA, 26 bp, Artificial Sequence
  Description of Artificial Sequence: Synthetic oligonucleotide
tggccatggcattgtgggctcaccag

SEQ ID NO: 349538 - DNA, 25 bp, Artificial Sequence
  Description of Artificial Sequence: Synthetic oligonucleotide
ggccatggcattgtgggctcaccag

SEQ ID NO: 349539 - DNA, 25 bp, Artificial Sequence
  Description of Artificial Sequence: Synthetic oligonucleotide
gccatggcattgtgggctcaccagc

SEQ ID NO: 349540 - DNA, 27 bp, Artificial Sequence
  Description of Artificial Sequence: Synthetic oligonucleotide
ccatggcattgtgggctcaccagccaa

SEQ ID NO: 349541 - DNA, 28 bp, Artificial Sequence
  Description of Artificial Sequence: Synthetic oligonucleotide
catggcattgtgggctcaccagccaaag

SEQ ID NO: 349542 - DNA, 33 bp, Artificial Sequence
  Description of Artificial Sequence: Synthetic oligonucleotide
atggcattgtgggctcaccagccaaagatattg

SEQ ID NO: 349543 - DNA, 32 bp, Artificial Sequence
  Description of Artificial Sequence: Synthetic oligonucleotide
tggcattgtgggctcaccagccaaagatattg

SEQ ID NO: 349544 - DNA, 31 bp, Artificial Sequence
  Description of Artificial Sequence: Synthetic oligonucleotide
ggcattgtgggctcaccagccaaagatattg

SEQ ID NO: 349545 - DNA, 31 bp, Artificial Sequence
  Description of Artificial Sequence: Synthetic oligonucleotide
gcattgtgggctcaccagccaaagatattgc

SEQ ID NO: 349546 - DNA, 32 bp, Artificial Sequence
  Description of Artificial Sequence: Synthetic oligonucleotide
cattgtgggctcaccagccaaagatattgctc

SEQ ID NO: 349547 - DNA, 34 bp, Artificial Sequence
  Description of Artificial Sequence: Synthetic oligonucleotide
attgtgggctcaccagccaaagatattgctctac

SEQ ID NO: 349548 - DNA, 33 bp, Artificial Sequence
  Description of Artificial Sequence: Synthetic oligonucleotide
ttgtgggctcaccagccaaagatattgctctac

SEQ ID NO: 349549 - DNA, 32 bp, Artificial Sequence
  Description of Artificial Sequence: Synthetic oligonucleotide
tgtgggctcaccagccaaagatattgctctac

SEQ ID NO: 349550 - DNA, 31 bp, Artificial Sequence
  Description of Artificial Sequence: Synthetic oligonucleotide
gtgggctcaccagccaaagatattgctctac

SEQ ID NO: 349551 - DNA, 32 bp, Artificial Sequence
  Description of Artificial Sequence: Synthetic oligonucleotide
tgggctcaccagccaaagatattgctctacac

SEQ ID NO: 349552 - DNA, 31 bp, Artificial Sequence
  Description of Artificial Sequence: Synthetic oligonucleotide
gggctcaccagccaaagatattgctctacac

SEQ ID NO: 349553 - DNA, 32 bp, Artificial Sequence
  Description of Artificial Sequence: Synthetic oligonucleotide
ggctcaccagccaaagatattgctctacacac

SEQ ID NO: 349554 - DNA, 33 bp, Artificial Sequence
  Description of Artificial Sequence: Synthetic oligonucleotide
gctcaccagccaaagatattgctctacacacac

SEQ ID NO: 349555 - DNA, 34 bp, Artificial Sequence
  Description of Artificial Sequence: Synthetic oligonucleotide
ctcaccagccaaagatattgctctacacacacag

SEQ ID NO: 349556 - DNA, 35 bp, Artificial Sequence
  Description of Artificial Sequence: Synthetic oligonucleotide
tcaccagccaaagatattgctctacacacacagtg

SEQ ID NO: 349557 - DNA, 34 bp, Artificial Sequence
  Description of Artificial Sequence: Synthetic oligonucleotide
caccagccaaagatattgctctacacacacagtg

SEQ ID NO: 349558 - DNA, 37 bp, Artificial Sequence
  Description of Artificial Sequence: Synthetic oligonucleotide
accagccaaagatattgctctacacacacagtgaaac

SEQ ID NO: 349559 - DNA, 36 bp, Artificial Sequence
  Description of Artificial Sequence: Synthetic oligonucleotide
ccagccaaagatattgctctacacacacagtgaaac

SEQ ID NO: 349560 - DNA, 36 bp, Artificial Sequence
  Description of Artificial Sequence: Synthetic oligonucleotide
cagccaaagatattgctctacacacacagtgaaacc

SEQ ID NO: 349561 - DNA, 37 bp, Artificial Sequence
  Description of Artificial Sequence: Synthetic oligonucleotide
agccaaagatattgctctacacacacagtgaaaccac

SEQ ID NO: 349562 - DNA, 36 bp, Artificial Sequence
  Description of Artificial Sequence: Synthetic oligonucleotide
gccaaagatattgctctacacacacagtgaaaccac

SEQ ID NO: 349563 - DNA, 37 bp, Artificial Sequence
  Description of Artificial Sequence: Synthetic oligonucleotide
ccaaagatattgctctacacacacagtgaaaccacac

SEQ ID NO: 349564 - DNA, 37 bp, Artificial Sequence
  Description of Artificial Sequence: Synthetic oligonucleotide
caaagatattgctctacacacacagtgaaaccacacc

SEQ ID NO: 349565 - DNA, 39 bp, Artificial Sequence
  Description of Artificial Sequence: Synthetic oligonucleotide
aaagatattgctctacacacacagtgaaaccacaccttc

SEQ ID NO: 349566 - DNA, 38 bp, Artificial Sequence
  Description of Artificial Sequence: Synthetic oligonucleotide
aagatattgctctacacacacagtgaaaccacaccttc

SEQ ID NO: 349567 - DNA, 37 bp, Artificial Sequence
  Description of Artificial Sequence: Synthetic oligonucleotide
agatattgctctacacacacagtgaaaccacaccttc

SEQ ID NO: 349568 - DNA, 36 bp, Artificial Sequence
  Description of Artificial Sequence: Synthetic oligonucleotide
gatattgctctacacacacagtgaaaccacaccttc

SEQ ID NO: 349569 - DNA, 38 bp, Artificial Sequence
  Description of Artificial Sequence: Synthetic oligonucleotide
atattgctctacacacacagtgaaaccacaccttcatg

SEQ ID NO: 349570 - DNA, 37 bp, Artificial Sequence
  Description of Artificial Sequence: Synthetic oligonucleotide
tattgctctacacacacagtgaaaccacaccttcatg

SEQ ID NO: 349571 - DNA, 36 bp, Artificial Sequence
  Description of Artificial Sequence: Synthetic oligonucleotide
attgctctacacacacagtgaaaccacaccttcatg

SEQ ID NO: 349572 - DNA, 35 bp, Artificial Sequence
  Description of Artificial Sequence: Synthetic oligonucleotide
ttgctctacacacacagtgaaaccacaccttcatg

SEQ ID NO: 349573 - DNA, 34 bp, Artificial Sequence
  Description of Artificial Sequence: Synthetic oligonucleotide
tgctctacacacacagtgaaaccacaccttcatg

SEQ ID NO: 349574 - DNA, 33 bp, Artificial Sequence
  Description of Artificial Sequence: Synthetic oligonucleotide
gctctacacacacagtgaaaccacaccttcatg

SEQ ID NO: 349575 - DNA, 34 bp, Artificial Sequence
  Description of Artificial Sequence: Synthetic oligonucleotide
ctctacacacacagtgaaaccacaccttcatgac

SEQ ID NO: 349576 - DNA, 34 bp, Artificial Sequence
  Description of Artificial Sequence: Synthetic oligonucleotide
tctacacacacagtgaaaccacaccttcatgacc

SEQ ID NO: 349577 - DNA, 33 bp, Artificial Sequence
  Description of Artificial Sequence: Synthetic oligonucleotide
ctacacacacagtgaaaccacaccttcatgacc

SEQ ID NO: 349578 - DNA, 36 bp, Artificial Sequence
  Description of Artificial Sequence: Synthetic oligonucleotide
tacacacacagtgaaaccacaccttcatgaccaatg

SEQ ID NO: 349579 - DNA, 35 bp, Artificial Sequence
  Description of Artificial Sequence: Synthetic oligonucleotide
acacacacagtgaaaccacaccttcatgaccaatg

SEQ ID NO: 349580 - DNA, 34 bp, Artificial Sequence
  Description of Artificial Sequence: Synthetic oligonucleotide
cacacacagtgaaaccacaccttcatgaccaatg

SEQ ID NO: 349581 - DNA, 34 bp, Artificial Sequence
  Description of Artificial Sequence: Synthetic oligonucleotide
acacacagtgaaaccacaccttcatgaccaatgg

SEQ ID NO: 349582 - DNA, 33 bp, Artificial Sequence
  Description of Artificial Sequence: Synthetic oligonucleotide
cacacagtgaaaccacaccttcatgaccaatgg

SEQ ID NO: 349583 - DNA, 33 bp, Artificial Sequence
  Description of Artificial Sequence: Synthetic oligonucleotide
acacagtgaaaccacaccttcatgaccaatggg

SEQ ID NO: 349584 - DNA, 32 bp, Artificial Sequence
  Description of Artificial Sequence: Synthetic oligonucleotide
cacagtgaaaccacaccttcatgaccaatggg

SEQ ID NO: 349585 - DNA, 33 bp, Artificial Sequence
  Description of Artificial Sequence: Synthetic oligonucleotide
acagtgaaaccacaccttcatgaccaatgggac

SEQ ID NO: 349586 - DNA, 32 bp, Artificial Sequence
  Description of Artificial Sequence: Synthetic oligonucleotide
cagtgaaaccacaccttcatgaccaatgggac

SEQ ID NO: 349587 - DNA, 32 bp, Artificial Sequence
  Description of Artificial Sequence: Synthetic oligonucleotide
agtgaaaccacaccttcatgaccaatgggacg

SEQ ID NO: 349588 - DNA, 31 bp, Artificial Sequence
  Description of Artificial Sequence: Synthetic oligonucleotide
gtgaaaccacaccttcatgaccaatgggacg

SEQ ID NO: 349589 - DNA, 33 bp, Artificial Sequence
  Description of Artificial Sequence: Synthetic oligonucleotide
tgaaaccacaccttcatgaccaatgggacgttg

SEQ ID NO: 349590 - DNA, 32 bp, Artificial Sequence
  Description of Artificial Sequence: Synthetic oligonucleotide
gaaaccacaccttcatgaccaatgggacgttg

SEQ ID NO: 349591 - DNA, 32 bp, Artificial Sequence
  Description of Artificial Sequence: Synthetic oligonucleotide
aaaccacaccttcatgaccaatgggacgttgg

SEQ ID NO: 349592 - DNA, 31 bp, Artificial Sequence
  Description of Artificial Sequence: Synthetic oligonucleotide
aaccacaccttcatgaccaatgggacgttgg

SEQ ID NO: 349593 - DNA, 30 bp, Artificial Sequence
  Description of Artificial Sequence: Synthetic oligonucleotide
accacaccttcatgaccaatgggacgttgg

SEQ ID NO: 349594 - DNA, 29 bp, Artificial Sequence
  Description of Artificial Sequence: Synthetic oligonucleotide
ccacaccttcatgaccaatgggacgttgg

SEQ ID NO: 349595 - DNA, 29 bp, Artificial Sequence
  Description of Artificial Sequence: Synthetic oligonucleotide
cacaccttcatgaccaatgggacgttggg

SEQ ID NO: 349596 - DNA, 29 bp, Artificial Sequence
  Description of Artificial Sequence: Synthetic oligonucleotide
acaccttcatgaccaatgggacgttgggg

SEQ ID NO: 349597 - DNA, 28 bp, Artificial Sequence
  Description of Artificial Sequence: Synthetic oligonucleotide
caccttcatgaccaatgggacgttgggg

SEQ ID NO: 349598 - DNA, 30 bp, Artificial Sequence
  Description of Artificial Sequence: Synthetic oligonucleotide
accttcatgaccaatgggacgttggggatc

SEQ ID NO: 349599 - DNA, 29 bp, Artificial Sequence
  Description of Artificial Sequence: Synthetic oligonucleotide
ccttcatgaccaatgggacgttggggatc

SEQ ID NO: 349600 - DNA, 30 bp, Artificial Sequence
  Description of Artificial Sequence: Synthetic oligonucleotide
cttcatgaccaatgggacgttggggatctg

SEQ ID NO: 349601 - DNA, 30 bp, Artificial Sequence
  Description of Artificial Sequence: Synthetic oligonucleotide
ttcatgaccaatgggacgttggggatctgg

SEQ ID NO: 349602 - DNA, 29 bp, Artificial Sequence
  Description of Artificial Sequence: Synthetic oligonucleotide
tcatgaccaatgggacgttggggatctgg

SEQ ID NO: 349603 - DNA, 28 bp, Artificial Sequence
  Description of Artificial Sequence: Synthetic oligonucleotide
catgaccaatgggacgttggggatctgg

SEQ ID NO: 349604 - DNA, 28 bp, Artificial Sequence
  Description of Artificial Sequence: Synthetic oligonucleotide
atgaccaatgggacgttggggatctggc

SEQ ID NO: 349605 - DNA, 27 bp, Artificial Sequence
  Description of Artificial Sequence: Synthetic oligonucleotide
tgaccaatgggacgttggggatctggc

SEQ ID NO: 349606 - DNA, 26 bp, Artificial Sequence
  Description of Artificial Sequence: Synthetic oligonucleotide
gaccaatgggacgttggggatctggc

SEQ ID NO: 349607 - DNA, 26 bp, Artificial Sequence
  Description of Artificial Sequence: Synthetic oligonucleotide
accaatgggacgttggggatctggcc

SEQ ID NO: 349608 - DNA, 25 bp, Artificial Sequence
  Description of Artificial Sequence: Synthetic oligonucleotide
ccaatgggacgttggggatctggcc

SEQ ID NO: 349609 - DNA, 25 bp, Artificial Sequence
  Description of Artificial Sequence: Synthetic oligonucleotide
caatgggacgttggggatctggccc

SEQ ID NO: 349610 - DNA, 25 bp, Artificial Sequence
  Description of Artificial Sequence: Synthetic oligonucleotide
aatgggacgttggggatctggcccg

SEQ ID NO: 349611 - DNA, 24 bp, Artificial Sequence
  Description of Artificial Sequence: Synthetic oligonucleotide
atgggacgttggggatctggcccg

SEQ ID NO: 349612 - DNA, 23 bp, Artificial Sequence
  Description of Artificial Sequence: Synthetic oligonucleotide
tgggacgttggggatctggcccg

SEQ ID NO: 349613 - DNA, 22 bp, Artificial Sequence
  Description of Artificial Sequence: Synthetic oligonucleotide
gggacgttggggatctggcccg

SEQ ID NO: 349614 - DNA, 25 bp, Artificial Sequence
  Description of Artificial Sequence: Synthetic oligonucleotide
ggacgttggggatctggcccgcata

SEQ ID NO: 349615 - DNA, 25 bp, Artificial Sequence
  Description of Artificial Sequence: Synthetic oligonucleotide
gacgttggggatctggcccgcatac

SEQ ID NO: 349616 - DNA, 26 bp, Artificial Sequence
  Description of Artificial Sequence: Synthetic oligonucleotide
acgttggggatctggcccgcatacca

SEQ ID NO: 349617 - DNA, 25 bp, Artificial Sequence
  Description of Artificial Sequence: Synthetic oligonucleotide
cgttggggatctggcccgcatacca

SEQ ID NO: 349618 - DNA, 26 bp, Artificial Sequence
  Description of Artificial Sequence: Synthetic oligonucleotide
gttggggatctggcccgcataccaca

SEQ ID NO: 349619 - DNA, 26 bp, Artificial Sequence
  Description of Artificial Sequence: Synthetic oligonucleotide
ttggggatctggcccgcataccacac

SEQ ID NO: 349620 - DNA, 25 bp, Artificial Sequence
  Description of Artificial Sequence: Synthetic oligonucleotide
tggggatctggcccgcataccacac

SEQ ID NO: 349621 - DNA, 24 bp, Artificial Sequence
  Description of Artificial Sequence: Synthetic oligonucleotide
ggggatctggcccgcataccacac

SEQ ID NO: 349622 - DNA, 24 bp, Artificial Sequence
  Description of Artificial Sequence: Synthetic oligonucleotide
gggatctggcccgcataccacacg

SEQ ID NO: 349623 - DNA, 24 bp, Artificial Sequence
  Description of Artificial Sequence: Synthetic oligonucleotide
ggatctggcccgcataccacacgg

SEQ ID NO: 349624 - DNA, 24 bp, Artificial Sequence
  Description of Artificial Sequence: Synthetic oligonucleotide
gatctggcccgcataccacacggg

SEQ ID NO: 349625 - DNA, 24 bp, Artificial Sequence
  Description of Artificial Sequence: Synthetic oligonucleotide
atctggcccgcataccacacgggc

SEQ ID NO: 349626 - DNA, 23 bp, Artificial Sequence
  Description of Artificial Sequence: Synthetic oligonucleotide
tctggcccgcataccacacgggc

SEQ ID NO: 349627 - DNA, 22 bp, Artificial Sequence
  Description of Artificial Sequence: Synthetic oligonucleotide
ctggcccgcataccacacgggc

SEQ ID NO: 349628 - DNA, 22 bp, Artificial Sequence
  Description of Artificial Sequence: Synthetic oligonucleotide
tggcccgcataccacacgggcg

SEQ ID NO: 349629 - DNA, 21 bp, Artificial Sequence
  Description of Artificial Sequence: Synthetic oligonucleotide
ggcccgcataccacacgggcg

SEQ ID NO: 349630 - DNA, 22 bp, Artificial Sequence
  Description of Artificial Sequence: Synthetic oligonucleotide
gcccgcataccacacgggcggt

SEQ ID NO: 349631 - DNA, 23 bp, Artificial Sequence
  Description of Artificial Sequence: Synthetic oligonucleotide
cccgcataccacacgggcggtga

SEQ ID NO: 349632 - DNA, 24 bp, Artificial Sequence
  Description of Artificial Sequence: Synthetic oligonucleotide
ccgcataccacacgggcggtgaca

SEQ ID NO: 349633 - DNA, 24 bp, Artificial Sequence
  Description of Artificial Sequence: Synthetic oligonucleotide
cgcataccacacgggcggtgacac

SEQ ID NO: 349634 - DNA, 26 bp, Artificial Sequence
  Description of Artificial Sequence: Synthetic oligonucleotide
gcataccacacgggcggtgacaccat

SEQ ID NO: 349635 - DNA, 27 bp, Artificial Sequence
  Description of Artificial Sequence: Synthetic oligonucleotide
cataccacacgggcggtgacaccatca

SEQ ID NO: 349636 - DNA, 28 bp, Artificial Sequence
  Description of Artificial Sequence: Synthetic oligonucleotide
ataccacacgggcggtgacaccatcaac

SEQ ID NO: 349637 - DNA, 27 bp, Artificial Sequence
  Description of Artificial Sequence: Synthetic oligonucleotide
taccacacgggcggtgacaccatcaac

SEQ ID NO: 349638 - DNA, 26 bp, Artificial Sequence
  Description of Artificial Sequence: Synthetic oligonucleotide
accacacgggcggtgacaccatcaac

SEQ ID NO: 349639 - DNA, 25 bp, Artificial Sequence
  Description of Artificial Sequence: Synthetic oligonucleotide
ccacacgggcggtgacaccatcaac

SEQ ID NO: 349640 - DNA, 26 bp, Artificial Sequence
  Description of Artificial Sequence: Synthetic oligonucleotide
cacacgggcggtgacaccatcaacct

SEQ ID NO: 349641 - DNA, 26 bp, Artificial Sequence
  Description of Artificial Sequence: Synthetic oligonucleotide
acacgggcggtgacaccatcaacctg

SEQ ID NO: 349642 - DNA, 25 bp, Artificial Sequence
  Description of Artificial Sequence: Synthetic oligonucleotide
cacgggcggtgacaccatcaacctg

SEQ ID NO: 349643 - DNA, 25 bp, Artificial Sequence
  Description of Artificial Sequence: Synthetic oligonucleotide
acgggcggtgacaccatcaacctgg

SEQ ID NO: 349644 - DNA, 24 bp, Artificial Sequence
  Description of Artificial Sequence: Synthetic oligonucleotide
cgggcggtgacaccatcaacctgg

SEQ ID NO: 349645 - DNA, 24 bp, Artificial Sequence
  Description of Artificial Sequence: Synthetic oligonucleotide
gggcggtgacaccatcaacctggc

SEQ ID NO: 349646 - DNA, 27 bp, Artificial Sequence
  Description of Artificial Sequence: Synthetic oligonucleotide
ggcggtgacaccatcaacctggccatt

SEQ ID NO: 349647 - DNA, 29 bp, Artificial Sequence
  Description of Artificial Sequence: Synthetic oligonucleotide
gcggtgacaccatcaacctggccatttac

SEQ ID NO: 349648 - DNA, 30 bp, Artificial Sequence
  Description of Artificial Sequence: Synthetic oligonucleotide
cggtgacaccatcaacctggccatttacac

SEQ ID NO: 349649 - DNA, 30 bp, Artificial Sequence
  Description of Artificial Sequence: Synthetic oligonucleotide
ggtgacaccatcaacctggccatttacacc

SEQ ID NO: 349650 - DNA, 30 bp, Artificial Sequence
  Description of Artificial Sequence: Synthetic oligonucleotide
gtgacaccatcaacctggccatttacaccc

SEQ ID NO: 349651 - DNA, 31 bp, Artificial Sequence
  Description of Artificial Sequence: Synthetic oligonucleotide
tgacaccatcaacctggccatttacaccctg

SEQ ID NO: 349652 - DNA, 30 bp, Artificial Sequence
  Description of Artificial Sequence: Synthetic oligonucleotide
gacaccatcaacctggccatttacaccctg

SEQ ID NO: 349653 - DNA, 30 bp, Artificial Sequence
  Description of Artificial Sequence: Synthetic oligonucleotide
acaccatcaacctggccatttacaccctgc

SEQ ID NO: 349654 - DNA, 29 bp, Artificial Sequence
  Description of Artificial Sequence: Synthetic oligonucleotide
caccatcaacctggccatttacaccctgc

SEQ ID NO: 349655 - DNA, 29 bp, Artificial Sequence
  Description of Artificial Sequence: Synthetic oligonucleotide
accatcaacctggccatttacaccctgcc

SEQ ID NO: 349656 - DNA, 28 bp, Artificial Sequence
  Description of Artificial Sequence: Synthetic oligonucleotide
ccatcaacctggccatttacaccctgcc

SEQ ID NO: 349657 - DNA, 28 bp, Artificial Sequence
  Description of Artificial Sequence: Synthetic oligonucleotide
catcaacctggccatttacaccctgccc

SEQ ID NO: 349658 - DNA, 28 bp, Artificial Sequence
  Description of Artificial Sequence: Synthetic oligonucleotide
atcaacctggccatttacaccctgcccg

SEQ ID NO: 349659 - DNA, 27 bp, Artificial Sequence
  Description of Artificial Sequence: Synthetic oligonucleotide
tcaacctggccatttacaccctgcccg

SEQ ID NO: 349660 - DNA, 27 bp, Artificial Sequence
  Description of Artificial Sequence: Synthetic oligonucleotide
caacctggccatttacaccctgcccga

SEQ ID NO: 349661 - DNA, 27 bp, Artificial Sequence
  Description of Artificial Sequence: Synthetic oligonucleotide
aacctggccatttacaccctgcccgac

SEQ ID NO: 349662 - DNA, 27 bp, Artificial Sequence
  Description of Artificial Sequence: Synthetic oligonucleotide
acctggccatttacaccctgcccgact

SEQ ID NO: 349663 - DNA, 26 bp, Artificial Sequence
  Description of Artificial Sequence: Synthetic oligonucleotide
cctggccatttacaccctgcccgact

SEQ ID NO: 349664 - DNA, 26 bp, Artificial Sequence
  Description of Artificial Sequence: Synthetic oligonucleotide
ctggccatttacaccctgcccgactc

SEQ ID NO: 349665 - DNA, 26 bp, Artificial Sequence
  Description of Artificial Sequence: Synthetic oligonucleotide
tggccatttacaccctgcccgactcc

SEQ ID NO: 349666 - DNA, 25 bp, Artificial Sequence
  Description of Artificial Sequence: Synthetic oligonucleotide
ggccatttacaccctgcccgactcc

SEQ ID NO: 349667 - DNA, 25 bp, Artificial Sequence
  Description of Artificial Sequence: Synthetic oligonucleotide
gccatttacaccctgcccgactccg

SEQ ID NO: 349668 - DNA, 27 bp, Artificial Sequence
  Description of Artificial Sequence: Synthetic oligonucleotide
ccatttacaccctgcccgactccgctt

SEQ ID NO: 349669 - DNA, 28 bp, Artificial Sequence
  Description of Artificial Sequence: Synthetic oligonucleotide
catttacaccctgcccgactccgctttc

SEQ ID NO: 349670 - DNA, 28 bp, Artificial Sequence
  Description of Artificial Sequence: Synthetic oligonucleotide
atttacaccctgcccgactccgctttcc

SEQ ID NO: 349671 - DNA, 27 bp, Artificial Sequence
  Description of Artificial Sequence: Synthetic oligonucleotide
tttacaccctgcccgactccgctttcc

SEQ ID NO: 349672 - DNA, 27 bp, Artificial Sequence
  Description of Artificial Sequence: Synthetic oligonucleotide
ttacaccctgcccgactccgctttcct

SEQ ID NO: 349673 - DNA, 26 bp, Artificial Sequence
  Description of Artificial Sequence: Synthetic oligonucleotide
tacaccctgcccgactccgctttcct

SEQ ID NO: 349674 - DNA, 25 bp, Artificial Sequence
  Description of Artificial Sequence: Synthetic oligonucleotide
acaccctgcccgactccgctttcct

SEQ ID NO: 349675 - DNA, 24 bp, Artificial Sequence
  Description of Artificial Sequence: Synthetic oligonucleotide
caccctgcccgactccgctttcct

SEQ ID NO: 349676 - DNA, 27 bp, Artificial Sequence
  Description of Artificial Sequence: Synthetic oligonucleotide
accctgcccgactccgctttcctcata

SEQ ID NO: 349677 - DNA, 27 bp, Artificial Sequence
  Description of Artificial Sequence: Synthetic oligonucleotide
ccctgcccgactccgctttcctcataa

SEQ ID NO: 349678 - DNA, 28 bp, Artificial Sequence
  Description of Artificial Sequence: Synthetic oligonucleotide
cctgcccgactccgctttcctcataatc

SEQ ID NO: 349679 - DNA, 33 bp, Artificial Sequence
  Description of Artificial Sequence: Synthetic oligonucleotide
ctgcccgactccgctttcctcataatctttaac

SEQ ID NO: 349680 - DNA, 33 bp, Artificial Sequence
  Description of Artificial Sequence: Synthetic oligonucleotide
tgcccgactccgctttcctcataatctttaacc

SEQ ID NO: 349681 - DNA, 32 bp, Artificial Sequence
  Description of Artificial Sequence: Synthetic oligonucleotide
gcccgactccgctttcctcataatctttaacc

SEQ ID NO: 349682 - DNA, 32 bp, Artificial Sequence
  Description of Artificial Sequence: Synthetic oligonucleotide
cccgactccgctttcctcataatctttaaccc

SEQ ID NO: 349683 - DNA, 33 bp, Artificial Sequence
  Description of Artificial Sequence: Synthetic oligonucleotide
ccgactccgctttcctcataatctttaacccag

SEQ ID NO: 349684 - DNA, 34 bp, Artificial Sequence
  Description of Artificial Sequence: Synthetic oligonucleotide
cgactccgctttcctcataatctttaacccagag

SEQ ID NO: 349685 - DNA, 34 bp, Artificial Sequence
  Description of Artificial Sequence: Synthetic oligonucleotide
gactccgctttcctcataatctttaacccagagg

SEQ ID NO: 349686 - DNA, 34 bp, Artificial Sequence
  Description of Artificial Sequence: Synthetic oligonucleotide
actccgctttcctcataatctttaacccagaggc

SEQ ID NO: 349687 - DNA, 33 bp, Artificial Sequence
  Description of Artificial Sequence: Synthetic oligonucleotide
ctccgctttcctcataatctttaacccagaggc

SEQ ID NO: 349688 - DNA, 34 bp, Artificial Sequence
  Description of Artificial Sequence: Synthetic oligonucleotide
tccgctttcctcataatctttaacccagaggcac

SEQ ID NO: 349689 - DNA, 33 bp, Artificial Sequence
  Description of Artificial Sequence: Synthetic oligonucleotide
ccgctttcctcataatctttaacccagaggcac

SEQ ID NO: 349690 - DNA, 33 bp, Artificial Sequence
  Description of Artificial Sequence: Synthetic oligonucleotide
cgctttcctcataatctttaacccagaggcacc

SEQ ID NO: 349691 - DNA, 33 bp, Artificial Sequence
  Description of Artificial Sequence: Synthetic oligonucleotide
gctttcctcataatctttaacccagaggcaccc

SEQ ID NO: 349692 - DNA, 35 bp, Artificial Sequence
  Description of Artificial Sequence: Synthetic oligonucleotide
ctttcctcataatctttaacccagaggcacccttc

SEQ ID NO: 349693 - DNA, 35 bp, Artificial Sequence
  Description of Artificial Sequence: Synthetic oligonucleotide
tttcctcataatctttaacccagaggcacccttcc

SEQ ID NO: 349694 - DNA, 34 bp, Artificial Sequence
  Description of Artificial Sequence: Synthetic oligonucleotide
ttcctcataatctttaacccagaggcacccttcc

SEQ ID NO: 349695 - DNA, 33 bp, Artificial Sequence
  Description of Artificial Sequence: Synthetic oligonucleotide
tcctcataatctttaacccagaggcacccttcc

SEQ ID NO: 349696 - DNA, 32 bp, Artificial Sequence
  Description of Artificial Sequence: Synthetic oligonucleotide
cctcataatctttaacccagaggcacccttcc

SEQ ID NO: 349697 - DNA, 33 bp, Artificial Sequence
  Description of Artificial Sequence: Synthetic oligonucleotide
ctcataatctttaacccagaggcacccttcctg

SEQ ID NO: 349698 - DNA, 33 bp, Artificial Sequence
  Description of Artificial Sequence: Synthetic oligonucleotide
tcataatctttaacccagaggcacccttcctgc

SEQ ID NO: 349699 - DNA, 32 bp, Artificial Sequence
  Description of Artificial Sequence: Synthetic oligonucleotide
cataatctttaacccagaggcacccttcctgc

SEQ ID NO: 349700 - DNA, 32 bp, Artificial Sequence
  Description of Artificial Sequence: Synthetic oligonucleotide
ataatctttaacccagaggcacccttcctgcg

SEQ ID NO: 349701 - DNA, 31 bp, Artificial Sequence
  Description of Artificial Sequence: Synthetic oligonucleotide
taatctttaacccagaggcacccttcctgcg

SEQ ID NO: 349702 - DNA, 30 bp, Artificial Sequence
  Description of Artificial Sequence: Synthetic oligonucleotide
aatctttaacccagaggcacccttcctgcg

SEQ ID NO: 349703 - DNA, 29 bp, Artificial Sequence
  Description of Artificial Sequence: Synthetic oligonucleotide
atctttaacccagaggcacccttcctgcg

SEQ ID NO: 349704 - DNA, 28 bp, Artificial Sequence
  Description of Artificial Sequence: Synthetic oligonucleotide
tctttaacccagaggcacccttcctgcg

SEQ ID NO: 349705 - DNA, 27 bp, Artificial Sequence
  Description of Artificial Sequence: Synthetic oligonucleotide
ctttaacccagaggcacccttcctgcg

SEQ ID NO: 349706 - DNA, 27 bp, Artificial Sequence
  Description of Artificial Sequence: Synthetic oligonucleotide
tttaacccagaggcacccttcctgcgg

SEQ ID NO: 349707 - DNA, 26 bp, Artificial Sequence
  Description of Artificial Sequence: Synthetic oligonucleotide
ttaacccagaggcacccttcctgcgg

SEQ ID NO: 349708 - DNA, 25 bp, Artificial Sequence
  Description of Artificial Sequence: Synthetic oligonucleotide
taacccagaggcacccttcctgcgg

SEQ ID NO: 349709 - DNA, 24 bp, Artificial Sequence
  Description of Artificial Sequence: Synthetic oligonucleotide
aacccagaggcacccttcctgcgg

SEQ ID NO: 349710 - DNA, 23 bp, Artificial Sequence
  Description of Artificial Sequence: Synthetic oligonucleotide
acccagaggcacccttcctgcgg

SEQ ID NO: 349711 - DNA, 22 bp, Artificial Sequence
  Description of Artificial Sequence: Synthetic oligonucleotide
cccagaggcacccttcctgcgg

SEQ ID NO: 349712 - DNA, 23 bp, Artificial Sequence
  Description of Artificial Sequence: Synthetic oligonucleotide
ccagaggcacccttcctgcggga

SEQ ID NO: 349713 - DNA, 24 bp, Artificial Sequence
  Description of Artificial Sequence: Synthetic oligonucleotide
cagaggcacccttcctgcgggagt

SEQ ID NO: 349714 - DNA, 24 bp, Artificial Sequence
  Description of Artificial Sequence: Synthetic oligonucleotide
agaggcacccttcctgcgggagtg

SEQ ID NO: 349715 - DNA, 23 bp, Artificial Sequence
  Description of Artificial Sequence: Synthetic oligonucleotide
gaggcacccttcctgcgggagtg

SEQ ID NO: 349716 - DNA, 24 bp, Artificial Sequence
  Description of Artificial Sequence: Synthetic oligonucleotide
aggcacccttcctgcgggagtgga

SEQ ID NO: 349717 - DNA, 23 bp, Artificial Sequence
  Description of Artificial Sequence: Synthetic oligonucleotide
ggcacccttcctgcgggagtgga

SEQ ID NO: 349718 - DNA, 24 bp, Artificial Sequence
  Description of Artificial Sequence: Synthetic oligonucleotide
gcacccttcctgcgggagtggact

SEQ ID NO: 349719 - DNA, 24 bp, Artificial Sequence
  Description of Artificial Sequence: Synthetic oligonucleotide
cacccttcctgcgggagtggactg

SEQ ID NO: 349720 - DNA, 24 bp, Artificial Sequence
  Description of Artificial Sequence: Synthetic oligonucleotide
acccttcctgcgggagtggactgg

SEQ ID NO: 349721 - DNA, 23 bp, Artificial Sequence
  Description of Artificial Sequence: Synthetic oligonucleotide
cccttcctgcgggagtggactgg

SEQ ID NO: 349722 - DNA, 26 bp, Artificial Sequence
  Description of Artificial Sequence: Synthetic oligonucleotide
ccttcctgcgggagtggactgggatt

SEQ ID NO: 349723 - DNA, 26 bp, Artificial Sequence
  Description of Artificial Sequence: Synthetic oligonucleotide
cttcctgcgggagtggactgggattg

SEQ ID NO: 349724 - DNA, 26 bp, Artificial Sequence
  Description of Artificial Sequence: Synthetic oligonucleotide
ttcctgcgggagtggactgggattgc

SEQ ID NO: 349725 - DNA, 25 bp, Artificial Sequence
  Description of Artificial Sequence: Synthetic oligonucleotide
tcctgcgggagtggactgggattgc

SEQ ID NO: 349726 - DNA, 24 bp, Artificial Sequence
  Description of Artificial Sequence: Synthetic oligonucleotide
cctgcgggagtggactgggattgc

SEQ ID NO: 349727 - DNA, 24 bp, Artificial Sequence
  Description of Artificial Sequence: Synthetic oligonucleotide
ctgcgggagtggactgggattgcc

SEQ ID NO: 349728 - DNA, 24 bp, Artificial Sequence
  Description of Artificial Sequence: Synthetic oligonucleotide
tgcgggagtggactgggattgccc

SEQ ID NO: 349729 - DNA, 23 bp, Artificial Sequence
  Description of Artificial Sequence: Synthetic oligonucleotide
gcgggagtggactgggattgccc

SEQ ID NO: 349730 - DNA, 24 bp, Artificial Sequence
  Description of Artificial Sequence: Synthetic oligonucleotide
cgggagtggactgggattgcccca

SEQ ID NO: 349731 - DNA, 25 bp, Artificial Sequence
  Description of Artificial Sequence: Synthetic oligonucleotide
gggagtggactgggattgccccaga

SEQ ID NO: 349732 - DNA, 25 bp, Artificial Sequence
  Description of Artificial Sequence: Synthetic oligonucleotide
ggagtggactgggattgccccagac

SEQ ID NO: 349733 - DNA, 26 bp, Artificial Sequence
  Description of Artificial Sequence: Synthetic oligonucleotide
gagtggactgggattgccccagacct

SEQ ID NO: 349734 - DNA, 27 bp, Artificial Sequence
  Description of Artificial Sequence: Synthetic oligonucleotide
agtggactgggattgccccagacctgt

SEQ ID NO: 349735 - DNA, 26 bp, Artificial Sequence
  Description of Artificial Sequence: Synthetic oligonucleotide
gtggactgggattgccccagacctgt

SEQ ID NO: 349736 - DNA, 26 bp, Artificial Sequence
  Description of Artificial Sequence: Synthetic oligonucleotide
tggactgggattgccccagacctgtg

SEQ ID NO: 349737 - DNA, 25 bp, Artificial Sequence
  Description of Artificial Sequence: Synthetic oligonucleotide
ggactgggattgccccagacctgtg

SEQ ID NO: 349738 - DNA, 25 bp, Artificial Sequence
  Description of Artificial Sequence: Synthetic oligonucleotide
gactgggattgccccagacctgtgc

SEQ ID NO: 349739 - DNA, 25 bp, Artificial Sequence
  Description of Artificial Sequence: Synthetic oligonucleotide
actgggattgccccagacctgtgcc

SEQ ID NO: 349740 - DNA, 24 bp, Artificial Sequence
  Description of Artificial Sequence: Synthetic oligonucleotide
ctgggattgccccagacctgtgcc

SEQ ID NO: 349741 - DNA, 24 bp, Artificial Sequence
  Description of Artificial Sequence: Synthetic oligonucleotide
tgggattgccccagacctgtgccc

SEQ ID NO: 349742 - DNA, 23 bp, Artificial Sequence
  Description of Artificial Sequence: Synthetic oligonucleotide
gggattgccccagacctgtgccc

SEQ ID NO: 349743 - DNA, 26 bp, Artificial Sequence
  Description of Artificial Sequence: Synthetic oligonucleotide
ggattgccccagacctgtgcccctta

SEQ ID NO: 349744 - DNA, 27 bp, Artificial Sequence
  Description of Artificial Sequence: Synthetic oligonucleotide
gattgccccagacctgtgccccttact

SEQ ID NO: 349745 - DNA, 27 bp, Artificial Sequence
  Description of Artificial Sequence: Synthetic oligonucleotide
attgccccagacctgtgccccttactg

SEQ ID NO: 349746 - DNA, 27 bp, Artificial Sequence
  Description of Artificial Sequence: Synthetic oligonucleotide
ttgccccagacctgtgccccttactga

SEQ ID NO: 349747 - DNA, 27 bp, Artificial Sequence
  Description of Artificial Sequence: Synthetic oligonucleotide
tgccccagacctgtgccccttactgaa

SEQ ID NO: 349748 - DNA, 26 bp, Artificial Sequence
  Description of Artificial Sequence: Synthetic oligonucleotide
gccccagacctgtgccccttactgaa

SEQ ID NO: 349749 - DNA, 26 bp, Artificial Sequence
  Description of Artificial Sequence: Synthetic oligonucleotide
ccccagacctgtgccccttactgaag

SEQ ID NO: 349750 - DNA, 27 bp, Artificial Sequence
  Description of Artificial Sequence: Synthetic oligonucleotide
cccagacctgtgccccttactgaagca

SEQ ID NO: 349751 - DNA, 27 bp, Artificial Sequence
  Description of Artificial Sequence: Synthetic oligonucleotide
ccagacctgtgccccttactgaagcac

SEQ ID NO: 349752 - DNA, 36 bp, Artificial Sequence
  Description of Artificial Sequence: Synthetic oligonucleotide
atgctttctcaaagcagctgctttttgaacggtgtg

SEQ ID NO: 349753 - DNA, 35 bp, Artificial Sequence
  Description of Artificial Sequence: Synthetic oligonucleotide
tgctttctcaaagcagctgctttttgaacggtgtg

SEQ ID NO: 349754 - DNA, 34 bp, Artificial Sequence
  Description of Artificial Sequence: Synthetic oligonucleotide
gctttctcaaagcagctgctttttgaacggtgtg

SEQ ID NO: 349755 - DNA, 36 bp, Artificial Sequence
  Description of Artificial Sequence: Synthetic oligonucleotide
ctttctcaaagcagctgctttttgaacggtgtgatg

SEQ ID NO: 349756 - DNA, 36 bp, Artificial Sequence
  Description of Artificial Sequence: Synthetic oligonucleotide
tttctcaaagcagctgctttttgaacggtgtgatgg

SEQ ID NO: 349757 - DNA, 35 bp, Artificial Sequence
  Description of Artificial Sequence: Synthetic oligonucleotide
ttctcaaagcagctgctttttgaacggtgtgatgg

SEQ ID NO: 349758 - DNA, 34 bp, Artificial Sequence
  Description of Artificial Sequence: Synthetic oligonucleotide
tctcaaagcagctgctttttgaacggtgtgatgg

SEQ ID NO: 349759 - DNA, 33 bp, Artificial Sequence
  Description of Artificial Sequence: Synthetic oligonucleotide
ctcaaagcagctgctttttgaacggtgtgatgg

SEQ ID NO: 349760 - DNA, 35 bp, Artificial Sequence
  Description of Artificial Sequence: Synthetic oligonucleotide
tcaaagcagctgctttttgaacggtgtgatggttg

SEQ ID NO: 349761 - DNA, 34 bp, Artificial Sequence
  Description of Artificial Sequence: Synthetic oligonucleotide
caaagcagctgctttttgaacggtgtgatggttg

SEQ ID NO: 349762 - DNA, 34 bp, Artificial Sequence
  Description of Artificial Sequence: Synthetic oligonucleotide
aaagcagctgctttttgaacggtgtgatggttgg

SEQ ID NO: 349763 - DNA, 33 bp, Artificial Sequence
  Description of Artificial Sequence: Synthetic oligonucleotide
aagcagctgctttttgaacggtgtgatggttgg

SEQ ID NO: 349764 - DNA, 32 bp, Artificial Sequence
  Description of Artificial Sequence: Synthetic oligonucleotide
agcagctgctttttgaacggtgtgatggttgg

SEQ ID NO: 349765 - DNA, 31 bp, Artificial Sequence
  Description of Artificial Sequence: Synthetic oligonucleotide
gcagctgctttttgaacggtgtgatggttgg

SEQ ID NO: 349766 - DNA, 33 bp, Artificial Sequence
  Description of Artificial Sequence: Synthetic oligonucleotide
cagctgctttttgaacggtgtgatggttggaag

SEQ ID NO: 349767 - DNA, 33 bp, Artificial Sequence
  Description of Artificial Sequence: Synthetic oligonucleotide
agctgctttttgaacggtgtgatggttggaagc

SEQ ID NO: 349768 - DNA, 32 bp, Artificial Sequence
  Description of Artificial Sequence: Synthetic oligonucleotide
gctgctttttgaacggtgtgatggttggaagc

SEQ ID NO: 349769 - DNA, 37 bp, Artificial Sequence
  Description of Artificial Sequence: Synthetic oligonucleotide
ctgctttttgaacggtgtgatggttggaagcaatttc

SEQ ID NO: 349770 - DNA, 38 bp, Artificial Sequence
  Description of Artificial Sequence: Synthetic oligonucleotide
tgctttttgaacggtgtgatggttggaagcaatttctg

SEQ ID NO: 349771 - DNA, 37 bp, Artificial Sequence
  Description of Artificial Sequence: Synthetic oligonucleotide
gctttttgaacggtgtgatggttggaagcaatttctg

SEQ ID NO: 349772 - DNA, 38 bp, Artificial Sequence
  Description of Artificial Sequence: Synthetic oligonucleotide
ctttttgaacggtgtgatggttggaagcaatttctgtg

SEQ ID NO: 349773 - DNA, 38 bp, Artificial Sequence
  Description of Artificial Sequence: Synthetic oligonucleotide
tttttgaacggtgtgatggttggaagcaatttctgtgc

SEQ ID NO: 349774 - DNA, 37 bp, Artificial Sequence
  Description of Artificial Sequence: Synthetic oligonucleotide
ttttgaacggtgtgatggttggaagcaatttctgtgc

SEQ ID NO: 349775 - DNA, 36 bp, Artificial Sequence
  Description of Artificial Sequence: Synthetic oligonucleotide
tttgaacggtgtgatggttggaagcaatttctgtgc

SEQ ID NO: 349776 - DNA, 35 bp, Artificial Sequence
  Description of Artificial Sequence: Synthetic oligonucleotide
ttgaacggtgtgatggttggaagcaatttctgtgc

SEQ ID NO: 349777 - DNA, 34 bp, Artificial Sequence
  Description of Artificial Sequence: Synthetic oligonucleotide
tgaacggtgtgatggttggaagcaatttctgtgc

SEQ ID NO: 349778 - DNA, 33 bp, Artificial Sequence
  Description of Artificial Sequence: Synthetic oligonucleotide
gaacggtgtgatggttggaagcaatttctgtgc

SEQ ID NO: 349779 - DNA, 36 bp, Artificial Sequence
  Description of Artificial Sequence: Synthetic oligonucleotide
aacggtgtgatggttggaagcaatttctgtgcattg

SEQ ID NO: 349780 - DNA, 35 bp, Artificial Sequence
  Description of Artificial Sequence: Synthetic oligonucleotide
acggtgtgatggttggaagcaatttctgtgcattg

SEQ ID NO: 349781 - DNA, 34 bp, Artificial Sequence
  Description of Artificial Sequence: Synthetic oligonucleotide
cggtgtgatggttggaagcaatttctgtgcattg

SEQ ID NO: 349782 - DNA, 36 bp, Artificial Sequence
  Description of Artificial Sequence: Synthetic oligonucleotide
ggtgtgatggttggaagcaatttctgtgcattgatc

SEQ ID NO: 349783 - DNA, 37 bp, Artificial Sequence
  Description of Artificial Sequence: Synthetic oligonucleotide
gtgtgatggttggaagcaatttctgtgcattgatcac

SEQ ID NO: 349784 - DNA, 40 bp, Artificial Sequence
  Description of Artificial Sequence: Synthetic oligonucleotide
tgtgatggttggaagcaatttctgtgcattgatcactttg

SEQ ID NO: 349785 - DNA, 39 bp, Artificial Sequence
  Description of Artificial Sequence: Synthetic oligonucleotide
gtgatggttggaagcaatttctgtgcattgatcactttg

SEQ ID NO: 349786 - DNA, 39 bp, Artificial Sequence
  Description of Artificial Sequence: Synthetic oligonucleotide
tgatggttggaagcaatttctgtgcattgatcactttgc

SEQ ID NO: 349787 - DNA, 38 bp, Artificial Sequence
  Description of Artificial Sequence: Synthetic oligonucleotide
gatggttggaagcaatttctgtgcattgatcactttgc

SEQ ID NO: 349788 - DNA, 40 bp, Artificial Sequence
  Description of Artificial Sequence: Synthetic oligonucleotide
atggttggaagcaatttctgtgcattgatcactttgctag

SEQ ID NO: 349789 - DNA, 39 bp, Artificial Sequence
  Description of Artificial Sequence: Synthetic oligonucleotide
tggttggaagcaatttctgtgcattgatcactttgctag

SEQ ID NO: 349790 - DNA, 38 bp, Artificial Sequence
  Description of Artificial Sequence: Synthetic oligonucleotide
ggttggaagcaatttctgtgcattgatcactttgctag

SEQ ID NO: 349791 - DNA, 38 bp, Artificial Sequence
  Description of Artificial Sequence: Synthetic oligonucleotide
gttggaagcaatttctgtgcattgatcactttgctagg

SEQ ID NO: 349792 - DNA, 39 bp, Artificial Sequence
  Description of Artificial Sequence: Synthetic oligonucleotide
ttggaagcaatttctgtgcattgatcactttgctaggac

SEQ ID NO: 349793 - DNA, 38 bp, Artificial Sequence
  Description of Artificial Sequence: Synthetic oligonucleotide
tggaagcaatttctgtgcattgatcactttgctaggac

SEQ ID NO: 349794 - DNA, 37 bp, Artificial Sequence
  Description of Artificial Sequence: Synthetic oligonucleotide
ggaagcaatttctgtgcattgatcactttgctaggac

SEQ ID NO: 349795 - DNA, 38 bp, Artificial Sequence
  Description of Artificial Sequence: Synthetic oligonucleotide
gaagcaatttctgtgcattgatcactttgctaggactc

SEQ ID NO: 349796 - DNA, 42 bp, Artificial Sequence
  Description of Artificial Sequence: Synthetic oligonucleotide
aagcaatttctgtgcattgatcactttgctaggactcattag

SEQ ID NO: 349797 - DNA, 41 bp, Artificial Sequence
  Description of Artificial Sequence: Synthetic oligonucleotide
agcaatttctgtgcattgatcactttgctaggactcattag

SEQ ID NO: 349798 - DNA, 40 bp, Artificial Sequence
  Description of Artificial Sequence: Synthetic oligonucleotide
gcaatttctgtgcattgatcactttgctaggactcattag

SEQ ID NO: 349799 - DNA, 40 bp, Artificial Sequence
  Description of Artificial Sequence: Synthetic oligonucleotide
caatttctgtgcattgatcactttgctaggactcattagg

SEQ ID NO: 349800 - DNA, 43 bp, Artificial Sequence
  Description of Artificial Sequence: Synthetic oligonucleotide
aatttctgtgcattgatcactttgctaggactcattaggatag

SEQ ID NO: 349801 - DNA, 42 bp, Artificial Sequence
  Description of Artificial Sequence: Synthetic oligonucleotide
atttctgtgcattgatcactttgctaggactcattaggatag

SEQ ID NO: 349802 - DNA, 41 bp, Artificial Sequence
  Description of Artificial Sequence: Synthetic oligonucleotide
tttctgtgcattgatcactttgctaggactcattaggatag

SEQ ID NO: 349803 - DNA, 40 bp, Artificial Sequence
  Description of Artificial Sequence: Synthetic oligonucleotide
ttctgtgcattgatcactttgctaggactcattaggatag

SEQ ID NO: 349804 - DNA, 39 bp, Artificial Sequence
  Description of Artificial Sequence: Synthetic oligonucleotide
tctgtgcattgatcactttgctaggactcattaggatag

SEQ ID NO: 349805 - DNA, 38 bp, Artificial Sequence
  Description of Artificial Sequence: Synthetic oligonucleotide
ctgtgcattgatcactttgctaggactcattaggatag

SEQ ID NO: 349806 - DNA, 38 bp, Artificial Sequence
  Description of Artificial Sequence: Synthetic oligonucleotide
tgtgcattgatcactttgctaggactcattaggatagg

SEQ ID NO: 349807 - DNA, 37 bp, Artificial Sequence
  Description of Artificial Sequence: Synthetic oligonucleotide
gtgcattgatcactttgctaggactcattaggatagg

SEQ ID NO: 349808 - DNA, 38 bp, Artificial Sequence
  Description of Artificial Sequence: Synthetic oligonucleotide
tgcattgatcactttgctaggactcattaggataggtc

SEQ ID NO: 349809 - DNA, 37 bp, Artificial Sequence
  Description of Artificial Sequence: Synthetic oligonucleotide
gcattgatcactttgctaggactcattaggataggtc

SEQ ID NO: 349810 - DNA, 39 bp, Artificial Sequence
  Description of Artificial Sequence: Synthetic oligonucleotide
cattgatcactttgctaggactcattaggataggtcatg

SEQ ID NO: 349811 - DNA, 39 bp, Artificial Sequence
  Description of Artificial Sequence: Synthetic oligonucleotide
attgatcactttgctaggactcattaggataggtcatgg

SEQ ID NO: 349812 - DNA, 38 bp, Artificial Sequence
  Description of Artificial Sequence: Synthetic oligonucleotide
ttgatcactttgctaggactcattaggataggtcatgg

SEQ ID NO: 349813 - DNA, 37 bp, Artificial Sequence
  Description of Artificial Sequence: Synthetic oligonucleotide
tgatcactttgctaggactcattaggataggtcatgg

SEQ ID NO: 349814 - DNA, 36 bp, Artificial Sequence
  Description of Artificial Sequence: Synthetic oligonucleotide
gatcactttgctaggactcattaggataggtcatgg

SEQ ID NO: 349815 - DNA, 41 bp, Artificial Sequence
  Description of Artificial Sequence: Synthetic oligonucleotide
atcactttgctaggactcattaggataggtcatggatatag

SEQ ID NO: 349816 - DNA, 40 bp, Artificial Sequence
  Description of Artificial Sequence: Synthetic oligonucleotide
tcactttgctaggactcattaggataggtcatggatatag

SEQ ID NO: 349817 - DNA, 39 bp, Artificial Sequence
  Description of Artificial Sequence: Synthetic oligonucleotide
cactttgctaggactcattaggataggtcatggatatag

SEQ ID NO: 349818 - DNA, 42 bp, Artificial Sequence
  Description of Artificial Sequence: Synthetic oligonucleotide
actttgctaggactcattaggataggtcatggatatagaatg

SEQ ID NO: 349819 - DNA, 41 bp, Artificial Sequence
  Description of Artificial Sequence: Synthetic oligonucleotide
ctttgctaggactcattaggataggtcatggatatagaatg

SEQ ID NO: 349820 - DNA, 41 bp, Artificial Sequence
  Description of Artificial Sequence: Synthetic oligonucleotide
tttgctaggactcattaggataggtcatggatatagaatgc

SEQ ID NO: 349821 - DNA, 40 bp, Artificial Sequence
  Description of Artificial Sequence: Synthetic oligonucleotide
ttgctaggactcattaggataggtcatggatatagaatgc

SEQ ID NO: 349822 - DNA, 39 bp, Artificial Sequence
  Description of Artificial Sequence: Synthetic oligonucleotide
tgctaggactcattaggataggtcatggatatagaatgc

SEQ ID NO: 349823 - DNA, 38 bp, Artificial Sequence
  Description of Artificial Sequence: Synthetic oligonucleotide
gctaggactcattaggataggtcatggatatagaatgc

SEQ ID NO: 349824 - DNA, 39 bp, Artificial Sequence
  Description of Artificial Sequence: Synthetic oligonucleotide
ctaggactcattaggataggtcatggatatagaatgctc

SEQ ID NO: 349825 - DNA, 39 bp, Artificial Sequence
  Description of Artificial Sequence: Synthetic oligonucleotide
taggactcattaggataggtcatggatatagaatgctcc

SEQ ID NO: 349826 - DNA, 38 bp, Artificial Sequence
  Description of Artificial Sequence: Synthetic oligonucleotide
aggactcattaggataggtcatggatatagaatgctcc

SEQ ID NO: 349827 - DNA, 37 bp, Artificial Sequence
  Description of Artificial Sequence: Synthetic oligonucleotide
ggactcattaggataggtcatggatatagaatgctcc

SEQ ID NO: 349828 - DNA, 38 bp, Artificial Sequence
  Description of Artificial Sequence: Synthetic oligonucleotide
gactcattaggataggtcatggatatagaatgctccac

SEQ ID NO: 349829 - DNA, 38 bp, Artificial Sequence
  Description of Artificial Sequence: Synthetic oligonucleotide
actcattaggataggtcatggatatagaatgctccacc

SEQ ID NO: 349830 - DNA, 37 bp, Artificial Sequence
  Description of Artificial Sequence: Synthetic oligonucleotide
ctcattaggataggtcatggatatagaatgctccacc

SEQ ID NO: 349831 - DNA, 39 bp, Artificial Sequence
  Description of Artificial Sequence: Synthetic oligonucleotide
tcattaggataggtcatggatatagaatgctccaccatg

SEQ ID NO: 349832 - DNA, 38 bp, Artificial Sequence
  Description of Artificial Sequence: Synthetic oligonucleotide
cattaggataggtcatggatatagaatgctccaccatg

SEQ ID NO: 349833 - DNA, 39 bp, Artificial Sequence
  Description of Artificial Sequence: Synthetic oligonucleotide
attaggataggtcatggatatagaatgctccaccatgac

SEQ ID NO: 349834 - DNA, 38 bp, Artificial Sequence
  Description of Artificial Sequence: Synthetic oligonucleotide
ttaggataggtcatggatatagaatgctccaccatgac

SEQ ID NO: 349835 - DNA, 37 bp, Artificial Sequence
  Description of Artificial Sequence: Synthetic oligonucleotide
taggataggtcatggatatagaatgctccaccatgac

SEQ ID NO: 349836 - DNA, 36 bp, Artificial Sequence
  Description of Artificial Sequence: Synthetic oligonucleotide
aggataggtcatggatatagaatgctccaccatgac

SEQ ID NO: 349837 - DNA, 35 bp, Artificial Sequence
  Description of Artificial Sequence: Synthetic oligonucleotide
ggataggtcatggatatagaatgctccaccatgac

SEQ ID NO: 349838 - DNA, 35 bp, Artificial Sequence
  Description of Artificial Sequence: Synthetic oligonucleotide
gataggtcatggatatagaatgctccaccatgacc

SEQ ID NO: 349839 - DNA, 37 bp, Artificial Sequence
  Description of Artificial Sequence: Synthetic oligonucleotide
ataggtcatggatatagaatgctccaccatgaccatc

SEQ ID NO: 349840 - DNA, 36 bp, Artificial Sequence
  Description of Artificial Sequence: Synthetic oligonucleotide
taggtcatggatatagaatgctccaccatgaccatc

SEQ ID NO: 349841 - DNA, 35 bp, Artificial Sequence
  Description of Artificial Sequence: Synthetic oligonucleotide
aggtcatggatatagaatgctccaccatgaccatc

SEQ ID NO: 349842 - DNA, 34 bp, Artificial Sequence
  Description of Artificial Sequence: Synthetic oligonucleotide
ggtcatggatatagaatgctccaccatgaccatc

SEQ ID NO: 349843 - DNA, 36 bp, Artificial Sequence
  Description of Artificial Sequence: Synthetic oligonucleotide
gtcatggatatagaatgctccaccatgaccatcatc

SEQ ID NO: 349844 - DNA, 37 bp, Artificial Sequence
  Description of Artificial Sequence: Synthetic oligonucleotide
tcatggatatagaatgctccaccatgaccatcatcac

SEQ ID NO: 349845 - DNA, 36 bp, Artificial Sequence
  Description of Artificial Sequence: Synthetic oligonucleotide
catggatatagaatgctccaccatgaccatcatcac

SEQ ID NO: 349846 - DNA, 36 bp, Artificial Sequence
  Description of Artificial Sequence: Synthetic oligonucleotide
atggatatagaatgctccaccatgaccatcatcacg

SEQ ID NO: 349847 - DNA, 35 bp, Artificial Sequence
  Description of Artificial Sequence: Synthetic oligonucleotide
tggatatagaatgctccaccatgaccatcatcacg

SEQ ID NO: 349848 - DNA, 34 bp, Artificial Sequence
  Description of Artificial Sequence: Synthetic oligonucleotide
ggatatagaatgctccaccatgaccatcatcacg

SEQ ID NO: 349849 - DNA, 36 bp, Artificial Sequence
  Description of Artificial Sequence: Synthetic oligonucleotide
gatatagaatgctccaccatgaccatcatcacgtac

SEQ ID NO: 349850 - DNA, 38 bp, Artificial Sequence
  Description of Artificial Sequence: Synthetic oligonucleotide
atatagaatgctccaccatgaccatcatcacgtacaag

SEQ ID NO: 349851 - DNA, 37 bp, Artificial Sequence
  Description of Artificial Sequence: Synthetic oligonucleotide
tatagaatgctccaccatgaccatcatcacgtacaag

SEQ ID NO: 349852 - DNA, 36 bp, Artificial Sequence
  Description of Artificial Sequence: Synthetic oligonucleotide
atagaatgctccaccatgaccatcatcacgtacaag

SEQ ID NO: 349853 - DNA, 35 bp, Artificial Sequence
  Description of Artificial Sequence: Synthetic oligonucleotide
tagaatgctccaccatgaccatcatcacgtacaag

SEQ ID NO: 349854 - DNA, 34 bp, Artificial Sequence
  Description of Artificial Sequence: Synthetic oligonucleotide
agaatgctccaccatgaccatcatcacgtacaag

SEQ ID NO: 349855 - DNA, 33 bp, Artificial Sequence
  Description of Artificial Sequence: Synthetic oligonucleotide
gaatgctccaccatgaccatcatcacgtacaag

SEQ ID NO: 349856 - DNA, 33 bp, Artificial Sequence
  Description of Artificial Sequence: Synthetic oligonucleotide
aatgctccaccatgaccatcatcacgtacaagc

SEQ ID NO: 349857 - DNA, 32 bp, Artificial Sequence
  Description of Artificial Sequence: Synthetic oligonucleotide
atgctccaccatgaccatcatcacgtacaagc

SEQ ID NO: 349858 - DNA, 31 bp, Artificial Sequence
  Description of Artificial Sequence: Synthetic oligonucleotide
tgctccaccatgaccatcatcacgtacaagc

SEQ ID NO: 349859 - DNA, 30 bp, Artificial Sequence
  Description of Artificial Sequence: Synthetic oligonucleotide
gctccaccatgaccatcatcacgtacaagc

SEQ ID NO: 349860 - DNA, 31 bp, Artificial Sequence
  Description of Artificial Sequence: Synthetic oligonucleotide
ctccaccatgaccatcatcacgtacaagctc

SEQ ID NO: 349861 - DNA, 31 bp, Artificial Sequence
  Description of Artificial Sequence: Synthetic oligonucleotide
tccaccatgaccatcatcacgtacaagctcg

SEQ ID NO: 349862 - DNA, 30 bp, Artificial Sequence
  Description of Artificial Sequence: Synthetic oligonucleotide
ccaccatgaccatcatcacgtacaagctcg

SEQ ID NO: 349863 - DNA, 33 bp, Artificial Sequence
  Description of Artificial Sequence: Synthetic oligonucleotide
caccatgaccatcatcacgtacaagctcgtaac

SEQ ID NO: 349864 - DNA, 36 bp, Artificial Sequence
  Description of Artificial Sequence: Synthetic oligonucleotide
accatgaccatcatcacgtacaagctcgtaacaaag

SEQ ID NO: 349865 - DNA, 35 bp, Artificial Sequence
  Description of Artificial Sequence: Synthetic oligonucleotide
ccatgaccatcatcacgtacaagctcgtaacaaag

SEQ ID NO: 349866 - DNA, 37 bp, Artificial Sequence
  Description of Artificial Sequence: Synthetic oligonucleotide
catgaccatcatcacgtacaagctcgtaacaaagatg

SEQ ID NO: 349867 - DNA, 41 bp, Artificial Sequence
  Description of Artificial Sequence: Synthetic oligonucleotide
atgaccatcatcacgtacaagctcgtaacaaagatgatatc

SEQ ID NO: 349868 - DNA, 40 bp, Artificial Sequence
  Description of Artificial Sequence: Synthetic oligonucleotide
tgaccatcatcacgtacaagctcgtaacaaagatgatatc

SEQ ID NO: 349869 - DNA, 39 bp, Artificial Sequence
  Description of Artificial Sequence: Synthetic oligonucleotide
gaccatcatcacgtacaagctcgtaacaaagatgatatc

SEQ ID NO: 349870 - DNA, 41 bp, Artificial Sequence
  Description of Artificial Sequence: Synthetic oligonucleotide
accatcatcacgtacaagctcgtaacaaagatgatatcttg

SEQ ID NO: 349871 - DNA, 40 bp, Artificial Sequence
  Description of Artificial Sequence: Synthetic oligonucleotide
ccatcatcacgtacaagctcgtaacaaagatgatatcttg

SEQ ID NO: 349872 - DNA, 47 bp, Artificial Sequence
  Description of Artificial Sequence: Synthetic oligonucleotide
catcatcacgtacaagctcgtaacaaagatgatatcttgtaaatttc

SEQ ID NO: 349873 - DNA, 48 bp, Artificial Sequence
  Description of Artificial Sequence: Synthetic oligonucleotide
atcatcacgtacaagctcgtaacaaagatgatatcttgtaaatttcag

SEQ ID NO: 349874 - DNA, 47 bp, Artificial Sequence
  Description of Artificial Sequence: Synthetic oligonucleotide
tcatcacgtacaagctcgtaacaaagatgatatcttgtaaatttcag

SEQ ID NO: 349875 - DNA, 46 bp, Artificial Sequence
  Description of Artificial Sequence: Synthetic oligonucleotide
catcacgtacaagctcgtaacaaagatgatatcttgtaaatttcag

SEQ ID NO: 349876 - DNA, 47 bp, Artificial Sequence
  Description of Artificial Sequence: Synthetic oligonucleotide
atcacgtacaagctcgtaacaaagatgatatcttgtaaatttcagtg

SEQ ID NO: 349877 - DNA, 46 bp, Artificial Sequence
  Description of Artificial Sequence: Synthetic oligonucleotide
tcacgtacaagctcgtaacaaagatgatatcttgtaaatttcagtg

SEQ ID NO: 349878 - DNA, 45 bp, Artificial Sequence
  Description of Artificial Sequence: Synthetic oligonucleotide
cacgtacaagctcgtaacaaagatgatatcttgtaaatttcagtg

SEQ ID NO: 349879 - DNA, 45 bp, Artificial Sequence
  Description of Artificial Sequence: Synthetic oligonucleotide
acgtacaagctcgtaacaaagatgatatcttgtaaatttcagtgg

SEQ ID NO: 349880 - DNA, 44 bp, Artificial Sequence
  Description of Artificial Sequence: Synthetic oligonucleotide
cgtacaagctcgtaacaaagatgatatcttgtaaatttcagtgg

SEQ ID NO: 349881 - DNA, 46 bp, Artificial Sequence
  Description of Artificial Sequence: Synthetic oligonucleotide
gtacaagctcgtaacaaagatgatatcttgtaaatttcagtggatg

SEQ ID NO: 349882 - DNA, 47 bp, Artificial Sequence
  Description of Artificial Sequence: Synthetic oligonucleotide
tacaagctcgtaacaaagatgatatcttgtaaatttcagtggatgag

SEQ ID NO: 349883 - DNA, 46 bp, Artificial Sequence
  Description of Artificial Sequence: Synthetic oligonucleotide
acaagctcgtaacaaagatgatatcttgtaaatttcagtggatgag

SEQ ID NO: 349884 - DNA, 45 bp, Artificial Sequence
  Description of Artificial Sequence: Synthetic oligonucleotide
caagctcgtaacaaagatgatatcttgtaaatttcagtggatgag

SEQ ID NO: 349885 - DNA, 45 bp, Artificial Sequence
  Description of Artificial Sequence: Synthetic oligonucleotide
aagctcgtaacaaagatgatatcttgtaaatttcagtggatgagc

SEQ ID NO: 349886 - DNA, 44 bp, Artificial Sequence
  Description of Artificial Sequence: Synthetic oligonucleotide
agctcgtaacaaagatgatatcttgtaaatttcagtggatgagc

SEQ ID NO: 349887 - DNA, 43 bp, Artificial Sequence
  Description of Artificial Sequence: Synthetic oligonucleotide
gctcgtaacaaagatgatatcttgtaaatttcagtggatgagc

SEQ ID NO: 349888 - DNA, 43 bp, Artificial Sequence
  Description of Artificial Sequence: Synthetic oligonucleotide
ctcgtaacaaagatgatatcttgtaaatttcagtggatgagcg

SEQ ID NO: 349889 - DNA, 43 bp, Artificial Sequence
  Description of Artificial Sequence: Synthetic oligonucleotide
tcgtaacaaagatgatatcttgtaaatttcagtggatgagcgg

SEQ ID NO: 349890 - DNA, 42 bp, Artificial Sequence
  Description of Artificial Sequence: Synthetic oligonucleotide
cgtaacaaagatgatatcttgtaaatttcagtggatgagcgg

SEQ ID NO: 349891 - DNA, 44 bp, Artificial Sequence
  Description of Artificial Sequence: Synthetic oligonucleotide
gtaacaaagatgatatcttgtaaatttcagtggatgagcggatg

SEQ ID NO: 349892 - DNA, 44 bp, Artificial Sequence
  Description of Artificial Sequence: Synthetic oligonucleotide
taacaaagatgatatcttgtaaatttcagtggatgagcggatgg

SEQ ID NO: 349893 - DNA, 43 bp, Artificial Sequence
  Description of Artificial Sequence: Synthetic oligonucleotide
aacaaagatgatatcttgtaaatttcagtggatgagcggatgg

SEQ ID NO: 349894 - DNA, 42 bp, Artificial Sequence
  Description of Artificial Sequence: Synthetic oligonucleotide
acaaagatgatatcttgtaaatttcagtggatgagcggatgg

SEQ ID NO: 349895 - DNA, 41 bp, Artificial Sequence
  Description of Artificial Sequence: Synthetic oligonucleotide
caaagatgatatcttgtaaatttcagtggatgagcggatgg

SEQ ID NO: 349896 - DNA, 42 bp, Artificial Sequence
  Description of Artificial Sequence: Synthetic oligonucleotide
aaagatgatatcttgtaaatttcagtggatgagcggatggag

SEQ ID NO: 349897 - DNA, 41 bp, Artificial Sequence
  Description of Artificial Sequence: Synthetic oligonucleotide
aagatgatatcttgtaaatttcagtggatgagcggatggag

SEQ ID NO: 349898 - DNA, 40 bp, Artificial Sequence
  Description of Artificial Sequence: Synthetic oligonucleotide
agatgatatcttgtaaatttcagtggatgagcggatggag

SEQ ID NO: 349899 - DNA, 39 bp, Artificial Sequence
  Description of Artificial Sequence: Synthetic oligonucleotide
gatgatatcttgtaaatttcagtggatgagcggatggag

SEQ ID NO: 349900 - DNA, 39 bp, Artificial Sequence
  Description of Artificial Sequence: Synthetic oligonucleotide
atgatatcttgtaaatttcagtggatgagcggatggagc

SEQ ID NO: 349901 - DNA, 38 bp, Artificial Sequence
  Description of Artificial Sequence: Synthetic oligonucleotide
tgatatcttgtaaatttcagtggatgagcggatggagc

SEQ ID NO: 349902 - DNA, 37 bp, Artificial Sequence
  Description of Artificial Sequence: Synthetic oligonucleotide
gatatcttgtaaatttcagtggatgagcggatggagc

SEQ ID NO: 349903 - DNA, 38 bp, Artificial Sequence
  Description of Artificial Sequence: Synthetic oligonucleotide
atatcttgtaaatttcagtggatgagcggatggagctc

SEQ ID NO: 349904 - DNA, 37 bp, Artificial Sequence
  Description of Artificial Sequence: Synthetic oligonucleotide
tatcttgtaaatttcagtggatgagcggatggagctc

SEQ ID NO: 349905 - DNA, 36 bp, Artificial Sequence
  Description of Artificial Sequence: Synthetic oligonucleotide
atcttgtaaatttcagtggatgagcggatggagctc

SEQ ID NO: 349906 - DNA, 35 bp, Artificial Sequence
  Description of Artificial Sequence: Synthetic oligonucleotide
tcttgtaaatttcagtggatgagcggatggagctc

SEQ ID NO: 349907 - DNA, 34 bp, Artificial Sequence
  Description of Artificial Sequence: Synthetic oligonucleotide
cttgtaaatttcagtggatgagcggatggagctc

SEQ ID NO: 349908 - DNA, 35 bp, Artificial Sequence
  Description of Artificial Sequence: Synthetic oligonucleotide
ttgtaaatttcagtggatgagcggatggagctctg

SEQ ID NO: 349909 - DNA, 34 bp, Artificial Sequence
  Description of Artificial Sequence: Synthetic oligonucleotide
tgtaaatttcagtggatgagcggatggagctctg

SEQ ID NO: 349910 - DNA, 33 bp, Artificial Sequence
  Description of Artificial Sequence: Synthetic oligonucleotide
gtaaatttcagtggatgagcggatggagctctg

SEQ ID NO: 349911 - DNA, 36 bp, Artificial Sequence
  Description of Artificial Sequence: Synthetic oligonucleotide
taaatttcagtggatgagcggatggagctctgtaag

SEQ ID NO: 349912 - DNA, 35 bp, Artificial Sequence
  Description of Artificial Sequence: Synthetic oligonucleotide
aaatttcagtggatgagcggatggagctctgtaag

SEQ ID NO: 349913 - DNA, 34 bp, Artificial Sequence
  Description of Artificial Sequence: Synthetic oligonucleotide
aatttcagtggatgagcggatggagctctgtaag

SEQ ID NO: 349914 - DNA, 33 bp, Artificial Sequence
  Description of Artificial Sequence: Synthetic oligonucleotide
atttcagtggatgagcggatggagctctgtaag

SEQ ID NO: 349915 - DNA, 32 bp, Artificial Sequence
  Description of Artificial Sequence: Synthetic oligonucleotide
tttcagtggatgagcggatggagctctgtaag

SEQ ID NO: 349916 - DNA, 31 bp, Artificial Sequence
  Description of Artificial Sequence: Synthetic oligonucleotide
ttcagtggatgagcggatggagctctgtaag

SEQ ID NO: 349917 - DNA, 30 bp, Artificial Sequence
  Description of Artificial Sequence: Synthetic oligonucleotide
tcagtggatgagcggatggagctctgtaag

SEQ ID NO: 349918 - DNA, 29 bp, Artificial Sequence
  Description of Artificial Sequence: Synthetic oligonucleotide
cagtggatgagcggatggagctctgtaag

SEQ ID NO: 349919 - DNA, 30 bp, Artificial Sequence
  Description of Artificial Sequence: Synthetic oligonucleotide
agtggatgagcggatggagctctgtaagag

SEQ ID NO: 349920 - DNA, 29 bp, Artificial Sequence
  Description of Artificial Sequence: Synthetic oligonucleotide
gtggatgagcggatggagctctgtaagag

SEQ ID NO: 349921 - DNA, 29 bp, Artificial Sequence
  Description of Artificial Sequence: Synthetic oligonucleotide
tggatgagcggatggagctctgtaagagc

SEQ ID NO: 349922 - DNA, 28 bp, Artificial Sequence
  Description of Artificial Sequence: Synthetic oligonucleotide
ggatgagcggatggagctctgtaagagc

SEQ ID NO: 349923 - DNA, 31 bp, Artificial Sequence
  Description of Artificial Sequence: Synthetic oligonucleotide
gatgagcggatggagctctgtaagagctatc

SEQ ID NO: 349924 - DNA, 31 bp, Artificial Sequence
  Description of Artificial Sequence: Synthetic oligonucleotide
atgagcggatggagctctgtaagagctatcg

SEQ ID NO: 349925 - DNA, 30 bp, Artificial Sequence
  Description of Artificial Sequence: Synthetic oligonucleotide
tgagcggatggagctctgtaagagctatcg

SEQ ID NO: 349926 - DNA, 29 bp, Artificial Sequence
  Description of Artificial Sequence: Synthetic oligonucleotide
gagcggatggagctctgtaagagctatcg

SEQ ID NO: 349927 - DNA, 30 bp, Artificial Sequence
  Description of Artificial Sequence: Synthetic oligonucleotide
agcggatggagctctgtaagagctatcgag

SEQ ID NO: 349928 - DNA, 29 bp, Artificial Sequence
  Description of Artificial Sequence: Synthetic oligonucleotide
gcggatggagctctgtaagagctatcgag

SEQ ID NO: 349929 - DNA, 33 bp, Artificial Sequence
  Description of Artificial Sequence: Synthetic oligonucleotide
cggatggagctctgtaagagctatcgagtatag

SEQ ID NO: 349930 - DNA, 34 bp, Artificial Sequence
  Description of Artificial Sequence: Synthetic oligonucleotide
ggatggagctctgtaagagctatcgagtatagtg

SEQ ID NO: 349931 - DNA, 40 bp, Artificial Sequence
  Description of Artificial Sequence: Synthetic oligonucleotide
gatggagctctgtaagagctatcgagtatagtgtattatc

SEQ ID NO: 349932 - DNA, 40 bp, Artificial Sequence
  Description of Artificial Sequence: Synthetic oligonucleotide
atggagctctgtaagagctatcgagtatagtgtattatcg

SEQ ID NO: 349933 - DNA, 39 bp, Artificial Sequence
  Description of Artificial Sequence: Synthetic oligonucleotide
tggagctctgtaagagctatcgagtatagtgtattatcg

SEQ ID NO: 349934 - DNA, 38 bp, Artificial Sequence
  Description of Artificial Sequence: Synthetic oligonucleotide
ggagctctgtaagagctatcgagtatagtgtattatcg

SEQ ID NO: 349935 - DNA, 40 bp, Artificial Sequence
  Description of Artificial Sequence: Synthetic oligonucleotide
gagctctgtaagagctatcgagtatagtgtattatcgttg

SEQ ID NO: 349936 - DNA, 45 bp, Artificial Sequence
  Description of Artificial Sequence: Synthetic oligonucleotide
agctctgtaagagctatcgagtatagtgtattatcgttgtaaaac

SEQ ID NO: 349937 - DNA, 44 bp, Artificial Sequence
  Description of Artificial Sequence: Synthetic oligonucleotide
gctctgtaagagctatcgagtatagtgtattatcgttgtaaaac

SEQ ID NO: 349938 - DNA, 44 bp, Artificial Sequence
  Description of Artificial Sequence: Synthetic oligonucleotide
ctctgtaagagctatcgagtatagtgtattatcgttgtaaaacg

SEQ ID NO: 349939 - DNA, 44 bp, Artificial Sequence
  Description of Artificial Sequence: Synthetic oligonucleotide
tctgtaagagctatcgagtatagtgtattatcgttgtaaaacgc

SEQ ID NO: 349940 - DNA, 43 bp, Artificial Sequence
  Description of Artificial Sequence: Synthetic oligonucleotide
ctgtaagagctatcgagtatagtgtattatcgttgtaaaacgc

SEQ ID NO: 349941 - DNA, 46 bp, Artificial Sequence
  Description of Artificial Sequence: Synthetic oligonucleotide
tgtaagagctatcgagtatagtgtattatcgttgtaaaacgcaaag

SEQ ID NO: 349942 - DNA, 45 bp, Artificial Sequence
  Description of Artificial Sequence: Synthetic oligonucleotide
gtaagagctatcgagtatagtgtattatcgttgtaaaacgcaaag

SEQ ID NO: 349943 - DNA, 47 bp, Artificial Sequence
  Description of Artificial Sequence: Synthetic oligonucleotide
taagagctatcgagtatagtgtattatcgttgtaaaacgcaaagatg

SEQ ID NO: 349944 - DNA, 46 bp, Artificial Sequence
  Description of Artificial Sequence: Synthetic oligonucleotide
aagagctatcgagtatagtgtattatcgttgtaaaacgcaaagatg

SEQ ID NO: 349945 - DNA, 45 bp, Artificial Sequence
  Description of Artificial Sequence: Synthetic oligonucleotide
agagctatcgagtatagtgtattatcgttgtaaaacgcaaagatg

SEQ ID NO: 349946 - DNA, 44 bp, Artificial Sequence
  Description of Artificial Sequence: Synthetic oligonucleotide
gagctatcgagtatagtgtattatcgttgtaaaacgcaaagatg

SEQ ID NO: 349947 - DNA, 45 bp, Artificial Sequence
  Description of Artificial Sequence: Synthetic oligonucleotide
agctatcgagtatagtgtattatcgttgtaaaacgcaaagatgtc

SEQ ID NO: 349948 - DNA, 44 bp, Artificial Sequence
  Description of Artificial Sequence: Synthetic oligonucleotide
gctatcgagtatagtgtattatcgttgtaaaacgcaaagatgtc

SEQ ID NO: 349949 - DNA, 45 bp, Artificial Sequence
  Description of Artificial Sequence: Synthetic oligonucleotide
ctatcgagtatagtgtattatcgttgtaaaacgcaaagatgtcag

SEQ ID NO: 349950 - DNA, 46 bp, Artificial Sequence
  Description of Artificial Sequence: Synthetic oligonucleotide
tatcgagtatagtgtattatcgttgtaaaacgcaaagatgtcagtc

SEQ ID NO: 349951 - DNA, 45 bp, Artificial Sequence
  Description of Artificial Sequence: Synthetic oligonucleotide
atcgagtatagtgtattatcgttgtaaaacgcaaagatgtcagtc

SEQ ID NO: 349952 - DNA, 44 bp, Artificial Sequence
  Description of Artificial Sequence: Synthetic oligonucleotide
tcgagtatagtgtattatcgttgtaaaacgcaaagatgtcagtc

SEQ ID NO: 349953 - DNA, 43 bp, Artificial Sequence
  Description of Artificial Sequence: Synthetic oligonucleotide
cgagtatagtgtattatcgttgtaaaacgcaaagatgtcagtc

SEQ ID NO: 349954 - DNA, 46 bp, Artificial Sequence
  Description of Artificial Sequence: Synthetic oligonucleotide
gagtatagtgtattatcgttgtaaaacgcaaagatgtcagtctttg

SEQ ID NO: 349955 - DNA, 46 bp, Artificial Sequence
  Description of Artificial Sequence: Synthetic oligonucleotide
agtatagtgtattatcgttgtaaaacgcaaagatgtcagtctttgg

SEQ ID NO: 349956 - DNA, 45 bp, Artificial Sequence
  Description of Artificial Sequence: Synthetic oligonucleotide
gtatagtgtattatcgttgtaaaacgcaaagatgtcagtctttgg

SEQ ID NO: 349957 - DNA, 45 bp, Artificial Sequence
  Description of Artificial Sequence: Synthetic oligonucleotide
tatagtgtattatcgttgtaaaacgcaaagatgtcagtctttggc

SEQ ID NO: 349958 - DNA, 44 bp, Artificial Sequence
  Description of Artificial Sequence: Synthetic oligonucleotide
atagtgtattatcgttgtaaaacgcaaagatgtcagtctttggc

SEQ ID NO: 349959 - DNA, 43 bp, Artificial Sequence
  Description of Artificial Sequence: Synthetic oligonucleotide
tagtgtattatcgttgtaaaacgcaaagatgtcagtctttggc

SEQ ID NO: 349960 - DNA, 42 bp, Artificial Sequence
  Description of Artificial Sequence: Synthetic oligonucleotide
agtgtattatcgttgtaaaacgcaaagatgtcagtctttggc

SEQ ID NO: 349961 - DNA, 41 bp, Artificial Sequence
  Description of Artificial Sequence: Synthetic oligonucleotide
gtgtattatcgttgtaaaacgcaaagatgtcagtctttggc

SEQ ID NO: 349962 - DNA, 41 bp, Artificial Sequence
  Description of Artificial Sequence: Synthetic oligonucleotide
tgtattatcgttgtaaaacgcaaagatgtcagtctttggcc

SEQ ID NO: 349963 - DNA, 40 bp, Artificial Sequence
  Description of Artificial Sequence: Synthetic oligonucleotide
gtattatcgttgtaaaacgcaaagatgtcagtctttggcc

SEQ ID NO: 349964 - DNA, 41 bp, Artificial Sequence
  Description of Artificial Sequence: Synthetic oligonucleotide
tattatcgttgtaaaacgcaaagatgtcagtctttggcctg

SEQ ID NO: 349965 - DNA, 40 bp, Artificial Sequence
  Description of Artificial Sequence: Synthetic oligonucleotide
attatcgttgtaaaacgcaaagatgtcagtctttggcctg

SEQ ID NO: 349966 - DNA, 39 bp, Artificial Sequence
  Description of Artificial Sequence: Synthetic oligonucleotide
ttatcgttgtaaaacgcaaagatgtcagtctttggcctg

SEQ ID NO: 349967 - DNA, 38 bp, Artificial Sequence
  Description of Artificial Sequence: Synthetic oligonucleotide
tatcgttgtaaaacgcaaagatgtcagtctttggcctg

SEQ ID NO: 349968 - DNA, 37 bp, Artificial Sequence
  Description of Artificial Sequence: Synthetic oligonucleotide
atcgttgtaaaacgcaaagatgtcagtctttggcctg

SEQ ID NO: 349969 - DNA, 36 bp, Artificial Sequence
  Description of Artificial Sequence: Synthetic oligonucleotide
tcgttgtaaaacgcaaagatgtcagtctttggcctg

SEQ ID NO: 349970 - DNA, 35 bp, Artificial Sequence
  Description of Artificial Sequence: Synthetic oligonucleotide
cgttgtaaaacgcaaagatgtcagtctttggcctg

SEQ ID NO: 349971 - DNA, 35 bp, Artificial Sequence
  Description of Artificial Sequence: Synthetic oligonucleotide
gttgtaaaacgcaaagatgtcagtctttggcctgc

SEQ ID NO: 349972 - DNA, 36 bp, Artificial Sequence
  Description of Artificial Sequence: Synthetic oligonucleotide
ttgtaaaacgcaaagatgtcagtctttggcctgcag

SEQ ID NO: 349973 - DNA, 35 bp, Artificial Sequence
  Description of Artificial Sequence: Synthetic oligonucleotide
tgtaaaacgcaaagatgtcagtctttggcctgcag

SEQ ID NO: 349974 - DNA, 34 bp, Artificial Sequence
  Description of Artificial Sequence: Synthetic oligonucleotide
gtaaaacgcaaagatgtcagtctttggcctgcag

SEQ ID NO: 349975 - DNA, 38 bp, Artificial Sequence
  Description of Artificial Sequence: Synthetic oligonucleotide
taaaacgcaaagatgtcagtctttggcctgcagtaatg

SEQ ID NO: 349976 - DNA, 37 bp, Artificial Sequence
  Description of Artificial Sequence: Synthetic oligonucleotide
aaaacgcaaagatgtcagtctttggcctgcagtaatg

SEQ ID NO: 349977 - DNA, 36 bp, Artificial Sequence
  Description of Artificial Sequence: Synthetic oligonucleotide
aaacgcaaagatgtcagtctttggcctgcagtaatg

SEQ ID NO: 349978 - DNA, 35 bp, Artificial Sequence
  Description of Artificial Sequence: Synthetic oligonucleotide
aacgcaaagatgtcagtctttggcctgcagtaatg

SEQ ID NO: 349979 - DNA, 34 bp, Artificial Sequence
  Description of Artificial Sequence: Synthetic oligonucleotide
acgcaaagatgtcagtctttggcctgcagtaatg

SEQ ID NO: 349980 - DNA, 33 bp, Artificial Sequence
  Description of Artificial Sequence: Synthetic oligonucleotide
cgcaaagatgtcagtctttggcctgcagtaatg

SEQ ID NO: 349981 - DNA, 33 bp, Artificial Sequence
  Description of Artificial Sequence: Synthetic oligonucleotide
gcaaagatgtcagtctttggcctgcagtaatgg

SEQ ID NO: 349982 - DNA, 34 bp, Artificial Sequence
  Description of Artificial Sequence: Synthetic oligonucleotide
caaagatgtcagtctttggcctgcagtaatggag

SEQ ID NO: 349983 - DNA, 35 bp, Artificial Sequence
  Description of Artificial Sequence: Synthetic oligonucleotide
aaagatgtcagtctttggcctgcagtaatggagac

SEQ ID NO: 349984 - DNA, 34 bp, Artificial Sequence
  Description of Artificial Sequence: Synthetic oligonucleotide
aagatgtcagtctttggcctgcagtaatggagac

SEQ ID NO: 349985 - DNA, 33 bp, Artificial Sequence
  Description of Artificial Sequence: Synthetic oligonucleotide
agatgtcagtctttggcctgcagtaatggagac

SEQ ID NO: 349986 - DNA, 32 bp, Artificial Sequence
  Description of Artificial Sequence: Synthetic oligonucleotide
gatgtcagtctttggcctgcagtaatggagac

SEQ ID NO: 349987 - DNA, 34 bp, Artificial Sequence
  Description of Artificial Sequence: Synthetic oligonucleotide
atgtcagtctttggcctgcagtaatggagacttg

SEQ ID NO: 349988 - DNA, 33 bp, Artificial Sequence
  Description of Artificial Sequence: Synthetic oligonucleotide
tgtcagtctttggcctgcagtaatggagacttg

SEQ ID NO: 349989 - DNA, 32 bp, Artificial Sequence
  Description of Artificial Sequence: Synthetic oligonucleotide
gtcagtctttggcctgcagtaatggagacttg

SEQ ID NO: 349990 - DNA, 32 bp, Artificial Sequence
  Description of Artificial Sequence: Synthetic oligonucleotide
tcagtctttggcctgcagtaatggagacttgc

SEQ ID NO: 349991 - DNA, 31 bp, Artificial Sequence
  Description of Artificial Sequence: Synthetic oligonucleotide
cagtctttggcctgcagtaatggagacttgc

SEQ ID NO: 349992 - DNA, 32 bp, Artificial Sequence
  Description of Artificial Sequence: Synthetic oligonucleotide
agtctttggcctgcagtaatggagacttgcac

SEQ ID NO: 349993 - DNA, 31 bp, Artificial Sequence
  Description of Artificial Sequence: Synthetic oligonucleotide
gtctttggcctgcagtaatggagacttgcac

SEQ ID NO: 349994 - DNA, 31 bp, Artificial Sequence
  Description of Artificial Sequence: Synthetic oligonucleotide
tctttggcctgcagtaatggagacttgcacc

SEQ ID NO: 349995 - DNA, 30 bp, Artificial Sequence
  Description of Artificial Sequence: Synthetic oligonucleotide
ctttggcctgcagtaatggagacttgcacc

SEQ ID NO: 349996 - DNA, 33 bp, Artificial Sequence
  Description of Artificial Sequence: Synthetic oligonucleotide
tttggcctgcagtaatggagacttgcaccaaac

SEQ ID NO: 349997 - DNA, 32 bp, Artificial Sequence
  Description of Artificial Sequence: Synthetic oligonucleotide
ttggcctgcagtaatggagacttgcaccaaac

SEQ ID NO: 349998 - DNA, 31 bp, Artificial Sequence
  Description of Artificial Sequence: Synthetic oligonucleotide
tggcctgcagtaatggagacttgcaccaaac

SEQ ID NO: 349999 - DNA, 30 bp, Artificial Sequence
  Description of Artificial Sequence: Synthetic oligonucleotide
ggcctgcagtaatggagacttgcaccaaac

SEQ ID NO: 350000 - DNA, 31 bp, Artificial Sequence
  Description of Artificial Sequence: Synthetic oligonucleotide
gcctgcagtaatggagacttgcaccaaacac

SEQ ID NO: 350001 - DNA, 32 bp, Artificial Sequence
  Description of Artificial Sequence: Synthetic oligonucleotide
cctgcagtaatggagacttgcaccaaacacag

SEQ ID NO: 350002 - DNA, 33 bp, Artificial Sequence
  Description of Artificial Sequence: Synthetic oligonucleotide
ctgcagtaatggagacttgcaccaaacacagtg

SEQ ID NO: 350003 - DNA, 34 bp, Artificial Sequence
  Description of Artificial Sequence: Synthetic oligonucleotide
tgcagtaatggagacttgcaccaaacacagtgac

SEQ ID NO: 350004 - DNA, 33 bp, Artificial Sequence
  Description of Artificial Sequence: Synthetic oligonucleotide
gcagtaatggagacttgcaccaaacacagtgac

SEQ ID NO: 350005 - DNA, 36 bp, Artificial Sequence
  Description of Artificial Sequence: Synthetic oligonucleotide
cagtaatggagacttgcaccaaacacagtgacaaag

SEQ ID NO: 350006 - DNA, 36 bp, Artificial Sequence
  Description of Artificial Sequence: Synthetic oligonucleotide
agtaatggagacttgcaccaaacacagtgacaaagg

SEQ ID NO: 350007 - DNA, 35 bp, Artificial Sequence
  Description of Artificial Sequence: Synthetic oligonucleotide
gtaatggagacttgcaccaaacacagtgacaaagg

SEQ ID NO: 350008 - DNA, 36 bp, Artificial Sequence
  Description of Artificial Sequence: Synthetic oligonucleotide
taatggagacttgcaccaaacacagtgacaaaggag

SEQ ID NO: 350009 - DNA, 35 bp, Artificial Sequence
  Description of Artificial Sequence: Synthetic oligonucleotide
aatggagacttgcaccaaacacagtgacaaaggag

SEQ ID NO: 350010 - DNA, 34 bp, Artificial Sequence
  Description of Artificial Sequence: Synthetic oligonucleotide
atggagacttgcaccaaacacagtgacaaaggag

SEQ ID NO: 350011 - DNA, 33 bp, Artificial Sequence
  Description of Artificial Sequence: Synthetic oligonucleotide
tggagacttgcaccaaacacagtgacaaaggag

SEQ ID NO: 350012 - DNA, 32 bp, Artificial Sequence
  Description of Artificial Sequence: Synthetic oligonucleotide
ggagacttgcaccaaacacagtgacaaaggag

SEQ ID NO: 350013 - DNA, 33 bp, Artificial Sequence
  Description of Artificial Sequence: Synthetic oligonucleotide
gagacttgcaccaaacacagtgacaaaggagag

SEQ ID NO: 350014 - DNA, 35 bp, Artificial Sequence
  Description of Artificial Sequence: Synthetic oligonucleotide
agacttgcaccaaacacagtgacaaaggagagttc

SEQ ID NO: 350015 - DNA, 34 bp, Artificial Sequence
  Description of Artificial Sequence: Synthetic oligonucleotide
gacttgcaccaaacacagtgacaaaggagagttc

SEQ ID NO: 350016 - DNA, 36 bp, Artificial Sequence
  Description of Artificial Sequence: Synthetic oligonucleotide
acttgcaccaaacacagtgacaaaggagagttcttg

SEQ ID NO: 350017 - DNA, 35 bp, Artificial Sequence
  Description of Artificial Sequence: Synthetic oligonucleotide
cttgcaccaaacacagtgacaaaggagagttcttg

SEQ ID NO: 350018 - DNA, 36 bp, Artificial Sequence
  Description of Artificial Sequence: Synthetic oligonucleotide
ttgcaccaaacacagtgacaaaggagagttcttgag

SEQ ID NO: 350019 - DNA, 35 bp, Artificial Sequence
  Description of Artificial Sequence: Synthetic oligonucleotide
tgcaccaaacacagtgacaaaggagagttcttgag

SEQ ID NO: 350020 - DNA, 34 bp, Artificial Sequence
  Description of Artificial Sequence: Synthetic oligonucleotide
gcaccaaacacagtgacaaaggagagttcttgag

SEQ ID NO: 350021 - DNA, 36 bp, Artificial Sequence
  Description of Artificial Sequence: Synthetic oligonucleotide
caccaaacacagtgacaaaggagagttcttgagttc

SEQ ID NO: 350022 - DNA, 37 bp, Artificial Sequence
  Description of Artificial Sequence: Synthetic oligonucleotide
accaaacacagtgacaaaggagagttcttgagttctg

SEQ ID NO: 350023 - DNA, 36 bp, Artificial Sequence
  Description of Artificial Sequence: Synthetic oligonucleotide
ccaaacacagtgacaaaggagagttcttgagttctg

SEQ ID NO: 350024 - DNA, 41 bp, Artificial Sequence
  Description of Artificial Sequence: Synthetic oligonucleotide
caaacacagtgacaaaggagagttcttgagttctgaatatg

SEQ ID NO: 350025 - DNA, 46 bp, Artificial Sequence
  Description of Artificial Sequence: Synthetic oligonucleotide
aaacacagtgacaaaggagagttcttgagttctgaatatgttaaag

SEQ ID NO: 350026 - DNA, 45 bp, Artificial Sequence
  Description of Artificial Sequence: Synthetic oligonucleotide
aacacagtgacaaaggagagttcttgagttctgaatatgttaaag

SEQ ID NO: 350027 - DNA, 44 bp, Artificial Sequence
  Description of Artificial Sequence: Synthetic oligonucleotide
acacagtgacaaaggagagttcttgagttctgaatatgttaaag

SEQ ID NO: 350028 - DNA, 43 bp, Artificial Sequence
  Description of Artificial Sequence: Synthetic oligonucleotide
cacagtgacaaaggagagttcttgagttctgaatatgttaaag

SEQ ID NO: 350029 - DNA, 44 bp, Artificial Sequence
  Description of Artificial Sequence: Synthetic oligonucleotide
acagtgacaaaggagagttcttgagttctgaatatgttaaagag

SEQ ID NO: 350030 - DNA, 43 bp, Artificial Sequence
  Description of Artificial Sequence: Synthetic oligonucleotide
cagtgacaaaggagagttcttgagttctgaatatgttaaagag

SEQ ID NO: 350031 - DNA, 46 bp, Artificial Sequence
  Description of Artificial Sequence: Synthetic oligonucleotide
agtgacaaaggagagttcttgagttctgaatatgttaaagagtttg

SEQ ID NO: 350032 - DNA, 45 bp, Artificial Sequence
  Description of Artificial Sequence: Synthetic oligonucleotide
gtgacaaaggagagttcttgagttctgaatatgttaaagagtttg

SEQ ID NO: 350033 - DNA, 46 bp, Artificial Sequence
  Description of Artificial Sequence: Synthetic oligonucleotide
tgacaaaggagagttcttgagttctgaatatgttaaagagtttgag

SEQ ID NO: 350034 - DNA, 45 bp, Artificial Sequence
  Description of Artificial Sequence: Synthetic oligonucleotide
gacaaaggagagttcttgagttctgaatatgttaaagagtttgag

SEQ ID NO: 350035 - DNA, 46 bp, Artificial Sequence
  Description of Artificial Sequence: Synthetic oligonucleotide
acaaaggagagttcttgagttctgaatatgttaaagagtttgagtc

SEQ ID NO: 350036 - DNA, 45 bp, Artificial Sequence
  Description of Artificial Sequence: Synthetic oligonucleotide
caaaggagagttcttgagttctgaatatgttaaagagtttgagtc

SEQ ID NO: 350037 - DNA, 54 bp, Artificial Sequence
  Description of Artificial Sequence: Synthetic oligonucleotide
aaaggagagttcttgagttctgaatatgttaaagagtttgagtctattaatatg

SEQ ID NO: 350038 - DNA, 53 bp, Artificial Sequence
  Description of Artificial Sequence: Synthetic oligonucleotide
aaggagagttcttgagttctgaatatgttaaagagtttgagtctattaatatg

SEQ ID NO: 350039 - DNA, 52 bp, Artificial Sequence
  Description of Artificial Sequence: Synthetic oligonucleotide
aggagagttcttgagttctgaatatgttaaagagtttgagtctattaatatg

SEQ ID NO: 350040 - DNA, 51 bp, Artificial Sequence
  Description of Artificial Sequence: Synthetic oligonucleotide
ggagagttcttgagttctgaatatgttaaagagtttgagtctattaatatg

SEQ ID NO: 350041 - DNA, 51 bp, Artificial Sequence
  Description of Artificial Sequence: Synthetic oligonucleotide
gagagttcttgagttctgaatatgttaaagagtttgagtctattaatatgc

SEQ ID NO: 350042 - DNA, 52 bp, Artificial Sequence
  Description of Artificial Sequence: Synthetic oligonucleotide
agagttcttgagttctgaatatgttaaagagtttgagtctattaatatgcac

SEQ ID NO: 350043 - DNA, 51 bp, Artificial Sequence
  Description of Artificial Sequence: Synthetic oligonucleotide
gagttcttgagttctgaatatgttaaagagtttgagtctattaatatgcac

SEQ ID NO: 350044 - DNA, 52 bp, Artificial Sequence
  Description of Artificial Sequence: Synthetic oligonucleotide
agttcttgagttctgaatatgttaaagagtttgagtctattaatatgcacac

SEQ ID NO: 350045 - DNA, 51 bp, Artificial Sequence
  Description of Artificial Sequence: Synthetic oligonucleotide
gttcttgagttctgaatatgttaaagagtttgagtctattaatatgcacac

SEQ ID NO: 350046 - DNA, 55 bp, Artificial Sequence
  Description of Artificial Sequence: Synthetic oligonucleotide
ttcttgagttctgaatatgttaaagagtttgagtctattaatatgcacacaaatg

SEQ ID NO: 350047 - DNA, 54 bp, Artificial Sequence
  Description of Artificial Sequence: Synthetic oligonucleotide
tcttgagttctgaatatgttaaagagtttgagtctattaatatgcacacaaatg

SEQ ID NO: 350048 - DNA, 53 bp, Artificial Sequence
  Description of Artificial Sequence: Synthetic oligonucleotide
cttgagttctgaatatgttaaagagtttgagtctattaatatgcacacaaatg

SEQ ID NO: 350049 - DNA, 54 bp, Artificial Sequence
  Description of Artificial Sequence: Synthetic oligonucleotide
ttgagttctgaatatgttaaagagtttgagtctattaatatgcacacaaatgtc

SEQ ID NO: 350050 - DNA, 53 bp, Artificial Sequence
  Description of Artificial Sequence: Synthetic oligonucleotide
tgagttctgaatatgttaaagagtttgagtctattaatatgcacacaaatgtc

SEQ ID NO: 350051 - DNA, 52 bp, Artificial Sequence
  Description of Artificial Sequence: Synthetic oligonucleotide
gagttctgaatatgttaaagagtttgagtctattaatatgcacacaaatgtc

SEQ ID NO: 350052 - DNA, 54 bp, Artificial Sequence
  Description of Artificial Sequence: Synthetic oligonucleotide
agttctgaatatgttaaagagtttgagtctattaatatgcacacaaatgtcatg

SEQ ID NO: 350053 - DNA, 53 bp, Artificial Sequence
  Description of Artificial Sequence: Synthetic oligonucleotide
gttctgaatatgttaaagagtttgagtctattaatatgcacacaaatgtcatg

SEQ ID NO: 350054 - DNA, 54 bp, Artificial Sequence
  Description of Artificial Sequence: Synthetic oligonucleotide
ttctgaatatgttaaagagtttgagtctattaatatgcacacaaatgtcatgtg

SEQ ID NO: 350055 - DNA, 53 bp, Artificial Sequence
  Description of Artificial Sequence: Synthetic oligonucleotide
tctgaatatgttaaagagtttgagtctattaatatgcacacaaatgtcatgtg

SEQ ID NO: 350056 - DNA, 52 bp, Artificial Sequence
  Description of Artificial Sequence: Synthetic oligonucleotide
ctgaatatgttaaagagtttgagtctattaatatgcacacaaatgtcatgtg

SEQ ID NO: 350057 - DNA, 52 bp, Artificial Sequence
  Description of Artificial Sequence: Synthetic oligonucleotide
tgaatatgttaaagagtttgagtctattaatatgcacacaaatgtcatgtgg

SEQ ID NO: 350058 - DNA, 51 bp, Artificial Sequence
  Description of Artificial Sequence: Synthetic oligonucleotide
gaatatgttaaagagtttgagtctattaatatgcacacaaatgtcatgtgg

SEQ ID NO: 350059 - DNA, 56 bp, Artificial Sequence
  Description of Artificial Sequence: Synthetic oligonucleotide
aatatgttaaagagtttgagtctattaatatgcacacaaatgtcatgtggtttatg

SEQ ID NO: 350060 - DNA, 55 bp, Artificial Sequence
  Description of Artificial Sequence: Synthetic oligonucleotide
atatgttaaagagtttgagtctattaatatgcacacaaatgtcatgtggtttatg

SEQ ID NO: 350061 - DNA, 54 bp, Artificial Sequence
  Description of Artificial Sequence: Synthetic oligonucleotide
tatgttaaagagtttgagtctattaatatgcacacaaatgtcatgtggtttatg

SEQ ID NO: 350062 - DNA, 53 bp, Artificial Sequence
  Description of Artificial Sequence: Synthetic oligonucleotide
atgttaaagagtttgagtctattaatatgcacacaaatgtcatgtggtttatg

SEQ ID NO: 350063 - DNA, 52 bp, Artificial Sequence
  Description of Artificial Sequence: Synthetic oligonucleotide
tgttaaagagtttgagtctattaatatgcacacaaatgtcatgtggtttatg

SEQ ID NO: 350064 - DNA, 51 bp, Artificial Sequence
  Description of Artificial Sequence: Synthetic oligonucleotide
gttaaagagtttgagtctattaatatgcacacaaatgtcatgtggtttatg

SEQ ID NO: 350065 - DNA, 53 bp, Artificial Sequence
  Description of Artificial Sequence: Synthetic oligonucleotide
ttaaagagtttgagtctattaatatgcacacaaatgtcatgtggtttatgatg

SEQ ID NO: 350066 - DNA, 52 bp, Artificial Sequence
  Description of Artificial Sequence: Synthetic oligonucleotide
taaagagtttgagtctattaatatgcacacaaatgtcatgtggtttatgatg

SEQ ID NO: 350067 - DNA, 51 bp, Artificial Sequence
  Description of Artificial Sequence: Synthetic oligonucleotide
aaagagtttgagtctattaatatgcacacaaatgtcatgtggtttatgatg

SEQ ID NO: 350068 - DNA, 50 bp, Artificial Sequence
  Description of Artificial Sequence: Synthetic oligonucleotide
aagagtttgagtctattaatatgcacacaaatgtcatgtggtttatgatg

SEQ ID NO: 350069 - DNA, 49 bp, Artificial Sequence
  Description of Artificial Sequence: Synthetic oligonucleotide
agagtttgagtctattaatatgcacacaaatgtcatgtggtttatgatg

SEQ ID NO: 350070 - DNA, 48 bp, Artificial Sequence
  Description of Artificial Sequence: Synthetic oligonucleotide
gagtttgagtctattaatatgcacacaaatgtcatgtggtttatgatg

SEQ ID NO: 350071 - DNA, 49 bp, Artificial Sequence
  Description of Artificial Sequence: Synthetic oligonucleotide
agtttgagtctattaatatgcacacaaatgtcatgtggtttatgatgag

SEQ ID NO: 350072 - DNA, 48 bp, Artificial Sequence
  Description of Artificial Sequence: Synthetic oligonucleotide
gtttgagtctattaatatgcacacaaatgtcatgtggtttatgatgag

SEQ ID NO: 350073 - DNA, 52 bp, Artificial Sequence
  Description of Artificial Sequence: Synthetic oligonucleotide
tttgagtctattaatatgcacacaaatgtcatgtggtttatgatgagataag

SEQ ID NO: 350074 - DNA, 51 bp, Artificial Sequence
  Description of Artificial Sequence: Synthetic oligonucleotide
ttgagtctattaatatgcacacaaatgtcatgtggtttatgatgagataag

SEQ ID NO: 350075 - DNA, 50 bp, Artificial Sequence
  Description of Artificial Sequence: Synthetic oligonucleotide
tgagtctattaatatgcacacaaatgtcatgtggtttatgatgagataag

SEQ ID NO: 350076 - DNA, 49 bp, Artificial Sequence
  Description of Artificial Sequence: Synthetic oligonucleotide
gagtctattaatatgcacacaaatgtcatgtggtttatgatgagataag

SEQ ID NO: 350077 - DNA, 49 bp, Artificial Sequence
  Description of Artificial Sequence: Synthetic oligonucleotide
agtctattaatatgcacacaaatgtcatgtggtttatgatgagataagc

SEQ ID NO: 350078 - DNA, 48 bp, Artificial Sequence
  Description of Artificial Sequence: Synthetic oligonucleotide
gtctattaatatgcacacaaatgtcatgtggtttatgatgagataagc

SEQ ID NO: 350079 - DNA, 51 bp, Artificial Sequence
  Description of Artificial Sequence: Synthetic oligonucleotide
tctattaatatgcacacaaatgtcatgtggtttatgatgagataagcttac

SEQ ID NO: 350080 - DNA, 50 bp, Artificial Sequence
  Description of Artificial Sequence: Synthetic oligonucleotide
ctattaatatgcacacaaatgtcatgtggtttatgatgagataagcttac

SEQ ID NO: 350081 - DNA, 55 bp, Artificial Sequence
  Description of Artificial Sequence: Synthetic oligonucleotide
tattaatatgcacacaaatgtcatgtggtttatgatgagataagcttacatatac

SEQ ID NO: 350082 - DNA, 54 bp, Artificial Sequence
  Description of Artificial Sequence: Synthetic oligonucleotide
attaatatgcacacaaatgtcatgtggtttatgatgagataagcttacatatac

SEQ ID NO: 350083 - DNA, 53 bp, Artificial Sequence
  Description of Artificial Sequence: Synthetic oligonucleotide
ttaatatgcacacaaatgtcatgtggtttatgatgagataagcttacatatac

SEQ ID NO: 350084 - DNA, 52 bp, Artificial Sequence
  Description of Artificial Sequence: Synthetic oligonucleotide
taatatgcacacaaatgtcatgtggtttatgatgagataagcttacatatac

SEQ ID NO: 350085 - DNA, 51 bp, Artificial Sequence
  Description of Artificial Sequence: Synthetic oligonucleotide
aatatgcacacaaatgtcatgtggtttatgatgagataagcttacatatac

SEQ ID NO: 350086 - DNA, 50 bp, Artificial Sequence
  Description of Artificial Sequence: Synthetic oligonucleotide
atatgcacacaaatgtcatgtggtttatgatgagataagcttacatatac

SEQ ID NO: 350087 - DNA, 49 bp, Artificial Sequence
  Description of Artificial Sequence: Synthetic oligonucleotide
tatgcacacaaatgtcatgtggtttatgatgagataagcttacatatac

SEQ ID NO: 350088 - DNA, 48 bp, Artificial Sequence
  Description of Artificial Sequence: Synthetic oligonucleotide
atgcacacaaatgtcatgtggtttatgatgagataagcttacatatac

SEQ ID NO: 350089 - DNA, 47 bp, Artificial Sequence
  Description of Artificial Sequence: Synthetic oligonucleotide
tgcacacaaatgtcatgtggtttatgatgagataagcttacatatac

SEQ ID NO: 350090 - DNA, 46 bp, Artificial Sequence
  Description of Artificial Sequence: Synthetic oligonucleotide
gcacacaaatgtcatgtggtttatgatgagataagcttacatatac

SEQ ID NO: 350091 - DNA, 46 bp, Artificial Sequence
  Description of Artificial Sequence: Synthetic oligonucleotide
cacacaaatgtcatgtggtttatgatgagataagcttacatatacg

SEQ ID NO: 350092 - DNA, 46 bp, Artificial Sequence
  Description of Artificial Sequence: Synthetic oligonucleotide
acacaaatgtcatgtggtttatgatgagataagcttacatatacgc

SEQ ID NO: 350093 - DNA, 45 bp, Artificial Sequence
  Description of Artificial Sequence: Synthetic oligonucleotide
cacaaatgtcatgtggtttatgatgagataagcttacatatacgc

SEQ ID NO: 350094 - DNA, 45 bp, Artificial Sequence
  Description of Artificial Sequence: Synthetic oligonucleotide
acaaatgtcatgtggtttatgatgagataagcttacatatacgcc

SEQ ID NO: 350095 - DNA, 44 bp, Artificial Sequence
  Description of Artificial Sequence: Synthetic oligonucleotide
caaatgtcatgtggtttatgatgagataagcttacatatacgcc

SEQ ID NO: 350096 - DNA, 47 bp, Artificial Sequence
  Description of Artificial Sequence: Synthetic oligonucleotide
aaatgtcatgtggtttatgatgagataagcttacatatacgccttag

SEQ ID NO: 350097 - DNA, 46 bp, Artificial Sequence
  Description of Artificial Sequence: Synthetic oligonucleotide
aatgtcatgtggtttatgatgagataagcttacatatacgccttag

SEQ ID NO: 350098 - DNA, 45 bp, Artificial Sequence
  Description of Artificial Sequence: Synthetic oligonucleotide
atgtcatgtggtttatgatgagataagcttacatatacgccttag

SEQ ID NO: 350099 - DNA, 44 bp, Artificial Sequence
  Description of Artificial Sequence: Synthetic oligonucleotide
tgtcatgtggtttatgatgagataagcttacatatacgccttag

SEQ ID NO: 350100 - DNA, 43 bp, Artificial Sequence
  Description of Artificial Sequence: Synthetic oligonucleotide
gtcatgtggtttatgatgagataagcttacatatacgccttag

SEQ ID NO: 350101 - DNA, 47 bp, Artificial Sequence
  Description of Artificial Sequence: Synthetic oligonucleotide
tcatgtggtttatgatgagataagcttacatatacgccttagataag

SEQ ID NO: 350102 - DNA, 46 bp, Artificial Sequence
  Description of Artificial Sequence: Synthetic oligonucleotide
catgtggtttatgatgagataagcttacatatacgccttagataag

SEQ ID NO: 350103 - DNA, 50 bp, Artificial Sequence
  Description of Artificial Sequence: Synthetic oligonucleotide
atgtggtttatgatgagataagcttacatatacgccttagataagtattg

SEQ ID NO: 350104 - DNA, 49 bp, Artificial Sequence
  Description of Artificial Sequence: Synthetic oligonucleotide
tgtggtttatgatgagataagcttacatatacgccttagataagtattg

SEQ ID NO: 350105 - DNA, 48 bp, Artificial Sequence
  Description of Artificial Sequence: Synthetic oligonucleotide
gtggtttatgatgagataagcttacatatacgccttagataagtattg

SEQ ID NO: 350106 - DNA, 49 bp, Artificial Sequence
  Description of Artificial Sequence: Synthetic oligonucleotide
tggtttatgatgagataagcttacatatacgccttagataagtattgag

SEQ ID NO: 350107 - DNA, 48 bp, Artificial Sequence
  Description of Artificial Sequence: Synthetic oligonucleotide
ggtttatgatgagataagcttacatatacgccttagataagtattgag

SEQ ID NO: 350108 - DNA, 49 bp, Artificial Sequence
  Description of Artificial Sequence: Synthetic oligonucleotide
gtttatgatgagataagcttacatatacgccttagataagtattgagac

SEQ ID NO: 350109 - DNA, 49 bp, Artificial Sequence
  Description of Artificial Sequence: Synthetic oligonucleotide
tttatgatgagataagcttacatatacgccttagataagtattgagacc

SEQ ID NO: 350110 - DNA, 48 bp, Artificial Sequence
  Description of Artificial Sequence: Synthetic oligonucleotide
ttatgatgagataagcttacatatacgccttagataagtattgagacc

SEQ ID NO: 350111 - DNA, 47 bp, Artificial Sequence
  Description of Artificial Sequence: Synthetic oligonucleotide
tatgatgagataagcttacatatacgccttagataagtattgagacc

SEQ ID NO: 350112 - DNA, 46 bp, Artificial Sequence
  Description of Artificial Sequence: Synthetic oligonucleotide
atgatgagataagcttacatatacgccttagataagtattgagacc

SEQ ID NO: 350113 - DNA, 45 bp, Artificial Sequence
  Description of Artificial Sequence: Synthetic oligonucleotide
tgatgagataagcttacatatacgccttagataagtattgagacc

SEQ ID NO: 350114 - DNA, 44 bp, Artificial Sequence
  Description of Artificial Sequence: Synthetic oligonucleotide
gatgagataagcttacatatacgccttagataagtattgagacc

SEQ ID NO: 350115 - DNA, 48 bp, Artificial Sequence
  Description of Artificial Sequence: Synthetic oligonucleotide
atgagataagcttacatatacgccttagataagtattgagaccaattc

SEQ ID NO: 350116 - DNA, 47 bp, Artificial Sequence
  Description of Artificial Sequence: Synthetic oligonucleotide
tgagataagcttacatatacgccttagataagtattgagaccaattc

SEQ ID NO: 350117 - DNA, 46 bp, Artificial Sequence
  Description of Artificial Sequence: Synthetic oligonucleotide
gagataagcttacatatacgccttagataagtattgagaccaattc

SEQ ID NO: 350118 - DNA, 48 bp, Artificial Sequence
  Description of Artificial Sequence: Synthetic oligonucleotide
agataagcttacatatacgccttagataagtattgagaccaattcaac

SEQ ID NO: 350119 - DNA, 47 bp, Artificial Sequence
  Description of Artificial Sequence: Synthetic oligonucleotide
gataagcttacatatacgccttagataagtattgagaccaattcaac

SEQ ID NO: 350120 - DNA, 48 bp, Artificial Sequence
  Description of Artificial Sequence: Synthetic oligonucleotide
ataagcttacatatacgccttagataagtattgagaccaattcaactg

SEQ ID NO: 350121 - DNA, 47 bp, Artificial Sequence
  Description of Artificial Sequence: Synthetic oligonucleotide
taagcttacatatacgccttagataagtattgagaccaattcaactg

SEQ ID NO: 350122 - DNA, 46 bp, Artificial Sequence
  Description of Artificial Sequence: Synthetic oligonucleotide
aagcttacatatacgccttagataagtattgagaccaattcaactg

SEQ ID NO: 350123 - DNA, 45 bp, Artificial Sequence
  Description of Artificial Sequence: Synthetic oligonucleotide
agcttacatatacgccttagataagtattgagaccaattcaactg

SEQ ID NO: 350124 - DNA, 44 bp, Artificial Sequence
  Description of Artificial Sequence: Synthetic oligonucleotide
gcttacatatacgccttagataagtattgagaccaattcaactg

SEQ ID NO: 350125 - DNA, 44 bp, Artificial Sequence
  Description of Artificial Sequence: Synthetic oligonucleotide
cttacatatacgccttagataagtattgagaccaattcaactgg

SEQ ID NO: 350126 - DNA, 46 bp, Artificial Sequence
  Description of Artificial Sequence: Synthetic oligonucleotide
ttacatatacgccttagataagtattgagaccaattcaactggttg

SEQ ID NO: 350127 - DNA, 45 bp, Artificial Sequence
  Description of Artificial Sequence: Synthetic oligonucleotide
tacatatacgccttagataagtattgagaccaattcaactggttg

SEQ ID NO: 350128 - DNA, 44 bp, Artificial Sequence
  Description of Artificial Sequence: Synthetic oligonucleotide
acatatacgccttagataagtattgagaccaattcaactggttg

SEQ ID NO: 350129 - DNA, 43 bp, Artificial Sequence
  Description of Artificial Sequence: Synthetic oligonucleotide
catatacgccttagataagtattgagaccaattcaactggttg

SEQ ID NO: 350130 - DNA, 45 bp, Artificial Sequence
  Description of Artificial Sequence: Synthetic oligonucleotide
atatacgccttagataagtattgagaccaattcaactggttgttc

SEQ ID NO: 350131 - DNA, 44 bp, Artificial Sequence
  Description of Artificial Sequence: Synthetic oligonucleotide
tatacgccttagataagtattgagaccaattcaactggttgttc

SEQ ID NO: 350132 - DNA, 43 bp, Artificial Sequence
  Description of Artificial Sequence: Synthetic oligonucleotide
atacgccttagataagtattgagaccaattcaactggttgttc

SEQ ID NO: 350133 - DNA, 42 bp, Artificial Sequence
  Description of Artificial Sequence: Synthetic oligonucleotide
tacgccttagataagtattgagaccaattcaactggttgttc

SEQ ID NO: 350134 - DNA, 41 bp, Artificial Sequence
  Description of Artificial Sequence: Synthetic oligonucleotide
acgccttagataagtattgagaccaattcaactggttgttc

SEQ ID NO: 350135 - DNA, 40 bp, Artificial Sequence
  Description of Artificial Sequence: Synthetic oligonucleotide
cgccttagataagtattgagaccaattcaactggttgttc

SEQ ID NO: 350136 - DNA, 40 bp, Artificial Sequence
  Description of Artificial Sequence: Synthetic oligonucleotide
gccttagataagtattgagaccaattcaactggttgttcc

SEQ ID NO: 350137 - DNA, 42 bp, Artificial Sequence
  Description of Artificial Sequence: Synthetic oligonucleotide
ccttagataagtattgagaccaattcaactggttgttccttg

SEQ ID NO: 350138 - DNA, 42 bp, Artificial Sequence
  Description of Artificial Sequence: Synthetic oligonucleotide
cttagataagtattgagaccaattcaactggttgttccttgc

SEQ ID NO: 350139 - DNA, 43 bp, Artificial Sequence
  Description of Artificial Sequence: Synthetic oligonucleotide
ttagataagtattgagaccaattcaactggttgttccttgcag

SEQ ID NO: 350140 - DNA, 42 bp, Artificial Sequence
  Description of Artificial Sequence: Synthetic oligonucleotide
tagataagtattgagaccaattcaactggttgttccttgcag

SEQ ID NO: 350141 - DNA, 41 bp, Artificial Sequence
  Description of Artificial Sequence: Synthetic oligonucleotide
agataagtattgagaccaattcaactggttgttccttgcag

SEQ ID NO: 350142 - DNA, 40 bp, Artificial Sequence
  Description of Artificial Sequence: Synthetic oligonucleotide
gataagtattgagaccaattcaactggttgttccttgcag

SEQ ID NO: 350143 - DNA, 40 bp, Artificial Sequence
  Description of Artificial Sequence: Synthetic oligonucleotide
ataagtattgagaccaattcaactggttgttccttgcagg

SEQ ID NO: 350144 - DNA, 39 bp, Artificial Sequence
  Description of Artificial Sequence: Synthetic oligonucleotide
taagtattgagaccaattcaactggttgttccttgcagg

SEQ ID NO: 350145 - DNA, 38 bp, Artificial Sequence
  Description of Artificial Sequence: Synthetic oligonucleotide
aagtattgagaccaattcaactggttgttccttgcagg

SEQ ID NO: 350146 - DNA, 37 bp, Artificial Sequence
  Description of Artificial Sequence: Synthetic oligonucleotide
agtattgagaccaattcaactggttgttccttgcagg

SEQ ID NO: 350147 - DNA, 36 bp, Artificial Sequence
  Description of Artificial Sequence: Synthetic oligonucleotide
gtattgagaccaattcaactggttgttccttgcagg

SEQ ID NO: 350148 - DNA, 36 bp, Artificial Sequence
  Description of Artificial Sequence: Synthetic oligonucleotide
tattgagaccaattcaactggttgttccttgcaggc

SEQ ID NO: 350149 - DNA, 35 bp, Artificial Sequence
  Description of Artificial Sequence: Synthetic oligonucleotide
attgagaccaattcaactggttgttccttgcaggc

SEQ ID NO: 350150 - DNA, 34 bp, Artificial Sequence
  Description of Artificial Sequence: Synthetic oligonucleotide
ttgagaccaattcaactggttgttccttgcaggc

SEQ ID NO: 350151 - DNA, 33 bp, Artificial Sequence
  Description of Artificial Sequence: Synthetic oligonucleotide
tgagaccaattcaactggttgttccttgcaggc

SEQ ID NO: 350152 - DNA, 32 bp, Artificial Sequence
  Description of Artificial Sequence: Synthetic oligonucleotide
gagaccaattcaactggttgttccttgcaggc

SEQ ID NO: 350153 - DNA, 32 bp, Artificial Sequence
  Description of Artificial Sequence: Synthetic oligonucleotide
agaccaattcaactggttgttccttgcaggcc

SEQ ID NO: 350154 - DNA, 31 bp, Artificial Sequence
  Description of Artificial Sequence: Synthetic oligonucleotide
gaccaattcaactggttgttccttgcaggcc

SEQ ID NO: 350155 - DNA, 31 bp, Artificial Sequence
  Description of Artificial Sequence: Synthetic oligonucleotide
accaattcaactggttgttccttgcaggccc

SEQ ID NO: 350156 - DNA, 30 bp, Artificial Sequence
  Description of Artificial Sequence: Synthetic oligonucleotide
ccaattcaactggttgttccttgcaggccc

SEQ ID NO: 350157 - DNA, 30 bp, Artificial Sequence
  Description of Artificial Sequence: Synthetic oligonucleotide
caattcaactggttgttccttgcaggcccc

SEQ ID NO: 350158 - DNA, 31 bp, Artificial Sequence
  Description of Artificial Sequence: Synthetic oligonucleotide
aattcaactggttgttccttgcaggccccac

SEQ ID NO: 350159 - DNA, 30 bp, Artificial Sequence
  Description of Artificial Sequence: Synthetic oligonucleotide
attcaactggttgttccttgcaggccccac

SEQ ID NO: 350160 - DNA, 29 bp, Artificial Sequence
  Description of Artificial Sequence: Synthetic oligonucleotide
ttcaactggttgttccttgcaggccccac

SEQ ID NO: 350161 - DNA, 28 bp, Artificial Sequence
  Description of Artificial Sequence: Synthetic oligonucleotide
tcaactggttgttccttgcaggccccac

SEQ ID NO: 350162 - DNA, 27 bp, Artificial Sequence
  Description of Artificial Sequence: Synthetic oligonucleotide
caactggttgttccttgcaggccccac

SEQ ID NO: 350163 - DNA, 29 bp, Artificial Sequence
  Description of Artificial Sequence: Synthetic oligonucleotide
aactggttgttccttgcaggccccactag

SEQ ID NO: 350164 - DNA, 28 bp, Artificial Sequence
  Description of Artificial Sequence: Synthetic oligonucleotide
actggttgttccttgcaggccccactag

SEQ ID NO: 350165 - DNA, 27 bp, Artificial Sequence
  Description of Artificial Sequence: Synthetic oligonucleotide
ctggttgttccttgcaggccccactag

SEQ ID NO: 350166 - DNA, 27 bp, Artificial Sequence
  Description of Artificial Sequence: Synthetic oligonucleotide
tggttgttccttgcaggccccactagg

SEQ ID NO: 350167 - DNA, 27 bp, Artificial Sequence
  Description of Artificial Sequence: Synthetic oligonucleotide
ggttgttccttgcaggccccactaggt

SEQ ID NO: 350168 - DNA, 29 bp, Artificial Sequence
  Description of Artificial Sequence: Synthetic oligonucleotide
gttgttccttgcaggccccactaggtttg

SEQ ID NO: 350169 - DNA, 29 bp, Artificial Sequence
  Description of Artificial Sequence: Synthetic oligonucleotide
ttgttccttgcaggccccactaggtttgc

SEQ ID NO: 350170 - DNA, 28 bp, Artificial Sequence
  Description of Artificial Sequence: Synthetic oligonucleotide
tgttccttgcaggccccactaggtttgc

SEQ ID NO: 350171 - DNA, 27 bp, Artificial Sequence
  Description of Artificial Sequence: Synthetic oligonucleotide
gttccttgcaggccccactaggtttgc

SEQ ID NO: 350172 - DNA, 30 bp, Artificial Sequence
  Description of Artificial Sequence: Synthetic oligonucleotide
ttccttgcaggccccactaggtttgctatg

SEQ ID NO: 350173 - DNA, 29 bp, Artificial Sequence
  Description of Artificial Sequence: Synthetic oligonucleotide
tccttgcaggccccactaggtttgctatg

SEQ ID NO: 350174 - DNA, 28 bp, Artificial Sequence
  Description of Artificial Sequence: Synthetic oligonucleotide
ccttgcaggccccactaggtttgctatg

SEQ ID NO: 350175 - DNA, 31 bp, Artificial Sequence
  Description of Artificial Sequence: Synthetic oligonucleotide
cttgcaggccccactaggtttgctatgattg

SEQ ID NO: 350176 - DNA, 35 bp, Artificial Sequence
  Description of Artificial Sequence: Synthetic oligonucleotide
ttgcaggccccactaggtttgctatgattgaaaac

SEQ ID NO: 350177 - DNA, 34 bp, Artificial Sequence
  Description of Artificial Sequence: Synthetic oligonucleotide
tgcaggccccactaggtttgctatgattgaaaac

SEQ ID NO: 350178 - DNA, 33 bp, Artificial Sequence
  Description of Artificial Sequence: Synthetic oligonucleotide
gcaggccccactaggtttgctatgattgaaaac

SEQ ID NO: 350179 - DNA, 33 bp, Artificial Sequence
  Description of Artificial Sequence: Synthetic oligonucleotide
caggccccactaggtttgctatgattgaaaacg

SEQ ID NO: 350180 - DNA, 37 bp, Artificial Sequence
  Description of Artificial Sequence: Synthetic oligonucleotide
aggccccactaggtttgctatgattgaaaacgtaaag

SEQ ID NO: 350181 - DNA, 36 bp, Artificial Sequence
  Description of Artificial Sequence: Synthetic oligonucleotide
ggccccactaggtttgctatgattgaaaacgtaaag

SEQ ID NO: 350182 - DNA, 44 bp, Artificial Sequence
  Description of Artificial Sequence: Synthetic oligonucleotide
gccccactaggtttgctatgattgaaaacgtaaagtattatttg

SEQ ID NO: 350183 - DNA, 52 bp, Artificial Sequence
  Description of Artificial Sequence: Synthetic oligonucleotide
ccccactaggtttgctatgattgaaaacgtaaagtattatttgttaaataag

SEQ ID NO: 350184 - DNA, 52 bp, Artificial Sequence
  Description of Artificial Sequence: Synthetic oligonucleotide
cccactaggtttgctatgattgaaaacgtaaagtattatttgttaaataagg

SEQ ID NO: 350185 - DNA, 54 bp, Artificial Sequence
  Description of Artificial Sequence: Synthetic oligonucleotide
ccactaggtttgctatgattgaaaacgtaaagtattatttgttaaataaggatc

SEQ ID NO: 350186 - DNA, 54 bp, Artificial Sequence
  Description of Artificial Sequence: Synthetic oligonucleotide
cactaggtttgctatgattgaaaacgtaaagtattatttgttaaataaggatcc

SEQ ID NO: 350187 - DNA, 56 bp, Artificial Sequence
  Description of Artificial Sequence: Synthetic oligonucleotide
actaggtttgctatgattgaaaacgtaaagtattatttgttaaataaggatccaac

SEQ ID NO: 350188 - DNA, 55 bp, Artificial Sequence
  Description of Artificial Sequence: Synthetic oligonucleotide
ctaggtttgctatgattgaaaacgtaaagtattatttgttaaataaggatccaac

SEQ ID NO: 350189 - DNA, 56 bp, Artificial Sequence
  Description of Artificial Sequence: Synthetic oligonucleotide
taggtttgctatgattgaaaacgtaaagtattatttgttaaataaggatccaacac

SEQ ID NO: 350190 - DNA, 55 bp, Artificial Sequence
  Description of Artificial Sequence: Synthetic oligonucleotide
aggtttgctatgattgaaaacgtaaagtattatttgttaaataaggatccaacac

SEQ ID NO: 350191 - DNA, 54 bp, Artificial Sequence
  Description of Artificial Sequence: Synthetic oligonucleotide
ggtttgctatgattgaaaacgtaaagtattatttgttaaataaggatccaacac

SEQ ID NO: 350192 - DNA, 55 bp, Artificial Sequence
  Description of Artificial Sequence: Synthetic oligonucleotide
gtttgctatgattgaaaacgtaaagtattatttgttaaataaggatccaacacag

SEQ ID NO: 350193 - DNA, 55 bp, Artificial Sequence
  Description of Artificial Sequence: Synthetic oligonucleotide
tttgctatgattgaaaacgtaaagtattatttgttaaataaggatccaacacagc

SEQ ID NO: 350194 - DNA, 54 bp, Artificial Sequence
  Description of Artificial Sequence: Synthetic oligonucleotide
ttgctatgattgaaaacgtaaagtattatttgttaaataaggatccaacacagc

SEQ ID NO: 350195 - DNA, 53 bp, Artificial Sequence
  Description of Artificial Sequence: Synthetic oligonucleotide
tgctatgattgaaaacgtaaagtattatttgttaaataaggatccaacacagc

SEQ ID NO: 350196 - DNA, 52 bp, Artificial Sequence
  Description of Artificial Sequence: Synthetic oligonucleotide
gctatgattgaaaacgtaaagtattatttgttaaataaggatccaacacagc

SEQ ID NO: 350197 - DNA, 52 bp, Artificial Sequence
  Description of Artificial Sequence: Synthetic oligonucleotide
ctatgattgaaaacgtaaagtattatttgttaaataaggatccaacacagcc

SEQ ID NO: 350198 - DNA, 55 bp, Artificial Sequence
  Description of Artificial Sequence: Synthetic oligonucleotide
tatgattgaaaacgtaaagtattatttgttaaataaggatccaacacagccttac

SEQ ID NO: 350199 - DNA, 54 bp, Artificial Sequence
  Description of Artificial Sequence: Synthetic oligonucleotide
atgattgaaaacgtaaagtattatttgttaaataaggatccaacacagccttac

SEQ ID NO: 350200 - DNA, 53 bp, Artificial Sequence
  Description of Artificial Sequence: Synthetic oligonucleotide
tgattgaaaacgtaaagtattatttgttaaataaggatccaacacagccttac

SEQ ID NO: 350201 - DNA, 52 bp, Artificial Sequence
  Description of Artificial Sequence: Synthetic oligonucleotide
gattgaaaacgtaaagtattatttgttaaataaggatccaacacagccttac

SEQ ID NO: 350202 - DNA, 55 bp, Artificial Sequence
  Description of Artificial Sequence: Synthetic oligonucleotide
attgaaaacgtaaagtattatttgttaaataaggatccaacacagccttactatc

SEQ ID NO: 350203 - DNA, 54 bp, Artificial Sequence
  Description of Artificial Sequence: Synthetic oligonucleotide
ttgaaaacgtaaagtattatttgttaaataaggatccaacacagccttactatc

SEQ ID NO: 350204 - DNA, 53 bp, Artificial Sequence
  Description of Artificial Sequence: Synthetic oligonucleotide
tgaaaacgtaaagtattatttgttaaataaggatccaacacagccttactatc

SEQ ID NO: 350205 - DNA, 52 bp, Artificial Sequence
  Description of Artificial Sequence: Synthetic oligonucleotide
gaaaacgtaaagtattatttgttaaataaggatccaacacagccttactatc

SEQ ID NO: 350206 - DNA, 54 bp, Artificial Sequence
  Description of Artificial Sequence: Synthetic oligonucleotide
aaaacgtaaagtattatttgttaaataaggatccaacacagccttactatctag

SEQ ID NO: 350207 - DNA, 53 bp, Artificial Sequence
  Description of Artificial Sequence: Synthetic oligonucleotide
aaacgtaaagtattatttgttaaataaggatccaacacagccttactatctag

SEQ ID NO: 350208 - DNA, 52 bp, Artificial Sequence
  Description of Artificial Sequence: Synthetic oligonucleotide
aacgtaaagtattatttgttaaataaggatccaacacagccttactatctag

SEQ ID NO: 350209 - DNA, 51 bp, Artificial Sequence
  Description of Artificial Sequence: Synthetic oligonucleotide
acgtaaagtattatttgttaaataaggatccaacacagccttactatctag

SEQ ID NO: 350210 - DNA, 50 bp, Artificial Sequence
  Description of Artificial Sequence: Synthetic oligonucleotide
cgtaaagtattatttgttaaataaggatccaacacagccttactatctag

SEQ ID NO: 350211 - DNA, 50 bp, Artificial Sequence
  Description of Artificial Sequence: Synthetic oligonucleotide
gtaaagtattatttgttaaataaggatccaacacagccttactatctagg

SEQ ID NO: 350212 - DNA, 50 bp, Artificial Sequence
  Description of Artificial Sequence: Synthetic oligonucleotide
taaagtattatttgttaaataaggatccaacacagccttactatctaggg

SEQ ID NO: 350213 - DNA, 49 bp, Artificial Sequence
  Description of Artificial Sequence: Synthetic oligonucleotide
aaagtattatttgttaaataaggatccaacacagccttactatctaggg

SEQ ID NO: 350214 - DNA, 48 bp, Artificial Sequence
  Description of Artificial Sequence: Synthetic oligonucleotide
aagtattatttgttaaataaggatccaacacagccttactatctaggg

SEQ ID NO: 350215 - DNA, 47 bp, Artificial Sequence
  Description of Artificial Sequence: Synthetic oligonucleotide
agtattatttgttaaataaggatccaacacagccttactatctaggg

SEQ ID NO: 350216 - DNA, 46 bp, Artificial Sequence
  Description of Artificial Sequence: Synthetic oligonucleotide
gtattatttgttaaataaggatccaacacagccttactatctaggg

SEQ ID NO: 350217 - DNA, 46 bp, Artificial Sequence
  Description of Artificial Sequence: Synthetic oligonucleotide
tattatttgttaaataaggatccaacacagccttactatctagggc

SEQ ID NO: 350218 - DNA, 45 bp, Artificial Sequence
  Description of Artificial Sequence: Synthetic oligonucleotide
attatttgttaaataaggatccaacacagccttactatctagggc

SEQ ID NO: 350219 - DNA, 44 bp, Artificial Sequence
  Description of Artificial Sequence: Synthetic oligonucleotide
ttatttgttaaataaggatccaacacagccttactatctagggc

SEQ ID NO: 350220 - DNA, 43 bp, Artificial Sequence
  Description of Artificial Sequence: Synthetic oligonucleotide
tatttgttaaataaggatccaacacagccttactatctagggc

SEQ ID NO: 350221 - DNA, 42 bp, Artificial Sequence
  Description of Artificial Sequence: Synthetic oligonucleotide
atttgttaaataaggatccaacacagccttactatctagggc

SEQ ID NO: 350222 - DNA, 41 bp, Artificial Sequence
  Description of Artificial Sequence: Synthetic oligonucleotide
tttgttaaataaggatccaacacagccttactatctagggc

SEQ ID NO: 350223 - DNA, 40 bp, Artificial Sequence
  Description of Artificial Sequence: Synthetic oligonucleotide
ttgttaaataaggatccaacacagccttactatctagggc

SEQ ID NO: 350224 - DNA, 39 bp, Artificial Sequence
  Description of Artificial Sequence: Synthetic oligonucleotide
tgttaaataaggatccaacacagccttactatctagggc

SEQ ID NO: 350225 - DNA, 38 bp, Artificial Sequence
  Description of Artificial Sequence: Synthetic oligonucleotide
gttaaataaggatccaacacagccttactatctagggc

SEQ ID NO: 350226 - DNA, 39 bp, Artificial Sequence
  Description of Artificial Sequence: Synthetic oligonucleotide
ttaaataaggatccaacacagccttactatctagggcac

SEQ ID NO: 350227 - DNA, 38 bp, Artificial Sequence
  Description of Artificial Sequence: Synthetic oligonucleotide
taaataaggatccaacacagccttactatctagggcac

SEQ ID NO: 350228 - DNA, 37 bp, Artificial Sequence
  Description of Artificial Sequence: Synthetic oligonucleotide
aaataaggatccaacacagccttactatctagggcac

SEQ ID NO: 350229 - DNA, 36 bp, Artificial Sequence
  Description of Artificial Sequence: Synthetic oligonucleotide
aataaggatccaacacagccttactatctagggcac

SEQ ID NO: 350230 - DNA, 35 bp, Artificial Sequence
  Description of Artificial Sequence: Synthetic oligonucleotide
ataaggatccaacacagccttactatctagggcac

SEQ ID NO: 350231 - DNA, 34 bp, Artificial Sequence
  Description of Artificial Sequence: Synthetic oligonucleotide
taaggatccaacacagccttactatctagggcac

SEQ ID NO: 350232 - DNA, 33 bp, Artificial Sequence
  Description of Artificial Sequence: Synthetic oligonucleotide
aaggatccaacacagccttactatctagggcac

SEQ ID NO: 350233 - DNA, 32 bp, Artificial Sequence
  Description of Artificial Sequence: Synthetic oligonucleotide
aggatccaacacagccttactatctagggcac

SEQ ID NO: 350234 - DNA, 31 bp, Artificial Sequence
  Description of Artificial Sequence: Synthetic oligonucleotide
ggatccaacacagccttactatctagggcac

SEQ ID NO: 350235 - DNA, 32 bp, Artificial Sequence
  Description of Artificial Sequence: Synthetic oligonucleotide
gatccaacacagccttactatctagggcacac

SEQ ID NO: 350236 - DNA, 40 bp, Artificial Sequence
  Description of Artificial Sequence: Synthetic oligonucleotide
atccaacacagccttactatctagggcacactatataatc

SEQ ID NO: 350237 - DNA, 39 bp, Artificial Sequence
  Description of Artificial Sequence: Synthetic oligonucleotide
tccaacacagccttactatctagggcacactatataatc

SEQ ID NO: 350238 - DNA, 38 bp, Artificial Sequence
  Description of Artificial Sequence: Synthetic oligonucleotide
ccaacacagccttactatctagggcacactatataatc

SEQ ID NO: 350239 - DNA, 39 bp, Artificial Sequence
  Description of Artificial Sequence: Synthetic oligonucleotide
caacacagccttactatctagggcacactatataatctg

SEQ ID NO: 350240 - DNA, 39 bp, Artificial Sequence
  Description of Artificial Sequence: Synthetic oligonucleotide
aacacagccttactatctagggcacactatataatctgg

SEQ ID NO: 350241 - DNA, 38 bp, Artificial Sequence
  Description of Artificial Sequence: Synthetic oligonucleotide
acacagccttactatctagggcacactatataatctgg

SEQ ID NO: 350242 - DNA, 37 bp, Artificial Sequence
  Description of Artificial Sequence: Synthetic oligonucleotide
cacagccttactatctagggcacactatataatctgg

SEQ ID NO: 350243 - DNA, 38 bp, Artificial Sequence
  Description of Artificial Sequence: Synthetic oligonucleotide
acagccttactatctagggcacactatataatctggag

SEQ ID NO: 350244 - DNA, 37 bp, Artificial Sequence
  Description of Artificial Sequence: Synthetic oligonucleotide
cagccttactatctagggcacactatataatctggag

SEQ ID NO: 350245 - DNA, 38 bp, Artificial Sequence
  Description of Artificial Sequence: Synthetic oligonucleotide
agccttactatctagggcacactatataatctggagtc

SEQ ID NO: 350246 - DNA, 37 bp, Artificial Sequence
  Description of Artificial Sequence: Synthetic oligonucleotide
gccttactatctagggcacactatataatctggagtc

SEQ ID NO: 350247 - DNA, 37 bp, Artificial Sequence
  Description of Artificial Sequence: Synthetic oligonucleotide
ccttactatctagggcacactatataatctggagtcc

SEQ ID NO: 350248 - DNA, 39 bp, Artificial Sequence
  Description of Artificial Sequence: Synthetic oligonucleotide
cttactatctagggcacactatataatctggagtccttg

SEQ ID NO: 350249 - DNA, 44 bp, Artificial Sequence
  Description of Artificial Sequence: Synthetic oligonucleotide
ttactatctagggcacactatataatctggagtccttgaataag

SEQ ID NO: 350250 - DNA, 43 bp, Artificial Sequence
  Description of Artificial Sequence: Synthetic oligonucleotide
tactatctagggcacactatataatctggagtccttgaataag

SEQ ID NO: 350251 - DNA, 42 bp, Artificial Sequence
  Description of Artificial Sequence: Synthetic oligonucleotide
actatctagggcacactatataatctggagtccttgaataag

SEQ ID NO: 350252 - DNA, 41 bp, Artificial Sequence
  Description of Artificial Sequence: Synthetic oligonucleotide
ctatctagggcacactatataatctggagtccttgaataag

SEQ ID NO: 350253 - DNA, 42 bp, Artificial Sequence
  Description of Artificial Sequence: Synthetic oligonucleotide
tatctagggcacactatataatctggagtccttgaataagtg

SEQ ID NO: 350254 - DNA, 41 bp, Artificial Sequence
  Description of Artificial Sequence: Synthetic oligonucleotide
atctagggcacactatataatctggagtccttgaataagtg

SEQ ID NO: 350255 - DNA, 40 bp, Artificial Sequence
  Description of Artificial Sequence: Synthetic oligonucleotide
tctagggcacactatataatctggagtccttgaataagtg

SEQ ID NO: 350256 - DNA, 39 bp, Artificial Sequence
  Description of Artificial Sequence: Synthetic oligonucleotide
ctagggcacactatataatctggagtccttgaataagtg

SEQ ID NO: 350257 - DNA, 39 bp, Artificial Sequence
  Description of Artificial Sequence: Synthetic oligonucleotide
tagggcacactatataatctggagtccttgaataagtgg

SEQ ID NO: 350258 - DNA, 38 bp, Artificial Sequence
  Description of Artificial Sequence: Synthetic oligonucleotide
agggcacactatataatctggagtccttgaataagtgg

SEQ ID NO: 350259 - DNA, 37 bp, Artificial Sequence
  Description of Artificial Sequence: Synthetic oligonucleotide
gggcacactatataatctggagtccttgaataagtgg

SEQ ID NO: 350260 - DNA, 37 bp, Artificial Sequence
  Description of Artificial Sequence: Synthetic oligonucleotide
ggcacactatataatctggagtccttgaataagtggg

SEQ ID NO: 350261 - DNA, 40 bp, Artificial Sequence
  Description of Artificial Sequence: Synthetic oligonucleotide
gcacactatataatctggagtccttgaataagtgggtatg

SEQ ID NO: 350262 - DNA, 40 bp, Artificial Sequence
  Description of Artificial Sequence: Synthetic oligonucleotide
cacactatataatctggagtccttgaataagtgggtatgc

SEQ ID NO: 350263 - DNA, 42 bp, Artificial Sequence
  Description of Artificial Sequence: Synthetic oligonucleotide
acactatataatctggagtccttgaataagtgggtatgcaag

SEQ ID NO: 350264 - DNA, 41 bp, Artificial Sequence
  Description of Artificial Sequence: Synthetic oligonucleotide
cactatataatctggagtccttgaataagtgggtatgcaag

SEQ ID NO: 350265 - DNA, 41 bp, Artificial Sequence
  Description of Artificial Sequence: Synthetic oligonucleotide
actatataatctggagtccttgaataagtgggtatgcaagg

SEQ ID NO: 350266 - DNA, 40 bp, Artificial Sequence
  Description of Artificial Sequence: Synthetic oligonucleotide
ctatataatctggagtccttgaataagtgggtatgcaagg

SEQ ID NO: 350267 - DNA, 41 bp, Artificial Sequence
  Description of Artificial Sequence: Synthetic oligonucleotide
tatataatctggagtccttgaataagtgggtatgcaaggag

SEQ ID NO: 350268 - DNA, 40 bp, Artificial Sequence
  Description of Artificial Sequence: Synthetic oligonucleotide
atataatctggagtccttgaataagtgggtatgcaaggag

SEQ ID NO: 350269 - DNA, 39 bp, Artificial Sequence
  Description of Artificial Sequence: Synthetic oligonucleotide
tataatctggagtccttgaataagtgggtatgcaaggag

SEQ ID NO: 350270 - DNA, 38 bp, Artificial Sequence
  Description of Artificial Sequence: Synthetic oligonucleotide
ataatctggagtccttgaataagtgggtatgcaaggag

SEQ ID NO: 350271 - DNA, 37 bp, Artificial Sequence
  Description of Artificial Sequence: Synthetic oligonucleotide
taatctggagtccttgaataagtgggtatgcaaggag

SEQ ID NO: 350272 - DNA, 36 bp, Artificial Sequence
  Description of Artificial Sequence: Synthetic oligonucleotide
aatctggagtccttgaataagtgggtatgcaaggag

SEQ ID NO: 350273 - DNA, 35 bp, Artificial Sequence
  Description of Artificial Sequence: Synthetic oligonucleotide
atctggagtccttgaataagtgggtatgcaaggag

SEQ ID NO: 350274 - DNA, 34 bp, Artificial Sequence
  Description of Artificial Sequence: Synthetic oligonucleotide
tctggagtccttgaataagtgggtatgcaaggag

SEQ ID NO: 350275 - DNA, 33 bp, Artificial Sequence
  Description of Artificial Sequence: Synthetic oligonucleotide
ctggagtccttgaataagtgggtatgcaaggag

SEQ ID NO: 350276 - DNA, 33 bp, Artificial Sequence
  Description of Artificial Sequence: Synthetic oligonucleotide
tggagtccttgaataagtgggtatgcaaggagg

SEQ ID NO: 350277 - DNA, 32 bp, Artificial Sequence
  Description of Artificial Sequence: Synthetic oligonucleotide
ggagtccttgaataagtgggtatgcaaggagg

SEQ ID NO: 350278 - DNA, 36 bp, Artificial Sequence
  Description of Artificial Sequence: Synthetic oligonucleotide
gagtccttgaataagtgggtatgcaaggaggaaatg

SEQ ID NO: 350279 - DNA, 37 bp, Artificial Sequence
  Description of Artificial Sequence: Synthetic oligonucleotide
agtccttgaataagtgggtatgcaaggaggaaatgtc

SEQ ID NO: 350280 - DNA, 36 bp, Artificial Sequence
  Description of Artificial Sequence: Synthetic oligonucleotide
gtccttgaataagtgggtatgcaaggaggaaatgtc

SEQ ID NO: 350281 - DNA, 40 bp, Artificial Sequence
  Description of Artificial Sequence: Synthetic oligonucleotide
tccttgaataagtgggtatgcaaggaggaaatgtcttaag

SEQ ID NO: 350282 - DNA, 39 bp, Artificial Sequence
  Description of Artificial Sequence: Synthetic oligonucleotide
ccttgaataagtgggtatgcaaggaggaaatgtcttaag

SEQ ID NO: 350283 - DNA, 40 bp, Artificial Sequence
  Description of Artificial Sequence: Synthetic oligonucleotide
cttgaataagtgggtatgcaaggaggaaatgtcttaagag

SEQ ID NO: 350284 - DNA, 42 bp, Artificial Sequence
  Description of Artificial Sequence: Synthetic oligonucleotide
ttgaataagtgggtatgcaaggaggaaatgtcttaagagtag

SEQ ID NO: 350285 - DNA, 41 bp, Artificial Sequence
  Description of Artificial Sequence: Synthetic oligonucleotide
tgaataagtgggtatgcaaggaggaaatgtcttaagagtag

SEQ ID NO: 350286 - DNA, 40 bp, Artificial Sequence
  Description of Artificial Sequence: Synthetic oligonucleotide
gaataagtgggtatgcaaggaggaaatgtcttaagagtag

SEQ ID NO: 350287 - DNA, 43 bp, Artificial Sequence
  Description of Artificial Sequence: Synthetic oligonucleotide
aataagtgggtatgcaaggaggaaatgtcttaagagtagaatc

SEQ ID NO: 350288 - DNA, 42 bp, Artificial Sequence
  Description of Artificial Sequence: Synthetic oligonucleotide
ataagtgggtatgcaaggaggaaatgtcttaagagtagaatc

SEQ ID NO: 350289 - DNA, 41 bp, Artificial Sequence
  Description of Artificial Sequence: Synthetic oligonucleotide
taagtgggtatgcaaggaggaaatgtcttaagagtagaatc

SEQ ID NO: 350290 - DNA, 40 bp, Artificial Sequence
  Description of Artificial Sequence: Synthetic oligonucleotide
aagtgggtatgcaaggaggaaatgtcttaagagtagaatc

SEQ ID NO: 350291 - DNA, 39 bp, Artificial Sequence
  Description of Artificial Sequence: Synthetic oligonucleotide
agtgggtatgcaaggaggaaatgtcttaagagtagaatc

SEQ ID NO: 350292 - DNA, 38 bp, Artificial Sequence
  Description of Artificial Sequence: Synthetic oligonucleotide
gtgggtatgcaaggaggaaatgtcttaagagtagaatc

SEQ ID NO: 350293 - DNA, 41 bp, Artificial Sequence
  Description of Artificial Sequence: Synthetic oligonucleotide
tgggtatgcaaggaggaaatgtcttaagagtagaatcattg

SEQ ID NO: 350294 - DNA, 40 bp, Artificial Sequence
  Description of Artificial Sequence: Synthetic oligonucleotide
gggtatgcaaggaggaaatgtcttaagagtagaatcattg

SEQ ID NO: 350295 - DNA, 44 bp, Artificial Sequence
  Description of Artificial Sequence: Synthetic oligonucleotide
ggtatgcaaggaggaaatgtcttaagagtagaatcattgaaaag

SEQ ID NO: 350296 - DNA, 45 bp, Artificial Sequence
  Description of Artificial Sequence: Synthetic oligonucleotide
gtatgcaaggaggaaatgtcttaagagtagaatcattgaaaagac

SEQ ID NO: 350297 - DNA, 49 bp, Artificial Sequence
  Description of Artificial Sequence: Synthetic oligonucleotide
tatgcaaggaggaaatgtcttaagagtagaatcattgaaaagacataac

SEQ ID NO: 350298 - DNA, 48 bp, Artificial Sequence
  Description of Artificial Sequence: Synthetic oligonucleotide
atgcaaggaggaaatgtcttaagagtagaatcattgaaaagacataac

SEQ ID NO: 350299 - DNA, 47 bp, Artificial Sequence
  Description of Artificial Sequence: Synthetic oligonucleotide
tgcaaggaggaaatgtcttaagagtagaatcattgaaaagacataac

SEQ ID NO: 350300 - DNA, 46 bp, Artificial Sequence
  Description of Artificial Sequence: Synthetic oligonucleotide
gcaaggaggaaatgtcttaagagtagaatcattgaaaagacataac

SEQ ID NO: 350301 - DNA, 47 bp, Artificial Sequence
  Description of Artificial Sequence: Synthetic oligonucleotide
caaggaggaaatgtcttaagagtagaatcattgaaaagacataacag

SEQ ID NO: 350302 - DNA, 47 bp, Artificial Sequence
  Description of Artificial Sequence: Synthetic oligonucleotide
aaggaggaaatgtcttaagagtagaatcattgaaaagacataacagc

SEQ ID NO: 350303 - DNA, 46 bp, Artificial Sequence
  Description of Artificial Sequence: Synthetic oligonucleotide
aggaggaaatgtcttaagagtagaatcattgaaaagacataacagc

SEQ ID NO: 350304 - DNA, 45 bp, Artificial Sequence
  Description of Artificial Sequence: Synthetic oligonucleotide
ggaggaaatgtcttaagagtagaatcattgaaaagacataacagc

SEQ ID NO: 350305 - DNA, 45 bp, Artificial Sequence
  Description of Artificial Sequence: Synthetic oligonucleotide
gaggaaatgtcttaagagtagaatcattgaaaagacataacagcc

SEQ ID NO: 350306 - DNA, 47 bp, Artificial Sequence
  Description of Artificial Sequence: Synthetic oligonucleotide
aggaaatgtcttaagagtagaatcattgaaaagacataacagcctac

SEQ ID NO: 350307 - DNA, 46 bp, Artificial Sequence
  Description of Artificial Sequence: Synthetic oligonucleotide
ggaaatgtcttaagagtagaatcattgaaaagacataacagcctac

SEQ ID NO: 350308 - DNA, 47 bp, Artificial Sequence
  Description of Artificial Sequence: Synthetic oligonucleotide
gaaatgtcttaagagtagaatcattgaaaagacataacagcctactc

SEQ ID NO: 350309 - DNA, 52 bp, Artificial Sequence
  Description of Artificial Sequence: Synthetic oligonucleotide
aaatgtcttaagagtagaatcattgaaaagacataacagcctactcaatatc

SEQ ID NO: 350310 - DNA, 51 bp, Artificial Sequence
  Description of Artificial Sequence: Synthetic oligonucleotide
aatgtcttaagagtagaatcattgaaaagacataacagcctactcaatatc

SEQ ID NO: 350311 - DNA, 50 bp, Artificial Sequence
  Description of Artificial Sequence: Synthetic oligonucleotide
atgtcttaagagtagaatcattgaaaagacataacagcctactcaatatc

SEQ ID NO: 350312 - DNA, 49 bp, Artificial Sequence
  Description of Artificial Sequence: Synthetic oligonucleotide
tgtcttaagagtagaatcattgaaaagacataacagcctactcaatatc

SEQ ID NO: 350313 - DNA, 48 bp, Artificial Sequence
  Description of Artificial Sequence: Synthetic oligonucleotide
gtcttaagagtagaatcattgaaaagacataacagcctactcaatatc

SEQ ID NO: 350314 - DNA, 48 bp, Artificial Sequence
  Description of Artificial Sequence: Synthetic oligonucleotide
tcttaagagtagaatcattgaaaagacataacagcctactcaatatcg

SEQ ID NO: 350315 - DNA, 47 bp, Artificial Sequence
  Description of Artificial Sequence: Synthetic oligonucleotide
cttaagagtagaatcattgaaaagacataacagcctactcaatatcg

SEQ ID NO: 350316 - DNA, 47 bp, Artificial Sequence
  Description of Artificial Sequence: Synthetic oligonucleotide
ttaagagtagaatcattgaaaagacataacagcctactcaatatcgc

SEQ ID NO: 350317 - DNA, 46 bp, Artificial Sequence
  Description of Artificial Sequence: Synthetic oligonucleotide
taagagtagaatcattgaaaagacataacagcctactcaatatcgc

SEQ ID NO: 350318 - DNA, 45 bp, Artificial Sequence
  Description of Artificial Sequence: Synthetic oligonucleotide
aagagtagaatcattgaaaagacataacagcctactcaatatcgc

SEQ ID NO: 350319 - DNA, 44 bp, Artificial Sequence
  Description of Artificial Sequence: Synthetic oligonucleotide
agagtagaatcattgaaaagacataacagcctactcaatatcgc

SEQ ID NO: 350320 - DNA, 43 bp, Artificial Sequence
  Description of Artificial Sequence: Synthetic oligonucleotide
gagtagaatcattgaaaagacataacagcctactcaatatcgc

SEQ ID NO: 350321 - DNA, 44 bp, Artificial Sequence
  Description of Artificial Sequence: Synthetic oligonucleotide
agtagaatcattgaaaagacataacagcctactcaatatcgcag

SEQ ID NO: 350322 - DNA, 43 bp, Artificial Sequence
  Description of Artificial Sequence: Synthetic oligonucleotide
gtagaatcattgaaaagacataacagcctactcaatatcgcag

SEQ ID NO: 350323 - DNA, 47 bp, Artificial Sequence
  Description of Artificial Sequence: Synthetic oligonucleotide
tagaatcattgaaaagacataacagcctactcaatatcgcagaaaag

SEQ ID NO: 350324 - DNA, 46 bp, Artificial Sequence
  Description of Artificial Sequence: Synthetic oligonucleotide
agaatcattgaaaagacataacagcctactcaatatcgcagaaaag

SEQ ID NO: 350325 - DNA, 45 bp, Artificial Sequence
  Description of Artificial Sequence: Synthetic oligonucleotide
gaatcattgaaaagacataacagcctactcaatatcgcagaaaag

SEQ ID NO: 350326 - DNA, 46 bp, Artificial Sequence
  Description of Artificial Sequence: Synthetic oligonucleotide
aatcattgaaaagacataacagcctactcaatatcgcagaaaagtc

SEQ ID NO: 350327 - DNA, 45 bp, Artificial Sequence
  Description of Artificial Sequence: Synthetic oligonucleotide
atcattgaaaagacataacagcctactcaatatcgcagaaaagtc

SEQ ID NO: 350328 - DNA, 44 bp, Artificial Sequence
  Description of Artificial Sequence: Synthetic oligonucleotide
tcattgaaaagacataacagcctactcaatatcgcagaaaagtc

SEQ ID NO: 350329 - DNA, 43 bp, Artificial Sequence
  Description of Artificial Sequence: Synthetic oligonucleotide
cattgaaaagacataacagcctactcaatatcgcagaaaagtc

SEQ ID NO: 350330 - DNA, 44 bp, Artificial Sequence
  Description of Artificial Sequence: Synthetic oligonucleotide
attgaaaagacataacagcctactcaatatcgcagaaaagtctc

SEQ ID NO: 350331 - DNA, 43 bp, Artificial Sequence
  Description of Artificial Sequence: Synthetic oligonucleotide
ttgaaaagacataacagcctactcaatatcgcagaaaagtctc

SEQ ID NO: 350332 - DNA, 42 bp, Artificial Sequence
  Description of Artificial Sequence: Synthetic oligonucleotide
tgaaaagacataacagcctactcaatatcgcagaaaagtctc

SEQ ID NO: 350333 - DNA, 41 bp, Artificial Sequence
  Description of Artificial Sequence: Synthetic oligonucleotide
gaaaagacataacagcctactcaatatcgcagaaaagtctc

SEQ ID NO: 350334 - DNA, 41 bp, Artificial Sequence
  Description of Artificial Sequence: Synthetic oligonucleotide
aaaagacataacagcctactcaatatcgcagaaaagtctcc

SEQ ID NO: 350335 - DNA, 40 bp, Artificial Sequence
  Description of Artificial Sequence: Synthetic oligonucleotide
aaagacataacagcctactcaatatcgcagaaaagtctcc

SEQ ID NO: 350336 - DNA, 39 bp, Artificial Sequence
  Description of Artificial Sequence: Synthetic oligonucleotide
aagacataacagcctactcaatatcgcagaaaagtctcc

SEQ ID NO: 350337 - DNA, 38 bp, Artificial Sequence
  Description of Artificial Sequence: Synthetic oligonucleotide
agacataacagcctactcaatatcgcagaaaagtctcc

SEQ ID NO: 350338 - DNA, 37 bp, Artificial Sequence
  Description of Artificial Sequence: Synthetic oligonucleotide
gacataacagcctactcaatatcgcagaaaagtctcc

SEQ ID NO: 350339 - DNA, 38 bp, Artificial Sequence
  Description of Artificial Sequence: Synthetic oligonucleotide
acataacagcctactcaatatcgcagaaaagtctcctg

SEQ ID NO: 350340 - DNA, 37 bp, Artificial Sequence
  Description of Artificial Sequence: Synthetic oligonucleotide
cataacagcctactcaatatcgcagaaaagtctcctg

SEQ ID NO: 350341 - DNA, 39 bp, Artificial Sequence
  Description of Artificial Sequence: Synthetic oligonucleotide
ataacagcctactcaatatcgcagaaaagtctcctgaac

SEQ ID NO: 350342 - DNA, 38 bp, Artificial Sequence
  Description of Artificial Sequence: Synthetic oligonucleotide
taacagcctactcaatatcgcagaaaagtctcctgaac

SEQ ID NO: 350343 - DNA, 37 bp, Artificial Sequence
  Description of Artificial Sequence: Synthetic oligonucleotide
aacagcctactcaatatcgcagaaaagtctcctgaac

SEQ ID NO: 350344 - DNA, 36 bp, Artificial Sequence
  Description of Artificial Sequence: Synthetic oligonucleotide
acagcctactcaatatcgcagaaaagtctcctgaac

SEQ ID NO: 350345 - DNA, 35 bp, Artificial Sequence
  Description of Artificial Sequence: Synthetic oligonucleotide
cagcctactcaatatcgcagaaaagtctcctgaac

SEQ ID NO: 350346 - DNA, 36 bp, Artificial Sequence
  Description of Artificial Sequence: Synthetic oligonucleotide
agcctactcaatatcgcagaaaagtctcctgaacac

SEQ ID NO: 350347 - DNA, 35 bp, Artificial Sequence
  Description of Artificial Sequence: Synthetic oligonucleotide
gcctactcaatatcgcagaaaagtctcctgaacac

SEQ ID NO: 350348 - DNA, 35 bp, Artificial Sequence
  Description of Artificial Sequence: Synthetic oligonucleotide
cctactcaatatcgcagaaaagtctcctgaacacg

SEQ ID NO: 350349 - DNA, 35 bp, Artificial Sequence
  Description of Artificial Sequence: Synthetic oligonucleotide
ctactcaatatcgcagaaaagtctcctgaacacgg

SEQ ID NO: 350350 - DNA, 36 bp, Artificial Sequence
  Description of Artificial Sequence: Synthetic oligonucleotide
tactcaatatcgcagaaaagtctcctgaacacggag

SEQ ID NO: 350351 - DNA, 35 bp, Artificial Sequence
  Description of Artificial Sequence: Synthetic oligonucleotide
actcaatatcgcagaaaagtctcctgaacacggag

SEQ ID NO: 350352 - DNA, 34 bp, Artificial Sequence
  Description of Artificial Sequence: Synthetic oligonucleotide
ctcaatatcgcagaaaagtctcctgaacacggag

SEQ ID NO: 350353 - DNA, 34 bp, Artificial Sequence
  Description of Artificial Sequence: Synthetic oligonucleotide
tcaatatcgcagaaaagtctcctgaacacggagg

SEQ ID NO: 350354 - DNA, 33 bp, Artificial Sequence
  Description of Artificial Sequence: Synthetic oligonucleotide
caatatcgcagaaaagtctcctgaacacggagg

SEQ ID NO: 350355 - DNA, 33 bp, Artificial Sequence
  Description of Artificial Sequence: Synthetic oligonucleotide
aatatcgcagaaaagtctcctgaacacggaggg

SEQ ID NO: 350356 - DNA, 32 bp, Artificial Sequence
  Description of Artificial Sequence: Synthetic oligonucleotide
atatcgcagaaaagtctcctgaacacggaggg

SEQ ID NO: 350357 - DNA, 31 bp, Artificial Sequence
  Description of Artificial Sequence: Synthetic oligonucleotide
tatcgcagaaaagtctcctgaacacggaggg

SEQ ID NO: 350358 - DNA, 30 bp, Artificial Sequence
  Description of Artificial Sequence: Synthetic oligonucleotide
atcgcagaaaagtctcctgaacacggaggg

SEQ ID NO: 350359 - DNA, 29 bp, Artificial Sequence
  Description of Artificial Sequence: Synthetic oligonucleotide
tcgcagaaaagtctcctgaacacggaggg

SEQ ID NO: 350360 - DNA, 28 bp, Artificial Sequence
  Description of Artificial Sequence: Synthetic oligonucleotide
cgcagaaaagtctcctgaacacggaggg

SEQ ID NO: 350361 - DNA, 30 bp, Artificial Sequence
  Description of Artificial Sequence: Synthetic oligonucleotide
gcagaaaagtctcctgaacacggagggatg

SEQ ID NO: 350362 - DNA, 34 bp, Artificial Sequence
  Description of Artificial Sequence: Synthetic oligonucleotide
cagaaaagtctcctgaacacggagggatgttttg

SEQ ID NO: 350363 - DNA, 34 bp, Artificial Sequence
  Description of Artificial Sequence: Synthetic oligonucleotide
agaaaagtctcctgaacacggagggatgttttgg

SEQ ID NO: 350364 - DNA, 33 bp, Artificial Sequence
  Description of Artificial Sequence: Synthetic oligonucleotide
gaaaagtctcctgaacacggagggatgttttgg

SEQ ID NO: 350365 - DNA, 35 bp, Artificial Sequence
  Description of Artificial Sequence: Synthetic oligonucleotide
aaaagtctcctgaacacggagggatgttttggaag

SEQ ID NO: 350366 - DNA, 34 bp, Artificial Sequence
  Description of Artificial Sequence: Synthetic oligonucleotide
aaagtctcctgaacacggagggatgttttggaag

SEQ ID NO: 350367 - DNA, 33 bp, Artificial Sequence
  Description of Artificial Sequence: Synthetic oligonucleotide
aagtctcctgaacacggagggatgttttggaag

SEQ ID NO: 350368 - DNA, 32 bp, Artificial Sequence
  Description of Artificial Sequence: Synthetic oligonucleotide
agtctcctgaacacggagggatgttttggaag

SEQ ID NO: 350369 - DNA, 31 bp, Artificial Sequence
  Description of Artificial Sequence: Synthetic oligonucleotide
gtctcctgaacacggagggatgttttggaag

SEQ ID NO: 350370 - DNA, 35 bp, Artificial Sequence
  Description of Artificial Sequence: Synthetic oligonucleotide
tctcctgaacacggagggatgttttggaagaaatc

SEQ ID NO: 350371 - DNA, 34 bp, Artificial Sequence
  Description of Artificial Sequence: Synthetic oligonucleotide
ctcctgaacacggagggatgttttggaagaaatc

SEQ ID NO: 350372 - DNA, 35 bp, Artificial Sequence
  Description of Artificial Sequence: Synthetic oligonucleotide
tcctgaacacggagggatgttttggaagaaatctg

SEQ ID NO: 350373 - DNA, 34 bp, Artificial Sequence
  Description of Artificial Sequence: Synthetic oligonucleotide
cctgaacacggagggatgttttggaagaaatctg

SEQ ID NO: 350374 - DNA, 36 bp, Artificial Sequence
  Description of Artificial Sequence: Synthetic oligonucleotide
ctgaacacggagggatgttttggaagaaatctgaag

SEQ ID NO: 350375 - DNA, 41 bp, Artificial Sequence
  Description of Artificial Sequence: Synthetic oligonucleotide
tgaacacggagggatgttttggaagaaatctgaagaaaaac

SEQ ID NO: 350376 - DNA, 40 bp, Artificial Sequence
  Description of Artificial Sequence: Synthetic oligonucleotide
gaacacggagggatgttttggaagaaatctgaagaaaaac

SEQ ID NO: 350377 - DNA, 41 bp, Artificial Sequence
  Description of Artificial Sequence: Synthetic oligonucleotide
aacacggagggatgttttggaagaaatctgaagaaaaacag

SEQ ID NO: 350378 - DNA, 40 bp, Artificial Sequence
  Description of Artificial Sequence: Synthetic oligonucleotide
acacggagggatgttttggaagaaatctgaagaaaaacag

SEQ ID NO: 350379 - DNA, 39 bp, Artificial Sequence
  Description of Artificial Sequence: Synthetic oligonucleotide
cacggagggatgttttggaagaaatctgaagaaaaacag

SEQ ID NO: 350380 - DNA, 39 bp, Artificial Sequence
  Description of Artificial Sequence: Synthetic oligonucleotide
acggagggatgttttggaagaaatctgaagaaaaacagc

SEQ ID NO: 350381 - DNA, 38 bp, Artificial Sequence
  Description of Artificial Sequence: Synthetic oligonucleotide
cggagggatgttttggaagaaatctgaagaaaaacagc

SEQ ID NO: 350382 - DNA, 40 bp, Artificial Sequence
  Description of Artificial Sequence: Synthetic oligonucleotide
ggagggatgttttggaagaaatctgaagaaaaacagctac

SEQ ID NO: 350383 - DNA, 40 bp, Artificial Sequence
  Description of Artificial Sequence: Synthetic oligonucleotide
gagggatgttttggaagaaatctgaagaaaaacagctacc

SEQ ID NO: 350384 - DNA, 41 bp, Artificial Sequence
  Description of Artificial Sequence: Synthetic oligonucleotide
agggatgttttggaagaaatctgaagaaaaacagctaccag

SEQ ID NO: 350385 - DNA, 40 bp, Artificial Sequence
  Description of Artificial Sequence: Synthetic oligonucleotide
gggatgttttggaagaaatctgaagaaaaacagctaccag

SEQ ID NO: 350386 - DNA, 43 bp, Artificial Sequence
  Description of Artificial Sequence: Synthetic oligonucleotide
ggatgttttggaagaaatctgaagaaaaacagctaccagtttg

SEQ ID NO: 350387 - DNA, 43 bp, Artificial Sequence
  Description of Artificial Sequence: Synthetic oligonucleotide
gatgttttggaagaaatctgaagaaaaacagctaccagtttgc

SEQ ID NO: 350388 - DNA, 43 bp, Artificial Sequence
  Description of Artificial Sequence: Synthetic oligonucleotide
atgttttggaagaaatctgaagaaaaacagctaccagtttgcc

SEQ ID NO: 350389 - DNA, 42 bp, Artificial Sequence
  Description of Artificial Sequence: Synthetic oligonucleotide
tgttttggaagaaatctgaagaaaaacagctaccagtttgcc

SEQ ID NO: 350390 - DNA, 41 bp, Artificial Sequence
  Description of Artificial Sequence: Synthetic oligonucleotide
gttttggaagaaatctgaagaaaaacagctaccagtttgcc

SEQ ID NO: 350391 - DNA, 42 bp, Artificial Sequence
  Description of Artificial Sequence: Synthetic oligonucleotide
ttttggaagaaatctgaagaaaaacagctaccagtttgccag

SEQ ID NO: 350392 - DNA, 41 bp, Artificial Sequence
  Description of Artificial Sequence: Synthetic oligonucleotide
tttggaagaaatctgaagaaaaacagctaccagtttgccag

SEQ ID NO: 350393 - DNA, 40 bp, Artificial Sequence
  Description of Artificial Sequence: Synthetic oligonucleotide
ttggaagaaatctgaagaaaaacagctaccagtttgccag

SEQ ID NO: 350394 - DNA, 39 bp, Artificial Sequence
  Description of Artificial Sequence: Synthetic oligonucleotide
tggaagaaatctgaagaaaaacagctaccagtttgccag

SEQ ID NO: 350395 - DNA, 38 bp, Artificial Sequence
  Description of Artificial Sequence: Synthetic oligonucleotide
ggaagaaatctgaagaaaaacagctaccagtttgccag

SEQ ID NO: 350396 - DNA, 44 bp, Artificial Sequence
  Description of Artificial Sequence: Synthetic oligonucleotide
gaagaaatctgaagaaaaacagctaccagtttgccagaaatatg

SEQ ID NO: 350397 - DNA, 44 bp, Artificial Sequence
  Description of Artificial Sequence: Synthetic oligonucleotide
aagaaatctgaagaaaaacagctaccagtttgccagaaatatgc

SEQ ID NO: 350398 - DNA, 43 bp, Artificial Sequence
  Description of Artificial Sequence: Synthetic oligonucleotide
agaaatctgaagaaaaacagctaccagtttgccagaaatatgc

SEQ ID NO: 350399 - DNA, 42 bp, Artificial Sequence
  Description of Artificial Sequence: Synthetic oligonucleotide
gaaatctgaagaaaaacagctaccagtttgccagaaatatgc

SEQ ID NO: 350400 - DNA, 43 bp, Artificial Sequence
  Description of Artificial Sequence: Synthetic oligonucleotide
aaatctgaagaaaaacagctaccagtttgccagaaatatgcag

SEQ ID NO: 350401 - DNA, 42 bp, Artificial Sequence
  Description of Artificial Sequence: Synthetic oligonucleotide
aatctgaagaaaaacagctaccagtttgccagaaatatgcag

SEQ ID NO: 350402 - DNA, 41 bp, Artificial Sequence
  Description of Artificial Sequence: Synthetic oligonucleotide
atctgaagaaaaacagctaccagtttgccagaaatatgcag

SEQ ID NO: 350403 - DNA, 40 bp, Artificial Sequence
  Description of Artificial Sequence: Synthetic oligonucleotide
tctgaagaaaaacagctaccagtttgccagaaatatgcag

SEQ ID NO: 350404 - DNA, 39 bp, Artificial Sequence
  Description of Artificial Sequence: Synthetic oligonucleotide
ctgaagaaaaacagctaccagtttgccagaaatatgcag

SEQ ID NO: 350405 - DNA, 39 bp, Artificial Sequence
  Description of Artificial Sequence: Synthetic oligonucleotide
tgaagaaaaacagctaccagtttgccagaaatatgcagg

SEQ ID NO: 350406 - DNA, 38 bp, Artificial Sequence
  Description of Artificial Sequence: Synthetic oligonucleotide
gaagaaaaacagctaccagtttgccagaaatatgcagg

SEQ ID NO: 350407 - DNA, 39 bp, Artificial Sequence
  Description of Artificial Sequence: Synthetic oligonucleotide
aagaaaaacagctaccagtttgccagaaatatgcaggag

SEQ ID NO: 350408 - DNA, 38 bp, Artificial Sequence
  Description of Artificial Sequence: Synthetic oligonucleotide
agaaaaacagctaccagtttgccagaaatatgcaggag

SEQ ID NO: 350409 - DNA, 37 bp, Artificial Sequence
  Description of Artificial Sequence: Synthetic oligonucleotide
gaaaaacagctaccagtttgccagaaatatgcaggag

SEQ ID NO: 350410 - DNA, 42 bp, Artificial Sequence
  Description of Artificial Sequence: Synthetic oligonucleotide
aaaaacagctaccagtttgccagaaatatgcaggagtatttc

SEQ ID NO: 350411 - DNA, 41 bp, Artificial Sequence
  Description of Artificial Sequence: Synthetic oligonucleotide
aaaacagctaccagtttgccagaaatatgcaggagtatttc

SEQ ID NO: 350412 - DNA, 40 bp, Artificial Sequence
  Description of Artificial Sequence: Synthetic oligonucleotide
aaacagctaccagtttgccagaaatatgcaggagtatttc

SEQ ID NO: 350413 - DNA, 39 bp, Artificial Sequence
  Description of Artificial Sequence: Synthetic oligonucleotide
aacagctaccagtttgccagaaatatgcaggagtatttc

SEQ ID NO: 350414 - DNA, 38 bp, Artificial Sequence
  Description of Artificial Sequence: Synthetic oligonucleotide
acagctaccagtttgccagaaatatgcaggagtatttc

SEQ ID NO: 350415 - DNA, 37 bp, Artificial Sequence
  Description of Artificial Sequence: Synthetic oligonucleotide
cagctaccagtttgccagaaatatgcaggagtatttc

SEQ ID NO: 350416 - DNA, 37 bp, Artificial Sequence
  Description of Artificial Sequence: Synthetic oligonucleotide
agctaccagtttgccagaaatatgcaggagtatttcc

SEQ ID NO: 350417 - DNA, 36 bp, Artificial Sequence
  Description of Artificial Sequence: Synthetic oligonucleotide
gctaccagtttgccagaaatatgcaggagtatttcc

SEQ ID NO: 350418 - DNA, 37 bp, Artificial Sequence
  Description of Artificial Sequence: Synthetic oligonucleotide
ctaccagtttgccagaaatatgcaggagtatttccag

SEQ ID NO: 350419 - DNA, 42 bp, Artificial Sequence
  Description of Artificial Sequence: Synthetic oligonucleotide
taccagtttgccagaaatatgcaggagtatttccagaaaatg

SEQ ID NO: 350420 - DNA, 41 bp, Artificial Sequence
  Description of Artificial Sequence: Synthetic oligonucleotide
accagtttgccagaaatatgcaggagtatttccagaaaatg

SEQ ID NO: 350421 - DNA, 40 bp, Artificial Sequence
  Description of Artificial Sequence: Synthetic oligonucleotide
ccagtttgccagaaatatgcaggagtatttccagaaaatg

SEQ ID NO: 350422 - DNA, 40 bp, Artificial Sequence
  Description of Artificial Sequence: Synthetic oligonucleotide
cagtttgccagaaatatgcaggagtatttccagaaaatgg

SEQ ID NO: 350423 - DNA, 41 bp, Artificial Sequence
  Description of Artificial Sequence: Synthetic oligonucleotide
agtttgccagaaatatgcaggagtatttccagaaaatggag

SEQ ID NO: 350424 - DNA, 40 bp, Artificial Sequence
  Description of Artificial Sequence: Synthetic oligonucleotide
gtttgccagaaatatgcaggagtatttccagaaaatggag

SEQ ID NO: 350425 - DNA, 42 bp, Artificial Sequence
  Description of Artificial Sequence: Synthetic oligonucleotide
tttgccagaaatatgcaggagtatttccagaaaatggagaag

SEQ ID NO: 350426 - DNA, 41 bp, Artificial Sequence
  Description of Artificial Sequence: Synthetic oligonucleotide
ttgccagaaatatgcaggagtatttccagaaaatggagaag

SEQ ID NO: 350427 - DNA, 40 bp, Artificial Sequence
  Description of Artificial Sequence: Synthetic oligonucleotide
tgccagaaatatgcaggagtatttccagaaaatggagaag

SEQ ID NO: 350428 - DNA, 39 bp, Artificial Sequence
  Description of Artificial Sequence: Synthetic oligonucleotide
gccagaaatatgcaggagtatttccagaaaatggagaag

SEQ ID NO: 350429 - DNA, 41 bp, Artificial Sequence
  Description of Artificial Sequence: Synthetic oligonucleotide
ccagaaatatgcaggagtatttccagaaaatggagaagatg

SEQ ID NO: 350430 - DNA, 41 bp, Artificial Sequence
  Description of Artificial Sequence: Synthetic oligonucleotide
cagaaatatgcaggagtatttccagaaaatggagaagatgc

SEQ ID NO: 350431 - DNA, 42 bp, Artificial Sequence
  Description of Artificial Sequence: Synthetic oligonucleotide
agaaatatgcaggagtatttccagaaaatggagaagatgcag

SEQ ID NO: 350432 - DNA, 41 bp, Artificial Sequence
  Description of Artificial Sequence: Synthetic oligonucleotide
gaaatatgcaggagtatttccagaaaatggagaagatgcag

SEQ ID NO: 350433 - DNA, 43 bp, Artificial Sequence
  Description of Artificial Sequence: Synthetic oligonucleotide
aaatatgcaggagtatttccagaaaatggagaagatgcagatg

SEQ ID NO: 350434 - DNA, 42 bp, Artificial Sequence
  Description of Artificial Sequence: Synthetic oligonucleotide
aatatgcaggagtatttccagaaaatggagaagatgcagatg

SEQ ID NO: 350435 - DNA, 41 bp, Artificial Sequence
  Description of Artificial Sequence: Synthetic oligonucleotide
atatgcaggagtatttccagaaaatggagaagatgcagatg

SEQ ID NO: 350436 - DNA, 40 bp, Artificial Sequence
  Description of Artificial Sequence: Synthetic oligonucleotide
tatgcaggagtatttccagaaaatggagaagatgcagatg

SEQ ID NO: 350437 - DNA, 39 bp, Artificial Sequence
  Description of Artificial Sequence: Synthetic oligonucleotide
atgcaggagtatttccagaaaatggagaagatgcagatg

SEQ ID NO: 350438 - DNA, 38 bp, Artificial Sequence
  Description of Artificial Sequence: Synthetic oligonucleotide
tgcaggagtatttccagaaaatggagaagatgcagatg

SEQ ID NO: 350439 - DNA, 37 bp, Artificial Sequence
  Description of Artificial Sequence: Synthetic oligonucleotide
gcaggagtatttccagaaaatggagaagatgcagatg

SEQ ID NO: 350440 - DNA, 37 bp, Artificial Sequence
  Description of Artificial Sequence: Synthetic oligonucleotide
caggagtatttccagaaaatggagaagatgcagatgg

SEQ ID NO: 350441 - DNA, 41 bp, Artificial Sequence
  Description of Artificial Sequence: Synthetic oligonucleotide
aggagtatttccagaaaatggagaagatgcagatggaaaac

SEQ ID NO: 350442 - DNA, 40 bp, Artificial Sequence
  Description of Artificial Sequence: Synthetic oligonucleotide
ggagtatttccagaaaatggagaagatgcagatggaaaac

SEQ ID NO: 350443 - DNA, 42 bp, Artificial Sequence
  Description of Artificial Sequence: Synthetic oligonucleotide
gagtatttccagaaaatggagaagatgcagatggaaaacatg

SEQ ID NO: 350444 - DNA, 51 bp, Artificial Sequence
  Description of Artificial Sequence: Synthetic oligonucleotide
agtatttccagaaaatggagaagatgcagatggaaaacatgtatttattac

SEQ ID NO: 350445 - DNA, 50 bp, Artificial Sequence
  Description of Artificial Sequence: Synthetic oligonucleotide
gtatttccagaaaatggagaagatgcagatggaaaacatgtatttattac

SEQ ID NO: 350446 - DNA, 50 bp, Artificial Sequence
  Description of Artificial Sequence: Synthetic oligonucleotide
tatttccagaaaatggagaagatgcagatggaaaacatgtatttattacc

SEQ ID NO: 350447 - DNA, 49 bp, Artificial Sequence
  Description of Artificial Sequence: Synthetic oligonucleotide
atttccagaaaatggagaagatgcagatggaaaacatgtatttattacc

SEQ ID NO: 350448 - DNA, 48 bp, Artificial Sequence
  Description of Artificial Sequence: Synthetic oligonucleotide
tttccagaaaatggagaagatgcagatggaaaacatgtatttattacc

SEQ ID NO: 350449 - DNA, 47 bp, Artificial Sequence
  Description of Artificial Sequence: Synthetic oligonucleotide
ttccagaaaatggagaagatgcagatggaaaacatgtatttattacc

SEQ ID NO: 350450 - DNA, 46 bp, Artificial Sequence
  Description of Artificial Sequence: Synthetic oligonucleotide
tccagaaaatggagaagatgcagatggaaaacatgtatttattacc

SEQ ID NO: 350451 - DNA, 45 bp, Artificial Sequence
  Description of Artificial Sequence: Synthetic oligonucleotide
ccagaaaatggagaagatgcagatggaaaacatgtatttattacc

SEQ ID NO: 350452 - DNA, 49 bp, Artificial Sequence
  Description of Artificial Sequence: Synthetic oligonucleotide
cagaaaatggagaagatgcagatggaaaacatgtatttattaccaaatc

SEQ ID NO: 350453 - DNA, 50 bp, Artificial Sequence
  Description of Artificial Sequence: Synthetic oligonucleotide
agaaaatggagaagatgcagatggaaaacatgtatttattaccaaatcag

SEQ ID NO: 350454 - DNA, 49 bp, Artificial Sequence
  Description of Artificial Sequence: Synthetic oligonucleotide
gaaaatggagaagatgcagatggaaaacatgtatttattaccaaatcag

SEQ ID NO: 350455 - DNA, 51 bp, Artificial Sequence
  Description of Artificial Sequence: Synthetic oligonucleotide
aaaatggagaagatgcagatggaaaacatgtatttattaccaaatcagttg

SEQ ID NO: 350456 - DNA, 50 bp, Artificial Sequence
  Description of Artificial Sequence: Synthetic oligonucleotide
aaatggagaagatgcagatggaaaacatgtatttattaccaaatcagttg

SEQ ID NO: 350457 - DNA, 49 bp, Artificial Sequence
  Description of Artificial Sequence: Synthetic oligonucleotide
aatggagaagatgcagatggaaaacatgtatttattaccaaatcagttg

SEQ ID NO: 350458 - DNA, 48 bp, Artificial Sequence
  Description of Artificial Sequence: Synthetic oligonucleotide
atggagaagatgcagatggaaaacatgtatttattaccaaatcagttg

SEQ ID NO: 350459 - DNA, 47 bp, Artificial Sequence
  Description of Artificial Sequence: Synthetic oligonucleotide
tggagaagatgcagatggaaaacatgtatttattaccaaatcagttg

SEQ ID NO: 350460 - DNA, 46 bp, Artificial Sequence
  Description of Artificial Sequence: Synthetic oligonucleotide
ggagaagatgcagatggaaaacatgtatttattaccaaatcagttg

SEQ ID NO: 350461 - DNA, 46 bp, Artificial Sequence
  Description of Artificial Sequence: Synthetic oligonucleotide
gagaagatgcagatggaaaacatgtatttattaccaaatcagttgg

SEQ ID NO: 350462 - DNA, 46 bp, Artificial Sequence
  Description of Artificial Sequence: Synthetic oligonucleotide
agaagatgcagatggaaaacatgtatttattaccaaatcagttggg

SEQ ID NO: 350463 - DNA, 45 bp, Artificial Sequence
  Description of Artificial Sequence: Synthetic oligonucleotide
gaagatgcagatggaaaacatgtatttattaccaaatcagttggg

SEQ ID NO: 350464 - DNA, 45 bp, Artificial Sequence
  Description of Artificial Sequence: Synthetic oligonucleotide
aagatgcagatggaaaacatgtatttattaccaaatcagttgggc

SEQ ID NO: 350465 - DNA, 44 bp, Artificial Sequence
  Description of Artificial Sequence: Synthetic oligonucleotide
agatgcagatggaaaacatgtatttattaccaaatcagttgggc

SEQ ID NO: 350466 - DNA, 43 bp, Artificial Sequence
  Description of Artificial Sequence: Synthetic oligonucleotide
gatgcagatggaaaacatgtatttattaccaaatcagttgggc

SEQ ID NO: 350467 - DNA, 46 bp, Artificial Sequence
  Description of Artificial Sequence: Synthetic oligonucleotide
atgcagatggaaaacatgtatttattaccaaatcagttgggcttac

SEQ ID NO: 350468 - DNA, 45 bp, Artificial Sequence
  Description of Artificial Sequence: Synthetic oligonucleotide
tgcagatggaaaacatgtatttattaccaaatcagttgggcttac

SEQ ID NO: 350469 - DNA, 44 bp, Artificial Sequence
  Description of Artificial Sequence: Synthetic oligonucleotide
gcagatggaaaacatgtatttattaccaaatcagttgggcttac

SEQ ID NO: 350470 - DNA, 51 bp, Artificial Sequence
  Description of Artificial Sequence: Synthetic oligonucleotide
cagatggaaaacatgtatttattaccaaatcagttgggcttactattaaag

SEQ ID NO: 350471 - DNA, 52 bp, Artificial Sequence
  Description of Artificial Sequence: Synthetic oligonucleotide
agatggaaaacatgtatttattaccaaatcagttgggcttactattaaagtg

SEQ ID NO: 350472 - DNA, 51 bp, Artificial Sequence
  Description of Artificial Sequence: Synthetic oligonucleotide
gatggaaaacatgtatttattaccaaatcagttgggcttactattaaagtg

SEQ ID NO: 350473 - DNA, 51 bp, Artificial Sequence
  Description of Artificial Sequence: Synthetic oligonucleotide
atggaaaacatgtatttattaccaaatcagttgggcttactattaaagtgg

SEQ ID NO: 350474 - DNA, 50 bp, Artificial Sequence
  Description of Artificial Sequence: Synthetic oligonucleotide
tggaaaacatgtatttattaccaaatcagttgggcttactattaaagtgg

SEQ ID NO: 350475 - DNA, 49 bp, Artificial Sequence
  Description of Artificial Sequence: Synthetic oligonucleotide
ggaaaacatgtatttattaccaaatcagttgggcttactattaaagtgg

SEQ ID NO: 350476 - DNA, 49 bp, Artificial Sequence
  Description of Artificial Sequence: Synthetic oligonucleotide
gaaaacatgtatttattaccaaatcagttgggcttactattaaagtggc

SEQ ID NO: 350477 - DNA, 52 bp, Artificial Sequence
  Description of Artificial Sequence: Synthetic oligonucleotide
aaaacatgtatttattaccaaatcagttgggcttactattaaagtggcaatg

SEQ ID NO: 350478 - DNA, 51 bp, Artificial Sequence
  Description of Artificial Sequence: Synthetic oligonucleotide
aaacatgtatttattaccaaatcagttgggcttactattaaagtggcaatg

SEQ ID NO: 350479 - DNA, 50 bp, Artificial Sequence
  Description of Artificial Sequence: Synthetic oligonucleotide
aacatgtatttattaccaaatcagttgggcttactattaaagtggcaatg

SEQ ID NO: 350480 - DNA, 49 bp, Artificial Sequence
  Description of Artificial Sequence: Synthetic oligonucleotide
acatgtatttattaccaaatcagttgggcttactattaaagtggcaatg

SEQ ID NO: 350481 - DNA, 48 bp, Artificial Sequence
  Description of Artificial Sequence: Synthetic oligonucleotide
catgtatttattaccaaatcagttgggcttactattaaagtggcaatg

SEQ ID NO: 350482 - DNA, 49 bp, Artificial Sequence
  Description of Artificial Sequence: Synthetic oligonucleotide
atgtatttattaccaaatcagttgggcttactattaaagtggcaatgac

SEQ ID NO: 350483 - DNA, 48 bp, Artificial Sequence
  Description of Artificial Sequence: Synthetic oligonucleotide
tgtatttattaccaaatcagttgggcttactattaaagtggcaatgac

SEQ ID NO: 350484 - DNA, 47 bp, Artificial Sequence
  Description of Artificial Sequence: Synthetic oligonucleotide
gtatttattaccaaatcagttgggcttactattaaagtggcaatgac

SEQ ID NO: 350485 - DNA, 51 bp, Artificial Sequence
  Description of Artificial Sequence: Synthetic oligonucleotide
tatttattaccaaatcagttgggcttactattaaagtggcaatgacatatc

SEQ ID NO: 350486 - DNA, 50 bp, Artificial Sequence
  Description of Artificial Sequence: Synthetic oligonucleotide
atttattaccaaatcagttgggcttactattaaagtggcaatgacatatc

SEQ ID NO: 350487 - DNA, 49 bp, Artificial Sequence
  Description of Artificial Sequence: Synthetic oligonucleotide
tttattaccaaatcagttgggcttactattaaagtggcaatgacatatc

SEQ ID NO: 350488 - DNA, 48 bp, Artificial Sequence
  Description of Artificial Sequence: Synthetic oligonucleotide
ttattaccaaatcagttgggcttactattaaagtggcaatgacatatc

SEQ ID NO: 350489 - DNA, 47 bp, Artificial Sequence
  Description of Artificial Sequence: Synthetic oligonucleotide
tattaccaaatcagttgggcttactattaaagtggcaatgacatatc

SEQ ID NO: 350490 - DNA, 46 bp, Artificial Sequence
  Description of Artificial Sequence: Synthetic oligonucleotide
attaccaaatcagttgggcttactattaaagtggcaatgacatatc

SEQ ID NO: 350491 - DNA, 45 bp, Artificial Sequence
  Description of Artificial Sequence: Synthetic oligonucleotide
ttaccaaatcagttgggcttactattaaagtggcaatgacatatc

SEQ ID NO: 350492 - DNA, 44 bp, Artificial Sequence
  Description of Artificial Sequence: Synthetic oligonucleotide
taccaaatcagttgggcttactattaaagtggcaatgacatatc

SEQ ID NO: 350493 - DNA, 43 bp, Artificial Sequence
  Description of Artificial Sequence: Synthetic oligonucleotide
accaaatcagttgggcttactattaaagtggcaatgacatatc

SEQ ID NO: 350494 - DNA, 42 bp, Artificial Sequence
  Description of Artificial Sequence: Synthetic oligonucleotide
ccaaatcagttgggcttactattaaagtggcaatgacatatc

SEQ ID NO: 350495 - DNA, 43 bp, Artificial Sequence
  Description of Artificial Sequence: Synthetic oligonucleotide
caaatcagttgggcttactattaaagtggcaatgacatatcac

SEQ ID NO: 350496 - DNA, 43 bp, Artificial Sequence
  Description of Artificial Sequence: Synthetic oligonucleotide
aaatcagttgggcttactattaaagtggcaatgacatatcacc

SEQ ID NO: 350497 - DNA, 42 bp, Artificial Sequence
  Description of Artificial Sequence: Synthetic oligonucleotide
aatcagttgggcttactattaaagtggcaatgacatatcacc

SEQ ID NO: 350498 - DNA, 41 bp, Artificial Sequence
  Description of Artificial Sequence: Synthetic oligonucleotide
atcagttgggcttactattaaagtggcaatgacatatcacc

SEQ ID NO: 350499 - DNA, 40 bp, Artificial Sequence
  Description of Artificial Sequence: Synthetic oligonucleotide
tcagttgggcttactattaaagtggcaatgacatatcacc

SEQ ID NO: 350500 - DNA, 39 bp, Artificial Sequence
  Description of Artificial Sequence: Synthetic oligonucleotide
cagttgggcttactattaaagtggcaatgacatatcacc

SEQ ID NO: 350501 - DNA, 39 bp, Artificial Sequence
  Description of Artificial Sequence: Synthetic oligonucleotide
agttgggcttactattaaagtggcaatgacatatcaccc

SEQ ID NO: 350502 - DNA, 38 bp, Artificial Sequence
  Description of Artificial Sequence: Synthetic oligonucleotide
gttgggcttactattaaagtggcaatgacatatcaccc

SEQ ID NO: 350503 - DNA, 38 bp, Artificial Sequence
  Description of Artificial Sequence: Synthetic oligonucleotide
ttgggcttactattaaagtggcaatgacatatcacccc

SEQ ID NO: 350504 - DNA, 37 bp, Artificial Sequence
  Description of Artificial Sequence: Synthetic oligonucleotide
tgggcttactattaaagtggcaatgacatatcacccc

SEQ ID NO: 350505 - DNA, 36 bp, Artificial Sequence
  Description of Artificial Sequence: Synthetic oligonucleotide
gggcttactattaaagtggcaatgacatatcacccc

SEQ ID NO: 350506 - DNA, 38 bp, Artificial Sequence
  Description of Artificial Sequence: Synthetic oligonucleotide
ggcttactattaaagtggcaatgacatatcacccctac

SEQ ID NO: 350507 - DNA, 38 bp, Artificial Sequence
  Description of Artificial Sequence: Synthetic oligonucleotide
gcttactattaaagtggcaatgacatatcacccctacc

SEQ ID NO: 350508 - DNA, 39 bp, Artificial Sequence
  Description of Artificial Sequence: Synthetic oligonucleotide
cttactattaaagtggcaatgacatatcacccctaccag

SEQ ID NO: 350509 - DNA, 39 bp, Artificial Sequence
  Description of Artificial Sequence: Synthetic oligonucleotide
ttactattaaagtggcaatgacatatcacccctaccagg

SEQ ID NO: 350510 - DNA, 38 bp, Artificial Sequence
  Description of Artificial Sequence: Synthetic oligonucleotide
tactattaaagtggcaatgacatatcacccctaccagg

SEQ ID NO: 350511 - DNA, 37 bp, Artificial Sequence
  Description of Artificial Sequence: Synthetic oligonucleotide
actattaaagtggcaatgacatatcacccctaccagg

SEQ ID NO: 350512 - DNA, 36 bp, Artificial Sequence
  Description of Artificial Sequence: Synthetic oligonucleotide
ctattaaagtggcaatgacatatcacccctaccagg

SEQ ID NO: 350513 - DNA, 38 bp, Artificial Sequence
  Description of Artificial Sequence: Synthetic oligonucleotide
tattaaagtggcaatgacatatcacccctaccaggtag

SEQ ID NO: 350514 - DNA, 37 bp, Artificial Sequence
  Description of Artificial Sequence: Synthetic oligonucleotide
attaaagtggcaatgacatatcacccctaccaggtag

SEQ ID NO: 350515 - DNA, 36 bp, Artificial Sequence
  Description of Artificial Sequence: Synthetic oligonucleotide
ttaaagtggcaatgacatatcacccctaccaggtag

SEQ ID NO: 350516 - DNA, 35 bp, Artificial Sequence
  Description of Artificial Sequence: Synthetic oligonucleotide
taaagtggcaatgacatatcacccctaccaggtag

SEQ ID NO: 350517 - DNA, 34 bp, Artificial Sequence
  Description of Artificial Sequence: Synthetic oligonucleotide
aaagtggcaatgacatatcacccctaccaggtag

SEQ ID NO: 350518 - DNA, 33 bp, Artificial Sequence
  Description of Artificial Sequence: Synthetic oligonucleotide
aagtggcaatgacatatcacccctaccaggtag

SEQ ID NO: 350519 - DNA, 32 bp, Artificial Sequence
  Description of Artificial Sequence: Synthetic oligonucleotide
agtggcaatgacatatcacccctaccaggtag

SEQ ID NO: 350520 - DNA, 31 bp, Artificial Sequence
  Description of Artificial Sequence: Synthetic oligonucleotide
gtggcaatgacatatcacccctaccaggtag

SEQ ID NO: 350521 - DNA, 33 bp, Artificial Sequence
  Description of Artificial Sequence: Synthetic oligonucleotide
tggcaatgacatatcacccctaccaggtagaag

SEQ ID NO: 350522 - DNA, 32 bp, Artificial Sequence
  Description of Artificial Sequence: Synthetic oligonucleotide
ggcaatgacatatcacccctaccaggtagaag

SEQ ID NO: 350523 - DNA, 34 bp, Artificial Sequence
  Description of Artificial Sequence: Synthetic oligonucleotide
gcaatgacatatcacccctaccaggtagaagaag

SEQ ID NO: 350524 - DNA, 34 bp, Artificial Sequence
  Description of Artificial Sequence: Synthetic oligonucleotide
caatgacatatcacccctaccaggtagaagaagg

SEQ ID NO: 350525 - DNA, 34 bp, Artificial Sequence
  Description of Artificial Sequence: Synthetic oligonucleotide
aatgacatatcacccctaccaggtagaagaaggc

SEQ ID NO: 350526 - DNA, 33 bp, Artificial Sequence
  Description of Artificial Sequence: Synthetic oligonucleotide
atgacatatcacccctaccaggtagaagaaggc

SEQ ID NO: 350527 - DNA, 32 bp, Artificial Sequence
  Description of Artificial Sequence: Synthetic oligonucleotide
tgacatatcacccctaccaggtagaagaaggc

SEQ ID NO: 350528 - DNA, 31 bp, Artificial Sequence
  Description of Artificial Sequence: Synthetic oligonucleotide
gacatatcacccctaccaggtagaagaaggc

SEQ ID NO: 350529 - DNA, 32 bp, Artificial Sequence
  Description of Artificial Sequence: Synthetic oligonucleotide
acatatcacccctaccaggtagaagaaggctg

SEQ ID NO: 350530 - DNA, 31 bp, Artificial Sequence
  Description of Artificial Sequence: Synthetic oligonucleotide
catatcacccctaccaggtagaagaaggctg

SEQ ID NO: 350531 - DNA, 33 bp, Artificial Sequence
  Description of Artificial Sequence: Synthetic oligonucleotide
atatcacccctaccaggtagaagaaggctgatg

SEQ ID NO: 350532 - DNA, 32 bp, Artificial Sequence
  Description of Artificial Sequence: Synthetic oligonucleotide
tatcacccctaccaggtagaagaaggctgatg

SEQ ID NO: 350533 - DNA, 31 bp, Artificial Sequence
  Description of Artificial Sequence: Synthetic oligonucleotide
atcacccctaccaggtagaagaaggctgatg

SEQ ID NO: 350534 - DNA, 30 bp, Artificial Sequence
  Description of Artificial Sequence: Synthetic oligonucleotide
tcacccctaccaggtagaagaaggctgatg

SEQ ID NO: 350535 - DNA, 29 bp, Artificial Sequence
  Description of Artificial Sequence: Synthetic oligonucleotide
cacccctaccaggtagaagaaggctgatg

SEQ ID NO: 350536 - DNA, 31 bp, Artificial Sequence
  Description of Artificial Sequence: Synthetic oligonucleotide
acccctaccaggtagaagaaggctgatgttc

SEQ ID NO: 350537 - DNA, 30 bp, Artificial Sequence
  Description of Artificial Sequence: Synthetic oligonucleotide
cccctaccaggtagaagaaggctgatgttc

SEQ ID NO: 350538 - DNA, 31 bp, Artificial Sequence
  Description of Artificial Sequence: Synthetic oligonucleotide
ccctaccaggtagaagaaggctgatgttcag

SEQ ID NO: 350539 - DNA, 35 bp, Artificial Sequence
  Description of Artificial Sequence: Synthetic oligonucleotide
cctaccaggtagaagaaggctgatgttcagatttg

SEQ ID NO: 350540 - DNA, 35 bp, Artificial Sequence
  Description of Artificial Sequence: Synthetic oligonucleotide
ctaccaggtagaagaaggctgatgttcagatttgg

SEQ ID NO: 350541 - DNA, 35 bp, Artificial Sequence
  Description of Artificial Sequence: Synthetic oligonucleotide
taccaggtagaagaaggctgatgttcagatttggc

SEQ ID NO: 350542 - DNA, 34 bp, Artificial Sequence
  Description of Artificial Sequence: Synthetic oligonucleotide
accaggtagaagaaggctgatgttcagatttggc

SEQ ID NO: 350543 - DNA, 33 bp, Artificial Sequence
  Description of Artificial Sequence: Synthetic oligonucleotide
ccaggtagaagaaggctgatgttcagatttggc

SEQ ID NO: 350544 - DNA, 34 bp, Artificial Sequence
  Description of Artificial Sequence: Synthetic oligonucleotide
caggtagaagaaggctgatgttcagatttggctg

SEQ ID NO: 350545 - DNA, 37 bp, Artificial Sequence
  Description of Artificial Sequence: Synthetic oligonucleotide
aggtagaagaaggctgatgttcagatttggctgttag

SEQ ID NO: 350546 - DNA, 36 bp, Artificial Sequence
  Description of Artificial Sequence: Synthetic oligonucleotide
ggtagaagaaggctgatgttcagatttggctgttag

SEQ ID NO: 350547 - DNA, 43 bp, Artificial Sequence
  Description of Artificial Sequence: Synthetic oligonucleotide
gtagaagaaggctgatgttcagatttggctgttagttttaatg

SEQ ID NO: 350548 - DNA, 43 bp, Artificial Sequence
  Description of Artificial Sequence: Synthetic oligonucleotide
tagaagaaggctgatgttcagatttggctgttagttttaatgg

SEQ ID NO: 350549 - DNA, 42 bp, Artificial Sequence
  Description of Artificial Sequence: Synthetic oligonucleotide
agaagaaggctgatgttcagatttggctgttagttttaatgg

SEQ ID NO: 350550 - DNA, 41 bp, Artificial Sequence
  Description of Artificial Sequence: Synthetic oligonucleotide
gaagaaggctgatgttcagatttggctgttagttttaatgg

SEQ ID NO: 350551 - DNA, 42 bp, Artificial Sequence
  Description of Artificial Sequence: Synthetic oligonucleotide
aagaaggctgatgttcagatttggctgttagttttaatggtc

SEQ ID NO: 350552 - DNA, 41 bp, Artificial Sequence
  Description of Artificial Sequence: Synthetic oligonucleotide
agaaggctgatgttcagatttggctgttagttttaatggtc

SEQ ID NO: 350553 - DNA, 40 bp, Artificial Sequence
  Description of Artificial Sequence: Synthetic oligonucleotide
gaaggctgatgttcagatttggctgttagttttaatggtc

SEQ ID NO: 350554 - DNA, 41 bp, Artificial Sequence
  Description of Artificial Sequence: Synthetic oligonucleotide
aaggctgatgttcagatttggctgttagttttaatggtctg

SEQ ID NO: 350555 - DNA, 40 bp, Artificial Sequence
  Description of Artificial Sequence: Synthetic oligonucleotide
aggctgatgttcagatttggctgttagttttaatggtctg

SEQ ID NO: 350556 - DNA, 39 bp, Artificial Sequence
  Description of Artificial Sequence: Synthetic oligonucleotide
ggctgatgttcagatttggctgttagttttaatggtctg

SEQ ID NO: 350557 - DNA, 40 bp, Artificial Sequence
  Description of Artificial Sequence: Synthetic oligonucleotide
gctgatgttcagatttggctgttagttttaatggtctgac

SEQ ID NO: 350558 - DNA, 41 bp, Artificial Sequence
  Description of Artificial Sequence: Synthetic oligonucleotide
ctgatgttcagatttggctgttagttttaatggtctgactc

SEQ ID NO: 350559 - DNA, 41 bp, Artificial Sequence
  Description of Artificial Sequence: Synthetic oligonucleotide
tgatgttcagatttggctgttagttttaatggtctgactcc

SEQ ID NO: 350560 - DNA, 40 bp, Artificial Sequence
  Description of Artificial Sequence: Synthetic oligonucleotide
gatgttcagatttggctgttagttttaatggtctgactcc

SEQ ID NO: 350561 - DNA, 44 bp, Artificial Sequence
  Description of Artificial Sequence: Synthetic oligonucleotide
atgttcagatttggctgttagttttaatggtctgactccatatc

SEQ ID NO: 350562 - DNA, 43 bp, Artificial Sequence
  Description of Artificial Sequence: Synthetic oligonucleotide
tgttcagatttggctgttagttttaatggtctgactccatatc

SEQ ID NO: 350563 - DNA, 42 bp, Artificial Sequence
  Description of Artificial Sequence: Synthetic oligonucleotide
gttcagatttggctgttagttttaatggtctgactccatatc

SEQ ID NO: 350564 - DNA, 43 bp, Artificial Sequence
  Description of Artificial Sequence: Synthetic oligonucleotide
ttcagatttggctgttagttttaatggtctgactccatatcag

SEQ ID NO: 350565 - DNA, 42 bp, Artificial Sequence
  Description of Artificial Sequence: Synthetic oligonucleotide
tcagatttggctgttagttttaatggtctgactccatatcag

SEQ ID NO: 350566 - DNA, 41 bp, Artificial Sequence
  Description of Artificial Sequence: Synthetic oligonucleotide
cagatttggctgttagttttaatggtctgactccatatcag

SEQ ID NO: 350567 - DNA, 43 bp, Artificial Sequence
  Description of Artificial Sequence: Synthetic oligonucleotide
agatttggctgttagttttaatggtctgactccatatcagatg

SEQ ID NO: 350568 - DNA, 42 bp, Artificial Sequence
  Description of Artificial Sequence: Synthetic oligonucleotide
gatttggctgttagttttaatggtctgactccatatcagatg

SEQ ID NO: 350569 - DNA, 42 bp, Artificial Sequence
  Description of Artificial Sequence: Synthetic oligonucleotide
atttggctgttagttttaatggtctgactccatatcagatgc

SEQ ID NO: 350570 - DNA, 41 bp, Artificial Sequence
  Description of Artificial Sequence: Synthetic oligonucleotide
tttggctgttagttttaatggtctgactccatatcagatgc

SEQ ID NO: 350571 - DNA, 40 bp, Artificial Sequence
  Description of Artificial Sequence: Synthetic oligonucleotide
ttggctgttagttttaatggtctgactccatatcagatgc

SEQ ID NO: 350572 - DNA, 39 bp, Artificial Sequence
  Description of Artificial Sequence: Synthetic oligonucleotide
tggctgttagttttaatggtctgactccatatcagatgc

SEQ ID NO: 350573 - DNA, 38 bp, Artificial Sequence
  Description of Artificial Sequence: Synthetic oligonucleotide
ggctgttagttttaatggtctgactccatatcagatgc

SEQ ID NO: 350574 - DNA, 40 bp, Artificial Sequence
  Description of Artificial Sequence: Synthetic oligonucleotide
gctgttagttttaatggtctgactccatatcagatgcttg

SEQ ID NO: 350575 - DNA, 41 bp, Artificial Sequence
  Description of Artificial Sequence: Synthetic oligonucleotide
ctgttagttttaatggtctgactccatatcagatgcttgtg

SEQ ID NO: 350576 - DNA, 43 bp, Artificial Sequence
  Description of Artificial Sequence: Synthetic oligonucleotide
tgttagttttaatggtctgactccatatcagatgcttgtgatg

SEQ ID NO: 350577 - DNA, 42 bp, Artificial Sequence
  Description of Artificial Sequence: Synthetic oligonucleotide
gttagttttaatggtctgactccatatcagatgcttgtgatg

SEQ ID NO: 350578 - DNA, 44 bp, Artificial Sequence
  Description of Artificial Sequence: Synthetic oligonucleotide
ttagttttaatggtctgactccatatcagatgcttgtgatgatc

SEQ ID NO: 350579 - DNA, 43 bp, Artificial Sequence
  Description of Artificial Sequence: Synthetic oligonucleotide
tagttttaatggtctgactccatatcagatgcttgtgatgatc

SEQ ID NO: 350580 - DNA, 42 bp, Artificial Sequence
  Description of Artificial Sequence: Synthetic oligonucleotide
agttttaatggtctgactccatatcagatgcttgtgatgatc

SEQ ID NO: 350581 - DNA, 41 bp, Artificial Sequence
  Description of Artificial Sequence: Synthetic oligonucleotide
gttttaatggtctgactccatatcagatgcttgtgatgatc

SEQ ID NO: 350582 - DNA, 44 bp, Artificial Sequence
  Description of Artificial Sequence: Synthetic oligonucleotide
ttttaatggtctgactccatatcagatgcttgtgatgatctatg

SEQ ID NO: 350583 - DNA, 43 bp, Artificial Sequence
  Description of Artificial Sequence: Synthetic oligonucleotide
tttaatggtctgactccatatcagatgcttgtgatgatctatg

SEQ ID NO: 350584 - DNA, 42 bp, Artificial Sequence
  Description of Artificial Sequence: Synthetic oligonucleotide
ttaatggtctgactccatatcagatgcttgtgatgatctatg

SEQ ID NO: 350585 - DNA, 41 bp, Artificial Sequence
  Description of Artificial Sequence: Synthetic oligonucleotide
taatggtctgactccatatcagatgcttgtgatgatctatg

SEQ ID NO: 350586 - DNA, 40 bp, Artificial Sequence
  Description of Artificial Sequence: Synthetic oligonucleotide
aatggtctgactccatatcagatgcttgtgatgatctatg

SEQ ID NO: 350587 - DNA, 39 bp, Artificial Sequence
  Description of Artificial Sequence: Synthetic oligonucleotide
atggtctgactccatatcagatgcttgtgatgatctatg

SEQ ID NO: 350588 - DNA, 38 bp, Artificial Sequence
  Description of Artificial Sequence: Synthetic oligonucleotide
tggtctgactccatatcagatgcttgtgatgatctatg

SEQ ID NO: 350589 - DNA, 37 bp, Artificial Sequence
  Description of Artificial Sequence: Synthetic oligonucleotide
ggtctgactccatatcagatgcttgtgatgatctatg

SEQ ID NO: 350590 - DNA, 37 bp, Artificial Sequence
  Description of Artificial Sequence: Synthetic oligonucleotide
gtctgactccatatcagatgcttgtgatgatctatgg

SEQ ID NO: 350591 - DNA, 37 bp, Artificial Sequence
  Description of Artificial Sequence: Synthetic oligonucleotide
tctgactccatatcagatgcttgtgatgatctatggg

SEQ ID NO: 350592 - DNA, 36 bp, Artificial Sequence
  Description of Artificial Sequence: Synthetic oligonucleotide
ctgactccatatcagatgcttgtgatgatctatggg

SEQ ID NO: 350593 - DNA, 36 bp, Artificial Sequence
  Description of Artificial Sequence: Synthetic oligonucleotide
tgactccatatcagatgcttgtgatgatctatgggg

SEQ ID NO: 350594 - DNA, 35 bp, Artificial Sequence
  Description of Artificial Sequence: Synthetic oligonucleotide
gactccatatcagatgcttgtgatgatctatgggg

SEQ ID NO: 350595 - DNA, 39 bp, Artificial Sequence
  Description of Artificial Sequence: Synthetic oligonucleotide
actccatatcagatgcttgtgatgatctatggggtaaac

SEQ ID NO: 350596 - DNA, 38 bp, Artificial Sequence
  Description of Artificial Sequence: Synthetic oligonucleotide
ctccatatcagatgcttgtgatgatctatggggtaaac

SEQ ID NO: 350597 - DNA, 38 bp, Artificial Sequence
  Description of Artificial Sequence: Synthetic oligonucleotide
tccatatcagatgcttgtgatgatctatggggtaaacc

SEQ ID NO: 350598 - DNA, 37 bp, Artificial Sequence
  Description of Artificial Sequence: Synthetic oligonucleotide
ccatatcagatgcttgtgatgatctatggggtaaacc

SEQ ID NO: 350599 - DNA, 37 bp, Artificial Sequence
  Description of Artificial Sequence: Synthetic oligonucleotide
catatcagatgcttgtgatgatctatggggtaaaccg

SEQ ID NO: 350600 - DNA, 37 bp, Artificial Sequence
  Description of Artificial Sequence: Synthetic oligonucleotide
atatcagatgcttgtgatgatctatggggtaaaccgc

SEQ ID NO: 350601 - DNA, 36 bp, Artificial Sequence
  Description of Artificial Sequence: Synthetic oligonucleotide
tatcagatgcttgtgatgatctatggggtaaaccgc

SEQ ID NO: 350602 - DNA, 35 bp, Artificial Sequence
  Description of Artificial Sequence: Synthetic oligonucleotide
atcagatgcttgtgatgatctatggggtaaaccgc

SEQ ID NO: 350603 - DNA, 34 bp, Artificial Sequence
  Description of Artificial Sequence: Synthetic oligonucleotide
tcagatgcttgtgatgatctatggggtaaaccgc

SEQ ID NO: 350604 - DNA, 33 bp, Artificial Sequence
  Description of Artificial Sequence: Synthetic oligonucleotide
cagatgcttgtgatgatctatggggtaaaccgc

SEQ ID NO: 350605 - DNA, 33 bp, Artificial Sequence
  Description of Artificial Sequence: Synthetic oligonucleotide
agatgcttgtgatgatctatggggtaaaccgcc

SEQ ID NO: 350606 - DNA, 32 bp, Artificial Sequence
  Description of Artificial Sequence: Synthetic oligonucleotide
gatgcttgtgatgatctatggggtaaaccgcc

SEQ ID NO: 350607 - DNA, 35 bp, Artificial Sequence
  Description of Artificial Sequence: Synthetic oligonucleotide
atgcttgtgatgatctatggggtaaaccgccttac

SEQ ID NO: 350608 - DNA, 34 bp, Artificial Sequence
  Description of Artificial Sequence: Synthetic oligonucleotide
tgcttgtgatgatctatggggtaaaccgccttac

SEQ ID NO: 350609 - DNA, 33 bp, Artificial Sequence
  Description of Artificial Sequence: Synthetic oligonucleotide
gcttgtgatgatctatggggtaaaccgccttac

SEQ ID NO: 350610 - DNA, 33 bp, Artificial Sequence
  Description of Artificial Sequence: Synthetic oligonucleotide
cttgtgatgatctatggggtaaaccgccttacg

SEQ ID NO: 350611 - DNA, 33 bp, Artificial Sequence
  Description of Artificial Sequence: Synthetic oligonucleotide
ttgtgatgatctatggggtaaaccgccttacgg

SEQ ID NO: 350612 - DNA, 32 bp, Artificial Sequence
  Description of Artificial Sequence: Synthetic oligonucleotide
tgtgatgatctatggggtaaaccgccttacgg

SEQ ID NO: 350613 - DNA, 31 bp, Artificial Sequence
  Description of Artificial Sequence: Synthetic oligonucleotide
gtgatgatctatggggtaaaccgccttacgg

SEQ ID NO: 350614 - DNA, 31 bp, Artificial Sequence
  Description of Artificial Sequence: Synthetic oligonucleotide
tgatgatctatggggtaaaccgccttacggc

SEQ ID NO: 350615 - DNA, 30 bp, Artificial Sequence
  Description of Artificial Sequence: Synthetic oligonucleotide
gatgatctatggggtaaaccgccttacggc

SEQ ID NO: 350616 - DNA, 34 bp, Artificial Sequence
  Description of Artificial Sequence: Synthetic oligonucleotide
atgatctatggggtaaaccgccttacggcatttg

SEQ ID NO: 350617 - DNA, 33 bp, Artificial Sequence
  Description of Artificial Sequence: Synthetic oligonucleotide
tgatctatggggtaaaccgccttacggcatttg

SEQ ID NO: 350618 - DNA, 32 bp, Artificial Sequence
  Description of Artificial Sequence: Synthetic oligonucleotide
gatctatggggtaaaccgccttacggcatttg

SEQ ID NO: 350619 - DNA, 32 bp, Artificial Sequence
  Description of Artificial Sequence: Synthetic oligonucleotide
atctatggggtaaaccgccttacggcatttgg

SEQ ID NO: 350620 - DNA, 31 bp, Artificial Sequence
  Description of Artificial Sequence: Synthetic oligonucleotide
tctatggggtaaaccgccttacggcatttgg

SEQ ID NO: 350621 - DNA, 30 bp, Artificial Sequence
  Description of Artificial Sequence: Synthetic oligonucleotide
ctatggggtaaaccgccttacggcatttgg

SEQ ID NO: 350622 - DNA, 30 bp, Artificial Sequence
  Description of Artificial Sequence: Synthetic oligonucleotide
tatggggtaaaccgccttacggcatttggc

SEQ ID NO: 350623 - DNA, 29 bp, Artificial Sequence
  Description of Artificial Sequence: Synthetic oligonucleotide
atggggtaaaccgccttacggcatttggc

SEQ ID NO: 350624 - DNA, 28 bp, Artificial Sequence
  Description of Artificial Sequence: Synthetic oligonucleotide
tggggtaaaccgccttacggcatttggc

SEQ ID NO: 350625 - DNA, 27 bp, Artificial Sequence
  Description of Artificial Sequence: Synthetic oligonucleotide
ggggtaaaccgccttacggcatttggc

SEQ ID NO: 350626 - DNA, 27 bp, Artificial Sequence
  Description of Artificial Sequence: Synthetic oligonucleotide
gggtaaaccgccttacggcatttggcc

SEQ ID NO: 350627 - DNA, 34 bp, Artificial Sequence
  Description of Artificial Sequence: Synthetic oligonucleotide
ggtaaaccgccttacggcatttggccatattttc

SEQ ID NO: 350628 - DNA, 37 bp, Artificial Sequence
  Description of Artificial Sequence: Synthetic oligonucleotide
gtaaaccgccttacggcatttggccatattttctatg

SEQ ID NO: 350629 - DNA, 39 bp, Artificial Sequence
  Description of Artificial Sequence: Synthetic oligonucleotide
taaaccgccttacggcatttggccatattttctatgatg

SEQ ID NO: 350630 - DNA, 38 bp, Artificial Sequence
  Description of Artificial Sequence: Synthetic oligonucleotide
aaaccgccttacggcatttggccatattttctatgatg

SEQ ID NO: 350631 - DNA, 37 bp, Artificial Sequence
  Description of Artificial Sequence: Synthetic oligonucleotide
aaccgccttacggcatttggccatattttctatgatg

SEQ ID NO: 350632 - DNA, 36 bp, Artificial Sequence
  Description of Artificial Sequence: Synthetic oligonucleotide
accgccttacggcatttggccatattttctatgatg

SEQ ID NO: 350633 - DNA, 35 bp, Artificial Sequence
  Description of Artificial Sequence: Synthetic oligonucleotide
ccgccttacggcatttggccatattttctatgatg

SEQ ID NO: 350634 - DNA, 35 bp, Artificial Sequence
  Description of Artificial Sequence: Synthetic oligonucleotide
cgccttacggcatttggccatattttctatgatgc

SEQ ID NO: 350635 - DNA, 38 bp, Artificial Sequence
  Description of Artificial Sequence: Synthetic oligonucleotide
gccttacggcatttggccatattttctatgatgcatag

SEQ ID NO: 350636 - DNA, 38 bp, Artificial Sequence
  Description of Artificial Sequence: Synthetic oligonucleotide
ccttacggcatttggccatattttctatgatgcatagg

SEQ ID NO: 350637 - DNA, 42 bp, Artificial Sequence
  Description of Artificial Sequence: Synthetic oligonucleotide
cttacggcatttggccatattttctatgatgcataggttttc

SEQ ID NO: 350638 - DNA, 45 bp, Artificial Sequence
  Description of Artificial Sequence: Synthetic oligonucleotide
ttacggcatttggccatattttctatgatgcataggttttctttc

SEQ ID NO: 350639 - DNA, 44 bp, Artificial Sequence
  Description of Artificial Sequence: Synthetic oligonucleotide
tacggcatttggccatattttctatgatgcataggttttctttc

SEQ ID NO: 350640 - DNA, 43 bp, Artificial Sequence
  Description of Artificial Sequence: Synthetic oligonucleotide
acggcatttggccatattttctatgatgcataggttttctttc

SEQ ID NO: 350641 - DNA, 42 bp, Artificial Sequence
  Description of Artificial Sequence: Synthetic oligonucleotide
cggcatttggccatattttctatgatgcataggttttctttc

SEQ ID NO: 350642 - DNA, 42 bp, Artificial Sequence
  Description of Artificial Sequence: Synthetic oligonucleotide
ggcatttggccatattttctatgatgcataggttttctttcc

SEQ ID NO: 350643 - DNA, 43 bp, Artificial Sequence
  Description of Artificial Sequence: Synthetic oligonucleotide
gcatttggccatattttctatgatgcataggttttctttcctc

SEQ ID NO: 350644 - DNA, 43 bp, Artificial Sequence
  Description of Artificial Sequence: Synthetic oligonucleotide
catttggccatattttctatgatgcataggttttctttcctcc

SEQ ID NO: 350645 - DNA, 47 bp, Artificial Sequence
  Description of Artificial Sequence: Synthetic oligonucleotide
atttggccatattttctatgatgcataggttttctttcctccaaatc

SEQ ID NO: 350646 - DNA, 46 bp, Artificial Sequence
  Description of Artificial Sequence: Synthetic oligonucleotide
tttggccatattttctatgatgcataggttttctttcctccaaatc

SEQ ID NO: 350647 - DNA, 45 bp, Artificial Sequence
  Description of Artificial Sequence: Synthetic oligonucleotide
ttggccatattttctatgatgcataggttttctttcctccaaatc

SEQ ID NO: 350648 - DNA, 44 bp, Artificial Sequence
  Description of Artificial Sequence: Synthetic oligonucleotide
tggccatattttctatgatgcataggttttctttcctccaaatc

SEQ ID NO: 350649 - DNA, 43 bp, Artificial Sequence
  Description of Artificial Sequence: Synthetic oligonucleotide
ggccatattttctatgatgcataggttttctttcctccaaatc

SEQ ID NO: 350650 - DNA, 43 bp, Artificial Sequence
  Description of Artificial Sequence: Synthetic oligonucleotide
gccatattttctatgatgcataggttttctttcctccaaatcg

SEQ ID NO: 350651 - DNA, 45 bp, Artificial Sequence
  Description of Artificial Sequence: Synthetic oligonucleotide
ccatattttctatgatgcataggttttctttcctccaaatcgttc

SEQ ID NO: 350652 - DNA, 46 bp, Artificial Sequence
  Description of Artificial Sequence: Synthetic oligonucleotide
catattttctatgatgcataggttttctttcctccaaatcgttctg

SEQ ID NO: 350653 - DNA, 47 bp, Artificial Sequence
  Description of Artificial Sequence: Synthetic oligonucleotide
atattttctatgatgcataggttttctttcctccaaatcgttctgac

SEQ ID NO: 350654 - DNA, 46 bp, Artificial Sequence
  Description of Artificial Sequence: Synthetic oligonucleotide
tattttctatgatgcataggttttctttcctccaaatcgttctgac

SEQ ID NO: 350655 - DNA, 45 bp, Artificial Sequence
  Description of Artificial Sequence: Synthetic oligonucleotide
attttctatgatgcataggttttctttcctccaaatcgttctgac

SEQ ID NO: 350656 - DNA, 44 bp, Artificial Sequence
  Description of Artificial Sequence: Synthetic oligonucleotide
ttttctatgatgcataggttttctttcctccaaatcgttctgac

SEQ ID NO: 350657 - DNA, 43 bp, Artificial Sequence
  Description of Artificial Sequence: Synthetic oligonucleotide
tttctatgatgcataggttttctttcctccaaatcgttctgac

SEQ ID NO: 350658 - DNA, 42 bp, Artificial Sequence
  Description of Artificial Sequence: Synthetic oligonucleotide
ttctatgatgcataggttttctttcctccaaatcgttctgac

SEQ ID NO: 350659 - DNA, 41 bp, Artificial Sequence
  Description of Artificial Sequence: Synthetic oligonucleotide
tctatgatgcataggttttctttcctccaaatcgttctgac

SEQ ID NO: 350660 - DNA, 40 bp, Artificial Sequence
  Description of Artificial Sequence: Synthetic oligonucleotide
ctatgatgcataggttttctttcctccaaatcgttctgac

SEQ ID NO: 350661 - DNA, 43 bp, Artificial Sequence
  Description of Artificial Sequence: Synthetic oligonucleotide
tatgatgcataggttttctttcctccaaatcgttctgacattg

SEQ ID NO: 350662 - DNA, 42 bp, Artificial Sequence
  Description of Artificial Sequence: Synthetic oligonucleotide
atgatgcataggttttctttcctccaaatcgttctgacattg

SEQ ID NO: 350663 - DNA, 41 bp, Artificial Sequence
  Description of Artificial Sequence: Synthetic oligonucleotide
tgatgcataggttttctttcctccaaatcgttctgacattg

SEQ ID NO: 350664 - DNA, 40 bp, Artificial Sequence
  Description of Artificial Sequence: Synthetic oligonucleotide
gatgcataggttttctttcctccaaatcgttctgacattg

SEQ ID NO: 350665 - DNA, 41 bp, Artificial Sequence
  Description of Artificial Sequence: Synthetic oligonucleotide
atgcataggttttctttcctccaaatcgttctgacattgac

SEQ ID NO: 350666 - DNA, 40 bp, Artificial Sequence
  Description of Artificial Sequence: Synthetic oligonucleotide
tgcataggttttctttcctccaaatcgttctgacattgac

SEQ ID NO: 350667 - DNA, 39 bp, Artificial Sequence
  Description of Artificial Sequence: Synthetic oligonucleotide
gcataggttttctttcctccaaatcgttctgacattgac

SEQ ID NO: 350668 - DNA, 40 bp, Artificial Sequence
  Description of Artificial Sequence: Synthetic oligonucleotide
cataggttttctttcctccaaatcgttctgacattgactg

SEQ ID NO: 350669 - DNA, 29 bp, Artificial Sequence
  Description of Artificial Sequence: Synthetic oligonucleotide
agttttggcaactcggacaacacggacgg

SEQ ID NO: 350670 - DNA, 28 bp, Artificial Sequence
  Description of Artificial Sequence: Synthetic oligonucleotide
gttttggcaactcggacaacacggacgg

SEQ ID NO: 350671 - DNA, 29 bp, Artificial Sequence
  Description of Artificial Sequence: Synthetic oligonucleotide
ttttggcaactcggacaacacggacggtg

SEQ ID NO: 350672 - DNA, 28 bp, Artificial Sequence
  Description of Artificial Sequence: Synthetic oligonucleotide
tttggcaactcggacaacacggacggtg

SEQ ID NO: 350673 - DNA, 27 bp, Artificial Sequence
  Description of Artificial Sequence: Synthetic oligonucleotide
ttggcaactcggacaacacggacggtg

SEQ ID NO: 350674 - DNA, 26 bp, Artificial Sequence
  Description of Artificial Sequence: Synthetic oligonucleotide
tggcaactcggacaacacggacggtg

SEQ ID NO: 350675 - DNA, 25 bp, Artificial Sequence
  Description of Artificial Sequence: Synthetic oligonucleotide
ggcaactcggacaacacggacggtg

SEQ ID NO: 350676 - DNA, 26 bp, Artificial Sequence
  Description of Artificial Sequence: Synthetic oligonucleotide
gcaactcggacaacacggacggtgga

SEQ ID NO: 350677 - DNA, 27 bp, Artificial Sequence
  Description of Artificial Sequence: Synthetic oligonucleotide
caactcggacaacacggacggtggagt

SEQ ID NO: 350678 - DNA, 28 bp, Artificial Sequence
  Description of Artificial Sequence: Synthetic oligonucleotide
aactcggacaacacggacggtggagttc

SEQ ID NO: 350679 - DNA, 27 bp, Artificial Sequence
  Description of Artificial Sequence: Synthetic oligonucleotide
actcggacaacacggacggtggagttc

SEQ ID NO: 350680 - DNA, 27 bp, Artificial Sequence
  Description of Artificial Sequence: Synthetic oligonucleotide
ctcggacaacacggacggtggagttca

SEQ ID NO: 350681 - DNA, 27 bp, Artificial Sequence
  Description of Artificial Sequence: Synthetic oligonucleotide
tcggacaacacggacggtggagttcac

SEQ ID NO: 350682 - DNA, 26 bp, Artificial Sequence
  Description of Artificial Sequence: Synthetic oligonucleotide
cggacaacacggacggtggagttcac

SEQ ID NO: 350683 - DNA, 27 bp, Artificial Sequence
  Description of Artificial Sequence: Synthetic oligonucleotide
ggacaacacggacggtggagttcacca

SEQ ID NO: 350684 - DNA, 29 bp, Artificial Sequence
  Description of Artificial Sequence: Synthetic oligonucleotide
gacaacacggacggtggagttcaccattc

SEQ ID NO: 350685 - DNA, 31 bp, Artificial Sequence
  Description of Artificial Sequence: Synthetic oligonucleotide
acaacacggacggtggagttcaccattctac

SEQ ID NO: 350686 - DNA, 30 bp, Artificial Sequence
  Description of Artificial Sequence: Synthetic oligonucleotide
caacacggacggtggagttcaccattctac

SEQ ID NO: 350687 - DNA, 30 bp, Artificial Sequence
  Description of Artificial Sequence: Synthetic oligonucleotide
aacacggacggtggagttcaccattctacg

SEQ ID NO: 350688 - DNA, 29 bp, Artificial Sequence
  Description of Artificial Sequence: Synthetic oligonucleotide
acacggacggtggagttcaccattctacg

SEQ ID NO: 350689 - DNA, 28 bp, Artificial Sequence
  Description of Artificial Sequence: Synthetic oligonucleotide
cacggacggtggagttcaccattctacg

SEQ ID NO: 350690 - DNA, 31 bp, Artificial Sequence
  Description of Artificial Sequence: Synthetic oligonucleotide
acggacggtggagttcaccattctacgtatg

SEQ ID NO: 350691 - DNA, 30 bp, Artificial Sequence
  Description of Artificial Sequence: Synthetic oligonucleotide
cggacggtggagttcaccattctacgtatg

SEQ ID NO: 350692 - DNA, 30 bp, Artificial Sequence
  Description of Artificial Sequence: Synthetic oligonucleotide
ggacggtggagttcaccattctacgtatgg

SEQ ID NO: 350693 - DNA, 30 bp, Artificial Sequence
  Description of Artificial Sequence: Synthetic oligonucleotide
gacggtggagttcaccattctacgtatggc

SEQ ID NO: 350694 - DNA, 33 bp, Artificial Sequence
  Description of Artificial Sequence: Synthetic oligonucleotide
acggtggagttcaccattctacgtatggctatc

SEQ ID NO: 350695 - DNA, 32 bp, Artificial Sequence
  Description of Artificial Sequence: Synthetic oligonucleotide
cggtggagttcaccattctacgtatggctatc

SEQ ID NO: 350696 - DNA, 32 bp, Artificial Sequence
  Description of Artificial Sequence: Synthetic oligonucleotide
ggtggagttcaccattctacgtatggctatcc

SEQ ID NO: 350697 - DNA, 33 bp, Artificial Sequence
  Description of Artificial Sequence: Synthetic oligonucleotide
gtggagttcaccattctacgtatggctatccag

SEQ ID NO: 350698 - DNA, 35 bp, Artificial Sequence
  Description of Artificial Sequence: Synthetic oligonucleotide
tggagttcaccattctacgtatggctatccagaag

SEQ ID NO: 350699 - DNA, 34 bp, Artificial Sequence
  Description of Artificial Sequence: Synthetic oligonucleotide
ggagttcaccattctacgtatggctatccagaag

SEQ ID NO: 350700 - DNA, 34 bp, Artificial Sequence
  Description of Artificial Sequence: Synthetic oligonucleotide
gagttcaccattctacgtatggctatccagaagc

SEQ ID NO: 350701 - DNA, 34 bp, Artificial Sequence
  Description of Artificial Sequence: Synthetic oligonucleotide
agttcaccattctacgtatggctatccagaagcc

SEQ ID NO: 350702 - DNA, 33 bp, Artificial Sequence
  Description of Artificial Sequence: Synthetic oligonucleotide
gttcaccattctacgtatggctatccagaagcc

SEQ ID NO: 350703 - DNA, 38 bp, Artificial Sequence
  Description of Artificial Sequence: Synthetic oligonucleotide
ttcaccattctacgtatggctatccagaagccaatatg

SEQ ID NO: 350704 - DNA, 37 bp, Artificial Sequence
  Description of Artificial Sequence: Synthetic oligonucleotide
tcaccattctacgtatggctatccagaagccaatatg

SEQ ID NO: 350705 - DNA, 36 bp, Artificial Sequence
  Description of Artificial Sequence: Synthetic oligonucleotide
caccattctacgtatggctatccagaagccaatatg

SEQ ID NO: 350706 - DNA, 36 bp, Artificial Sequence
  Description of Artificial Sequence: Synthetic oligonucleotide
accattctacgtatggctatccagaagccaatatgg

SEQ ID NO: 350707 - DNA, 35 bp, Artificial Sequence
  Description of Artificial Sequence: Synthetic oligonucleotide
ccattctacgtatggctatccagaagccaatatgg

SEQ ID NO: 350708 - DNA, 37 bp, Artificial Sequence
  Description of Artificial Sequence: Synthetic oligonucleotide
cattctacgtatggctatccagaagccaatatggttg

SEQ ID NO: 350709 - DNA, 37 bp, Artificial Sequence
  Description of Artificial Sequence: Synthetic oligonucleotide
attctacgtatggctatccagaagccaatatggttgc

SEQ ID NO: 350710 - DNA, 36 bp, Artificial Sequence
  Description of Artificial Sequence: Synthetic oligonucleotide
ttctacgtatggctatccagaagccaatatggttgc

SEQ ID NO: 350711 - DNA, 35 bp, Artificial Sequence
  Description of Artificial Sequence: Synthetic oligonucleotide
tctacgtatggctatccagaagccaatatggttgc

SEQ ID NO: 350712 - DNA, 34 bp, Artificial Sequence
  Description of Artificial Sequence: Synthetic oligonucleotide
ctacgtatggctatccagaagccaatatggttgc

SEQ ID NO: 350713 - DNA, 40 bp, Artificial Sequence
  Description of Artificial Sequence: Synthetic oligonucleotide
tacgtatggctatccagaagccaatatggttgcaaaaatc

SEQ ID NO: 350714 - DNA, 39 bp, Artificial Sequence
  Description of Artificial Sequence: Synthetic oligonucleotide
acgtatggctatccagaagccaatatggttgcaaaaatc

SEQ ID NO: 350715 - DNA, 38 bp, Artificial Sequence
  Description of Artificial Sequence: Synthetic oligonucleotide
cgtatggctatccagaagccaatatggttgcaaaaatc

SEQ ID NO: 350716 - DNA, 38 bp, Artificial Sequence
  Description of Artificial Sequence: Synthetic oligonucleotide
gtatggctatccagaagccaatatggttgcaaaaatcc

SEQ ID NO: 350717 - DNA, 39 bp, Artificial Sequence
  Description of Artificial Sequence: Synthetic oligonucleotide
tatggctatccagaagccaatatggttgcaaaaatcctg

SEQ ID NO: 350718 - DNA, 38 bp, Artificial Sequence
  Description of Artificial Sequence: Synthetic oligonucleotide
atggctatccagaagccaatatggttgcaaaaatcctg

SEQ ID NO: 350719 - DNA, 37 bp, Artificial Sequence
  Description of Artificial Sequence: Synthetic oligonucleotide
tggctatccagaagccaatatggttgcaaaaatcctg

SEQ ID NO: 350720 - DNA, 36 bp, Artificial Sequence
  Description of Artificial Sequence: Synthetic oligonucleotide
ggctatccagaagccaatatggttgcaaaaatcctg

SEQ ID NO: 350721 - DNA, 37 bp, Artificial Sequence
  Description of Artificial Sequence: Synthetic oligonucleotide
gctatccagaagccaatatggttgcaaaaatcctgtc

SEQ ID NO: 350722 - DNA, 38 bp, Artificial Sequence
  Description of Artificial Sequence: Synthetic oligonucleotide
ctatccagaagccaatatggttgcaaaaatcctgtctc

SEQ ID NO: 350723 - DNA, 38 bp, Artificial Sequence
  Description of Artificial Sequence: Synthetic oligonucleotide
tatccagaagccaatatggttgcaaaaatcctgtctcc

SEQ ID NO: 350724 - DNA, 37 bp, Artificial Sequence
  Description of Artificial Sequence: Synthetic oligonucleotide
atccagaagccaatatggttgcaaaaatcctgtctcc

SEQ ID NO: 350725 - DNA, 36 bp, Artificial Sequence
  Description of Artificial Sequence: Synthetic oligonucleotide
tccagaagccaatatggttgcaaaaatcctgtctcc

SEQ ID NO: 350726 - DNA, 35 bp, Artificial Sequence
  Description of Artificial Sequence: Synthetic oligonucleotide
ccagaagccaatatggttgcaaaaatcctgtctcc

SEQ ID NO: 350727 - DNA, 35 bp, Artificial Sequence
  Description of Artificial Sequence: Synthetic oligonucleotide
cagaagccaatatggttgcaaaaatcctgtctccc

SEQ ID NO: 350728 - DNA, 37 bp, Artificial Sequence
  Description of Artificial Sequence: Synthetic oligonucleotide
agaagccaatatggttgcaaaaatcctgtctcccaac

SEQ ID NO: 350729 - DNA, 36 bp, Artificial Sequence
  Description of Artificial Sequence: Synthetic oligonucleotide
gaagccaatatggttgcaaaaatcctgtctcccaac

SEQ ID NO: 350730 - DNA, 36 bp, Artificial Sequence
  Description of Artificial Sequence: Synthetic oligonucleotide
aagccaatatggttgcaaaaatcctgtctcccaacg

SEQ ID NO: 350731 - DNA, 35 bp, Artificial Sequence
  Description of Artificial Sequence: Synthetic oligonucleotide
agccaatatggttgcaaaaatcctgtctcccaacg

SEQ ID NO: 350732 - DNA, 34 bp, Artificial Sequence
  Description of Artificial Sequence: Synthetic oligonucleotide
gccaatatggttgcaaaaatcctgtctcccaacg

SEQ ID NO: 350733 - DNA, 26 bp, Artificial Sequence
  Description of Artificial Sequence: Synthetic oligonucleotide
atgaaattcgcggcctcggagctggc

SEQ ID NO: 350734 - DNA, 25 bp, Artificial Sequence
  Description of Artificial Sequence: Synthetic oligonucleotide
tgaaattcgcggcctcggagctggc

SEQ ID NO: 350735 - DNA, 24 bp, Artificial Sequence
  Description of Artificial Sequence: Synthetic oligonucleotide
gaaattcgcggcctcggagctggc

SEQ ID NO: 350736 - DNA, 25 bp, Artificial Sequence
  Description of Artificial Sequence: Synthetic oligonucleotide
aaattcgcggcctcggagctggcgt

SEQ ID NO: 350737 - DNA, 24 bp, Artificial Sequence
  Description of Artificial Sequence: Synthetic oligonucleotide
aattcgcggcctcggagctggcgt

SEQ ID NO: 350738 - DNA, 23 bp, Artificial Sequence
  Description of Artificial Sequence: Synthetic oligonucleotide
attcgcggcctcggagctggcgt

SEQ ID NO: 350739 - DNA, 22 bp, Artificial Sequence
  Description of Artificial Sequence: Synthetic oligonucleotide
ttcgcggcctcggagctggcgt

SEQ ID NO: 350740 - DNA, 21 bp, Artificial Sequence
  Description of Artificial Sequence: Synthetic oligonucleotide
tcgcggcctcggagctggcgt

SEQ ID NO: 350741 - DNA, 20 bp, Artificial Sequence
  Description of Artificial Sequence: Synthetic oligonucleotide
cgcggcctcggagctggcgt

SEQ ID NO: 350742 - DNA, 20 bp, Artificial Sequence
  Description of Artificial Sequence: Synthetic oligonucleotide
gcggcctcggagctggcgtc

SEQ ID NO: 350743 - DNA, 20 bp, Artificial Sequence
  Description of Artificial Sequence: Synthetic oligonucleotide
cggcctcggagctggcgtcg

SEQ ID NO: 350744 - DNA, 21 bp, Artificial Sequence
  Description of Artificial Sequence: Synthetic oligonucleotide
ggcctcggagctggcgtcggt

SEQ ID NO: 350745 - DNA, 23 bp, Artificial Sequence
  Description of Artificial Sequence: Synthetic oligonucleotide
gcctcggagctggcgtcggtgtt

SEQ ID NO: 350746 - DNA, 23 bp, Artificial Sequence
  Description of Artificial Sequence: Synthetic oligonucleotide
cctcggagctggcgtcggtgttc

SEQ ID NO: 350747 - DNA, 24 bp, Artificial Sequence
  Description of Artificial Sequence: Synthetic oligonucleotide
ctcggagctggcgtcggtgttcct

SEQ ID NO: 350748 - DNA, 26 bp, Artificial Sequence
  Description of Artificial Sequence: Synthetic oligonucleotide
tcggagctggcgtcggtgttcctgat

SEQ ID NO: 350749 - DNA, 25 bp, Artificial Sequence
  Description of Artificial Sequence: Synthetic oligonucleotide
cggagctggcgtcggtgttcctgat

SEQ ID NO: 350750 - DNA, 25 bp, Artificial Sequence
  Description of Artificial Sequence: Synthetic oligonucleotide
ggagctggcgtcggtgttcctgatc

SEQ ID NO: 350751 - DNA, 26 bp, Artificial Sequence
  Description of Artificial Sequence: Synthetic oligonucleotide
gagctggcgtcggtgttcctgatcgt

SEQ ID NO: 350752 - DNA, 26 bp, Artificial Sequence
  Description of Artificial Sequence: Synthetic oligonucleotide
agctggcgtcggtgttcctgatcgtg

SEQ ID NO: 350753 - DNA, 25 bp, Artificial Sequence
  Description of Artificial Sequence: Synthetic oligonucleotide
gctggcgtcggtgttcctgatcgtg

SEQ ID NO: 350754 - DNA, 25 bp, Artificial Sequence
  Description of Artificial Sequence: Synthetic oligonucleotide
ctggcgtcggtgttcctgatcgtgg

SEQ ID NO: 350755 - DNA, 25 bp, Artificial Sequence
  Description of Artificial Sequence: Synthetic oligonucleotide
tggcgtcggtgttcctgatcgtggc

SEQ ID NO: 350756 - DNA, 24 bp, Artificial Sequence
  Description of Artificial Sequence: Synthetic oligonucleotide
ggcgtcggtgttcctgatcgtggc

SEQ ID NO: 350757 - DNA, 24 bp, Artificial Sequence
  Description of Artificial Sequence: Synthetic oligonucleotide
gcgtcggtgttcctgatcgtggcc

SEQ ID NO: 350758 - DNA, 25 bp, Artificial Sequence
  Description of Artificial Sequence: Synthetic oligonucleotide
cgtcggtgttcctgatcgtggccgt

SEQ ID NO: 350759 - DNA, 26 bp, Artificial Sequence
  Description of Artificial Sequence: Synthetic oligonucleotide
gtcggtgttcctgatcgtggccgtga

SEQ ID NO: 350760 - DNA, 27 bp, Artificial Sequence
  Description of Artificial Sequence: Synthetic oligonucleotide
tcggtgttcctgatcgtggccgtgaca

SEQ ID NO: 350761 - DNA, 27 bp, Artificial Sequence
  Description of Artificial Sequence: Synthetic oligonucleotide
cggtgttcctgatcgtggccgtgacaa

SEQ ID NO: 350762 - DNA, 27 bp, Artificial Sequence
  Description of Artificial Sequence: Synthetic oligonucleotide
ggtgttcctgatcgtggccgtgacaac

SEQ ID NO: 350763 - DNA, 27 bp, Artificial Sequence
  Description of Artificial Sequence: Synthetic oligonucleotide
gtgttcctgatcgtggccgtgacaacg

SEQ ID NO: 350764 - DNA, 27 bp, Artificial Sequence
  Description of Artificial Sequence: Synthetic oligonucleotide
tgttcctgatcgtggccgtgacaacgg

SEQ ID NO: 350765 - DNA, 26 bp, Artificial Sequence
  Description of Artificial Sequence: Synthetic oligonucleotide
gttcctgatcgtggccgtgacaacgg

SEQ ID NO: 350766 - DNA, 26 bp, Artificial Sequence
  Description of Artificial Sequence: Synthetic oligonucleotide
ttcctgatcgtggccgtgacaacggc

SEQ ID NO: 350767 - DNA, 25 bp, Artificial Sequence
  Description of Artificial Sequence: Synthetic oligonucleotide
tcctgatcgtggccgtgacaacggc

SEQ ID NO: 350768 - DNA, 24 bp, Artificial Sequence
  Description of Artificial Sequence: Synthetic oligonucleotide
cctgatcgtggccgtgacaacggc

SEQ ID NO: 350769 - DNA, 24 bp, Artificial Sequence
  Description of Artificial Sequence: Synthetic oligonucleotide
ctgatcgtggccgtgacaacggcc

SEQ ID NO: 350770 - DNA, 24 bp, Artificial Sequence
  Description of Artificial Sequence: Synthetic oligonucleotide
tgatcgtggccgtgacaacggccg

SEQ ID NO: 350771 - DNA, 23 bp, Artificial Sequence
  Description of Artificial Sequence: Synthetic oligonucleotide
gatcgtggccgtgacaacggccg

SEQ ID NO: 350772 - DNA, 23 bp, Artificial Sequence
  Description of Artificial Sequence: Synthetic oligonucleotide
atcgtggccgtgacaacggccgc

SEQ ID NO: 350773 - DNA, 22 bp, Artificial Sequence
  Description of Artificial Sequence: Synthetic oligonucleotide
tcgtggccgtgacaacggccgc

SEQ ID NO: 350774 - DNA, 21 bp, Artificial Sequence
  Description of Artificial Sequence: Synthetic oligonucleotide
cgtggccgtgacaacggccgc

SEQ ID NO: 350775 - DNA, 21 bp, Artificial Sequence
  Description of Artificial Sequence: Synthetic oligonucleotide
gtggccgtgacaacggccgcg

SEQ ID NO: 350776 - DNA, 22 bp, Artificial Sequence
  Description of Artificial Sequence: Synthetic oligonucleotide
tggccgtgacaacggccgcgct

SEQ ID NO: 350777 - DNA, 21 bp, Artificial Sequence
  Description of Artificial Sequence: Synthetic oligonucleotide
ggccgtgacaacggccgcgct

SEQ ID NO: 350778 - DNA, 22 bp, Artificial Sequence
  Description of Artificial Sequence: Synthetic oligonucleotide
gccgtgacaacggccgcgctca

SEQ ID NO: 350779 - DNA, 22 bp, Artificial Sequence
  Description of Artificial Sequence: Synthetic oligonucleotide
ccgtgacaacggccgcgctcag

SEQ ID NO: 350780 - DNA, 22 bp, Artificial Sequence
  Description of Artificial Sequence: Synthetic oligonucleotide
cgtgacaacggccgcgctcagc

SEQ ID NO: 350781 - DNA, 23 bp, Artificial Sequence
  Description of Artificial Sequence: Synthetic oligonucleotide
gtgacaacggccgcgctcagcgt

SEQ ID NO: 350782 - DNA, 24 bp, Artificial Sequence
  Description of Artificial Sequence: Synthetic oligonucleotide
tgacaacggccgcgctcagcgtga

SEQ ID NO: 350783 - DNA, 23 bp, Artificial Sequence
  Description of Artificial Sequence: Synthetic oligonucleotide
gacaacggccgcgctcagcgtga

SEQ ID NO: 350784 - DNA, 23 bp, Artificial Sequence
  Description of Artificial Sequence: Synthetic oligonucleotide
acaacggccgcgctcagcgtgag

SEQ ID NO: 350785 - DNA, 22 bp, Artificial Sequence
  Description of Artificial Sequence: Synthetic oligonucleotide
caacggccgcgctcagcgtgag

SEQ ID NO: 350786 - DNA, 23 bp, Artificial Sequence
  Description of Artificial Sequence: Synthetic oligonucleotide
aacggccgcgctcagcgtgagca

SEQ ID NO: 350787 - DNA, 22 bp, Artificial Sequence
  Description of Artificial Sequence: Synthetic oligonucleotide
acggccgcgctcagcgtgagca

SEQ ID NO: 350788 - DNA, 21 bp, Artificial Sequence
  Description of Artificial Sequence: Synthetic oligonucleotide
cggccgcgctcagcgtgagca

SEQ ID NO: 350789 - DNA, 21 bp, Artificial Sequence
  Description of Artificial Sequence: Synthetic oligonucleotide
ggccgcgctcagcgtgagcag

SEQ ID NO: 350790 - DNA, 22 bp, Artificial Sequence
  Description of Artificial Sequence: Synthetic oligonucleotide
gccgcgctcagcgtgagcagca

SEQ ID NO: 350791 - DNA, 22 bp, Artificial Sequence
  Description of Artificial Sequence: Synthetic oligonucleotide
ccgcgctcagcgtgagcagcag

SEQ ID NO: 350792 - DNA, 24 bp, Artificial Sequence
  Description of Artificial Sequence: Synthetic oligonucleotide
cgcgctcagcgtgagcagcagcta

SEQ ID NO: 350793 - DNA, 24 bp, Artificial Sequence
  Description of Artificial Sequence: Synthetic oligonucleotide
gcgctcagcgtgagcagcagctac

SEQ ID NO: 350794 - DNA, 24 bp, Artificial Sequence
  Description of Artificial Sequence: Synthetic oligonucleotide
cgctcagcgtgagcagcagctacc

SEQ ID NO: 350795 - DNA, 24 bp, Artificial Sequence
  Description of Artificial Sequence: Synthetic oligonucleotide
gctcagcgtgagcagcagctaccg

SEQ ID NO: 350796 - DNA, 25 bp, Artificial Sequence
  Description of Artificial Sequence: Synthetic oligonucleotide
ctcagcgtgagcagcagctaccgct

SEQ ID NO: 350797 - DNA, 25 bp, Artificial Sequence
  Description of Artificial Sequence: Synthetic oligonucleotide
tcagcgtgagcagcagctaccgctc

SEQ ID NO: 350798 - DNA, 24 bp, Artificial Sequence
  Description of Artificial Sequence: Synthetic oligonucleotide
cagcgtgagcagcagctaccgctc

SEQ ID NO: 350799 - DNA, 24 bp, Artificial Sequence
  Description of Artificial Sequence: Synthetic oligonucleotide
agcgtgagcagcagctaccgctcc

SEQ ID NO: 350800 - DNA, 23 bp, Artificial Sequence
  Description of Artificial Sequence: Synthetic oligonucleotide
gcgtgagcagcagctaccgctcc

SEQ ID NO: 350801 - DNA, 23 bp, Artificial Sequence
  Description of Artificial Sequence: Synthetic oligonucleotide
cgtgagcagcagctaccgctccg

SEQ ID NO: 350802 - DNA, 23 bp, Artificial Sequence
  Description of Artificial Sequence: Synthetic oligonucleotide
gtgagcagcagctaccgctccgg

SEQ ID NO: 350803 - DNA, 23 bp, Artificial Sequence
  Description of Artificial Sequence: Synthetic oligonucleotide
tgagcagcagctaccgctccggc

SEQ ID NO: 350804 - DNA, 22 bp, Artificial Sequence
  Description of Artificial Sequence: Synthetic oligonucleotide
gagcagcagctaccgctccggc

SEQ ID NO: 350805 - DNA, 22 bp, Artificial Sequence
  Description of Artificial Sequence: Synthetic oligonucleotide
agcagcagctaccgctccggcg

SEQ ID NO: 350806 - DNA, 21 bp, Artificial Sequence
  Description of Artificial Sequence: Synthetic oligonucleotide
gcagcagctaccgctccggcg

SEQ ID NO: 350807 - DNA, 21 bp, Artificial Sequence
  Description of Artificial Sequence: Synthetic oligonucleotide
cagcagctaccgctccggcgg

SEQ ID NO: 350808 - DNA, 21 bp, Artificial Sequence
  Description of Artificial Sequence: Synthetic oligonucleotide
agcagctaccgctccggcggg

SEQ ID NO: 350809 - DNA, 20 bp, Artificial Sequence
  Description of Artificial Sequence: Synthetic oligonucleotide
gcagctaccgctccggcggg

SEQ ID NO: 350810 - DNA, 21 bp, Artificial Sequence
  Description of Artificial Sequence: Synthetic oligonucleotide
cagctaccgctccggcgggga

SEQ ID NO: 350811 - DNA, 21 bp, Artificial Sequence
  Description of Artificial Sequence: Synthetic oligonucleotide
agctaccgctccggcggggac

SEQ ID NO: 350812 - DNA, 20 bp, Artificial Sequence
  Description of Artificial Sequence: Synthetic oligonucleotide
gctaccgctccggcggggac

SEQ ID NO: 350813 - DNA, 20 bp, Artificial Sequence
  Description of Artificial Sequence: Synthetic oligonucleotide
ctaccgctccggcggggacg

SEQ ID NO: 350814 - DNA, 20 bp, Artificial Sequence
  Description of Artificial Sequence: Synthetic oligonucleotide
taccgctccggcggggacgg

SEQ ID NO: 350815 - DNA, 20 bp, Artificial Sequence
  Description of Artificial Sequence: Synthetic oligonucleotide
accgctccggcggggacggt

SEQ ID NO: 350816 - DNA, 20 bp, Artificial Sequence
  Description of Artificial Sequence: Synthetic oligonucleotide
ccgctccggcggggacggtt

SEQ ID NO: 350817 - DNA, 20 bp, Artificial Sequence
  Description of Artificial Sequence: Synthetic oligonucleotide
cgctccggcggggacggcat

SEQ ID NO: 350818 - DNA, 21 bp, Artificial Sequence
  Description of Artificial Sequence: Synthetic oligonucleotide
gctccggcggggacggcatgt

SEQ ID NO: 350819 - DNA, 21 bp, Artificial Sequence
  Description of Artificial Sequence: Synthetic oligonucleotide
ctccggcggggacggcatgtg

SEQ ID NO: 350820 - DNA, 21 bp, Artificial Sequence
  Description of Artificial Sequence: Synthetic oligonucleotide
tccggcggggacggcatgtgg

SEQ ID NO: 350821 - DNA, 20 bp, Artificial Sequence
  Description of Artificial Sequence: Synthetic oligonucleotide
ccggcggggacggcatgtgg

SEQ ID NO: 350822 - DNA, 21 bp, Artificial Sequence
  Description of Artificial Sequence: Synthetic oligonucleotide
cggcggggacggcatgtggct

SEQ ID NO: 350823 - DNA, 21 bp, Artificial Sequence
  Description of Artificial Sequence: Synthetic oligonucleotide
ggcggggacggcatgtggctg

SEQ ID NO: 350824 - DNA, 21 bp, Artificial Sequence
  Description of Artificial Sequence: Synthetic oligonucleotide
gcggggacggcatgtggctgg

SEQ ID NO: 350825 - DNA, 21 bp, Artificial Sequence
  Description of Artificial Sequence: Synthetic oligonucleotide
cggggacggcatgtggctggc

SEQ ID NO: 350826 - DNA, 21 bp, Artificial Sequence
  Description of Artificial Sequence: Synthetic oligonucleotide
ggggacggcatgtggctggcg

SEQ ID NO: 350827 - DNA, 22 bp, Artificial Sequence
  Description of Artificial Sequence: Synthetic oligonucleotide
gggacggcatgtggctggcgct

SEQ ID NO: 350828 - DNA, 23 bp, Artificial Sequence
  Description of Artificial Sequence: Synthetic oligonucleotide
ggacggcatgtggctggcgctga

SEQ ID NO: 350829 - DNA, 23 bp, Artificial Sequence
  Description of Artificial Sequence: Synthetic oligonucleotide
gacggcatgtggctggcgctgac

SEQ ID NO: 350830 - DNA, 25 bp, Artificial Sequence
  Description of Artificial Sequence: Synthetic oligonucleotide
acggcatgtggctggcgctgacctt

SEQ ID NO: 350831 - DNA, 24 bp, Artificial Sequence
  Description of Artificial Sequence: Synthetic oligonucleotide
cggcatgtggctggcgctgacctt

SEQ ID NO: 350832 - DNA, 24 bp, Artificial Sequence
  Description of Artificial Sequence: Synthetic oligonucleotide
ggcatgtggctggcgctgaccttg

SEQ ID NO: 350833 - DNA, 27 bp, Artificial Sequence
  Description of Artificial Sequence: Synthetic oligonucleotide
gcatgtggctggcgctgaccttgcttt

SEQ ID NO: 350834 - DNA, 28 bp, Artificial Sequence
  Description of Artificial Sequence: Synthetic oligonucleotide
catgtggctggcgctgaccttgcttttc

SEQ ID NO: 350835 - DNA, 29 bp, Artificial Sequence
  Description of Artificial Sequence: Synthetic oligonucleotide
atgtggctggcgctgaccttgcttttcac

SEQ ID NO: 350836 - DNA, 28 bp, Artificial Sequence
  Description of Artificial Sequence: Synthetic oligonucleotide
tgtggctggcgctgaccttgcttttcac

SEQ ID NO: 350837 - DNA, 27 bp, Artificial Sequence
  Description of Artificial Sequence: Synthetic oligonucleotide
gtggctggcgctgaccttgcttttcac

SEQ ID NO: 350838 - DNA, 27 bp, Artificial Sequence
  Description of Artificial Sequence: Synthetic oligonucleotide
tggctggcgctgaccttgcttttcacg

SEQ ID NO: 350839 - DNA, 26 bp, Artificial Sequence
  Description of Artificial Sequence: Synthetic oligonucleotide
ggctggcgctgaccttgcttttcacg

SEQ ID NO: 350840 - DNA, 27 bp, Artificial Sequence
  Description of Artificial Sequence: Synthetic oligonucleotide
gctggcgctgaccttgcttttcacgct

SEQ ID NO: 350841 - DNA, 28 bp, Artificial Sequence
  Description of Artificial Sequence: Synthetic oligonucleotide
ctggcgctgaccttgcttttcacgctac

SEQ ID NO: 350842 - DNA, 29 bp, Artificial Sequence
  Description of Artificial Sequence: Synthetic oligonucleotide
tggcgctgaccttgcttttcacgctactg

SEQ ID NO: 350843 - DNA, 28 bp, Artificial Sequence
  Description of Artificial Sequence: Synthetic oligonucleotide
ggcgctgaccttgcttttcacgctactg

SEQ ID NO: 350844 - DNA, 28 bp, Artificial Sequence
  Description of Artificial Sequence: Synthetic oligonucleotide
gcgctgaccttgcttttcacgctactgc

SEQ ID NO: 350845 - DNA, 28 bp, Artificial Sequence
  Description of Artificial Sequence: Synthetic oligonucleotide
cgctgaccttgcttttcacgctactgcg

SEQ ID NO: 350846 - DNA, 30 bp, Artificial Sequence
  Description of Artificial Sequence: Synthetic oligonucleotide
gctgaccttgcttttcacgctactgcgttg

SEQ ID NO: 350847 - DNA, 30 bp, Artificial Sequence
  Description of Artificial Sequence: Synthetic oligonucleotide
ctgaccttgcttttcacgctactgcgttgc

SEQ ID NO: 350848 - DNA, 30 bp, Artificial Sequence
  Description of Artificial Sequence: Synthetic oligonucleotide
tgaccttgcttttcacgctactgcgttgcg

SEQ ID NO: 350849 - DNA, 29 bp, Artificial Sequence
  Description of Artificial Sequence: Synthetic oligonucleotide
gaccttgcttttcacgctactgcgttgcg

SEQ ID NO: 350850 - DNA, 29 bp, Artificial Sequence
  Description of Artificial Sequence: Synthetic oligonucleotide
accttgcttttcacgctactgcgttgcgc

SEQ ID NO: 350851 - DNA, 28 bp, Artificial Sequence
  Description of Artificial Sequence: Synthetic oligonucleotide
ccttgcttttcacgctactgcgttgcgc

SEQ ID NO: 350852 - DNA, 28 bp, Artificial Sequence
  Description of Artificial Sequence: Synthetic oligonucleotide
cttgcttttcacgctactgcgttgcgcg

SEQ ID NO: 350853 - DNA, 28 bp, Artificial Sequence
  Description of Artificial Sequence: Synthetic oligonucleotide
ttgcttttcacgctactgcgttgcgcgc

SEQ ID NO: 350854 - DNA, 27 bp, Artificial Sequence
  Description of Artificial Sequence: Synthetic oligonucleotide
tgcttttcacgctactgcgttgcgcgc

SEQ ID NO: 350855 - DNA, 27 bp, Artificial Sequence
  Description of Artificial Sequence: Synthetic oligonucleotide
gcttttcacgctactgcgttgcgcgct

SEQ ID NO: 350856 - DNA, 27 bp, Artificial Sequence
  Description of Artificial Sequence: Synthetic oligonucleotide
cttttcacgctactgcgttgcgcgctg

SEQ ID NO: 350857 - DNA, 27 bp, Artificial Sequence
  Description of Artificial Sequence: Synthetic oligonucleotide
ttttcacgctactgcgttgcgcgctgg

SEQ ID NO: 350858 - DNA, 27 bp, Artificial Sequence
  Description of Artificial Sequence: Synthetic oligonucleotide
tttcacgctactgcgttgcgcgctggt

SEQ ID NO: 350859 - DNA, 26 bp, Artificial Sequence
  Description of Artificial Sequence: Synthetic oligonucleotide
ttcacgctactgcgttgcgcgctggt

SEQ ID NO: 350860 - DNA, 25 bp, Artificial Sequence
  Description of Artificial Sequence: Synthetic oligonucleotide
tcacgctactgcgttgcgcgctggt

SEQ ID NO: 350861 - DNA, 24 bp, Artificial Sequence
  Description of Artificial Sequence: Synthetic oligonucleotide
cacgctactgcgttgcgcgctggt

SEQ ID NO: 350862 - DNA, 24 bp, Artificial Sequence
  Description of Artificial Sequence: Synthetic oligonucleotide
acgctactgcgttgcgcgctggtg

SEQ ID NO: 350863 - DNA, 23 bp, Artificial Sequence
  Description of Artificial Sequence: Synthetic oligonucleotide
cgctactgcgttgcgcgctggtg

SEQ ID NO: 350864 - DNA, 24 bp, Artificial Sequence
  Description of Artificial Sequence: Synthetic oligonucleotide
gctactgcgttgcgcgctggtgca

SEQ ID NO: 350865 - DNA, 24 bp, Artificial Sequence
  Description of Artificial Sequence: Synthetic oligonucleotide
ctactgcgttgcgcgctggtgcag

SEQ ID NO: 350866 - DNA, 25 bp, Artificial Sequence
  Description of Artificial Sequence: Synthetic oligonucleotide
tactgcgttgcgcgctggtgcagct

SEQ ID NO: 350867 - DNA, 24 bp, Artificial Sequence
  Description of Artificial Sequence: Synthetic oligonucleotide
actgcgttgcgcgctggtgcagct

SEQ ID NO: 350868 - DNA, 23 bp, Artificial Sequence
  Description of Artificial Sequence: Synthetic oligonucleotide
ctgcgttgcgcgctggtgcagct

SEQ ID NO: 350869 - DNA, 24 bp, Artificial Sequence
  Description of Artificial Sequence: Synthetic oligonucleotide
tgcgttgcgcgctggtgcagctct

SEQ ID NO: 350870 - DNA, 23 bp, Artificial Sequence
  Description of Artificial Sequence: Synthetic oligonucleotide
gcgttgcgcgctggtgcagctct

SEQ ID NO: 350871 - DNA, 23 bp, Artificial Sequence
  Description of Artificial Sequence: Synthetic oligonucleotide
cgttgcgcgctggtgcagctctc

SEQ ID NO: 350872 - DNA, 23 bp, Artificial Sequence
  Description of Artificial Sequence: Synthetic oligonucleotide
gttgcgcgctggtgcagctctcg

SEQ ID NO: 350873 - DNA, 25 bp, Artificial Sequence
  Description of Artificial Sequence: Synthetic oligonucleotide
ttgcgcgctggtgcagctctcgctt

SEQ ID NO: 350874 - DNA, 24 bp, Artificial Sequence
  Description of Artificial Sequence: Synthetic oligonucleotide
tgcgcgctggtgcagctctcgctt

SEQ ID NO: 350875 - DNA, 23 bp, Artificial Sequence
  Description of Artificial Sequence: Synthetic oligonucleotide
gcgcgctggtgcagctctcgctt

SEQ ID NO: 350876 - DNA, 24 bp, Artificial Sequence
  Description of Artificial Sequence: Synthetic oligonucleotide
cgcgctggtgcagctctcgcttct

SEQ ID NO: 350877 - DNA, 26 bp, Artificial Sequence
  Description of Artificial Sequence: Synthetic oligonucleotide
gcgctggtgcagctctcgcttctcta

SEQ ID NO: 350878 - DNA, 26 bp, Artificial Sequence
  Description of Artificial Sequence: Synthetic oligonucleotide
cgctggtgcagctctcgcttctctac

SEQ ID NO: 350879 - DNA, 27 bp, Artificial Sequence
  Description of Artificial Sequence: Synthetic oligonucleotide
gctggtgcagctctcgcttctctacgt

SEQ ID NO: 350880 - DNA, 28 bp, Artificial Sequence
  Description of Artificial Sequence: Synthetic oligonucleotide
ctggtgcagctctcgcttctctacgtac

SEQ ID NO: 350881 - DNA, 29 bp, Artificial Sequence
  Description of Artificial Sequence: Synthetic oligonucleotide
tggtgcagctctcgcttctctacgtacac

SEQ ID NO: 350882 - DNA, 28 bp, Artificial Sequence
  Description of Artificial Sequence: Synthetic oligonucleotide
ggtgcagctctcgcttctctacgtacac

SEQ ID NO: 350883 - DNA, 28 bp, Artificial Sequence
  Description of Artificial Sequence: Synthetic oligonucleotide
gtgcagctctcgcttctctacgtacacc

SEQ ID NO: 350884 - DNA, 28 bp, Artificial Sequence
  Description of Artificial Sequence: Synthetic oligonucleotide
tgcagctctcgcttctctacgtacaccg

SEQ ID NO: 350885 - DNA, 27 bp, Artificial Sequence
  Description of Artificial Sequence: Synthetic oligonucleotide
gcagctctcgcttctctacgtacaccg

SEQ ID NO: 350886 - DNA, 27 bp, Artificial Sequence
  Description of Artificial Sequence: Synthetic oligonucleotide
cagctctcgcttctctacgtacaccgg

SEQ ID NO: 350887 - DNA, 27 bp, Artificial Sequence
  Description of Artificial Sequence: Synthetic oligonucleotide
agctctcgcttctctacgtacaccggg

SEQ ID NO: 350888 - DNA, 27 bp, Artificial Sequence
  Description of Artificial Sequence: Synthetic oligonucleotide
gctctcgcttctctacgtacaccggga

SEQ ID NO: 350889 - DNA, 27 bp, Artificial Sequence
  Description of Artificial Sequence: Synthetic oligonucleotide
ctctcgcttctctacgtacaccgggac

SEQ ID NO: 350890 - DNA, 27 bp, Artificial Sequence
  Description of Artificial Sequence: Synthetic oligonucleotide
tctcgcttctctacgtacaccgggacc

SEQ ID NO: 350891 - DNA, 27 bp, Artificial Sequence
  Description of Artificial Sequence: Synthetic oligonucleotide
ctcgcttctctacgtacaccgggacct

SEQ ID NO: 350892 - DNA, 27 bp, Artificial Sequence
  Description of Artificial Sequence: Synthetic oligonucleotide
tcgcttctctacgtacaccgggacctc

SEQ ID NO: 350893 - DNA, 27 bp, Artificial Sequence
  Description of Artificial Sequence: Synthetic oligonucleotide
cgcttctctacgtacaccgggacctca

SEQ ID NO: 350894 - DNA, 27 bp, Artificial Sequence
  Description of Artificial Sequence: Synthetic oligonucleotide
gcttctctacgtacaccgggacctcag

SEQ ID NO: 350895 - DNA, 27 bp, Artificial Sequence
  Description of Artificial Sequence: Synthetic oligonucleotide
cttctctacgtacaccgggacctcagc

SEQ ID NO: 350896 - DNA, 27 bp, Artificial Sequence
  Description of Artificial Sequence: Synthetic oligonucleotide
ttctctacgtacaccgggacctcagcg

SEQ ID NO: 350897 - DNA, 26 bp, Artificial Sequence
  Description of Artificial Sequence: Synthetic oligonucleotide
tctctacgtacaccgggacctcagcg

SEQ ID NO: 350898 - DNA, 25 bp, Artificial Sequence
  Description of Artificial Sequence: Synthetic oligonucleotide
ctctacgtacaccgggacctcagcg

SEQ ID NO: 350899 - DNA, 25 bp, Artificial Sequence
  Description of Artificial Sequence: Synthetic oligonucleotide
tctacgtacaccgggacctcagcgg

SEQ ID NO: 350900 - DNA, 24 bp, Artificial Sequence
  Description of Artificial Sequence: Synthetic oligonucleotide
ctacgtacaccgggacctcagcgg

SEQ ID NO: 350901 - DNA, 24 bp, Artificial Sequence
  Description of Artificial Sequence: Synthetic oligonucleotide
tacgtacaccgggacctcagcggc

SEQ ID NO: 350902 - DNA, 23 bp, Artificial Sequence
  Description of Artificial Sequence: Synthetic oligonucleotide
acgtacaccgggacctcagcggc

SEQ ID NO: 350903 - DNA, 22 bp, Artificial Sequence
  Description of Artificial Sequence: Synthetic oligonucleotide
cgtacaccgggacctcagcggc

SEQ ID NO: 350904 - DNA, 23 bp, Artificial Sequence
  Description of Artificial Sequence: Synthetic oligonucleotide
gtacaccgggacctcagcggcga

SEQ ID NO: 350905 - DNA, 23 bp, Artificial Sequence
  Description of Artificial Sequence: Synthetic oligonucleotide
tacaccgggacctcagcggcgac

SEQ ID NO: 350906 - DNA, 22 bp, Artificial Sequence
  Description of Artificial Sequence: Synthetic oligonucleotide
acaccgggacctcagcggcgac

SEQ ID NO: 350907 - DNA, 21 bp, Artificial Sequence
  Description of Artificial Sequence: Synthetic oligonucleotide
caccgggacctcagcggcgac

SEQ ID NO: 350908 - DNA, 21 bp, Artificial Sequence
  Description of Artificial Sequence: Synthetic oligonucleotide
accgggacctcagcggcgacc

SEQ ID NO: 350909 - DNA, 20 bp, Artificial Sequence
  Description of Artificial Sequence: Synthetic oligonucleotide
ccgggacctcagcggcgacc

SEQ ID NO: 350910 - DNA, 20 bp, Artificial Sequence
  Description of Artificial Sequence: Synthetic oligonucleotide
cgggacctcagcggcgaccg

SEQ ID NO: 350911 - DNA, 20 bp, Artificial Sequence
  Description of Artificial Sequence: Synthetic oligonucleotide
gggacctcagcggcgaccgc

SEQ ID NO: 350912 - DNA, 20 bp, Artificial Sequence
  Description of Artificial Sequence: Synthetic oligonucleotide
ggacctcagcggcgaccgcc

SEQ ID NO: 350913 - DNA, 20 bp, Artificial Sequence
  Description of Artificial Sequence: Synthetic oligonucleotide
gacctcagcggcgaccgccg

SEQ ID NO: 350914 - DNA, 20 bp, Artificial Sequence
  Description of Artificial Sequence: Synthetic oligonucleotide
acctcagcggcgaccgccgg

SEQ ID NO: 350915 - DNA, 20 bp, Artificial Sequence
  Description of Artificial Sequence: Synthetic oligonucleotide
cctcagcggcgaccgccggt

SEQ ID NO: 350916 - DNA, 20 bp, Artificial Sequence
  Description of Artificial Sequence: Synthetic oligonucleotide
ctcagcggcgaccgccggct

SEQ ID NO: 350917 - DNA, 20 bp, Artificial Sequence
  Description of Artificial Sequence: Synthetic oligonucleotide
tcagcggcgaccgccggctc

SEQ ID NO: 350918 - DNA, 20 bp, Artificial Sequence
  Description of Artificial Sequence: Synthetic oligonucleotide
cagcggcgaccgccggctct

SEQ ID NO: 350919 - DNA, 21 bp, Artificial Sequence
  Description of Artificial Sequence: Synthetic oligonucleotide
agcggcgaccgccggctcgta

SEQ ID NO: 350920 - DNA, 20 bp, Artificial Sequence
  Description of Artificial Sequence: Synthetic oligonucleotide
gcggcgaccgccggctcgta

SEQ ID NO: 350921 - DNA, 21 bp, Artificial Sequence
  Description of Artificial Sequence: Synthetic oligonucleotide
cggcgaccgccggctcgtact

SEQ ID NO: 350922 - DNA, 21 bp, Artificial Sequence
  Description of Artificial Sequence: Synthetic oligonucleotide
ggcgaccgccggctcgtactc

SEQ ID NO: 350923 - DNA, 22 bp, Artificial Sequence
  Description of Artificial Sequence: Synthetic oligonucleotide
gcgaccgccggctcgtactcct

SEQ ID NO: 350924 - DNA, 22 bp, Artificial Sequence
  Description of Artificial Sequence: Synthetic oligonucleotide
cgaccgccggctcgtactcctg

SEQ ID NO: 350925 - DNA, 23 bp, Artificial Sequence
  Description of Artificial Sequence: Synthetic oligonucleotide
gaccgccggctcgtactcctgct

SEQ ID NO: 350926 - DNA, 23 bp, Artificial Sequence
  Description of Artificial Sequence: Synthetic oligonucleotide
accgccggctcgtactcctgctg

SEQ ID NO: 350927 - DNA, 22 bp, Artificial Sequence
  Description of Artificial Sequence: Synthetic oligonucleotide
ccgccggctcgtactcctgctg

SEQ ID NO: 350928 - DNA, 23 bp, Artificial Sequence
  Description of Artificial Sequence: Synthetic oligonucleotide
cgccggctcgtactcctgctgca

SEQ ID NO: 350929 - DNA, 23 bp, Artificial Sequence
  Description of Artificial Sequence: Synthetic oligonucleotide
gccggctcgtactcctgctgcac

SEQ ID NO: 350930 - DNA, 24 bp, Artificial Sequence
  Description of Artificial Sequence: Synthetic oligonucleotide
ccggctcgtactcctgctgcacgt

SEQ ID NO: 350931 - DNA, 24 bp, Artificial Sequence
  Description of Artificial Sequence: Synthetic oligonucleotide
cggctcgtactcctgctgcacgtg

SEQ ID NO: 350932 - DNA, 25 bp, Artificial Sequence
  Description of Artificial Sequence: Synthetic oligonucleotide
ggctcgtactcctgctgcacgtgct

SEQ ID NO: 350933 - DNA, 25 bp, Artificial Sequence
  Description of Artificial Sequence: Synthetic oligonucleotide
gctcgtactcctgctgcacgtgctg

SEQ ID NO: 350934 - DNA, 27 bp, Artificial Sequence
  Description of Artificial Sequence: Synthetic oligonucleotide
ctcgtactcctgctgcacgtgctgcaa

SEQ ID NO: 350935 - DNA, 27 bp, Artificial Sequence
  Description of Artificial Sequence: Synthetic oligonucleotide
tcgtactcctgctgcacgtgctgcaac

SEQ ID NO: 350936 - DNA, 27 bp, Artificial Sequence
  Description of Artificial Sequence: Synthetic oligonucleotide
cgtactcctgctgcacgtgctgcaaca

SEQ ID NO: 350937 - DNA, 28 bp, Artificial Sequence
  Description of Artificial Sequence: Synthetic oligonucleotide
gtactcctgctgcacgtgctgcaacatg

SEQ ID NO: 350938 - DNA, 28 bp, Artificial Sequence
  Description of Artificial Sequence: Synthetic oligonucleotide
tactcctgctgcacgtgctgcaacatgg

SEQ ID NO: 350939 - DNA, 27 bp, Artificial Sequence
  Description of Artificial Sequence: Synthetic oligonucleotide
actcctgctgcacgtgctgcaacatgg

SEQ ID NO: 350940 - DNA, 26 bp, Artificial Sequence
  Description of Artificial Sequence: Synthetic oligonucleotide
ctcctgctgcacgtgctgcaacatgg

SEQ ID NO: 350941 - DNA, 26 bp, Artificial Sequence
  Description of Artificial Sequence: Synthetic oligonucleotide
tcctgctgcacgtgctgcaacatggg

SEQ ID NO: 350942 - DNA, 25 bp, Artificial Sequence
  Description of Artificial Sequence: Synthetic oligonucleotide
cctgctgcacgtgctgcaacatggg

SEQ ID NO: 350943 - DNA, 25 bp, Artificial Sequence
  Description of Artificial Sequence: Synthetic oligonucleotide
ctgctgcacgtgctgcaacatgggc

SEQ ID NO: 350944 - DNA, 25 bp, Artificial Sequence
  Description of Artificial Sequence: Synthetic oligonucleotide
tgctgcacgtgctgcaacatgggcc

SEQ ID NO: 350945 - DNA, 24 bp, Artificial Sequence
  Description of Artificial Sequence: Synthetic oligonucleotide
gctgcacgtgctgcaacatgggcc

SEQ ID NO: 350946 - DNA, 24 bp, Artificial Sequence
  Description of Artificial Sequence: Synthetic oligonucleotide
ctgcacgtgctgcaacatgggccc

SEQ ID NO: 350947 - DNA, 27 bp, Artificial Sequence
  Description of Artificial Sequence: Synthetic oligonucleotide
tgcacgtgctgcaacatgggcccctat

SEQ ID NO: 350948 - DNA, 27 bp, Artificial Sequence
  Description of Artificial Sequence: Synthetic oligonucleotide
gcacgtgctgcaacatgggcccctatt

SEQ ID NO: 350949 - DNA, 27 bp, Artificial Sequence
  Description of Artificial Sequence: Synthetic oligonucleotide
cacgtgctgcaacatgggcccctattc

SEQ ID NO: 350950 - DNA, 28 bp, Artificial Sequence
  Description of Artificial Sequence: Synthetic oligonucleotide
acgtgctgcaacatgggcccctattcag

SEQ ID NO: 350951 - DNA, 27 bp, Artificial Sequence
  Description of Artificial Sequence: Synthetic oligonucleotide
cgtgctgcaacatgggcccctattcag

SEQ ID NO: 350952 - DNA, 27 bp, Artificial Sequence
  Description of Artificial Sequence: Synthetic oligonucleotide
gtgctgcaacatgggcccctattcagg

SEQ ID NO: 350953 - DNA, 28 bp, Artificial Sequence
  Description of Artificial Sequence: Synthetic oligonucleotide
tgctgcaacatgggcccctattcaggtg

SEQ ID NO: 350954 - DNA, 27 bp, Artificial Sequence
  Description of Artificial Sequence: Synthetic oligonucleotide
gctgcaacatgggcccctattcaggtg

SEQ ID NO: 350955 - DNA, 31 bp, Artificial Sequence
  Description of Artificial Sequence: Synthetic oligonucleotide
ctgcaacatgggcccctattcaggtgtattg

SEQ ID NO: 350956 - DNA, 33 bp, Artificial Sequence
  Description of Artificial Sequence: Synthetic oligonucleotide
tgcaacatgggcccctattcaggtgtattgaag

SEQ ID NO: 350957 - DNA, 32 bp, Artificial Sequence
  Description of Artificial Sequence: Synthetic oligonucleotide
gcaacatgggcccctattcaggtgtattgaag

SEQ ID NO: 350958 - DNA, 33 bp, Artificial Sequence
  Description of Artificial Sequence: Synthetic oligonucleotide
caacatgggcccctattcaggtgtattgaagtc

SEQ ID NO: 350959 - DNA, 35 bp, Artificial Sequence
  Description of Artificial Sequence: Synthetic oligonucleotide
aacatgggcccctattcaggtgtattgaagtctac

SEQ ID NO: 350960 - DNA, 34 bp, Artificial Sequence
  Description of Artificial Sequence: Synthetic oligonucleotide
acatgggcccctattcaggtgtattgaagtctac

SEQ ID NO: 350961 - DNA, 33 bp, Artificial Sequence
  Description of Artificial Sequence: Synthetic oligonucleotide
catgggcccctattcaggtgtattgaagtctac

SEQ ID NO: 350962 - DNA, 34 bp, Artificial Sequence
  Description of Artificial Sequence: Synthetic oligonucleotide
atgggcccctattcaggtgtattgaagtctactg

SEQ ID NO: 350963 - DNA, 33 bp, Artificial Sequence
  Description of Artificial Sequence: Synthetic oligonucleotide
tgggcccctattcaggtgtattgaagtctactg

SEQ ID NO: 350964 - DNA, 32 bp, Artificial Sequence
  Description of Artificial Sequence: Synthetic oligonucleotide
gggcccctattcaggtgtattgaagtctactg

SEQ ID NO: 350965 - DNA, 32 bp, Artificial Sequence
  Description of Artificial Sequence: Synthetic oligonucleotide
ggcccctattcaggtgtattgaagtctactgc

SEQ ID NO: 350966 - DNA, 34 bp, Artificial Sequence
  Description of Artificial Sequence: Synthetic oligonucleotide
gcccctattcaggtgtattgaagtctactgcatc

SEQ ID NO: 350967 - DNA, 36 bp, Artificial Sequence
  Description of Artificial Sequence: Synthetic oligonucleotide
cccctattcaggtgtattgaagtctactgcatctag

SEQ ID NO: 350968 - DNA, 39 bp, Artificial Sequence
  Description of Artificial Sequence: Synthetic oligonucleotide
ccctattcaggtgtattgaagtctactgcatctagtttc

SEQ ID NO: 350969 - DNA, 40 bp, Artificial Sequence
  Description of Artificial Sequence: Synthetic oligonucleotide
cctattcaggtgtattgaagtctactgcatctagtttcag

SEQ ID NO: 350970 - DNA, 41 bp, Artificial Sequence
  Description of Artificial Sequence: Synthetic oligonucleotide
ctattcaggtgtattgaagtctactgcatctagtttcagtc

SEQ ID NO: 350971 - DNA, 42 bp, Artificial Sequence
  Description of Artificial Sequence: Synthetic oligonucleotide
tattcaggtgtattgaagtctactgcatctagtttcagtcac

SEQ ID NO: 350972 - DNA, 41 bp, Artificial Sequence
  Description of Artificial Sequence: Synthetic oligonucleotide
attcaggtgtattgaagtctactgcatctagtttcagtcac

SEQ ID NO: 350973 - DNA, 40 bp, Artificial Sequence
  Description of Artificial Sequence: Synthetic oligonucleotide
ttcaggtgtattgaagtctactgcatctagtttcagtcac

SEQ ID NO: 350974 - DNA, 39 bp, Artificial Sequence
  Description of Artificial Sequence: Synthetic oligonucleotide
tcaggtgtattgaagtctactgcatctagtttcagtcac

SEQ ID NO: 350975 - DNA, 38 bp, Artificial Sequence
  Description of Artificial Sequence: Synthetic oligonucleotide
caggtgtattgaagtctactgcatctagtttcagtcac

SEQ ID NO: 350976 - DNA, 38 bp, Artificial Sequence
  Description of Artificial Sequence: Synthetic oligonucleotide
aggtgtattgaagtctactgcatctagtttcagtcacg

SEQ ID NO: 350977 - DNA, 37 bp, Artificial Sequence
  Description of Artificial Sequence: Synthetic oligonucleotide
ggtgtattgaagtctactgcatctagtttcagtcacg

SEQ ID NO: 350978 - DNA, 37 bp, Artificial Sequence
  Description of Artificial Sequence: Synthetic oligonucleotide
gtgtattgaagtctactgcatctagtttcagtcacgc

SEQ ID NO: 350979 - DNA, 39 bp, Artificial Sequence
  Description of Artificial Sequence: Synthetic oligonucleotide
tgtattgaagtctactgcatctagtttcagtcacgcaac

SEQ ID NO: 350980 - DNA, 38 bp, Artificial Sequence
  Description of Artificial Sequence: Synthetic oligonucleotide
gtattgaagtctactgcatctagtttcagtcacgcaac

SEQ ID NO: 350981 - DNA, 41 bp, Artificial Sequence
  Description of Artificial Sequence: Synthetic oligonucleotide
tattgaagtctactgcatctagtttcagtcacgcaacaatg

SEQ ID NO: 350982 - DNA, 40 bp, Artificial Sequence
  Description of Artificial Sequence: Synthetic oligonucleotide
attgaagtctactgcatctagtttcagtcacgcaacaatg

SEQ ID NO: 350983 - DNA, 39 bp, Artificial Sequence
  Description of Artificial Sequence: Synthetic oligonucleotide
ttgaagtctactgcatctagtttcagtcacgcaacaatg

SEQ ID NO: 350984 - DNA, 38 bp, Artificial Sequence
  Description of Artificial Sequence: Synthetic oligonucleotide
tgaagtctactgcatctagtttcagtcacgcaacaatg

SEQ ID NO: 350985 - DNA, 37 bp, Artificial Sequence
  Description of Artificial Sequence: Synthetic oligonucleotide
gaagtctactgcatctagtttcagtcacgcaacaatg

SEQ ID NO: 350986 - DNA, 39 bp, Artificial Sequence
  Description of Artificial Sequence: Synthetic oligonucleotide
aagtctactgcatctagtttcagtcacgcaacaatgtag

SEQ ID NO: 350987 - DNA, 38 bp, Artificial Sequence
  Description of Artificial Sequence: Synthetic oligonucleotide
agtctactgcatctagtttcagtcacgcaacaatgtag

SEQ ID NO: 350988 - DNA, 37 bp, Artificial Sequence
  Description of Artificial Sequence: Synthetic oligonucleotide
gtctactgcatctagtttcagtcacgcaacaatgtag

SEQ ID NO: 350989 - DNA, 38 bp, Artificial Sequence
  Description of Artificial Sequence: Synthetic oligonucleotide
tctactgcatctagtttcagtcacgcaacaatgtagag

SEQ ID NO: 350990 - DNA, 37 bp, Artificial Sequence
  Description of Artificial Sequence: Synthetic oligonucleotide
ctactgcatctagtttcagtcacgcaacaatgtagag

SEQ ID NO: 350991 - DNA, 37 bp, Artificial Sequence
  Description of Artificial Sequence: Synthetic oligonucleotide
tactgcatctagtttcagtcacgcaacaatgtagagc

SEQ ID NO: 350992 - DNA, 36 bp, Artificial Sequence
  Description of Artificial Sequence: Synthetic oligonucleotide
actgcatctagtttcagtcacgcaacaatgtagagc

SEQ ID NO: 350993 - DNA, 35 bp, Artificial Sequence
  Description of Artificial Sequence: Synthetic oligonucleotide
ctgcatctagtttcagtcacgcaacaatgtagagc

SEQ ID NO: 350994 - DNA, 35 bp, Artificial Sequence
  Description of Artificial Sequence: Synthetic oligonucleotide
tgcatctagtttcagtcacgcaacaatgtagagcc

SEQ ID NO: 350995 - DNA, 34 bp, Artificial Sequence
  Description of Artificial Sequence: Synthetic oligonucleotide
gcatctagtttcagtcacgcaacaatgtagagcc

SEQ ID NO: 350996 - DNA, 38 bp, Artificial Sequence
  Description of Artificial Sequence: Synthetic oligonucleotide
catctagtttcagtcacgcaacaatgtagagccttaag

SEQ ID NO: 350997 - DNA, 39 bp, Artificial Sequence
  Description of Artificial Sequence: Synthetic oligonucleotide
atctagtttcagtcacgcaacaatgtagagccttaagtc

SEQ ID NO: 350998 - DNA, 38 bp, Artificial Sequence
  Description of Artificial Sequence: Synthetic oligonucleotide
tctagtttcagtcacgcaacaatgtagagccttaagtc

SEQ ID NO: 350999 - DNA, 37 bp, Artificial Sequence
  Description of Artificial Sequence: Synthetic oligonucleotide
ctagtttcagtcacgcaacaatgtagagccttaagtc

SEQ ID NO: 351000 - DNA, 38 bp, Artificial Sequence
  Description of Artificial Sequence: Synthetic oligonucleotide
tagtttcagtcacgcaacaatgtagagccttaagtcag

SEQ ID NO: 351001 - DNA, 37 bp, Artificial Sequence
  Description of Artificial Sequence: Synthetic oligonucleotide
agtttcagtcacgcaacaatgtagagccttaagtcag

SEQ ID NO: 351002 - DNA, 36 bp, Artificial Sequence
  Description of Artificial Sequence: Synthetic oligonucleotide
gtttcagtcacgcaacaatgtagagccttaagtcag

SEQ ID NO: 351003 - DNA, 39 bp, Artificial Sequence
  Description of Artificial Sequence: Synthetic oligonucleotide
tttcagtcacgcaacaatgtagagccttaagtcagtatc

SEQ ID NO: 351004 - DNA, 38 bp, Artificial Sequence
  Description of Artificial Sequence: Synthetic oligonucleotide
ttcagtcacgcaacaatgtagagccttaagtcagtatc

SEQ ID NO: 351005 - DNA, 37 bp, Artificial Sequence
  Description of Artificial Sequence: Synthetic oligonucleotide
tcagtcacgcaacaatgtagagccttaagtcagtatc

SEQ ID NO: 351006 - DNA, 36 bp, Artificial Sequence
  Description of Artificial Sequence: Synthetic oligonucleotide
cagtcacgcaacaatgtagagccttaagtcagtatc

SEQ ID NO: 351007 - DNA, 37 bp, Artificial Sequence
  Description of Artificial Sequence: Synthetic oligonucleotide
agtcacgcaacaatgtagagccttaagtcagtatctc

SEQ ID NO: 351008 - DNA, 36 bp, Artificial Sequence
  Description of Artificial Sequence: Synthetic oligonucleotide
gtcacgcaacaatgtagagccttaagtcagtatctc

SEQ ID NO: 351009 - DNA, 36 bp, Artificial Sequence
  Description of Artificial Sequence: Synthetic oligonucleotide
tcacgcaacaatgtagagccttaagtcagtatctcc

SEQ ID NO: 351010 - DNA, 35 bp, Artificial Sequence
  Description of Artificial Sequence: Synthetic oligonucleotide
cacgcaacaatgtagagccttaagtcagtatctcc

SEQ ID NO: 351011 - DNA, 37 bp, Artificial Sequence
  Description of Artificial Sequence: Synthetic oligonucleotide
acgcaacaatgtagagccttaagtcagtatctccaag

SEQ ID NO: 351012 - DNA, 36 bp, Artificial Sequence
  Description of Artificial Sequence: Synthetic oligonucleotide
cgcaacaatgtagagccttaagtcagtatctccaag

SEQ ID NO: 351013 - DNA, 38 bp, Artificial Sequence
  Description of Artificial Sequence: Synthetic oligonucleotide
gcaacaatgtagagccttaagtcagtatctccaagaag

SEQ ID NO: 351014 - DNA, 39 bp, Artificial Sequence
  Description of Artificial Sequence: Synthetic oligonucleotide
caacaatgtagagccttaagtcagtatctccaagaagac

SEQ ID NO: 351015 - DNA, 39 bp, Artificial Sequence
  Description of Artificial Sequence: Synthetic oligonucleotide
aacaatgtagagccttaagtcagtatctccaagaagacg

SEQ ID NO: 351016 - DNA, 38 bp, Artificial Sequence
  Description of Artificial Sequence: Synthetic oligonucleotide
acaatgtagagccttaagtcagtatctccaagaagacg

SEQ ID NO: 351017 - DNA, 37 bp, Artificial Sequence
  Description of Artificial Sequence: Synthetic oligonucleotide
caatgtagagccttaagtcagtatctccaagaagacg

SEQ ID NO: 351018 - DNA, 37 bp, Artificial Sequence
  Description of Artificial Sequence: Synthetic oligonucleotide
aatgtagagccttaagtcagtatctccaagaagacgc

SEQ ID NO: 351019 - DNA, 36 bp, Artificial Sequence
  Description of Artificial Sequence: Synthetic oligonucleotide
atgtagagccttaagtcagtatctccaagaagacgc

SEQ ID NO: 351020 - DNA, 35 bp, Artificial Sequence
  Description of Artificial Sequence: Synthetic oligonucleotide
tgtagagccttaagtcagtatctccaagaagacgc

SEQ ID NO: 351021 - DNA, 34 bp, Artificial Sequence
  Description of Artificial Sequence: Synthetic oligonucleotide
gtagagccttaagtcagtatctccaagaagacgc

SEQ ID NO: 351022 - DNA, 38 bp, Artificial Sequence
  Description of Artificial Sequence: Synthetic oligonucleotide
tagagccttaagtcagtatctccaagaagacgcaaatg

SEQ ID NO: 351023 - DNA, 37 bp, Artificial Sequence
  Description of Artificial Sequence: Synthetic oligonucleotide
agagccttaagtcagtatctccaagaagacgcaaatg

SEQ ID NO: 351024 - DNA, 36 bp, Artificial Sequence
  Description of Artificial Sequence: Synthetic oligonucleotide
gagccttaagtcagtatctccaagaagacgcaaatg

SEQ ID NO: 351025 - DNA, 36 bp, Artificial Sequence
  Description of Artificial Sequence: Synthetic oligonucleotide
agccttaagtcagtatctccaagaagacgcaaatgc

SEQ ID NO: 351026 - DNA, 35 bp, Artificial Sequence
  Description of Artificial Sequence: Synthetic oligonucleotide
gccttaagtcagtatctccaagaagacgcaaatgc

SEQ ID NO: 351027 - DNA, 35 bp, Artificial Sequence
  Description of Artificial Sequence: Synthetic oligonucleotide
ccttaagtcagtatctccaagaagacgcaaatgcc

SEQ ID NO: 351028 - DNA, 42 bp, Artificial Sequence
  Description of Artificial Sequence: Synthetic oligonucleotide
cttaagtcagtatctccaagaagacgcaaatgcctaaaaatg

SEQ ID NO: 351029 - DNA, 42 bp, Artificial Sequence
  Description of Artificial Sequence: Synthetic oligonucleotide
ttaagtcagtatctccaagaagacgcaaatgcctaaaaatgg

SEQ ID NO: 351030 - DNA, 41 bp, Artificial Sequence
  Description of Artificial Sequence: Synthetic oligonucleotide
taagtcagtatctccaagaagacgcaaatgcctaaaaatgg

SEQ ID NO: 351031 - DNA, 40 bp, Artificial Sequence
  Description of Artificial Sequence: Synthetic oligonucleotide
aagtcagtatctccaagaagacgcaaatgcctaaaaatgg

SEQ ID NO: 351032 - DNA, 39 bp, Artificial Sequence
  Description of Artificial Sequence: Synthetic oligonucleotide
agtcagtatctccaagaagacgcaaatgcctaaaaatgg

SEQ ID NO: 351033 - DNA, 38 bp, Artificial Sequence
  Description of Artificial Sequence: Synthetic oligonucleotide
gtcagtatctccaagaagacgcaaatgcctaaaaatgg

SEQ ID NO: 351034 - DNA, 38 bp, Artificial Sequence
  Description of Artificial Sequence: Synthetic oligonucleotide
tcagtatctccaagaagacgcaaatgcctaaaaatggc

SEQ ID NO: 351035 - DNA, 37 bp, Artificial Sequence
  Description of Artificial Sequence: Synthetic oligonucleotide
cagtatctccaagaagacgcaaatgcctaaaaatggc

SEQ ID NO: 351036 - DNA, 37 bp, Artificial Sequence
  Description of Artificial Sequence: Synthetic oligonucleotide
agtatctccaagaagacgcaaatgcctaaaaatggcg

SEQ ID NO: 351037 - DNA, 36 bp, Artificial Sequence
  Description of Artificial Sequence: Synthetic oligonucleotide
gtatctccaagaagacgcaaatgcctaaaaatggcg

SEQ ID NO: 351038 - DNA, 37 bp, Artificial Sequence
  Description of Artificial Sequence: Synthetic oligonucleotide
tatctccaagaagacgcaaatgcctaaaaatggcgtc

SEQ ID NO: 351039 - DNA, 36 bp, Artificial Sequence
  Description of Artificial Sequence: Synthetic oligonucleotide
atctccaagaagacgcaaatgcctaaaaatggcgtc

SEQ ID NO: 351040 - DNA, 35 bp, Artificial Sequence
  Description of Artificial Sequence: Synthetic oligonucleotide
tctccaagaagacgcaaatgcctaaaaatggcgtc

SEQ ID NO: 351041 - DNA, 34 bp, Artificial Sequence
  Description of Artificial Sequence: Synthetic oligonucleotide
ctccaagaagacgcaaatgcctaaaaatggcgtc

SEQ ID NO: 351042 - DNA, 35 bp, Artificial Sequence
  Description of Artificial Sequence: Synthetic oligonucleotide
tccaagaagacgcaaatgcctaaaaatggcgtctc

SEQ ID NO: 351043 - DNA, 34 bp, Artificial Sequence
  Description of Artificial Sequence: Synthetic oligonucleotide
ccaagaagacgcaaatgcctaaaaatggcgtctc

SEQ ID NO: 351044 - DNA, 35 bp, Artificial Sequence
  Description of Artificial Sequence: Synthetic oligonucleotide
caagaagacgcaaatgcctaaaaatggcgtctcag

SEQ ID NO: 351045 - DNA, 36 bp, Artificial Sequence
  Description of Artificial Sequence: Synthetic oligonucleotide
aagaagacgcaaatgcctaaaaatggcgtctcagag

SEQ ID NO: 351046 - DNA, 35 bp, Artificial Sequence
  Description of Artificial Sequence: Synthetic oligonucleotide
agaagacgcaaatgcctaaaaatggcgtctcagag

SEQ ID NO: 351047 - DNA, 34 bp, Artificial Sequence
  Description of Artificial Sequence: Synthetic oligonucleotide
gaagacgcaaatgcctaaaaatggcgtctcagag

SEQ ID NO: 351048 - DNA, 34 bp, Artificial Sequence
  Description of Artificial Sequence: Synthetic oligonucleotide
aagacgcaaatgcctaaaaatggcgtctcagagg

SEQ ID NO: 351049 - DNA, 33 bp, Artificial Sequence
  Description of Artificial Sequence: Synthetic oligonucleotide
agacgcaaatgcctaaaaatggcgtctcagagg

SEQ ID NO: 351050 - DNA, 32 bp, Artificial Sequence
  Description of Artificial Sequence: Synthetic oligonucleotide
gacgcaaatgcctaaaaatggcgtctcagagg

SEQ ID NO: 351051 - DNA, 33 bp, Artificial Sequence
  Description of Artificial Sequence: Synthetic oligonucleotide
acgcaaatgcctaaaaatggcgtctcagaggtg

SEQ ID NO: 351052 - DNA, 32 bp, Artificial Sequence
  Description of Artificial Sequence: Synthetic oligonucleotide
cgcaaatgcctaaaaatggcgtctcagaggtg

SEQ ID NO: 351053 - DNA, 35 bp, Artificial Sequence
  Description of Artificial Sequence: Synthetic oligonucleotide
gcaaatgcctaaaaatggcgtctcagaggtgattg

SEQ ID NO: 351054 - DNA, 36 bp, Artificial Sequence
  Description of Artificial Sequence: Synthetic oligonucleotide
caaatgcctaaaaatggcgtctcagaggtgattgag

SEQ ID NO: 351055 - DNA, 38 bp, Artificial Sequence
  Description of Artificial Sequence: Synthetic oligonucleotide
aaatgcctaaaaatggcgtctcagaggtgattgagaac

SEQ ID NO: 351056 - DNA, 37 bp, Artificial Sequence
  Description of Artificial Sequence: Synthetic oligonucleotide
aatgcctaaaaatggcgtctcagaggtgattgagaac

SEQ ID NO: 351057 - DNA, 36 bp, Artificial Sequence
  Description of Artificial Sequence: Synthetic oligonucleotide
atgcctaaaaatggcgtctcagaggtgattgagaac

SEQ ID NO: 351058 - DNA, 35 bp, Artificial Sequence
  Description of Artificial Sequence: Synthetic oligonucleotide
tgcctaaaaatggcgtctcagaggtgattgagaac

SEQ ID NO: 351059 - DNA, 34 bp, Artificial Sequence
  Description of Artificial Sequence: Synthetic oligonucleotide
gcctaaaaatggcgtctcagaggtgattgagaac

SEQ ID NO: 351060 - DNA, 34 bp, Artificial Sequence
  Description of Artificial Sequence: Synthetic oligonucleotide
cctaaaaatggcgtctcagaggtgattgagaacg

SEQ ID NO: 351061 - DNA, 35 bp, Artificial Sequence
  Description of Artificial Sequence: Synthetic oligonucleotide
ctaaaaatggcgtctcagaggtgattgagaacgag

SEQ ID NO: 351062 - DNA, 35 bp, Artificial Sequence
  Description of Artificial Sequence: Synthetic oligonucleotide
taaaaatggcgtctcagaggtgattgagaacgagg

SEQ ID NO: 351063 - DNA, 34 bp, Artificial Sequence
  Description of Artificial Sequence: Synthetic oligonucleotide
aaaaatggcgtctcagaggtgattgagaacgagg

SEQ ID NO: 351064 - DNA, 33 bp, Artificial Sequence
  Description of Artificial Sequence: Synthetic oligonucleotide
aaaatggcgtctcagaggtgattgagaacgagg

SEQ ID NO: 351065 - DNA, 32 bp, Artificial Sequence
  Description of Artificial Sequence: Synthetic oligonucleotide
aaatggcgtctcagaggtgattgagaacgagg

SEQ ID NO: 351066 - DNA, 31 bp, Artificial Sequence
  Description of Artificial Sequence: Synthetic oligonucleotide
aatggcgtctcagaggtgattgagaacgagg

SEQ ID NO: 351067 - DNA, 30 bp, Artificial Sequence
  Description of Artificial Sequence: Synthetic oligonucleotide
atggcgtctcagaggtgattgagaacgagg

SEQ ID NO: 351068 - DNA, 29 bp, Artificial Sequence
  Description of Artificial Sequence: Synthetic oligonucleotide
tggcgtctcagaggtgattgagaacgagg

SEQ ID NO: 351069 - DNA, 28 bp, Artificial Sequence
  Description of Artificial Sequence: Synthetic oligonucleotide
ggcgtctcagaggtgattgagaacgagg

SEQ ID NO: 351070 - DNA, 29 bp, Artificial Sequence
  Description of Artificial Sequence: Synthetic oligonucleotide
gcgtctcagaggtgattgagaacgaggtg

SEQ ID NO: 351071 - DNA, 29 bp, Artificial Sequence
  Description of Artificial Sequence: Synthetic oligonucleotide
cgtctcagaggtgattgagaacgaggtgg

SEQ ID NO: 351072 - DNA, 29 bp, Artificial Sequence
  Description of Artificial Sequence: Synthetic oligonucleotide
gtctcagaggtgattgagaacgaggtggg

SEQ ID NO: 351073 - DNA, 29 bp, Artificial Sequence
  Description of Artificial Sequence: Synthetic oligonucleotide
tctcagaggtgattgagaacgaggtgggc

SEQ ID NO: 351074 - DNA, 28 bp, Artificial Sequence
  Description of Artificial Sequence: Synthetic oligonucleotide
ctcagaggtgattgagaacgaggtgggc

SEQ ID NO: 351075 - DNA, 28 bp, Artificial Sequence
  Description of Artificial Sequence: Synthetic oligonucleotide
tcagaggtgattgagaacgaggtgggcg

SEQ ID NO: 351076 - DNA, 27 bp, Artificial Sequence
  Description of Artificial Sequence: Synthetic oligonucleotide
cagaggtgattgagaacgaggtgggcg

SEQ ID NO: 351077 - DNA, 28 bp, Artificial Sequence
  Description of Artificial Sequence: Synthetic oligonucleotide
agaggtgattgagaacgaggtgggcgag

SEQ ID NO: 351078 - DNA, 27 bp, Artificial Sequence
  Description of Artificial Sequence: Synthetic oligonucleotide
gaggtgattgagaacgaggtgggcgag

SEQ ID NO: 351079 - DNA, 27 bp, Artificial Sequence
  Description of Artificial Sequence: Synthetic oligonucleotide
aggtgattgagaacgaggtgggcgagg

SEQ ID NO: 351080 - DNA, 26 bp, Artificial Sequence
  Description of Artificial Sequence: Synthetic oligonucleotide
ggtgattgagaacgaggtgggcgagg

SEQ ID NO: 351081 - DNA, 27 bp, Artificial Sequence
  Description of Artificial Sequence: Synthetic oligonucleotide
gtgattgagaacgaggtgggcgaggca

SEQ ID NO: 351082 - DNA, 27 bp, Artificial Sequence
  Description of Artificial Sequence: Synthetic oligonucleotide
tgattgagaacgaggtgggcgaggcag

SEQ ID NO: 351083 - DNA, 27 bp, Artificial Sequence
  Description of Artificial Sequence: Synthetic oligonucleotide
gattgagaacgaggtgggcgaggcaga

SEQ ID NO: 351084 - DNA, 28 bp, Artificial Sequence
  Description of Artificial Sequence: Synthetic oligonucleotide
attgagaacgaggtgggcgaggcagaag

SEQ ID NO: 351085 - DNA, 27 bp, Artificial Sequence
  Description of Artificial Sequence: Synthetic oligonucleotide
ttgagaacgaggtgggcgaggcagaag

SEQ ID NO: 351086 - DNA, 26 bp, Artificial Sequence
  Description of Artificial Sequence: Synthetic oligonucleotide
tgagaacgaggtgggcgaggcagaag

SEQ ID NO: 351087 - DNA, 25 bp, Artificial Sequence
  Description of Artificial Sequence: Synthetic oligonucleotide
gagaacgaggtgggcgaggcagaag

SEQ ID NO: 351088 - DNA, 25 bp, Artificial Sequence
  Description of Artificial Sequence: Synthetic oligonucleotide
agaacgaggtgggcgaggcagaagc

SEQ ID NO: 351089 - DNA, 24 bp, Artificial Sequence
  Description of Artificial Sequence: Synthetic oligonucleotide
gaacgaggtgggcgaggcagaagc

SEQ ID NO: 351090 - DNA, 27 bp, Artificial Sequence
  Description of Artificial Sequence: Synthetic oligonucleotide
aacgaggtgggcgaggcagaagccaaa

SEQ ID NO: 351091 - DNA, 26 bp, Artificial Sequence
  Description of Artificial Sequence: Synthetic oligonucleotide
acgaggtgggcgaggcagaagccaaa

SEQ ID NO: 351092 - DNA, 25 bp, Artificial Sequence
  Description of Artificial Sequence: Synthetic oligonucleotide
cgaggtgggcgaggcagaagccaaa

SEQ ID NO: 351093 - DNA, 27 bp, Artificial Sequence
  Description of Artificial Sequence: Synthetic oligonucleotide
gaggtgggcgaggcagaagccaaacta

SEQ ID NO: 351094 - DNA, 29 bp, Artificial Sequence
  Description of Artificial Sequence: Synthetic oligonucleotide
aggtgggcgaggcagaagccaaactaatg

SEQ ID NO: 351095 - DNA, 28 bp, Artificial Sequence
  Description of Artificial Sequence: Synthetic oligonucleotide
ggtgggcgaggcagaagccaaactaatg

SEQ ID NO: 351096 - DNA, 29 bp, Artificial Sequence
  Description of Artificial Sequence: Synthetic oligonucleotide
gtgggcgaggcagaagccaaactaatgac

SEQ ID NO: 351097 - DNA, 29 bp, Artificial Sequence
  Description of Artificial Sequence: Synthetic oligonucleotide
tgggcgaggcagaagccaaactaatgacc

SEQ ID NO: 351098 - DNA, 28 bp, Artificial Sequence
  Description of Artificial Sequence: Synthetic oligonucleotide
gggcgaggcagaagccaaactaatgacc

SEQ ID NO: 351099 - DNA, 28 bp, Artificial Sequence
  Description of Artificial Sequence: Synthetic oligonucleotide
ggcgaggcagaagccaaactaatgaccc

SEQ ID NO: 351100 - DNA, 29 bp, Artificial Sequence
  Description of Artificial Sequence: Synthetic oligonucleotide
gcgaggcagaagccaaactaatgacccac

SEQ ID NO: 351101 - DNA, 29 bp, Artificial Sequence
  Description of Artificial Sequence: Synthetic oligonucleotide
cgaggcagaagccaaactaatgacccacc

SEQ ID NO: 351102 - DNA, 29 bp, Artificial Sequence
  Description of Artificial Sequence: Synthetic oligonucleotide
gaggcagaagccaaactaatgacccaccg

SEQ ID NO: 351103 - DNA, 31 bp, Artificial Sequence
  Description of Artificial Sequence: Synthetic oligonucleotide
aggcagaagccaaactaatgacccaccgaac

SEQ ID NO: 351104 - DNA, 30 bp, Artificial Sequence
  Description of Artificial Sequence: Synthetic oligonucleotide
ggcagaagccaaactaatgacccaccgaac

SEQ ID NO: 351105 - DNA, 31 bp, Artificial Sequence
  Description of Artificial Sequence: Synthetic oligonucleotide
gcagaagccaaactaatgacccaccgaacag

SEQ ID NO: 351106 - DNA, 31 bp, Artificial Sequence
  Description of Artificial Sequence: Synthetic oligonucleotide
cagaagccaaactaatgacccaccgaacagc

SEQ ID NO: 351107 - DNA, 31 bp, Artificial Sequence
  Description of Artificial Sequence: Synthetic oligonucleotide
agaagccaaactaatgacccaccgaacagcg

SEQ ID NO: 351108 - DNA, 30 bp, Artificial Sequence
  Description of Artificial Sequence: Synthetic oligonucleotide
gaagccaaactaatgacccaccgaacagcg

SEQ ID NO: 351109 - DNA, 32 bp, Artificial Sequence
  Description of Artificial Sequence: Synthetic oligonucleotide
aagccaaactaatgacccaccgaacagcgttc

SEQ ID NO: 351110 - DNA, 31 bp, Artificial Sequence
  Description of Artificial Sequence: Synthetic oligonucleotide
agccaaactaatgacccaccgaacagcgttc

SEQ ID NO: 351111 - DNA, 30 bp, Artificial Sequence
  Description of Artificial Sequence: Synthetic oligonucleotide
gccaaactaatgacccaccgaacagcgttc

SEQ ID NO: 351112 - DNA, 31 bp, Artificial Sequence
  Description of Artificial Sequence: Synthetic oligonucleotide
ccaaactaatgacccaccgaacagcgttcac

SEQ ID NO: 351113 - DNA, 31 bp, Artificial Sequence
  Description of Artificial Sequence: Synthetic oligonucleotide
caaactaatgacccaccgaacagcgttcacc

SEQ ID NO: 351114 - DNA, 31 bp, Artificial Sequence
  Description of Artificial Sequence: Synthetic oligonucleotide
aaactaatgacccaccgaacagcgttcaccc

SEQ ID NO: 351115 - DNA, 30 bp, Artificial Sequence
  Description of Artificial Sequence: Synthetic oligonucleotide
aactaatgacccaccgaacagcgttcaccc

SEQ ID NO: 351116 - DNA, 29 bp, Artificial Sequence
  Description of Artificial Sequence: Synthetic oligonucleotide
actaatgacccaccgaacagcgttcaccc

SEQ ID NO: 351117 - DNA, 28 bp, Artificial Sequence
  Description of Artificial Sequence: Synthetic oligonucleotide
ctaatgacccaccgaacagcgttcaccc

SEQ ID NO: 351118 - DNA, 28 bp, Artificial Sequence
  Description of Artificial Sequence: Synthetic oligonucleotide
taatgacccaccgaacagcgttcacccg

SEQ ID NO: 351119 - DNA, 27 bp, Artificial Sequence
  Description of Artificial Sequence: Synthetic oligonucleotide
aatgacccaccgaacagcgttcacccg

SEQ ID NO: 351120 - DNA, 26 bp, Artificial Sequence
  Description of Artificial Sequence: Synthetic oligonucleotide
atgacccaccgaacagcgttcacccg

SEQ ID NO: 351121 - DNA, 25 bp, Artificial Sequence
  Description of Artificial Sequence: Synthetic oligonucleotide
tgacccaccgaacagcgttcacccg

SEQ ID NO: 351122 - DNA, 24 bp, Artificial Sequence
  Description of Artificial Sequence: Synthetic oligonucleotide
gacccaccgaacagcgttcacccg

SEQ ID NO: 351123 - DNA, 24 bp, Artificial Sequence
  Description of Artificial Sequence: Synthetic oligonucleotide
acccaccgaacagcgttcacccgg

SEQ ID NO: 351124 - DNA, 23 bp, Artificial Sequence
  Description of Artificial Sequence: Synthetic oligonucleotide
cccaccgaacagcgttcacccgg

SEQ ID NO: 351125 - DNA, 23 bp, Artificial Sequence
  Description of Artificial Sequence: Synthetic oligonucleotide
ccaccgaacagcgttcacccggg

SEQ ID NO: 351126 - DNA, 23 bp, Artificial Sequence
  Description of Artificial Sequence: Synthetic oligonucleotide
caccgaacagcgttcacccgggc

SEQ ID NO: 351127 - DNA, 24 bp, Artificial Sequence
  Description of Artificial Sequence: Synthetic oligonucleotide
accgaacagcgttcacccgggcgt

SEQ ID NO: 351128 - DNA, 23 bp, Artificial Sequence
  Description of Artificial Sequence: Synthetic oligonucleotide
ccgaacagcgttcacccgggcgt

SEQ ID NO: 351129 - DNA, 23 bp, Artificial Sequence
  Description of Artificial Sequence: Synthetic oligonucleotide
cgaacagcgttcacccgggcgtc

SEQ ID NO: 351130 - DNA, 23 bp, Artificial Sequence
  Description of Artificial Sequence: Synthetic oligonucleotide
gaacagcgttcacccgggcgtcc

SEQ ID NO: 351131 - DNA, 24 bp, Artificial Sequence
  Description of Artificial Sequence: Synthetic oligonucleotide
aacagcgttcacccgggcgtccgt

SEQ ID NO: 351132 - DNA, 23 bp, Artificial Sequence
  Description of Artificial Sequence: Synthetic oligonucleotide
acagcgttcacccgggcgtccgt

SEQ ID NO: 351133 - DNA, 22 bp, Artificial Sequence
  Description of Artificial Sequence: Synthetic oligonucleotide
cagcgttcacccgggcgtccgt

SEQ ID NO: 351134 - DNA, 24 bp, Artificial Sequence
  Description of Artificial Sequence: Synthetic oligonucleotide
agcgttcacccgggcgtccgtgat

SEQ ID NO: 351135 - DNA, 23 bp, Artificial Sequence
  Description of Artificial Sequence: Synthetic oligonucleotide
gcgttcacccgggcgtccgtgat

SEQ ID NO: 351136 - DNA, 23 bp, Artificial Sequence
  Description of Artificial Sequence: Synthetic oligonucleotide
cgttcacccgggcgtccgtgatc

SEQ ID NO: 351137 - DNA, 24 bp, Artificial Sequence
  Description of Artificial Sequence: Synthetic oligonucleotide
gttcacccgggcgtccgtgatcca

SEQ ID NO: 351138 - DNA, 24 bp, Artificial Sequence
  Description of Artificial Sequence: Synthetic oligonucleotide
ttcacccgggcgtccgtgatccag

SEQ ID NO: 351139 - DNA, 23 bp, Artificial Sequence
  Description of Artificial Sequence: Synthetic oligonucleotide
tcacccgggcgtccgtgatccag

SEQ ID NO: 351140 - DNA, 22 bp, Artificial Sequence
  Description of Artificial Sequence: Synthetic oligonucleotide
cacccgggcgtccgtgatccag

SEQ ID NO: 351141 - DNA, 22 bp, Artificial Sequence
  Description of Artificial Sequence: Synthetic oligonucleotide
acccgggcgtccgtgatccagc

SEQ ID NO: 351142 - DNA, 21 bp, Artificial Sequence
  Description of Artificial Sequence: Synthetic oligonucleotide
cccgggcgtccgtgatccagc

SEQ ID NO: 351143 - DNA, 24 bp, Artificial Sequence
  Description of Artificial Sequence: Synthetic oligonucleotide
ccgggcgtccgtgatccagccttt

SEQ ID NO: 351144 - DNA, 26 bp, Artificial Sequence
  Description of Artificial Sequence: Synthetic oligonucleotide
cgggcgtccgtgatccagcctttctt

SEQ ID NO: 351145 - DNA, 26 bp, Artificial Sequence
  Description of Artificial Sequence: Synthetic oligonucleotide
gggcgtccgtgatccagcctttcttg

SEQ ID NO: 351146 - DNA, 26 bp, Artificial Sequence
  Description of Artificial Sequence: Synthetic oligonucleotide
ggcgtccgtgatccagcctttcttgg

SEQ ID NO: 351147 - DNA, 26 bp, Artificial Sequence
  Description of Artificial Sequence: Synthetic oligonucleotide
gcgtccgtgatccagcctttcttggc

SEQ ID NO: 351148 - DNA, 27 bp, Artificial Sequence
  Description of Artificial Sequence: Synthetic oligonucleotide
cgtccgtgatccagcctttcttggcct

SEQ ID NO: 351149 - DNA, 27 bp, Artificial Sequence
  Description of Artificial Sequence: Synthetic oligonucleotide
gtccgtgatccagcctttcttggcctc

SEQ ID NO: 351150 - DNA, 28 bp, Artificial Sequence
  Description of Artificial Sequence: Synthetic oligonucleotide
tccgtgatccagcctttcttggcctcag

SEQ ID NO: 351151 - DNA, 27 bp, Artificial Sequence
  Description of Artificial Sequence: Synthetic oligonucleotide
ccgtgatccagcctttcttggcctcag

SEQ ID NO: 351152 - DNA, 27 bp, Artificial Sequence
  Description of Artificial Sequence: Synthetic oligonucleotide
cgtgatccagcctttcttggcctcagc

SEQ ID NO: 351153 - DNA, 27 bp, Artificial Sequence
  Description of Artificial Sequence: Synthetic oligonucleotide
gtgatccagcctttcttggcctcagcc

SEQ ID NO: 351154 - DNA, 27 bp, Artificial Sequence
  Description of Artificial Sequence: Synthetic oligonucleotide
tgatccagcctttcttggcctcagccc

SEQ ID NO: 351155 - DNA, 26 bp, Artificial Sequence
  Description of Artificial Sequence: Synthetic oligonucleotide
gatccagcctttcttggcctcagccc

SEQ ID NO: 351156 - DNA, 26 bp, Artificial Sequence
  Description of Artificial Sequence: Synthetic oligonucleotide
atccagcctttcttggcctcagcccc

SEQ ID NO: 351157 - DNA, 25 bp, Artificial Sequence
  Description of Artificial Sequence: Synthetic oligonucleotide
tccagcctttcttggcctcagcccc

SEQ ID NO: 351158 - DNA, 24 bp, Artificial Sequence
  Description of Artificial Sequence: Synthetic oligonucleotide
ccagcctttcttggcctcagcccc

SEQ ID NO: 351159 - DNA, 24 bp, Artificial Sequence
  Description of Artificial Sequence: Synthetic oligonucleotide
cagcctttcttggcctcagccccg

SEQ ID NO: 351160 - DNA, 25 bp, Artificial Sequence
  Description of Artificial Sequence: Synthetic oligonucleotide
agcctttcttggcctcagccccgca

SEQ ID NO: 351161 - DNA, 24 bp, Artificial Sequence
  Description of Artificial Sequence: Synthetic oligonucleotide
gcctttcttggcctcagccccgca

SEQ ID NO: 351162 - DNA, 24 bp, Artificial Sequence
  Description of Artificial Sequence: Synthetic oligonucleotide
cctttcttggcctcagccccgcag

SEQ ID NO: 351163 - DNA, 25 bp, Artificial Sequence
  Description of Artificial Sequence: Synthetic oligonucleotide
ctttcttggcctcagccccgcagct

SEQ ID NO: 351164 - DNA, 26 bp, Artificial Sequence
  Description of Artificial Sequence: Synthetic oligonucleotide
tttcttggcctcagccccgcagctga

SEQ ID NO: 351165 - DNA, 25 bp, Artificial Sequence
  Description of Artificial Sequence: Synthetic oligonucleotide
ttcttggcctcagccccgcagctga

SEQ ID NO: 351166 - DNA, 24 bp, Artificial Sequence
  Description of Artificial Sequence: Synthetic oligonucleotide
tcttggcctcagccccgcagctga

SEQ ID NO: 351167 - DNA, 23 bp, Artificial Sequence
  Description of Artificial Sequence: Synthetic oligonucleotide
cttggcctcagccccgcagctga

SEQ ID NO: 351168 - DNA, 23 bp, Artificial Sequence
  Description of Artificial Sequence: Synthetic oligonucleotide
ttggcctcagccccgcagctgac

SEQ ID NO: 351169 - DNA, 22 bp, Artificial Sequence
  Description of Artificial Sequence: Synthetic oligonucleotide
tggcctcagccccgcagctgac

SEQ ID NO: 351170 - DNA, 21 bp, Artificial Sequence
  Description of Artificial Sequence: Synthetic oligonucleotide
ggcctcagccccgcagctgac

SEQ ID NO: 351171 - DNA, 21 bp, Artificial Sequence
  Description of Artificial Sequence: Synthetic oligonucleotide
gcctcagccccgcagctgacc

SEQ ID NO: 351172 - DNA, 23 bp, Artificial Sequence
  Description of Artificial Sequence: Synthetic oligonucleotide
cctcagccccgcagctgaccgta

SEQ ID NO: 351173 - DNA, 24 bp, Artificial Sequence
  Description of Artificial Sequence: Synthetic oligonucleotide
ctcagccccgcagctgaccgtaca

SEQ ID NO: 351174 - DNA, 24 bp, Artificial Sequence
  Description of Artificial Sequence: Synthetic oligonucleotide
tcagccccgcagctgaccgtacag

SEQ ID NO: 351175 - DNA, 23 bp, Artificial Sequence
  Description of Artificial Sequence: Synthetic oligonucleotide
cagccccgcagctgaccgtacag

SEQ ID NO: 351176 - DNA, 24 bp, Artificial Sequence
  Description of Artificial Sequence: Synthetic oligonucleotide
agccccgcagctgaccgtacagct

SEQ ID NO: 351177 - DNA, 23 bp, Artificial Sequence
  Description of Artificial Sequence: Synthetic oligonucleotide
gccccgcagctgaccgtacagct

SEQ ID NO: 351178 - DNA, 25 bp, Artificial Sequence
  Description of Artificial Sequence: Synthetic oligonucleotide
ccccgcagctgaccgtacagctgtt

SEQ ID NO: 351179 - DNA, 27 bp, Artificial Sequence
  Description of Artificial Sequence: Synthetic oligonucleotide
cccgcagctgaccgtacagctgttcat

SEQ ID NO: 351180 - DNA, 29 bp, Artificial Sequence
  Description of Artificial Sequence: Synthetic oligonucleotide
ccgcagctgaccgtacagctgttcataag

SEQ ID NO: 351181 - DNA, 30 bp, Artificial Sequence
  Description of Artificial Sequence: Synthetic oligonucleotide
cgcagctgaccgtacagctgttcataagtg

SEQ ID NO: 351182 - DNA, 31 bp, Artificial Sequence
  Description of Artificial Sequence: Synthetic oligonucleotide
gcagctgaccgtacagctgttcataagtgtg

SEQ ID NO: 351183 - DNA, 33 bp, Artificial Sequence
  Description of Artificial Sequence: Synthetic oligonucleotide
cagctgaccgtacagctgttcataagtgtgatg

SEQ ID NO: 351184 - DNA, 33 bp, Artificial Sequence
  Description of Artificial Sequence: Synthetic oligonucleotide
agctgaccgtacagctgttcataagtgtgatgc

SEQ ID NO: 351185 - DNA, 32 bp, Artificial Sequence
  Description of Artificial Sequence: Synthetic oligonucleotide
gctgaccgtacagctgttcataagtgtgatgc

SEQ ID NO: 351186 - DNA, 33 bp, Artificial Sequence
  Description of Artificial Sequence: Synthetic oligonucleotide
ctgaccgtacagctgttcataagtgtgatgcag

SEQ ID NO: 351187 - DNA, 33 bp, Artificial Sequence
  Description of Artificial Sequence: Synthetic oligonucleotide
tgaccgtacagctgttcataagtgtgatgcagc

SEQ ID NO: 351188 - DNA, 32 bp, Artificial Sequence
  Description of Artificial Sequence: Synthetic oligonucleotide
gaccgtacagctgttcataagtgtgatgcagc

SEQ ID NO: 351189 - DNA, 33 bp, Artificial Sequence
  Description of Artificial Sequence: Synthetic oligonucleotide
accgtacagctgttcataagtgtgatgcagcag

SEQ ID NO: 351190 - DNA, 32 bp, Artificial Sequence
  Description of Artificial Sequence: Synthetic oligonucleotide
ccgtacagctgttcataagtgtgatgcagcag

SEQ ID NO: 351191 - DNA, 32 bp, Artificial Sequence
  Description of Artificial Sequence: Synthetic oligonucleotide
cgtacagctgttcataagtgtgatgcagcagc

SEQ ID NO: 351192 - DNA, 33 bp, Artificial Sequence
  Description of Artificial Sequence: Synthetic oligonucleotide
gtacagctgttcataagtgtgatgcagcagcac

SEQ ID NO: 351193 - DNA, 33 bp, Artificial Sequence
  Description of Artificial Sequence: Synthetic oligonucleotide
tacagctgttcataagtgtgatgcagcagcacg

SEQ ID NO: 351194 - DNA, 32 bp, Artificial Sequence
  Description of Artificial Sequence: Synthetic oligonucleotide
acagctgttcataagtgtgatgcagcagcacg

SEQ ID NO: 351195 - DNA, 31 bp, Artificial Sequence
  Description of Artificial Sequence: Synthetic oligonucleotide
cagctgttcataagtgtgatgcagcagcacg

SEQ ID NO: 351196 - DNA, 32 bp, Artificial Sequence
  Description of Artificial Sequence: Synthetic oligonucleotide
agctgttcataagtgtgatgcagcagcacgtc

SEQ ID NO: 351197 - DNA, 31 bp, Artificial Sequence
  Description of Artificial Sequence: Synthetic oligonucleotide
gctgttcataagtgtgatgcagcagcacgtc

SEQ ID NO: 351198 - DNA, 32 bp, Artificial Sequence
  Description of Artificial Sequence: Synthetic oligonucleotide
ctgttcataagtgtgatgcagcagcacgtcac

SEQ ID NO: 351199 - DNA, 33 bp, Artificial Sequence
  Description of Artificial Sequence: Synthetic oligonucleotide
tgttcataagtgtgatgcagcagcacgtcactg

SEQ ID NO: 351200 - DNA, 32 bp, Artificial Sequence
  Description of Artificial Sequence: Synthetic oligonucleotide
gttcataagtgtgatgcagcagcacgtcactg

SEQ ID NO: 351201 - DNA, 34 bp, Artificial Sequence
  Description of Artificial Sequence: Synthetic oligonucleotide
ttcataagtgtgatgcagcagcacgtcactgatg

SEQ ID NO: 351202 - DNA, 33 bp, Artificial Sequence
  Description of Artificial Sequence: Synthetic oligonucleotide
tcataagtgtgatgcagcagcacgtcactgatg

SEQ ID NO: 351203 - DNA, 32 bp, Artificial Sequence
  Description of Artificial Sequence: Synthetic oligonucleotide
cataagtgtgatgcagcagcacgtcactgatg

SEQ ID NO: 351204 - DNA, 32 bp, Artificial Sequence
  Description of Artificial Sequence: Synthetic oligonucleotide
ataagtgtgatgcagcagcacgtcactgatgg

SEQ ID NO: 351205 - DNA, 31 bp, Artificial Sequence
  Description of Artificial Sequence: Synthetic oligonucleotide
taagtgtgatgcagcagcacgtcactgatgg

SEQ ID NO: 351206 - DNA, 30 bp, Artificial Sequence
  Description of Artificial Sequence: Synthetic oligonucleotide
aagtgtgatgcagcagcacgtcactgatgg

SEQ ID NO: 351207 - DNA, 29 bp, Artificial Sequence
  Description of Artificial Sequence: Synthetic oligonucleotide
agtgtgatgcagcagcacgtcactgatgg

SEQ ID NO: 351208 - DNA, 28 bp, Artificial Sequence
  Description of Artificial Sequence: Synthetic oligonucleotide
gtgtgatgcagcagcacgtcactgatgg

SEQ ID NO: 351209 - DNA, 30 bp, Artificial Sequence
  Description of Artificial Sequence: Synthetic oligonucleotide
tgtgatgcagcagcacgtcactgatggaag

SEQ ID NO: 351210 - DNA, 29 bp, Artificial Sequence
  Description of Artificial Sequence: Synthetic oligonucleotide
gtgatgcagcagcacgtcactgatggaag

SEQ ID NO: 351211 - DNA, 31 bp, Artificial Sequence
  Description of Artificial Sequence: Synthetic oligonucleotide
tgatgcagcagcacgtcactgatggaagaag

SEQ ID NO: 351212 - DNA, 30 bp, Artificial Sequence
  Description of Artificial Sequence: Synthetic oligonucleotide
gatgcagcagcacgtcactgatggaagaag

SEQ ID NO: 351213 - DNA, 31 bp, Artificial Sequence
  Description of Artificial Sequence: Synthetic oligonucleotide
atgcagcagcacgtcactgatggaagaagac

SEQ ID NO: 351214 - DNA, 30 bp, Artificial Sequence
  Description of Artificial Sequence: Synthetic oligonucleotide
tgcagcagcacgtcactgatggaagaagac

SEQ ID NO: 351215 - DNA, 29 bp, Artificial Sequence
  Description of Artificial Sequence: Synthetic oligonucleotide
gcagcagcacgtcactgatggaagaagac

SEQ ID NO: 351216 - DNA, 30 bp, Artificial Sequence
  Description of Artificial Sequence: Synthetic oligonucleotide
cagcagcacgtcactgatggaagaagactc

SEQ ID NO: 351217 - DNA, 30 bp, Artificial Sequence
  Description of Artificial Sequence: Synthetic oligonucleotide
agcagcacgtcactgatggaagaagactcc

SEQ ID NO: 351218 - DNA, 29 bp, Artificial Sequence
  Description of Artificial Sequence: Synthetic oligonucleotide
gcagcacgtcactgatggaagaagactcc

SEQ ID NO: 351219 - DNA, 30 bp, Artificial Sequence
  Description of Artificial Sequence: Synthetic oligonucleotide
cagcacgtcactgatggaagaagactcctc

SEQ ID NO: 351220 - DNA, 32 bp, Artificial Sequence
  Description of Artificial Sequence: Synthetic oligonucleotide
agcacgtcactgatggaagaagactcctcatg

SEQ ID NO: 351221 - DNA, 31 bp, Artificial Sequence
  Description of Artificial Sequence: Synthetic oligonucleotide
gcacgtcactgatggaagaagactcctcatg

SEQ ID NO: 351222 - DNA, 32 bp, Artificial Sequence
  Description of Artificial Sequence: Synthetic oligonucleotide
cacgtcactgatggaagaagactcctcatgtc

SEQ ID NO: 351223 - DNA, 32 bp, Artificial Sequence
  Description of Artificial Sequence: Synthetic oligonucleotide
acgtcactgatggaagaagactcctcatgtcc

SEQ ID NO: 351224 - DNA, 31 bp, Artificial Sequence
  Description of Artificial Sequence: Synthetic oligonucleotide
cgtcactgatggaagaagactcctcatgtcc

SEQ ID NO: 351225 - DNA, 35 bp, Artificial Sequence
  Description of Artificial Sequence: Synthetic oligonucleotide
gtcactgatggaagaagactcctcatgtccatatc

SEQ ID NO: 351226 - DNA, 35 bp, Artificial Sequence
  Description of Artificial Sequence: Synthetic oligonucleotide
tcactgatggaagaagactcctcatgtccatatcc

SEQ ID NO: 351227 - DNA, 34 bp, Artificial Sequence
  Description of Artificial Sequence: Synthetic oligonucleotide
cactgatggaagaagactcctcatgtccatatcc

SEQ ID NO: 351228 - DNA, 34 bp, Artificial Sequence
  Description of Artificial Sequence: Synthetic oligonucleotide
actgatggaagaagactcctcatgtccatatccc

SEQ ID NO: 351229 - DNA, 33 bp, Artificial Sequence
  Description of Artificial Sequence: Synthetic oligonucleotide
ctgatggaagaagactcctcatgtccatatccc

SEQ ID NO: 351230 - DNA, 34 bp, Artificial Sequence
  Description of Artificial Sequence: Synthetic oligonucleotide
tgatggaagaagactcctcatgtccatatcccag

SEQ ID NO: 351231 - DNA, 33 bp, Artificial Sequence
  Description of Artificial Sequence: Synthetic oligonucleotide
gatggaagaagactcctcatgtccatatcccag

SEQ ID NO: 351232 - DNA, 35 bp, Artificial Sequence
  Description of Artificial Sequence: Synthetic oligonucleotide
atggaagaagactcctcatgtccatatcccagttg

SEQ ID NO: 351233 - DNA, 34 bp, Artificial Sequence
  Description of Artificial Sequence: Synthetic oligonucleotide
tggaagaagactcctcatgtccatatcccagttg

SEQ ID NO: 351234 - DNA, 33 bp, Artificial Sequence
  Description of Artificial Sequence: Synthetic oligonucleotide
ggaagaagactcctcatgtccatatcccagttg

SEQ ID NO: 351235 - DNA, 34 bp, Artificial Sequence
  Description of Artificial Sequence: Synthetic oligonucleotide
gaagaagactcctcatgtccatatcccagttgtc

SEQ ID NO: 351236 - DNA, 34 bp, Artificial Sequence
  Description of Artificial Sequence: Synthetic oligonucleotide
aagaagactcctcatgtccatatcccagttgtcc

SEQ ID NO: 351237 - DNA, 33 bp, Artificial Sequence
  Description of Artificial Sequence: Synthetic oligonucleotide
agaagactcctcatgtccatatcccagttgtcc

SEQ ID NO: 351238 - DNA, 32 bp, Artificial Sequence
  Description of Artificial Sequence: Synthetic oligonucleotide
gaagactcctcatgtccatatcccagttgtcc

SEQ ID NO: 351239 - DNA, 35 bp, Artificial Sequence
  Description of Artificial Sequence: Synthetic oligonucleotide
aagactcctcatgtccatatcccagttgtccatag

SEQ ID NO: 351240 - DNA, 34 bp, Artificial Sequence
  Description of Artificial Sequence: Synthetic oligonucleotide
agactcctcatgtccatatcccagttgtccatag

SEQ ID NO: 351241 - DNA, 33 bp, Artificial Sequence
  Description of Artificial Sequence: Synthetic oligonucleotide
gactcctcatgtccatatcccagttgtccatag

SEQ ID NO: 351242 - DNA, 34 bp, Artificial Sequence
  Description of Artificial Sequence: Synthetic oligonucleotide
actcctcatgtccatatcccagttgtccatagtg

SEQ ID NO: 351243 - DNA, 33 bp, Artificial Sequence
  Description of Artificial Sequence: Synthetic oligonucleotide
ctcctcatgtccatatcccagttgtccatagtg

SEQ ID NO: 351244 - DNA, 36 bp, Artificial Sequence
  Description of Artificial Sequence: Synthetic oligonucleotide
tcctcatgtccatatcccagttgtccatagtgtatg

SEQ ID NO: 351245 - DNA, 35 bp, Artificial Sequence
  Description of Artificial Sequence: Synthetic oligonucleotide
cctcatgtccatatcccagttgtccatagtgtatg

SEQ ID NO: 351246 - DNA, 35 bp, Artificial Sequence
  Description of Artificial Sequence: Synthetic oligonucleotide
ctcatgtccatatcccagttgtccatagtgtatgg

SEQ ID NO: 351247 - DNA, 36 bp, Artificial Sequence
  Description of Artificial Sequence: Synthetic oligonucleotide
tcatgtccatatcccagttgtccatagtgtatggac

SEQ ID NO: 351248 - DNA, 35 bp, Artificial Sequence
  Description of Artificial Sequence: Synthetic oligonucleotide
catgtccatatcccagttgtccatagtgtatggac

SEQ ID NO: 351249 - DNA, 35 bp, Artificial Sequence
  Description of Artificial Sequence: Synthetic oligonucleotide
atgtccatatcccagttgtccatagtgtatggacc

SEQ ID NO: 351250 - DNA, 34 bp, Artificial Sequence
  Description of Artificial Sequence: Synthetic oligonucleotide
tgtccatatcccagttgtccatagtgtatggacc

SEQ ID NO: 351251 - DNA, 33 bp, Artificial Sequence
  Description of Artificial Sequence: Synthetic oligonucleotide
gtccatatcccagttgtccatagtgtatggacc

SEQ ID NO: 351252 - DNA, 33 bp, Artificial Sequence
  Description of Artificial Sequence: Synthetic oligonucleotide
tccatatcccagttgtccatagtgtatggaccc

SEQ ID NO: 351253 - DNA, 32 bp, Artificial Sequence
  Description of Artificial Sequence: Synthetic oligonucleotide
ccatatcccagttgtccatagtgtatggaccc

SEQ ID NO: 351254 - DNA, 34 bp, Artificial Sequence
  Description of Artificial Sequence: Synthetic oligonucleotide
catatcccagttgtccatagtgtatggacccttg

SEQ ID NO: 351255 - DNA, 34 bp, Artificial Sequence
  Description of Artificial Sequence: Synthetic oligonucleotide
atatcccagttgtccatagtgtatggacccttgc

SEQ ID NO: 351256 - DNA, 33 bp, Artificial Sequence
  Description of Artificial Sequence: Synthetic oligonucleotide
tatcccagttgtccatagtgtatggacccttgc

SEQ ID NO: 351257 - DNA, 32 bp, Artificial Sequence
  Description of Artificial Sequence: Synthetic oligonucleotide
atcccagttgtccatagtgtatggacccttgc

SEQ ID NO: 351258 - DNA, 31 bp, Artificial Sequence
  Description of Artificial Sequence: Synthetic oligonucleotide
tcccagttgtccatagtgtatggacccttgc

SEQ ID NO: 351259 - DNA, 30 bp, Artificial Sequence
  Description of Artificial Sequence: Synthetic oligonucleotide
cccagttgtccatagtgtatggacccttgc

SEQ ID NO: 351260 - DNA, 30 bp, Artificial Sequence
  Description of Artificial Sequence: Synthetic oligonucleotide
ccagttgtccatagtgtatggacccttgcg

SEQ ID NO: 351261 - DNA, 30 bp, Artificial Sequence
  Description of Artificial Sequence: Synthetic oligonucleotide
cagttgtccatagtgtatggacccttgcgc

SEQ ID NO: 351262 - DNA, 31 bp, Artificial Sequence
  Description of Artificial Sequence: Synthetic oligonucleotide
agttgtccatagtgtatggacccttgcgctc

SEQ ID NO: 351263 - DNA, 30 bp, Artificial Sequence
  Description of Artificial Sequence: Synthetic oligonucleotide
gttgtccatagtgtatggacccttgcgctc

SEQ ID NO: 351264 - DNA, 30 bp, Artificial Sequence
  Description of Artificial Sequence: Synthetic oligonucleotide
ttgtccatagtgtatggacccttgcgctcc

SEQ ID NO: 351265 - DNA, 29 bp, Artificial Sequence
  Description of Artificial Sequence: Synthetic oligonucleotide
tgtccatagtgtatggacccttgcgctcc

SEQ ID NO: 351266 - DNA, 28 bp, Artificial Sequence
  Description of Artificial Sequence: Synthetic oligonucleotide
gtccatagtgtatggacccttgcgctcc

SEQ ID NO: 351267 - DNA, 30 bp, Artificial Sequence
  Description of Artificial Sequence: Synthetic oligonucleotide
tccatagtgtatggacccttgcgctccaac

SEQ ID NO: 351268 - DNA, 29 bp, Artificial Sequence
  Description of Artificial Sequence: Synthetic oligonucleotide
ccatagtgtatggacccttgcgctccaac

SEQ ID NO: 351269 - DNA, 31 bp, Artificial Sequence
  Description of Artificial Sequence: Synthetic oligonucleotide
catagtgtatggacccttgcgctccaacatc

SEQ ID NO: 351270 - DNA, 31 bp, Artificial Sequence
  Description of Artificial Sequence: Synthetic oligonucleotide
atagtgtatggacccttgcgctccaacatcc

SEQ ID NO: 351271 - DNA, 30 bp, Artificial Sequence
  Description of Artificial Sequence: Synthetic oligonucleotide
tagtgtatggacccttgcgctccaacatcc

SEQ ID NO: 351272 - DNA, 29 bp, Artificial Sequence
  Description of Artificial Sequence: Synthetic oligonucleotide
agtgtatggacccttgcgctccaacatcc

SEQ ID NO: 351273 - DNA, 28 bp, Artificial Sequence
  Description of Artificial Sequence: Synthetic oligonucleotide
gtgtatggacccttgcgctccaacatcc

SEQ ID NO: 351274 - DNA, 30 bp, Artificial Sequence
  Description of Artificial Sequence: Synthetic oligonucleotide
tgtatggacccttgcgctccaacatccttg

SEQ ID NO: 351275 - DNA, 29 bp, Artificial Sequence
  Description of Artificial Sequence: Synthetic oligonucleotide
gtatggacccttgcgctccaacatccttg

SEQ ID NO: 351276 - DNA, 29 bp, Artificial Sequence
  Description of Artificial Sequence: Synthetic oligonucleotide
tatggacccttgcgctccaacatccttgc

SEQ ID NO: 351277 - DNA, 28 bp, Artificial Sequence
  Description of Artificial Sequence: Synthetic oligonucleotide
atggacccttgcgctccaacatccttgc

SEQ ID NO: 351278 - DNA, 27 bp, Artificial Sequence
  Description of Artificial Sequence: Synthetic oligonucleotide
tggacccttgcgctccaacatccttgc

SEQ ID NO: 351279 - DNA, 26 bp, Artificial Sequence
  Description of Artificial Sequence: Synthetic oligonucleotide
ggacccttgcgctccaacatccttgc

SEQ ID NO: 351280 - DNA, 27 bp, Artificial Sequence
  Description of Artificial Sequence: Synthetic oligonucleotide
gacccttgcgctccaacatccttgcca

SEQ ID NO: 351281 - DNA, 28 bp, Artificial Sequence
  Description of Artificial Sequence: Synthetic oligonucleotide
acccttgcgctccaacatccttgccatc

SEQ ID NO: 351282 - DNA, 27 bp, Artificial Sequence
  Description of Artificial Sequence: Synthetic oligonucleotide
cccttgcgctccaacatccttgccatc

SEQ ID NO: 351283 - DNA, 32 bp, Artificial Sequence
  Description of Artificial Sequence: Synthetic oligonucleotide
ccttgcgctccaacatccttgccatcaaattc

SEQ ID NO: 351284 - DNA, 34 bp, Artificial Sequence
  Description of Artificial Sequence: Synthetic oligonucleotide
cttgcgctccaacatccttgccatcaaattcaag

SEQ ID NO: 351285 - DNA, 36 bp, Artificial Sequence
  Description of Artificial Sequence: Synthetic oligonucleotide
ttgcgctccaacatccttgccatcaaattcaagtac

SEQ ID NO: 351286 - DNA, 35 bp, Artificial Sequence
  Description of Artificial Sequence: Synthetic oligonucleotide
tgcgctccaacatccttgccatcaaattcaagtac

SEQ ID NO: 351287 - DNA, 34 bp, Artificial Sequence
  Description of Artificial Sequence: Synthetic oligonucleotide
gcgctccaacatccttgccatcaaattcaagtac

SEQ ID NO: 351288 - DNA, 34 bp, Artificial Sequence
  Description of Artificial Sequence: Synthetic oligonucleotide
cgctccaacatccttgccatcaaattcaagtacg

SEQ ID NO: 351289 - DNA, 36 bp, Artificial Sequence
  Description of Artificial Sequence: Synthetic oligonucleotide
gctccaacatccttgccatcaaattcaagtacgttg

SEQ ID NO: 351290 - DNA, 37 bp, Artificial Sequence
  Description of Artificial Sequence: Synthetic oligonucleotide
ctccaacatccttgccatcaaattcaagtacgttgag

SEQ ID NO: 351291 - DNA, 40 bp, Artificial Sequence
  Description of Artificial Sequence: Synthetic oligonucleotide
tccaacatccttgccatcaaattcaagtacgttgagtatg

SEQ ID NO: 351292 - DNA, 39 bp, Artificial Sequence
  Description of Artificial Sequence: Synthetic oligonucleotide
ccaacatccttgccatcaaattcaagtacgttgagtatg

SEQ ID NO: 351293 - DNA, 41 bp, Artificial Sequence
  Description of Artificial Sequence: Synthetic oligonucleotide
caacatccttgccatcaaattcaagtacgttgagtatgatg

SEQ ID NO: 351294 - DNA, 42 bp, Artificial Sequence
  Description of Artificial Sequence: Synthetic oligonucleotide
aacatccttgccatcaaattcaagtacgttgagtatgatgtc

SEQ ID NO: 351295 - DNA, 41 bp, Artificial Sequence
  Description of Artificial Sequence: Synthetic oligonucleotide
acatccttgccatcaaattcaagtacgttgagtatgatgtc

SEQ ID NO: 351296 - DNA, 40 bp, Artificial Sequence
  Description of Artificial Sequence: Synthetic oligonucleotide
catccttgccatcaaattcaagtacgttgagtatgatgtc

SEQ ID NO: 351297 - DNA, 43 bp, Artificial Sequence
  Description of Artificial Sequence: Synthetic oligonucleotide
atccttgccatcaaattcaagtacgttgagtatgatgtcaaag

SEQ ID NO: 351298 - DNA, 42 bp, Artificial Sequence
  Description of Artificial Sequence: Synthetic oligonucleotide
tccttgccatcaaattcaagtacgttgagtatgatgtcaaag

SEQ ID NO: 351299 - DNA, 41 bp, Artificial Sequence
  Description of Artificial Sequence: Synthetic oligonucleotide
ccttgccatcaaattcaagtacgttgagtatgatgtcaaag

SEQ ID NO: 351300 - DNA, 42 bp, Artificial Sequence
  Description of Artificial Sequence: Synthetic oligonucleotide
cttgccatcaaattcaagtacgttgagtatgatgtcaaagtg

SEQ ID NO: 351301 - DNA, 44 bp, Artificial Sequence
  Description of Artificial Sequence: Synthetic oligonucleotide
ttgccatcaaattcaagtacgttgagtatgatgtcaaagtgtag

SEQ ID NO: 351302 - DNA, 43 bp, Artificial Sequence
  Description of Artificial Sequence: Synthetic oligonucleotide
tgccatcaaattcaagtacgttgagtatgatgtcaaagtgtag

SEQ ID NO: 351303 - DNA, 42 bp, Artificial Sequence
  Description of Artificial Sequence: Synthetic oligonucleotide
gccatcaaattcaagtacgttgagtatgatgtcaaagtgtag

SEQ ID NO: 351304 - DNA, 42 bp, Artificial Sequence
  Description of Artificial Sequence: Synthetic oligonucleotide
ccatcaaattcaagtacgttgagtatgatgtcaaagtgtagc

SEQ ID NO: 351305 - DNA, 42 bp, Artificial Sequence
  Description of Artificial Sequence: Synthetic oligonucleotide
catcaaattcaagtacgttgagtatgatgtcaaagtgtagcc

SEQ ID NO: 351306 - DNA, 43 bp, Artificial Sequence
  Description of Artificial Sequence: Synthetic oligonucleotide
atcaaattcaagtacgttgagtatgatgtcaaagtgtagcctc

SEQ ID NO: 351307 - DNA, 42 bp, Artificial Sequence
  Description of Artificial Sequence: Synthetic oligonucleotide
tcaaattcaagtacgttgagtatgatgtcaaagtgtagcctc

SEQ ID NO: 351308 - DNA, 41 bp, Artificial Sequence
  Description of Artificial Sequence: Synthetic oligonucleotide
caaattcaagtacgttgagtatgatgtcaaagtgtagcctc

SEQ ID NO: 351309 - DNA, 42 bp, Artificial Sequence
  Description of Artificial Sequence: Synthetic oligonucleotide
aaattcaagtacgttgagtatgatgtcaaagtgtagcctctg

SEQ ID NO: 351310 - DNA, 41 bp, Artificial Sequence
  Description of Artificial Sequence: Synthetic oligonucleotide
aattcaagtacgttgagtatgatgtcaaagtgtagcctctg

SEQ ID NO: 351311 - DNA, 40 bp, Artificial Sequence
  Description of Artificial Sequence: Synthetic oligonucleotide
attcaagtacgttgagtatgatgtcaaagtgtagcctctg

SEQ ID NO: 351312 - DNA, 39 bp, Artificial Sequence
  Description of Artificial Sequence: Synthetic oligonucleotide
ttcaagtacgttgagtatgatgtcaaagtgtagcctctg

SEQ ID NO: 351313 - DNA, 38 bp, Artificial Sequence
  Description of Artificial Sequence: Synthetic oligonucleotide
tcaagtacgttgagtatgatgtcaaagtgtagcctctg

SEQ ID NO: 351314 - DNA, 37 bp, Artificial Sequence
  Description of Artificial Sequence: Synthetic oligonucleotide
caagtacgttgagtatgatgtcaaagtgtagcctctg

SEQ ID NO: 351315 - DNA, 37 bp, Artificial Sequence
  Description of Artificial Sequence: Synthetic oligonucleotide
aagtacgttgagtatgatgtcaaagtgtagcctctgg

SEQ ID NO: 351316 - DNA, 36 bp, Artificial Sequence
  Description of Artificial Sequence: Synthetic oligonucleotide
agtacgttgagtatgatgtcaaagtgtagcctctgg

SEQ ID NO: 351317 - DNA, 35 bp, Artificial Sequence
  Description of Artificial Sequence: Synthetic oligonucleotide
gtacgttgagtatgatgtcaaagtgtagcctctgg

SEQ ID NO: 351318 - DNA, 35 bp, Artificial Sequence
  Description of Artificial Sequence: Synthetic oligonucleotide
tacgttgagtatgatgtcaaagtgtagcctctggg

SEQ ID NO: 351319 - DNA, 34 bp, Artificial Sequence
  Description of Artificial Sequence: Synthetic oligonucleotide
acgttgagtatgatgtcaaagtgtagcctctggg

SEQ ID NO: 351320 - DNA, 33 bp, Artificial Sequence
  Description of Artificial Sequence: Synthetic oligonucleotide
cgttgagtatgatgtcaaagtgtagcctctggg

SEQ ID NO: 351321 - DNA, 33 bp, Artificial Sequence
  Description of Artificial Sequence: Synthetic oligonucleotide
gttgagtatgatgtcaaagtgtagcctctgggc

SEQ ID NO: 351322 - DNA, 36 bp, Artificial Sequence
  Description of Artificial Sequence: Synthetic oligonucleotide
ttgagtatgatgtcaaagtgtagcctctgggctatg

SEQ ID NO: 351323 - DNA, 35 bp, Artificial Sequence
  Description of Artificial Sequence: Synthetic oligonucleotide
tgagtatgatgtcaaagtgtagcctctgggctatg

SEQ ID NO: 351324 - DNA, 34 bp, Artificial Sequence
  Description of Artificial Sequence: Synthetic oligonucleotide
gagtatgatgtcaaagtgtagcctctgggctatg

SEQ ID NO: 351325 - DNA, 35 bp, Artificial Sequence
  Description of Artificial Sequence: Synthetic oligonucleotide
agtatgatgtcaaagtgtagcctctgggctatgtc

SEQ ID NO: 351326 - DNA, 34 bp, Artificial Sequence
  Description of Artificial Sequence: Synthetic oligonucleotide
gtatgatgtcaaagtgtagcctctgggctatgtc

SEQ ID NO: 351327 - DNA, 35 bp, Artificial Sequence
  Description of Artificial Sequence: Synthetic oligonucleotide
tatgatgtcaaagtgtagcctctgggctatgtctg

SEQ ID NO: 351328 - DNA, 34 bp, Artificial Sequence
  Description of Artificial Sequence: Synthetic oligonucleotide
atgatgtcaaagtgtagcctctgggctatgtctg

SEQ ID NO: 351329 - DNA, 33 bp, Artificial Sequence
  Description of Artificial Sequence: Synthetic oligonucleotide
tgatgtcaaagtgtagcctctgggctatgtctg

SEQ ID NO: 351330 - DNA, 32 bp, Artificial Sequence
  Description of Artificial Sequence: Synthetic oligonucleotide
gatgtcaaagtgtagcctctgggctatgtctg

SEQ ID NO: 351331 - DNA, 35 bp, Artificial Sequence
  Description of Artificial Sequence: Synthetic oligonucleotide
atgtcaaagtgtagcctctgggctatgtctgaatc

SEQ ID NO: 351332 - DNA, 34 bp, Artificial Sequence
  Description of Artificial Sequence: Synthetic oligonucleotide
tgtcaaagtgtagcctctgggctatgtctgaatc

SEQ ID NO: 351333 - DNA, 33 bp, Artificial Sequence
  Description of Artificial Sequence: Synthetic oligonucleotide
gtcaaagtgtagcctctgggctatgtctgaatc

SEQ ID NO: 351334 - DNA, 35 bp, Artificial Sequence
  Description of Artificial Sequence: Synthetic oligonucleotide
tcaaagtgtagcctctgggctatgtctgaatcttc

SEQ ID NO: 351335 - DNA, 34 bp, Artificial Sequence
  Description of Artificial Sequence: Synthetic oligonucleotide
caaagtgtagcctctgggctatgtctgaatcttc

SEQ ID NO: 351336 - DNA, 34 bp, Artificial Sequence
  Description of Artificial Sequence: Synthetic oligonucleotide
aaagtgtagcctctgggctatgtctgaatcttcc

SEQ ID NO: 351337 - DNA, 33 bp, Artificial Sequence
  Description of Artificial Sequence: Synthetic oligonucleotide
aagtgtagcctctgggctatgtctgaatcttcc

SEQ ID NO: 351338 - DNA, 32 bp, Artificial Sequence
  Description of Artificial Sequence: Synthetic oligonucleotide
agtgtagcctctgggctatgtctgaatcttcc

SEQ ID NO: 351339 - DNA, 31 bp, Artificial Sequence
  Description of Artificial Sequence: Synthetic oligonucleotide
gtgtagcctctgggctatgtctgaatcttcc

SEQ ID NO: 351340 - DNA, 32 bp, Artificial Sequence
  Description of Artificial Sequence: Synthetic oligonucleotide
tgtagcctctgggctatgtctgaatcttcctg

SEQ ID NO: 351341 - DNA, 31 bp, Artificial Sequence
  Description of Artificial Sequence: Synthetic oligonucleotide
gtagcctctgggctatgtctgaatcttcctg

SEQ ID NO: 351342 - DNA, 32 bp, Artificial Sequence
  Description of Artificial Sequence: Synthetic oligonucleotide
tagcctctgggctatgtctgaatcttcctgag

SEQ ID NO: 351343 - DNA, 31 bp, Artificial Sequence
  Description of Artificial Sequence: Synthetic oligonucleotide
agcctctgggctatgtctgaatcttcctgag

SEQ ID NO: 351344 - DNA, 30 bp, Artificial Sequence
  Description of Artificial Sequence: Synthetic oligonucleotide
gcctctgggctatgtctgaatcttcctgag

SEQ ID NO: 351345 - DNA, 30 bp, Artificial Sequence
  Description of Artificial Sequence: Synthetic oligonucleotide
cctctgggctatgtctgaatcttcctgagg

SEQ ID NO: 351346 - DNA, 31 bp, Artificial Sequence
  Description of Artificial Sequence: Synthetic oligonucleotide
ctctgggctatgtctgaatcttcctgaggag

SEQ ID NO: 351347 - DNA, 31 bp, Artificial Sequence
  Description of Artificial Sequence: Synthetic oligonucleotide
tctgggctatgtctgaatcttcctgaggagg

SEQ ID NO: 351348 - DNA, 30 bp, Artificial Sequence
  Description of Artificial Sequence: Synthetic oligonucleotide
ctgggctatgtctgaatcttcctgaggagg

SEQ ID NO: 351349 - DNA, 31 bp, Artificial Sequence
  Description of Artificial Sequence: Synthetic oligonucleotide
tgggctatgtctgaatcttcctgaggaggag

SEQ ID NO: 351350 - DNA, 30 bp, Artificial Sequence
  Description of Artificial Sequence: Synthetic oligonucleotide
gggctatgtctgaatcttcctgaggaggag

SEQ ID NO: 351351 - DNA, 30 bp, Artificial Sequence
  Description of Artificial Sequence: Synthetic oligonucleotide
ggctatgtctgaatcttcctgaggaggagc

SEQ ID NO: 351352 - DNA, 33 bp, Artificial Sequence
  Description of Artificial Sequence: Synthetic oligonucleotide
gctatgtctgaatcttcctgaggaggagctatg

SEQ ID NO: 351353 - DNA, 34 bp, Artificial Sequence
  Description of Artificial Sequence: Synthetic oligonucleotide
ctatgtctgaatcttcctgaggaggagctatgag

SEQ ID NO: 351354 - DNA, 37 bp, Artificial Sequence
  Description of Artificial Sequence: Synthetic oligonucleotide
tatgtctgaatcttcctgaggaggagctatgagattg

SEQ ID NO: 351355 - DNA, 36 bp, Artificial Sequence
  Description of Artificial Sequence: Synthetic oligonucleotide
atgtctgaatcttcctgaggaggagctatgagattg

SEQ ID NO: 351356 - DNA, 35 bp, Artificial Sequence
  Description of Artificial Sequence: Synthetic oligonucleotide
tgtctgaatcttcctgaggaggagctatgagattg

SEQ ID NO: 351357 - DNA, 34 bp, Artificial Sequence
  Description of Artificial Sequence: Synthetic oligonucleotide
gtctgaatcttcctgaggaggagctatgagattg

SEQ ID NO: 351358 - DNA, 34 bp, Artificial Sequence
  Description of Artificial Sequence: Synthetic oligonucleotide
tctgaatcttcctgaggaggagctatgagattgc

SEQ ID NO: 351359 - DNA, 33 bp, Artificial Sequence
  Description of Artificial Sequence: Synthetic oligonucleotide
ctgaatcttcctgaggaggagctatgagattgc

SEQ ID NO: 351360 - DNA, 33 bp, Artificial Sequence
  Description of Artificial Sequence: Synthetic oligonucleotide
tgaatcttcctgaggaggagctatgagattgcg

SEQ ID NO: 351361 - DNA, 32 bp, Artificial Sequence
  Description of Artificial Sequence: Synthetic oligonucleotide
gaatcttcctgaggaggagctatgagattgcg

SEQ ID NO: 351362 - DNA, 33 bp, Artificial Sequence
  Description of Artificial Sequence: Synthetic oligonucleotide
aatcttcctgaggaggagctatgagattgcgac

SEQ ID NO: 351363 - DNA, 32 bp, Artificial Sequence
  Description of Artificial Sequence: Synthetic oligonucleotide
atcttcctgaggaggagctatgagattgcgac

SEQ ID NO: 351364 - DNA, 31 bp, Artificial Sequence
  Description of Artificial Sequence: Synthetic oligonucleotide
tcttcctgaggaggagctatgagattgcgac

SEQ ID NO: 351365 - DNA, 30 bp, Artificial Sequence
  Description of Artificial Sequence: Synthetic oligonucleotide
cttcctgaggaggagctatgagattgcgac

SEQ ID NO: 351366 - DNA, 31 bp, Artificial Sequence
  Description of Artificial Sequence: Synthetic oligonucleotide
ttcctgaggaggagctatgagattgcgactc

SEQ ID NO: 351367 - DNA, 30 bp, Artificial Sequence
  Description of Artificial Sequence: Synthetic oligonucleotide
tcctgaggaggagctatgagattgcgactc

SEQ ID NO: 351368 - DNA, 29 bp, Artificial Sequence
  Description of Artificial Sequence: Synthetic oligonucleotide
cctgaggaggagctatgagattgcgactc

SEQ ID NO: 351369 - DNA, 29 bp, Artificial Sequence
  Description of Artificial Sequence: Synthetic oligonucleotide
ctgaggaggagctatgagattgcgactcg

SEQ ID NO: 351370 - DNA, 30 bp, Artificial Sequence
  Description of Artificial Sequence: Synthetic oligonucleotide
tgaggaggagctatgagattgcgactcgag

SEQ ID NO: 351371 - DNA, 29 bp, Artificial Sequence
  Description of Artificial Sequence: Synthetic oligonucleotide
gaggaggagctatgagattgcgactcgag

SEQ ID NO: 351372 - DNA, 31 bp, Artificial Sequence
  Description of Artificial Sequence: Synthetic oligonucleotide
aggaggagctatgagattgcgactcgagttc

SEQ ID NO: 351373 - DNA, 30 bp, Artificial Sequence
  Description of Artificial Sequence: Synthetic oligonucleotide
ggaggagctatgagattgcgactcgagttc

SEQ ID NO: 351374 - DNA, 32 bp, Artificial Sequence
  Description of Artificial Sequence: Synthetic oligonucleotide
gaggagctatgagattgcgactcgagttctag

SEQ ID NO: 351375 - DNA, 33 bp, Artificial Sequence
  Description of Artificial Sequence: Synthetic oligonucleotide
aggagctatgagattgcgactcgagttctagtc

SEQ ID NO: 351376 - DNA, 32 bp, Artificial Sequence
  Description of Artificial Sequence: Synthetic oligonucleotide
ggagctatgagattgcgactcgagttctagtc

SEQ ID NO: 351377 - DNA, 32 bp, Artificial Sequence
  Description of Artificial Sequence: Synthetic oligonucleotide
gagctatgagattgcgactcgagttctagtcc

SEQ ID NO: 351378 - DNA, 33 bp, Artificial Sequence
  Description of Artificial Sequence: Synthetic oligonucleotide
agctatgagattgcgactcgagttctagtcctg

SEQ ID NO: 351379 - DNA, 32 bp, Artificial Sequence
  Description of Artificial Sequence: Synthetic oligonucleotide
gctatgagattgcgactcgagttctagtcctg

SEQ ID NO: 351380 - DNA, 32 bp, Artificial Sequence
  Description of Artificial Sequence: Synthetic oligonucleotide
ctatgagattgcgactcgagttctagtcctgg

SEQ ID NO: 351381 - DNA, 33 bp, Artificial Sequence
  Description of Artificial Sequence: Synthetic oligonucleotide
tatgagattgcgactcgagttctagtcctggac

SEQ ID NO: 351382 - DNA, 32 bp, Artificial Sequence
  Description of Artificial Sequence: Synthetic oligonucleotide
atgagattgcgactcgagttctagtcctggac

SEQ ID NO: 351383 - DNA, 31 bp, Artificial Sequence
  Description of Artificial Sequence: Synthetic oligonucleotide
tgagattgcgactcgagttctagtcctggac

SEQ ID NO: 351384 - DNA, 30 bp, Artificial Sequence
  Description of Artificial Sequence: Synthetic oligonucleotide
gagattgcgactcgagttctagtcctggac

SEQ ID NO: 351385 - DNA, 30 bp, Artificial Sequence
  Description of Artificial Sequence: Synthetic oligonucleotide
agattgcgactcgagttctagtcctggacc

SEQ ID NO: 351386 - DNA, 29 bp, Artificial Sequence
  Description of Artificial Sequence: Synthetic oligonucleotide
gattgcgactcgagttctagtcctggacc

SEQ ID NO: 351387 - DNA, 30 bp, Artificial Sequence
  Description of Artificial Sequence: Synthetic oligonucleotide
attgcgactcgagttctagtcctggacctc

SEQ ID NO: 351388 - DNA, 29 bp, Artificial Sequence
  Description of Artificial Sequence: Synthetic oligonucleotide
ttgcgactcgagttctagtcctggacctc

SEQ ID NO: 351389 - DNA, 28 bp, Artificial Sequence
  Description of Artificial Sequence: Synthetic oligonucleotide
tgcgactcgagttctagtcctggacctc

SEQ ID NO: 351390 - DNA, 27 bp, Artificial Sequence
  Description of Artificial Sequence: Synthetic oligonucleotide
gcgactcgagttctagtcctggacctc

SEQ ID NO: 351391 - DNA, 31 bp, Artificial Sequence
  Description of Artificial Sequence: Synthetic oligonucleotide
cgactcgagttctagtcctggacctctttac

SEQ ID NO: 351392 - DNA, 31 bp, Artificial Sequence
  Description of Artificial Sequence: Synthetic oligonucleotide
gactcgagttctagtcctggacctctttacg

SEQ ID NO: 351393 - DNA, 32 bp, Artificial Sequence
  Description of Artificial Sequence: Synthetic oligonucleotide
actcgagttctagtcctggacctctttacgtc

SEQ ID NO: 351394 - DNA, 31 bp, Artificial Sequence
  Description of Artificial Sequence: Synthetic oligonucleotide
ctcgagttctagtcctggacctctttacgtc

SEQ ID NO: 351395 - DNA, 31 bp, Artificial Sequence
  Description of Artificial Sequence: Synthetic oligonucleotide
tcgagttctagtcctggacctctttacgtcc

SEQ ID NO: 351396 - DNA, 30 bp, Artificial Sequence
  Description of Artificial Sequence: Synthetic oligonucleotide
cgagttctagtcctggacctctttacgtcc

SEQ ID NO: 351397 - DNA, 30 bp, Artificial Sequence
  Description of Artificial Sequence: Synthetic oligonucleotide
gagttctagtcctggacctctttacgtccg

SEQ ID NO: 351398 - DNA, 31 bp, Artificial Sequence
  Description of Artificial Sequence: Synthetic oligonucleotide
agttctagtcctggacctctttacgtccgtc

SEQ ID NO: 351399 - DNA, 30 bp, Artificial Sequence
  Description of Artificial Sequence: Synthetic oligonucleotide
gttctagtcctggacctctttacgtccgtc

SEQ ID NO: 351400 - DNA, 30 bp, Artificial Sequence
  Description of Artificial Sequence: Synthetic oligonucleotide
ttctagtcctggacctctttacgtccgtcc

SEQ ID NO: 351401 - DNA, 29 bp, Artificial Sequence
  Description of Artificial Sequence: Synthetic oligonucleotide
tctagtcctggacctctttacgtccgtcc

SEQ ID NO: 351402 - DNA, 28 bp, Artificial Sequence
  Description of Artificial Sequence: Synthetic oligonucleotide
ctagtcctggacctctttacgtccgtcc

SEQ ID NO: 351403 - DNA, 29 bp, Artificial Sequence
  Description of Artificial Sequence: Synthetic oligonucleotide
tagtcctggacctctttacgtccgtcctg

SEQ ID NO: 351404 - DNA, 28 bp, Artificial Sequence
  Description of Artificial Sequence: Synthetic oligonucleotide
agtcctggacctctttacgtccgtcctg

SEQ ID NO: 351405 - DNA, 27 bp, Artificial Sequence
  Description of Artificial Sequence: Synthetic oligonucleotide
gtcctggacctctttacgtccgtcctg

SEQ ID NO: 351406 - DNA, 29 bp, Artificial Sequence
  Description of Artificial Sequence: Synthetic oligonucleotide
tcctggacctctttacgtccgtcctgtag

SEQ ID NO: 351407 - DNA, 28 bp, Artificial Sequence
  Description of Artificial Sequence: Synthetic oligonucleotide
cctggacctctttacgtccgtcctgtag

SEQ ID NO: 351408 - DNA, 29 bp, Artificial Sequence
  Description of Artificial Sequence: Synthetic oligonucleotide
ctggacctctttacgtccgtcctgtagac

SEQ ID NO: 351409 - DNA, 29 bp, Artificial Sequence
  Description of Artificial Sequence: Synthetic oligonucleotide
tggacctctttacgtccgtcctgtagacc

SEQ ID NO: 351410 - DNA, 28 bp, Artificial Sequence
  Description of Artificial Sequence: Synthetic oligonucleotide
ggacctctttacgtccgtcctgtagacc

SEQ ID NO: 351411 - DNA, 29 bp, Artificial Sequence
  Description of Artificial Sequence: Synthetic oligonucleotide
gacctctttacgtccgtcctgtagacctg

SEQ ID NO: 351412 - DNA, 29 bp, Artificial Sequence
  Description of Artificial Sequence: Synthetic oligonucleotide
acctctttacgtccgtcctgtagacctgg

SEQ ID NO: 351413 - DNA, 28 bp, Artificial Sequence
  Description of Artificial Sequence: Synthetic oligonucleotide
cctctttacgtccgtcctgtagacctgg

SEQ ID NO: 351414 - DNA, 28 bp, Artificial Sequence
  Description of Artificial Sequence: Synthetic oligonucleotide
ctctttacgtccgtcctgtagacctggg

SEQ ID NO: 351415 - DNA, 29 bp, Artificial Sequence
  Description of Artificial Sequence: Synthetic oligonucleotide
tctttacgtccgtcctgtagacctgggag

SEQ ID NO: 351416 - DNA, 28 bp, Artificial Sequence
  Description of Artificial Sequence: Synthetic oligonucleotide
ctttacgtccgtcctgtagacctgggag

SEQ ID NO: 351417 - DNA, 28 bp, Artificial Sequence
  Description of Artificial Sequence: Synthetic oligonucleotide
tttacgtccgtcctgtagacctgggagg

SEQ ID NO: 351418 - DNA, 27 bp, Artificial Sequence
  Description of Artificial Sequence: Synthetic oligonucleotide
ttacgtccgtcctgtagacctgggagg

SEQ ID NO: 351419 - DNA, 27 bp, Artificial Sequence
  Description of Artificial Sequence: Synthetic oligonucleotide
tacgtccgtcctgtagacctgggaggt

SEQ ID NO: 351420 - DNA, 26 bp, Artificial Sequence
  Description of Artificial Sequence: Synthetic oligonucleotide
acgtccgtcctgtagacctgggaggt

SEQ ID NO: 351421 - DNA, 25 bp, Artificial Sequence
  Description of Artificial Sequence: Synthetic oligonucleotide
cgtccgtcctgtagacctgggaggt

SEQ ID NO: 351422 - DNA, 25 bp, Artificial Sequence
  Description of Artificial Sequence: Synthetic oligonucleotide
gtccgtcctgtagacctgggaggtg

SEQ ID NO: 351423 - DNA, 27 bp, Artificial Sequence
  Description of Artificial Sequence: Synthetic oligonucleotide
tccgtcctgtagacctgggaggtggtt

SEQ ID NO: 351424 - DNA, 27 bp, Artificial Sequence
  Description of Artificial Sequence: Synthetic oligonucleotide
ccgtcctgtagacctgggaggtggtta

SEQ ID NO: 351425 - DNA, 32 bp, Artificial Sequence
  Description of Artificial Sequence: Synthetic oligonucleotide
cgtcctgtagacctgggaggtggttattatac

SEQ ID NO: 351426 - DNA, 33 bp, Artificial Sequence
  Description of Artificial Sequence: Synthetic oligonucleotide
gtcctgtagacctgggaggtggttattatactc

SEQ ID NO: 351427 - DNA, 35 bp, Artificial Sequence
  Description of Artificial Sequence: Synthetic oligonucleotide
tcctgtagacctgggaggtggttattatactcatc

SEQ ID NO: 351428 - DNA, 34 bp, Artificial Sequence
  Description of Artificial Sequence: Synthetic oligonucleotide
cctgtagacctgggaggtggttattatactcatc

SEQ ID NO: 351429 - DNA, 36 bp, Artificial Sequence
  Description of Artificial Sequence: Synthetic oligonucleotide
ctgtagacctgggaggtggttattatactcatctac

SEQ ID NO: 351430 - DNA, 38 bp, Artificial Sequence
  Description of Artificial Sequence: Synthetic oligonucleotide
tgtagacctgggaggtggttattatactcatctacttc

SEQ ID NO: 351431 - DNA, 37 bp, Artificial Sequence
  Description of Artificial Sequence: Synthetic oligonucleotide
gtagacctgggaggtggttattatactcatctacttc

SEQ ID NO: 351432 - DNA, 39 bp, Artificial Sequence
  Description of Artificial Sequence: Synthetic oligonucleotide
tagacctgggaggtggttattatactcatctacttcttc

SEQ ID NO: 351433 - DNA, 38 bp, Artificial Sequence
  Description of Artificial Sequence: Synthetic oligonucleotide
agacctgggaggtggttattatactcatctacttcttc

SEQ ID NO: 351434 - DNA, 37 bp, Artificial Sequence
  Description of Artificial Sequence: Synthetic oligonucleotide
gacctgggaggtggttattatactcatctacttcttc

SEQ ID NO: 351435 - DNA, 38 bp, Artificial Sequence
  Description of Artificial Sequence: Synthetic oligonucleotide
acctgggaggtggttattatactcatctacttcttcac

SEQ ID NO: 351436 - DNA, 37 bp, Artificial Sequence
  Description of Artificial Sequence: Synthetic oligonucleotide
cctgggaggtggttattatactcatctacttcttcac

SEQ ID NO: 351437 - DNA, 40 bp, Artificial Sequence
  Description of Artificial Sequence: Synthetic oligonucleotide
ctgggaggtggttattatactcatctacttcttcactttc

SEQ ID NO: 351438 - DNA, 42 bp, Artificial Sequence
  Description of Artificial Sequence: Synthetic oligonucleotide
tgggaggtggttattatactcatctacttcttcactttcttc

SEQ ID NO: 351439 - DNA, 41 bp, Artificial Sequence
  Description of Artificial Sequence: Synthetic oligonucleotide
gggaggtggttattatactcatctacttcttcactttcttc

SEQ ID NO: 351440 - DNA, 43 bp, Artificial Sequence
  Description of Artificial Sequence: Synthetic oligonucleotide
ggaggtggttattatactcatctacttcttcactttcttcttc

SEQ ID NO: 351441 - DNA, 45 bp, Artificial Sequence
  Description of Artificial Sequence: Synthetic oligonucleotide
gaggtggttattatactcatctacttcttcactttcttcttctac

SEQ ID NO: 351442 - DNA, 45 bp, Artificial Sequence
  Description of Artificial Sequence: Synthetic oligonucleotide
aggtggttattatactcatctacttcttcactttcttcttctacc

SEQ ID NO: 351443 - DNA, 44 bp, Artificial Sequence
  Description of Artificial Sequence: Synthetic oligonucleotide
ggtggttattatactcatctacttcttcactttcttcttctacc

SEQ ID NO: 351444 - DNA, 44 bp, Artificial Sequence
  Description of Artificial Sequence: Synthetic oligonucleotide
gtggttattatactcatctacttcttcactttcttcttctaccc

SEQ ID NO: 351445 - DNA, 44 bp, Artificial Sequence
  Description of Artificial Sequence: Synthetic oligonucleotide
tggttattatactcatctacttcttcactttcttcttctacccc

SEQ ID NO: 351446 - DNA, 43 bp, Artificial Sequence
  Description of Artificial Sequence: Synthetic oligonucleotide
ggttattatactcatctacttcttcactttcttcttctacccc

SEQ ID NO: 351447 - DNA, 44 bp, Artificial Sequence
  Description of Artificial Sequence: Synthetic oligonucleotide
gttattatactcatctacttcttcactttcttcttctacccctg

SEQ ID NO: 351448 - DNA, 44 bp, Artificial Sequence
  Description of Artificial Sequence: Synthetic oligonucleotide
ttattatactcatctacttcttcactttcttcttctacccctgg

SEQ ID NO: 351449 - DNA, 43 bp, Artificial Sequence
  Description of Artificial Sequence: Synthetic oligonucleotide
tattatactcatctacttcttcactttcttcttctacccctgg

SEQ ID NO: 351450 - DNA, 42 bp, Artificial Sequence
  Description of Artificial Sequence: Synthetic oligonucleotide
attatactcatctacttcttcactttcttcttctacccctgg

SEQ ID NO: 351451 - DNA, 41 bp, Artificial Sequence
  Description of Artificial Sequence: Synthetic oligonucleotide
ttatactcatctacttcttcactttcttcttctacccctgg

SEQ ID NO: 351452 - DNA, 40 bp, Artificial Sequence
  Description of Artificial Sequence: Synthetic oligonucleotide
tatactcatctacttcttcactttcttcttctacccctgg

SEQ ID NO: 351453 - DNA, 39 bp, Artificial Sequence
  Description of Artificial Sequence: Synthetic oligonucleotide
atactcatctacttcttcactttcttcttctacccctgg

SEQ ID NO: 351454 - DNA, 38 bp, Artificial Sequence
  Description of Artificial Sequence: Synthetic oligonucleotide
tactcatctacttcttcactttcttcttctacccctgg

SEQ ID NO: 351455 - DNA, 37 bp, Artificial Sequence
  Description of Artificial Sequence: Synthetic oligonucleotide
actcatctacttcttcactttcttcttctacccctgg

SEQ ID NO: 351456 - DNA, 36 bp, Artificial Sequence
  Description of Artificial Sequence: Synthetic oligonucleotide
ctcatctacttcttcactttcttcttctacccctgg

SEQ ID NO: 351457 - DNA, 38 bp, Artificial Sequence
  Description of Artificial Sequence: Synthetic oligonucleotide
tcatctacttcttcactttcttcttctacccctggttc

SEQ ID NO: 351458 - DNA, 37 bp, Artificial Sequence
  Description of Artificial Sequence: Synthetic oligonucleotide
catctacttcttcactttcttcttctacccctggttc

SEQ ID NO: 351459 - DNA, 37 bp, Artificial Sequence
  Description of Artificial Sequence: Synthetic oligonucleotide
atctacttcttcactttcttcttctacccctggttcc

SEQ ID NO: 351460 - DNA, 36 bp, Artificial Sequence
  Description of Artificial Sequence: Synthetic oligonucleotide
tctacttcttcactttcttcttctacccctggttcc

SEQ ID NO: 351461 - DNA, 35 bp, Artificial Sequence
  Description of Artificial Sequence: Synthetic oligonucleotide
ctacttcttcactttcttcttctacccctggttcc

SEQ ID NO: 351462 - DNA, 36 bp, Artificial Sequence
  Description of Artificial Sequence: Synthetic oligonucleotide
tacttcttcactttcttcttctacccctggttcctc

SEQ ID NO: 351463 - DNA, 35 bp, Artificial Sequence
  Description of Artificial Sequence: Synthetic oligonucleotide
acttcttcactttcttcttctacccctggttcctc

SEQ ID NO: 351464 - DNA, 34 bp, Artificial Sequence
  Description of Artificial Sequence: Synthetic oligonucleotide
cttcttcactttcttcttctacccctggttcctc

SEQ ID NO: 351465 - DNA, 36 bp, Artificial Sequence
  Description of Artificial Sequence: Synthetic oligonucleotide
ttcttcactttcttcttctacccctggttcctcttc

SEQ ID NO: 351466 - DNA, 35 bp, Artificial Sequence
  Description of Artificial Sequence: Synthetic oligonucleotide
tcttcactttcttcttctacccctggttcctcttc

SEQ ID NO: 351467 - DNA, 34 bp, Artificial Sequence
  Description of Artificial Sequence: Synthetic oligonucleotide
cttcactttcttcttctacccctggttcctcttc

SEQ ID NO: 351468 - DNA, 35 bp, Artificial Sequence
  Description of Artificial Sequence: Synthetic oligonucleotide
ttcactttcttcttctacccctggttcctcttctc

SEQ ID NO: 351469 - DNA, 34 bp, Artificial Sequence
  Description of Artificial Sequence: Synthetic oligonucleotide
tcactttcttcttctacccctggttcctcttctc

SEQ ID NO: 351470 - DNA, 33 bp, Artificial Sequence
  Description of Artificial Sequence: Synthetic oligonucleotide
cactttcttcttctacccctggttcctcttctc

SEQ ID NO: 351471 - DNA, 33 bp, Artificial Sequence
  Description of Artificial Sequence: Synthetic oligonucleotide
actttcttcttctacccctggttcctcttctcg

SEQ ID NO: 351472 - DNA, 32 bp, Artificial Sequence
  Description of Artificial Sequence: Synthetic oligonucleotide
ctttcttcttctacccctggttcctcttctcg

SEQ ID NO: 351473 - DNA, 33 bp, Artificial Sequence
  Description of Artificial Sequence: Synthetic oligonucleotide
tttcttcttctacccctggttcctcttctcgtg

SEQ ID NO: 351474 - DNA, 32 bp, Artificial Sequence
  Description of Artificial Sequence: Synthetic oligonucleotide
ttcttcttctacccctggttcctcttctcgtg

SEQ ID NO: 351475 - DNA, 31 bp, Artificial Sequence
  Description of Artificial Sequence: Synthetic oligonucleotide
tcttcttctacccctggttcctcttctcgtg

SEQ ID NO: 351476 - DNA, 30 bp, Artificial Sequence
  Description of Artificial Sequence: Synthetic oligonucleotide
cttcttctacccctggttcctcttctcgtg

SEQ ID NO: 351477 - DNA, 30 bp, Artificial Sequence
  Description of Artificial Sequence: Synthetic oligonucleotide
ttcttctacccctggttcctcttctcgtgc

SEQ ID NO: 351478 - DNA, 29 bp, Artificial Sequence
  Description of Artificial Sequence: Synthetic oligonucleotide
tcttctacccctggttcctcttctcgtgc

SEQ ID NO: 351479 - DNA, 28 bp, Artificial Sequence
  Description of Artificial Sequence: Synthetic oligonucleotide
cttctacccctggttcctcttctcgtgc

SEQ ID NO: 351480 - DNA, 29 bp, Artificial Sequence
  Description of Artificial Sequence: Synthetic oligonucleotide
ttctacccctggttcctcttctcgtgcag

SEQ ID NO: 351481 - DNA, 28 bp, Artificial Sequence
  Description of Artificial Sequence: Synthetic oligonucleotide
tctacccctggttcctcttctcgtgcag

SEQ ID NO: 351482 - DNA, 27 bp, Artificial Sequence
  Description of Artificial Sequence: Synthetic oligonucleotide
ctacccctggttcctcttctcgtgcag

SEQ ID NO: 351483 - DNA, 28 bp, Artificial Sequence
  Description of Artificial Sequence: Synthetic oligonucleotide
tacccctggttcctcttctcgtgcagtg

SEQ ID NO: 351484 - DNA, 27 bp, Artificial Sequence
  Description of Artificial Sequence: Synthetic oligonucleotide
acccctggttcctcttctcgtgcagtg

SEQ ID NO: 351485 - DNA, 26 bp, Artificial Sequence
  Description of Artificial Sequence: Synthetic oligonucleotide
cccctggttcctcttctcgtgcagtg

SEQ ID NO: 351486 - DNA, 27 bp, Artificial Sequence
  Description of Artificial Sequence: Synthetic oligonucleotide
ccctggttcctcttctcgtgcagtgga

SEQ ID NO: 351487 - DNA, 28 bp, Artificial Sequence
  Description of Artificial Sequence: Synthetic oligonucleotide
cctggttcctcttctcgtgcagtggatc

SEQ ID NO: 351488 - DNA, 28 bp, Artificial Sequence
  Description of Artificial Sequence: Synthetic oligonucleotide
ctggttcctcttctcgtgcagtggatcc

SEQ ID NO: 351489 - DNA, 28 bp, Artificial Sequence
  Description of Artificial Sequence: Synthetic oligonucleotide
tggttcctcttctcgtgcagtggatccc

SEQ ID NO: 351490 - DNA, 27 bp, Artificial Sequence
  Description of Artificial Sequence: Synthetic oligonucleotide
ggttcctcttctcgtgcagtggatccc

SEQ ID NO: 351491 - DNA, 27 bp, Artificial Sequence
  Description of Artificial Sequence: Synthetic oligonucleotide
gttcctcttctcgtgcagtggatcccc

SEQ ID NO: 351492 - DNA, 30 bp, Artificial Sequence
  Description of Artificial Sequence: Synthetic oligonucleotide
ttcctcttctcgtgcagtggatccccattc

SEQ ID NO: 351493 - DNA, 29 bp, Artificial Sequence
  Description of Artificial Sequence: Synthetic oligonucleotide
tcctcttctcgtgcagtggatccccattc

SEQ ID NO: 351494 - DNA, 28 bp, Artificial Sequence
  Description of Artificial Sequence: Synthetic oligonucleotide
cctcttctcgtgcagtggatccccattc

SEQ ID NO: 351495 - DNA, 28 bp, Artificial Sequence
  Description of Artificial Sequence: Synthetic oligonucleotide
ctcttctcgtgcagtggatccccattcg

SEQ ID NO: 351496 - DNA, 28 bp, Artificial Sequence
  Description of Artificial Sequence: Synthetic oligonucleotide
tcttctcgtgcagtggatccccattcgc

SEQ ID NO: 351497 - DNA, 27 bp, Artificial Sequence
  Description of Artificial Sequence: Synthetic oligonucleotide
cttctcgtgcagtggatccccattcgc

SEQ ID NO: 351498 - DNA, 28 bp, Artificial Sequence
  Description of Artificial Sequence: Synthetic oligonucleotide
ttctcgtgcagtggatccccattcgctg

SEQ ID NO: 351499 - DNA, 27 bp, Artificial Sequence
  Description of Artificial Sequence: Synthetic oligonucleotide
tctcgtgcagtggatccccattcgctg

SEQ ID NO: 351500 - DNA, 27 bp, Artificial Sequence
  Description of Artificial Sequence: Synthetic oligonucleotide
ctcgtgcagtggatccccattcgctga

SEQ ID NO: 351501 - DNA, 27 bp, Artificial Sequence
  Description of Artificial Sequence: Synthetic oligonucleotide
tcgtgcagtggatccccattcgctgag

SEQ ID NO: 351502 - DNA, 27 bp, Artificial Sequence
  Description of Artificial Sequence: Synthetic oligonucleotide
cgtgcagtggatccccattcgctgaga

SEQ ID NO: 351503 - DNA, 28 bp, Artificial Sequence
  Description of Artificial Sequence: Synthetic oligonucleotide
gtgcagtggatccccattcgctgagaac

SEQ ID NO: 351504 - DNA, 31 bp, Artificial Sequence
  Description of Artificial Sequence: Synthetic oligonucleotide
tgcagtggatccccattcgctgagaacaaag

SEQ ID NO: 351505 - DNA, 30 bp, Artificial Sequence
  Description of Artificial Sequence: Synthetic oligonucleotide
gcagtggatccccattcgctgagaacaaag

SEQ ID NO: 351506 - DNA, 31 bp, Artificial Sequence
  Description of Artificial Sequence: Synthetic oligonucleotide
cagtggatccccattcgctgagaacaaagag

SEQ ID NO: 351507 - DNA, 33 bp, Artificial Sequence
  Description of Artificial Sequence: Synthetic oligonucleotide
agtggatccccattcgctgagaacaaagagaag

SEQ ID NO: 351508 - DNA, 32 bp, Artificial Sequence
  Description of Artificial Sequence: Synthetic oligonucleotide
gtggatccccattcgctgagaacaaagagaag

SEQ ID NO: 351509 - DNA, 32 bp, Artificial Sequence
  Description of Artificial Sequence: Synthetic oligonucleotide
tggatccccattcgctgagaacaaagagaagg

SEQ ID NO: 351510 - DNA, 31 bp, Artificial Sequence
  Description of Artificial Sequence: Synthetic oligonucleotide
ggatccccattcgctgagaacaaagagaagg

SEQ ID NO: 351511 - DNA, 31 bp, Artificial Sequence
  Description of Artificial Sequence: Synthetic oligonucleotide
gatccccattcgctgagaacaaagagaaggc

SEQ ID NO: 351512 - DNA, 31 bp, Artificial Sequence
  Description of Artificial Sequence: Synthetic oligonucleotide
atccccattcgctgagaacaaagagaaggcg

SEQ ID NO: 351513 - DNA, 30 bp, Artificial Sequence
  Description of Artificial Sequence: Synthetic oligonucleotide
tccccattcgctgagaacaaagagaaggcg

SEQ ID NO: 351514 - DNA, 29 bp, Artificial Sequence
  Description of Artificial Sequence: Synthetic oligonucleotide
ccccattcgctgagaacaaagagaaggcg

SEQ ID NO: 351515 - DNA, 29 bp, Artificial Sequence
  Description of Artificial Sequence: Synthetic oligonucleotide
cccattcgctgagaacaaagagaaggcgc

SEQ ID NO: 351516 - DNA, 30 bp, Artificial Sequence
  Description of Artificial Sequence: Synthetic oligonucleotide
ccattcgctgagaacaaagagaaggcgctc

SEQ ID NO: 351517 - DNA, 31 bp, Artificial Sequence
  Description of Artificial Sequence: Synthetic oligonucleotide
cattcgctgagaacaaagagaaggcgctcag

SEQ ID NO: 351518 - DNA, 33 bp, Artificial Sequence
  Description of Artificial Sequence: Synthetic oligonucleotide
attcgctgagaacaaagagaaggcgctcagtag

SEQ ID NO: 351519 - DNA, 32 bp, Artificial Sequence
  Description of Artificial Sequence: Synthetic oligonucleotide
ttcgctgagaacaaagagaaggcgctcagtag

SEQ ID NO: 351520 - DNA, 31 bp, Artificial Sequence
  Description of Artificial Sequence: Synthetic oligonucleotide
tcgctgagaacaaagagaaggcgctcagtag

SEQ ID NO: 351521 - DNA, 30 bp, Artificial Sequence
  Description of Artificial Sequence: Synthetic oligonucleotide
cgctgagaacaaagagaaggcgctcagtag

SEQ ID NO: 351522 - DNA, 31 bp, Artificial Sequence
  Description of Artificial Sequence: Synthetic oligonucleotide
gctgagaacaaagagaaggcgctcagtagac

SEQ ID NO: 351523 - DNA, 32 bp, Artificial Sequence
  Description of Artificial Sequence: Synthetic oligonucleotide
ctgagaacaaagagaaggcgctcagtagactg

SEQ ID NO: 351524 - DNA, 32 bp, Artificial Sequence
  Description of Artificial Sequence: Synthetic oligonucleotide
tgagaacaaagagaaggcgctcagtagactgg

SEQ ID NO: 351525 - DNA, 31 bp, Artificial Sequence
  Description of Artificial Sequence: Synthetic oligonucleotide
gagaacaaagagaaggcgctcagtagactgg

SEQ ID NO: 351526 - DNA, 31 bp, Artificial Sequence
  Description of Artificial Sequence: Synthetic oligonucleotide
agaacaaagagaaggcgctcagtagactggg

SEQ ID NO: 351527 - DNA, 30 bp, Artificial Sequence
  Description of Artificial Sequence: Synthetic oligonucleotide
gaacaaagagaaggcgctcagtagactggg

SEQ ID NO: 351528 - DNA, 30 bp, Artificial Sequence
  Description of Artificial Sequence: Synthetic oligonucleotide
aacaaagagaaggcgctcagtagactgggc

SEQ ID NO: 351529 - DNA, 29 bp, Artificial Sequence
  Description of Artificial Sequence: Synthetic oligonucleotide
acaaagagaaggcgctcagtagactgggc

SEQ ID NO: 351530 - DNA, 28 bp, Artificial Sequence
  Description of Artificial Sequence: Synthetic oligonucleotide
caaagagaaggcgctcagtagactgggc

SEQ ID NO: 351531 - DNA, 29 bp, Artificial Sequence
  Description of Artificial Sequence: Synthetic oligonucleotide
aaagagaaggcgctcagtagactgggcac

SEQ ID NO: 351532 - DNA, 28 bp, Artificial Sequence
  Description of Artificial Sequence: Synthetic oligonucleotide
aagagaaggcgctcagtagactgggcac

SEQ ID NO: 351533 - DNA, 27 bp, Artificial Sequence
  Description of Artificial Sequence: Synthetic oligonucleotide
agagaaggcgctcagtagactgggcac

SEQ ID NO: 351534 - DNA, 26 bp, Artificial Sequence
  Description of Artificial Sequence: Synthetic oligonucleotide
gagaaggcgctcagtagactgggcac

SEQ ID NO: 351535 - DNA, 27 bp, Artificial Sequence
  Description of Artificial Sequence: Synthetic oligonucleotide
agaaggcgctcagtagactgggcacca

SEQ ID NO: 351536 - DNA, 26 bp, Artificial Sequence
  Description of Artificial Sequence: Synthetic oligonucleotide
gaaggcgctcagtagactgggcacca

SEQ ID NO: 351537 - DNA, 26 bp, Artificial Sequence
  Description of Artificial Sequence: Synthetic oligonucleotide
aaggcgctcagtagactgggcaccag

SEQ ID NO: 351538 - DNA, 25 bp, Artificial Sequence
  Description of Artificial Sequence: Synthetic oligonucleotide
aggcgctcagtagactgggcaccag

SEQ ID NO: 351539 - DNA, 24 bp, Artificial Sequence
  Description of Artificial Sequence: Synthetic oligonucleotide
ggcgctcagtagactgggcaccag

SEQ ID NO: 351540 - DNA, 27 bp, Artificial Sequence
  Description of Artificial Sequence: Synthetic oligonucleotide
gcgctcagtagactgggcaccagcatt

SEQ ID NO: 351541 - DNA, 27 bp, Artificial Sequence
  Description of Artificial Sequence: Synthetic oligonucleotide
cgctcagtagactgggcaccagcattg

SEQ ID NO: 351542 - DNA, 29 bp, Artificial Sequence
  Description of Artificial Sequence: Synthetic oligonucleotide
gctcagtagactgggcaccagcattgtac

SEQ ID NO: 351543 - DNA, 32 bp, Artificial Sequence
  Description of Artificial Sequence: Synthetic oligonucleotide
ctcagtagactgggcaccagcattgtactttg

SEQ ID NO: 351544 - DNA, 32 bp, Artificial Sequence
  Description of Artificial Sequence: Synthetic oligonucleotide
tcagtagactgggcaccagcattgtactttgc

SEQ ID NO: 351545 - DNA, 31 bp, Artificial Sequence
  Description of Artificial Sequence: Synthetic oligonucleotide
cagtagactgggcaccagcattgtactttgc

SEQ ID NO: 351546 - DNA, 34 bp, Artificial Sequence
  Description of Artificial Sequence: Synthetic oligonucleotide
agtagactgggcaccagcattgtactttgctttc

SEQ ID NO: 351547 - DNA, 33 bp, Artificial Sequence
  Description of Artificial Sequence: Synthetic oligonucleotide
gtagactgggcaccagcattgtactttgctttc

SEQ ID NO: 351548 - DNA, 36 bp, Artificial Sequence
  Description of Artificial Sequence: Synthetic oligonucleotide
tagactgggcaccagcattgtactttgctttctatc

SEQ ID NO: 351549 - DNA, 35 bp, Artificial Sequence
  Description of Artificial Sequence: Synthetic oligonucleotide
agactgggcaccagcattgtactttgctttctatc

SEQ ID NO: 351550 - DNA, 34 bp, Artificial Sequence
  Description of Artificial Sequence: Synthetic oligonucleotide
gactgggcaccagcattgtactttgctttctatc

SEQ ID NO: 351551 - DNA, 38 bp, Artificial Sequence
  Description of Artificial Sequence: Synthetic oligonucleotide
actgggcaccagcattgtactttgctttctatctttac

SEQ ID NO: 351552 - DNA, 37 bp, Artificial Sequence
  Description of Artificial Sequence: Synthetic oligonucleotide
ctgggcaccagcattgtactttgctttctatctttac

SEQ ID NO: 351553 - DNA, 38 bp, Artificial Sequence
  Description of Artificial Sequence: Synthetic oligonucleotide
tgggcaccagcattgtactttgctttctatctttactc

SEQ ID NO: 351554 - DNA, 37 bp, Artificial Sequence
  Description of Artificial Sequence: Synthetic oligonucleotide
gggcaccagcattgtactttgctttctatctttactc

SEQ ID NO: 351555 - DNA, 41 bp, Artificial Sequence
  Description of Artificial Sequence: Synthetic oligonucleotide
ggcaccagcattgtactttgctttctatctttactctttac

SEQ ID NO: 351556 - DNA, 42 bp, Artificial Sequence
  Description of Artificial Sequence: Synthetic oligonucleotide
gcaccagcattgtactttgctttctatctttactctttactg

SEQ ID NO: 351557 - DNA, 42 bp, Artificial Sequence
  Description of Artificial Sequence: Synthetic oligonucleotide
caccagcattgtactttgctttctatctttactctttactgg

SEQ ID NO: 351558 - DNA, 45 bp, Artificial Sequence
  Description of Artificial Sequence: Synthetic oligonucleotide
accagcattgtactttgctttctatctttactctttactggtatg

SEQ ID NO: 351559 - DNA, 44 bp, Artificial Sequence
  Description of Artificial Sequence: Synthetic oligonucleotide
ccagcattgtactttgctttctatctttactctttactggtatg

SEQ ID NO: 351560 - DNA, 46 bp, Artificial Sequence
  Description of Artificial Sequence: Synthetic oligonucleotide
cagcattgtactttgctttctatctttactctttactggtatgaac

SEQ ID NO: 351561 - DNA, 48 bp, Artificial Sequence
  Description of Artificial Sequence: Synthetic oligonucleotide
agcattgtactttgctttctatctttactctttactggtatgaacatg

SEQ ID NO: 351562 - DNA, 47 bp, Artificial Sequence
  Description of Artificial Sequence: Synthetic oligonucleotide
gcattgtactttgctttctatctttactctttactggtatgaacatg

SEQ ID NO: 351563 - DNA, 49 bp, Artificial Sequence
  Description of Artificial Sequence: Synthetic oligonucleotide
cattgtactttgctttctatctttactctttactggtatgaacatgttc

SEQ ID NO: 351564 - DNA, 50 bp, Artificial Sequence
  Description of Artificial Sequence: Synthetic oligonucleotide
attgtactttgctttctatctttactctttactggtatgaacatgttcag

SEQ ID NO: 351565 - DNA, 49 bp, Artificial Sequence
  Description of Artificial Sequence: Synthetic oligonucleotide
ttgtactttgctttctatctttactctttactggtatgaacatgttcag

SEQ ID NO: 351566 - DNA, 48 bp, Artificial Sequence
  Description of Artificial Sequence: Synthetic oligonucleotide
tgtactttgctttctatctttactctttactggtatgaacatgttcag

SEQ ID NO: 351567 - DNA, 47 bp, Artificial Sequence
  Description of Artificial Sequence: Synthetic oligonucleotide
gtactttgctttctatctttactctttactggtatgaacatgttcag

SEQ ID NO: 351568 - DNA, 47 bp, Artificial Sequence
  Description of Artificial Sequence: Synthetic oligonucleotide
tactttgctttctatctttactctttactggtatgaacatgttcagc

SEQ ID NO: 351569 - DNA, 46 bp, Artificial Sequence
  Description of Artificial Sequence: Synthetic oligonucleotide
actttgctttctatctttactctttactggtatgaacatgttcagc

SEQ ID NO: 351570 - DNA, 45 bp, Artificial Sequence
  Description of Artificial Sequence: Synthetic oligonucleotide
ctttgctttctatctttactctttactggtatgaacatgttcagc

SEQ ID NO: 351571 - DNA, 46 bp, Artificial Sequence
  Description of Artificial Sequence: Synthetic oligonucleotide
tttgctttctatctttactctttactggtatgaacatgttcagctg

SEQ ID NO: 351572 - DNA, 45 bp, Artificial Sequence
  Description of Artificial Sequence: Synthetic oligonucleotide
ttgctttctatctttactctttactggtatgaacatgttcagctg

SEQ ID NO: 351573 - DNA, 44 bp, Artificial Sequence
  Description of Artificial Sequence: Synthetic oligonucleotide
tgctttctatctttactctttactggtatgaacatgttcagctg

SEQ ID NO: 351574 - DNA, 43 bp, Artificial Sequence
  Description of Artificial Sequence: Synthetic oligonucleotide
gctttctatctttactctttactggtatgaacatgttcagctg

SEQ ID NO: 351575 - DNA, 43 bp, Artificial Sequence
  Description of Artificial Sequence: Synthetic oligonucleotide
ctttctatctttactctttactggtatgaacatgttcagctgg

SEQ ID NO: 351576 - DNA, 44 bp, Artificial Sequence
  Description of Artificial Sequence: Synthetic oligonucleotide
tttctatctttactctttactggtatgaacatgttcagctggtc

SEQ ID NO: 351577 - DNA, 43 bp, Artificial Sequence
  Description of Artificial Sequence: Synthetic oligonucleotide
ttctatctttactctttactggtatgaacatgttcagctggtc

SEQ ID NO: 351578 - DNA, 42 bp, Artificial Sequence
  Description of Artificial Sequence: Synthetic oligonucleotide
tctatctttactctttactggtatgaacatgttcagctggtc

SEQ ID NO: 351579 - DNA, 41 bp, Artificial Sequence
  Description of Artificial Sequence: Synthetic oligonucleotide
ctatctttactctttactggtatgaacatgttcagctggtc

SEQ ID NO: 351580 - DNA, 42 bp, Artificial Sequence
  Description of Artificial Sequence: Synthetic oligonucleotide
tatctttactctttactggtatgaacatgttcagctggtctg

SEQ ID NO: 351581 - DNA, 41 bp, Artificial Sequence
  Description of Artificial Sequence: Synthetic oligonucleotide
atctttactctttactggtatgaacatgttcagctggtctg

SEQ ID NO: 351582 - DNA, 40 bp, Artificial Sequence
  Description of Artificial Sequence: Synthetic oligonucleotide
tctttactctttactggtatgaacatgttcagctggtctg

SEQ ID NO: 351583 - DNA, 39 bp, Artificial Sequence
  Description of Artificial Sequence: Synthetic oligonucleotide
ctttactctttactggtatgaacatgttcagctggtctg

SEQ ID NO: 351584 - DNA, 39 bp, Artificial Sequence
  Description of Artificial Sequence: Synthetic oligonucleotide
tttactctttactggtatgaacatgttcagctggtctgg

SEQ ID NO: 351585 - DNA, 38 bp, Artificial Sequence
  Description of Artificial Sequence: Synthetic oligonucleotide
ttactctttactggtatgaacatgttcagctggtctgg

SEQ ID NO: 351586 - DNA, 37 bp, Artificial Sequence
  Description of Artificial Sequence: Synthetic oligonucleotide
tactctttactggtatgaacatgttcagctggtctgg

SEQ ID NO: 351587 - DNA, 36 bp, Artificial Sequence
  Description of Artificial Sequence: Synthetic oligonucleotide
actctttactggtatgaacatgttcagctggtctgg

SEQ ID NO: 351588 - DNA, 35 bp, Artificial Sequence
  Description of Artificial Sequence: Synthetic oligonucleotide
ctctttactggtatgaacatgttcagctggtctgg

SEQ ID NO: 351589 - DNA, 36 bp, Artificial Sequence
  Description of Artificial Sequence: Synthetic oligonucleotide
tctttactggtatgaacatgttcagctggtctggtg

SEQ ID NO: 351590 - DNA, 35 bp, Artificial Sequence
  Description of Artificial Sequence: Synthetic oligonucleotide
ctttactggtatgaacatgttcagctggtctggtg

SEQ ID NO: 351591 - DNA, 37 bp, Artificial Sequence
  Description of Artificial Sequence: Synthetic oligonucleotide
tttactggtatgaacatgttcagctggtctggtgtac

SEQ ID NO: 351592 - DNA, 36 bp, Artificial Sequence
  Description of Artificial Sequence: Synthetic oligonucleotide
ttactggtatgaacatgttcagctggtctggtgtac

SEQ ID NO: 351593 - DNA, 35 bp, Artificial Sequence
  Description of Artificial Sequence: Synthetic oligonucleotide
tactggtatgaacatgttcagctggtctggtgtac

SEQ ID NO: 351594 - DNA, 34 bp, Artificial Sequence
  Description of Artificial Sequence: Synthetic oligonucleotide
actggtatgaacatgttcagctggtctggtgtac

SEQ ID NO: 351595 - DNA, 33 bp, Artificial Sequence
  Description of Artificial Sequence: Synthetic oligonucleotide
ctggtatgaacatgttcagctggtctggtgtac

SEQ ID NO: 351596 - DNA, 34 bp, Artificial Sequence
  Description of Artificial Sequence: Synthetic oligonucleotide
tggtatgaacatgttcagctggtctggtgtacag

SEQ ID NO: 351597 - DNA, 33 bp, Artificial Sequence
  Description of Artificial Sequence: Synthetic oligonucleotide
ggtatgaacatgttcagctggtctggtgtacag

SEQ ID NO: 351598 - DNA, 33 bp, Artificial Sequence
  Description of Artificial Sequence: Synthetic oligonucleotide
gtatgaacatgttcagctggtctggtgtacagc

SEQ ID NO: 351599 - DNA, 34 bp, Artificial Sequence
  Description of Artificial Sequence: Synthetic oligonucleotide
tatgaacatgttcagctggtctggtgtacagctc

SEQ ID NO: 351600 - DNA, 33 bp, Artificial Sequence
  Description of Artificial Sequence: Synthetic oligonucleotide
atgaacatgttcagctggtctggtgtacagctc

SEQ ID NO: 351601 - DNA, 32 bp, Artificial Sequence
  Description of Artificial Sequence: Synthetic oligonucleotide
tgaacatgttcagctggtctggtgtacagctc

SEQ ID NO: 351602 - DNA, 31 bp, Artificial Sequence
  Description of Artificial Sequence: Synthetic oligonucleotide
gaacatgttcagctggtctggtgtacagctc

SEQ ID NO: 351603 - DNA, 37 bp, Artificial Sequence
  Description of Artificial Sequence: Synthetic oligonucleotide
aacatgttcagctggtctggtgtacagctcaaaattg

SEQ ID NO: 351604 - DNA, 36 bp, Artificial Sequence
  Description of Artificial Sequence: Synthetic oligonucleotide
acatgttcagctggtctggtgtacagctcaaaattg

SEQ ID NO: 351605 - DNA, 35 bp, Artificial Sequence
  Description of Artificial Sequence: Synthetic oligonucleotide
catgttcagctggtctggtgtacagctcaaaattg

SEQ ID NO: 351606 - DNA, 36 bp, Artificial Sequence
  Description of Artificial Sequence: Synthetic oligonucleotide
atgttcagctggtctggtgtacagctcaaaattgac

SEQ ID NO: 351607 - DNA, 35 bp, Artificial Sequence
  Description of Artificial Sequence: Synthetic oligonucleotide
tgttcagctggtctggtgtacagctcaaaattgac

SEQ ID NO: 351608 - DNA, 34 bp, Artificial Sequence
  Description of Artificial Sequence: Synthetic oligonucleotide
gttcagctggtctggtgtacagctcaaaattgac

SEQ ID NO: 351609 - DNA, 35 bp, Artificial Sequence
  Description of Artificial Sequence: Synthetic oligonucleotide
ttcagctggtctggtgtacagctcaaaattgactg

SEQ ID NO: 351610 - DNA, 34 bp, Artificial Sequence
  Description of Artificial Sequence: Synthetic oligonucleotide
tcagctggtctggtgtacagctcaaaattgactg

SEQ ID NO: 351611 - DNA, 33 bp, Artificial Sequence
  Description of Artificial Sequence: Synthetic oligonucleotide
cagctggtctggtgtacagctcaaaattgactg

SEQ ID NO: 351612 - DNA, 33 bp, Artificial Sequence
  Description of Artificial Sequence: Synthetic oligonucleotide
agctggtctggtgtacagctcaaaattgactgc

SEQ ID NO: 351613 - DNA, 32 bp, Artificial Sequence
  Description of Artificial Sequence: Synthetic oligonucleotide
gctggtctggtgtacagctcaaaattgactgc

SEQ ID NO: 351614 - DNA, 32 bp, Artificial Sequence
  Description of Artificial Sequence: Synthetic oligonucleotide
ctggtctggtgtacagctcaaaattgactgcc

SEQ ID NO: 351615 - DNA, 32 bp, Artificial Sequence
  Description of Artificial Sequence: Synthetic oligonucleotide
tggtctggtgtacagctcaaaattgactgccc

SEQ ID NO: 351616 - DNA, 31 bp, Artificial Sequence
  Description of Artificial Sequence: Synthetic oligonucleotide
ggtctggtgtacagctcaaaattgactgccc

SEQ ID NO: 351617 - DNA, 32 bp, Artificial Sequence
  Description of Artificial Sequence: Synthetic oligonucleotide
gtctggtgtacagctcaaaattgactgccctg

SEQ ID NO: 351618 - DNA, 33 bp, Artificial Sequence
  Description of Artificial Sequence: Synthetic oligonucleotide
tctggtgtacagctcaaaattgactgccctgac

SEQ ID NO: 351619 - DNA, 32 bp, Artificial Sequence
  Description of Artificial Sequence: Synthetic oligonucleotide
ctggtgtacagctcaaaattgactgccctgac

SEQ ID NO: 351620 - DNA, 32 bp, Artificial Sequence
  Description of Artificial Sequence: Synthetic oligonucleotide
tggtgtacagctcaaaattgactgccctgacc

SEQ ID NO: 351621 - DNA, 31 bp, Artificial Sequence
  Description of Artificial Sequence: Synthetic oligonucleotide
ggtgtacagctcaaaattgactgccctgacc

SEQ ID NO: 351622 - DNA, 32 bp, Artificial Sequence
  Description of Artificial Sequence: Synthetic oligonucleotide
gtgtacagctcaaaattgactgccctgaccac

SEQ ID NO: 351623 - DNA, 34 bp, Artificial Sequence
  Description of Artificial Sequence: Synthetic oligonucleotide
tgtacagctcaaaattgactgccctgaccacatc

SEQ ID NO: 351624 - DNA, 33 bp, Artificial Sequence
  Description of Artificial Sequence: Synthetic oligonucleotide
gtacagctcaaaattgactgccctgaccacatc

SEQ ID NO: 351625 - DNA, 34 bp, Artificial Sequence
  Description of Artificial Sequence: Synthetic oligonucleotide
tacagctcaaaattgactgccctgaccacatcag

SEQ ID NO: 351626 - DNA, 33 bp, Artificial Sequence
  Description of Artificial Sequence: Synthetic oligonucleotide
acagctcaaaattgactgccctgaccacatcag

SEQ ID NO: 351627 - DNA, 32 bp, Artificial Sequence
  Description of Artificial Sequence: Synthetic oligonucleotide
cagctcaaaattgactgccctgaccacatcag

SEQ ID NO: 351628 - DNA, 32 bp, Artificial Sequence
  Description of Artificial Sequence: Synthetic oligonucleotide
agctcaaaattgactgccctgaccacatcagc

SEQ ID NO: 351629 - DNA, 31 bp, Artificial Sequence
  Description of Artificial Sequence: Synthetic oligonucleotide
gctcaaaattgactgccctgaccacatcagc

SEQ ID NO: 351630 - DNA, 33 bp, Artificial Sequence
  Description of Artificial Sequence: Synthetic oligonucleotide
ctcaaaattgactgccctgaccacatcagcaac

SEQ ID NO: 351631 - DNA, 34 bp, Artificial Sequence
  Description of Artificial Sequence: Synthetic oligonucleotide
tcaaaattgactgccctgaccacatcagcaactc

SEQ ID NO: 351632 - DNA, 33 bp, Artificial Sequence
  Description of Artificial Sequence: Synthetic oligonucleotide
caaaattgactgccctgaccacatcagcaactc

SEQ ID NO: 351633 - DNA, 33 bp, Artificial Sequence
  Description of Artificial Sequence: Synthetic oligonucleotide
aaaattgactgccctgaccacatcagcaactcc

SEQ ID NO: 351634 - DNA, 32 bp, Artificial Sequence
  Description of Artificial Sequence: Synthetic oligonucleotide
aaattgactgccctgaccacatcagcaactcc

SEQ ID NO: 351635 - DNA, 31 bp, Artificial Sequence
  Description of Artificial Sequence: Synthetic oligonucleotide
aattgactgccctgaccacatcagcaactcc

SEQ ID NO: 351636 - DNA, 30 bp, Artificial Sequence
  Description of Artificial Sequence: Synthetic oligonucleotide
attgactgccctgaccacatcagcaactcc

SEQ ID NO: 351637 - DNA, 29 bp, Artificial Sequence
  Description of Artificial Sequence: Synthetic oligonucleotide
ttgactgccctgaccacatcagcaactcc

SEQ ID NO: 351638 - DNA, 28 bp, Artificial Sequence
  Description of Artificial Sequence: Synthetic oligonucleotide
tgactgccctgaccacatcagcaactcc

SEQ ID NO: 351639 - DNA, 27 bp, Artificial Sequence
  Description of Artificial Sequence: Synthetic oligonucleotide
gactgccctgaccacatcagcaactcc

SEQ ID NO: 351640 - DNA, 27 bp, Artificial Sequence
  Description of Artificial Sequence: Synthetic oligonucleotide
actgccctgaccacatcagcaactccc

SEQ ID NO: 351641 - DNA, 27 bp, Artificial Sequence
  Description of Artificial Sequence: Synthetic oligonucleotide
ctgccctgaccacatcagcaactccca

SEQ ID NO: 351642 - DNA, 32 bp, Artificial Sequence
  Description of Artificial Sequence: Synthetic oligonucleotide
tgccctgaccacatcagcaactcccataatag

SEQ ID NO: 351643 - DNA, 31 bp, Artificial Sequence
  Description of Artificial Sequence: Synthetic oligonucleotide
gccctgaccacatcagcaactcccataatag

SEQ ID NO: 351644 - DNA, 31 bp, Artificial Sequence
  Description of Artificial Sequence: Synthetic oligonucleotide
ccctgaccacatcagcaactcccataatagg

SEQ ID NO: 351645 - DNA, 33 bp, Artificial Sequence
  Description of Artificial Sequence: Synthetic oligonucleotide
cctgaccacatcagcaactcccataataggtac

SEQ ID NO: 351646 - DNA, 33 bp, Artificial Sequence
  Description of Artificial Sequence: Synthetic oligonucleotide
ctgaccacatcagcaactcccataataggtacc

SEQ ID NO: 351647 - DNA, 34 bp, Artificial Sequence
  Description of Artificial Sequence: Synthetic oligonucleotide
tgaccacatcagcaactcccataataggtaccag

SEQ ID NO: 351648 - DNA, 33 bp, Artificial Sequence
  Description of Artificial Sequence: Synthetic oligonucleotide
gaccacatcagcaactcccataataggtaccag

SEQ ID NO: 351649 - DNA, 33 bp, Artificial Sequence
  Description of Artificial Sequence: Synthetic oligonucleotide
accacatcagcaactcccataataggtaccagc

SEQ ID NO: 351650 - DNA, 32 bp, Artificial Sequence
  Description of Artificial Sequence: Synthetic oligonucleotide
ccacatcagcaactcccataataggtaccagc

SEQ ID NO: 351651 - DNA, 34 bp, Artificial Sequence
  Description of Artificial Sequence: Synthetic oligonucleotide
cacatcagcaactcccataataggtaccagcaac

SEQ ID NO: 351652 - DNA, 35 bp, Artificial Sequence
  Description of Artificial Sequence: Synthetic oligonucleotide
acatcagcaactcccataataggtaccagcaactg

SEQ ID NO: 351653 - DNA, 34 bp, Artificial Sequence
  Description of Artificial Sequence: Synthetic oligonucleotide
catcagcaactcccataataggtaccagcaactg

SEQ ID NO: 351654 - DNA, 34 bp, Artificial Sequence
  Description of Artificial Sequence: Synthetic oligonucleotide
atcagcaactcccataataggtaccagcaactgg

SEQ ID NO: 351655 - DNA, 33 bp, Artificial Sequence
  Description of Artificial Sequence: Synthetic oligonucleotide
tcagcaactcccataataggtaccagcaactgg

SEQ ID NO: 351656 - DNA, 32 bp, Artificial Sequence
  Description of Artificial Sequence: Synthetic oligonucleotide
cagcaactcccataataggtaccagcaactgg

SEQ ID NO: 351657 - DNA, 33 bp, Artificial Sequence
  Description of Artificial Sequence: Synthetic oligonucleotide
agcaactcccataataggtaccagcaactggtg

SEQ ID NO: 351658 - DNA, 32 bp, Artificial Sequence
  Description of Artificial Sequence: Synthetic oligonucleotide
gcaactcccataataggtaccagcaactggtg

SEQ ID NO: 351659 - DNA, 37 bp, Artificial Sequence
  Description of Artificial Sequence: Synthetic oligonucleotide
caactcccataataggtaccagcaactggtgtaatac

SEQ ID NO: 351660 - DNA, 39 bp, Artificial Sequence
  Description of Artificial Sequence: Synthetic oligonucleotide
aactcccataataggtaccagcaactggtgtaatacatg

SEQ ID NO: 351661 - DNA, 38 bp, Artificial Sequence
  Description of Artificial Sequence: Synthetic oligonucleotide
actcccataataggtaccagcaactggtgtaatacatg

SEQ ID NO: 351662 - DNA, 37 bp, Artificial Sequence
  Description of Artificial Sequence: Synthetic oligonucleotide
ctcccataataggtaccagcaactggtgtaatacatg

SEQ ID NO: 351663 - DNA, 41 bp, Artificial Sequence
  Description of Artificial Sequence: Synthetic oligonucleotide
tcccataataggtaccagcaactggtgtaatacatgatatg

SEQ ID NO: 351664 - DNA, 40 bp, Artificial Sequence
  Description of Artificial Sequence: Synthetic oligonucleotide
cccataataggtaccagcaactggtgtaatacatgatatg

SEQ ID NO: 351665 - DNA, 43 bp, Artificial Sequence
  Description of Artificial Sequence: Synthetic oligonucleotide
ccataataggtaccagcaactggtgtaatacatgatatgattc

SEQ ID NO: 351666 - DNA, 45 bp, Artificial Sequence
  Description of Artificial Sequence: Synthetic oligonucleotide
cataataggtaccagcaactggtgtaatacatgatatgattcatc

SEQ ID NO: 351667 - DNA, 45 bp, Artificial Sequence
  Description of Artificial Sequence: Synthetic oligonucleotide
ataataggtaccagcaactggtgtaatacatgatatgattcatcg

SEQ ID NO: 351668 - DNA, 44 bp, Artificial Sequence
  Description of Artificial Sequence: Synthetic oligonucleotide
taataggtaccagcaactggtgtaatacatgatatgattcatcg

SEQ ID NO: 351669 - DNA, 43 bp, Artificial Sequence
  Description of Artificial Sequence: Synthetic oligonucleotide
aataggtaccagcaactggtgtaatacatgatatgattcatcg

SEQ ID NO: 351670 - DNA, 42 bp, Artificial Sequence
  Description of Artificial Sequence: Synthetic oligonucleotide
ataggtaccagcaactggtgtaatacatgatatgattcatcg

SEQ ID NO: 351671 - DNA, 41 bp, Artificial Sequence
  Description of Artificial Sequence: Synthetic oligonucleotide
taggtaccagcaactggtgtaatacatgatatgattcatcg

SEQ ID NO: 351672 - DNA, 40 bp, Artificial Sequence
  Description of Artificial Sequence: Synthetic oligonucleotide
aggtaccagcaactggtgtaatacatgatatgattcatcg

SEQ ID NO: 351673 - DNA, 39 bp, Artificial Sequence
  Description of Artificial Sequence: Synthetic oligonucleotide
ggtaccagcaactggtgtaatacatgatatgattcatcg

SEQ ID NO: 351674 - DNA, 40 bp, Artificial Sequence
  Description of Artificial Sequence: Synthetic oligonucleotide
gtaccagcaactggtgtaatacatgatatgattcatcgtg

SEQ ID NO: 351675 - DNA, 43 bp, Artificial Sequence
  Description of Artificial Sequence: Synthetic oligonucleotide
taccagcaactggtgtaatacatgatatgattcatcgtgaatg

SEQ ID NO: 351676 - DNA, 42 bp, Artificial Sequence
  Description of Artificial Sequence: Synthetic oligonucleotide
accagcaactggtgtaatacatgatatgattcatcgtgaatg

SEQ ID NO: 351677 - DNA, 41 bp, Artificial Sequence
  Description of Artificial Sequence: Synthetic oligonucleotide
ccagcaactggtgtaatacatgatatgattcatcgtgaatg

SEQ ID NO: 351678 - DNA, 41 bp, Artificial Sequence
  Description of Artificial Sequence: Synthetic oligonucleotide
cagcaactggtgtaatacatgatatgattcatcgtgaatgc

SEQ ID NO: 351679 - DNA, 41 bp, Artificial Sequence
  Description of Artificial Sequence: Synthetic oligonucleotide
agcaactggtgtaatacatgatatgattcatcgtgaatgcc

SEQ ID NO: 351680 - DNA, 40 bp, Artificial Sequence
  Description of Artificial Sequence: Synthetic oligonucleotide
gcaactggtgtaatacatgatatgattcatcgtgaatgcc

SEQ ID NO: 351681 - DNA, 42 bp, Artificial Sequence
  Description of Artificial Sequence: Synthetic oligonucleotide
caactggtgtaatacatgatatgattcatcgtgaatgccatg

SEQ ID NO: 351682 - DNA, 42 bp, Artificial Sequence
  Description of Artificial Sequence: Synthetic oligonucleotide
aactggtgtaatacatgatatgattcatcgtgaatgccatgc

SEQ ID NO: 351683 - DNA, 41 bp, Artificial Sequence
  Description of Artificial Sequence: Synthetic oligonucleotide
actggtgtaatacatgatatgattcatcgtgaatgccatgc

SEQ ID NO: 351684 - DNA, 40 bp, Artificial Sequence
  Description of Artificial Sequence: Synthetic oligonucleotide
ctggtgtaatacatgatatgattcatcgtgaatgccatgc

SEQ ID NO: 351685 - DNA, 41 bp, Artificial Sequence
  Description of Artificial Sequence: Synthetic oligonucleotide
tggtgtaatacatgatatgattcatcgtgaatgccatgctc

SEQ ID NO: 351686 - DNA, 40 bp, Artificial Sequence
  Description of Artificial Sequence: Synthetic oligonucleotide
ggtgtaatacatgatatgattcatcgtgaatgccatgctc

SEQ ID NO: 351687 - DNA, 40 bp, Artificial Sequence
  Description of Artificial Sequence: Synthetic oligonucleotide
gtgtaatacatgatatgattcatcgtgaatgccatgctcc

SEQ ID NO: 351688 - DNA, 41 bp, Artificial Sequence
  Description of Artificial Sequence: Synthetic oligonucleotide
tgtaatacatgatatgattcatcgtgaatgccatgctcctc

SEQ ID NO: 351689 - DNA, 40 bp, Artificial Sequence
  Description of Artificial Sequence: Synthetic oligonucleotide
gtaatacatgatatgattcatcgtgaatgccatgctcctc

SEQ ID NO: 351690 - DNA, 40 bp, Artificial Sequence
  Description of Artificial Sequence: Synthetic oligonucleotide
taatacatgatatgattcatcgtgaatgccatgctcctcc

SEQ ID NO: 351691 - DNA, 39 bp, Artificial Sequence
  Description of Artificial Sequence: Synthetic oligonucleotide
aatacatgatatgattcatcgtgaatgccatgctcctcc

SEQ ID NO: 351692 - DNA, 38 bp, Artificial Sequence
  Description of Artificial Sequence: Synthetic oligonucleotide
atacatgatatgattcatcgtgaatgccatgctcctcc

SEQ ID NO: 351693 - DNA, 37 bp, Artificial Sequence
  Description of Artificial Sequence: Synthetic oligonucleotide
tacatgatatgattcatcgtgaatgccatgctcctcc

SEQ ID NO: 351694 - DNA, 36 bp, Artificial Sequence
  Description of Artificial Sequence: Synthetic oligonucleotide
acatgatatgattcatcgtgaatgccatgctcctcc

SEQ ID NO: 351695 - DNA, 35 bp, Artificial Sequence
  Description of Artificial Sequence: Synthetic oligonucleotide
catgatatgattcatcgtgaatgccatgctcctcc

SEQ ID NO: 351696 - DNA, 36 bp, Artificial Sequence
  Description of Artificial Sequence: Synthetic oligonucleotide
atgatatgattcatcgtgaatgccatgctcctcctc

SEQ ID NO: 351697 - DNA, 35 bp, Artificial Sequence
  Description of Artificial Sequence: Synthetic oligonucleotide
tgatatgattcatcgtgaatgccatgctcctcctc

SEQ ID NO: 351698 - DNA, 34 bp, Artificial Sequence
  Description of Artificial Sequence: Synthetic oligonucleotide
gatatgattcatcgtgaatgccatgctcctcctc

SEQ ID NO: 351699 - DNA, 34 bp, Artificial Sequence
  Description of Artificial Sequence: Synthetic oligonucleotide
atatgattcatcgtgaatgccatgctcctcctcg

SEQ ID NO: 351700 - DNA, 33 bp, Artificial Sequence
  Description of Artificial Sequence: Synthetic oligonucleotide
tatgattcatcgtgaatgccatgctcctcctcg

SEQ ID NO: 351701 - DNA, 32 bp, Artificial Sequence
  Description of Artificial Sequence: Synthetic oligonucleotide
atgattcatcgtgaatgccatgctcctcctcg

SEQ ID NO: 351702 - DNA, 31 bp, Artificial Sequence
  Description of Artificial Sequence: Synthetic oligonucleotide
tgattcatcgtgaatgccatgctcctcctcg

SEQ ID NO: 351703 - DNA, 30 bp, Artificial Sequence
  Description of Artificial Sequence: Synthetic oligonucleotide
gattcatcgtgaatgccatgctcctcctcg

SEQ ID NO: 351704 - DNA, 31 bp, Artificial Sequence
  Description of Artificial Sequence: Synthetic oligonucleotide
attcatcgtgaatgccatgctcctcctcgtg

SEQ ID NO: 351705 - DNA, 30 bp, Artificial Sequence
  Description of Artificial Sequence: Synthetic oligonucleotide
ttcatcgtgaatgccatgctcctcctcgtg

SEQ ID NO: 351706 - DNA, 29 bp, Artificial Sequence
  Description of Artificial Sequence: Synthetic oligonucleotide
tcatcgtgaatgccatgctcctcctcgtg

SEQ ID NO: 351707 - DNA, 28 bp, Artificial Sequence
  Description of Artificial Sequence: Synthetic oligonucleotide
catcgtgaatgccatgctcctcctcgtg

SEQ ID NO: 351708 - DNA, 29 bp, Artificial Sequence
  Description of Artificial Sequence: Synthetic oligonucleotide
atcgtgaatgccatgctcctcctcgtgtg

SEQ ID NO: 351709 - DNA, 28 bp, Artificial Sequence
  Description of Artificial Sequence: Synthetic oligonucleotide
tcgtgaatgccatgctcctcctcgtgtg

SEQ ID NO: 351710 - DNA, 27 bp, Artificial Sequence
  Description of Artificial Sequence: Synthetic oligonucleotide
cgtgaatgccatgctcctcctcgtgtg

SEQ ID NO: 351711 - DNA, 27 bp, Artificial Sequence
  Description of Artificial Sequence: Synthetic oligonucleotide
gtgaatgccatgctcctcctcgtgtgg

SEQ ID NO: 351712 - DNA, 30 bp, Artificial Sequence
  Description of Artificial Sequence: Synthetic oligonucleotide
tgaatgccatgctcctcctcgtgtggtatc

SEQ ID NO: 351713 - DNA, 29 bp, Artificial Sequence
  Description of Artificial Sequence: Synthetic oligonucleotide
gaatgccatgctcctcctcgtgtggtatc

SEQ ID NO: 351714 - DNA, 33 bp, Artificial Sequence
  Description of Artificial Sequence: Synthetic oligonucleotide
aatgccatgctcctcctcgtgtggtatcatttc

SEQ ID NO: 351715 - DNA, 32 bp, Artificial Sequence
  Description of Artificial Sequence: Synthetic oligonucleotide
atgccatgctcctcctcgtgtggtatcatttc

SEQ ID NO: 351716 - DNA, 31 bp, Artificial Sequence
  Description of Artificial Sequence: Synthetic oligonucleotide
tgccatgctcctcctcgtgtggtatcatttc

SEQ ID NO: 351717 - DNA, 30 bp, Artificial Sequence
  Description of Artificial Sequence: Synthetic oligonucleotide
gccatgctcctcctcgtgtggtatcatttc

SEQ ID NO: 351718 - DNA, 32 bp, Artificial Sequence
  Description of Artificial Sequence: Synthetic oligonucleotide
ccatgctcctcctcgtgtggtatcatttcaag

SEQ ID NO: 351719 - DNA, 33 bp, Artificial Sequence
  Description of Artificial Sequence: Synthetic oligonucleotide
catgctcctcctcgtgtggtatcatttcaagac

SEQ ID NO: 351720 - DNA, 34 bp, Artificial Sequence
  Description of Artificial Sequence: Synthetic oligonucleotide
atgctcctcctcgtgtggtatcatttcaagacag

SEQ ID NO: 351721 - DNA, 33 bp, Artificial Sequence
  Description of Artificial Sequence: Synthetic oligonucleotide
tgctcctcctcgtgtggtatcatttcaagacag

SEQ ID NO: 351722 - DNA, 32 bp, Artificial Sequence
  Description of Artificial Sequence: Synthetic oligonucleotide
gctcctcctcgtgtggtatcatttcaagacag

SEQ ID NO: 351723 - DNA, 33 bp, Artificial Sequence
  Description of Artificial Sequence: Synthetic oligonucleotide
ctcctcctcgtgtggtatcatttcaagacagac

SEQ ID NO: 351724 - DNA, 35 bp, Artificial Sequence
  Description of Artificial Sequence: Synthetic oligonucleotide
tcctcctcgtgtggtatcatttcaagacagacatc

SEQ ID NO: 351725 - DNA, 34 bp, Artificial Sequence
  Description of Artificial Sequence: Synthetic oligonucleotide
cctcctcgtgtggtatcatttcaagacagacatc

SEQ ID NO: 351726 - DNA, 39 bp, Artificial Sequence
  Description of Artificial Sequence: Synthetic oligonucleotide
ctcctcgtgtggtatcatttcaagacagacatctatttg

SEQ ID NO: 351727 - DNA, 42 bp, Artificial Sequence
  Description of Artificial Sequence: Synthetic oligonucleotide
tcctcgtgtggtatcatttcaagacagacatctatttgtatg

SEQ ID NO: 351728 - DNA, 41 bp, Artificial Sequence
  Description of Artificial Sequence: Synthetic oligonucleotide
cctcgtgtggtatcatttcaagacagacatctatttgtatg

SEQ ID NO: 351729 - DNA, 42 bp, Artificial Sequence
  Description of Artificial Sequence: Synthetic oligonucleotide
ctcgtgtggtatcatttcaagacagacatctatttgtatgtg

SEQ ID NO: 351730 - DNA, 43 bp, Artificial Sequence
  Description of Artificial Sequence: Synthetic oligonucleotide
tcgtgtggtatcatttcaagacagacatctatttgtatgtgtc

SEQ ID NO: 351731 - DNA, 42 bp, Artificial Sequence
  Description of Artificial Sequence: Synthetic oligonucleotide
cgtgtggtatcatttcaagacagacatctatttgtatgtgtc

SEQ ID NO: 351732 - DNA, 42 bp, Artificial Sequence
  Description of Artificial Sequence: Synthetic oligonucleotide
gtgtggtatcatttcaagacagacatctatttgtatgtgtcc

SEQ ID NO: 351733 - DNA, 42 bp, Artificial Sequence
  Description of Artificial Sequence: Synthetic oligonucleotide
tgtggtatcatttcaagacagacatctatttgtatgtgtccg

SEQ ID NO: 351734 - DNA, 41 bp, Artificial Sequence
  Description of Artificial Sequence: Synthetic oligonucleotide
gtggtatcatttcaagacagacatctatttgtatgtgtccg

SEQ ID NO: 351735 - DNA, 41 bp, Artificial Sequence
  Description of Artificial Sequence: Synthetic oligonucleotide
tggtatcatttcaagacagacatctatttgtatgtgtccgc

SEQ ID NO: 351736 - DNA, 40 bp, Artificial Sequence
  Description of Artificial Sequence: Synthetic oligonucleotide
ggtatcatttcaagacagacatctatttgtatgtgtccgc

SEQ ID NO: 351737 - DNA, 41 bp, Artificial Sequence
  Description of Artificial Sequence: Synthetic oligonucleotide
gtatcatttcaagacagacatctatttgtatgtgtccgcac

SEQ ID NO: 351738 - DNA, 41 bp, Artificial Sequence
  Description of Artificial Sequence: Synthetic oligonucleotide
tatcatttcaagacagacatctatttgtatgtgtccgcacc

SEQ ID NO: 351739 - DNA, 40 bp, Artificial Sequence
  Description of Artificial Sequence: Synthetic oligonucleotide
atcatttcaagacagacatctatttgtatgtgtccgcacc

SEQ ID NO: 351740 - DNA, 39 bp, Artificial Sequence
  Description of Artificial Sequence: Synthetic oligonucleotide
tcatttcaagacagacatctatttgtatgtgtccgcacc

SEQ ID NO: 351741 - DNA, 38 bp, Artificial Sequence
  Description of Artificial Sequence: Synthetic oligonucleotide
catttcaagacagacatctatttgtatgtgtccgcacc

SEQ ID NO: 351742 - DNA, 39 bp, Artificial Sequence
  Description of Artificial Sequence: Synthetic oligonucleotide
atttcaagacagacatctatttgtatgtgtccgcacctc

SEQ ID NO: 351743 - DNA, 38 bp, Artificial Sequence
  Description of Artificial Sequence: Synthetic oligonucleotide
tttcaagacagacatctatttgtatgtgtccgcacctc

SEQ ID NO: 351744 - DNA, 37 bp, Artificial Sequence
  Description of Artificial Sequence: Synthetic oligonucleotide
ttcaagacagacatctatttgtatgtgtccgcacctc

SEQ ID NO: 351745 - DNA, 36 bp, Artificial Sequence
  Description of Artificial Sequence: Synthetic oligonucleotide
tcaagacagacatctatttgtatgtgtccgcacctc

SEQ ID NO: 351746 - DNA, 35 bp, Artificial Sequence
  Description of Artificial Sequence: Synthetic oligonucleotide
caagacagacatctatttgtatgtgtccgcacctc

SEQ ID NO: 351747 - DNA, 36 bp, Artificial Sequence
  Description of Artificial Sequence: Synthetic oligonucleotide
aagacagacatctatttgtatgtgtccgcacctctc

SEQ ID NO: 351748 - DNA, 35 bp, Artificial Sequence
  Description of Artificial Sequence: Synthetic oligonucleotide
agacagacatctatttgtatgtgtccgcacctctc

SEQ ID NO: 351749 - DNA, 34 bp, Artificial Sequence
  Description of Artificial Sequence: Synthetic oligonucleotide
gacagacatctatttgtatgtgtccgcacctctc

SEQ ID NO: 351750 - DNA, 36 bp, Artificial Sequence
  Description of Artificial Sequence: Synthetic oligonucleotide
acagacatctatttgtatgtgtccgcacctctcttg

SEQ ID NO: 351751 - DNA, 35 bp, Artificial Sequence
  Description of Artificial Sequence: Synthetic oligonucleotide
cagacatctatttgtatgtgtccgcacctctcttg

SEQ ID NO: 351752 - DNA, 35 bp, Artificial Sequence
  Description of Artificial Sequence: Synthetic oligonucleotide
agacatctatttgtatgtgtccgcacctctcttgg

SEQ ID NO: 351753 - DNA, 34 bp, Artificial Sequence
  Description of Artificial Sequence: Synthetic oligonucleotide
gacatctatttgtatgtgtccgcacctctcttgg

SEQ ID NO: 351754 - DNA, 35 bp, Artificial Sequence
  Description of Artificial Sequence: Synthetic oligonucleotide
acatctatttgtatgtgtccgcacctctcttggtc

SEQ ID NO: 351755 - DNA, 34 bp, Artificial Sequence
  Description of Artificial Sequence: Synthetic oligonucleotide
catctatttgtatgtgtccgcacctctcttggtc

SEQ ID NO: 351756 - DNA, 34 bp, Artificial Sequence
  Description of Artificial Sequence: Synthetic oligonucleotide
atctatttgtatgtgtccgcacctctcttggtcc

SEQ ID NO: 351757 - DNA, 33 bp, Artificial Sequence
  Description of Artificial Sequence: Synthetic oligonucleotide
tctatttgtatgtgtccgcacctctcttggtcc

SEQ ID NO: 351758 - DNA, 32 bp, Artificial Sequence
  Description of Artificial Sequence: Synthetic oligonucleotide
ctatttgtatgtgtccgcacctctcttggtcc

SEQ ID NO: 351759 - DNA, 33 bp, Artificial Sequence
  Description of Artificial Sequence: Synthetic oligonucleotide
tatttgtatgtgtccgcacctctcttggtcctg

SEQ ID NO: 351760 - DNA, 32 bp, Artificial Sequence
  Description of Artificial Sequence: Synthetic oligonucleotide
atttgtatgtgtccgcacctctcttggtcctg

SEQ ID NO: 351761 - DNA, 31 bp, Artificial Sequence
  Description of Artificial Sequence: Synthetic oligonucleotide
tttgtatgtgtccgcacctctcttggtcctg

SEQ ID NO: 351762 - DNA, 30 bp, Artificial Sequence
  Description of Artificial Sequence: Synthetic oligonucleotide
ttgtatgtgtccgcacctctcttggtcctg

SEQ ID NO: 351763 - DNA, 29 bp, Artificial Sequence
  Description of Artificial Sequence: Synthetic oligonucleotide
tgtatgtgtccgcacctctcttggtcctg

SEQ ID NO: 351764 - DNA, 28 bp, Artificial Sequence
  Description of Artificial Sequence: Synthetic oligonucleotide
gtatgtgtccgcacctctcttggtcctg

SEQ ID NO: 351765 - DNA, 28 bp, Artificial Sequence
  Description of Artificial Sequence: Synthetic oligonucleotide
tatgtgtccgcacctctcttggtcctgg

SEQ ID NO: 351766 - DNA, 27 bp, Artificial Sequence
  Description of Artificial Sequence: Synthetic oligonucleotide
atgtgtccgcacctctcttggtcctgg

SEQ ID NO: 351767 - DNA, 27 bp, Artificial Sequence
  Description of Artificial Sequence: Synthetic oligonucleotide
tgtgtccgcacctctcttggtcctgga

SEQ ID NO: 351768 - DNA, 26 bp, Artificial Sequence
  Description of Artificial Sequence: Synthetic oligonucleotide
gtgtccgcacctctcttggtcctgga

SEQ ID NO: 351769 - DNA, 26 bp, Artificial Sequence
  Description of Artificial Sequence: Synthetic oligonucleotide
tgtccgcacctctcttggtcctggag

SEQ ID NO: 351770 - DNA, 25 bp, Artificial Sequence
  Description of Artificial Sequence: Synthetic oligonucleotide
gtccgcacctctcttggtcctggag

SEQ ID NO: 351771 - DNA, 26 bp, Artificial Sequence
  Description of Artificial Sequence: Synthetic oligonucleotide
tccgcacctctcttggtcctggagct

SEQ ID NO: 351772 - DNA, 25 bp, Artificial Sequence
  Description of Artificial Sequence: Synthetic oligonucleotide
ccgcacctctcttggtcctggagct

SEQ ID NO: 351773 - DNA, 25 bp, Artificial Sequence
  Description of Artificial Sequence: Synthetic oligonucleotide
cgcacctctcttggtcctggagctg

SEQ ID NO: 351774 - DNA, 26 bp, Artificial Sequence
  Description of Artificial Sequence: Synthetic oligonucleotide
gcacctctcttggtcctggagctgct

SEQ ID NO: 351775 - DNA, 27 bp, Artificial Sequence
  Description of Artificial Sequence: Synthetic oligonucleotide
cacctctcttggtcctggagctgctca

SEQ ID NO: 351776 - DNA, 29 bp, Artificial Sequence
  Description of Artificial Sequence: Synthetic oligonucleotide
acctctcttggtcctggagctgctcaatg

SEQ ID NO: 351777 - DNA, 28 bp, Artificial Sequence
  Description of Artificial Sequence: Synthetic oligonucleotide
cctctcttggtcctggagctgctcaatg

SEQ ID NO: 351778 - DNA, 28 bp, Artificial Sequence
  Description of Artificial Sequence: Synthetic oligonucleotide
ctctcttggtcctggagctgctcaatgg

SEQ ID NO: 351779 - DNA, 28 bp, Artificial Sequence
  Description of Artificial Sequence: Synthetic oligonucleotide
tctcttggtcctggagctgctcaatggg

SEQ ID NO: 351780 - DNA, 27 bp, Artificial Sequence
  Description of Artificial Sequence: Synthetic oligonucleotide
ctcttggtcctggagctgctcaatggg

SEQ ID NO: 351781 - DNA, 29 bp, Artificial Sequence
  Description of Artificial Sequence: Synthetic oligonucleotide
tcttggtcctggagctgctcaatgggtac

SEQ ID NO: 351782 - DNA, 28 bp, Artificial Sequence
  Description of Artificial Sequence: Synthetic oligonucleotide
cttggtcctggagctgctcaatgggtac

SEQ ID NO: 351783 - DNA, 29 bp, Artificial Sequence
  Description of Artificial Sequence: Synthetic oligonucleotide
ttggtcctggagctgctcaatgggtactg

SEQ ID NO: 351784 - DNA, 28 bp, Artificial Sequence
  Description of Artificial Sequence: Synthetic oligonucleotide
tggtcctggagctgctcaatgggtactg

SEQ ID NO: 351785 - DNA, 27 bp, Artificial Sequence
  Description of Artificial Sequence: Synthetic oligonucleotide
ggtcctggagctgctcaatgggtactg

SEQ ID NO: 351786 - DNA, 27 bp, Artificial Sequence
  Description of Artificial Sequence: Synthetic oligonucleotide
gtcctggagctgctcaatgggtactgg

SEQ ID NO: 351787 - DNA, 28 bp, Artificial Sequence
  Description of Artificial Sequence: Synthetic oligonucleotide
tcctggagctgctcaatgggtactggac

SEQ ID NO: 351788 - DNA, 27 bp, Artificial Sequence
  Description of Artificial Sequence: Synthetic oligonucleotide
cctggagctgctcaatgggtactggac

SEQ ID NO: 351789 - DNA, 28 bp, Artificial Sequence
  Description of Artificial Sequence: Synthetic oligonucleotide
ctggagctgctcaatgggtactggacag

SEQ ID NO: 351790 - DNA, 28 bp, Artificial Sequence
  Description of Artificial Sequence: Synthetic oligonucleotide
tggagctgctcaatgggtactggacagc

SEQ ID NO: 351791 - DNA, 27 bp, Artificial Sequence
  Description of Artificial Sequence: Synthetic oligonucleotide
ggagctgctcaatgggtactggacagc

SEQ ID NO: 351792 - DNA, 27 bp, Artificial Sequence
  Description of Artificial Sequence: Synthetic oligonucleotide
gagctgctcaatgggtactggacagcc

SEQ ID NO: 351793 - DNA, 30 bp, Artificial Sequence
  Description of Artificial Sequence: Synthetic oligonucleotide
agctgctcaatgggtactggacagccattg

SEQ ID NO: 351794 - DNA, 29 bp, Artificial Sequence
  Description of Artificial Sequence: Synthetic oligonucleotide
gctgctcaatgggtactggacagccattg

SEQ ID NO: 351795 - DNA, 30 bp, Artificial Sequence
  Description of Artificial Sequence: Synthetic oligonucleotide
ctgctcaatgggtactggacagccattgtc

SEQ ID NO: 351796 - DNA, 32 bp, Artificial Sequence
  Description of Artificial Sequence: Synthetic oligonucleotide
tgctcaatgggtactggacagccattgtcttc

SEQ ID NO: 351797 - DNA, 31 bp, Artificial Sequence
  Description of Artificial Sequence: Synthetic oligonucleotide
gctcaatgggtactggacagccattgtcttc

SEQ ID NO: 351798 - DNA, 33 bp, Artificial Sequence
  Description of Artificial Sequence: Synthetic oligonucleotide
ctcaatgggtactggacagccattgtcttcatg

SEQ ID NO: 351799 - DNA, 33 bp, Artificial Sequence
  Description of Artificial Sequence: Synthetic oligonucleotide
tcaatgggtactggacagccattgtcttcatgc

SEQ ID NO: 351800 - DNA, 32 bp, Artificial Sequence
  Description of Artificial Sequence: Synthetic oligonucleotide
caatgggtactggacagccattgtcttcatgc

SEQ ID NO: 351801 - DNA, 34 bp, Artificial Sequence
  Description of Artificial Sequence: Synthetic oligonucleotide
aatgggtactggacagccattgtcttcatgcatg

SEQ ID NO: 351802 - DNA, 33 bp, Artificial Sequence
  Description of Artificial Sequence: Synthetic oligonucleotide
atgggtactggacagccattgtcttcatgcatg

SEQ ID NO: 351803 - DNA, 32 bp, Artificial Sequence
  Description of Artificial Sequence: Synthetic oligonucleotide
tgggtactggacagccattgtcttcatgcatg

SEQ ID NO: 351804 - DNA, 31 bp, Artificial Sequence
  Description of Artificial Sequence: Synthetic oligonucleotide
gggtactggacagccattgtcttcatgcatg

SEQ ID NO: 351805 - DNA, 35 bp, Artificial Sequence
  Description of Artificial Sequence: Synthetic oligonucleotide
ggtactggacagccattgtcttcatgcatgtattc

SEQ ID NO: 351806 - DNA, 38 bp, Artificial Sequence
  Description of Artificial Sequence: Synthetic oligonucleotide
gtactggacagccattgtcttcatgcatgtattctaac

SEQ ID NO: 351807 - DNA, 39 bp, Artificial Sequence
  Description of Artificial Sequence: Synthetic oligonucleotide
tactggacagccattgtcttcatgcatgtattctaacag

SEQ ID NO: 351808 - DNA, 38 bp, Artificial Sequence
  Description of Artificial Sequence: Synthetic oligonucleotide
actggacagccattgtcttcatgcatgtattctaacag

SEQ ID NO: 351809 - DNA, 37 bp, Artificial Sequence
  Description of Artificial Sequence: Synthetic oligonucleotide
ctggacagccattgtcttcatgcatgtattctaacag

SEQ ID NO: 351810 - DNA, 39 bp, Artificial Sequence
  Description of Artificial Sequence: Synthetic oligonucleotide
tggacagccattgtcttcatgcatgtattctaacagttc

SEQ ID NO: 351811 - DNA, 38 bp, Artificial Sequence
  Description of Artificial Sequence: Synthetic oligonucleotide
ggacagccattgtcttcatgcatgtattctaacagttc

SEQ ID NO: 351812 - DNA, 40 bp, Artificial Sequence
  Description of Artificial Sequence: Synthetic oligonucleotide
gacagccattgtcttcatgcatgtattctaacagttcttc

SEQ ID NO: 351813 - DNA, 40 bp, Artificial Sequence
  Description of Artificial Sequence: Synthetic oligonucleotide
acagccattgtcttcatgcatgtattctaacagttcttcg

SEQ ID NO: 351814 - DNA, 39 bp, Artificial Sequence
  Description of Artificial Sequence: Synthetic oligonucleotide
cagccattgtcttcatgcatgtattctaacagttcttcg

SEQ ID NO: 351815 - DNA, 40 bp, Artificial Sequence
  Description of Artificial Sequence: Synthetic oligonucleotide
agccattgtcttcatgcatgtattctaacagttcttcgac

SEQ ID NO: 351816 - DNA, 39 bp, Artificial Sequence
  Description of Artificial Sequence: Synthetic oligonucleotide
gccattgtcttcatgcatgtattctaacagttcttcgac

SEQ ID NO: 351817 - DNA, 39 bp, Artificial Sequence
  Description of Artificial Sequence: Synthetic oligonucleotide
ccattgtcttcatgcatgtattctaacagttcttcgacc

SEQ ID NO: 351818 - DNA, 39 bp, Artificial Sequence
  Description of Artificial Sequence: Synthetic oligonucleotide
cattgtcttcatgcatgtattctaacagttcttcgaccc

SEQ ID NO: 351819 - DNA, 41 bp, Artificial Sequence
  Description of Artificial Sequence: Synthetic oligonucleotide
attgtcttcatgcatgtattctaacagttcttcgacccttg

SEQ ID NO: 351820 - DNA, 40 bp, Artificial Sequence
  Description of Artificial Sequence: Synthetic oligonucleotide
ttgtcttcatgcatgtattctaacagttcttcgacccttg

SEQ ID NO: 351821 - DNA, 39 bp, Artificial Sequence
  Description of Artificial Sequence: Synthetic oligonucleotide
tgtcttcatgcatgtattctaacagttcttcgacccttg

SEQ ID NO: 351822 - DNA, 38 bp, Artificial Sequence
  Description of Artificial Sequence: Synthetic oligonucleotide
gtcttcatgcatgtattctaacagttcttcgacccttg

SEQ ID NO: 351823 - DNA, 38 bp, Artificial Sequence
  Description of Artificial Sequence: Synthetic oligonucleotide
tcttcatgcatgtattctaacagttcttcgacccttgc

SEQ ID NO: 351824 - DNA, 37 bp, Artificial Sequence
  Description of Artificial Sequence: Synthetic oligonucleotide
cttcatgcatgtattctaacagttcttcgacccttgc

SEQ ID NO: 351825 - DNA, 42 bp, Artificial Sequence
  Description of Artificial Sequence: Synthetic oligonucleotide
ttcatgcatgtattctaacagttcttcgacccttgcataaag

SEQ ID NO: 351826 - DNA, 41 bp, Artificial Sequence
  Description of Artificial Sequence: Synthetic oligonucleotide
tcatgcatgtattctaacagttcttcgacccttgcataaag

SEQ ID NO: 351827 - DNA, 40 bp, Artificial Sequence
  Description of Artificial Sequence: Synthetic oligonucleotide
catgcatgtattctaacagttcttcgacccttgcataaag

SEQ ID NO: 351828 - DNA, 40 bp, Artificial Sequence
  Description of Artificial Sequence: Synthetic oligonucleotide
atgcatgtattctaacagttcttcgacccttgcataaagc

SEQ ID NO: 351829 - DNA, 39 bp, Artificial Sequence
  Description of Artificial Sequence: Synthetic oligonucleotide
tgcatgtattctaacagttcttcgacccttgcataaagc

SEQ ID NO: 351830 - DNA, 38 bp, Artificial Sequence
  Description of Artificial Sequence: Synthetic oligonucleotide
gcatgtattctaacagttcttcgacccttgcataaagc

SEQ ID NO: 351831 - DNA, 39 bp, Artificial Sequence
  Description of Artificial Sequence: Synthetic oligonucleotide
catgtattctaacagttcttcgacccttgcataaagctc

SEQ ID NO: 351832 - DNA, 43 bp, Artificial Sequence
  Description of Artificial Sequence: Synthetic oligonucleotide
atgtattctaacagttcttcgacccttgcataaagctcttatc

SEQ ID NO: 351833 - DNA, 42 bp, Artificial Sequence
  Description of Artificial Sequence: Synthetic oligonucleotide
tgtattctaacagttcttcgacccttgcataaagctcttatc

SEQ ID NO: 351834 - DNA, 41 bp, Artificial Sequence
  Description of Artificial Sequence: Synthetic oligonucleotide
gtattctaacagttcttcgacccttgcataaagctcttatc

SEQ ID NO: 351835 - DNA, 43 bp, Artificial Sequence
  Description of Artificial Sequence: Synthetic oligonucleotide
tattctaacagttcttcgacccttgcataaagctcttatcttc

SEQ ID NO: 351836 - DNA, 42 bp, Artificial Sequence
  Description of Artificial Sequence: Synthetic oligonucleotide
attctaacagttcttcgacccttgcataaagctcttatcttc

SEQ ID NO: 351837 - DNA, 41 bp, Artificial Sequence
  Description of Artificial Sequence: Synthetic oligonucleotide
ttctaacagttcttcgacccttgcataaagctcttatcttc

SEQ ID NO: 351838 - DNA, 40 bp, Artificial Sequence
  Description of Artificial Sequence: Synthetic oligonucleotide
tctaacagttcttcgacccttgcataaagctcttatcttc

SEQ ID NO: 351839 - DNA, 39 bp, Artificial Sequence
  Description of Artificial Sequence: Synthetic oligonucleotide
ctaacagttcttcgacccttgcataaagctcttatcttc

SEQ ID NO: 351840 - DNA, 39 bp, Artificial Sequence
  Description of Artificial Sequence: Synthetic oligonucleotide
taacagttcttcgacccttgcataaagctcttatcttcc

SEQ ID NO: 351841 - DNA, 38 bp, Artificial Sequence
  Description of Artificial Sequence: Synthetic oligonucleotide
aacagttcttcgacccttgcataaagctcttatcttcc

SEQ ID NO: 351842 - DNA, 37 bp, Artificial Sequence
  Description of Artificial Sequence: Synthetic oligonucleotide
acagttcttcgacccttgcataaagctcttatcttcc

SEQ ID NO: 351843 - DNA, 36 bp, Artificial Sequence
  Description of Artificial Sequence: Synthetic oligonucleotide
cagttcttcgacccttgcataaagctcttatcttcc

SEQ ID NO: 351844 - DNA, 37 bp, Artificial Sequence
  Description of Artificial Sequence: Synthetic oligonucleotide
agttcttcgacccttgcataaagctcttatcttccag

SEQ ID NO: 351845 - DNA, 36 bp, Artificial Sequence
  Description of Artificial Sequence: Synthetic oligonucleotide
gttcttcgacccttgcataaagctcttatcttccag

SEQ ID NO: 351846 - DNA, 37 bp, Artificial Sequence
  Description of Artificial Sequence: Synthetic oligonucleotide
ttcttcgacccttgcataaagctcttatcttccagtc

SEQ ID NO: 351847 - DNA, 36 bp, Artificial Sequence
  Description of Artificial Sequence: Synthetic oligonucleotide
tcttcgacccttgcataaagctcttatcttccagtc

SEQ ID NO: 351848 - DNA, 35 bp, Artificial Sequence
  Description of Artificial Sequence: Synthetic oligonucleotide
cttcgacccttgcataaagctcttatcttccagtc

SEQ ID NO: 351849 - DNA, 38 bp, Artificial Sequence
  Description of Artificial Sequence: Synthetic oligonucleotide
ttcgacccttgcataaagctcttatcttccagtctttc

SEQ ID NO: 351850 - DNA, 37 bp, Artificial Sequence
  Description of Artificial Sequence: Synthetic oligonucleotide
tcgacccttgcataaagctcttatcttccagtctttc

SEQ ID NO: 351851 - DNA, 36 bp, Artificial Sequence
  Description of Artificial Sequence: Synthetic oligonucleotide
cgacccttgcataaagctcttatcttccagtctttc

SEQ ID NO: 351852 - DNA, 37 bp, Artificial Sequence
  Description of Artificial Sequence: Synthetic oligonucleotide
gacccttgcataaagctcttatcttccagtctttctg

SEQ ID NO: 351853 - DNA, 39 bp, Artificial Sequence
  Description of Artificial Sequence: Synthetic oligonucleotide
acccttgcataaagctcttatcttccagtctttctgaag

SEQ ID NO: 351854 - DNA, 38 bp, Artificial Sequence
  Description of Artificial Sequence: Synthetic oligonucleotide
cccttgcataaagctcttatcttccagtctttctgaag

SEQ ID NO: 351855 - DNA, 38 bp, Artificial Sequence
  Description of Artificial Sequence: Synthetic oligonucleotide
ccttgcataaagctcttatcttccagtctttctgaagc

SEQ ID NO: 351856 - DNA, 38 bp, Artificial Sequence
  Description of Artificial Sequence: Synthetic oligonucleotide
cttgcataaagctcttatcttccagtctttctgaagcc

SEQ ID NO: 351857 - DNA, 41 bp, Artificial Sequence
  Description of Artificial Sequence: Synthetic oligonucleotide
ttgcataaagctcttatcttccagtctttctgaagcctttc

SEQ ID NO: 351858 - DNA, 40 bp, Artificial Sequence
  Description of Artificial Sequence: Synthetic oligonucleotide
tgcataaagctcttatcttccagtctttctgaagcctttc

SEQ ID NO: 351859 - DNA, 39 bp, Artificial Sequence
  Description of Artificial Sequence: Synthetic oligonucleotide
gcataaagctcttatcttccagtctttctgaagcctttc

SEQ ID NO: 351860 - DNA, 40 bp, Artificial Sequence
  Description of Artificial Sequence: Synthetic oligonucleotide
cataaagctcttatcttccagtctttctgaagcctttcag

SEQ ID NO: 351861 - DNA, 41 bp, Artificial Sequence
  Description of Artificial Sequence: Synthetic oligonucleotide
ataaagctcttatcttccagtctttctgaagcctttcagag

SEQ ID NO: 351862 - DNA, 40 bp, Artificial Sequence
  Description of Artificial Sequence: Synthetic oligonucleotide
taaagctcttatcttccagtctttctgaagcctttcagag

SEQ ID NO: 351863 - DNA, 39 bp, Artificial Sequence
  Description of Artificial Sequence: Synthetic oligonucleotide
aaagctcttatcttccagtctttctgaagcctttcagag

SEQ ID NO: 351864 - DNA, 38 bp, Artificial Sequence
  Description of Artificial Sequence: Synthetic oligonucleotide
aagctcttatcttccagtctttctgaagcctttcagag

SEQ ID NO: 351865 - DNA, 37 bp, Artificial Sequence
  Description of Artificial Sequence: Synthetic oligonucleotide
agctcttatcttccagtctttctgaagcctttcagag

SEQ ID NO: 351866 - DNA, 36 bp, Artificial Sequence
  Description of Artificial Sequence: Synthetic oligonucleotide
gctcttatcttccagtctttctgaagcctttcagag

SEQ ID NO: 351867 - DNA, 36 bp, Artificial Sequence
  Description of Artificial Sequence: Synthetic oligonucleotide
ctcttatcttccagtctttctgaagcctttcagagc

SEQ ID NO: 351868 - DNA, 37 bp, Artificial Sequence
  Description of Artificial Sequence: Synthetic oligonucleotide
tcttatcttccagtctttctgaagcctttcagagctg

SEQ ID NO: 351869 - DNA, 36 bp, Artificial Sequence
  Description of Artificial Sequence: Synthetic oligonucleotide
cttatcttccagtctttctgaagcctttcagagctg

SEQ ID NO: 351870 - DNA, 36 bp, Artificial Sequence
  Description of Artificial Sequence: Synthetic oligonucleotide
ttatcttccagtctttctgaagcctttcagagctgg

SEQ ID NO: 351871 - DNA, 35 bp, Artificial Sequence
  Description of Artificial Sequence: Synthetic oligonucleotide
tatcttccagtctttctgaagcctttcagagctgg

SEQ ID NO: 351872 - DNA, 34 bp, Artificial Sequence
  Description of Artificial Sequence: Synthetic oligonucleotide
atcttccagtctttctgaagcctttcagagctgg

SEQ ID NO: 351873 - DNA, 33 bp, Artificial Sequence
  Description of Artificial Sequence: Synthetic oligonucleotide
tcttccagtctttctgaagcctttcagagctgg

SEQ ID NO: 351874 - DNA, 32 bp, Artificial Sequence
  Description of Artificial Sequence: Synthetic oligonucleotide
cttccagtctttctgaagcctttcagagctgg

SEQ ID NO: 351875 - DNA, 32 bp, Artificial Sequence
  Description of Artificial Sequence: Synthetic oligonucleotide
ttccagtctttctgaagcctttcagagctggc

SEQ ID NO: 351876 - DNA, 31 bp, Artificial Sequence
  Description of Artificial Sequence: Synthetic oligonucleotide
tccagtctttctgaagcctttcagagctggc

SEQ ID NO: 351877 - DNA, 30 bp, Artificial Sequence
  Description of Artificial Sequence: Synthetic oligonucleotide
ccagtctttctgaagcctttcagagctggc

SEQ ID NO: 351878 - DNA, 31 bp, Artificial Sequence
  Description of Artificial Sequence: Synthetic oligonucleotide
cagtctttctgaagcctttcagagctggctc

SEQ ID NO: 351879 - DNA, 32 bp, Artificial Sequence
  Description of Artificial Sequence: Synthetic oligonucleotide
agtctttctgaagcctttcagagctggctcag

SEQ ID NO: 351880 - DNA, 31 bp, Artificial Sequence
  Description of Artificial Sequence: Synthetic oligonucleotide
gtctttctgaagcctttcagagctggctcag

SEQ ID NO: 351881 - DNA, 31 bp, Artificial Sequence
  Description of Artificial Sequence: Synthetic oligonucleotide
tctttctgaagcctttcagagctggctcagg

SEQ ID NO: 351882 - DNA, 30 bp, Artificial Sequence
  Description of Artificial Sequence: Synthetic oligonucleotide
ctttctgaagcctttcagagctggctcagg

SEQ ID NO: 351883 - DNA, 31 bp, Artificial Sequence
  Description of Artificial Sequence: Synthetic oligonucleotide
tttctgaagcctttcagagctggctcaggag

SEQ ID NO: 351884 - DNA, 30 bp, Artificial Sequence
  Description of Artificial Sequence: Synthetic oligonucleotide
ttctgaagcctttcagagctggctcaggag

SEQ ID NO: 351885 - DNA, 29 bp, Artificial Sequence
  Description of Artificial Sequence: Synthetic oligonucleotide
tctgaagcctttcagagctggctcaggag

SEQ ID NO: 351886 - DNA, 28 bp, Artificial Sequence
  Description of Artificial Sequence: Synthetic oligonucleotide
ctgaagcctttcagagctggctcaggag

SEQ ID NO: 351887 - DNA, 33 bp, Artificial Sequence
  Description of Artificial Sequence: Synthetic oligonucleotide
tgaagcctttcagagctggctcaggagtttttg

SEQ ID NO: 351888 - DNA, 32 bp, Artificial Sequence
  Description of Artificial Sequence: Synthetic oligonucleotide
gaagcctttcagagctggctcaggagtttttg

SEQ ID NO: 351889 - DNA, 32 bp, Artificial Sequence
  Description of Artificial Sequence: Synthetic oligonucleotide
aagcctttcagagctggctcaggagtttttgc

SEQ ID NO: 351890 - DNA, 31 bp, Artificial Sequence
  Description of Artificial Sequence: Synthetic oligonucleotide
agcctttcagagctggctcaggagtttttgc

SEQ ID NO: 351891 - DNA, 30 bp, Artificial Sequence
  Description of Artificial Sequence: Synthetic oligonucleotide
gcctttcagagctggctcaggagtttttgc

SEQ ID NO: 351892 - DNA, 31 bp, Artificial Sequence
  Description of Artificial Sequence: Synthetic oligonucleotide
cctttcagagctggctcaggagtttttgctc

SEQ ID NO: 351893 - DNA, 31 bp, Artificial Sequence
  Description of Artificial Sequence: Synthetic oligonucleotide
ctttcagagctggctcaggagtttttgctcg

SEQ ID NO: 351894 - DNA, 31 bp, Artificial Sequence
  Description of Artificial Sequence: Synthetic oligonucleotide
tttcagagctggctcaggagtttttgctcgg

SEQ ID NO: 351895 - DNA, 30 bp, Artificial Sequence
  Description of Artificial Sequence: Synthetic oligonucleotide
ttcagagctggctcaggagtttttgctcgg

SEQ ID NO: 351896 - DNA, 29 bp, Artificial Sequence
  Description of Artificial Sequence: Synthetic oligonucleotide
tcagagctggctcaggagtttttgctcgg

SEQ ID NO: 351897 - DNA, 28 bp, Artificial Sequence
  Description of Artificial Sequence: Synthetic oligonucleotide
cagagctggctcaggagtttttgctcgg

SEQ ID NO: 351898 - DNA, 28 bp, Artificial Sequence
  Description of Artificial Sequence: Synthetic oligonucleotide
agagctggctcaggagtttttgctcggc

SEQ ID NO: 351899 - DNA, 27 bp, Artificial Sequence
  Description of Artificial Sequence: Synthetic oligonucleotide
gagctggctcaggagtttttgctcggc

SEQ ID NO: 351900 - DNA, 27 bp, Artificial Sequence
  Description of Artificial Sequence: Synthetic oligonucleotide
agctggctcaggagtttttgctcggcc

SEQ ID NO: 351901 - DNA, 27 bp, Artificial Sequence
  Description of Artificial Sequence: Synthetic oligonucleotide
gctggctcaggagtttttgctcggcct

SEQ ID NO: 351902 - DNA, 27 bp, Artificial Sequence
  Description of Artificial Sequence: Synthetic oligonucleotide
ctggctcaggagtttttgctcggcctg

SEQ ID NO: 351903 - DNA, 27 bp, Artificial Sequence
  Description of Artificial Sequence: Synthetic oligonucleotide
tggctcaggagtttttgctcggcctgc

SEQ ID NO: 351904 - DNA, 27 bp, Artificial Sequence
  Description of Artificial Sequence: Synthetic oligonucleotide
ggctcaggagtttttgctcggcctgca

SEQ ID NO: 351905 - DNA, 27 bp, Artificial Sequence
  Description of Artificial Sequence: Synthetic oligonucleotide
gctcaggagtttttgctcggcctgcag

SEQ ID NO: 351906 - DNA, 27 bp, Artificial Sequence
  Description of Artificial Sequence: Synthetic oligonucleotide
ctcaggagtttttgctcggcctgcagc

SEQ ID NO: 351907 - DNA, 27 bp, Artificial Sequence
  Description of Artificial Sequence: Synthetic oligonucleotide
tcaggagtttttgctcggcctgcagcc

SEQ ID NO: 351908 - DNA, 27 bp, Artificial Sequence
  Description of Artificial Sequence: Synthetic oligonucleotide
caggagtttttgctcggcctgcagcca

SEQ ID NO: 351909 - DNA, 27 bp, Artificial Sequence
  Description of Artificial Sequence: Synthetic oligonucleotide
aggagtttttgctcggcctgcagccag

SEQ ID NO: 351910 - DNA, 26 bp, Artificial Sequence
  Description of Artificial Sequence: Synthetic oligonucleotide
ggagtttttgctcggcctgcagccag

SEQ ID NO: 351911 - DNA, 27 bp, Artificial Sequence
  Description of Artificial Sequence: Synthetic oligonucleotide
gagtttttgctcggcctgcagccagca

SEQ ID NO: 351912 - DNA, 31 bp, Artificial Sequence
  Description of Artificial Sequence: Synthetic oligonucleotide
agtttttgctcggcctgcagccagcaaaaag

SEQ ID NO: 351913 - DNA, 30 bp, Artificial Sequence
  Description of Artificial Sequence: Synthetic oligonucleotide
gtttttgctcggcctgcagccagcaaaaag

SEQ ID NO: 351914 - DNA, 30 bp, Artificial Sequence
  Description of Artificial Sequence: Synthetic oligonucleotide
tttttgctcggcctgcagccagcaaaaagc

SEQ ID NO: 351915 - DNA, 29 bp, Artificial Sequence
  Description of Artificial Sequence: Synthetic oligonucleotide
ttttgctcggcctgcagccagcaaaaagc

SEQ ID NO: 351916 - DNA, 28 bp, Artificial Sequence
  Description of Artificial Sequence: Synthetic oligonucleotide
tttgctcggcctgcagccagcaaaaagc

SEQ ID NO: 351917 - DNA, 27 bp, Artificial Sequence
  Description of Artificial Sequence: Synthetic oligonucleotide
ttgctcggcctgcagccagcaaaaagc

SEQ ID NO: 351918 - DNA, 26 bp, Artificial Sequence
  Description of Artificial Sequence: Synthetic oligonucleotide
tgctcggcctgcagccagcaaaaagc

SEQ ID NO: 351919 - DNA, 25 bp, Artificial Sequence
  Description of Artificial Sequence: Synthetic oligonucleotide
gctcggcctgcagccagcaaaaagc

SEQ ID NO: 351920 - DNA, 26 bp, Artificial Sequence
  Description of Artificial Sequence: Synthetic oligonucleotide
ctcggcctgcagccagcaaaaagcct

SEQ ID NO: 351921 - DNA, 27 bp, Artificial Sequence
  Description of Artificial Sequence: Synthetic oligonucleotide
tcggcctgcagccagcaaaaagcctgt

SEQ ID NO: 351922 - DNA, 26 bp, Artificial Sequence
  Description of Artificial Sequence: Synthetic oligonucleotide
cggcctgcagccagcaaaaagcctgt

SEQ ID NO: 351923 - DNA, 27 bp, Artificial Sequence
  Description of Artificial Sequence: Synthetic oligonucleotide
ggcctgcagccagcaaaaagcctgtga

SEQ ID NO: 351924 - DNA, 27 bp, Artificial Sequence
  Description of Artificial Sequence: Synthetic oligonucleotide
gcctgcagccagcaaaaagcctgtgag

SEQ ID NO: 351925 - DNA, 27 bp, Artificial Sequence
  Description of Artificial Sequence: Synthetic oligonucleotide
cctgcagccagcaaaaagcctgtgagc

SEQ ID NO: 351926 - DNA, 27 bp, Artificial Sequence
  Description of Artificial Sequence: Synthetic oligonucleotide
ctgcagccagcaaaaagcctgtgagcg

SEQ ID NO: 351927 - DNA, 27 bp, Artificial Sequence
  Description of Artificial Sequence: Synthetic oligonucleotide
tgcagccagcaaaaagcctgtgagcgg

SEQ ID NO: 351928 - DNA, 27 bp, Artificial Sequence
  Description of Artificial Sequence: Synthetic oligonucleotide
gcagccagcaaaaagcctgtgagcgga

SEQ ID NO: 351929 - DNA, 29 bp, Artificial Sequence
  Description of Artificial Sequence: Synthetic oligonucleotide
cagccagcaaaaagcctgtgagcggatag

SEQ ID NO: 351930 - DNA, 29 bp, Artificial Sequence
  Description of Artificial Sequence: Synthetic oligonucleotide
agccagcaaaaagcctgtgagcggatagg

SEQ ID NO: 351931 - DNA, 28 bp, Artificial Sequence
  Description of Artificial Sequence: Synthetic oligonucleotide
gccagcaaaaagcctgtgagcggatagg

SEQ ID NO: 351932 - DNA, 31 bp, Artificial Sequence
  Description of Artificial Sequence: Synthetic oligonucleotide
ccagcaaaaagcctgtgagcggataggaaac

SEQ ID NO: 351933 - DNA, 31 bp, Artificial Sequence
  Description of Artificial Sequence: Synthetic oligonucleotide
cagcaaaaagcctgtgagcggataggaaacg

SEQ ID NO: 351934 - DNA, 33 bp, Artificial Sequence
  Description of Artificial Sequence: Synthetic oligonucleotide
agcaaaaagcctgtgagcggataggaaacgaag

SEQ ID NO: 351935 - DNA, 32 bp, Artificial Sequence
  Description of Artificial Sequence: Synthetic oligonucleotide
gcaaaaagcctgtgagcggataggaaacgaag

SEQ ID NO: 351936 - DNA, 34 bp, Artificial Sequence
  Description of Artificial Sequence: Synthetic oligonucleotide
caaaaagcctgtgagcggataggaaacgaagatc

SEQ ID NO: 351937 - DNA, 36 bp, Artificial Sequence
  Description of Artificial Sequence: Synthetic oligonucleotide
aaaaagcctgtgagcggataggaaacgaagatctag

SEQ ID NO: 351938 - DNA, 35 bp, Artificial Sequence
  Description of Artificial Sequence: Synthetic oligonucleotide
aaaagcctgtgagcggataggaaacgaagatctag

SEQ ID NO: 351939 - DNA, 34 bp, Artificial Sequence
  Description of Artificial Sequence: Synthetic oligonucleotide
aaagcctgtgagcggataggaaacgaagatctag

SEQ ID NO: 351940 - DNA, 33 bp, Artificial Sequence
  Description of Artificial Sequence: Synthetic oligonucleotide
aagcctgtgagcggataggaaacgaagatctag

SEQ ID NO: 351941 - DNA, 32 bp, Artificial Sequence
  Description of Artificial Sequence: Synthetic oligonucleotide
agcctgtgagcggataggaaacgaagatctag

SEQ ID NO: 351942 - DNA, 31 bp, Artificial Sequence
  Description of Artificial Sequence: Synthetic oligonucleotide
gcctgtgagcggataggaaacgaagatctag

SEQ ID NO: 351943 - DNA, 32 bp, Artificial Sequence
  Description of Artificial Sequence: Synthetic oligonucleotide
cctgtgagcggataggaaacgaagatctagag

SEQ ID NO: 351944 - DNA, 33 bp, Artificial Sequence
  Description of Artificial Sequence: Synthetic oligonucleotide
ctgtgagcggataggaaacgaagatctagagtc

SEQ ID NO: 351945 - DNA, 35 bp, Artificial Sequence
  Description of Artificial Sequence: Synthetic oligonucleotide
tgtgagcggataggaaacgaagatctagagtcatc

SEQ ID NO: 351946 - DNA, 34 bp, Artificial Sequence
  Description of Artificial Sequence: Synthetic oligonucleotide
gtgagcggataggaaacgaagatctagagtcatc

SEQ ID NO: 351947 - DNA, 34 bp, Artificial Sequence
  Description of Artificial Sequence: Synthetic oligonucleotide
tgagcggataggaaacgaagatctagagtcatcc

SEQ ID NO: 351948 - DNA, 33 bp, Artificial Sequence
  Description of Artificial Sequence: Synthetic oligonucleotide
gagcggataggaaacgaagatctagagtcatcc

SEQ ID NO: 351949 - DNA, 34 bp, Artificial Sequence
  Description of Artificial Sequence: Synthetic oligonucleotide
agcggataggaaacgaagatctagagtcatccac

SEQ ID NO: 351950 - DNA, 33 bp, Artificial Sequence
  Description of Artificial Sequence: Synthetic oligonucleotide
gcggataggaaacgaagatctagagtcatccac

SEQ ID NO: 351951 - DNA, 34 bp, Artificial Sequence
  Description of Artificial Sequence: Synthetic oligonucleotide
cggataggaaacgaagatctagagtcatccacag

SEQ ID NO: 351952 - DNA, 37 bp, Artificial Sequence
  Description of Artificial Sequence: Synthetic oligonucleotide
ggataggaaacgaagatctagagtcatccacagatag

SEQ ID NO: 351953 - DNA, 38 bp, Artificial Sequence
  Description of Artificial Sequence: Synthetic oligonucleotide
gataggaaacgaagatctagagtcatccacagatagag

SEQ ID NO: 351954 - DNA, 40 bp, Artificial Sequence
  Description of Artificial Sequence: Synthetic oligonucleotide
ataggaaacgaagatctagagtcatccacagatagagaag

SEQ ID NO: 351955 - DNA, 39 bp, Artificial Sequence
  Description of Artificial Sequence: Synthetic oligonucleotide
taggaaacgaagatctagagtcatccacagatagagaag

SEQ ID NO: 351956 - DNA, 38 bp, Artificial Sequence
  Description of Artificial Sequence: Synthetic oligonucleotide
aggaaacgaagatctagagtcatccacagatagagaag

SEQ ID NO: 351957 - DNA, 37 bp, Artificial Sequence
  Description of Artificial Sequence: Synthetic oligonucleotide
ggaaacgaagatctagagtcatccacagatagagaag

SEQ ID NO: 351958 - DNA, 38 bp, Artificial Sequence
  Description of Artificial Sequence: Synthetic oligonucleotide
gaaacgaagatctagagtcatccacagatagagaagag

SEQ ID NO: 351959 - DNA, 39 bp, Artificial Sequence
  Description of Artificial Sequence: Synthetic oligonucleotide
aaacgaagatctagagtcatccacagatagagaagagac

SEQ ID NO: 351960 - DNA, 38 bp, Artificial Sequence
  Description of Artificial Sequence: Synthetic oligonucleotide
aacgaagatctagagtcatccacagatagagaagagac

SEQ ID NO: 351961 - DNA, 37 bp, Artificial Sequence
  Description of Artificial Sequence: Synthetic oligonucleotide
acgaagatctagagtcatccacagatagagaagagac

SEQ ID NO: 351962 - DNA, 36 bp, Artificial Sequence
  Description of Artificial Sequence: Synthetic oligonucleotide
cgaagatctagagtcatccacagatagagaagagac

SEQ ID NO: 351963 - DNA, 37 bp, Artificial Sequence
  Description of Artificial Sequence: Synthetic oligonucleotide
gaagatctagagtcatccacagatagagaagagacac

SEQ ID NO: 351964 - DNA, 37 bp, Artificial Sequence
  Description of Artificial Sequence: Synthetic oligonucleotide
aagatctagagtcatccacagatagagaagagacacc

SEQ ID NO: 351965 - DNA, 36 bp, Artificial Sequence
  Description of Artificial Sequence: Synthetic oligonucleotide
agatctagagtcatccacagatagagaagagacacc

SEQ ID NO: 351966 - DNA, 35 bp, Artificial Sequence
  Description of Artificial Sequence: Synthetic oligonucleotide
gatctagagtcatccacagatagagaagagacacc

SEQ ID NO: 351967 - DNA, 37 bp, Artificial Sequence
  Description of Artificial Sequence: Synthetic oligonucleotide
atctagagtcatccacagatagagaagagacacctac

SEQ ID NO: 351968 - DNA, 36 bp, Artificial Sequence
  Description of Artificial Sequence: Synthetic oligonucleotide
tctagagtcatccacagatagagaagagacacctac

SEQ ID NO: 351969 - DNA, 35 bp, Artificial Sequence
  Description of Artificial Sequence: Synthetic oligonucleotide
ctagagtcatccacagatagagaagagacacctac

SEQ ID NO: 351970 - DNA, 37 bp, Artificial Sequence
  Description of Artificial Sequence: Synthetic oligonucleotide
tagagtcatccacagatagagaagagacacctactag

SEQ ID NO: 351971 - DNA, 36 bp, Artificial Sequence
  Description of Artificial Sequence: Synthetic oligonucleotide
agagtcatccacagatagagaagagacacctactag

SEQ ID NO: 351972 - DNA, 35 bp, Artificial Sequence
  Description of Artificial Sequence: Synthetic oligonucleotide
gagtcatccacagatagagaagagacacctactag

SEQ ID NO: 351973 - DNA, 35 bp, Artificial Sequence
  Description of Artificial Sequence: Synthetic oligonucleotide
agtcatccacagatagagaagagacacctactagc

SEQ ID NO: 351974 - DNA, 34 bp, Artificial Sequence
  Description of Artificial Sequence: Synthetic oligonucleotide
gtcatccacagatagagaagagacacctactagc

SEQ ID NO: 351975 - DNA, 35 bp, Artificial Sequence
  Description of Artificial Sequence: Synthetic oligonucleotide
tcatccacagatagagaagagacacctactagcag

SEQ ID NO: 351976 - DNA, 34 bp, Artificial Sequence
  Description of Artificial Sequence: Synthetic oligonucleotide
catccacagatagagaagagacacctactagcag

SEQ ID NO: 351977 - DNA, 39 bp, Artificial Sequence
  Description of Artificial Sequence: Synthetic oligonucleotide
atccacagatagagaagagacacctactagcagtataac

SEQ ID NO: 351978 - DNA, 38 bp, Artificial Sequence
  Description of Artificial Sequence: Synthetic oligonucleotide
tccacagatagagaagagacacctactagcagtataac

SEQ ID NO: 351979 - DNA, 37 bp, Artificial Sequence
  Description of Artificial Sequence: Synthetic oligonucleotide
ccacagatagagaagagacacctactagcagtataac

SEQ ID NO: 351980 - DNA, 39 bp, Artificial Sequence
  Description of Artificial Sequence: Synthetic oligonucleotide
cacagatagagaagagacacctactagcagtataacaag

SEQ ID NO: 351981 - DNA, 40 bp, Artificial Sequence
  Description of Artificial Sequence: Synthetic oligonucleotide
acagatagagaagagacacctactagcagtataacaagtc

SEQ ID NO: 351982 - DNA, 39 bp, Artificial Sequence
  Description of Artificial Sequence: Synthetic oligonucleotide
cagatagagaagagacacctactagcagtataacaagtc

SEQ ID NO: 351983 - DNA, 39 bp, Artificial Sequence
  Description of Artificial Sequence: Synthetic oligonucleotide
agatagagaagagacacctactagcagtataacaagtcc

SEQ ID NO: 351984 - DNA, 38 bp, Artificial Sequence
  Description of Artificial Sequence: Synthetic oligonucleotide
gatagagaagagacacctactagcagtataacaagtcc

SEQ ID NO: 351985 - DNA, 39 bp, Artificial Sequence
  Description of Artificial Sequence: Synthetic oligonucleotide
atagagaagagacacctactagcagtataacaagtccag

SEQ ID NO: 351986 - DNA, 38 bp, Artificial Sequence
  Description of Artificial Sequence: Synthetic oligonucleotide
tagagaagagacacctactagcagtataacaagtccag

SEQ ID NO: 351987 - DNA, 37 bp, Artificial Sequence
  Description of Artificial Sequence: Synthetic oligonucleotide
agagaagagacacctactagcagtataacaagtccag

SEQ ID NO: 351988 - DNA, 36 bp, Artificial Sequence
  Description of Artificial Sequence: Synthetic oligonucleotide
gagaagagacacctactagcagtataacaagtccag

SEQ ID NO: 351989 - DNA, 37 bp, Artificial Sequence
  Description of Artificial Sequence: Synthetic oligonucleotide
agaagagacacctactagcagtataacaagtccagag

SEQ ID NO: 351990 - DNA, 36 bp, Artificial Sequence
  Description of Artificial Sequence: Synthetic oligonucleotide
gaagagacacctactagcagtataacaagtccagag

SEQ ID NO: 351991 - DNA, 36 bp, Artificial Sequence
  Description of Artificial Sequence: Synthetic oligonucleotide
aagagacacctactagcagtataacaagtccagagc

SEQ ID NO: 351992 - DNA, 35 bp, Artificial Sequence
  Description of Artificial Sequence: Synthetic oligonucleotide
agagacacctactagcagtataacaagtccagagc

SEQ ID NO: 351993 - DNA, 34 bp, Artificial Sequence
  Description of Artificial Sequence: Synthetic oligonucleotide
gagacacctactagcagtataacaagtccagagc

SEQ ID NO: 351994 - DNA, 34 bp, Artificial Sequence
  Description of Artificial Sequence: Synthetic oligonucleotide
agacacctactagcagtataacaagtccagagcc

SEQ ID NO: 351995 - DNA, 33 bp, Artificial Sequence
  Description of Artificial Sequence: Synthetic oligonucleotide
gacacctactagcagtataacaagtccagagcc

SEQ ID NO: 351996 - DNA, 34 bp, Artificial Sequence
  Description of Artificial Sequence: Synthetic oligonucleotide
acacctactagcagtataacaagtccagagcctg

SEQ ID NO: 351997 - DNA, 33 bp, Artificial Sequence
  Description of Artificial Sequence: Synthetic oligonucleotide
cacctactagcagtataacaagtccagagcctg

SEQ ID NO: 351998 - DNA, 33 bp, Artificial Sequence
  Description of Artificial Sequence: Synthetic oligonucleotide
acctactagcagtataacaagtccagagcctgg

SEQ ID NO: 351999 - DNA, 32 bp, Artificial Sequence
  Description of Artificial Sequence: Synthetic oligonucleotide
cctactagcagtataacaagtccagagcctgg

SEQ ID NO: 352000 - DNA, 33 bp, Artificial Sequence
  Description of Artificial Sequence: Synthetic oligonucleotide
ctactagcagtataacaagtccagagcctggtg

SEQ ID NO: 352001 - DNA, 34 bp, Artificial Sequence
  Description of Artificial Sequence: Synthetic oligonucleotide
tactagcagtataacaagtccagagcctggtgag

SEQ ID NO: 352002 - DNA, 33 bp, Artificial Sequence
  Description of Artificial Sequence: Synthetic oligonucleotide
actagcagtataacaagtccagagcctggtgag

SEQ ID NO: 352003 - DNA, 32 bp, Artificial Sequence
  Description of Artificial Sequence: Synthetic oligonucleotide
ctagcagtataacaagtccagagcctggtgag

SEQ ID NO: 352004 - DNA, 34 bp, Artificial Sequence
  Description of Artificial Sequence: Synthetic oligonucleotide
tagcagtataacaagtccagagcctggtgagttc

SEQ ID NO: 352005 - DNA, 33 bp, Artificial Sequence
  Description of Artificial Sequence: Synthetic oligonucleotide
agcagtataacaagtccagagcctggtgagttc

SEQ ID NO: 352006 - DNA, 32 bp, Artificial Sequence
  Description of Artificial Sequence: Synthetic oligonucleotide
gcagtataacaagtccagagcctggtgagttc

SEQ ID NO: 352007 - DNA, 34 bp, Artificial Sequence
  Description of Artificial Sequence: Synthetic oligonucleotide
cagtataacaagtccagagcctggtgagttcttg

SEQ ID NO: 352008 - DNA, 37 bp, Artificial Sequence
  Description of Artificial Sequence: Synthetic oligonucleotide
agtataacaagtccagagcctggtgagttcttgattg

SEQ ID NO: 352009 - DNA, 36 bp, Artificial Sequence
  Description of Artificial Sequence: Synthetic oligonucleotide
gtataacaagtccagagcctggtgagttcttgattg

SEQ ID NO: 352010 - DNA, 36 bp, Artificial Sequence
  Description of Artificial Sequence: Synthetic oligonucleotide
tataacaagtccagagcctggtgagttcttgattgc

SEQ ID NO: 352011 - DNA, 35 bp, Artificial Sequence
  Description of Artificial Sequence: Synthetic oligonucleotide
ataacaagtccagagcctggtgagttcttgattgc

SEQ ID NO: 352012 - DNA, 34 bp, Artificial Sequence
  Description of Artificial Sequence: Synthetic oligonucleotide
taacaagtccagagcctggtgagttcttgattgc

SEQ ID NO: 352013 - DNA, 33 bp, Artificial Sequence
  Description of Artificial Sequence: Synthetic oligonucleotide
aacaagtccagagcctggtgagttcttgattgc

SEQ ID NO: 352014 - DNA, 32 bp, Artificial Sequence
  Description of Artificial Sequence: Synthetic oligonucleotide
acaagtccagagcctggtgagttcttgattgc

SEQ ID NO: 352015 - DNA, 31 bp, Artificial Sequence
  Description of Artificial Sequence: Synthetic oligonucleotide
caagtccagagcctggtgagttcttgattgc

SEQ ID NO: 352016 - DNA, 32 bp, Artificial Sequence
  Description of Artificial Sequence: Synthetic oligonucleotide
aagtccagagcctggtgagttcttgattgctg

SEQ ID NO: 352017 - DNA, 31 bp, Artificial Sequence
  Description of Artificial Sequence: Synthetic oligonucleotide
agtccagagcctggtgagttcttgattgctg

SEQ ID NO: 352018 - DNA, 30 bp, Artificial Sequence
  Description of Artificial Sequence: Synthetic oligonucleotide
gtccagagcctggtgagttcttgattgctg

SEQ ID NO: 352019 - DNA, 32 bp, Artificial Sequence
  Description of Artificial Sequence: Synthetic oligonucleotide
tccagagcctggtgagttcttgattgctgaag

SEQ ID NO: 352020 - DNA, 31 bp, Artificial Sequence
  Description of Artificial Sequence: Synthetic oligonucleotide
ccagagcctggtgagttcttgattgctgaag

SEQ ID NO: 352021 - DNA, 33 bp, Artificial Sequence
  Description of Artificial Sequence: Synthetic oligonucleotide
cagagcctggtgagttcttgattgctgaagaac

SEQ ID NO: 352022 - DNA, 34 bp, Artificial Sequence
  Description of Artificial Sequence: Synthetic oligonucleotide
agagcctggtgagttcttgattgctgaagaactc

SEQ ID NO: 352023 - DNA, 33 bp, Artificial Sequence
  Description of Artificial Sequence: Synthetic oligonucleotide
gagcctggtgagttcttgattgctgaagaactc

SEQ ID NO: 352024 - DNA, 34 bp, Artificial Sequence
  Description of Artificial Sequence: Synthetic oligonucleotide
agcctggtgagttcttgattgctgaagaactctg

SEQ ID NO: 352025 - DNA, 33 bp, Artificial Sequence
  Description of Artificial Sequence: Synthetic oligonucleotide
gcctggtgagttcttgattgctgaagaactctg

SEQ ID NO: 352026 - DNA, 33 bp, Artificial Sequence
  Description of Artificial Sequence: Synthetic oligonucleotide
cctggtgagttcttgattgctgaagaactctgc

SEQ ID NO: 352027 - DNA, 34 bp, Artificial Sequence
  Description of Artificial Sequence: Synthetic oligonucleotide
ctggtgagttcttgattgctgaagaactctgctc

SEQ ID NO: 352028 - DNA, 35 bp, Artificial Sequence
  Description of Artificial Sequence: Synthetic oligonucleotide
tggtgagttcttgattgctgaagaactctgctctc

SEQ ID NO: 352029 - DNA, 34 bp, Artificial Sequence
  Description of Artificial Sequence: Synthetic oligonucleotide
ggtgagttcttgattgctgaagaactctgctctc

SEQ ID NO: 352030 - DNA, 34 bp, Artificial Sequence
  Description of Artificial Sequence: Synthetic oligonucleotide
gtgagttcttgattgctgaagaactctgctctcc

SEQ ID NO: 352031 - DNA, 24 bp, Artificial Sequence
  Description of Artificial Sequence: Synthetic oligonucleotide
atgaggcccgcgcagtgtcagctg

SEQ ID NO: 352032 - DNA, 23 bp, Artificial Sequence
  Description of Artificial Sequence: Synthetic oligonucleotide
tgaggcccgcgcagtgtcagctg

SEQ ID NO: 352033 - DNA, 22 bp, Artificial Sequence
  Description of Artificial Sequence: Synthetic oligonucleotide
gaggcccgcgcagtgtcagctg

SEQ ID NO: 352034 - DNA, 23 bp, Artificial Sequence
  Description of Artificial Sequence: Synthetic oligonucleotide
aggcccgcgcagtgtcagctgca

SEQ ID NO: 352035 - DNA, 22 bp, Artificial Sequence
  Description of Artificial Sequence: Synthetic oligonucleotide
ggcccgcgcagtgtcagctgca

SEQ ID NO: 352036 - DNA, 23 bp, Artificial Sequence
  Description of Artificial Sequence: Synthetic oligonucleotide
gcccgcgcagtgtcagctgcaca

SEQ ID NO: 352037 - DNA, 23 bp, Artificial Sequence
  Description of Artificial Sequence: Synthetic oligonucleotide
cccgcgcagtgtcagctgcacac

SEQ ID NO: 352038 - DNA, 23 bp, Artificial Sequence
  Description of Artificial Sequence: Synthetic oligonucleotide
ccgcgcagtgtcagctgcacacc

SEQ ID NO: 352039 - DNA, 23 bp, Artificial Sequence
  Description of Artificial Sequence: Synthetic oligonucleotide
cgcgcagtgtcagctgcacaccc

SEQ ID NO: 352040 - DNA, 25 bp, Artificial Sequence
  Description of Artificial Sequence: Synthetic oligonucleotide
gcgcagtgtcagctgcacacccctt

SEQ ID NO: 352041 - DNA, 25 bp, Artificial Sequence
  Description of Artificial Sequence: Synthetic oligonucleotide
cgcagtgtcagctgcacaccccttc

SEQ ID NO: 352042 - DNA, 25 bp, Artificial Sequence
  Description of Artificial Sequence: Synthetic oligonucleotide
gcagtgtcagctgcacaccccttcc

SEQ ID NO: 352043 - DNA, 26 bp, Artificial Sequence
  Description of Artificial Sequence: Synthetic oligonucleotide
cagtgtcagctgcacaccccttccct

SEQ ID NO: 352044 - DNA, 26 bp, Artificial Sequence
  Description of Artificial Sequence: Synthetic oligonucleotide
agtgtcagctgcacaccccttccctg

SEQ ID NO: 352045 - DNA, 25 bp, Artificial Sequence
  Description of Artificial Sequence: Synthetic oligonucleotide
gtgtcagctgcacaccccttccctg

SEQ ID NO: 352046 - DNA, 25 bp, Artificial Sequence
  Description of Artificial Sequence: Synthetic oligonucleotide
tgtcagctgcacaccccttccctgc

SEQ ID NO: 352047 - DNA, 24 bp, Artificial Sequence
  Description of Artificial Sequence: Synthetic oligonucleotide
gtcagctgcacaccccttccctgc

SEQ ID NO: 352048 - DNA, 26 bp, Artificial Sequence
  Description of Artificial Sequence: Synthetic oligonucleotide
tcagctgcacaccccttccctgcctt

SEQ ID NO: 352049 - DNA, 25 bp, Artificial Sequence
  Description of Artificial Sequence: Synthetic oligonucleotide
cagctgcacaccccttccctgcctt

SEQ ID NO: 352050 - DNA, 25 bp, Artificial Sequence
  Description of Artificial Sequence: Synthetic oligonucleotide
agctgcacaccccttccctgccttc

SEQ ID NO: 352051 - DNA, 24 bp, Artificial Sequence
  Description of Artificial Sequence: Synthetic oligonucleotide
gctgcacaccccttccctgccttc

SEQ ID NO: 352052 - DNA, 24 bp, Artificial Sequence
  Description of Artificial Sequence: Synthetic oligonucleotide
ctgcacaccccttccctgccttcc

SEQ ID NO: 352053 - DNA, 24 bp, Artificial Sequence
  Description of Artificial Sequence: Synthetic oligonucleotide
tgcacaccccttccctgccttccc

SEQ ID NO: 352054 - DNA, 23 bp, Artificial Sequence
  Description of Artificial Sequence: Synthetic oligonucleotide
gcacaccccttccctgccttccc

SEQ ID NO: 352055 - DNA, 24 bp, Artificial Sequence
  Description of Artificial Sequence: Synthetic oligonucleotide
cacaccccttccctgccttcccca

SEQ ID NO: 352056 - DNA, 25 bp, Artificial Sequence
  Description of Artificial Sequence: Synthetic oligonucleotide
acaccccttccctgccttccccaca

SEQ ID NO: 352057 - DNA, 24 bp, Artificial Sequence
  Description of Artificial Sequence: Synthetic oligonucleotide
caccccttccctgccttccccaca

SEQ ID NO: 352058 - DNA, 24 bp, Artificial Sequence
  Description of Artificial Sequence: Synthetic oligonucleotide
accccttccctgccttccccacac

SEQ ID NO: 352059 - DNA, 23 bp, Artificial Sequence
  Description of Artificial Sequence: Synthetic oligonucleotide
ccccttccctgccttccccacac

SEQ ID NO: 352060 - DNA, 25 bp, Artificial Sequence
  Description of Artificial Sequence: Synthetic oligonucleotide
cccttccctgccttccccacacctt

SEQ ID NO: 352061 - DNA, 26 bp, Artificial Sequence
  Description of Artificial Sequence: Synthetic oligonucleotide
ccttccctgccttccccacaccttct

SEQ ID NO: 352062 - DNA, 26 bp, Artificial Sequence
  Description of Artificial Sequence: Synthetic oligonucleotide
cttccctgccttccccacaccttctc

SEQ ID NO: 352063 - DNA, 27 bp, Artificial Sequence
  Description of Artificial Sequence: Synthetic oligonucleotide
ttccctgccttccccacaccttctcct

SEQ ID NO: 352064 - DNA, 26 bp, Artificial Sequence
  Description of Artificial Sequence: Synthetic oligonucleotide
tccctgccttccccacaccttctcct

SEQ ID NO: 352065 - DNA, 25 bp, Artificial Sequence
  Description of Artificial Sequence: Synthetic oligonucleotide
ccctgccttccccacaccttctcct

SEQ ID NO: 352066 - DNA, 25 bp, Artificial Sequence
  Description of Artificial Sequence: Synthetic oligonucleotide
cctgccttccccacaccttctcctg

SEQ ID NO: 352067 - DNA, 26 bp, Artificial Sequence
  Description of Artificial Sequence: Synthetic oligonucleotide
ctgccttccccacaccttctcctgct

SEQ ID NO: 352068 - DNA, 26 bp, Artificial Sequence
  Description of Artificial Sequence: Synthetic oligonucleotide
tgccttccccacaccttctcctgctc

SEQ ID NO: 352069 - DNA, 25 bp, Artificial Sequence
  Description of Artificial Sequence: Synthetic oligonucleotide
gccttccccacaccttctcctgctc

SEQ ID NO: 352070 - DNA, 26 bp, Artificial Sequence
  Description of Artificial Sequence: Synthetic oligonucleotide
ccttccccacaccttctcctgctcct

SEQ ID NO: 352071 - DNA, 27 bp, Artificial Sequence
  Description of Artificial Sequence: Synthetic oligonucleotide
cttccccacaccttctcctgctcctct

SEQ ID NO: 352072 - DNA, 27 bp, Artificial Sequence
  Description of Artificial Sequence: Synthetic oligonucleotide
ttccccacaccttctcctgctcctctg

SEQ ID NO: 352073 - DNA, 26 bp, Artificial Sequence
  Description of Artificial Sequence: Synthetic oligonucleotide
tccccacaccttctcctgctcctctg

SEQ ID NO: 352074 - DNA, 25 bp, Artificial Sequence
  Description of Artificial Sequence: Synthetic oligonucleotide
ccccacaccttctcctgctcctctg

SEQ ID NO: 352075 - DNA, 25 bp, Artificial Sequence
  Description of Artificial Sequence: Synthetic oligonucleotide
cccacaccttctcctgctcctctgg

SEQ ID NO: 352076 - DNA, 26 bp, Artificial Sequence
  Description of Artificial Sequence: Synthetic oligonucleotide
ccacaccttctcctgctcctctgggt

SEQ ID NO: 352077 - DNA, 26 bp, Artificial Sequence
  Description of Artificial Sequence: Synthetic oligonucleotide
cacaccttctcctgctcctctgggtc

SEQ ID NO: 352078 - DNA, 27 bp, Artificial Sequence
  Description of Artificial Sequence: Synthetic oligonucleotide
acaccttctcctgctcctctgggtcct

SEQ ID NO: 352079 - DNA, 26 bp, Artificial Sequence
  Description of Artificial Sequence: Synthetic oligonucleotide
caccttctcctgctcctctgggtcct

SEQ ID NO: 352080 - DNA, 26 bp, Artificial Sequence
  Description of Artificial Sequence: Synthetic oligonucleotide
accttctcctgctcctctgggtcctg

SEQ ID NO: 352081 - DNA, 25 bp, Artificial Sequence
  Description of Artificial Sequence: Synthetic oligonucleotide
ccttctcctgctcctctgggtcctg

SEQ ID NO: 352082 - DNA, 25 bp, Artificial Sequence
  Description of Artificial Sequence: Synthetic oligonucleotide
cttctcctgctcctctgggtcctgg

SEQ ID NO: 352083 - DNA, 26 bp, Artificial Sequence
  Description of Artificial Sequence: Synthetic oligonucleotide
ttctcctgctcctctgggtcctgggt

SEQ ID NO: 352084 - DNA, 25 bp, Artificial Sequence
  Description of Artificial Sequence: Synthetic oligonucleotide
tctcctgctcctctgggtcctgggt

SEQ ID NO: 352085 - DNA, 24 bp, Artificial Sequence
  Description of Artificial Sequence: Synthetic oligonucleotide
ctcctgctcctctgggtcctgggt

SEQ ID NO: 352086 - DNA, 24 bp, Artificial Sequence
  Description of Artificial Sequence: Synthetic oligonucleotide
tcctgctcctctgggtcctgggtg

SEQ ID NO: 352087 - DNA, 23 bp, Artificial Sequence
  Description of Artificial Sequence: Synthetic oligonucleotide
cctgctcctctgggtcctgggtg

SEQ ID NO: 352088 - DNA, 24 bp, Artificial Sequence
  Description of Artificial Sequence: Synthetic oligonucleotide
ctgctcctctgggtcctgggtgca

SEQ ID NO: 352089 - DNA, 24 bp, Artificial Sequence
  Description of Artificial Sequence: Synthetic oligonucleotide
tgctcctctgggtcctgggtgcag

SEQ ID NO: 352090 - DNA, 23 bp, Artificial Sequence
  Description of Artificial Sequence: Synthetic oligonucleotide
gctcctctgggtcctgggtgcag

SEQ ID NO: 352091 - DNA, 24 bp, Artificial Sequence
  Description of Artificial Sequence: Synthetic oligonucleotide
ctcctctgggtcctgggtgcagga

SEQ ID NO: 352092 - DNA, 25 bp, Artificial Sequence
  Description of Artificial Sequence: Synthetic oligonucleotide
tcctctgggtcctgggtgcaggagt

SEQ ID NO: 352093 - DNA, 24 bp, Artificial Sequence
  Description of Artificial Sequence: Synthetic oligonucleotide
cctctgggtcctgggtgcaggagt

SEQ ID NO: 352094 - DNA, 24 bp, Artificial Sequence
  Description of Artificial Sequence: Synthetic oligonucleotide
ctctgggtcctgggtgcaggagtg

SEQ ID NO: 352095 - DNA, 24 bp, Artificial Sequence
  Description of Artificial Sequence: Synthetic oligonucleotide
tctgggtcctgggtgcaggagtgg

SEQ ID NO: 352096 - DNA, 23 bp, Artificial Sequence
  Description of Artificial Sequence: Synthetic oligonucleotide
ctgggtcctgggtgcaggagtgg

SEQ ID NO: 352097 - DNA, 23 bp, Artificial Sequence
  Description of Artificial Sequence: Synthetic oligonucleotide
tgggtcctgggtgcaggagtggg

SEQ ID NO: 352098 - DNA, 22 bp, Artificial Sequence
  Description of Artificial Sequence: Synthetic oligonucleotide
gggtcctgggtgcaggagtggg

SEQ ID NO: 352099 - DNA, 22 bp, Artificial Sequence
  Description of Artificial Sequence: Synthetic oligonucleotide
ggtcctgggtgcaggagtgggc

SEQ ID NO: 352100 - DNA, 22 bp, Artificial Sequence
  Description of Artificial Sequence: Synthetic oligonucleotide
gtcctgggtgcaggagtgggcg

SEQ ID NO: 352101 - DNA, 23 bp, Artificial Sequence
  Description of Artificial Sequence: Synthetic oligonucleotide
tcctgggtgcaggagtgggcgct

SEQ ID NO: 352102 - DNA, 22 bp, Artificial Sequence
  Description of Artificial Sequence: Synthetic oligonucleotide
cctgggtgcaggagtgggcgct

SEQ ID NO: 352103 - DNA, 23 bp, Artificial Sequence
  Description of Artificial Sequence: Synthetic oligonucleotide
ctgggtgcaggagtgggcgctga

SEQ ID NO: 352104 - DNA, 23 bp, Artificial Sequence
  Description of Artificial Sequence: Synthetic oligonucleotide
tgggtgcaggagtgggcgctgag

SEQ ID NO: 352105 - DNA, 22 bp, Artificial Sequence
  Description of Artificial Sequence: Synthetic oligonucleotide
gggtgcaggagtgggcgctgag

SEQ ID NO: 352106 - DNA, 22 bp, Artificial Sequence
  Description of Artificial Sequence: Synthetic oligonucleotide
ggtgcaggagtgggcgctgagg

SEQ ID NO: 352107 - DNA, 22 bp, Artificial Sequence
  Description of Artificial Sequence: Synthetic oligonucleotide
gtgcaggagtgggcgctgaggg

SEQ ID NO: 352108 - DNA, 22 bp, Artificial Sequence
  Description of Artificial Sequence: Synthetic oligonucleotide
tgcaggagtgggcgctgagggc

SEQ ID NO: 352109 - DNA, 21 bp, Artificial Sequence
  Description of Artificial Sequence: Synthetic oligonucleotide
gcaggagtgggcgctgagggc

SEQ ID NO: 352110 - DNA, 21 bp, Artificial Sequence
  Description of Artificial Sequence: Synthetic oligonucleotide
caggagtgggcgctgagggcg

SEQ ID NO: 352111 - DNA, 21 bp, Artificial Sequence
  Description of Artificial Sequence: Synthetic oligonucleotide
aggagtgggcgctgagggcgg

SEQ ID NO: 352112 - DNA, 20 bp, Artificial Sequence
  Description of Artificial Sequence: Synthetic oligonucleotide
ggagtgggcgctgagggcgg

SEQ ID NO: 352113 - DNA, 20 bp, Artificial Sequence
  Description of Artificial Sequence: Synthetic oligonucleotide
gagtgggcgctgagggcggg

SEQ ID NO: 352114 - DNA, 21 bp, Artificial Sequence
  Description of Artificial Sequence: Synthetic oligonucleotide
agtgggcgctgagggcgggga

SEQ ID NO: 352115 - DNA, 20 bp, Artificial Sequence
  Description of Artificial Sequence: Synthetic oligonucleotide
gtgggcgctgagggcgggga

SEQ ID NO: 352116 - DNA, 20 bp, Artificial Sequence
  Description of Artificial Sequence: Synthetic oligonucleotide
tgggcgctgagggcggggag

SEQ ID NO: 352117 - DNA, 20 bp, Artificial Sequence
  Description of Artificial Sequence: Synthetic oligonucleotide
gggcgctgagggcggggagt

SEQ ID NO: 352118 - DNA, 21 bp, Artificial Sequence
  Description of Artificial Sequence: Synthetic oligonucleotide
ggcgctgagggcggggaggat

SEQ ID NO: 352119 - DNA, 21 bp, Artificial Sequence
  Description of Artificial Sequence: Synthetic oligonucleotide
gcgctgagggcggggaggatg

SEQ ID NO: 352120 - DNA, 22 bp, Artificial Sequence
  Description of Artificial Sequence: Synthetic oligonucleotide
cgctgagggcggggaggatgga

SEQ ID NO: 352121 - DNA, 23 bp, Artificial Sequence
  Description of Artificial Sequence: Synthetic oligonucleotide
gctgagggcggggaggatggaga

SEQ ID NO: 352122 - DNA, 23 bp, Artificial Sequence
  Description of Artificial Sequence: Synthetic oligonucleotide
ctgagggcggggaggatggagag

SEQ ID NO: 352123 - DNA, 24 bp, Artificial Sequence
  Description of Artificial Sequence: Synthetic oligonucleotide
tgagggcggggaggatggagagct

SEQ ID NO: 352124 - DNA, 23 bp, Artificial Sequence
  Description of Artificial Sequence: Synthetic oligonucleotide
gagggcggggaggatggagagct

SEQ ID NO: 352125 - DNA, 23 bp, Artificial Sequence
  Description of Artificial Sequence: Synthetic oligonucleotide
agggcggggaggatggagagctg

SEQ ID NO: 352126 - DNA, 22 bp, Artificial Sequence
  Description of Artificial Sequence: Synthetic oligonucleotide
gggcggggaggatggagagctg

SEQ ID NO: 352127 - DNA, 23 bp, Artificial Sequence
  Description of Artificial Sequence: Synthetic oligonucleotide
ggcggggaggatggagagctgct

SEQ ID NO: 352128 - DNA, 23 bp, Artificial Sequence
  Description of Artificial Sequence: Synthetic oligonucleotide
gcggggaggatggagagctgctc

SEQ ID NO: 352129 - DNA, 24 bp, Artificial Sequence
  Description of Artificial Sequence: Synthetic oligonucleotide
cggggaggatggagagctgctcgt

SEQ ID NO: 352130 - DNA, 25 bp, Artificial Sequence
  Description of Artificial Sequence: Synthetic oligonucleotide
ggggaggatggagagctgctcgtga

SEQ ID NO: 352131 - DNA, 25 bp, Artificial Sequence
  Description of Artificial Sequence: Synthetic oligonucleotide
gggaggatggagagctgctcgtgac

SEQ ID NO: 352132 - DNA, 25 bp, Artificial Sequence
  Description of Artificial Sequence: Synthetic oligonucleotide
ggaggatggagagctgctcgtgacg

SEQ ID NO: 352133 - DNA, 26 bp, Artificial Sequence
  Description of Artificial Sequence: Synthetic oligonucleotide
gaggatggagagctgctcgtgacggt

SEQ ID NO: 352134 - DNA, 26 bp, Artificial Sequence
  Description of Artificial Sequence: Synthetic oligonucleotide
aggatggagagctgctcgtgacggtg

SEQ ID NO: 352135 - DNA, 25 bp, Artificial Sequence
  Description of Artificial Sequence: Synthetic oligonucleotide
ggatggagagctgctcgtgacggtg

SEQ ID NO: 352136 - DNA, 25 bp, Artificial Sequence
  Description of Artificial Sequence: Synthetic oligonucleotide
gatggagagctgctcgtgacggtgg

SEQ ID NO: 352137 - DNA, 26 bp, Artificial Sequence
  Description of Artificial Sequence: Synthetic oligonucleotide
atggagagctgctcgtgacggtgggt

SEQ ID NO: 352138 - DNA, 25 bp, Artificial Sequence
  Description of Artificial Sequence: Synthetic oligonucleotide
tggagagctgctcgtgacggtgggt

SEQ ID NO: 352139 - DNA, 24 bp, Artificial Sequence
  Description of Artificial Sequence: Synthetic oligonucleotide
ggagagctgctcgtgacggtgggt

SEQ ID NO: 352140 - DNA, 24 bp, Artificial Sequence
  Description of Artificial Sequence: Synthetic oligonucleotide
gagagctgctcgtgacggtgggtg

SEQ ID NO: 352141 - DNA, 24 bp, Artificial Sequence
  Description of Artificial Sequence: Synthetic oligonucleotide
agagctgctcgtgacggtgggtgg

SEQ ID NO: 352142 - DNA, 23 bp, Artificial Sequence
  Description of Artificial Sequence: Synthetic oligonucleotide
gagctgctcgtgacggtgggtgg

SEQ ID NO: 352143 - DNA, 23 bp, Artificial Sequence
  Description of Artificial Sequence: Synthetic oligonucleotide
agctgctcgtgacggtgggtggg

SEQ ID NO: 352144 - DNA, 22 bp, Artificial Sequence
  Description of Artificial Sequence: Synthetic oligonucleotide
gctgctcgtgacggtgggtggg

SEQ ID NO: 352145 - DNA, 22 bp, Artificial Sequence
  Description of Artificial Sequence: Synthetic oligonucleotide
ctgctcgtgacggtgggtgggg

SEQ ID NO: 352146 - DNA, 22 bp, Artificial Sequence
  Description of Artificial Sequence: Synthetic oligonucleotide
tgctcgtgacggtgggtggggg

SEQ ID NO: 352147 - DNA, 21 bp, Artificial Sequence
  Description of Artificial Sequence: Synthetic oligonucleotide
gctcgtgacggtgggtggggg

SEQ ID NO: 352148 - DNA, 21 bp, Artificial Sequence
  Description of Artificial Sequence: Synthetic oligonucleotide
ctcgtgacggtgggtgggggc

SEQ ID NO: 352149 - DNA, 21 bp, Artificial Sequence
  Description of Artificial Sequence: Synthetic oligonucleotide
tcgtgacggtgggtgggggcc

SEQ ID NO: 352150 - DNA, 20 bp, Artificial Sequence
  Description of Artificial Sequence: Synthetic oligonucleotide
cgtgacggtgggtgggggcc

SEQ ID NO: 352151 - DNA, 20 bp, Artificial Sequence
  Description of Artificial Sequence: Synthetic oligonucleotide
gtgacggtgggtgggggccc

SEQ ID NO: 352152 - DNA, 20 bp, Artificial Sequence
  Description of Artificial Sequence: Synthetic oligonucleotide
tgacggtgggtgggggcccg

SEQ ID NO: 352153 - DNA, 20 bp, Artificial Sequence
  Description of Artificial Sequence: Synthetic oligonucleotide
gacggtgggtgggggcccgt

SEQ ID NO: 352154 - DNA, 20 bp, Artificial Sequence
  Description of Artificial Sequence: Synthetic oligonucleotide
acggtgggtgggggcccgct

SEQ ID NO: 352155 - DNA, 20 bp, Artificial Sequence
  Description of Artificial Sequence: Synthetic oligonucleotide
cggtgggtgggggcccgctt

SEQ ID NO: 352156 - DNA, 20 bp, Artificial Sequence
  Description of Artificial Sequence: Synthetic oligonucleotide
ggtgggtgggggcccgctgt

SEQ ID NO: 352157 - DNA, 20 bp, Artificial Sequence
  Description of Artificial Sequence: Synthetic oligonucleotide
gtgggtgggggcccgctgct

SEQ ID NO: 352158 - DNA, 20 bp, Artificial Sequence
  Description of Artificial Sequence: Synthetic oligonucleotide
tgggtgggggcccgctgcgt

SEQ ID NO: 352159 - DNA, 20 bp, Artificial Sequence
  Description of Artificial Sequence: Synthetic oligonucleotide
gggtgggggcccgctgcgtt

SEQ ID NO: 352160 - DNA, 20 bp, Artificial Sequence
  Description of Artificial Sequence: Synthetic oligonucleotide
ggtgggggcccgctgcggtt

SEQ ID NO: 352161 - DNA, 20 bp, Artificial Sequence
  Description of Artificial Sequence: Synthetic oligonucleotide
gtgggggcccgctgcgggtt

SEQ ID NO: 352162 - DNA, 20 bp, Artificial Sequence
  Description of Artificial Sequence: Synthetic oligonucleotide
tgggggcccgctgcggggtt

SEQ ID NO: 352163 - DNA, 20 bp, Artificial Sequence
  Description of Artificial Sequence: Synthetic oligonucleotide
gggggcccgctgcggggttt

SEQ ID NO: 352164 - DNA, 20 bp, Artificial Sequence
  Description of Artificial Sequence: Synthetic oligonucleotide
ggggcccgctgcgggggatt

SEQ ID NO: 352165 - DNA, 20 bp, Artificial Sequence
  Description of Artificial Sequence: Synthetic oligonucleotide
gggcccgctgcgggggattc

SEQ ID NO: 352166 - DNA, 20 bp, Artificial Sequence
  Description of Artificial Sequence: Synthetic oligonucleotide
ggcccgctgcgggggattcg

SEQ ID NO: 352167 - DNA, 20 bp, Artificial Sequence
  Description of Artificial Sequence: Synthetic oligonucleotide
gcccgctgcgggggattcgc

SEQ ID NO: 352168 - DNA, 21 bp, Artificial Sequence
  Description of Artificial Sequence: Synthetic oligonucleotide
cccgctgcgggggattcgcct

SEQ ID NO: 352169 - DNA, 23 bp, Artificial Sequence
  Description of Artificial Sequence: Synthetic oligonucleotide
ccgctgcgggggattcgcctgta

SEQ ID NO: 352170 - DNA, 24 bp, Artificial Sequence
  Description of Artificial Sequence: Synthetic oligonucleotide
cgctgcgggggattcgcctgtaga

SEQ ID NO: 352171 - DNA, 24 bp, Artificial Sequence
  Description of Artificial Sequence: Synthetic oligonucleotide
gctgcgggggattcgcctgtagac

SEQ ID NO: 352172 - DNA, 24 bp, Artificial Sequence
  Description of Artificial Sequence: Synthetic oligonucleotide
ctgcgggggattcgcctgtagacc

SEQ ID NO: 352173 - DNA, 24 bp, Artificial Sequence
  Description of Artificial Sequence: Synthetic oligonucleotide
tgcgggggattcgcctgtagaccc

SEQ ID NO: 352174 - DNA, 23 bp, Artificial Sequence
  Description of Artificial Sequence: Synthetic oligonucleotide
gcgggggattcgcctgtagaccc

SEQ ID NO: 352175 - DNA, 23 bp, Artificial Sequence
  Description of Artificial Sequence: Synthetic oligonucleotide
cgggggattcgcctgtagacccc

SEQ ID NO: 352176 - DNA, 23 bp, Artificial Sequence
  Description of Artificial Sequence: Synthetic oligonucleotide
gggggattcgcctgtagaccccc

SEQ ID NO: 352177 - DNA, 23 bp, Artificial Sequence
  Description of Artificial Sequence: Synthetic oligonucleotide
ggggattcgcctgtagacccccg

SEQ ID NO: 352178 - DNA, 23 bp, Artificial Sequence
  Description of Artificial Sequence: Synthetic oligonucleotide
gggattcgcctgtagacccccgc

SEQ ID NO: 352179 - DNA, 23 bp, Artificial Sequence
  Description of Artificial Sequence: Synthetic oligonucleotide
ggattcgcctgtagacccccgcg

SEQ ID NO: 352180 - DNA, 23 bp, Artificial Sequence
  Description of Artificial Sequence: Synthetic oligonucleotide
gattcgcctgtagacccccgcgg

SEQ ID NO: 352181 - DNA, 23 bp, Artificial Sequence
  Description of Artificial Sequence: Synthetic oligonucleotide
attcgcctgtagacccccgcggg

SEQ ID NO: 352182 - DNA, 22 bp, Artificial Sequence
  Description of Artificial Sequence: Synthetic oligonucleotide
ttcgcctgtagacccccgcggg

SEQ ID NO: 352183 - DNA, 21 bp, Artificial Sequence
  Description of Artificial Sequence: Synthetic oligonucleotide
tcgcctgtagacccccgcggg

SEQ ID NO: 352184 - DNA, 20 bp, Artificial Sequence
  Description of Artificial Sequence: Synthetic oligonucleotide
cgcctgtagacccccgcggg

SEQ ID NO: 352185 - DNA, 20 bp, Artificial Sequence
  Description of Artificial Sequence: Synthetic oligonucleotide
gcctgtagacccccgcgggc

SEQ ID NO: 352186 - DNA, 20 bp, Artificial Sequence
  Description of Artificial Sequence: Synthetic oligonucleotide
cctgtagacccccgcgggcc

SEQ ID NO: 352187 - DNA, 21 bp, Artificial Sequence
  Description of Artificial Sequence: Synthetic oligonucleotide
ctgtagacccccgcgggccct

SEQ ID NO: 352188 - DNA, 22 bp, Artificial Sequence
  Description of Artificial Sequence: Synthetic oligonucleotide
tgtagacccccgcgggccctgt

SEQ ID NO: 352189 - DNA, 21 bp, Artificial Sequence
  Description of Artificial Sequence: Synthetic oligonucleotide
gtagacccccgcgggccctgt

SEQ ID NO: 352190 - DNA, 22 bp, Artificial Sequence
  Description of Artificial Sequence: Synthetic oligonucleotide
tagacccccgcgggccctgtgt

SEQ ID NO: 352191 - DNA, 21 bp, Artificial Sequence
  Description of Artificial Sequence: Synthetic oligonucleotide
agacccccgcgggccctgtgt

SEQ ID NO: 352192 - DNA, 20 bp, Artificial Sequence
  Description of Artificial Sequence: Synthetic oligonucleotide
gacccccgcgggccctgtgt

SEQ ID NO: 352193 - DNA, 21 bp, Artificial Sequence
  Description of Artificial Sequence: Synthetic oligonucleotide
acccccgcgggccctgtgtct

SEQ ID NO: 352194 - DNA, 20 bp, Artificial Sequence
  Description of Artificial Sequence: Synthetic oligonucleotide
cccccgcgggccctgtgtct

SEQ ID NO: 352195 - DNA, 20 bp, Artificial Sequence
  Description of Artificial Sequence: Synthetic oligonucleotide
ccccgcgggccctgtgtctg

SEQ ID NO: 352196 - DNA, 23 bp, Artificial Sequence
  Description of Artificial Sequence: Synthetic oligonucleotide
cccgcgggccctgtgtctgcttt

SEQ ID NO: 352197 - DNA, 23 bp, Artificial Sequence
  Description of Artificial Sequence: Synthetic oligonucleotide
ccgcgggccctgtgtctgctttc

SEQ ID NO: 352198 - DNA, 24 bp, Artificial Sequence
  Description of Artificial Sequence: Synthetic oligonucleotide
cgcgggccctgtgtctgctttcgt

SEQ ID NO: 352199 - DNA, 24 bp, Artificial Sequence
  Description of Artificial Sequence: Synthetic oligonucleotide
gcgggccctgtgtctgctttcgtg

SEQ ID NO: 352200 - DNA, 24 bp, Artificial Sequence
  Description of Artificial Sequence: Synthetic oligonucleotide
cgggccctgtgtctgctttcgtgg

SEQ ID NO: 352201 - DNA, 24 bp, Artificial Sequence
  Description of Artificial Sequence: Synthetic oligonucleotide
gggccctgtgtctgctttcgtggg

SEQ ID NO: 352202 - DNA, 26 bp, Artificial Sequence
  Description of Artificial Sequence: Synthetic oligonucleotide
ggccctgtgtctgctttcgtgggcat

SEQ ID NO: 352203 - DNA, 26 bp, Artificial Sequence
  Description of Artificial Sequence: Synthetic oligonucleotide
gccctgtgtctgctttcgtgggcatc

SEQ ID NO: 352204 - DNA, 26 bp, Artificial Sequence
  Description of Artificial Sequence: Synthetic oligonucleotide
ccctgtgtctgctttcgtgggcatcc

SEQ ID NO: 352205 - DNA, 26 bp, Artificial Sequence
  Description of Artificial Sequence: Synthetic oligonucleotide
cctgtgtctgctttcgtgggcatccg

SEQ ID NO: 352206 - DNA, 27 bp, Artificial Sequence
  Description of Artificial Sequence: Synthetic oligonucleotide
ctgtgtctgctttcgtgggcatccgct

SEQ ID NO: 352207 - DNA, 29 bp, Artificial Sequence
  Description of Artificial Sequence: Synthetic oligonucleotide
tgtgtctgctttcgtgggcatccgctttg

SEQ ID NO: 352208 - DNA, 28 bp, Artificial Sequence
  Description of Artificial Sequence: Synthetic oligonucleotide
gtgtctgctttcgtgggcatccgctttg

SEQ ID NO: 352209 - DNA, 28 bp, Artificial Sequence
  Description of Artificial Sequence: Synthetic oligonucleotide
tgtctgctttcgtgggcatccgctttgc

SEQ ID NO: 352210 - DNA, 27 bp, Artificial Sequence
  Description of Artificial Sequence: Synthetic oligonucleotide
gtctgctttcgtgggcatccgctttgc

SEQ ID NO: 352211 - DNA, 27 bp, Artificial Sequence
  Description of Artificial Sequence: Synthetic oligonucleotide
tctgctttcgtgggcatccgctttgcg

SEQ ID NO: 352212 - DNA, 26 bp, Artificial Sequence
  Description of Artificial Sequence: Synthetic oligonucleotide
ctgctttcgtgggcatccgctttgcg

SEQ ID NO: 352213 - DNA, 27 bp, Artificial Sequence
  Description of Artificial Sequence: Synthetic oligonucleotide
tgctttcgtgggcatccgctttgcgga

SEQ ID NO: 352214 - DNA, 26 bp, Artificial Sequence
  Description of Artificial Sequence: Synthetic oligonucleotide
gctttcgtgggcatccgctttgcgga

SEQ ID NO: 352215 - DNA, 26 bp, Artificial Sequence
  Description of Artificial Sequence: Synthetic oligonucleotide
ctttcgtgggcatccgctttgcggac

SEQ ID NO: 352216 - DNA, 26 bp, Artificial Sequence
  Description of Artificial Sequence: Synthetic oligonucleotide
tttcgtgggcatccgctttgcggacc

SEQ ID NO: 352217 - DNA, 25 bp, Artificial Sequence
  Description of Artificial Sequence: Synthetic oligonucleotide
ttcgtgggcatccgctttgcggacc

SEQ ID NO: 352218 - DNA, 24 bp, Artificial Sequence
  Description of Artificial Sequence: Synthetic oligonucleotide
tcgtgggcatccgctttgcggacc

SEQ ID NO: 352219 - DNA, 23 bp, Artificial Sequence
  Description of Artificial Sequence: Synthetic oligonucleotide
cgtgggcatccgctttgcggacc

SEQ ID NO: 352220 - DNA, 24 bp, Artificial Sequence
  Description of Artificial Sequence: Synthetic oligonucleotide
gtgggcatccgctttgcggaccca

SEQ ID NO: 352221 - DNA, 24 bp, Artificial Sequence
  Description of Artificial Sequence: Synthetic oligonucleotide
tgggcatccgctttgcggacccac

SEQ ID NO: 352222 - DNA, 23 bp, Artificial Sequence
  Description of Artificial Sequence: Synthetic oligonucleotide
gggcatccgctttgcggacccac

SEQ ID NO: 352223 - DNA, 23 bp, Artificial Sequence
  Description of Artificial Sequence: Synthetic oligonucleotide
ggcatccgctttgcggacccacc

SEQ ID NO: 352224 - DNA, 25 bp, Artificial Sequence
  Description of Artificial Sequence: Synthetic oligonucleotide
gcatccgctttgcggacccacccat

SEQ ID NO: 352225 - DNA, 25 bp, Artificial Sequence
  Description of Artificial Sequence: Synthetic oligonucleotide
catccgctttgcggacccacccatg

SEQ ID NO: 352226 - DNA, 25 bp, Artificial Sequence
  Description of Artificial Sequence: Synthetic oligonucleotide
atccgctttgcggacccacccatgc

SEQ ID NO: 352227 - DNA, 24 bp, Artificial Sequence
  Description of Artificial Sequence: Synthetic oligonucleotide
tccgctttgcggacccacccatgc

SEQ ID NO: 352228 - DNA, 23 bp, Artificial Sequence
  Description of Artificial Sequence: Synthetic oligonucleotide
ccgctttgcggacccacccatgc

SEQ ID NO: 352229 - DNA, 24 bp, Artificial Sequence
  Description of Artificial Sequence: Synthetic oligonucleotide
cgctttgcggacccacccatgcga

SEQ ID NO: 352230 - DNA, 24 bp, Artificial Sequence
  Description of Artificial Sequence: Synthetic oligonucleotide
gctttgcggacccacccatgcgac

SEQ ID NO: 352231 - DNA, 24 bp, Artificial Sequence
  Description of Artificial Sequence: Synthetic oligonucleotide
ctttgcggacccacccatgcgacc

SEQ ID NO: 352232 - DNA, 24 bp, Artificial Sequence
  Description of Artificial Sequence: Synthetic oligonucleotide
tttgcggacccacccatgcgaccc

SEQ ID NO: 352233 - DNA, 23 bp, Artificial Sequence
  Description of Artificial Sequence: Synthetic oligonucleotide
ttgcggacccacccatgcgaccc

SEQ ID NO: 352234 - DNA, 22 bp, Artificial Sequence
  Description of Artificial Sequence: Synthetic oligonucleotide
tgcggacccacccatgcgaccc

SEQ ID NO: 352235 - DNA, 21 bp, Artificial Sequence
  Description of Artificial Sequence: Synthetic oligonucleotide
gcggacccacccatgcgaccc

SEQ ID NO: 352236 - DNA, 21 bp, Artificial Sequence
  Description of Artificial Sequence: Synthetic oligonucleotide
cggacccacccatgcgacccc

SEQ ID NO: 352237 - DNA, 22 bp, Artificial Sequence
  Description of Artificial Sequence: Synthetic oligonucleotide
ggacccacccatgcgaccccgt

SEQ ID NO: 352238 - DNA, 22 bp, Artificial Sequence
  Description of Artificial Sequence: Synthetic oligonucleotide
gacccacccatgcgaccccgtc

SEQ ID NO: 352239 - DNA, 22 bp, Artificial Sequence
  Description of Artificial Sequence: Synthetic oligonucleotide
acccacccatgcgaccccgtcc

SEQ ID NO: 352240 - DNA, 21 bp, Artificial Sequence
  Description of Artificial Sequence: Synthetic oligonucleotide
cccacccatgcgaccccgtcc

SEQ ID NO: 352241 - DNA, 24 bp, Artificial Sequence
  Description of Artificial Sequence: Synthetic oligonucleotide
ccacccatgcgaccccgtcccttt

SEQ ID NO: 352242 - DNA, 25 bp, Artificial Sequence
  Description of Artificial Sequence: Synthetic oligonucleotide
cacccatgcgaccccgtccctttct

SEQ ID NO: 352243 - DNA, 25 bp, Artificial Sequence
  Description of Artificial Sequence: Synthetic oligonucleotide
acccatgcgaccccgtccctttctg

SEQ ID NO: 352244 - DNA, 24 bp, Artificial Sequence
  Description of Artificial Sequence: Synthetic oligonucleotide
cccatgcgaccccgtccctttctg

SEQ ID NO: 352245 - DNA, 24 bp, Artificial Sequence
  Description of Artificial Sequence: Synthetic oligonucleotide
ccatgcgaccccgtccctttctgc

SEQ ID NO: 352246 - DNA, 25 bp, Artificial Sequence
  Description of Artificial Sequence: Synthetic oligonucleotide
catgcgaccccgtccctttctgcct

SEQ ID NO: 352247 - DNA, 25 bp, Artificial Sequence
  Description of Artificial Sequence: Synthetic oligonucleotide
atgcgaccccgtccctttctgcctc

SEQ ID NO: 352248 - DNA, 24 bp, Artificial Sequence
  Description of Artificial Sequence: Synthetic oligonucleotide
tgcgaccccgtccctttctgcctc

SEQ ID NO: 352249 - DNA, 23 bp, Artificial Sequence
  Description of Artificial Sequence: Synthetic oligonucleotide
gcgaccccgtccctttctgcctc

SEQ ID NO: 352250 - DNA, 23 bp, Artificial Sequence
  Description of Artificial Sequence: Synthetic oligonucleotide
cgaccccgtccctttctgcctcc

SEQ ID NO: 352251 - DNA, 23 bp, Artificial Sequence
  Description of Artificial Sequence: Synthetic oligonucleotide
gaccccgtccctttctgcctccg

SEQ ID NO: 352252 - DNA, 24 bp, Artificial Sequence
  Description of Artificial Sequence: Synthetic oligonucleotide
accccgtccctttctgcctccgga

SEQ ID NO: 352253 - DNA, 23 bp, Artificial Sequence
  Description of Artificial Sequence: Synthetic oligonucleotide
ccccgtccctttctgcctccgga

SEQ ID NO: 352254 - DNA, 23 bp, Artificial Sequence
  Description of Artificial Sequence: Synthetic oligonucleotide
cccgtccctttctgcctccggag

SEQ ID NO: 352255 - DNA, 23 bp, Artificial Sequence
  Description of Artificial Sequence: Synthetic oligonucleotide
ccgtccctttctgcctccggagc

SEQ ID NO: 352256 - DNA, 23 bp, Artificial Sequence
  Description of Artificial Sequence: Synthetic oligonucleotide
cgtccctttctgcctccggagcc

SEQ ID NO: 352257 - DNA, 25 bp, Artificial Sequence
  Description of Artificial Sequence: Synthetic oligonucleotide
gtccctttctgcctccggagcccta

SEQ ID NO: 352258 - DNA, 25 bp, Artificial Sequence
  Description of Artificial Sequence: Synthetic oligonucleotide
tccctttctgcctccggagccctag

SEQ ID NO: 352259 - DNA, 24 bp, Artificial Sequence
  Description of Artificial Sequence: Synthetic oligonucleotide
ccctttctgcctccggagccctag

SEQ ID NO: 352260 - DNA, 25 bp, Artificial Sequence
  Description of Artificial Sequence: Synthetic oligonucleotide
cctttctgcctccggagccctagca

SEQ ID NO: 352261 - DNA, 25 bp, Artificial Sequence
  Description of Artificial Sequence: Synthetic oligonucleotide
ctttctgcctccggagccctagcag

SEQ ID NO: 352262 - DNA, 25 bp, Artificial Sequence
  Description of Artificial Sequence: Synthetic oligonucleotide
tttctgcctccggagccctagcagc

SEQ ID NO: 352263 - DNA, 24 bp, Artificial Sequence
  Description of Artificial Sequence: Synthetic oligonucleotide
ttctgcctccggagccctagcagc

SEQ ID NO: 352264 - DNA, 23 bp, Artificial Sequence
  Description of Artificial Sequence: Synthetic oligonucleotide
tctgcctccggagccctagcagc

SEQ ID NO: 352265 - DNA, 22 bp, Artificial Sequence
  Description of Artificial Sequence: Synthetic oligonucleotide
ctgcctccggagccctagcagc

SEQ ID NO: 352266 - DNA, 24 bp, Artificial Sequence
  Description of Artificial Sequence: Synthetic oligonucleotide
tgcctccggagccctagcagcctt

SEQ ID NO: 352267 - DNA, 23 bp, Artificial Sequence
  Description of Artificial Sequence: Synthetic oligonucleotide
gcctccggagccctagcagcctt

SEQ ID NO: 352268 - DNA, 23 bp, Artificial Sequence
  Description of Artificial Sequence: Synthetic oligonucleotide
cctccggagccctagcagccttc

SEQ ID NO: 352269 - DNA, 24 bp, Artificial Sequence
  Description of Artificial Sequence: Synthetic oligonucleotide
ctccggagccctagcagccttcgt

SEQ ID NO: 352270 - DNA, 25 bp, Artificial Sequence
  Description of Artificial Sequence: Synthetic oligonucleotide
tccggagccctagcagccttcgtca

SEQ ID NO: 352271 - DNA, 24 bp, Artificial Sequence
  Description of Artificial Sequence: Synthetic oligonucleotide
ccggagccctagcagccttcgtca

SEQ ID NO: 352272 - DNA, 24 bp, Artificial Sequence
  Description of Artificial Sequence: Synthetic oligonucleotide
cggagccctagcagccttcgtcag

SEQ ID NO: 352273 - DNA, 24 bp, Artificial Sequence
  Description of Artificial Sequence: Synthetic oligonucleotide
ggagccctagcagccttcgtcagg

SEQ ID NO: 352274 - DNA, 24 bp, Artificial Sequence
  Description of Artificial Sequence: Synthetic oligonucleotide
gagccctagcagccttcgtcaggg

SEQ ID NO: 352275 - DNA, 25 bp, Artificial Sequence
  Description of Artificial Sequence: Synthetic oligonucleotide
agccctagcagccttcgtcaggggt

SEQ ID NO: 352276 - DNA, 24 bp, Artificial Sequence
  Description of Artificial Sequence: Synthetic oligonucleotide
gccctagcagccttcgtcaggggt

SEQ ID NO: 352277 - DNA, 24 bp, Artificial Sequence
  Description of Artificial Sequence: Synthetic oligonucleotide
ccctagcagccttcgtcaggggtc

SEQ ID NO: 352278 - DNA, 26 bp, Artificial Sequence
  Description of Artificial Sequence: Synthetic oligonucleotide
cctagcagccttcgtcaggggtcgta

SEQ ID NO: 352279 - DNA, 27 bp, Artificial Sequence
  Description of Artificial Sequence: Synthetic oligonucleotide
ctagcagccttcgtcaggggtcgtaga

SEQ ID NO: 352280 - DNA, 27 bp, Artificial Sequence
  Description of Artificial Sequence: Synthetic oligonucleotide
tagcagccttcgtcaggggtcgtagac

SEQ ID NO: 352281 - DNA, 26 bp, Artificial Sequence
  Description of Artificial Sequence: Synthetic oligonucleotide
agcagccttcgtcaggggtcgtagac

SEQ ID NO: 352282 - DNA, 25 bp, Artificial Sequence
  Description of Artificial Sequence: Synthetic oligonucleotide
gcagccttcgtcaggggtcgtagac

SEQ ID NO: 352283 - DNA, 25 bp, Artificial Sequence
  Description of Artificial Sequence: Synthetic oligonucleotide
cagccttcgtcaggggtcgtagacg

SEQ ID NO: 352284 - DNA, 27 bp, Artificial Sequence
  Description of Artificial Sequence: Synthetic oligonucleotide
agccttcgtcaggggtcgtagacgctt

SEQ ID NO: 352285 - DNA, 26 bp, Artificial Sequence
  Description of Artificial Sequence: Synthetic oligonucleotide
gccttcgtcaggggtcgtagacgctt

SEQ ID NO: 352286 - DNA, 27 bp, Artificial Sequence
  Description of Artificial Sequence: Synthetic oligonucleotide
ccttcgtcaggggtcgtagacgcttca

SEQ ID NO: 352287 - DNA, 28 bp, Artificial Sequence
  Description of Artificial Sequence: Synthetic oligonucleotide
cttcgtcaggggtcgtagacgcttcaac

SEQ ID NO: 352288 - DNA, 28 bp, Artificial Sequence
  Description of Artificial Sequence: Synthetic oligonucleotide
ttcgtcaggggtcgtagacgcttcaacc

SEQ ID NO: 352289 - DNA, 27 bp, Artificial Sequence
  Description of Artificial Sequence: Synthetic oligonucleotide
tcgtcaggggtcgtagacgcttcaacc

SEQ ID NO: 352290 - DNA, 27 bp, Artificial Sequence
  Description of Artificial Sequence: Synthetic oligonucleotide
cgtcaggggtcgtagacgcttcaacct

SEQ ID NO: 352291 - DNA, 28 bp, Artificial Sequence
  Description of Artificial Sequence: Synthetic oligonucleotide
gtcaggggtcgtagacgcttcaaccttc

SEQ ID NO: 352292 - DNA, 28 bp, Artificial Sequence
  Description of Artificial Sequence: Synthetic oligonucleotide
tcaggggtcgtagacgcttcaaccttcc

SEQ ID NO: 352293 - DNA, 27 bp, Artificial Sequence
  Description of Artificial Sequence: Synthetic oligonucleotide
caggggtcgtagacgcttcaaccttcc

SEQ ID NO: 352294 - DNA, 28 bp, Artificial Sequence
  Description of Artificial Sequence: Synthetic oligonucleotide
aggggtcgtagacgcttcaaccttcctg

SEQ ID NO: 352295 - DNA, 27 bp, Artificial Sequence
  Description of Artificial Sequence: Synthetic oligonucleotide
ggggtcgtagacgcttcaaccttcctg

SEQ ID NO: 352296 - DNA, 28 bp, Artificial Sequence
  Description of Artificial Sequence: Synthetic oligonucleotide
gggtcgtagacgcttcaaccttcctgag

SEQ ID NO: 352297 - DNA, 29 bp, Artificial Sequence
  Description of Artificial Sequence: Synthetic oligonucleotide
ggtcgtagacgcttcaaccttcctgagtg

SEQ ID NO: 352298 - DNA, 30 bp, Artificial Sequence
  Description of Artificial Sequence: Synthetic oligonucleotide
gtcgtagacgcttcaaccttcctgagtgtc

SEQ ID NO: 352299 - DNA, 31 bp, Artificial Sequence
  Description of Artificial Sequence: Synthetic oligonucleotide
tcgtagacgcttcaaccttcctgagtgtctg

SEQ ID NO: 352300 - DNA, 30 bp, Artificial Sequence
  Description of Artificial Sequence: Synthetic oligonucleotide
cgtagacgcttcaaccttcctgagtgtctg

SEQ ID NO: 352301 - DNA, 30 bp, Artificial Sequence
  Description of Artificial Sequence: Synthetic oligonucleotide
gtagacgcttcaaccttcctgagtgtctgg

SEQ ID NO: 352302 - DNA, 32 bp, Artificial Sequence
  Description of Artificial Sequence: Synthetic oligonucleotide
tagacgcttcaaccttcctgagtgtctggtac

SEQ ID NO: 352303 - DNA, 31 bp, Artificial Sequence
  Description of Artificial Sequence: Synthetic oligonucleotide
agacgcttcaaccttcctgagtgtctggtac

SEQ ID NO: 352304 - DNA, 30 bp, Artificial Sequence
  Description of Artificial Sequence: Synthetic oligonucleotide
gacgcttcaaccttcctgagtgtctggtac

SEQ ID NO: 352305 - DNA, 30 bp, Artificial Sequence
  Description of Artificial Sequence: Synthetic oligonucleotide
acgcttcaaccttcctgagtgtctggtacc

SEQ ID NO: 352306 - DNA, 29 bp, Artificial Sequence
  Description of Artificial Sequence: Synthetic oligonucleotide
cgcttcaaccttcctgagtgtctggtacc

SEQ ID NO: 352307 - DNA, 34 bp, Artificial Sequence
  Description of Artificial Sequence: Synthetic oligonucleotide
gcttcaaccttcctgagtgtctggtaccaatatc

SEQ ID NO: 352308 - DNA, 35 bp, Artificial Sequence
  Description of Artificial Sequence: Synthetic oligonucleotide
cttcaaccttcctgagtgtctggtaccaatatctg

SEQ ID NO: 352309 - DNA, 35 bp, Artificial Sequence
  Description of Artificial Sequence: Synthetic oligonucleotide
ttcaaccttcctgagtgtctggtaccaatatctgg

SEQ ID NO: 352310 - DNA, 34 bp, Artificial Sequence
  Description of Artificial Sequence: Synthetic oligonucleotide
tcaaccttcctgagtgtctggtaccaatatctgg

SEQ ID NO: 352311 - DNA, 33 bp, Artificial Sequence
  Description of Artificial Sequence: Synthetic oligonucleotide
caaccttcctgagtgtctggtaccaatatctgg

SEQ ID NO: 352312 - DNA, 34 bp, Artificial Sequence
  Description of Artificial Sequence: Synthetic oligonucleotide
aaccttcctgagtgtctggtaccaatatctggac

SEQ ID NO: 352313 - DNA, 33 bp, Artificial Sequence
  Description of Artificial Sequence: Synthetic oligonucleotide
accttcctgagtgtctggtaccaatatctggac

SEQ ID NO: 352314 - DNA, 32 bp, Artificial Sequence
  Description of Artificial Sequence: Synthetic oligonucleotide
ccttcctgagtgtctggtaccaatatctggac

SEQ ID NO: 352315 - DNA, 33 bp, Artificial Sequence
  Description of Artificial Sequence: Synthetic oligonucleotide
cttcctgagtgtctggtaccaatatctggacac

SEQ ID NO: 352316 - DNA, 33 bp, Artificial Sequence
  Description of Artificial Sequence: Synthetic oligonucleotide
ttcctgagtgtctggtaccaatatctggacacc

SEQ ID NO: 352317 - DNA, 32 bp, Artificial Sequence
  Description of Artificial Sequence: Synthetic oligonucleotide
tcctgagtgtctggtaccaatatctggacacc

SEQ ID NO: 352318 - DNA, 31 bp, Artificial Sequence
  Description of Artificial Sequence: Synthetic oligonucleotide
cctgagtgtctggtaccaatatctggacacc

SEQ ID NO: 352319 - DNA, 31 bp, Artificial Sequence
  Description of Artificial Sequence: Synthetic oligonucleotide
ctgagtgtctggtaccaatatctggacaccc

SEQ ID NO: 352320 - DNA, 35 bp, Artificial Sequence
  Description of Artificial Sequence: Synthetic oligonucleotide
tgagtgtctggtaccaatatctggacacccaatac

SEQ ID NO: 352321 - DNA, 34 bp, Artificial Sequence
  Description of Artificial Sequence: Synthetic oligonucleotide
gagtgtctggtaccaatatctggacacccaatac

SEQ ID NO: 352322 - DNA, 34 bp, Artificial Sequence
  Description of Artificial Sequence: Synthetic oligonucleotide
agtgtctggtaccaatatctggacacccaatacc

SEQ ID NO: 352323 - DNA, 33 bp, Artificial Sequence
  Description of Artificial Sequence: Synthetic oligonucleotide
gtgtctggtaccaatatctggacacccaatacc

SEQ ID NO: 352324 - DNA, 33 bp, Artificial Sequence
  Description of Artificial Sequence: Synthetic oligonucleotide
tgtctggtaccaatatctggacacccaataccc

SEQ ID NO: 352325 - DNA, 32 bp, Artificial Sequence
  Description of Artificial Sequence: Synthetic oligonucleotide
gtctggtaccaatatctggacacccaataccc

SEQ ID NO: 352326 - DNA, 33 bp, Artificial Sequence
  Description of Artificial Sequence: Synthetic oligonucleotide
tctggtaccaatatctggacacccaatacccag

SEQ ID NO: 352327 - DNA, 32 bp, Artificial Sequence
  Description of Artificial Sequence: Synthetic oligonucleotide
ctggtaccaatatctggacacccaatacccag

SEQ ID NO: 352328 - DNA, 32 bp, Artificial Sequence
  Description of Artificial Sequence: Synthetic oligonucleotide
tggtaccaatatctggacacccaatacccagg

SEQ ID NO: 352329 - DNA, 31 bp, Artificial Sequence
  Description of Artificial Sequence: Synthetic oligonucleotide
ggtaccaatatctggacacccaatacccagg

SEQ ID NO: 352330 - DNA, 35 bp, Artificial Sequence
  Description of Artificial Sequence: Synthetic oligonucleotide
gtaccaatatctggacacccaatacccaggatttg

SEQ ID NO: 352331 - DNA, 36 bp, Artificial Sequence
  Description of Artificial Sequence: Synthetic oligonucleotide
taccaatatctggacacccaatacccaggatttgag

SEQ ID NO: 352332 - DNA, 35 bp, Artificial Sequence
  Description of Artificial Sequence: Synthetic oligonucleotide
accaatatctggacacccaatacccaggatttgag

SEQ ID NO: 352333 - DNA, 34 bp, Artificial Sequence
  Description of Artificial Sequence: Synthetic oligonucleotide
ccaatatctggacacccaatacccaggatttgag

SEQ ID NO: 352334 - DNA, 34 bp, Artificial Sequence
  Description of Artificial Sequence: Synthetic oligonucleotide
caatatctggacacccaatacccaggatttgagg

SEQ ID NO: 352335 - DNA, 34 bp, Artificial Sequence
  Description of Artificial Sequence: Synthetic oligonucleotide
aatatctggacacccaatacccaggatttgaggg

SEQ ID NO: 352336 - DNA, 33 bp, Artificial Sequence
  Description of Artificial Sequence: Synthetic oligonucleotide
atatctggacacccaatacccaggatttgaggg

SEQ ID NO: 352337 - DNA, 32 bp, Artificial Sequence
  Description of Artificial Sequence: Synthetic oligonucleotide
tatctggacacccaatacccaggatttgaggg

SEQ ID NO: 352338 - DNA, 31 bp, Artificial Sequence
  Description of Artificial Sequence: Synthetic oligonucleotide
atctggacacccaatacccaggatttgaggg

SEQ ID NO: 352339 - DNA, 30 bp, Artificial Sequence
  Description of Artificial Sequence: Synthetic oligonucleotide
tctggacacccaatacccaggatttgaggg

SEQ ID NO: 352340 - DNA, 29 bp, Artificial Sequence
  Description of Artificial Sequence: Synthetic oligonucleotide
ctggacacccaatacccaggatttgaggg

SEQ ID NO: 352341 - DNA, 29 bp, Artificial Sequence
  Description of Artificial Sequence: Synthetic oligonucleotide
tggacacccaatacccaggatttgagggc

SEQ ID NO: 352342 - DNA, 28 bp, Artificial Sequence
  Description of Artificial Sequence: Synthetic oligonucleotide
ggacacccaatacccaggatttgagggc

SEQ ID NO: 352343 - DNA, 29 bp, Artificial Sequence
  Description of Artificial Sequence: Synthetic oligonucleotide
gacacccaatacccaggatttgagggctc

SEQ ID NO: 352344 - DNA, 29 bp, Artificial Sequence
  Description of Artificial Sequence: Synthetic oligonucleotide
acacccaatacccaggatttgagggctcc

SEQ ID NO: 352345 - DNA, 28 bp, Artificial Sequence
  Description of Artificial Sequence: Synthetic oligonucleotide
cacccaatacccaggatttgagggctcc

SEQ ID NO: 352346 - DNA, 28 bp, Artificial Sequence
  Description of Artificial Sequence: Synthetic oligonucleotide
acccaatacccaggatttgagggctccg

SEQ ID NO: 352347 - DNA, 27 bp, Artificial Sequence
  Description of Artificial Sequence: Synthetic oligonucleotide
cccaatacccaggatttgagggctccg

SEQ ID NO: 352348 - DNA, 28 bp, Artificial Sequence
  Description of Artificial Sequence: Synthetic oligonucleotide
ccaatacccaggatttgagggctccgag

SEQ ID NO: 352349 - DNA, 30 bp, Artificial Sequence
  Description of Artificial Sequence: Synthetic oligonucleotide
caatacccaggatttgagggctccgagatg

SEQ ID NO: 352350 - DNA, 31 bp, Artificial Sequence
  Description of Artificial Sequence: Synthetic oligonucleotide
aatacccaggatttgagggctccgagatgtc

SEQ ID NO: 352351 - DNA, 30 bp, Artificial Sequence
  Description of Artificial Sequence: Synthetic oligonucleotide
atacccaggatttgagggctccgagatgtc

SEQ ID NO: 352352 - DNA, 29 bp, Artificial Sequence
  Description of Artificial Sequence: Synthetic oligonucleotide
tacccaggatttgagggctccgagatgtc

SEQ ID NO: 352353 - DNA, 28 bp, Artificial Sequence
  Description of Artificial Sequence: Synthetic oligonucleotide
acccaggatttgagggctccgagatgtc

SEQ ID NO: 352354 - DNA, 27 bp, Artificial Sequence
  Description of Artificial Sequence: Synthetic oligonucleotide
cccaggatttgagggctccgagatgtc

SEQ ID NO: 352355 - DNA, 27 bp, Artificial Sequence
  Description of Artificial Sequence: Synthetic oligonucleotide
ccaggatttgagggctccgagatgtcg

SEQ ID NO: 352356 - DNA, 29 bp, Artificial Sequence
  Description of Artificial Sequence: Synthetic oligonucleotide
caggatttgagggctccgagatgtcgaac

SEQ ID NO: 352357 - DNA, 29 bp, Artificial Sequence
  Description of Artificial Sequence: Synthetic oligonucleotide
aggatttgagggctccgagatgtcgaacc

SEQ ID NO: 352358 - DNA, 28 bp, Artificial Sequence
  Description of Artificial Sequence: Synthetic oligonucleotide
ggatttgagggctccgagatgtcgaacc

SEQ ID NO: 352359 - DNA, 28 bp, Artificial Sequence
  Description of Artificial Sequence: Synthetic oligonucleotide
gatttgagggctccgagatgtcgaaccc

SEQ ID NO: 352360 - DNA, 28 bp, Artificial Sequence
  Description of Artificial Sequence: Synthetic oligonucleotide
atttgagggctccgagatgtcgaacccc

SEQ ID NO: 352361 - DNA, 27 bp, Artificial Sequence
  Description of Artificial Sequence: Synthetic oligonucleotide
tttgagggctccgagatgtcgaacccc

SEQ ID NO: 352362 - DNA, 27 bp, Artificial Sequence
  Description of Artificial Sequence: Synthetic oligonucleotide
ttgagggctccgagatgtcgaacccca

SEQ ID NO: 352363 - DNA, 27 bp, Artificial Sequence
  Description of Artificial Sequence: Synthetic oligonucleotide
tgagggctccgagatgtcgaaccccaa

SEQ ID NO: 352364 - DNA, 26 bp, Artificial Sequence
  Description of Artificial Sequence: Synthetic oligonucleotide
gagggctccgagatgtcgaaccccaa

SEQ ID NO: 352365 - DNA, 26 bp, Artificial Sequence
  Description of Artificial Sequence: Synthetic oligonucleotide
agggctccgagatgtcgaaccccaag

SEQ ID NO: 352366 - DNA, 25 bp, Artificial Sequence
  Description of Artificial Sequence: Synthetic oligonucleotide
gggctccgagatgtcgaaccccaag

SEQ ID NO: 352367 - DNA, 25 bp, Artificial Sequence
  Description of Artificial Sequence: Synthetic oligonucleotide
ggctccgagatgtcgaaccccaagc

SEQ ID NO: 352368 - DNA, 26 bp, Artificial Sequence
  Description of Artificial Sequence: Synthetic oligonucleotide
gctccgagatgtcgaaccccaagcgt

SEQ ID NO: 352369 - DNA, 27 bp, Artificial Sequence
  Description of Artificial Sequence: Synthetic oligonucleotide
ctccgagatgtcgaaccccaagcgtga

SEQ ID NO: 352370 - DNA, 27 bp, Artificial Sequence
  Description of Artificial Sequence: Synthetic oligonucleotide
tccgagatgtcgaaccccaagcgtgag

SEQ ID NO: 352371 - DNA, 26 bp, Artificial Sequence
  Description of Artificial Sequence: Synthetic oligonucleotide
ccgagatgtcgaaccccaagcgtgag

SEQ ID NO: 352372 - DNA, 27 bp, Artificial Sequence
  Description of Artificial Sequence: Synthetic oligonucleotide
cgagatgtcgaaccccaagcgtgagct

SEQ ID NO: 352373 - DNA, 27 bp, Artificial Sequence
  Description of Artificial Sequence: Synthetic oligonucleotide
gagatgtcgaaccccaagcgtgagctg

SEQ ID NO: 352374 - DNA, 28 bp, Artificial Sequence
  Description of Artificial Sequence: Synthetic oligonucleotide
agatgtcgaaccccaagcgtgagctgtg

SEQ ID NO: 352375 - DNA, 27 bp, Artificial Sequence
  Description of Artificial Sequence: Synthetic oligonucleotide
gatgtcgaaccccaagcgtgagctgtg

SEQ ID NO: 352376 - DNA, 27 bp, Artificial Sequence
  Description of Artificial Sequence: Synthetic oligonucleotide
atgtcgaaccccaagcgtgagctgtgc

SEQ ID NO: 352377 - DNA, 26 bp, Artificial Sequence
  Description of Artificial Sequence: Synthetic oligonucleotide
tgtcgaaccccaagcgtgagctgtgc

SEQ ID NO: 352378 - DNA, 25 bp, Artificial Sequence
  Description of Artificial Sequence: Synthetic oligonucleotide
gtcgaaccccaagcgtgagctgtgc

SEQ ID NO: 352379 - DNA, 26 bp, Artificial Sequence
  Description of Artificial Sequence: Synthetic oligonucleotide
tcgaaccccaagcgtgagctgtgcga

SEQ ID NO: 352380 - DNA, 25 bp, Artificial Sequence
  Description of Artificial Sequence: Synthetic oligonucleotide
cgaaccccaagcgtgagctgtgcga

SEQ ID NO: 352381 - DNA, 25 bp, Artificial Sequence
  Description of Artificial Sequence: Synthetic oligonucleotide
gaaccccaagcgtgagctgtgcgag

SEQ ID NO: 352382 - DNA, 26 bp, Artificial Sequence
  Description of Artificial Sequence: Synthetic oligonucleotide
aaccccaagcgtgagctgtgcgagga

SEQ ID NO: 352383 - DNA, 25 bp, Artificial Sequence
  Description of Artificial Sequence: Synthetic oligonucleotide
accccaagcgtgagctgtgcgagga

SEQ ID NO: 352384 - DNA, 24 bp, Artificial Sequence
  Description of Artificial Sequence: Synthetic oligonucleotide
ccccaagcgtgagctgtgcgagga

SEQ ID NO: 352385 - DNA, 25 bp, Artificial Sequence
  Description of Artificial Sequence: Synthetic oligonucleotide
cccaagcgtgagctgtgcgaggact

SEQ ID NO: 352386 - DNA, 25 bp, Artificial Sequence
  Description of Artificial Sequence: Synthetic oligonucleotide
ccaagcgtgagctgtgcgaggactc

SEQ ID NO: 352387 - DNA, 25 bp, Artificial Sequence
  Description of Artificial Sequence: Synthetic oligonucleotide
caagcgtgagctgtgcgaggactcc

SEQ ID NO: 352388 - DNA, 26 bp, Artificial Sequence
  Description of Artificial Sequence: Synthetic oligonucleotide
aagcgtgagctgtgcgaggactccct

SEQ ID NO: 352389 - DNA, 25 bp, Artificial Sequence
  Description of Artificial Sequence: Synthetic oligonucleotide
agcgtgagctgtgcgaggactccct

SEQ ID NO: 352390 - DNA, 24 bp, Artificial Sequence
  Description of Artificial Sequence: Synthetic oligonucleotide
gcgtgagctgtgcgaggactccct

SEQ ID NO: 352391 - DNA, 26 bp, Artificial Sequence
  Description of Artificial Sequence: Synthetic oligonucleotide
cgtgagctgtgcgaggactccctgta

SEQ ID NO: 352392 - DNA, 26 bp, Artificial Sequence
  Description of Artificial Sequence: Synthetic oligonucleotide
gtgagctgtgcgaggactccctgtac

SEQ ID NO: 352393 - DNA, 27 bp, Artificial Sequence
  Description of Artificial Sequence: Synthetic oligonucleotide
tgagctgtgcgaggactccctgtacct

SEQ ID NO: 352394 - DNA, 26 bp, Artificial Sequence
  Description of Artificial Sequence: Synthetic oligonucleotide
gagctgtgcgaggactccctgtacct

SEQ ID NO: 352395 - DNA, 27 bp, Artificial Sequence
  Description of Artificial Sequence: Synthetic oligonucleotide
agctgtgcgaggactccctgtacctga

SEQ ID NO: 352396 - DNA, 27 bp, Artificial Sequence
  Description of Artificial Sequence: Synthetic oligonucleotide
gctgtgcgaggactccctgtacctgaa

SEQ ID NO: 352397 - DNA, 27 bp, Artificial Sequence
  Description of Artificial Sequence: Synthetic oligonucleotide
ctgtgcgaggactccctgtacctgaac

SEQ ID NO: 352398 - DNA, 27 bp, Artificial Sequence
  Description of Artificial Sequence: Synthetic oligonucleotide
tgtgcgaggactccctgtacctgaacg

SEQ ID NO: 352399 - DNA, 27 bp, Artificial Sequence
  Description of Artificial Sequence: Synthetic oligonucleotide
gtgcgaggactccctgtacctgaacgt

SEQ ID NO: 352400 - DNA, 27 bp, Artificial Sequence
  Description of Artificial Sequence: Synthetic oligonucleotide
tgcgaggactccctgtacctgaacgtg

SEQ ID NO: 352401 - DNA, 27 bp, Artificial Sequence
  Description of Artificial Sequence: Synthetic oligonucleotide
gcgaggactccctgtacctgaacgtgt

SEQ ID NO: 352402 - DNA, 27 bp, Artificial Sequence
  Description of Artificial Sequence: Synthetic oligonucleotide
cgaggactccctgtacctgaacgtgtg

SEQ ID NO: 352403 - DNA, 27 bp, Artificial Sequence
  Description of Artificial Sequence: Synthetic oligonucleotide
gaggactccctgtacctgaacgtgtgg

SEQ ID NO: 352404 - DNA, 28 bp, Artificial Sequence
  Description of Artificial Sequence: Synthetic oligonucleotide
aggactccctgtacctgaacgtgtggtc

SEQ ID NO: 352405 - DNA, 27 bp, Artificial Sequence
  Description of Artificial Sequence: Synthetic oligonucleotide
ggactccctgtacctgaacgtgtggtc

SEQ ID NO: 352406 - DNA, 28 bp, Artificial Sequence
  Description of Artificial Sequence: Synthetic oligonucleotide
gactccctgtacctgaacgtgtggtcac

SEQ ID NO: 352407 - DNA, 28 bp, Artificial Sequence
  Description of Artificial Sequence: Synthetic oligonucleotide
actccctgtacctgaacgtgtggtcacc

SEQ ID NO: 352408 - DNA, 27 bp, Artificial Sequence
  Description of Artificial Sequence: Synthetic oligonucleotide
ctccctgtacctgaacgtgtggtcacc

SEQ ID NO: 352409 - DNA, 30 bp, Artificial Sequence
  Description of Artificial Sequence: Synthetic oligonucleotide
tccctgtacctgaacgtgtggtcaccatac

SEQ ID NO: 352410 - DNA, 29 bp, Artificial Sequence
  Description of Artificial Sequence: Synthetic oligonucleotide
ccctgtacctgaacgtgtggtcaccatac

SEQ ID NO: 352411 - DNA, 29 bp, Artificial Sequence
  Description of Artificial Sequence: Synthetic oligonucleotide
cctgtacctgaacgtgtggtcaccatacc

SEQ ID NO: 352412 - DNA, 29 bp, Artificial Sequence
  Description of Artificial Sequence: Synthetic oligonucleotide
ctgtacctgaacgtgtggtcaccataccg

SEQ ID NO: 352413 - DNA, 29 bp, Artificial Sequence
  Description of Artificial Sequence: Synthetic oligonucleotide
tgtacctgaacgtgtggtcaccataccgc

SEQ ID NO: 352414 - DNA, 28 bp, Artificial Sequence
  Description of Artificial Sequence: Synthetic oligonucleotide
gtacctgaacgtgtggtcaccataccgc

SEQ ID NO: 352415 - DNA, 28 bp, Artificial Sequence
  Description of Artificial Sequence: Synthetic oligonucleotide
tacctgaacgtgtggtcaccataccgcc

SEQ ID NO: 352416 - DNA, 27 bp, Artificial Sequence
  Description of Artificial Sequence: Synthetic oligonucleotide
acctgaacgtgtggtcaccataccgcc

SEQ ID NO: 352417 - DNA, 26 bp, Artificial Sequence
  Description of Artificial Sequence: Synthetic oligonucleotide
cctgaacgtgtggtcaccataccgcc

SEQ ID NO: 352418 - DNA, 26 bp, Artificial Sequence
  Description of Artificial Sequence: Synthetic oligonucleotide
ctgaacgtgtggtcaccataccgccg

SEQ ID NO: 352419 - DNA, 26 bp, Artificial Sequence
  Description of Artificial Sequence: Synthetic oligonucleotide
tgaacgtgtggtcaccataccgccgg

SEQ ID NO: 352420 - DNA, 25 bp, Artificial Sequence
  Description of Artificial Sequence: Synthetic oligonucleotide
gaacgtgtggtcaccataccgccgg

SEQ ID NO: 352421 - DNA, 25 bp, Artificial Sequence
  Description of Artificial Sequence: Synthetic oligonucleotide
aacgtgtggtcaccataccgccggc

SEQ ID NO: 352422 - DNA, 24 bp, Artificial Sequence
  Description of Artificial Sequence: Synthetic oligonucleotide
acgtgtggtcaccataccgccggc

SEQ ID NO: 352423 - DNA, 23 bp, Artificial Sequence
  Description of Artificial Sequence: Synthetic oligonucleotide
cgtgtggtcaccataccgccggc

SEQ ID NO: 352424 - DNA, 25 bp, Artificial Sequence
  Description of Artificial Sequence: Synthetic oligonucleotide
gtgtggtcaccataccgccggccta

SEQ ID NO: 352425 - DNA, 27 bp, Artificial Sequence
  Description of Artificial Sequence: Synthetic oligonucleotide
tgtggtcaccataccgccggcctactt

SEQ ID NO: 352426 - DNA, 26 bp, Artificial Sequence
  Description of Artificial Sequence: Synthetic oligonucleotide
gtggtcaccataccgccggcctactt

SEQ ID NO: 352427 - DNA, 26 bp, Artificial Sequence
  Description of Artificial Sequence: Synthetic oligonucleotide
tggtcaccataccgccggcctacttc

SEQ ID NO: 352428 - DNA, 25 bp, Artificial Sequence
  Description of Artificial Sequence: Synthetic oligonucleotide
ggtcaccataccgccggcctacttc

SEQ ID NO: 352429 - DNA, 25 bp, Artificial Sequence
  Description of Artificial Sequence: Synthetic oligonucleotide
gtcaccataccgccggcctacttcc

SEQ ID NO: 352430 - DNA, 25 bp, Artificial Sequence
  Description of Artificial Sequence: Synthetic oligonucleotide
tcaccataccgccggcctacttccc

SEQ ID NO: 352431 - DNA, 24 bp, Artificial Sequence
  Description of Artificial Sequence: Synthetic oligonucleotide
caccataccgccggcctacttccc

SEQ ID NO: 352432 - DNA, 24 bp, Artificial Sequence
  Description of Artificial Sequence: Synthetic oligonucleotide
accataccgccggcctacttcccc

SEQ ID NO: 352433 - DNA, 23 bp, Artificial Sequence
  Description of Artificial Sequence: Synthetic oligonucleotide
ccataccgccggcctacttcccc

SEQ ID NO: 352434 - DNA, 24 bp, Artificial Sequence
  Description of Artificial Sequence: Synthetic oligonucleotide
cataccgccggcctacttccccca

SEQ ID NO: 352435 - DNA, 24 bp, Artificial Sequence
  Description of Artificial Sequence: Synthetic oligonucleotide
ataccgccggcctacttcccccac

SEQ ID NO: 352436 - DNA, 23 bp, Artificial Sequence
  Description of Artificial Sequence: Synthetic oligonucleotide
taccgccggcctacttcccccac

SEQ ID NO: 352437 - DNA, 22 bp, Artificial Sequence
  Description of Artificial Sequence: Synthetic oligonucleotide
accgccggcctacttcccccac

SEQ ID NO: 352438 - DNA, 21 bp, Artificial Sequence
  Description of Artificial Sequence: Synthetic oligonucleotide
ccgccggcctacttcccccac

SEQ ID NO: 352439 - DNA, 21 bp, Artificial Sequence
  Description of Artificial Sequence: Synthetic oligonucleotide
cgccggcctacttcccccacc

SEQ ID NO: 352440 - DNA, 21 bp, Artificial Sequence
  Description of Artificial Sequence: Synthetic oligonucleotide
gccggcctacttcccccaccg

SEQ ID NO: 352441 - DNA, 22 bp, Artificial Sequence
  Description of Artificial Sequence: Synthetic oligonucleotide
ccggcctacttcccccaccgct

SEQ ID NO: 352442 - DNA, 23 bp, Artificial Sequence
  Description of Artificial Sequence: Synthetic oligonucleotide
cggcctacttcccccaccgctgt

SEQ ID NO: 352443 - DNA, 23 bp, Artificial Sequence
  Description of Artificial Sequence: Synthetic oligonucleotide
ggcctacttcccccaccgctgtc

SEQ ID NO: 352444 - DNA, 24 bp, Artificial Sequence
  Description of Artificial Sequence: Synthetic oligonucleotide
gcctacttcccccaccgctgtcct

SEQ ID NO: 352445 - DNA, 24 bp, Artificial Sequence
  Description of Artificial Sequence: Synthetic oligonucleotide
cctacttcccccaccgctgtcctc

SEQ ID NO: 352446 - DNA, 25 bp, Artificial Sequence
  Description of Artificial Sequence: Synthetic oligonucleotide
ctacttcccccaccgctgtcctcga

SEQ ID NO: 352447 - DNA, 26 bp, Artificial Sequence
  Description of Artificial Sequence: Synthetic oligonucleotide
tacttcccccaccgctgtcctcgact

SEQ ID NO: 352448 - DNA, 25 bp, Artificial Sequence
  Description of Artificial Sequence: Synthetic oligonucleotide
acttcccccaccgctgtcctcgact

SEQ ID NO: 352449 - DNA, 24 bp, Artificial Sequence
  Description of Artificial Sequence: Synthetic oligonucleotide
cttcccccaccgctgtcctcgact

SEQ ID NO: 352450 - DNA, 24 bp, Artificial Sequence
  Description of Artificial Sequence: Synthetic oligonucleotide
ttcccccaccgctgtcctcgactg

SEQ ID NO: 352451 - DNA, 23 bp, Artificial Sequence
  Description of Artificial Sequence: Synthetic oligonucleotide
tcccccaccgctgtcctcgactg

SEQ ID NO: 352452 - DNA, 22 bp, Artificial Sequence
  Description of Artificial Sequence: Synthetic oligonucleotide
cccccaccgctgtcctcgactg

SEQ ID NO: 352453 - DNA, 24 bp, Artificial Sequence
  Description of Artificial Sequence: Synthetic oligonucleotide
ccccaccgctgtcctcgactggat

SEQ ID NO: 352454 - DNA, 27 bp, Artificial Sequence
  Description of Artificial Sequence: Synthetic oligonucleotide
cccaccgctgtcctcgactggatctaa

SEQ ID NO: 352455 - DNA, 27 bp, Artificial Sequence
  Description of Artificial Sequence: Synthetic oligonucleotide
ccaccgctgtcctcgactggatctaag

SEQ ID NO: 352456 - DNA, 27 bp, Artificial Sequence
  Description of Artificial Sequence: Synthetic oligonucleotide
caccgctgtcctcgactggatctaagg

SEQ ID NO: 352457 - DNA, 27 bp, Artificial Sequence
  Description of Artificial Sequence: Synthetic oligonucleotide
accgctgtcctcgactggatctaaggg

SEQ ID NO: 352458 - DNA, 26 bp, Artificial Sequence
  Description of Artificial Sequence: Synthetic oligonucleotide
ccgctgtcctcgactggatctaaggg

SEQ ID NO: 352459 - DNA, 26 bp, Artificial Sequence
  Description of Artificial Sequence: Synthetic oligonucleotide
cgctgtcctcgactggatctaagggg

SEQ ID NO: 352460 - DNA, 27 bp, Artificial Sequence
  Description of Artificial Sequence: Synthetic oligonucleotide
gctgtcctcgactggatctaagggggt

SEQ ID NO: 352461 - DNA, 27 bp, Artificial Sequence
  Description of Artificial Sequence: Synthetic oligonucleotide
ctgtcctcgactggatctaagggggtg

SEQ ID NO: 352462 - DNA, 27 bp, Artificial Sequence
  Description of Artificial Sequence: Synthetic oligonucleotide
tgtcctcgactggatctaagggggtgg

SEQ ID NO: 352463 - DNA, 26 bp, Artificial Sequence
  Description of Artificial Sequence: Synthetic oligonucleotide
gtcctcgactggatctaagggggtgg

SEQ ID NO: 352464 - DNA, 27 bp, Artificial Sequence
  Description of Artificial Sequence: Synthetic oligonucleotide
tcctcgactggatctaagggggtggca

SEQ ID NO: 352465 - DNA, 27 bp, Artificial Sequence
  Description of Artificial Sequence: Synthetic oligonucleotide
cctcgactggatctaagggggtggcat

SEQ ID NO: 352466 - DNA, 27 bp, Artificial Sequence
  Description of Artificial Sequence: Synthetic oligonucleotide
ctcgactggatctaagggggtggcatc

SEQ ID NO: 352467 - DNA, 29 bp, Artificial Sequence
  Description of Artificial Sequence: Synthetic oligonucleotide
tcgactggatctaagggggtggcatctac

SEQ ID NO: 352468 - DNA, 28 bp, Artificial Sequence
  Description of Artificial Sequence: Synthetic oligonucleotide
cgactggatctaagggggtggcatctac

SEQ ID NO: 352469 - DNA, 29 bp, Artificial Sequence
  Description of Artificial Sequence: Synthetic oligonucleotide
gactggatctaagggggtggcatctacag

SEQ ID NO: 352470 - DNA, 30 bp, Artificial Sequence
  Description of Artificial Sequence: Synthetic oligonucleotide
actggatctaagggggtggcatctacagtg

SEQ ID NO: 352471 - DNA, 29 bp, Artificial Sequence
  Description of Artificial Sequence: Synthetic oligonucleotide
ctggatctaagggggtggcatctacagtg

SEQ ID NO: 352472 - DNA, 29 bp, Artificial Sequence
  Description of Artificial Sequence: Synthetic oligonucleotide
tggatctaagggggtggcatctacagtgc

SEQ ID NO: 352473 - DNA, 28 bp, Artificial Sequence
  Description of Artificial Sequence: Synthetic oligonucleotide
ggatctaagggggtggcatctacagtgc

SEQ ID NO: 352474 - DNA, 28 bp, Artificial Sequence
  Description of Artificial Sequence: Synthetic oligonucleotide
gatctaagggggtggcatctacagtgcg

SEQ ID NO: 352475 - DNA, 28 bp, Artificial Sequence
  Description of Artificial Sequence: Synthetic oligonucleotide
atctaagggggtggcatctacagtgcgg

SEQ ID NO: 352476 - DNA, 27 bp, Artificial Sequence
  Description of Artificial Sequence: Synthetic oligonucleotide
tctaagggggtggcatctacagtgcgg

SEQ ID NO: 352477 - DNA, 26 bp, Artificial Sequence
  Description of Artificial Sequence: Synthetic oligonucleotide
ctaagggggtggcatctacagtgcgg

SEQ ID NO: 352478 - DNA, 26 bp, Artificial Sequence
  Description of Artificial Sequence: Synthetic oligonucleotide
taagggggtggcatctacagtgcggc

SEQ ID NO: 352479 - DNA, 25 bp, Artificial Sequence
  Description of Artificial Sequence: Synthetic oligonucleotide
aagggggtggcatctacagtgcggc

SEQ ID NO: 352480 - DNA, 24 bp, Artificial Sequence
  Description of Artificial Sequence: Synthetic oligonucleotide
agggggtggcatctacagtgcggc

SEQ ID NO: 352481 - DNA, 23 bp, Artificial Sequence
  Description of Artificial Sequence: Synthetic oligonucleotide
gggggtggcatctacagtgcggc

SEQ ID NO: 352482 - DNA, 24 bp, Artificial Sequence
  Description of Artificial Sequence: Synthetic oligonucleotide
ggggtggcatctacagtgcggcct

SEQ ID NO: 352483 - DNA, 24 bp, Artificial Sequence
  Description of Artificial Sequence: Synthetic oligonucleotide
gggtggcatctacagtgcggcctc

SEQ ID NO: 352484 - DNA, 25 bp, Artificial Sequence
  Description of Artificial Sequence: Synthetic oligonucleotide
ggtggcatctacagtgcggcctcct

SEQ ID NO: 352485 - DNA, 25 bp, Artificial Sequence
  Description of Artificial Sequence: Synthetic oligonucleotide
gtggcatctacagtgcggcctcctc

SEQ ID NO: 352486 - DNA, 27 bp, Artificial Sequence
  Description of Artificial Sequence: Synthetic oligonucleotide
tggcatctacagtgcggcctcctcgtt

SEQ ID NO: 352487 - DNA, 26 bp, Artificial Sequence
  Description of Artificial Sequence: Synthetic oligonucleotide
ggcatctacagtgcggcctcctcgtt

SEQ ID NO: 352488 - DNA, 26 bp, Artificial Sequence
  Description of Artificial Sequence: Synthetic oligonucleotide
gcatctacagtgcggcctcctcgttg

SEQ ID NO: 352489 - DNA, 27 bp, Artificial Sequence
  Description of Artificial Sequence: Synthetic oligonucleotide
catctacagtgcggcctcctcgttgga

SEQ ID NO: 352490 - DNA, 27 bp, Artificial Sequence
  Description of Artificial Sequence: Synthetic oligonucleotide
atctacagtgcggcctcctcgttggac

SEQ ID NO: 352491 - DNA, 26 bp, Artificial Sequence
  Description of Artificial Sequence: Synthetic oligonucleotide
tctacagtgcggcctcctcgttggac

SEQ ID NO: 352492 - DNA, 25 bp, Artificial Sequence
  Description of Artificial Sequence: Synthetic oligonucleotide
ctacagtgcggcctcctcgttggac

SEQ ID NO: 352493 - DNA, 26 bp, Artificial Sequence
  Description of Artificial Sequence: Synthetic oligonucleotide
tacagtgcggcctcctcgttggacgt

SEQ ID NO: 352494 - DNA, 25 bp, Artificial Sequence
  Description of Artificial Sequence: Synthetic oligonucleotide
acagtgcggcctcctcgttggacgt

SEQ ID NO: 352495 - DNA, 24 bp, Artificial Sequence
  Description of Artificial Sequence: Synthetic oligonucleotide
cagtgcggcctcctcgttggacgt

SEQ ID NO: 352496 - DNA, 26 bp, Artificial Sequence
  Description of Artificial Sequence: Synthetic oligonucleotide
agtgcggcctcctcgttggacgtgaa

SEQ ID NO: 352497 - DNA, 25 bp, Artificial Sequence
  Description of Artificial Sequence: Synthetic oligonucleotide
gtgcggcctcctcgttggacgtgaa

SEQ ID NO: 352498 - DNA, 25 bp, Artificial Sequence
  Description of Artificial Sequence: Synthetic oligonucleotide
tgcggcctcctcgttggacgtgaac

SEQ ID NO: 352499 - DNA, 24 bp, Artificial Sequence
  Description of Artificial Sequence: Synthetic oligonucleotide
gcggcctcctcgttggacgtgaac

SEQ ID NO: 352500 - DNA, 26 bp, Artificial Sequence
  Description of Artificial Sequence: Synthetic oligonucleotide
cggcctcctcgttggacgtgaacgat

SEQ ID NO: 352501 - DNA, 26 bp, Artificial Sequence
  Description of Artificial Sequence: Synthetic oligonucleotide
ggcctcctcgttggacgtgaacgatg

SEQ ID NO: 352502 - DNA, 26 bp, Artificial Sequence
  Description of Artificial Sequence: Synthetic oligonucleotide
gcctcctcgttggacgtgaacgatgg

SEQ ID NO: 352503 - DNA, 26 bp, Artificial Sequence
  Description of Artificial Sequence: Synthetic oligonucleotide
cctcctcgttggacgtgaacgatggc

SEQ ID NO: 352504 - DNA, 26 bp, Artificial Sequence
  Description of Artificial Sequence: Synthetic oligonucleotide
ctcctcgttggacgtgaacgatggcc

SEQ ID NO: 352505 - DNA, 26 bp, Artificial Sequence
  Description of Artificial Sequence: Synthetic oligonucleotide
tcctcgttggacgtgaacgatggccc

SEQ ID NO: 352506 - DNA, 25 bp, Artificial Sequence
  Description of Artificial Sequence: Synthetic oligonucleotide
cctcgttggacgtgaacgatggccc

SEQ ID NO: 352507 - DNA, 27 bp, Artificial Sequence
  Description of Artificial Sequence: Synthetic oligonucleotide
ctcgttggacgtgaacgatggcccctt

SEQ ID NO: 352508 - DNA, 27 bp, Artificial Sequence
  Description of Artificial Sequence: Synthetic oligonucleotide
tcgttggacgtgaacgatggccccttc

SEQ ID NO: 352509 - DNA, 27 bp, Artificial Sequence
  Description of Artificial Sequence: Synthetic oligonucleotide
cgttggacgtgaacgatggccccttct

SEQ ID NO: 352510 - DNA, 28 bp, Artificial Sequence
  Description of Artificial Sequence: Synthetic oligonucleotide
gttggacgtgaacgatggccccttcttg

SEQ ID NO: 352511 - DNA, 28 bp, Artificial Sequence
  Description of Artificial Sequence: Synthetic oligonucleotide
ttggacgtgaacgatggccccttcttgg

SEQ ID NO: 352512 - DNA, 27 bp, Artificial Sequence
  Description of Artificial Sequence: Synthetic oligonucleotide
tggacgtgaacgatggccccttcttgg

SEQ ID NO: 352513 - DNA, 27 bp, Artificial Sequence
  Description of Artificial Sequence: Synthetic oligonucleotide
ggacgtgaacgatggccccttcttggt

SEQ ID NO: 352514 - DNA, 28 bp, Artificial Sequence
  Description of Artificial Sequence: Synthetic oligonucleotide
gacgtgaacgatggccccttcttggttc

SEQ ID NO: 352515 - DNA, 29 bp, Artificial Sequence
  Description of Artificial Sequence: Synthetic oligonucleotide
acgtgaacgatggccccttcttggttcag

SEQ ID NO: 352516 - DNA, 28 bp, Artificial Sequence
  Description of Artificial Sequence: Synthetic oligonucleotide
cgtgaacgatggccccttcttggttcag

SEQ ID NO: 352517 - DNA, 28 bp, Artificial Sequence
  Description of Artificial Sequence: Synthetic oligonucleotide
gtgaacgatggccccttcttggttcagg

SEQ ID NO: 352518 - DNA, 28 bp, Artificial Sequence
  Description of Artificial Sequence: Synthetic oligonucleotide
tgaacgatggccccttcttggttcaggc

SEQ ID NO: 352519 - DNA, 27 bp, Artificial Sequence
  Description of Artificial Sequence: Synthetic oligonucleotide
gaacgatggccccttcttggttcaggc

SEQ ID NO: 352520 - DNA, 27 bp, Artificial Sequence
  Description of Artificial Sequence: Synthetic oligonucleotide
aacgatggccccttcttggttcaggcc

SEQ ID NO: 352521 - DNA, 26 bp, Artificial Sequence
  Description of Artificial Sequence: Synthetic oligonucleotide
acgatggccccttcttggttcaggcc

SEQ ID NO: 352522 - DNA, 25 bp, Artificial Sequence
  Description of Artificial Sequence: Synthetic oligonucleotide
cgatggccccttcttggttcaggcc

SEQ ID NO: 352523 - DNA, 26 bp, Artificial Sequence
  Description of Artificial Sequence: Synthetic oligonucleotide
gatggccccttcttggttcaggccga

SEQ ID NO: 352524 - DNA, 27 bp, Artificial Sequence
  Description of Artificial Sequence: Synthetic oligonucleotide
atggccccttcttggttcaggccgagt

SEQ ID NO: 352525 - DNA, 26 bp, Artificial Sequence
  Description of Artificial Sequence: Synthetic oligonucleotide
tggccccttcttggttcaggccgagt

SEQ ID NO: 352526 - DNA, 25 bp, Artificial Sequence
  Description of Artificial Sequence: Synthetic oligonucleotide
ggccccttcttggttcaggccgagt

SEQ ID NO: 352527 - DNA, 25 bp, Artificial Sequence
  Description of Artificial Sequence: Synthetic oligonucleotide
gccccttcttggttcaggccgagtg

SEQ ID NO: 352528 - DNA, 26 bp, Artificial Sequence
  Description of Artificial Sequence: Synthetic oligonucleotide
ccccttcttggttcaggccgagtgga

SEQ ID NO: 352529 - DNA, 27 bp, Artificial Sequence
  Description of Artificial Sequence: Synthetic oligonucleotide
cccttcttggttcaggccgagtggact

SEQ ID NO: 352530 - DNA, 27 bp, Artificial Sequence
  Description of Artificial Sequence: Synthetic oligonucleotide
ccttcttggttcaggccgagtggactg

SEQ ID NO: 352531 - DNA, 28 bp, Artificial Sequence
  Description of Artificial Sequence: Synthetic oligonucleotide
cttcttggttcaggccgagtggactgtg

SEQ ID NO: 352532 - DNA, 28 bp, Artificial Sequence
  Description of Artificial Sequence: Synthetic oligonucleotide
ttcttggttcaggccgagtggactgtgc

SEQ ID NO: 352533 - DNA, 27 bp, Artificial Sequence
  Description of Artificial Sequence: Synthetic oligonucleotide
tcttggttcaggccgagtggactgtgc

SEQ ID NO: 352534 - DNA, 27 bp, Artificial Sequence
  Description of Artificial Sequence: Synthetic oligonucleotide
cttggttcaggccgagtggactgtgca

SEQ ID NO: 352535 - DNA, 27 bp, Artificial Sequence
  Description of Artificial Sequence: Synthetic oligonucleotide
ttggttcaggccgagtggactgtgcag

SEQ ID NO: 352536 - DNA, 26 bp, Artificial Sequence
  Description of Artificial Sequence: Synthetic oligonucleotide
tggttcaggccgagtggactgtgcag

SEQ ID NO: 352537 - DNA, 25 bp, Artificial Sequence
  Description of Artificial Sequence: Synthetic oligonucleotide
ggttcaggccgagtggactgtgcag

SEQ ID NO: 352538 - DNA, 26 bp, Artificial Sequence
  Description of Artificial Sequence: Synthetic oligonucleotide
gttcaggccgagtggactgtgcaggt

SEQ ID NO: 352539 - DNA, 26 bp, Artificial Sequence
  Description of Artificial Sequence: Synthetic oligonucleotide
ttcaggccgagtggactgtgcaggtg

SEQ ID NO: 352540 - DNA, 25 bp, Artificial Sequence
  Description of Artificial Sequence: Synthetic oligonucleotide
tcaggccgagtggactgtgcaggtg

SEQ ID NO: 352541 - DNA, 24 bp, Artificial Sequence
  Description of Artificial Sequence: Synthetic oligonucleotide
caggccgagtggactgtgcaggtg

SEQ ID NO: 352542 - DNA, 24 bp, Artificial Sequence
  Description of Artificial Sequence: Synthetic oligonucleotide
aggccgagtggactgtgcaggtgg

SEQ ID NO: 352543 - DNA, 23 bp, Artificial Sequence
  Description of Artificial Sequence: Synthetic oligonucleotide
ggccgagtggactgtgcaggtgg

SEQ ID NO: 352544 - DNA, 24 bp, Artificial Sequence
  Description of Artificial Sequence: Synthetic oligonucleotide
gccgagtggactgtgcaggtgggt

SEQ ID NO: 352545 - DNA, 25 bp, Artificial Sequence
  Description of Artificial Sequence: Synthetic oligonucleotide
ccgagtggactgtgcaggtgggtgt

SEQ ID NO: 352546 - DNA, 25 bp, Artificial Sequence
  Description of Artificial Sequence: Synthetic oligonucleotide
cgagtggactgtgcaggtgggtgtc

SEQ ID NO: 352547 - DNA, 26 bp, Artificial Sequence
  Description of Artificial Sequence: Synthetic oligonucleotide
gagtggactgtgcaggtgggtgtcgt

SEQ ID NO: 352548 - DNA, 27 bp, Artificial Sequence
  Description of Artificial Sequence: Synthetic oligonucleotide
agtggactgtgcaggtgggtgtcgtga

SEQ ID NO: 352549 - DNA, 27 bp, Artificial Sequence
  Description of Artificial Sequence: Synthetic oligonucleotide
gtggactgtgcaggtgggtgtcgtgaa

SEQ ID NO: 352550 - DNA, 27 bp, Artificial Sequence
  Description of Artificial Sequence: Synthetic oligonucleotide
tggactgtgcaggtgggtgtcgtgaag

SEQ ID NO: 352551 - DNA, 26 bp, Artificial Sequence
  Description of Artificial Sequence: Synthetic oligonucleotide
ggactgtgcaggtgggtgtcgtgaag

SEQ ID NO: 352552 - DNA, 27 bp, Artificial Sequence
  Description of Artificial Sequence: Synthetic oligonucleotide
gactgtgcaggtgggtgtcgtgaagga

SEQ ID NO: 352553 - DNA, 28 bp, Artificial Sequence
  Description of Artificial Sequence: Synthetic oligonucleotide
actgtgcaggtgggtgtcgtgaaggatc

SEQ ID NO: 352554 - DNA, 27 bp, Artificial Sequence
  Description of Artificial Sequence: Synthetic oligonucleotide
ctgtgcaggtgggtgtcgtgaaggatc

SEQ ID NO: 352555 - DNA, 28 bp, Artificial Sequence
  Description of Artificial Sequence: Synthetic oligonucleotide
tgtgcaggtgggtgtcgtgaaggatcag

SEQ ID NO: 352556 - DNA, 27 bp, Artificial Sequence
  Description of Artificial Sequence: Synthetic oligonucleotide
gtgcaggtgggtgtcgtgaaggatcag

SEQ ID NO: 352557 - DNA, 27 bp, Artificial Sequence
  Description of Artificial Sequence: Synthetic oligonucleotide
tgcaggtgggtgtcgtgaaggatcagg

SEQ ID NO: 352558 - DNA, 26 bp, Artificial Sequence
  Description of Artificial Sequence: Synthetic oligonucleotide
gcaggtgggtgtcgtgaaggatcagg

SEQ ID NO: 352559 - DNA, 26 bp, Artificial Sequence
  Description of Artificial Sequence: Synthetic oligonucleotide
caggtgggtgtcgtgaaggatcaggg

SEQ ID NO: 352560 - DNA, 27 bp, Artificial Sequence
  Description of Artificial Sequence: Synthetic oligonucleotide
aggtgggtgtcgtgaaggatcagggct

SEQ ID NO: 352561 - DNA, 26 bp, Artificial Sequence
  Description of Artificial Sequence: Synthetic oligonucleotide
ggtgggtgtcgtgaaggatcagggct

SEQ ID NO: 352562 - DNA, 26 bp, Artificial Sequence
  Description of Artificial Sequence: Synthetic oligonucleotide
gtgggtgtcgtgaaggatcagggctc

SEQ ID NO: 352563 - DNA, 27 bp, Artificial Sequence
  Description of Artificial Sequence: Synthetic oligonucleotide
tgggtgtcgtgaaggatcagggctcgt

SEQ ID NO: 352564 - DNA, 27 bp, Artificial Sequence
  Description of Artificial Sequence: Synthetic oligonucleotide
gggtgtcgtgaaggatcagggctcgtt

SEQ ID NO: 352565 - DNA, 31 bp, Artificial Sequence
  Description of Artificial Sequence: Synthetic oligonucleotide
ggtgtcgtgaaggatcagggctcgttttttc

SEQ ID NO: 352566 - DNA, 32 bp, Artificial Sequence
  Description of Artificial Sequence: Synthetic oligonucleotide
gtgtcgtgaaggatcagggctcgttttttctg

SEQ ID NO: 352567 - DNA, 32 bp, Artificial Sequence
  Description of Artificial Sequence: Synthetic oligonucleotide
tgtcgtgaaggatcagggctcgttttttctgg

SEQ ID NO: 352568 - DNA, 31 bp, Artificial Sequence
  Description of Artificial Sequence: Synthetic oligonucleotide
gtcgtgaaggatcagggctcgttttttctgg

SEQ ID NO: 352569 - DNA, 35 bp, Artificial Sequence
  Description of Artificial Sequence: Synthetic oligonucleotide
tcgtgaaggatcagggctcgttttttctggtatac

SEQ ID NO: 352570 - DNA, 34 bp, Artificial Sequence
  Description of Artificial Sequence: Synthetic oligonucleotide
cgtgaaggatcagggctcgttttttctggtatac

SEQ ID NO: 352571 - DNA, 34 bp, Artificial Sequence
  Description of Artificial Sequence: Synthetic oligonucleotide
gtgaaggatcagggctcgttttttctggtatacg

SEQ ID NO: 352572 - DNA, 34 bp, Artificial Sequence
  Description of Artificial Sequence: Synthetic oligonucleotide
tgaaggatcagggctcgttttttctggtatacgg

SEQ ID NO: 352573 - DNA, 33 bp, Artificial Sequence
  Description of Artificial Sequence: Synthetic oligonucleotide
gaaggatcagggctcgttttttctggtatacgg

SEQ ID NO: 352574 - DNA, 33 bp, Artificial Sequence
  Description of Artificial Sequence: Synthetic oligonucleotide
aaggatcagggctcgttttttctggtatacggg

SEQ ID NO: 352575 - DNA, 32 bp, Artificial Sequence
  Description of Artificial Sequence: Synthetic oligonucleotide
aggatcagggctcgttttttctggtatacggg

SEQ ID NO: 352576 - DNA, 31 bp, Artificial Sequence
  Description of Artificial Sequence: Synthetic oligonucleotide
ggatcagggctcgttttttctggtatacggg

SEQ ID NO: 352577 - DNA, 31 bp, Artificial Sequence
  Description of Artificial Sequence: Synthetic oligonucleotide
gatcagggctcgttttttctggtatacgggg

SEQ ID NO: 352578 - DNA, 31 bp, Artificial Sequence
  Description of Artificial Sequence: Synthetic oligonucleotide
atcagggctcgttttttctggtatacggggc

SEQ ID NO: 352579 - DNA, 30 bp, Artificial Sequence
  Description of Artificial Sequence: Synthetic oligonucleotide
tcagggctcgttttttctggtatacggggc

SEQ ID NO: 352580 - DNA, 29 bp, Artificial Sequence
  Description of Artificial Sequence: Synthetic oligonucleotide
cagggctcgttttttctggtatacggggc

SEQ ID NO: 352581 - DNA, 29 bp, Artificial Sequence
  Description of Artificial Sequence: Synthetic oligonucleotide
agggctcgttttttctggtatacggggcc

SEQ ID NO: 352582 - DNA, 28 bp, Artificial Sequence
  Description of Artificial Sequence: Synthetic oligonucleotide
gggctcgttttttctggtatacggggcc

SEQ ID NO: 352583 - DNA, 28 bp, Artificial Sequence
  Description of Artificial Sequence: Synthetic oligonucleotide
ggctcgttttttctggtatacggggccg

SEQ ID NO: 352584 - DNA, 28 bp, Artificial Sequence
  Description of Artificial Sequence: Synthetic oligonucleotide
gctcgttttttctggtatacggggccgc

SEQ ID NO: 352585 - DNA, 29 bp, Artificial Sequence
  Description of Artificial Sequence: Synthetic oligonucleotide
ctcgttttttctggtatacggggccgcag

SEQ ID NO: 352586 - DNA, 29 bp, Artificial Sequence
  Description of Artificial Sequence: Synthetic oligonucleotide
tcgttttttctggtatacggggccgcagg

SEQ ID NO: 352587 - DNA, 28 bp, Artificial Sequence
  Description of Artificial Sequence: Synthetic oligonucleotide
cgttttttctggtatacggggccgcagg

SEQ ID NO: 352588 - DNA, 28 bp, Artificial Sequence
  Description of Artificial Sequence: Synthetic oligonucleotide
gttttttctggtatacggggccgcaggc

SEQ ID NO: 352589 - DNA, 30 bp, Artificial Sequence
  Description of Artificial Sequence: Synthetic oligonucleotide
ttttttctggtatacggggccgcaggcttc

SEQ ID NO: 352590 - DNA, 29 bp, Artificial Sequence
  Description of Artificial Sequence: Synthetic oligonucleotide
tttttctggtatacggggccgcaggcttc

SEQ ID NO: 352591 - DNA, 28 bp, Artificial Sequence
  Description of Artificial Sequence: Synthetic oligonucleotide
ttttctggtatacggggccgcaggcttc

SEQ ID NO: 352592 - DNA, 27 bp, Artificial Sequence
  Description of Artificial Sequence: Synthetic oligonucleotide
tttctggtatacggggccgcaggcttc

SEQ ID NO: 352593 - DNA, 27 bp, Artificial Sequence
  Description of Artificial Sequence: Synthetic oligonucleotide
ttctggtatacggggccgcaggcttca

SEQ ID NO: 352594 - DNA, 26 bp, Artificial Sequence
  Description of Artificial Sequence: Synthetic oligonucleotide
tctggtatacggggccgcaggcttca

SEQ ID NO: 352595 - DNA, 25 bp, Artificial Sequence
  Description of Artificial Sequence: Synthetic oligonucleotide
ctggtatacggggccgcaggcttca

SEQ ID NO: 352596 - DNA, 25 bp, Artificial Sequence
  Description of Artificial Sequence: Synthetic oligonucleotide
tggtatacggggccgcaggcttcac

SEQ ID NO: 352597 - DNA, 24 bp, Artificial Sequence
  Description of Artificial Sequence: Synthetic oligonucleotide
ggtatacggggccgcaggcttcac

SEQ ID NO: 352598 - DNA, 27 bp, Artificial Sequence
  Description of Artificial Sequence: Synthetic oligonucleotide
gtatacggggccgcaggcttcaccaaa

SEQ ID NO: 352599 - DNA, 27 bp, Artificial Sequence
  Description of Artificial Sequence: Synthetic oligonucleotide
tatacggggccgcaggcttcaccaaag

SEQ ID NO: 352600 - DNA, 27 bp, Artificial Sequence
  Description of Artificial Sequence: Synthetic oligonucleotide
atacggggccgcaggcttcaccaaaga

SEQ ID NO: 352601 - DNA, 26 bp, Artificial Sequence
  Description of Artificial Sequence: Synthetic oligonucleotide
tacggggccgcaggcttcaccaaaga

SEQ ID NO: 352602 - DNA, 25 bp, Artificial Sequence
  Description of Artificial Sequence: Synthetic oligonucleotide
acggggccgcaggcttcaccaaaga

SEQ ID NO: 352603 - DNA, 24 bp, Artificial Sequence
  Description of Artificial Sequence: Synthetic oligonucleotide
cggggccgcaggcttcaccaaaga

SEQ ID NO: 352604 - DNA, 26 bp, Artificial Sequence
  Description of Artificial Sequence: Synthetic oligonucleotide
ggggccgcaggcttcaccaaagacaa

SEQ ID NO: 352605 - DNA, 26 bp, Artificial Sequence
  Description of Artificial Sequence: Synthetic oligonucleotide
gggccgcaggcttcaccaaagacaag

SEQ ID NO: 352606 - DNA, 27 bp, Artificial Sequence
  Description of Artificial Sequence: Synthetic oligonucleotide
ggccgcaggcttcaccaaagacaagga

SEQ ID NO: 352607 - DNA, 27 bp, Artificial Sequence
  Description of Artificial Sequence: Synthetic oligonucleotide
gccgcaggcttcaccaaagacaaggag

SEQ ID NO: 352608 - DNA, 28 bp, Artificial Sequence
  Description of Artificial Sequence: Synthetic oligonucleotide
ccgcaggcttcaccaaagacaaggagtc

SEQ ID NO: 352609 - DNA, 29 bp, Artificial Sequence
  Description of Artificial Sequence: Synthetic oligonucleotide
cgcaggcttcaccaaagacaaggagtctc

SEQ ID NO: 352610 - DNA, 30 bp, Artificial Sequence
  Description of Artificial Sequence: Synthetic oligonucleotide
gcaggcttcaccaaagacaaggagtctctc

SEQ ID NO: 352611 - DNA, 32 bp, Artificial Sequence
  Description of Artificial Sequence: Synthetic oligonucleotide
caggcttcaccaaagacaaggagtctctcttc

SEQ ID NO: 352612 - DNA, 33 bp, Artificial Sequence
  Description of Artificial Sequence: Synthetic oligonucleotide
aggcttcaccaaagacaaggagtctctcttcag

SEQ ID NO: 352613 - DNA, 32 bp, Artificial Sequence
  Description of Artificial Sequence: Synthetic oligonucleotide
ggcttcaccaaagacaaggagtctctcttcag

SEQ ID NO: 352614 - DNA, 32 bp, Artificial Sequence
  Description of Artificial Sequence: Synthetic oligonucleotide
gcttcaccaaagacaaggagtctctcttcagc

SEQ ID NO: 352615 - DNA, 32 bp, Artificial Sequence
  Description of Artificial Sequence: Synthetic oligonucleotide
cttcaccaaagacaaggagtctctcttcagcc

SEQ ID NO: 352616 - DNA, 32 bp, Artificial Sequence
  Description of Artificial Sequence: Synthetic oligonucleotide
ttcaccaaagacaaggagtctctcttcagccg

SEQ ID NO: 352617 - DNA, 31 bp, Artificial Sequence
  Description of Artificial Sequence: Synthetic oligonucleotide
tcaccaaagacaaggagtctctcttcagccg

SEQ ID NO: 352618 - DNA, 30 bp, Artificial Sequence
  Description of Artificial Sequence: Synthetic oligonucleotide
caccaaagacaaggagtctctcttcagccg

SEQ ID NO: 352619 - DNA, 30 bp, Artificial Sequence
  Description of Artificial Sequence: Synthetic oligonucleotide
accaaagacaaggagtctctcttcagccgg

SEQ ID NO: 352620 - DNA, 29 bp, Artificial Sequence
  Description of Artificial Sequence: Synthetic oligonucleotide
ccaaagacaaggagtctctcttcagccgg

SEQ ID NO: 352621 - DNA, 29 bp, Artificial Sequence
  Description of Artificial Sequence: Synthetic oligonucleotide
caaagacaaggagtctctcttcagccggg

SEQ ID NO: 352622 - DNA, 29 bp, Artificial Sequence
  Description of Artificial Sequence: Synthetic oligonucleotide
aaagacaaggagtctctcttcagccgggg

SEQ ID NO: 352623 - DNA, 28 bp, Artificial Sequence
  Description of Artificial Sequence: Synthetic oligonucleotide
aagacaaggagtctctcttcagccgggg

SEQ ID NO: 352624 - DNA, 27 bp, Artificial Sequence
  Description of Artificial Sequence: Synthetic oligonucleotide
agacaaggagtctctcttcagccgggg

SEQ ID NO: 352625 - DNA, 26 bp, Artificial Sequence
  Description of Artificial Sequence: Synthetic oligonucleotide
gacaaggagtctctcttcagccgggg

SEQ ID NO: 352626 - DNA, 26 bp, Artificial Sequence
  Description of Artificial Sequence: Synthetic oligonucleotide
acaaggagtctctcttcagccggggc

SEQ ID NO: 352627 - DNA, 25 bp, Artificial Sequence
  Description of Artificial Sequence: Synthetic oligonucleotide
caaggagtctctcttcagccggggc

SEQ ID NO: 352628 - DNA, 26 bp, Artificial Sequence
  Description of Artificial Sequence: Synthetic oligonucleotide
aaggagtctctcttcagccggggcga

SEQ ID NO: 352629 - DNA, 25 bp, Artificial Sequence
  Description of Artificial Sequence: Synthetic oligonucleotide
aggagtctctcttcagccggggcga

SEQ ID NO: 352630 - DNA, 24 bp, Artificial Sequence
  Description of Artificial Sequence: Synthetic oligonucleotide
ggagtctctcttcagccggggcga

SEQ ID NO: 352631 - DNA, 26 bp, Artificial Sequence
  Description of Artificial Sequence: Synthetic oligonucleotide
gagtctctcttcagccggggcgagtt

SEQ ID NO: 352632 - DNA, 26 bp, Artificial Sequence
  Description of Artificial Sequence: Synthetic oligonucleotide
agtctctcttcagccggggcgagttc

SEQ ID NO: 352633 - DNA, 25 bp, Artificial Sequence
  Description of Artificial Sequence: Synthetic oligonucleotide
gtctctcttcagccggggcgagttc

SEQ ID NO: 352634 - DNA, 26 bp, Artificial Sequence
  Description of Artificial Sequence: Synthetic oligonucleotide
tctctcttcagccggggcgagttcct

SEQ ID NO: 352635 - DNA, 25 bp, Artificial Sequence
  Description of Artificial Sequence: Synthetic oligonucleotide
ctctcttcagccggggcgagttcct

SEQ ID NO: 352636 - DNA, 25 bp, Artificial Sequence
  Description of Artificial Sequence: Synthetic oligonucleotide
tctcttcagccggggcgagttcctc

SEQ ID NO: 352637 - DNA, 24 bp, Artificial Sequence
  Description of Artificial Sequence: Synthetic oligonucleotide
ctcttcagccggggcgagttcctc

SEQ ID NO: 352638 - DNA, 24 bp, Artificial Sequence
  Description of Artificial Sequence: Synthetic oligonucleotide
tcttcagccggggcgagttcctcg

SEQ ID NO: 352639 - DNA, 23 bp, Artificial Sequence
  Description of Artificial Sequence: Synthetic oligonucleotide
cttcagccggggcgagttcctcg

SEQ ID NO: 352640 - DNA, 23 bp, Artificial Sequence
  Description of Artificial Sequence: Synthetic oligonucleotide
ttcagccggggcgagttcctcgc

SEQ ID NO: 352641 - DNA, 22 bp, Artificial Sequence
  Description of Artificial Sequence: Synthetic oligonucleotide
tcagccggggcgagttcctcgc

SEQ ID NO: 352642 - DNA, 21 bp, Artificial Sequence
  Description of Artificial Sequence: Synthetic oligonucleotide
cagccggggcgagttcctcgc

SEQ ID NO: 352643 - DNA, 21 bp, Artificial Sequence
  Description of Artificial Sequence: Synthetic oligonucleotide
agccggggcgagttcctcgcc

SEQ ID NO: 352644 - DNA, 20 bp, Artificial Sequence
  Description of Artificial Sequence: Synthetic oligonucleotide
gccggggcgagttcctcgcc

SEQ ID NO: 352645 - DNA, 20 bp, Artificial Sequence
  Description of Artificial Sequence: Synthetic oligonucleotide
ccggggcgagttcctcgccg

SEQ ID NO: 352646 - DNA, 20 bp, Artificial Sequence
  Description of Artificial Sequence: Synthetic oligonucleotide
cggggcgagttcctcgccgg

SEQ ID NO: 352647 - DNA, 20 bp, Artificial Sequence
  Description of Artificial Sequence: Synthetic oligonucleotide
ggggcgagttcctcgccggg

SEQ ID NO: 352648 - DNA, 21 bp, Artificial Sequence
  Description of Artificial Sequence: Synthetic oligonucleotide
gggcgagttcctcgccggggt

SEQ ID NO: 352649 - DNA, 21 bp, Artificial Sequence
  Description of Artificial Sequence: Synthetic oligonucleotide
ggcgagttcctcgccggggtg

SEQ ID NO: 352650 - DNA, 21 bp, Artificial Sequence
  Description of Artificial Sequence: Synthetic oligonucleotide
gcgagttcctcgccggggtgg

SEQ ID NO: 352651 - DNA, 21 bp, Artificial Sequence
  Description of Artificial Sequence: Synthetic oligonucleotide
cgagttcctcgccggggtggg

SEQ ID NO: 352652 - DNA, 21 bp, Artificial Sequence
  Description of Artificial Sequence: Synthetic oligonucleotide
gagttcctcgccggggtgggg

SEQ ID NO: 352653 - DNA, 22 bp, Artificial Sequence
  Description of Artificial Sequence: Synthetic oligonucleotide
agttcctcgccggggtgggggt

SEQ ID NO: 352654 - DNA, 21 bp, Artificial Sequence
  Description of Artificial Sequence: Synthetic oligonucleotide
gttcctcgccggggtgggggt

SEQ ID NO: 352655 - DNA, 21 bp, Artificial Sequence
  Description of Artificial Sequence: Synthetic oligonucleotide
ttcctcgccggggtgggggtc

SEQ ID NO: 352656 - DNA, 20 bp, Artificial Sequence
  Description of Artificial Sequence: Synthetic oligonucleotide
tcctcgccggggtgggggtc

SEQ ID NO: 352657 - DNA, 20 bp, Artificial Sequence
  Description of Artificial Sequence: Synthetic oligonucleotide
cctcgccggggtgggggtct

SEQ ID NO: 352658 - DNA, 20 bp, Artificial Sequence
  Description of Artificial Sequence: Synthetic oligonucleotide
ctcgccggggtgggggtcgt

SEQ ID NO: 352659 - DNA, 20 bp, Artificial Sequence
  Description of Artificial Sequence: Synthetic oligonucleotide
tcgccggggtgggggtcggt

SEQ ID NO: 352660 - DNA, 20 bp, Artificial Sequence
  Description of Artificial Sequence: Synthetic oligonucleotide
cgccggggtgggggtcggtt

SEQ ID NO: 352661 - DNA, 20 bp, Artificial Sequence
  Description of Artificial Sequence: Synthetic oligonucleotide
gccggggtgggggtcgggtt

SEQ ID NO: 352662 - DNA, 20 bp, Artificial Sequence
  Description of Artificial Sequence: Synthetic oligonucleotide
ccggggtgggggtcggggat

SEQ ID NO: 352663 - DNA, 20 bp, Artificial Sequence
  Description of Artificial Sequence: Synthetic oligonucleotide
cggggtgggggtcggggatc

SEQ ID NO: 352664 - DNA, 20 bp, Artificial Sequence
  Description of Artificial Sequence: Synthetic oligonucleotide
ggggtgggggtcggggatcc

SEQ ID NO: 352665 - DNA, 20 bp, Artificial Sequence
  Description of Artificial Sequence: Synthetic oligonucleotide
gggtgggggtcggggatccc

SEQ ID NO: 352666 - DNA, 21 bp, Artificial Sequence
  Description of Artificial Sequence: Synthetic oligonucleotide
ggtgggggtcggggatcccca

SEQ ID NO: 352667 - DNA, 21 bp, Artificial Sequence
  Description of Artificial Sequence: Synthetic oligonucleotide
gtgggggtcggggatccccag

SEQ ID NO: 352668 - DNA, 24 bp, Artificial Sequence
  Description of Artificial Sequence: Synthetic oligonucleotide
tgggggtcggggatccccaggtta

SEQ ID NO: 352669 - DNA, 23 bp, Artificial Sequence
  Description of Artificial Sequence: Synthetic oligonucleotide
gggggtcggggatccccaggtta

SEQ ID NO: 352670 - DNA, 24 bp, Artificial Sequence
  Description of Artificial Sequence: Synthetic oligonucleotide
ggggtcggggatccccaggttagt

SEQ ID NO: 352671 - DNA, 25 bp, Artificial Sequence
  Description of Artificial Sequence: Synthetic oligonucleotide
gggtcggggatccccaggttagtga

SEQ ID NO: 352672 - DNA, 25 bp, Artificial Sequence
  Description of Artificial Sequence: Synthetic oligonucleotide
ggtcggggatccccaggttagtgac

SEQ ID NO: 352673 - DNA, 26 bp, Artificial Sequence
  Description of Artificial Sequence: Synthetic oligonucleotide
gtcggggatccccaggttagtgacct

SEQ ID NO: 352674 - DNA, 26 bp, Artificial Sequence
  Description of Artificial Sequence: Synthetic oligonucleotide
tcggggatccccaggttagtgacctg

SEQ ID NO: 352675 - DNA, 25 bp, Artificial Sequence
  Description of Artificial Sequence: Synthetic oligonucleotide
cggggatccccaggttagtgacctg

SEQ ID NO: 352676 - DNA, 25 bp, Artificial Sequence
  Description of Artificial Sequence: Synthetic oligonucleotide
ggggatccccaggttagtgacctgc

SEQ ID NO: 352677 - DNA, 26 bp, Artificial Sequence
  Description of Artificial Sequence: Synthetic oligonucleotide
gggatccccaggttagtgacctgcca

SEQ ID NO: 352678 - DNA, 26 bp, Artificial Sequence
  Description of Artificial Sequence: Synthetic oligonucleotide
ggatccccaggttagtgacctgccag

SEQ ID NO: 352679 - DNA, 26 bp, Artificial Sequence
  Description of Artificial Sequence: Synthetic oligonucleotide
gatccccaggttagtgacctgccagc

SEQ ID NO: 352680 - DNA, 26 bp, Artificial Sequence
  Description of Artificial Sequence: Synthetic oligonucleotide
atccccaggttagtgacctgccagcc

SEQ ID NO: 352681 - DNA, 25 bp, Artificial Sequence
  Description of Artificial Sequence: Synthetic oligonucleotide
tccccaggttagtgacctgccagcc

SEQ ID NO: 352682 - DNA, 24 bp, Artificial Sequence
  Description of Artificial Sequence: Synthetic oligonucleotide
ccccaggttagtgacctgccagcc

SEQ ID NO: 352683 - DNA, 25 bp, Artificial Sequence
  Description of Artificial Sequence: Synthetic oligonucleotide
cccaggttagtgacctgccagccga

SEQ ID NO: 352684 - DNA, 25 bp, Artificial Sequence
  Description of Artificial Sequence: Synthetic oligonucleotide
ccaggttagtgacctgccagccgag

SEQ ID NO: 352685 - DNA, 25 bp, Artificial Sequence
  Description of Artificial Sequence: Synthetic oligonucleotide
caggttagtgacctgccagccgagg

SEQ ID NO: 352686 - DNA, 26 bp, Artificial Sequence
  Description of Artificial Sequence: Synthetic oligonucleotide
aggttagtgacctgccagccgagggt

SEQ ID NO: 352687 - DNA, 25 bp, Artificial Sequence
  Description of Artificial Sequence: Synthetic oligonucleotide
ggttagtgacctgccagccgagggt

SEQ ID NO: 352688 - DNA, 26 bp, Artificial Sequence
  Description of Artificial Sequence: Synthetic oligonucleotide
gttagtgacctgccagccgagggtgt

SEQ ID NO: 352689 - DNA, 26 bp, Artificial Sequence
  Description of Artificial Sequence: Synthetic oligonucleotide
ttagtgacctgccagccgagggtgtg

SEQ ID NO: 352690 - DNA, 25 bp, Artificial Sequence
  Description of Artificial Sequence: Synthetic oligonucleotide
tagtgacctgccagccgagggtgtg

SEQ ID NO: 352691 - DNA, 24 bp, Artificial Sequence
  Description of Artificial Sequence: Synthetic oligonucleotide
agtgacctgccagccgagggtgtg

SEQ ID NO: 352692 - DNA, 23 bp, Artificial Sequence
  Description of Artificial Sequence: Synthetic oligonucleotide
gtgacctgccagccgagggtgtg

SEQ ID NO: 352693 - DNA, 24 bp, Artificial Sequence
  Description of Artificial Sequence: Synthetic oligonucleotide
tgacctgccagccgagggtgtggt

SEQ ID NO: 352694 - DNA, 23 bp, Artificial Sequence
  Description of Artificial Sequence: Synthetic oligonucleotide
gacctgccagccgagggtgtggt

SEQ ID NO: 352695 - DNA, 23 bp, Artificial Sequence
  Description of Artificial Sequence: Synthetic oligonucleotide
acctgccagccgagggtgtggtc

SEQ ID NO: 352696 - DNA, 22 bp, Artificial Sequence
  Description of Artificial Sequence: Synthetic oligonucleotide
cctgccagccgagggtgtggtc

SEQ ID NO: 352697 - DNA, 23 bp, Artificial Sequence
  Description of Artificial Sequence: Synthetic oligonucleotide
ctgccagccgagggtgtggtcct

SEQ ID NO: 352698 - DNA, 23 bp, Artificial Sequence
  Description of Artificial Sequence: Synthetic oligonucleotide
tgccagccgagggtgtggtcctc

SEQ ID NO: 352699 - DNA, 22 bp, Artificial Sequence
  Description of Artificial Sequence: Synthetic oligonucleotide
gccagccgagggtgtggtcctc

SEQ ID NO: 352700 - DNA, 26 bp, Artificial Sequence
  Description of Artificial Sequence: Synthetic oligonucleotide
ccagccgagggtgtggtcctccatta

SEQ ID NO: 352701 - DNA, 27 bp, Artificial Sequence
  Description of Artificial Sequence: Synthetic oligonucleotide
cagccgagggtgtggtcctccattaca

SEQ ID NO: 352702 - DNA, 27 bp, Artificial Sequence
  Description of Artificial Sequence: Synthetic oligonucleotide
agccgagggtgtggtcctccattacac

SEQ ID NO: 352703 - DNA, 27 bp, Artificial Sequence
  Description of Artificial Sequence: Synthetic oligonucleotide
gccgagggtgtggtcctccattacaca

SEQ ID NO: 352704 - DNA, 27 bp, Artificial Sequence
  Description of Artificial Sequence: Synthetic oligonucleotide
ccgagggtgtggtcctccattacacac

SEQ ID NO: 352705 - DNA, 28 bp, Artificial Sequence
  Description of Artificial Sequence: Synthetic oligonucleotide
cgagggtgtggtcctccattacacacac

SEQ ID NO: 352706 - DNA, 29 bp, Artificial Sequence
  Description of Artificial Sequence: Synthetic oligonucleotide
gagggtgtggtcctccattacacacactg

SEQ ID NO: 352707 - DNA, 29 bp, Artificial Sequence
  Description of Artificial Sequence: Synthetic oligonucleotide
agggtgtggtcctccattacacacactgg

SEQ ID NO: 352708 - DNA, 28 bp, Artificial Sequence
  Description of Artificial Sequence: Synthetic oligonucleotide
gggtgtggtcctccattacacacactgg

SEQ ID NO: 352709 - DNA, 28 bp, Artificial Sequence
  Description of Artificial Sequence: Synthetic oligonucleotide
ggtgtggtcctccattacacacactggc

SEQ ID NO: 352710 - DNA, 29 bp, Artificial Sequence
  Description of Artificial Sequence: Synthetic oligonucleotide
gtgtggtcctccattacacacactggctg

SEQ ID NO: 352711 - DNA, 29 bp, Artificial Sequence
  Description of Artificial Sequence: Synthetic oligonucleotide
tgtggtcctccattacacacactggctgc

SEQ ID NO: 352712 - DNA, 28 bp, Artificial Sequence
  Description of Artificial Sequence: Synthetic oligonucleotide
gtggtcctccattacacacactggctgc

SEQ ID NO: 352713 - DNA, 30 bp, Artificial Sequence
  Description of Artificial Sequence: Synthetic oligonucleotide
tggtcctccattacacacactggctgcttc

SEQ ID NO: 352714 - DNA, 29 bp, Artificial Sequence
  Description of Artificial Sequence: Synthetic oligonucleotide
ggtcctccattacacacactggctgcttc

SEQ ID NO: 352715 - DNA, 29 bp, Artificial Sequence
  Description of Artificial Sequence: Synthetic oligonucleotide
gtcctccattacacacactggctgcttcc

SEQ ID NO: 352716 - DNA, 29 bp, Artificial Sequence
  Description of Artificial Sequence: Synthetic oligonucleotide
tcctccattacacacactggctgcttccc

SEQ ID NO: 352717 - DNA, 28 bp, Artificial Sequence
  Description of Artificial Sequence: Synthetic oligonucleotide
cctccattacacacactggctgcttccc

SEQ ID NO: 352718 - DNA, 28 bp, Artificial Sequence
  Description of Artificial Sequence: Synthetic oligonucleotide
ctccattacacacactggctgcttcccg

SEQ ID NO: 352719 - DNA, 29 bp, Artificial Sequence
  Description of Artificial Sequence: Synthetic oligonucleotide
tccattacacacactggctgcttcccgag

SEQ ID NO: 352720 - DNA, 28 bp, Artificial Sequence
  Description of Artificial Sequence: Synthetic oligonucleotide
ccattacacacactggctgcttcccgag

SEQ ID NO: 352721 - DNA, 28 bp, Artificial Sequence
  Description of Artificial Sequence: Synthetic oligonucleotide
cattacacacactggctgcttcccgagg

SEQ ID NO: 352722 - DNA, 29 bp, Artificial Sequence
  Description of Artificial Sequence: Synthetic oligonucleotide
attacacacactggctgcttcccgaggag

SEQ ID NO: 352723 - DNA, 28 bp, Artificial Sequence
  Description of Artificial Sequence: Synthetic oligonucleotide
ttacacacactggctgcttcccgaggag

SEQ ID NO: 352724 - DNA, 27 bp, Artificial Sequence
  Description of Artificial Sequence: Synthetic oligonucleotide
tacacacactggctgcttcccgaggag

SEQ ID NO: 352725 - DNA, 26 bp, Artificial Sequence
  Description of Artificial Sequence: Synthetic oligonucleotide
acacacactggctgcttcccgaggag

SEQ ID NO: 352726 - DNA, 25 bp, Artificial Sequence
  Description of Artificial Sequence: Synthetic oligonucleotide
cacacactggctgcttcccgaggag

SEQ ID NO: 352727 - DNA, 25 bp, Artificial Sequence
  Description of Artificial Sequence: Synthetic oligonucleotide
acacactggctgcttcccgaggagc

SEQ ID NO: 352728 - DNA, 24 bp, Artificial Sequence
  Description of Artificial Sequence: Synthetic oligonucleotide
cacactggctgcttcccgaggagc

SEQ ID NO: 352729 - DNA, 24 bp, Artificial Sequence
  Description of Artificial Sequence: Synthetic oligonucleotide
acactggctgcttcccgaggagcc

SEQ ID NO: 352730 - DNA, 23 bp, Artificial Sequence
  Description of Artificial Sequence: Synthetic oligonucleotide
cactggctgcttcccgaggagcc

SEQ ID NO: 352731 - DNA, 23 bp, Artificial Sequence
  Description of Artificial Sequence: Synthetic oligonucleotide
actggctgcttcccgaggagccg

SEQ ID NO: 352732 - DNA, 22 bp, Artificial Sequence
  Description of Artificial Sequence: Synthetic oligonucleotide
ctggctgcttcccgaggagccg

SEQ ID NO: 352733 - DNA, 22 bp, Artificial Sequence
  Description of Artificial Sequence: Synthetic oligonucleotide
tggctgcttcccgaggagccgg

SEQ ID NO: 352734 - DNA, 21 bp, Artificial Sequence
  Description of Artificial Sequence: Synthetic oligonucleotide
ggctgcttcccgaggagccgg

SEQ ID NO: 352735 - DNA, 22 bp, Artificial Sequence
  Description of Artificial Sequence: Synthetic oligonucleotide
gctgcttcccgaggagccggca

SEQ ID NO: 352736 - DNA, 22 bp, Artificial Sequence
  Description of Artificial Sequence: Synthetic oligonucleotide
ctgcttcccgaggagccggcac

SEQ ID NO: 352737 - DNA, 22 bp, Artificial Sequence
  Description of Artificial Sequence: Synthetic oligonucleotide
tgcttcccgaggagccggcacg

SEQ ID NO: 352738 - DNA, 21 bp, Artificial Sequence
  Description of Artificial Sequence: Synthetic oligonucleotide
gcttcccgaggagccggcacg

SEQ ID NO: 352739 - DNA, 21 bp, Artificial Sequence
  Description of Artificial Sequence: Synthetic oligonucleotide
cttcccgaggagccggcacgc

SEQ ID NO: 352740 - DNA, 22 bp, Artificial Sequence
  Description of Artificial Sequence: Synthetic oligonucleotide
ttcccgaggagccggcacgcgt

SEQ ID NO: 352741 - DNA, 21 bp, Artificial Sequence
  Description of Artificial Sequence: Synthetic oligonucleotide
tcccgaggagccggcacgcgt

SEQ ID NO: 352742 - DNA, 20 bp, Artificial Sequence
  Description of Artificial Sequence: Synthetic oligonucleotide
cccgaggagccggcacgcgt

SEQ ID NO: 352743 - DNA, 21 bp, Artificial Sequence
  Description of Artificial Sequence: Synthetic oligonucleotide
ccgaggagccggcacgcgtga

SEQ ID NO: 352744 - DNA, 21 bp, Artificial Sequence
  Description of Artificial Sequence: Synthetic oligonucleotide
cgaggagccggcacgcgtgag

SEQ ID NO: 352745 - DNA, 21 bp, Artificial Sequence
  Description of Artificial Sequence: Synthetic oligonucleotide
gaggagccggcacgcgtgagg

SEQ ID NO: 352746 - DNA, 22 bp, Artificial Sequence
  Description of Artificial Sequence: Synthetic oligonucleotide
aggagccggcacgcgtgaggga

SEQ ID NO: 352747 - DNA, 21 bp, Artificial Sequence
  Description of Artificial Sequence: Synthetic oligonucleotide
ggagccggcacgcgtgaggga

SEQ ID NO: 352748 - DNA, 21 bp, Artificial Sequence
  Description of Artificial Sequence: Synthetic oligonucleotide
gagccggcacgcgtgagggag

SEQ ID NO: 352749 - DNA, 21 bp, Artificial Sequence
  Description of Artificial Sequence: Synthetic oligonucleotide
agccggcacgcgtgagggagg

SEQ ID NO: 352750 - DNA, 20 bp, Artificial Sequence
  Description of Artificial Sequence: Synthetic oligonucleotide
gccggcacgcgtgagggagg

SEQ ID NO: 352751 - DNA, 20 bp, Artificial Sequence
  Description of Artificial Sequence: Synthetic oligonucleotide
ccggcacgcgtgagggaggg

SEQ ID NO: 352752 - DNA, 20 bp, Artificial Sequence
  Description of Artificial Sequence: Synthetic oligonucleotide
cggcacgcgtgagggagggc

SEQ ID NO: 352753 - DNA, 21 bp, Artificial Sequence
  Description of Artificial Sequence: Synthetic oligonucleotide
ggcacgcgtgagggagggcct

SEQ ID NO: 352754 - DNA, 22 bp, Artificial Sequence
  Description of Artificial Sequence: Synthetic oligonucleotide
gcacgcgtgagggagggcctga

SEQ ID NO: 352755 - DNA, 22 bp, Artificial Sequence
  Description of Artificial Sequence: Synthetic oligonucleotide
cacgcgtgagggagggcctgag

SEQ ID NO: 352756 - DNA, 22 bp, Artificial Sequence
  Description of Artificial Sequence: Synthetic oligonucleotide
acgcgtgagggagggcctgagc

SEQ ID NO: 352757 - DNA, 21 bp, Artificial Sequence
  Description of Artificial Sequence: Synthetic oligonucleotide
cgcgtgagggagggcctgagc

SEQ ID NO: 352758 - DNA, 23 bp, Artificial Sequence
  Description of Artificial Sequence: Synthetic oligonucleotide
gcgtgagggagggcctgagcgaa

SEQ ID NO: 352759 - DNA, 24 bp, Artificial Sequence
  Description of Artificial Sequence: Synthetic oligonucleotide
cgtgagggagggcctgagcgaagt

SEQ ID NO: 352760 - DNA, 24 bp, Artificial Sequence
  Description of Artificial Sequence: Synthetic oligonucleotide
gtgagggagggcctgagcgaagtg

SEQ ID NO: 352761 - DNA, 25 bp, Artificial Sequence
  Description of Artificial Sequence: Synthetic oligonucleotide
tgagggagggcctgagcgaagtggt

SEQ ID NO: 352762 - DNA, 24 bp, Artificial Sequence
  Description of Artificial Sequence: Synthetic oligonucleotide
gagggagggcctgagcgaagtggt

SEQ ID NO: 352763 - DNA, 24 bp, Artificial Sequence
  Description of Artificial Sequence: Synthetic oligonucleotide
agggagggcctgagcgaagtggtg

SEQ ID NO: 352764 - DNA, 23 bp, Artificial Sequence
  Description of Artificial Sequence: Synthetic oligonucleotide
gggagggcctgagcgaagtggtg

SEQ ID NO: 352765 - DNA, 23 bp, Artificial Sequence
  Description of Artificial Sequence: Synthetic oligonucleotide
ggagggcctgagcgaagtggtgg

SEQ ID NO: 352766 - DNA, 23 bp, Artificial Sequence
  Description of Artificial Sequence: Synthetic oligonucleotide
gagggcctgagcgaagtggtggg

SEQ ID NO: 352767 - DNA, 23 bp, Artificial Sequence
  Description of Artificial Sequence: Synthetic oligonucleotide
agggcctgagcgaagtggtgggc

SEQ ID NO: 352768 - DNA, 22 bp, Artificial Sequence
  Description of Artificial Sequence: Synthetic oligonucleotide
gggcctgagcgaagtggtgggc

SEQ ID NO: 352769 - DNA, 23 bp, Artificial Sequence
  Description of Artificial Sequence: Synthetic oligonucleotide
ggcctgagcgaagtggtgggcca

SEQ ID NO: 352770 - DNA, 23 bp, Artificial Sequence
  Description of Artificial Sequence: Synthetic oligonucleotide
gcctgagcgaagtggtgggccac

SEQ ID NO: 352771 - DNA, 24 bp, Artificial Sequence
  Description of Artificial Sequence: Synthetic oligonucleotide
cctgagcgaagtggtgggccacca

SEQ ID NO: 352772 - DNA, 27 bp, Artificial Sequence
  Description of Artificial Sequence: Synthetic oligonucleotide
ctgagcgaagtggtgggccaccacaat

SEQ ID NO: 352773 - DNA, 27 bp, Artificial Sequence
  Description of Artificial Sequence: Synthetic oligonucleotide
tgagcgaagtggtgggccaccacaatg

SEQ ID NO: 352774 - DNA, 27 bp, Artificial Sequence
  Description of Artificial Sequence: Synthetic oligonucleotide
gagcgaagtggtgggccaccacaatga

SEQ ID NO: 352775 - DNA, 27 bp, Artificial Sequence
  Description of Artificial Sequence: Synthetic oligonucleotide
agcgaagtggtgggccaccacaatgac

SEQ ID NO: 352776 - DNA, 26 bp, Artificial Sequence
  Description of Artificial Sequence: Synthetic oligonucleotide
gcgaagtggtgggccaccacaatgac

SEQ ID NO: 352777 - DNA, 27 bp, Artificial Sequence
  Description of Artificial Sequence: Synthetic oligonucleotide
cgaagtggtgggccaccacaatgacgt

SEQ ID NO: 352778 - DNA, 27 bp, Artificial Sequence
  Description of Artificial Sequence: Synthetic oligonucleotide
gaagtggtgggccaccacaatgacgtg

SEQ ID NO: 352779 - DNA, 28 bp, Artificial Sequence
  Description of Artificial Sequence: Synthetic oligonucleotide
aagtggtgggccaccacaatgacgtgtg

SEQ ID NO: 352780 - DNA, 27 bp, Artificial Sequence
  Description of Artificial Sequence: Synthetic oligonucleotide
agtggtgggccaccacaatgacgtgtg

SEQ ID NO: 352781 - DNA, 26 bp, Artificial Sequence
  Description of Artificial Sequence: Synthetic oligonucleotide
gtggtgggccaccacaatgacgtgtg

SEQ ID NO: 352782 - DNA, 26 bp, Artificial Sequence
  Description of Artificial Sequence: Synthetic oligonucleotide
tggtgggccaccacaatgacgtgtgc

SEQ ID NO: 352783 - DNA, 25 bp, Artificial Sequence
  Description of Artificial Sequence: Synthetic oligonucleotide
ggtgggccaccacaatgacgtgtgc

SEQ ID NO: 352784 - DNA, 25 bp, Artificial Sequence
  Description of Artificial Sequence: Synthetic oligonucleotide
gtgggccaccacaatgacgtgtgcc

SEQ ID NO: 352785 - DNA, 25 bp, Artificial Sequence
  Description of Artificial Sequence: Synthetic oligonucleotide
tgggccaccacaatgacgtgtgccc

SEQ ID NO: 352786 - DNA, 24 bp, Artificial Sequence
  Description of Artificial Sequence: Synthetic oligonucleotide
gggccaccacaatgacgtgtgccc

SEQ ID NO: 352787 - DNA, 24 bp, Artificial Sequence
  Description of Artificial Sequence: Synthetic oligonucleotide
ggccaccacaatgacgtgtgcccg

SEQ ID NO: 352788 - DNA, 25 bp, Artificial Sequence
  Description of Artificial Sequence: Synthetic oligonucleotide
gccaccacaatgacgtgtgcccggt

SEQ ID NO: 352789 - DNA, 25 bp, Artificial Sequence
  Description of Artificial Sequence: Synthetic oligonucleotide
ccaccacaatgacgtgtgcccggtg

SEQ ID NO: 352790 - DNA, 25 bp, Artificial Sequence
  Description of Artificial Sequence: Synthetic oligonucleotide
caccacaatgacgtgtgcccggtgg

SEQ ID NO: 352791 - DNA, 25 bp, Artificial Sequence
  Description of Artificial Sequence: Synthetic oligonucleotide
accacaatgacgtgtgcccggtggc

SEQ ID NO: 352792 - DNA, 24 bp, Artificial Sequence
  Description of Artificial Sequence: Synthetic oligonucleotide
ccacaatgacgtgtgcccggtggc

SEQ ID NO: 352793 - DNA, 24 bp, Artificial Sequence
  Description of Artificial Sequence: Synthetic oligonucleotide
cacaatgacgtgtgcccggtggcc

SEQ ID NO: 352794 - DNA, 25 bp, Artificial Sequence
  Description of Artificial Sequence: Synthetic oligonucleotide
acaatgacgtgtgcccggtggccca

SEQ ID NO: 352795 - DNA, 24 bp, Artificial Sequence
  Description of Artificial Sequence: Synthetic oligonucleotide
caatgacgtgtgcccggtggccca

SEQ ID NO: 352796 - DNA, 24 bp, Artificial Sequence
  Description of Artificial Sequence: Synthetic oligonucleotide
aatgacgtgtgcccggtggcccag

SEQ ID NO: 352797 - DNA, 23 bp, Artificial Sequence
  Description of Artificial Sequence: Synthetic oligonucleotide
atgacgtgtgcccggtggcccag

SEQ ID NO: 352798 - DNA, 22 bp, Artificial Sequence
  Description of Artificial Sequence: Synthetic oligonucleotide
tgacgtgtgcccggtggcccag

SEQ ID NO: 352799 - DNA, 21 bp, Artificial Sequence
  Description of Artificial Sequence: Synthetic oligonucleotide
gacgtgtgcccggtggcccag

SEQ ID NO: 352800 - DNA, 22 bp, Artificial Sequence
  Description of Artificial Sequence: Synthetic oligonucleotide
acgtgtgcccggtggcccaggt

SEQ ID NO: 352801 - DNA, 21 bp, Artificial Sequence
  Description of Artificial Sequence: Synthetic oligonucleotide
cgtgtgcccggtggcccaggt

SEQ ID NO: 352802 - DNA, 21 bp, Artificial Sequence
  Description of Artificial Sequence: Synthetic oligonucleotide
gtgtgcccggtggcccaggtg

SEQ ID NO: 352803 - DNA, 21 bp, Artificial Sequence
  Description of Artificial Sequence: Synthetic oligonucleotide
tgtgcccggtggcccaggtgg

SEQ ID NO: 352804 - DNA, 20 bp, Artificial Sequence
  Description of Artificial Sequence: Synthetic oligonucleotide
gtgcccggtggcccaggtgg

SEQ ID NO: 352805 - DNA, 21 bp, Artificial Sequence
  Description of Artificial Sequence: Synthetic oligonucleotide
tgcccggtggcccaggtggct

SEQ ID NO: 352806 - DNA, 20 bp, Artificial Sequence
  Description of Artificial Sequence: Synthetic oligonucleotide
gcccggtggcccaggtggct

SEQ ID NO: 352807 - DNA, 20 bp, Artificial Sequence
  Description of Artificial Sequence: Synthetic oligonucleotide
cccggtggcccaggtggctg

SEQ ID NO: 352808 - DNA, 20 bp, Artificial Sequence
  Description of Artificial Sequence: Synthetic oligonucleotide
ccggtggcccaggtggctgg

SEQ ID NO: 352809 - DNA, 20 bp, Artificial Sequence
  Description of Artificial Sequence: Synthetic oligonucleotide
cggtggcccaggtggctggg

SEQ ID NO: 352810 - DNA, 20 bp, Artificial Sequence
  Description of Artificial Sequence: Synthetic oligonucleotide
ggtggcccaggtggctgggc

SEQ ID NO: 352811 - DNA, 21 bp, Artificial Sequence
  Description of Artificial Sequence: Synthetic oligonucleotide
gtggcccaggtggctgggcca

SEQ ID NO: 352812 - DNA, 22 bp, Artificial Sequence
  Description of Artificial Sequence: Synthetic oligonucleotide
tggcccaggtggctgggccact

SEQ ID NO: 352813 - DNA, 21 bp, Artificial Sequence
  Description of Artificial Sequence: Synthetic oligonucleotide
ggcccaggtggctgggccact

SEQ ID NO: 352814 - DNA, 21 bp, Artificial Sequence
  Description of Artificial Sequence: Synthetic oligonucleotide
gcccaggtggctgggccactg

SEQ ID NO: 352815 - DNA, 21 bp, Artificial Sequence
  Description of Artificial Sequence: Synthetic oligonucleotide
cccaggtggctgggccactgg

SEQ ID NO: 352816 - DNA, 22 bp, Artificial Sequence
  Description of Artificial Sequence: Synthetic oligonucleotide
ccaggtggctgggccactggct

SEQ ID NO: 352817 - DNA, 22 bp, Artificial Sequence
  Description of Artificial Sequence: Synthetic oligonucleotide
caggtggctgggccactggctg

SEQ ID NO: 352818 - DNA, 22 bp, Artificial Sequence
  Description of Artificial Sequence: Synthetic oligonucleotide
aggtggctgggccactggctgc

SEQ ID NO: 352819 - DNA, 21 bp, Artificial Sequence
  Description of Artificial Sequence: Synthetic oligonucleotide
ggtggctgggccactggctgc

SEQ ID NO: 352820 - DNA, 21 bp, Artificial Sequence
  Description of Artificial Sequence: Synthetic oligonucleotide
gtggctgggccactggctgcg

SEQ ID NO: 352821 - DNA, 22 bp, Artificial Sequence
  Description of Artificial Sequence: Synthetic oligonucleotide
tggctgggccactggctgcgca

SEQ ID NO: 352822 - DNA, 21 bp, Artificial Sequence
  Description of Artificial Sequence: Synthetic oligonucleotide
ggctgggccactggctgcgca

SEQ ID NO: 352823 - DNA, 21 bp, Artificial Sequence
  Description of Artificial Sequence: Synthetic oligonucleotide
gctgggccactggctgcgcag

SEQ ID NO: 352824 - DNA, 21 bp, Artificial Sequence
  Description of Artificial Sequence: Synthetic oligonucleotide
ctgggccactggctgcgcagg

SEQ ID NO: 352825 - DNA, 22 bp, Artificial Sequence
  Description of Artificial Sequence: Synthetic oligonucleotide
tgggccactggctgcgcagggt

SEQ ID NO: 352826 - DNA, 21 bp, Artificial Sequence
  Description of Artificial Sequence: Synthetic oligonucleotide
gggccactggctgcgcagggt

SEQ ID NO: 352827 - DNA, 21 bp, Artificial Sequence
  Description of Artificial Sequence: Synthetic oligonucleotide
ggccactggctgcgcagggtg

SEQ ID NO: 352828 - DNA, 21 bp, Artificial Sequence
  Description of Artificial Sequence: Synthetic oligonucleotide
gccactggctgcgcagggtgc

SEQ ID NO: 352829 - DNA, 21 bp, Artificial Sequence
  Description of Artificial Sequence: Synthetic oligonucleotide
ccactggctgcgcagggtgcc

SEQ ID NO: 352830 - DNA, 21 bp, Artificial Sequence
  Description of Artificial Sequence: Synthetic oligonucleotide
cactggctgcgcagggtgccg

SEQ ID NO: 352831 - DNA, 21 bp, Artificial Sequence
  Description of Artificial Sequence: Synthetic oligonucleotide
actggctgcgcagggtgccgg

SEQ ID NO: 352832 - DNA, 20 bp, Artificial Sequence
  Description of Artificial Sequence: Synthetic oligonucleotide
ctggctgcgcagggtgccgg

SEQ ID NO: 352833 - DNA, 20 bp, Artificial Sequence
  Description of Artificial Sequence: Synthetic oligonucleotide
tggctgcgcagggtgccggg

SEQ ID NO: 352834 - DNA, 20 bp, Artificial Sequence
  Description of Artificial Sequence: Synthetic oligonucleotide
ggctgcgcagggtgccgggt

SEQ ID NO: 352835 - DNA, 20 bp, Artificial Sequence
  Description of Artificial Sequence: Synthetic oligonucleotide
gctgcgcagggtgccggggt

SEQ ID NO: 352836 - DNA, 22 bp, Artificial Sequence
  Description of Artificial Sequence: Synthetic oligonucleotide
ctgcgcagggtgccggggtcta

SEQ ID NO: 352837 - DNA, 22 bp, Artificial Sequence
  Description of Artificial Sequence: Synthetic oligonucleotide
tgcgcagggtgccggggtctac

SEQ ID NO: 352838 - DNA, 21 bp, Artificial Sequence
  Description of Artificial Sequence: Synthetic oligonucleotide
gcgcagggtgccggggtctac

SEQ ID NO: 352839 - DNA, 21 bp, Artificial Sequence
  Description of Artificial Sequence: Synthetic oligonucleotide
cgcagggtgccggggtctacg

SEQ ID NO: 352840 - DNA, 21 bp, Artificial Sequence
  Description of Artificial Sequence: Synthetic oligonucleotide
gcagggtgccggggtctacgg

SEQ ID NO: 352841 - DNA, 23 bp, Artificial Sequence
  Description of Artificial Sequence: Synthetic oligonucleotide
cagggtgccggggtctacggcta

SEQ ID NO: 352842 - DNA, 23 bp, Artificial Sequence
  Description of Artificial Sequence: Synthetic oligonucleotide
agggtgccggggtctacggctac

SEQ ID NO: 352843 - DNA, 22 bp, Artificial Sequence
  Description of Artificial Sequence: Synthetic oligonucleotide
gggtgccggggtctacggctac

SEQ ID NO: 352844 - DNA, 23 bp, Artificial Sequence
  Description of Artificial Sequence: Synthetic oligonucleotide
ggtgccggggtctacggctacgt

SEQ ID NO: 352845 - DNA, 26 bp, Artificial Sequence
  Description of Artificial Sequence: Synthetic oligonucleotide
gtgccggggtctacggctacgtctta

SEQ ID NO: 352846 - DNA, 27 bp, Artificial Sequence
  Description of Artificial Sequence: Synthetic oligonucleotide
tgccggggtctacggctacgtcttaga

SEQ ID NO: 352847 - DNA, 27 bp, Artificial Sequence
  Description of Artificial Sequence: Synthetic oligonucleotide
gccggggtctacggctacgtcttagaa

SEQ ID NO: 352848 - DNA, 27 bp, Artificial Sequence
  Description of Artificial Sequence: Synthetic oligonucleotide
ccggggtctacggctacgtcttagaac

SEQ ID NO: 352849 - DNA, 28 bp, Artificial Sequence
  Description of Artificial Sequence: Synthetic oligonucleotide
cggggtctacggctacgtcttagaacac

SEQ ID NO: 352850 - DNA, 28 bp, Artificial Sequence
  Description of Artificial Sequence: Synthetic oligonucleotide
ggggtctacggctacgtcttagaacacc

SEQ ID NO: 352851 - DNA, 28 bp, Artificial Sequence
  Description of Artificial Sequence: Synthetic oligonucleotide
gggtctacggctacgtcttagaacaccg

SEQ ID NO: 352852 - DNA, 29 bp, Artificial Sequence
  Description of Artificial Sequence: Synthetic oligonucleotide
ggtctacggctacgtcttagaacaccgtc

SEQ ID NO: 352853 - DNA, 29 bp, Artificial Sequence
  Description of Artificial Sequence: Synthetic oligonucleotide
gtctacggctacgtcttagaacaccgtcc

SEQ ID NO: 352854 - DNA, 31 bp, Artificial Sequence
  Description of Artificial Sequence: Synthetic oligonucleotide
tctacggctacgtcttagaacaccgtccttc

SEQ ID NO: 352855 - DNA, 30 bp, Artificial Sequence
  Description of Artificial Sequence: Synthetic oligonucleotide
ctacggctacgtcttagaacaccgtccttc

SEQ ID NO: 352856 - DNA, 30 bp, Artificial Sequence
  Description of Artificial Sequence: Synthetic oligonucleotide
tacggctacgtcttagaacaccgtccttcc

SEQ ID NO: 352857 - DNA, 29 bp, Artificial Sequence
  Description of Artificial Sequence: Synthetic oligonucleotide
acggctacgtcttagaacaccgtccttcc

SEQ ID NO: 352858 - DNA, 28 bp, Artificial Sequence
  Description of Artificial Sequence: Synthetic oligonucleotide
cggctacgtcttagaacaccgtccttcc

SEQ ID NO: 352859 - DNA, 29 bp, Artificial Sequence
  Description of Artificial Sequence: Synthetic oligonucleotide
ggctacgtcttagaacaccgtccttccac

SEQ ID NO: 352860 - DNA, 29 bp, Artificial Sequence
  Description of Artificial Sequence: Synthetic oligonucleotide
gctacgtcttagaacaccgtccttccacg

SEQ ID NO: 352861 - DNA, 29 bp, Artificial Sequence
  Description of Artificial Sequence: Synthetic oligonucleotide
ctacgtcttagaacaccgtccttccacgc

SEQ ID NO: 352862 - DNA, 30 bp, Artificial Sequence
  Description of Artificial Sequence: Synthetic oligonucleotide
tacgtcttagaacaccgtccttccacgcac

SEQ ID NO: 352863 - DNA, 29 bp, Artificial Sequence
  Description of Artificial Sequence: Synthetic oligonucleotide
acgtcttagaacaccgtccttccacgcac

SEQ ID NO: 352864 - DNA, 28 bp, Artificial Sequence
  Description of Artificial Sequence: Synthetic oligonucleotide
cgtcttagaacaccgtccttccacgcac

SEQ ID NO: 352865 - DNA, 29 bp, Artificial Sequence
  Description of Artificial Sequence: Synthetic oligonucleotide
gtcttagaacaccgtccttccacgcactc

SEQ ID NO: 352866 - DNA, 29 bp, Artificial Sequence
  Description of Artificial Sequence: Synthetic oligonucleotide
tcttagaacaccgtccttccacgcactcc

SEQ ID NO: 352867 - DNA, 28 bp, Artificial Sequence
  Description of Artificial Sequence: Synthetic oligonucleotide
cttagaacaccgtccttccacgcactcc

SEQ ID NO: 352868 - DNA, 29 bp, Artificial Sequence
  Description of Artificial Sequence: Synthetic oligonucleotide
ttagaacaccgtccttccacgcactcctg

SEQ ID NO: 352869 - DNA, 28 bp, Artificial Sequence
  Description of Artificial Sequence: Synthetic oligonucleotide
tagaacaccgtccttccacgcactcctg

SEQ ID NO: 352870 - DNA, 27 bp, Artificial Sequence
  Description of Artificial Sequence: Synthetic oligonucleotide
agaacaccgtccttccacgcactcctg

SEQ ID NO: 352871 - DNA, 26 bp, Artificial Sequence
  Description of Artificial Sequence: Synthetic oligonucleotide
gaacaccgtccttccacgcactcctg

SEQ ID NO: 352872 - DNA, 26 bp, Artificial Sequence
  Description of Artificial Sequence: Synthetic oligonucleotide
aacaccgtccttccacgcactcctgg

SEQ ID NO: 352873 - DNA, 25 bp, Artificial Sequence
  Description of Artificial Sequence: Synthetic oligonucleotide
acaccgtccttccacgcactcctgg

SEQ ID NO: 352874 - DNA, 24 bp, Artificial Sequence
  Description of Artificial Sequence: Synthetic oligonucleotide
caccgtccttccacgcactcctgg

SEQ ID NO: 352875 - DNA, 24 bp, Artificial Sequence
  Description of Artificial Sequence: Synthetic oligonucleotide
accgtccttccacgcactcctggc

SEQ ID NO: 352876 - DNA, 23 bp, Artificial Sequence
  Description of Artificial Sequence: Synthetic oligonucleotide
ccgtccttccacgcactcctggc

SEQ ID NO: 352877 - DNA, 23 bp, Artificial Sequence
  Description of Artificial Sequence: Synthetic oligonucleotide
cgtccttccacgcactcctggcc

SEQ ID NO: 352878 - DNA, 23 bp, Artificial Sequence
  Description of Artificial Sequence: Synthetic oligonucleotide
gtccttccacgcactcctggccg

SEQ ID NO: 352879 - DNA, 24 bp, Artificial Sequence
  Description of Artificial Sequence: Synthetic oligonucleotide
tccttccacgcactcctggccgct

SEQ ID NO: 352880 - DNA, 23 bp, Artificial Sequence
  Description of Artificial Sequence: Synthetic oligonucleotide
ccttccacgcactcctggccgct

SEQ ID NO: 352881 - DNA, 24 bp, Artificial Sequence
  Description of Artificial Sequence: Synthetic oligonucleotide
cttccacgcactcctggccgctgt

SEQ ID NO: 352882 - DNA, 24 bp, Artificial Sequence
  Description of Artificial Sequence: Synthetic oligonucleotide
ttccacgcactcctggccgctgtg

SEQ ID NO: 352883 - DNA, 23 bp, Artificial Sequence
  Description of Artificial Sequence: Synthetic oligonucleotide
tccacgcactcctggccgctgtg

SEQ ID NO: 352884 - DNA, 22 bp, Artificial Sequence
  Description of Artificial Sequence: Synthetic oligonucleotide
ccacgcactcctggccgctgtg

SEQ ID NO: 352885 - DNA, 24 bp, Artificial Sequence
  Description of Artificial Sequence: Synthetic oligonucleotide
cacgcactcctggccgctgtggat

SEQ ID NO: 352886 - DNA, 24 bp, Artificial Sequence
  Description of Artificial Sequence: Synthetic oligonucleotide
acgcactcctggccgctgtggatg

SEQ ID NO: 352887 - DNA, 23 bp, Artificial Sequence
  Description of Artificial Sequence: Synthetic oligonucleotide
cgcactcctggccgctgtggatg

SEQ ID NO: 352888 - DNA, 23 bp, Artificial Sequence
  Description of Artificial Sequence: Synthetic oligonucleotide
gcactcctggccgctgtggatgc

SEQ ID NO: 352889 - DNA, 23 bp, Artificial Sequence
  Description of Artificial Sequence: Synthetic oligonucleotide
cactcctggccgctgtggatgcg

SEQ ID NO: 352890 - DNA, 23 bp, Artificial Sequence
  Description of Artificial Sequence: Synthetic oligonucleotide
actcctggccgctgtggatgcgg

SEQ ID NO: 352891 - DNA, 22 bp, Artificial Sequence
  Description of Artificial Sequence: Synthetic oligonucleotide
ctcctggccgctgtggatgcgg

SEQ ID NO: 352892 - DNA, 23 bp, Artificial Sequence
  Description of Artificial Sequence: Synthetic oligonucleotide
tcctggccgctgtggatgcgggt

SEQ ID NO: 352893 - DNA, 22 bp, Artificial Sequence
  Description of Artificial Sequence: Synthetic oligonucleotide
cctggccgctgtggatgcgggt

SEQ ID NO: 352894 - DNA, 22 bp, Artificial Sequence
  Description of Artificial Sequence: Synthetic oligonucleotide
ctggccgctgtggatgcgggtg

SEQ ID NO: 352895 - DNA, 22 bp, Artificial Sequence
  Description of Artificial Sequence: Synthetic oligonucleotide
tggccgctgtggatgcgggtgc

SEQ ID NO: 352896 - DNA, 21 bp, Artificial Sequence
  Description of Artificial Sequence: Synthetic oligonucleotide
ggccgctgtggatgcgggtgc

SEQ ID NO: 352897 - DNA, 21 bp, Artificial Sequence
  Description of Artificial Sequence: Synthetic oligonucleotide
gccgctgtggatgcgggtgcc

SEQ ID NO: 352898 - DNA, 21 bp, Artificial Sequence
  Description of Artificial Sequence: Synthetic oligonucleotide
ccgctgtggatgcgggtgccc

SEQ ID NO: 352899 - DNA, 22 bp, Artificial Sequence
  Description of Artificial Sequence: Synthetic oligonucleotide
cgctgtggatgcgggtgcccct

SEQ ID NO: 352900 - DNA, 22 bp, Artificial Sequence
  Description of Artificial Sequence: Synthetic oligonucleotide
gctgtggatgcgggtgcccctc

SEQ ID NO: 352901 - DNA, 22 bp, Artificial Sequence
  Description of Artificial Sequence: Synthetic oligonucleotide
ctgtggatgcgggtgcccctcg

SEQ ID NO: 352902 - DNA, 22 bp, Artificial Sequence
  Description of Artificial Sequence: Synthetic oligonucleotide
tgtggatgcgggtgcccctcgg

SEQ ID NO: 352903 - DNA, 21 bp, Artificial Sequence
  Description of Artificial Sequence: Synthetic oligonucleotide
gtggatgcgggtgcccctcgg

SEQ ID NO: 352904 - DNA, 23 bp, Artificial Sequence
  Description of Artificial Sequence: Synthetic oligonucleotide
tggatgcgggtgcccctcggcta

SEQ ID NO: 352905 - DNA, 22 bp, Artificial Sequence
  Description of Artificial Sequence: Synthetic oligonucleotide
ggatgcgggtgcccctcggcta

SEQ ID NO: 352906 - DNA, 22 bp, Artificial Sequence
  Description of Artificial Sequence: Synthetic oligonucleotide
gatgcgggtgcccctcggctac

SEQ ID NO: 352907 - DNA, 23 bp, Artificial Sequence
  Description of Artificial Sequence: Synthetic oligonucleotide
atgcgggtgcccctcggctacga

SEQ ID NO: 352908 - DNA, 22 bp, Artificial Sequence
  Description of Artificial Sequence: Synthetic oligonucleotide
tgcgggtgcccctcggctacga

SEQ ID NO: 352909 - DNA, 21 bp, Artificial Sequence
  Description of Artificial Sequence: Synthetic oligonucleotide
gcgggtgcccctcggctacga

SEQ ID NO: 352910 - DNA, 23 bp, Artificial Sequence
  Description of Artificial Sequence: Synthetic oligonucleotide
cgggtgcccctcggctacgacat

SEQ ID NO: 352911 - DNA, 23 bp, Artificial Sequence
  Description of Artificial Sequence: Synthetic oligonucleotide
gggtgcccctcggctacgacatc

SEQ ID NO: 352912 - DNA, 24 bp, Artificial Sequence
  Description of Artificial Sequence: Synthetic oligonucleotide
ggtgcccctcggctacgacatcga

SEQ ID NO: 352913 - DNA, 26 bp, Artificial Sequence
  Description of Artificial Sequence: Synthetic oligonucleotide
gtgcccctcggctacgacatcgagtt

SEQ ID NO: 352914 - DNA, 27 bp, Artificial Sequence
  Description of Artificial Sequence: Synthetic oligonucleotide
tgcccctcggctacgacatcgagttct

SEQ ID NO: 352915 - DNA, 27 bp, Artificial Sequence
  Description of Artificial Sequence: Synthetic oligonucleotide
gcccctcggctacgacatcgagttctt

SEQ ID NO: 352916 - DNA, 27 bp, Artificial Sequence
  Description of Artificial Sequence: Synthetic oligonucleotide
cccctcggctacgacatcgagttcttc

SEQ ID NO: 352917 - DNA, 30 bp, Artificial Sequence
  Description of Artificial Sequence: Synthetic oligonucleotide
ccctcggctacgacatcgagttcttctttg

SEQ ID NO: 352918 - DNA, 30 bp, Artificial Sequence
  Description of Artificial Sequence: Synthetic oligonucleotide
cctcggctacgacatcgagttcttctttgg

SEQ ID NO: 352919 - DNA, 30 bp, Artificial Sequence
  Description of Artificial Sequence: Synthetic oligonucleotide
ctcggctacgacatcgagttcttctttggg

SEQ ID NO: 352920 - DNA, 32 bp, Artificial Sequence
  Description of Artificial Sequence: Synthetic oligonucleotide
tcggctacgacatcgagttcttctttgggaac

SEQ ID NO: 352921 - DNA, 31 bp, Artificial Sequence
  Description of Artificial Sequence: Synthetic oligonucleotide
cggctacgacatcgagttcttctttgggaac

SEQ ID NO: 352922 - DNA, 31 bp, Artificial Sequence
  Description of Artificial Sequence: Synthetic oligonucleotide
ggctacgacatcgagttcttctttgggaacc

SEQ ID NO: 352923 - DNA, 31 bp, Artificial Sequence
  Description of Artificial Sequence: Synthetic oligonucleotide
gctacgacatcgagttcttctttgggaaccc

SEQ ID NO: 352924 - DNA, 31 bp, Artificial Sequence
  Description of Artificial Sequence: Synthetic oligonucleotide
ctacgacatcgagttcttctttgggaacccc

SEQ ID NO: 352925 - DNA, 31 bp, Artificial Sequence
  Description of Artificial Sequence: Synthetic oligonucleotide
tacgacatcgagttcttctttgggaaccccc

SEQ ID NO: 352926 - DNA, 30 bp, Artificial Sequence
  Description of Artificial Sequence: Synthetic oligonucleotide
acgacatcgagttcttctttgggaaccccc

SEQ ID NO: 352927 - DNA, 29 bp, Artificial Sequence
  Description of Artificial Sequence: Synthetic oligonucleotide
cgacatcgagttcttctttgggaaccccc

SEQ ID NO: 352928 - DNA, 30 bp, Artificial Sequence
  Description of Artificial Sequence: Synthetic oligonucleotide
gacatcgagttcttctttgggaaccccctg

SEQ ID NO: 352929 - DNA, 30 bp, Artificial Sequence
  Description of Artificial Sequence: Synthetic oligonucleotide
acatcgagttcttctttgggaaccccctgg

SEQ ID NO: 352930 - DNA, 29 bp, Artificial Sequence
  Description of Artificial Sequence: Synthetic oligonucleotide
catcgagttcttctttgggaaccccctgg

SEQ ID NO: 352931 - DNA, 30 bp, Artificial Sequence
  Description of Artificial Sequence: Synthetic oligonucleotide
atcgagttcttctttgggaaccccctggag

SEQ ID NO: 352932 - DNA, 29 bp, Artificial Sequence
  Description of Artificial Sequence: Synthetic oligonucleotide
tcgagttcttctttgggaaccccctggag

SEQ ID NO: 352933 - DNA, 28 bp, Artificial Sequence
  Description of Artificial Sequence: Synthetic oligonucleotide
cgagttcttctttgggaaccccctggag

SEQ ID NO: 352934 - DNA, 28 bp, Artificial Sequence
  Description of Artificial Sequence: Synthetic oligonucleotide
gagttcttctttgggaaccccctggagc

SEQ ID NO: 352935 - DNA, 28 bp, Artificial Sequence
  Description of Artificial Sequence: Synthetic oligonucleotide
agttcttctttgggaaccccctggagcc

SEQ ID NO: 352936 - DNA, 27 bp, Artificial Sequence
  Description of Artificial Sequence: Synthetic oligonucleotide
gttcttctttgggaaccccctggagcc

SEQ ID NO: 352937 - DNA, 27 bp, Artificial Sequence
  Description of Artificial Sequence: Synthetic oligonucleotide
ttcttctttgggaaccccctggagccc

SEQ ID NO: 352938 - DNA, 27 bp, Artificial Sequence
  Description of Artificial Sequence: Synthetic oligonucleotide
tcttctttgggaaccccctggagccct

SEQ ID NO: 352939 - DNA, 26 bp, Artificial Sequence
  Description of Artificial Sequence: Synthetic oligonucleotide
cttctttgggaaccccctggagccct

SEQ ID NO: 352940 - DNA, 27 bp, Artificial Sequence
  Description of Artificial Sequence: Synthetic oligonucleotide
ttctttgggaaccccctggagccctct

SEQ ID NO: 352941 - DNA, 26 bp, Artificial Sequence
  Description of Artificial Sequence: Synthetic oligonucleotide
tctttgggaaccccctggagccctct

SEQ ID NO: 352942 - DNA, 25 bp, Artificial Sequence
  Description of Artificial Sequence: Synthetic oligonucleotide
ctttgggaaccccctggagccctct

SEQ ID NO: 352943 - DNA, 25 bp, Artificial Sequence
  Description of Artificial Sequence: Synthetic oligonucleotide
tttgggaaccccctggagccctctc

SEQ ID NO: 352944 - DNA, 24 bp, Artificial Sequence
  Description of Artificial Sequence: Synthetic oligonucleotide
ttgggaaccccctggagccctctc

SEQ ID NO: 352945 - DNA, 23 bp, Artificial Sequence
  Description of Artificial Sequence: Synthetic oligonucleotide
tgggaaccccctggagccctctc

SEQ ID NO: 352946 - DNA, 22 bp, Artificial Sequence
  Description of Artificial Sequence: Synthetic oligonucleotide
gggaaccccctggagccctctc

SEQ ID NO: 352947 - DNA, 25 bp, Artificial Sequence
  Description of Artificial Sequence: Synthetic oligonucleotide
ggaaccccctggagccctctcgata

SEQ ID NO: 352948 - DNA, 27 bp, Artificial Sequence
  Description of Artificial Sequence: Synthetic oligonucleotide
gaaccccctggagccctctcgatacta

SEQ ID NO: 352949 - DNA, 27 bp, Artificial Sequence
  Description of Artificial Sequence: Synthetic oligonucleotide
aaccccctggagccctctcgatactac

SEQ ID NO: 352950 - DNA, 27 bp, Artificial Sequence
  Description of Artificial Sequence: Synthetic oligonucleotide
accccctggagccctctcgatactaca

SEQ ID NO: 352951 - DNA, 26 bp, Artificial Sequence
  Description of Artificial Sequence: Synthetic oligonucleotide
ccccctggagccctctcgatactaca

SEQ ID NO: 352952 - DNA, 26 bp, Artificial Sequence
  Description of Artificial Sequence: Synthetic oligonucleotide
cccctggagccctctcgatactacac

SEQ ID NO: 352953 - DNA, 26 bp, Artificial Sequence
  Description of Artificial Sequence: Synthetic oligonucleotide
ccctggagccctctcgatactacacg

SEQ ID NO: 352954 - DNA, 26 bp, Artificial Sequence
  Description of Artificial Sequence: Synthetic oligonucleotide
cctggagccctctcgatactacacgg

SEQ ID NO: 352955 - DNA, 27 bp, Artificial Sequence
  Description of Artificial Sequence: Synthetic oligonucleotide
ctggagccctctcgatactacacggga

SEQ ID NO: 352956 - DNA, 27 bp, Artificial Sequence
  Description of Artificial Sequence: Synthetic oligonucleotide
tggagccctctcgatactacacgggag

SEQ ID NO: 352957 - DNA, 27 bp, Artificial Sequence
  Description of Artificial Sequence: Synthetic oligonucleotide
ggagccctctcgatactacacgggaga

SEQ ID NO: 352958 - DNA, 27 bp, Artificial Sequence
  Description of Artificial Sequence: Synthetic oligonucleotide
gagccctctcgatactacacgggagag

SEQ ID NO: 352959 - DNA, 27 bp, Artificial Sequence
  Description of Artificial Sequence: Synthetic oligonucleotide
agccctctcgatactacacgggagagg

SEQ ID NO: 352960 - DNA, 27 bp, Artificial Sequence
  Description of Artificial Sequence: Synthetic oligonucleotide
gccctctcgatactacacgggagagga

SEQ ID NO: 352961 - DNA, 27 bp, Artificial Sequence
  Description of Artificial Sequence: Synthetic oligonucleotide
ccctctcgatactacacgggagaggag

SEQ ID NO: 352962 - DNA, 32 bp, Artificial Sequence
  Description of Artificial Sequence: Synthetic oligonucleotide
cctctcgatactacacgggagaggagaatatc

SEQ ID NO: 352963 - DNA, 34 bp, Artificial Sequence
  Description of Artificial Sequence: Synthetic oligonucleotide
ctctcgatactacacgggagaggagaatatcttc

SEQ ID NO: 352964 - DNA, 34 bp, Artificial Sequence
  Description of Artificial Sequence: Synthetic oligonucleotide
tctcgatactacacgggagaggagaatatcttcg

SEQ ID NO: 352965 - DNA, 33 bp, Artificial Sequence
  Description of Artificial Sequence: Synthetic oligonucleotide
ctcgatactacacgggagaggagaatatcttcg

SEQ ID NO: 352966 - DNA, 33 bp, Artificial Sequence
  Description of Artificial Sequence: Synthetic oligonucleotide
tcgatactacacgggagaggagaatatcttcgc

SEQ ID NO: 352967 - DNA, 32 bp, Artificial Sequence
  Description of Artificial Sequence: Synthetic oligonucleotide
cgatactacacgggagaggagaatatcttcgc

SEQ ID NO: 352968 - DNA, 32 bp, Artificial Sequence
  Description of Artificial Sequence: Synthetic oligonucleotide
gatactacacgggagaggagaatatcttcgcc

SEQ ID NO: 352969 - DNA, 32 bp, Artificial Sequence
  Description of Artificial Sequence: Synthetic oligonucleotide
atactacacgggagaggagaatatcttcgccg

SEQ ID NO: 352970 - DNA, 31 bp, Artificial Sequence
  Description of Artificial Sequence: Synthetic oligonucleotide
tactacacgggagaggagaatatcttcgccg

SEQ ID NO: 352971 - DNA, 30 bp, Artificial Sequence
  Description of Artificial Sequence: Synthetic oligonucleotide
actacacgggagaggagaatatcttcgccg

SEQ ID NO: 352972 - DNA, 29 bp, Artificial Sequence
  Description of Artificial Sequence: Synthetic oligonucleotide
ctacacgggagaggagaatatcttcgccg

SEQ ID NO: 352973 - DNA, 30 bp, Artificial Sequence
  Description of Artificial Sequence: Synthetic oligonucleotide
tacacgggagaggagaatatcttcgccgag

SEQ ID NO: 352974 - DNA, 29 bp, Artificial Sequence
  Description of Artificial Sequence: Synthetic oligonucleotide
acacgggagaggagaatatcttcgccgag

SEQ ID NO: 352975 - DNA, 28 bp, Artificial Sequence
  Description of Artificial Sequence: Synthetic oligonucleotide
cacgggagaggagaatatcttcgccgag

SEQ ID NO: 352976 - DNA, 28 bp, Artificial Sequence
  Description of Artificial Sequence: Synthetic oligonucleotide
acgggagaggagaatatcttcgccgagc

SEQ ID NO: 352977 - DNA, 27 bp, Artificial Sequence
  Description of Artificial Sequence: Synthetic oligonucleotide
cgggagaggagaatatcttcgccgagc

SEQ ID NO: 352978 - DNA, 27 bp, Artificial Sequence
  Description of Artificial Sequence: Synthetic oligonucleotide
gggagaggagaatatcttcgccgagcg

SEQ ID NO: 352979 - DNA, 28 bp, Artificial Sequence
  Description of Artificial Sequence: Synthetic oligonucleotide
ggagaggagaatatcttcgccgagcgac

SEQ ID NO: 352980 - DNA, 29 bp, Artificial Sequence
  Description of Artificial Sequence: Synthetic oligonucleotide
gagaggagaatatcttcgccgagcgactg

SEQ ID NO: 352981 - DNA, 31 bp, Artificial Sequence
  Description of Artificial Sequence: Synthetic oligonucleotide
agaggagaatatcttcgccgagcgactgaag

SEQ ID NO: 352982 - DNA, 30 bp, Artificial Sequence
  Description of Artificial Sequence: Synthetic oligonucleotide
gaggagaatatcttcgccgagcgactgaag

SEQ ID NO: 352983 - DNA, 30 bp, Artificial Sequence
  Description of Artificial Sequence: Synthetic oligonucleotide
aggagaatatcttcgccgagcgactgaagc

SEQ ID NO: 352984 - DNA, 29 bp, Artificial Sequence
  Description of Artificial Sequence: Synthetic oligonucleotide
ggagaatatcttcgccgagcgactgaagc

SEQ ID NO: 352985 - DNA, 29 bp, Artificial Sequence
  Description of Artificial Sequence: Synthetic oligonucleotide
gagaatatcttcgccgagcgactgaagcg

SEQ ID NO: 352986 - DNA, 32 bp, Artificial Sequence
  Description of Artificial Sequence: Synthetic oligonucleotide
agaatatcttcgccgagcgactgaagcgatac

SEQ ID NO: 352987 - DNA, 31 bp, Artificial Sequence
  Description of Artificial Sequence: Synthetic oligonucleotide
gaatatcttcgccgagcgactgaagcgatac

SEQ ID NO: 352988 - DNA, 32 bp, Artificial Sequence
  Description of Artificial Sequence: Synthetic oligonucleotide
aatatcttcgccgagcgactgaagcgatactg

SEQ ID NO: 352989 - DNA, 31 bp, Artificial Sequence
  Description of Artificial Sequence: Synthetic oligonucleotide
atatcttcgccgagcgactgaagcgatactg

SEQ ID NO: 352990 - DNA, 30 bp, Artificial Sequence
  Description of Artificial Sequence: Synthetic oligonucleotide
tatcttcgccgagcgactgaagcgatactg

SEQ ID NO: 352991 - DNA, 29 bp, Artificial Sequence
  Description of Artificial Sequence: Synthetic oligonucleotide
atcttcgccgagcgactgaagcgatactg

SEQ ID NO: 352992 - DNA, 28 bp, Artificial Sequence
  Description of Artificial Sequence: Synthetic oligonucleotide
tcttcgccgagcgactgaagcgatactg

SEQ ID NO: 352993 - DNA, 27 bp, Artificial Sequence
  Description of Artificial Sequence: Synthetic oligonucleotide
cttcgccgagcgactgaagcgatactg

SEQ ID NO: 352994 - DNA, 27 bp, Artificial Sequence
  Description of Artificial Sequence: Synthetic oligonucleotide
ttcgccgagcgactgaagcgatactgc

SEQ ID NO: 352995 - DNA, 26 bp, Artificial Sequence
  Description of Artificial Sequence: Synthetic oligonucleotide
tcgccgagcgactgaagcgatactgc

SEQ ID NO: 352996 - DNA, 25 bp, Artificial Sequence
  Description of Artificial Sequence: Synthetic oligonucleotide
cgccgagcgactgaagcgatactgc

SEQ ID NO: 352997 - DNA, 25 bp, Artificial Sequence
  Description of Artificial Sequence: Synthetic oligonucleotide
gccgagcgactgaagcgatactgcg

SEQ ID NO: 352998 - DNA, 25 bp, Artificial Sequence
  Description of Artificial Sequence: Synthetic oligonucleotide
ccgagcgactgaagcgatactgcgc

SEQ ID NO: 352999 - DNA, 27 bp, Artificial Sequence
  Description of Artificial Sequence: Synthetic oligonucleotide
cgagcgactgaagcgatactgcgccaa

SEQ ID NO: 353000 - DNA, 27 bp, Artificial Sequence
  Description of Artificial Sequence: Synthetic oligonucleotide
gagcgactgaagcgatactgcgccaac

SEQ ID NO: 353001 - DNA, 30 bp, Artificial Sequence
  Description of Artificial Sequence: Synthetic oligonucleotide
agcgactgaagcgatactgcgccaactttc

SEQ ID NO: 353002 - DNA, 29 bp, Artificial Sequence
  Description of Artificial Sequence: Synthetic oligonucleotide
gcgactgaagcgatactgcgccaactttc

SEQ ID NO: 353003 - DNA, 29 bp, Artificial Sequence
  Description of Artificial Sequence: Synthetic oligonucleotide
cgactgaagcgatactgcgccaactttcc

SEQ ID NO: 353004 - DNA, 29 bp, Artificial Sequence
  Description of Artificial Sequence: Synthetic oligonucleotide
gactgaagcgatactgcgccaactttccc

SEQ ID NO: 353005 - DNA, 29 bp, Artificial Sequence
  Description of Artificial Sequence: Synthetic oligonucleotide
actgaagcgatactgcgccaactttcccc

SEQ ID NO: 353006 - DNA, 28 bp, Artificial Sequence
  Description of Artificial Sequence: Synthetic oligonucleotide
ctgaagcgatactgcgccaactttcccc

SEQ ID NO: 353007 - DNA, 28 bp, Artificial Sequence
  Description of Artificial Sequence: Synthetic oligonucleotide
tgaagcgatactgcgccaactttccccg

SEQ ID NO: 353008 - DNA, 27 bp, Artificial Sequence
  Description of Artificial Sequence: Synthetic oligonucleotide
gaagcgatactgcgccaactttccccg

SEQ ID NO: 353009 - DNA, 27 bp, Artificial Sequence
  Description of Artificial Sequence: Synthetic oligonucleotide
aagcgatactgcgccaactttccccgc

SEQ ID NO: 353010 - DNA, 27 bp, Artificial Sequence
  Description of Artificial Sequence: Synthetic oligonucleotide
agcgatactgcgccaactttccccgca

SEQ ID NO: 353011 - DNA, 26 bp, Artificial Sequence
  Description of Artificial Sequence: Synthetic oligonucleotide
gcgatactgcgccaactttccccgca

SEQ ID NO: 353012 - DNA, 27 bp, Artificial Sequence
  Description of Artificial Sequence: Synthetic oligonucleotide
cgatactgcgccaactttccccgcaca

SEQ ID NO: 353013 - DNA, 27 bp, Artificial Sequence
  Description of Artificial Sequence: Synthetic oligonucleotide
gatactgcgccaactttccccgcacag

SEQ ID NO: 353014 - DNA, 27 bp, Artificial Sequence
  Description of Artificial Sequence: Synthetic oligonucleotide
atactgcgccaactttccccgcacagc

SEQ ID NO: 353015 - DNA, 26 bp, Artificial Sequence
  Description of Artificial Sequence: Synthetic oligonucleotide
tactgcgccaactttccccgcacagc

SEQ ID NO: 353016 - DNA, 25 bp, Artificial Sequence
  Description of Artificial Sequence: Synthetic oligonucleotide
actgcgccaactttccccgcacagc

SEQ ID NO: 353017 - DNA, 24 bp, Artificial Sequence
  Description of Artificial Sequence: Synthetic oligonucleotide
ctgcgccaactttccccgcacagc

SEQ ID NO: 353018 - DNA, 24 bp, Artificial Sequence
  Description of Artificial Sequence: Synthetic oligonucleotide
tgcgccaactttccccgcacagcg

SEQ ID NO: 353019 - DNA, 23 bp, Artificial Sequence
  Description of Artificial Sequence: Synthetic oligonucleotide
gcgccaactttccccgcacagcg

SEQ ID NO: 353020 - DNA, 25 bp, Artificial Sequence
  Description of Artificial Sequence: Synthetic oligonucleotide
cgccaactttccccgcacagcggat

SEQ ID NO: 353021 - DNA, 25 bp, Artificial Sequence
  Description of Artificial Sequence: Synthetic oligonucleotide
gccaactttccccgcacagcggatc

SEQ ID NO: 353022 - DNA, 25 bp, Artificial Sequence
  Description of Artificial Sequence: Synthetic oligonucleotide
ccaactttccccgcacagcggatcc

SEQ ID NO: 353023 - DNA, 27 bp, Artificial Sequence
  Description of Artificial Sequence: Synthetic oligonucleotide
caactttccccgcacagcggatcccaa

SEQ ID NO: 353024 - DNA, 28 bp, Artificial Sequence
  Description of Artificial Sequence: Synthetic oligonucleotide
aactttccccgcacagcggatcccaaag

SEQ ID NO: 353025 - DNA, 27 bp, Artificial Sequence
  Description of Artificial Sequence: Synthetic oligonucleotide
actttccccgcacagcggatcccaaag

SEQ ID NO: 353026 - DNA, 27 bp, Artificial Sequence
  Description of Artificial Sequence: Synthetic oligonucleotide
ctttccccgcacagcggatcccaaaga

SEQ ID NO: 353027 - DNA, 27 bp, Artificial Sequence
  Description of Artificial Sequence: Synthetic oligonucleotide
tttccccgcacagcggatcccaaagag

SEQ ID NO: 353028 - DNA, 26 bp, Artificial Sequence
  Description of Artificial Sequence: Synthetic oligonucleotide
ttccccgcacagcggatcccaaagag

SEQ ID NO: 353029 - DNA, 25 bp, Artificial Sequence
  Description of Artificial Sequence: Synthetic oligonucleotide
tccccgcacagcggatcccaaagag

SEQ ID NO: 353030 - DNA, 24 bp, Artificial Sequence
  Description of Artificial Sequence: Synthetic oligonucleotide
ccccgcacagcggatcccaaagag

SEQ ID NO: 353031 - DNA, 24 bp, Artificial Sequence
  Description of Artificial Sequence: Synthetic oligonucleotide
cccgcacagcggatcccaaagagc

SEQ ID NO: 353032 - DNA, 24 bp, Artificial Sequence
  Description of Artificial Sequence: Synthetic oligonucleotide
ccgcacagcggatcccaaagagcc

SEQ ID NO: 353033 - DNA, 24 bp, Artificial Sequence
  Description of Artificial Sequence: Synthetic oligonucleotide
cgcacagcggatcccaaagagccc

SEQ ID NO: 353034 - DNA, 24 bp, Artificial Sequence
  Description of Artificial Sequence: Synthetic oligonucleotide
gcacagcggatcccaaagagcccc

SEQ ID NO: 353035 - DNA, 25 bp, Artificial Sequence
  Description of Artificial Sequence: Synthetic oligonucleotide
cacagcggatcccaaagagccccga

SEQ ID NO: 353036 - DNA, 26 bp, Artificial Sequence
  Description of Artificial Sequence: Synthetic oligonucleotide
acagcggatcccaaagagccccgaca

SEQ ID NO: 353037 - DNA, 25 bp, Artificial Sequence
  Description of Artificial Sequence: Synthetic oligonucleotide
cagcggatcccaaagagccccgaca

SEQ ID NO: 353038 - DNA, 25 bp, Artificial Sequence
  Description of Artificial Sequence: Synthetic oligonucleotide
agcggatcccaaagagccccgacac

SEQ ID NO: 353039 - DNA, 24 bp, Artificial Sequence
  Description of Artificial Sequence: Synthetic oligonucleotide
gcggatcccaaagagccccgacac

SEQ ID NO: 353040 - DNA, 24 bp, Artificial Sequence
  Description of Artificial Sequence: Synthetic oligonucleotide
cggatcccaaagagccccgacacc

SEQ ID NO: 353041 - DNA, 24 bp, Artificial Sequence
  Description of Artificial Sequence: Synthetic oligonucleotide
ggatcccaaagagccccgacaccc

SEQ ID NO: 353042 - DNA, 26 bp, Artificial Sequence
  Description of Artificial Sequence: Synthetic oligonucleotide
gatcccaaagagccccgacaccccaa

SEQ ID NO: 353043 - DNA, 26 bp, Artificial Sequence
  Description of Artificial Sequence: Synthetic oligonucleotide
atcccaaagagccccgacaccccaag

SEQ ID NO: 353044 - DNA, 25 bp, Artificial Sequence
  Description of Artificial Sequence: Synthetic oligonucleotide
tcccaaagagccccgacaccccaag

SEQ ID NO: 353045 - DNA, 24 bp, Artificial Sequence
  Description of Artificial Sequence: Synthetic oligonucleotide
cccaaagagccccgacaccccaag

SEQ ID NO: 353046 - DNA, 24 bp, Artificial Sequence
  Description of Artificial Sequence: Synthetic oligonucleotide
ccaaagagccccgacaccccaagg

SEQ ID NO: 353047 - DNA, 24 bp, Artificial Sequence
  Description of Artificial Sequence: Synthetic oligonucleotide
caaagagccccgacaccccaaggg

SEQ ID NO: 353048 - DNA, 24 bp, Artificial Sequence
  Description of Artificial Sequence: Synthetic oligonucleotide
aaagagccccgacaccccaagggc

SEQ ID NO: 353049 - DNA, 23 bp, Artificial Sequence
  Description of Artificial Sequence: Synthetic oligonucleotide
aagagccccgacaccccaagggc

SEQ ID NO: 353050 - DNA, 22 bp, Artificial Sequence
  Description of Artificial Sequence: Synthetic oligonucleotide
agagccccgacaccccaagggc

SEQ ID NO: 353051 - DNA, 21 bp, Artificial Sequence
  Description of Artificial Sequence: Synthetic oligonucleotide
gagccccgacaccccaagggc

SEQ ID NO: 353052 - DNA, 21 bp, Artificial Sequence
  Description of Artificial Sequence: Synthetic oligonucleotide
agccccgacaccccaagggcc

SEQ ID NO: 353053 - DNA, 20 bp, Artificial Sequence
  Description of Artificial Sequence: Synthetic oligonucleotide
gccccgacaccccaagggcc

SEQ ID NO: 353054 - DNA, 21 bp, Artificial Sequence
  Description of Artificial Sequence: Synthetic oligonucleotide
ccccgacaccccaagggccca

SEQ ID NO: 353055 - DNA, 24 bp, Artificial Sequence
  Description of Artificial Sequence: Synthetic oligonucleotide
cccgacaccccaagggcccacaat

SEQ ID NO: 353056 - DNA, 24 bp, Artificial Sequence
  Description of Artificial Sequence: Synthetic oligonucleotide
ccgacaccccaagggcccacaatg

SEQ ID NO: 353057 - DNA, 24 bp, Artificial Sequence
  Description of Artificial Sequence: Synthetic oligonucleotide
cgacaccccaagggcccacaatgc

SEQ ID NO: 353058 - DNA, 24 bp, Artificial Sequence
  Description of Artificial Sequence: Synthetic oligonucleotide
gacaccccaagggcccacaatgcc

SEQ ID NO: 353059 - DNA, 24 bp, Artificial Sequence
  Description of Artificial Sequence: Synthetic oligonucleotide
acaccccaagggcccacaatgccc

SEQ ID NO: 353060 - DNA, 23 bp, Artificial Sequence
  Description of Artificial Sequence: Synthetic oligonucleotide
caccccaagggcccacaatgccc

SEQ ID NO: 353061 - DNA, 23 bp, Artificial Sequence
  Description of Artificial Sequence: Synthetic oligonucleotide
accccaagggcccacaatgcccc

SEQ ID NO: 353062 - DNA, 22 bp, Artificial Sequence
  Description of Artificial Sequence: Synthetic oligonucleotide
ccccaagggcccacaatgcccc

SEQ ID NO: 353063 - DNA, 22 bp, Artificial Sequence
  Description of Artificial Sequence: Synthetic oligonucleotide
cccaagggcccacaatgccccc

SEQ ID NO: 353064 - DNA, 22 bp, Artificial Sequence
  Description of Artificial Sequence: Synthetic oligonucleotide
ccaagggcccacaatgcccccc

SEQ ID NO: 353065 - DNA, 24 bp, Artificial Sequence
  Description of Artificial Sequence: Synthetic oligonucleotide
caagggcccacaatgccccccgta

SEQ ID NO: 353066 - DNA, 25 bp, Artificial Sequence
  Description of Artificial Sequence: Synthetic oligonucleotide
aagggcccacaatgccccccgtact

SEQ ID NO: 353067 - DNA, 24 bp, Artificial Sequence
  Description of Artificial Sequence: Synthetic oligonucleotide
agggcccacaatgccccccgtact

SEQ ID NO: 353068 - DNA, 23 bp, Artificial Sequence
  Description of Artificial Sequence: Synthetic oligonucleotide
gggcccacaatgccccccgtact

SEQ ID NO: 353069 - DNA, 23 bp, Artificial Sequence
  Description of Artificial Sequence: Synthetic oligonucleotide
ggcccacaatgccccccgtactc

SEQ ID NO: 353070 - DNA, 23 bp, Artificial Sequence
  Description of Artificial Sequence: Synthetic oligonucleotide
gcccacaatgccccccgtactcg

SEQ ID NO: 353071 - DNA, 23 bp, Artificial Sequence
  Description of Artificial Sequence: Synthetic oligonucleotide
cccacaatgccccccgtactcgg

SEQ ID NO: 353072 - DNA, 23 bp, Artificial Sequence
  Description of Artificial Sequence: Synthetic oligonucleotide
ccacaatgccccccgtactcggc

SEQ ID NO: 353073 - DNA, 23 bp, Artificial Sequence
  Description of Artificial Sequence: Synthetic oligonucleotide
cacaatgccccccgtactcggcg

SEQ ID NO: 353074 - DNA, 23 bp, Artificial Sequence
  Description of Artificial Sequence: Synthetic oligonucleotide
acaatgccccccgtactcggcgg

SEQ ID NO: 353075 - DNA, 22 bp, Artificial Sequence
  Description of Artificial Sequence: Synthetic oligonucleotide
caatgccccccgtactcggcgg

SEQ ID NO: 353076 - DNA, 22 bp, Artificial Sequence
  Description of Artificial Sequence: Synthetic oligonucleotide
aatgccccccgtactcggcggg

SEQ ID NO: 353077 - DNA, 21 bp, Artificial Sequence
  Description of Artificial Sequence: Synthetic oligonucleotide
atgccccccgtactcggcggg

SEQ ID NO: 353078 - DNA, 20 bp, Artificial Sequence
  Description of Artificial Sequence: Synthetic oligonucleotide
tgccccccgtactcggcggg

SEQ ID NO: 353079 - DNA, 20 bp, Artificial Sequence
  Description of Artificial Sequence: Synthetic oligonucleotide
gccccccgtactcggcgggt

SEQ ID NO: 353080 - DNA, 20 bp, Artificial Sequence
  Description of Artificial Sequence: Synthetic oligonucleotide
ccccccgtactcggcggggt

SEQ ID NO: 353081 - DNA, 20 bp, Artificial Sequence
  Description of Artificial Sequence: Synthetic oligonucleotide
cccccgtactcggcgggggt

SEQ ID NO: 353082 - DNA, 20 bp, Artificial Sequence
  Description of Artificial Sequence: Synthetic oligonucleotide
ccccgtactcggcggggggt

SEQ ID NO: 353083 - DNA, 21 bp, Artificial Sequence
  Description of Artificial Sequence: Synthetic oligonucleotide
cccgtactcggcggggggtca

SEQ ID NO: 353084 - DNA, 21 bp, Artificial Sequence
  Description of Artificial Sequence: Synthetic oligonucleotide
ccgtactcggcggggggtcag

SEQ ID NO: 353085 - DNA, 22 bp, Artificial Sequence
  Description of Artificial Sequence: Synthetic oligonucleotide
cgtactcggcggggggtcagca

SEQ ID NO: 353086 - DNA, 24 bp, Artificial Sequence
  Description of Artificial Sequence: Synthetic oligonucleotide
gtactcggcggggggtcagcagta

SEQ ID NO: 353087 - DNA, 24 bp, Artificial Sequence
  Description of Artificial Sequence: Synthetic oligonucleotide
tactcggcggggggtcagcagtag

SEQ ID NO: 353088 - DNA, 23 bp, Artificial Sequence
  Description of Artificial Sequence: Synthetic oligonucleotide
actcggcggggggtcagcagtag

SEQ ID NO: 353089 - DNA, 22 bp, Artificial Sequence
  Description of Artificial Sequence: Synthetic oligonucleotide
ctcggcggggggtcagcagtag

SEQ ID NO: 353090 - DNA, 25 bp, Artificial Sequence
  Description of Artificial Sequence: Synthetic oligonucleotide
tcggcggggggtcagcagtaggtta

SEQ ID NO: 353091 - DNA, 24 bp, Artificial Sequence
  Description of Artificial Sequence: Synthetic oligonucleotide
cggcggggggtcagcagtaggtta

SEQ ID NO: 353092 - DNA, 25 bp, Artificial Sequence
  Description of Artificial Sequence: Synthetic oligonucleotide
ggcggggggtcagcagtaggttagt

SEQ ID NO: 353093 - DNA, 26 bp, Artificial Sequence
  Description of Artificial Sequence: Synthetic oligonucleotide
gcggggggtcagcagtaggttagtct

SEQ ID NO: 353094 - DNA, 26 bp, Artificial Sequence
  Description of Artificial Sequence: Synthetic oligonucleotide
cggggggtcagcagtaggttagtctg

SEQ ID NO: 353095 - DNA, 27 bp, Artificial Sequence
  Description of Artificial Sequence: Synthetic oligonucleotide
ggggggtcagcagtaggttagtctgca

SEQ ID NO: 353096 - DNA, 27 bp, Artificial Sequence
  Description of Artificial Sequence: Synthetic oligonucleotide
gggggtcagcagtaggttagtctgcac

SEQ ID NO: 353097 - DNA, 27 bp, Artificial Sequence
  Description of Artificial Sequence: Synthetic oligonucleotide
ggggtcagcagtaggttagtctgcacc

SEQ ID NO: 353098 - DNA, 28 bp, Artificial Sequence
  Description of Artificial Sequence: Synthetic oligonucleotide
gggtcagcagtaggttagtctgcacctg

SEQ ID NO: 353099 - DNA, 28 bp, Artificial Sequence
  Description of Artificial Sequence: Synthetic oligonucleotide
ggtcagcagtaggttagtctgcacctgc

SEQ ID NO: 353100 - DNA, 28 bp, Artificial Sequence
  Description of Artificial Sequence: Synthetic oligonucleotide
gtcagcagtaggttagtctgcacctgcg

SEQ ID NO: 353101 - DNA, 28 bp, Artificial Sequence
  Description of Artificial Sequence: Synthetic oligonucleotide
tcagcagtaggttagtctgcacctgcgg

SEQ ID NO: 353102 - DNA, 27 bp, Artificial Sequence
  Description of Artificial Sequence: Synthetic oligonucleotide
cagcagtaggttagtctgcacctgcgg

SEQ ID NO: 353103 - DNA, 27 bp, Artificial Sequence
  Description of Artificial Sequence: Synthetic oligonucleotide
agcagtaggttagtctgcacctgcggc

SEQ ID NO: 353104 - DNA, 26 bp, Artificial Sequence
  Description of Artificial Sequence: Synthetic oligonucleotide
gcagtaggttagtctgcacctgcggc

SEQ ID NO: 353105 - DNA, 26 bp, Artificial Sequence
  Description of Artificial Sequence: Synthetic oligonucleotide
cagtaggttagtctgcacctgcggcg

SEQ ID NO: 353106 - DNA, 26 bp, Artificial Sequence
  Description of Artificial Sequence: Synthetic oligonucleotide
agtaggttagtctgcacctgcggcgg

SEQ ID NO: 353107 - DNA, 25 bp, Artificial Sequence
  Description of Artificial Sequence: Synthetic oligonucleotide
gtaggttagtctgcacctgcggcgg

SEQ ID NO: 353108 - DNA, 26 bp, Artificial Sequence
  Description of Artificial Sequence: Synthetic oligonucleotide
taggttagtctgcacctgcggcggct

SEQ ID NO: 353109 - DNA, 25 bp, Artificial Sequence
  Description of Artificial Sequence: Synthetic oligonucleotide
aggttagtctgcacctgcggcggct

SEQ ID NO: 353110 - DNA, 24 bp, Artificial Sequence
  Description of Artificial Sequence: Synthetic oligonucleotide
ggttagtctgcacctgcggcggct

SEQ ID NO: 353111 - DNA, 24 bp, Artificial Sequence
  Description of Artificial Sequence: Synthetic oligonucleotide
gttagtctgcacctgcggcggctg

SEQ ID NO: 353112 - DNA, 25 bp, Artificial Sequence
  Description of Artificial Sequence: Synthetic oligonucleotide
ttagtctgcacctgcggcggctgga

SEQ ID NO: 353113 - DNA, 24 bp, Artificial Sequence
  Description of Artificial Sequence: Synthetic oligonucleotide
tagtctgcacctgcggcggctgga

SEQ ID NO: 353114 - DNA, 23 bp, Artificial Sequence
  Description of Artificial Sequence: Synthetic oligonucleotide
agtctgcacctgcggcggctgga

SEQ ID NO: 353115 - DNA, 22 bp, Artificial Sequence
  Description of Artificial Sequence: Synthetic oligonucleotide
gtctgcacctgcggcggctgga

SEQ ID NO: 353116 - DNA, 22 bp, Artificial Sequence
  Description of Artificial Sequence: Synthetic oligonucleotide
tctgcacctgcggcggctggag

SEQ ID NO: 353117 - DNA, 21 bp, Artificial Sequence
  Description of Artificial Sequence: Synthetic oligonucleotide
ctgcacctgcggcggctggag

SEQ ID NO: 353118 - DNA, 22 bp, Artificial Sequence
  Description of Artificial Sequence: Synthetic oligonucleotide
tgcacctgcggcggctggaggt

SEQ ID NO: 353119 - DNA, 21 bp, Artificial Sequence
  Description of Artificial Sequence: Synthetic oligonucleotide
gcacctgcggcggctggaggt

SEQ ID NO: 353120 - DNA, 21 bp, Artificial Sequence
  Description of Artificial Sequence: Synthetic oligonucleotide
cacctgcggcggctggaggtc

SEQ ID NO: 353121 - DNA, 21 bp, Artificial Sequence
  Description of Artificial Sequence: Synthetic oligonucleotide
acctgcggcggctggaggtcc

SEQ ID NO: 353122 - DNA, 20 bp, Artificial Sequence
  Description of Artificial Sequence: Synthetic oligonucleotide
cctgcggcggctggaggtcc

SEQ ID NO: 353123 - DNA, 20 bp, Artificial Sequence
  Description of Artificial Sequence: Synthetic oligonucleotide
ctgcggcggctggaggtccg

SEQ ID NO: 353124 - DNA, 20 bp, Artificial Sequence
  Description of Artificial Sequence: Synthetic oligonucleotide
tgcggcggctggaggtccgg

SEQ ID NO: 353125 - DNA, 20 bp, Artificial Sequence
  Description of Artificial Sequence: Synthetic oligonucleotide
gcggcggctggaggtccggt

SEQ ID NO: 353126 - DNA, 20 bp, Artificial Sequence
  Description of Artificial Sequence: Synthetic oligonucleotide
cggcggctggaggtccggct

SEQ ID NO: 353127 - DNA, 20 bp, Artificial Sequence
  Description of Artificial Sequence: Synthetic oligonucleotide
ggcggctggaggtccggcgt

SEQ ID NO: 353128 - DNA, 20 bp, Artificial Sequence
  Description of Artificial Sequence: Synthetic oligonucleotide
gcggctggaggtccggcggt

SEQ ID NO: 353129 - DNA, 20 bp, Artificial Sequence
  Description of Artificial Sequence: Synthetic oligonucleotide
cggctggaggtccggcgggt

SEQ ID NO: 353130 - DNA, 20 bp, Artificial Sequence
  Description of Artificial Sequence: Synthetic oligonucleotide
ggctggaggtccggcggggt

SEQ ID NO: 353131 - DNA, 20 bp, Artificial Sequence
  Description of Artificial Sequence: Synthetic oligonucleotide
gctggaggtccggcgggggt

SEQ ID NO: 353132 - DNA, 20 bp, Artificial Sequence
  Description of Artificial Sequence: Synthetic oligonucleotide
ctggaggtccggcggggggt

SEQ ID NO: 353133 - DNA, 20 bp, Artificial Sequence
  Description of Artificial Sequence: Synthetic oligonucleotide
tggaggtccggcggggggtg

SEQ ID NO: 353134 - DNA, 20 bp, Artificial Sequence
  Description of Artificial Sequence: Synthetic oligonucleotide
ggaggtccggcggggggtgt

SEQ ID NO: 353135 - DNA, 20 bp, Artificial Sequence
  Description of Artificial Sequence: Synthetic oligonucleotide
gaggtccggcggggggtgct

SEQ ID NO: 353136 - DNA, 20 bp, Artificial Sequence
  Description of Artificial Sequence: Synthetic oligonucleotide
aggtccggcggggggtgcgt

SEQ ID NO: 353137 - DNA, 20 bp, Artificial Sequence
  Description of Artificial Sequence: Synthetic oligonucleotide
ggtccggcggggggtgcgtt

SEQ ID NO: 353138 - DNA, 20 bp, Artificial Sequence
  Description of Artificial Sequence: Synthetic oligonucleotide
gtccggcggggggtgcgctt

SEQ ID NO: 353139 - DNA, 20 bp, Artificial Sequence
  Description of Artificial Sequence: Synthetic oligonucleotide
tccggcggggggtgcgcgtt

SEQ ID NO: 353140 - DNA, 20 bp, Artificial Sequence
  Description of Artificial Sequence: Synthetic oligonucleotide
ccggcggggggtgcgcgttt

SEQ ID NO: 353141 - DNA, 20 bp, Artificial Sequence
  Description of Artificial Sequence: Synthetic oligonucleotide
cggcggggggtgcgcgcttt

SEQ ID NO: 353142 - DNA, 20 bp, Artificial Sequence
  Description of Artificial Sequence: Synthetic oligonucleotide
ggcggggggtgcgcgccttt

SEQ ID NO: 353143 - DNA, 20 bp, Artificial Sequence
  Description of Artificial Sequence: Synthetic oligonucleotide
gcggggggtgcgcgcccttt

SEQ ID NO: 353144 - DNA, 20 bp, Artificial Sequence
  Description of Artificial Sequence: Synthetic oligonucleotide
cggggggtgcgcgccctgtt

SEQ ID NO: 353145 - DNA, 20 bp, Artificial Sequence
  Description of Artificial Sequence: Synthetic oligonucleotide
ggggggtgcgcgccctggtt

SEQ ID NO: 353146 - DNA, 20 bp, Artificial Sequence
  Description of Artificial Sequence: Synthetic oligonucleotide
gggggtgcgcgccctggctt

SEQ ID NO: 353147 - DNA, 20 bp, Artificial Sequence
  Description of Artificial Sequence: Synthetic oligonucleotide
ggggtgcgcgccctggcctt

SEQ ID NO: 353148 - DNA, 20 bp, Artificial Sequence
  Description of Artificial Sequence: Synthetic oligonucleotide
gggtgcgcgccctggcctgt

SEQ ID NO: 353149 - DNA, 20 bp, Artificial Sequence
  Description of Artificial Sequence: Synthetic oligonucleotide
ggtgcgcgccctggcctgct

SEQ ID NO: 353150 - DNA, 20 bp, Artificial Sequence
  Description of Artificial Sequence: Synthetic oligonucleotide
gtgcgcgccctggcctgcgt

SEQ ID NO: 353151 - DNA, 20 bp, Artificial Sequence
  Description of Artificial Sequence: Synthetic oligonucleotide
tgcgcgccctggcctgcgct

SEQ ID NO: 353152 - DNA, 20 bp, Artificial Sequence
  Description of Artificial Sequence: Synthetic oligonucleotide
gcgcgccctggcctgcgctt

SEQ ID NO: 353153 - DNA, 20 bp, Artificial Sequence
  Description of Artificial Sequence: Synthetic oligonucleotide
cgcgccctggcctgcgcgtt

SEQ ID NO: 353154 - DNA, 21 bp, Artificial Sequence
  Description of Artificial Sequence: Synthetic oligonucleotide
gcgccctggcctgcgcgttct

SEQ ID NO: 353155 - DNA, 21 bp, Artificial Sequence
  Description of Artificial Sequence: Synthetic oligonucleotide
cgccctggcctgcgcgttctg

SEQ ID NO: 353156 - DNA, 23 bp, Artificial Sequence
  Description of Artificial Sequence: Synthetic oligonucleotide
gccctggcctgcgcgttctggaa

SEQ ID NO: 353157 - DNA, 23 bp, Artificial Sequence
  Description of Artificial Sequence: Synthetic oligonucleotide
ccctggcctgcgcgttctggaac

SEQ ID NO: 353158 - DNA, 23 bp, Artificial Sequence
  Description of Artificial Sequence: Synthetic oligonucleotide
cctggcctgcgcgttctggaacg

SEQ ID NO: 353159 - DNA, 23 bp, Artificial Sequence
  Description of Artificial Sequence: Synthetic oligonucleotide
ctggcctgcgcgttctggaacgg

SEQ ID NO: 353160 - DNA, 25 bp, Artificial Sequence
  Description of Artificial Sequence: Synthetic oligonucleotide
tggcctgcgcgttctggaacggctt

SEQ ID NO: 353161 - DNA, 24 bp, Artificial Sequence
  Description of Artificial Sequence: Synthetic oligonucleotide
ggcctgcgcgttctggaacggctt

SEQ ID NO: 353162 - DNA, 24 bp, Artificial Sequence
  Description of Artificial Sequence: Synthetic oligonucleotide
gcctgcgcgttctggaacggcttc

SEQ ID NO: 353163 - DNA, 25 bp, Artificial Sequence
  Description of Artificial Sequence: Synthetic oligonucleotide
cctgcgcgttctggaacggcttcct

SEQ ID NO: 353164 - DNA, 25 bp, Artificial Sequence
  Description of Artificial Sequence: Synthetic oligonucleotide
ctgcgcgttctggaacggcttcctc

SEQ ID NO: 353165 - DNA, 25 bp, Artificial Sequence
  Description of Artificial Sequence: Synthetic oligonucleotide
tgcgcgttctggaacggcttcctcc

SEQ ID NO: 353166 - DNA, 24 bp, Artificial Sequence
  Description of Artificial Sequence: Synthetic oligonucleotide
gcgcgttctggaacggcttcctcc

SEQ ID NO: 353167 - DNA, 24 bp, Artificial Sequence
  Description of Artificial Sequence: Synthetic oligonucleotide
cgcgttctggaacggcttcctccg

SEQ ID NO: 353168 - DNA, 27 bp, Artificial Sequence
  Description of Artificial Sequence: Synthetic oligonucleotide
gcgttctggaacggcttcctccgcaaa

SEQ ID NO: 353169 - DNA, 29 bp, Artificial Sequence
  Description of Artificial Sequence: Synthetic oligonucleotide
cgttctggaacggcttcctccgcaaattg

SEQ ID NO: 353170 - DNA, 29 bp, Artificial Sequence
  Description of Artificial Sequence: Synthetic oligonucleotide
gttctggaacggcttcctccgcaaattgc

SEQ ID NO: 353171 - DNA, 30 bp, Artificial Sequence
  Description of Artificial Sequence: Synthetic oligonucleotide
ttctggaacggcttcctccgcaaattgctg

SEQ ID NO: 353172 - DNA, 29 bp, Artificial Sequence
  Description of Artificial Sequence: Synthetic oligonucleotide
tctggaacggcttcctccgcaaattgctg

SEQ ID NO: 353173 - DNA, 28 bp, Artificial Sequence
  Description of Artificial Sequence: Synthetic oligonucleotide
ctggaacggcttcctccgcaaattgctg

SEQ ID NO: 353174 - DNA, 29 bp, Artificial Sequence
  Description of Artificial Sequence: Synthetic oligonucleotide
tggaacggcttcctccgcaaattgctgag

SEQ ID NO: 353175 - DNA, 28 bp, Artificial Sequence
  Description of Artificial Sequence: Synthetic oligonucleotide
ggaacggcttcctccgcaaattgctgag

SEQ ID NO: 353176 - DNA, 28 bp, Artificial Sequence
  Description of Artificial Sequence: Synthetic oligonucleotide
gaacggcttcctccgcaaattgctgagc

SEQ ID NO: 353177 - DNA, 28 bp, Artificial Sequence
  Description of Artificial Sequence: Synthetic oligonucleotide
aacggcttcctccgcaaattgctgagcg

SEQ ID NO: 353178 - DNA, 27 bp, Artificial Sequence
  Description of Artificial Sequence: Synthetic oligonucleotide
acggcttcctccgcaaattgctgagcg

SEQ ID NO: 353179 - DNA, 26 bp, Artificial Sequence
  Description of Artificial Sequence: Synthetic oligonucleotide
cggcttcctccgcaaattgctgagcg

SEQ ID NO: 353180 - DNA, 26 bp, Artificial Sequence
  Description of Artificial Sequence: Synthetic oligonucleotide
ggcttcctccgcaaattgctgagcgc

SEQ ID NO: 353181 - DNA, 27 bp, Artificial Sequence
  Description of Artificial Sequence: Synthetic oligonucleotide
gcttcctccgcaaattgctgagcgcca

SEQ ID NO: 353182 - DNA, 27 bp, Artificial Sequence
  Description of Artificial Sequence: Synthetic oligonucleotide
cttcctccgcaaattgctgagcgccac

SEQ ID NO: 353183 - DNA, 27 bp, Artificial Sequence
  Description of Artificial Sequence: Synthetic oligonucleotide
ttcctccgcaaattgctgagcgccacc

SEQ ID NO: 353184 - DNA, 26 bp, Artificial Sequence
  Description of Artificial Sequence: Synthetic oligonucleotide
tcctccgcaaattgctgagcgccacc

SEQ ID NO: 353185 - DNA, 25 bp, Artificial Sequence
  Description of Artificial Sequence: Synthetic oligonucleotide
cctccgcaaattgctgagcgccacc

SEQ ID NO: 353186 - DNA, 26 bp, Artificial Sequence
  Description of Artificial Sequence: Synthetic oligonucleotide
ctccgcaaattgctgagcgccaccca

SEQ ID NO: 353187 - DNA, 27 bp, Artificial Sequence
  Description of Artificial Sequence: Synthetic oligonucleotide
tccgcaaattgctgagcgccacccaca

SEQ ID NO: 353188 - DNA, 26 bp, Artificial Sequence
  Description of Artificial Sequence: Synthetic oligonucleotide
ccgcaaattgctgagcgccacccaca

SEQ ID NO: 353189 - DNA, 26 bp, Artificial Sequence
  Description of Artificial Sequence: Synthetic oligonucleotide
cgcaaattgctgagcgccacccacac

SEQ ID NO: 353190 - DNA, 26 bp, Artificial Sequence
  Description of Artificial Sequence: Synthetic oligonucleotide
gcaaattgctgagcgccacccacacg

SEQ ID NO: 353191 - DNA, 27 bp, Artificial Sequence
  Description of Artificial Sequence: Synthetic oligonucleotide
caaattgctgagcgccacccacacgct

SEQ ID NO: 353192 - DNA, 27 bp, Artificial Sequence
  Description of Artificial Sequence: Synthetic oligonucleotide
aaattgctgagcgccacccacacgctc

SEQ ID NO: 353193 - DNA, 26 bp, Artificial Sequence
  Description of Artificial Sequence: Synthetic oligonucleotide
aattgctgagcgccacccacacgctc

SEQ ID NO: 353194 - DNA, 25 bp, Artificial Sequence
  Description of Artificial Sequence: Synthetic oligonucleotide
attgctgagcgccacccacacgctc

SEQ ID NO: 353195 - DNA, 24 bp, Artificial Sequence
  Description of Artificial Sequence: Synthetic oligonucleotide
ttgctgagcgccacccacacgctc

SEQ ID NO: 353196 - DNA, 23 bp, Artificial Sequence
  Description of Artificial Sequence: Synthetic oligonucleotide
tgctgagcgccacccacacgctc

SEQ ID NO: 353197 - DNA, 22 bp, Artificial Sequence
  Description of Artificial Sequence: Synthetic oligonucleotide
gctgagcgccacccacacgctc

SEQ ID NO: 353198 - DNA, 23 bp, Artificial Sequence
  Description of Artificial Sequence: Synthetic oligonucleotide
ctgagcgccacccacacgctcgt

SEQ ID NO: 353199 - DNA, 23 bp, Artificial Sequence
  Description of Artificial Sequence: Synthetic oligonucleotide
tgagcgccacccacacgctcgtc

SEQ ID NO: 353200 - DNA, 22 bp, Artificial Sequence
  Description of Artificial Sequence: Synthetic oligonucleotide
gagcgccacccacacgctcgtc

SEQ ID NO: 353201 - DNA, 23 bp, Artificial Sequence
  Description of Artificial Sequence: Synthetic oligonucleotide
agcgccacccacacgctcgtcga

SEQ ID NO: 353202 - DNA, 22 bp, Artificial Sequence
  Description of Artificial Sequence: Synthetic oligonucleotide
gcgccacccacacgctcgtcga

SEQ ID NO: 353203 - DNA, 22 bp, Artificial Sequence
  Description of Artificial Sequence: Synthetic oligonucleotide
cgccacccacacgctcgtcgag

SEQ ID NO: 353204 - DNA, 22 bp, Artificial Sequence
  Description of Artificial Sequence: Synthetic oligonucleotide
gccacccacacgctcgtcgagg

SEQ ID NO: 353205 - DNA, 22 bp, Artificial Sequence
  Description of Artificial Sequence: Synthetic oligonucleotide
ccacccacacgctcgtcgaggc

SEQ ID NO: 353206 - DNA, 22 bp, Artificial Sequence
  Description of Artificial Sequence: Synthetic oligonucleotide
cacccacacgctcgtcgaggcg

SEQ ID NO: 353207 - DNA, 23 bp, Artificial Sequence
  Description of Artificial Sequence: Synthetic oligonucleotide
acccacacgctcgtcgaggcgga

SEQ ID NO: 353208 - DNA, 22 bp, Artificial Sequence
  Description of Artificial Sequence: Synthetic oligonucleotide
cccacacgctcgtcgaggcgga

SEQ ID NO: 353209 - DNA, 22 bp, Artificial Sequence
  Description of Artificial Sequence: Synthetic oligonucleotide
ccacacgctcgtcgaggcggac

SEQ ID NO: 353210 - DNA, 22 bp, Artificial Sequence
  Description of Artificial Sequence: Synthetic oligonucleotide
cacacgctcgtcgaggcggacc

SEQ ID NO: 353211 - DNA, 22 bp, Artificial Sequence
  Description of Artificial Sequence: Synthetic oligonucleotide
acacgctcgtcgaggcggaccg

SEQ ID NO: 353212 - DNA, 21 bp, Artificial Sequence
  Description of Artificial Sequence: Synthetic oligonucleotide
cacgctcgtcgaggcggaccg

SEQ ID NO: 353213 - DNA, 21 bp, Artificial Sequence
  Description of Artificial Sequence: Synthetic oligonucleotide
acgctcgtcgaggcggaccgc

SEQ ID NO: 353214 - DNA, 20 bp, Artificial Sequence
  Description of Artificial Sequence: Synthetic oligonucleotide
cgctcgtcgaggcggaccgc

SEQ ID NO: 353215 - DNA, 21 bp, Artificial Sequence
  Description of Artificial Sequence: Synthetic oligonucleotide
gctcgtcgaggcggaccgcca

SEQ ID NO: 353216 - DNA, 22 bp, Artificial Sequence
  Description of Artificial Sequence: Synthetic oligonucleotide
ctcgtcgaggcggaccgccagt

SEQ ID NO: 353217 - DNA, 22 bp, Artificial Sequence
  Description of Artificial Sequence: Synthetic oligonucleotide
tcgtcgaggcggaccgccagtg

SEQ ID NO: 353218 - DNA, 21 bp, Artificial Sequence
  Description of Artificial Sequence: Synthetic oligonucleotide
cgtcgaggcggaccgccagtg

SEQ ID NO: 353219 - DNA, 23 bp, Artificial Sequence
  Description of Artificial Sequence: Synthetic oligonucleotide
gtcgaggcggaccgccagtggta

SEQ ID NO: 353220 - DNA, 23 bp, Artificial Sequence
  Description of Artificial Sequence: Synthetic oligonucleotide
tcgaggcggaccgccagtggtag

SEQ ID NO: 353221 - DNA, 22 bp, Artificial Sequence
  Description of Artificial Sequence: Synthetic oligonucleotide
cgaggcggaccgccagtggtag

SEQ ID NO: 353222 - DNA, 22 bp, Artificial Sequence
  Description of Artificial Sequence: Synthetic oligonucleotide
gaggcggaccgccagtggtagg

SEQ ID NO: 353223 - DNA, 22 bp, Artificial Sequence
  Description of Artificial Sequence: Synthetic oligonucleotide
aggcggaccgccagtggtaggc

SEQ ID NO: 353224 - DNA, 21 bp, Artificial Sequence
  Description of Artificial Sequence: Synthetic oligonucleotide
ggcggaccgccagtggtaggc

SEQ ID NO: 353225 - DNA, 21 bp, Artificial Sequence
  Description of Artificial Sequence: Synthetic oligonucleotide
gcggaccgccagtggtaggcc

SEQ ID NO: 353226 - DNA, 22 bp, Artificial Sequence
  Description of Artificial Sequence: Synthetic oligonucleotide
cggaccgccagtggtaggccga

SEQ ID NO: 353227 - DNA, 24 bp, Artificial Sequence
  Description of Artificial Sequence: Synthetic oligonucleotide
ggaccgccagtggtaggccgagta

SEQ ID NO: 353228 - DNA, 24 bp, Artificial Sequence
  Description of Artificial Sequence: Synthetic oligonucleotide
gaccgccagtggtaggccgagtac

SEQ ID NO: 353229 - DNA, 25 bp, Artificial Sequence
  Description of Artificial Sequence: Synthetic oligonucleotide
accgccagtggtaggccgagtacca

SEQ ID NO: 353230 - DNA, 24 bp, Artificial Sequence
  Description of Artificial Sequence: Synthetic oligonucleotide
ccgccagtggtaggccgagtacca

SEQ ID NO: 353231 - DNA, 24 bp, Artificial Sequence
  Description of Artificial Sequence: Synthetic oligonucleotide
cgccagtggtaggccgagtaccac

SEQ ID NO: 353232 - DNA, 24 bp, Artificial Sequence
  Description of Artificial Sequence: Synthetic oligonucleotide
gccagtggtaggccgagtaccacc

SEQ ID NO: 353233 - DNA, 24 bp, Artificial Sequence
  Description of Artificial Sequence: Synthetic oligonucleotide
ccagtggtaggccgagtaccaccg

SEQ ID NO: 353234 - DNA, 25 bp, Artificial Sequence
  Description of Artificial Sequence: Synthetic oligonucleotide
cagtggtaggccgagtaccaccgct

SEQ ID NO: 353235 - DNA, 25 bp, Artificial Sequence
  Description of Artificial Sequence: Synthetic oligonucleotide
agtggtaggccgagtaccaccgctg

SEQ ID NO: 353236 - DNA, 24 bp, Artificial Sequence
  Description of Artificial Sequence: Synthetic oligonucleotide
gtggtaggccgagtaccaccgctg

SEQ ID NO: 353237 - DNA, 25 bp, Artificial Sequence
  Description of Artificial Sequence: Synthetic oligonucleotide
tggtaggccgagtaccaccgctgca

SEQ ID NO: 353238 - DNA, 24 bp, Artificial Sequence
  Description of Artificial Sequence: Synthetic oligonucleotide
ggtaggccgagtaccaccgctgca

SEQ ID NO: 353239 - DNA, 24 bp, Artificial Sequence
  Description of Artificial Sequence: Synthetic oligonucleotide
gtaggccgagtaccaccgctgcag

SEQ ID NO: 353240 - DNA, 25 bp, Artificial Sequence
  Description of Artificial Sequence: Synthetic oligonucleotide
taggccgagtaccaccgctgcagct

SEQ ID NO: 353241 - DNA, 24 bp, Artificial Sequence
  Description of Artificial Sequence: Synthetic oligonucleotide
aggccgagtaccaccgctgcagct

SEQ ID NO: 353242 - DNA, 23 bp, Artificial Sequence
  Description of Artificial Sequence: Synthetic oligonucleotide
ggccgagtaccaccgctgcagct

SEQ ID NO: 353243 - DNA, 23 bp, Artificial Sequence
  Description of Artificial Sequence: Synthetic oligonucleotide
gccgagtaccaccgctgcagctc

SEQ ID NO: 353244 - DNA, 25 bp, Artificial Sequence
  Description of Artificial Sequence: Synthetic oligonucleotide
ccgagtaccaccgctgcagctccta

SEQ ID NO: 353245 - DNA, 27 bp, Artificial Sequence
  Description of Artificial Sequence: Synthetic oligonucleotide
cgagtaccaccgctgcagctcctactt

SEQ ID NO: 353246 - DNA, 27 bp, Artificial Sequence
  Description of Artificial Sequence: Synthetic oligonucleotide
gagtaccaccgctgcagctcctacttg

SEQ ID NO: 353247 - DNA, 27 bp, Artificial Sequence
  Description of Artificial Sequence: Synthetic oligonucleotide
agtaccaccgctgcagctcctacttgg

SEQ ID NO: 353248 - DNA, 27 bp, Artificial Sequence
  Description of Artificial Sequence: Synthetic oligonucleotide
gtaccaccgctgcagctcctacttggt

SEQ ID NO: 353249 - DNA, 27 bp, Artificial Sequence
  Description of Artificial Sequence: Synthetic oligonucleotide
taccaccgctgcagctcctacttggtg

SEQ ID NO: 353250 - DNA, 26 bp, Artificial Sequence
  Description of Artificial Sequence: Synthetic oligonucleotide
accaccgctgcagctcctacttggtg

SEQ ID NO: 353251 - DNA, 25 bp, Artificial Sequence
  Description of Artificial Sequence: Synthetic oligonucleotide
ccaccgctgcagctcctacttggtg

SEQ ID NO: 353252 - DNA, 26 bp, Artificial Sequence
  Description of Artificial Sequence: Synthetic oligonucleotide
caccgctgcagctcctacttggtgca

SEQ ID NO: 353253 - DNA, 27 bp, Artificial Sequence
  Description of Artificial Sequence: Synthetic oligonucleotide
accgctgcagctcctacttggtgcact

SEQ ID NO: 353254 - DNA, 26 bp, Artificial Sequence
  Description of Artificial Sequence: Synthetic oligonucleotide
ccgctgcagctcctacttggtgcact

SEQ ID NO: 353255 - DNA, 26 bp, Artificial Sequence
  Description of Artificial Sequence: Synthetic oligonucleotide
cgctgcagctcctacttggtgcactc

SEQ ID NO: 353256 - DNA, 27 bp, Artificial Sequence
  Description of Artificial Sequence: Synthetic oligonucleotide
gctgcagctcctacttggtgcactcga

SEQ ID NO: 353257 - DNA, 28 bp, Artificial Sequence
  Description of Artificial Sequence: Synthetic oligonucleotide
ctgcagctcctacttggtgcactcgaag

SEQ ID NO: 353258 - DNA, 30 bp, Artificial Sequence
  Description of Artificial Sequence: Synthetic oligonucleotide
tgcagctcctacttggtgcactcgaagaac

SEQ ID NO: 353259 - DNA, 29 bp, Artificial Sequence
  Description of Artificial Sequence: Synthetic oligonucleotide
gcagctcctacttggtgcactcgaagaac

SEQ ID NO: 353260 - DNA, 29 bp, Artificial Sequence
  Description of Artificial Sequence: Synthetic oligonucleotide
cagctcctacttggtgcactcgaagaacc

SEQ ID NO: 353261 - DNA, 30 bp, Artificial Sequence
  Description of Artificial Sequence: Synthetic oligonucleotide
agctcctacttggtgcactcgaagaaccac

SEQ ID NO: 353262 - DNA, 29 bp, Artificial Sequence
  Description of Artificial Sequence: Synthetic oligonucleotide
gctcctacttggtgcactcgaagaaccac

SEQ ID NO: 353263 - DNA, 31 bp, Artificial Sequence
  Description of Artificial Sequence: Synthetic oligonucleotide
ctcctacttggtgcactcgaagaaccacttc

SEQ ID NO: 353264 - DNA, 31 bp, Artificial Sequence
  Description of Artificial Sequence: Synthetic oligonucleotide
tcctacttggtgcactcgaagaaccacttcg

SEQ ID NO: 353265 - DNA, 30 bp, Artificial Sequence
  Description of Artificial Sequence: Synthetic oligonucleotide
cctacttggtgcactcgaagaaccacttcg

SEQ ID NO: 353266 - DNA, 31 bp, Artificial Sequence
  Description of Artificial Sequence: Synthetic oligonucleotide
ctacttggtgcactcgaagaaccacttcgac

SEQ ID NO: 353267 - DNA, 31 bp, Artificial Sequence
  Description of Artificial Sequence: Synthetic oligonucleotide
tacttggtgcactcgaagaaccacttcgacc

SEQ ID NO: 353268 - DNA, 30 bp, Artificial Sequence
  Description of Artificial Sequence: Synthetic oligonucleotide
acttggtgcactcgaagaaccacttcgacc

SEQ ID NO: 353269 - DNA, 29 bp, Artificial Sequence
  Description of Artificial Sequence: Synthetic oligonucleotide
cttggtgcactcgaagaaccacttcgacc

SEQ ID NO: 353270 - DNA, 30 bp, Artificial Sequence
  Description of Artificial Sequence: Synthetic oligonucleotide
ttggtgcactcgaagaaccacttcgaccac

SEQ ID NO: 353271 - DNA, 29 bp, Artificial Sequence
  Description of Artificial Sequence: Synthetic oligonucleotide
tggtgcactcgaagaaccacttcgaccac

SEQ ID NO: 353272 - DNA, 28 bp, Artificial Sequence
  Description of Artificial Sequence: Synthetic oligonucleotide
ggtgcactcgaagaaccacttcgaccac

SEQ ID NO: 353273 - DNA, 30 bp, Artificial Sequence
  Description of Artificial Sequence: Synthetic oligonucleotide
gtgcactcgaagaaccacttcgaccacaac

SEQ ID NO: 353274 - DNA, 31 bp, Artificial Sequence
  Description of Artificial Sequence: Synthetic oligonucleotide
tgcactcgaagaaccacttcgaccacaacag

SEQ ID NO: 353275 - DNA, 30 bp, Artificial Sequence
  Description of Artificial Sequence: Synthetic oligonucleotide
gcactcgaagaaccacttcgaccacaacag

SEQ ID NO: 353276 - DNA, 30 bp, Artificial Sequence
  Description of Artificial Sequence: Synthetic oligonucleotide
cactcgaagaaccacttcgaccacaacagc

SEQ ID NO: 353277 - DNA, 32 bp, Artificial Sequence
  Description of Artificial Sequence: Synthetic oligonucleotide
actcgaagaaccacttcgaccacaacagcaag

SEQ ID NO: 353278 - DNA, 31 bp, Artificial Sequence
  Description of Artificial Sequence: Synthetic oligonucleotide
ctcgaagaaccacttcgaccacaacagcaag

SEQ ID NO: 353279 - DNA, 31 bp, Artificial Sequence
  Description of Artificial Sequence: Synthetic oligonucleotide
tcgaagaaccacttcgaccacaacagcaagc

SEQ ID NO: 353280 - DNA, 30 bp, Artificial Sequence
  Description of Artificial Sequence: Synthetic oligonucleotide
cgaagaaccacttcgaccacaacagcaagc

SEQ ID NO: 353281 - DNA, 31 bp, Artificial Sequence
  Description of Artificial Sequence: Synthetic oligonucleotide
gaagaaccacttcgaccacaacagcaagctg

SEQ ID NO: 353282 - DNA, 31 bp, Artificial Sequence
  Description of Artificial Sequence: Synthetic oligonucleotide
aagaaccacttcgaccacaacagcaagctgg

SEQ ID NO: 353283 - DNA, 30 bp, Artificial Sequence
  Description of Artificial Sequence: Synthetic oligonucleotide
agaaccacttcgaccacaacagcaagctgg

SEQ ID NO: 353284 - DNA, 29 bp, Artificial Sequence
  Description of Artificial Sequence: Synthetic oligonucleotide
gaaccacttcgaccacaacagcaagctgg

SEQ ID NO: 353285 - DNA, 31 bp, Artificial Sequence
  Description of Artificial Sequence: Synthetic oligonucleotide
aaccacttcgaccacaacagcaagctggatc

SEQ ID NO: 353286 - DNA, 30 bp, Artificial Sequence
  Description of Artificial Sequence: Synthetic oligonucleotide
accacttcgaccacaacagcaagctggatc

SEQ ID NO: 353287 - DNA, 29 bp, Artificial Sequence
  Description of Artificial Sequence: Synthetic oligonucleotide
ccacttcgaccacaacagcaagctggatc

SEQ ID NO: 353288 - DNA, 29 bp, Artificial Sequence
  Description of Artificial Sequence: Synthetic oligonucleotide
cacttcgaccacaacagcaagctggatcg

SEQ ID NO: 353289 - DNA, 29 bp, Artificial Sequence
  Description of Artificial Sequence: Synthetic oligonucleotide
acttcgaccacaacagcaagctggatcgc

SEQ ID NO: 353290 - DNA, 28 bp, Artificial Sequence
  Description of Artificial Sequence: Synthetic oligonucleotide
cttcgaccacaacagcaagctggatcgc

SEQ ID NO: 353291 - DNA, 29 bp, Artificial Sequence
  Description of Artificial Sequence: Synthetic oligonucleotide
ttcgaccacaacagcaagctggatcgctg

SEQ ID NO: 353292 - DNA, 28 bp, Artificial Sequence
  Description of Artificial Sequence: Synthetic oligonucleotide
tcgaccacaacagcaagctggatcgctg

SEQ ID NO: 353293 - DNA, 27 bp, Artificial Sequence
  Description of Artificial Sequence: Synthetic oligonucleotide
cgaccacaacagcaagctggatcgctg

SEQ ID NO: 353294 - DNA, 27 bp, Artificial Sequence
  Description of Artificial Sequence: Synthetic oligonucleotide
gaccacaacagcaagctggatcgctgg

SEQ ID NO: 353295 - DNA, 28 bp, Artificial Sequence
  Description of Artificial Sequence: Synthetic oligonucleotide
accacaacagcaagctggatcgctggtc

SEQ ID NO: 353296 - DNA, 27 bp, Artificial Sequence
  Description of Artificial Sequence: Synthetic oligonucleotide
ccacaacagcaagctggatcgctggtc

SEQ ID NO: 353297 - DNA, 28 bp, Artificial Sequence
  Description of Artificial Sequence: Synthetic oligonucleotide
cacaacagcaagctggatcgctggtcag

SEQ ID NO: 353298 - DNA, 29 bp, Artificial Sequence
  Description of Artificial Sequence: Synthetic oligonucleotide
acaacagcaagctggatcgctggtcagac

SEQ ID NO: 353299 - DNA, 28 bp, Artificial Sequence
  Description of Artificial Sequence: Synthetic oligonucleotide
caacagcaagctggatcgctggtcagac

SEQ ID NO: 353300 - DNA, 28 bp, Artificial Sequence
  Description of Artificial Sequence: Synthetic oligonucleotide
aacagcaagctggatcgctggtcagacc

SEQ ID NO: 353301 - DNA, 27 bp, Artificial Sequence
  Description of Artificial Sequence: Synthetic oligonucleotide
acagcaagctggatcgctggtcagacc

SEQ ID NO: 353302 - DNA, 27 bp, Artificial Sequence
  Description of Artificial Sequence: Synthetic oligonucleotide
cagcaagctggatcgctggtcagacct

SEQ ID NO: 353303 - DNA, 27 bp, Artificial Sequence
  Description of Artificial Sequence: Synthetic oligonucleotide
agcaagctggatcgctggtcagacctg

SEQ ID NO: 353304 - DNA, 27 bp, Artificial Sequence
  Description of Artificial Sequence: Synthetic oligonucleotide
gcaagctggatcgctggtcagacctga

SEQ ID NO: 353305 - DNA, 27 bp, Artificial Sequence
  Description of Artificial Sequence: Synthetic oligonucleotide
caagctggatcgctggtcagacctgag

SEQ ID NO: 353306 - DNA, 23 bp, Artificial Sequence
  Description of Artificial Sequence: Synthetic oligonucleotide
atgcgggtcatcgcgcccccaac

SEQ ID NO: 353307 - DNA, 24 bp, Artificial Sequence
  Description of Artificial Sequence: Synthetic oligonucleotide
caggagcagaggggtcagggcgaa

SEQ ID NO: 353308 - DNA, 22 bp, Artificial Sequence
  Description of Artificial Sequence: Synthetic oligonucleotide
tgcgggtcatcgcgcccccaac

SEQ ID NO: 353309 - DNA, 25 bp, Artificial Sequence
  Description of Artificial Sequence: Synthetic oligonucleotide
aggagcagaggggtcagggcgaagt

SEQ ID NO: 353310 - DNA, 21 bp, Artificial Sequence
  Description of Artificial Sequence: Synthetic oligonucleotide
gcgggtcatcgcgcccccaac

SEQ ID NO: 353311 - DNA, 24 bp, Artificial Sequence
  Description of Artificial Sequence: Synthetic oligonucleotide
ggagcagaggggtcagggcgaagt

SEQ ID NO: 353312 - DNA, 21 bp, Artificial Sequence
  Description of Artificial Sequence: Synthetic oligonucleotide
cgggtcatcgcgcccccaacc

SEQ ID NO: 353313 - DNA, 24 bp, Artificial Sequence
  Description of Artificial Sequence: Synthetic oligonucleotide
gagcagaggggtcagggcgaagtc

SEQ ID NO: 353314 - DNA, 22 bp, Artificial Sequence
  Description of Artificial Sequence: Synthetic oligonucleotide
gggtcatcgcgcccccaaccct

SEQ ID NO: 353315 - DNA, 24 bp, Artificial Sequence
  Description of Artificial Sequence: Synthetic oligonucleotide
agcagaggggtcagggcgaagtcc

SEQ ID NO: 353316 - DNA, 22 bp, Artificial Sequence
  Description of Artificial Sequence: Synthetic oligonucleotide
ggtcatcgcgcccccaaccctc

SEQ ID NO: 353317 - DNA, 23 bp, Artificial Sequence
  Description of Artificial Sequence: Synthetic oligonucleotide
gcagaggggtcagggcgaagtcc

SEQ ID NO: 353318 - DNA, 23 bp, Artificial Sequence
  Description of Artificial Sequence: Synthetic oligonucleotide
gtcatcgcgcccccaaccctcct

SEQ ID NO: 353319 - DNA, 24 bp, Artificial Sequence
  Description of Artificial Sequence: Synthetic oligonucleotide
cagaggggtcagggcgaagtccca

SEQ ID NO: 353320 - DNA, 23 bp, Artificial Sequence
  Description of Artificial Sequence: Synthetic oligonucleotide
tcatcgcgcccccaaccctcctg

SEQ ID NO: 353321 - DNA, 24 bp, Artificial Sequence
  Description of Artificial Sequence: Synthetic oligonucleotide
agaggggtcagggcgaagtcccag

SEQ ID NO: 353322 - DNA, 22 bp, Artificial Sequence
  Description of Artificial Sequence: Synthetic oligonucleotide
catcgcgcccccaaccctcctg

SEQ ID NO: 353323 - DNA, 23 bp, Artificial Sequence
  Description of Artificial Sequence: Synthetic oligonucleotide
gaggggtcagggcgaagtcccag

SEQ ID NO: 353324 - DNA, 23 bp, Artificial Sequence
  Description of Artificial Sequence: Synthetic oligonucleotide
atcgcgcccccaaccctcctgct

SEQ ID NO: 353325 - DNA, 23 bp, Artificial Sequence
  Description of Artificial Sequence: Synthetic oligonucleotide
aggggtcagggcgaagtcccagg

SEQ ID NO: 353326 - DNA, 22 bp, Artificial Sequence
  Description of Artificial Sequence: Synthetic oligonucleotide
tcgcgcccccaaccctcctgct

SEQ ID NO: 353327 - DNA, 22 bp, Artificial Sequence
  Description of Artificial Sequence: Synthetic oligonucleotide
ggggtcagggcgaagtcccagg

SEQ ID NO: 353328 - DNA, 21 bp, Artificial Sequence
  Description of Artificial Sequence: Synthetic oligonucleotide
cgcgcccccaaccctcctgct

SEQ ID NO: 353329 - DNA, 22 bp, Artificial Sequence
  Description of Artificial Sequence: Synthetic oligonucleotide
gggtcagggcgaagtcccaggg

SEQ ID NO: 353330 - DNA, 21 bp, Artificial Sequence
  Description of Artificial Sequence: Synthetic oligonucleotide
gcgcccccaaccctcctgctg

SEQ ID NO: 353331 - DNA, 22 bp, Artificial Sequence
  Description of Artificial Sequence: Synthetic oligonucleotide
ggtcagggcgaagtcccagggc

SEQ ID NO: 353332 - DNA, 22 bp, Artificial Sequence
  Description of Artificial Sequence: Synthetic oligonucleotide
cgcccccaaccctcctgctgct

SEQ ID NO: 353333 - DNA, 22 bp, Artificial Sequence
  Description of Artificial Sequence: Synthetic oligonucleotide
gtcagggcgaagtcccagggcc

SEQ ID NO: 353334 - DNA, 22 bp, Artificial Sequence
  Description of Artificial Sequence: Synthetic oligonucleotide
gcccccaaccctcctgctgctg

SEQ ID NO: 353335 - DNA, 22 bp, Artificial Sequence
  Description of Artificial Sequence: Synthetic oligonucleotide
tcagggcgaagtcccagggccc

SEQ ID NO: 353336 - DNA, 23 bp, Artificial Sequence
  Description of Artificial Sequence: Synthetic oligonucleotide
cccccaaccctcctgctgctgct

SEQ ID NO: 353337 - DNA, 21 bp, Artificial Sequence
  Description of Artificial Sequence: Synthetic oligonucleotide
cagggcgaagtcccagggccc

SEQ ID NO: 353338 - DNA, 24 bp, Artificial Sequence
  Description of Artificial Sequence: Synthetic oligonucleotide
ccccaaccctcctgctgctgctca

SEQ ID NO: 353339 - DNA, 22 bp, Artificial Sequence
  Description of Artificial Sequence: Synthetic oligonucleotide
agggcgaagtcccagggcccca

SEQ ID NO: 353340 - DNA, 24 bp, Artificial Sequence
  Description of Artificial Sequence: Synthetic oligonucleotide
cccaaccctcctgctgctgctcac

SEQ ID NO: 353341 - DNA, 21 bp, Artificial Sequence
  Description of Artificial Sequence: Synthetic oligonucleotide
gggcgaagtcccagggcccca

SEQ ID NO: 353342 - DNA, 24 bp, Artificial Sequence
  Description of Artificial Sequence: Synthetic oligonucleotide
ccaaccctcctgctgctgctcacg

SEQ ID NO: 353343 - DNA, 21 bp, Artificial Sequence
  Description of Artificial Sequence: Synthetic oligonucleotide
ggcgaagtcccagggccccag

SEQ ID NO: 353344 - DNA, 24 bp, Artificial Sequence
  Description of Artificial Sequence: Synthetic oligonucleotide
caaccctcctgctgctgctcacgg

SEQ ID NO: 353345 - DNA, 21 bp, Artificial Sequence
  Description of Artificial Sequence: Synthetic oligonucleotide
gcgaagtcccagggccccagg

SEQ ID NO: 353346 - DNA, 24 bp, Artificial Sequence
  Description of Artificial Sequence: Synthetic oligonucleotide
aaccctcctgctgctgctcacggg

SEQ ID NO: 353347 - DNA, 21 bp, Artificial Sequence
  Description of Artificial Sequence: Synthetic oligonucleotide
cgaagtcccagggccccaggc

SEQ ID NO: 353348 - DNA, 23 bp, Artificial Sequence
  Description of Artificial Sequence: Synthetic oligonucleotide
accctcctgctgctgctcacggg

SEQ ID NO: 353349 - DNA, 22 bp, Artificial Sequence
  Description of Artificial Sequence: Synthetic oligonucleotide
gaagtcccagggccccaggcgt

SEQ ID NO: 353350 - DNA, 22 bp, Artificial Sequence
  Description of Artificial Sequence: Synthetic oligonucleotide
ccctcctgctgctgctcacggg

SEQ ID NO: 353351 - DNA, 22 bp, Artificial Sequence
  Description of Artificial Sequence: Synthetic oligonucleotide
aagtcccagggccccaggcgtg

SEQ ID NO: 353352 - DNA, 22 bp, Artificial Sequence
  Description of Artificial Sequence: Synthetic oligonucleotide
cctcctgctgctgctcacgggg

SEQ ID NO: 353353 - DNA, 21 bp, Artificial Sequence
  Description of Artificial Sequence: Synthetic oligonucleotide
agtcccagggccccaggcgtg

SEQ ID NO: 353354 - DNA, 22 bp, Artificial Sequence
  Description of Artificial Sequence: Synthetic oligonucleotide
ctcctgctgctgctcacggggg

SEQ ID NO: 353355 - DNA, 20 bp, Artificial Sequence
  Description of Artificial Sequence: Synthetic oligonucleotide
gtcccagggccccaggcgtg

SEQ ID NO: 353356 - DNA, 22 bp, Artificial Sequence
  Description of Artificial Sequence: Synthetic oligonucleotide
tcctgctgctgctcacgggggc

SEQ ID NO: 353357 - DNA, 20 bp, Artificial Sequence
  Description of Artificial Sequence: Synthetic oligonucleotide
tcccagggccccaggcgtgg

SEQ ID NO: 353358 - DNA, 21 bp, Artificial Sequence
  Description of Artificial Sequence: Synthetic oligonucleotide
cctgctgctgctcacgggggc

SEQ ID NO: 353359 - DNA, 20 bp, Artificial Sequence
  Description of Artificial Sequence: Synthetic oligonucleotide
cccagggccccaggcgtggt

SEQ ID NO: 353360 - DNA, 21 bp, Artificial Sequence
  Description of Artificial Sequence: Synthetic oligonucleotide
ctgctgctgctcacgggggcc

SEQ ID NO: 353361 - DNA, 20 bp, Artificial Sequence
  Description of Artificial Sequence: Synthetic oligonucleotide
ccagggccccaggcgtggct

SEQ ID NO: 353362 - DNA, 22 bp, Artificial Sequence
  Description of Artificial Sequence: Synthetic oligonucleotide
tgctgctgctcacgggggccca

SEQ ID NO: 353363 - DNA, 21 bp, Artificial Sequence
  Description of Artificial Sequence: Synthetic oligonucleotide
cagggccccaggcgtggctct

SEQ ID NO: 353364 - DNA, 21 bp, Artificial Sequence
  Description of Artificial Sequence: Synthetic oligonucleotide
gctgctgctcacgggggccca

SEQ ID NO: 353365 - DNA, 22 bp, Artificial Sequence
  Description of Artificial Sequence: Synthetic oligonucleotide
agggccccaggcgtggctctca

SEQ ID NO: 353366 - DNA, 21 bp, Artificial Sequence
  Description of Artificial Sequence: Synthetic oligonucleotide
ctgctgctcacgggggcccag

SEQ ID NO: 353367 - DNA, 21 bp, Artificial Sequence
  Description of Artificial Sequence: Synthetic oligonucleotide
gggccccaggcgtggctctca

SEQ ID NO: 353368 - DNA, 21 bp, Artificial Sequence
  Description of Artificial Sequence: Synthetic oligonucleotide
tgctgctcacgggggcccagg

SEQ ID NO: 353369 - DNA, 21 bp, Artificial Sequence
  Description of Artificial Sequence: Synthetic oligonucleotide
ggccccaggcgtggctctcag

SEQ ID NO: 353370 - DNA, 20 bp, Artificial Sequence
  Description of Artificial Sequence: Synthetic oligonucleotide
gctgctcacgggggcccagg

SEQ ID NO: 353371 - DNA, 21 bp, Artificial Sequence
  Description of Artificial Sequence: Synthetic oligonucleotide
gccccaggcgtggctctcagg

SEQ ID NO: 353372 - DNA, 20 bp, Artificial Sequence
  Description of Artificial Sequence: Synthetic oligonucleotide
ctgctcacgggggcccaggc

SEQ ID NO: 353373 - DNA, 22 bp, Artificial Sequence
  Description of Artificial Sequence: Synthetic oligonucleotide
ccccaggcgtggctctcagggt

SEQ ID NO: 353374 - DNA, 20 bp, Artificial Sequence
  Description of Artificial Sequence: Synthetic oligonucleotide
tgctcacgggggcccaggcc

SEQ ID NO: 353375 - DNA, 23 bp, Artificial Sequence
  Description of Artificial Sequence: Synthetic oligonucleotide
cccaggcgtggctctcagggtct

SEQ ID NO: 353376 - DNA, 20 bp, Artificial Sequence
  Description of Artificial Sequence: Synthetic oligonucleotide
gctcacgggggcccaggcct

SEQ ID NO: 353377 - DNA, 24 bp, Artificial Sequence
  Description of Artificial Sequence: Synthetic oligonucleotide
ccaggcgtggctctcagggtctca

SEQ ID NO: 353378 - DNA, 20 bp, Artificial Sequence
  Description of Artificial Sequence: Synthetic oligonucleotide
ctcacgggggcccaggccct

SEQ ID NO: 353379 - DNA, 24 bp, Artificial Sequence
  Description of Artificial Sequence: Synthetic oligonucleotide
caggcgtggctctcagggtctcag

SEQ ID NO: 353380 - DNA, 21 bp, Artificial Sequence
  Description of Artificial Sequence: Synthetic oligonucleotide
tcacgggggcccaggccctga

SEQ ID NO: 353381 - DNA, 24 bp, Artificial Sequence
  Description of Artificial Sequence: Synthetic oligonucleotide
aggcgtggctctcagggtctcagg

SEQ ID NO: 353382 - DNA, 20 bp, Artificial Sequence
  Description of Artificial Sequence: Synthetic oligonucleotide
cacgggggcccaggccctga

SEQ ID NO: 353383 - DNA, 23 bp, Artificial Sequence
  Description of Artificial Sequence: Synthetic oligonucleotide
ggcgtggctctcagggtctcagg

SEQ ID NO: 353384 - DNA, 20 bp, Artificial Sequence
  Description of Artificial Sequence: Synthetic oligonucleotide
acgggggcccaggccctgac

SEQ ID NO: 353385 - DNA, 23 bp, Artificial Sequence
  Description of Artificial Sequence: Synthetic oligonucleotide
gcgtggctctcagggtctcaggc

SEQ ID NO: 353386 - DNA, 20 bp, Artificial Sequence
  Description of Artificial Sequence: Synthetic oligonucleotide
cgggggcccaggccctgact

SEQ ID NO: 353387 - DNA, 23 bp, Artificial Sequence
  Description of Artificial Sequence: Synthetic oligonucleotide
cgtggctctcagggtctcaggcc

SEQ ID NO: 353388 - DNA, 20 bp, Artificial Sequence
  Description of Artificial Sequence: Synthetic oligonucleotide
gggggcccaggccctgacgt

SEQ ID NO: 353389 - DNA, 23 bp, Artificial Sequence
  Description of Artificial Sequence: Synthetic oligonucleotide
gtggctctcagggtctcaggccc

SEQ ID NO: 353390 - DNA, 20 bp, Artificial Sequence
  Description of Artificial Sequence: Synthetic oligonucleotide
ggggcccaggccctgacgga

SEQ ID NO: 353391 - DNA, 23 bp, Artificial Sequence
  Description of Artificial Sequence: Synthetic oligonucleotide
tggctctcagggtctcaggcccc

SEQ ID NO: 353392 - DNA, 21 bp, Artificial Sequence
  Description of Artificial Sequence: Synthetic oligonucleotide
gggcccaggccctgacggaga

SEQ ID NO: 353393 - DNA, 22 bp, Artificial Sequence
  Description of Artificial Sequence: Synthetic oligonucleotide
ggctctcagggtctcaggcccc

SEQ ID NO: 353394 - DNA, 21 bp, Artificial Sequence
  Description of Artificial Sequence: Synthetic oligonucleotide
ggcccaggccctgacggagac

SEQ ID NO: 353395 - DNA, 24 bp, Artificial Sequence
  Description of Artificial Sequence: Synthetic oligonucleotide
gctctcagggtctcaggccccgaa

SEQ ID NO: 353396 - DNA, 22 bp, Artificial Sequence
  Description of Artificial Sequence: Synthetic oligonucleotide
gcccaggccctgacggagacct

SEQ ID NO: 353397 - DNA, 24 bp, Artificial Sequence
  Description of Artificial Sequence: Synthetic oligonucleotide
ctctcagggtctcaggccccgaag

SEQ ID NO: 353398 - DNA, 22 bp, Artificial Sequence
  Description of Artificial Sequence: Synthetic oligonucleotide
cccaggccctgacggagacctg

SEQ ID NO: 353399 - DNA, 24 bp, Artificial Sequence
  Description of Artificial Sequence: Synthetic oligonucleotide
tctcagggtctcaggccccgaagg

SEQ ID NO: 353400 - DNA, 22 bp, Artificial Sequence
  Description of Artificial Sequence: Synthetic oligonucleotide
ccaggccctgacggagacctgg

SEQ ID NO: 353401 - DNA, 23 bp, Artificial Sequence
  Description of Artificial Sequence: Synthetic oligonucleotide
ctcagggtctcaggccccgaagg

SEQ ID NO: 353402 - DNA, 22 bp, Artificial Sequence
  Description of Artificial Sequence: Synthetic oligonucleotide
caggccctgacggagacctggc

SEQ ID NO: 353403 - DNA, 23 bp, Artificial Sequence
  Description of Artificial Sequence: Synthetic oligonucleotide
tcagggtctcaggccccgaaggc

SEQ ID NO: 353404 - DNA, 22 bp, Artificial Sequence
  Description of Artificial Sequence: Synthetic oligonucleotide
aggccctgacggagacctggcc

SEQ ID NO: 353405 - DNA, 22 bp, Artificial Sequence
  Description of Artificial Sequence: Synthetic oligonucleotide
cagggtctcaggccccgaaggc

SEQ ID NO: 353406 - DNA, 21 bp, Artificial Sequence
  Description of Artificial Sequence: Synthetic oligonucleotide
ggccctgacggagacctggcc

SEQ ID NO: 353407 - DNA, 22 bp, Artificial Sequence
  Description of Artificial Sequence: Synthetic oligonucleotide
agggtctcaggccccgaaggcg

SEQ ID NO: 353408 - DNA, 21 bp, Artificial Sequence
  Description of Artificial Sequence: Synthetic oligonucleotide
gccctgacggagacctggccc

SEQ ID NO: 353409 - DNA, 21 bp, Artificial Sequence
  Description of Artificial Sequence: Synthetic oligonucleotide
gggtctcaggccccgaaggcg

SEQ ID NO: 353410 - DNA, 21 bp, Artificial Sequence
  Description of Artificial Sequence: Synthetic oligonucleotide
ccctgacggagacctggcccg

SEQ ID NO: 353411 - DNA, 22 bp, Artificial Sequence
  Description of Artificial Sequence: Synthetic oligonucleotide
ggtctcaggccccgaaggcggt

SEQ ID NO: 353412 - DNA, 21 bp, Artificial Sequence
  Description of Artificial Sequence: Synthetic oligonucleotide
cctgacggagacctggcccgg

SEQ ID NO: 353413 - DNA, 25 bp, Artificial Sequence
  Description of Artificial Sequence: Synthetic oligonucleotide
gtctcaggccccgaaggcggtgtat

SEQ ID NO: 353414 - DNA, 22 bp, Artificial Sequence
  Description of Artificial Sequence: Synthetic oligonucleotide
ctgacggagacctggcccggct

SEQ ID NO: 353415 - DNA, 25 bp, Artificial Sequence
  Description of Artificial Sequence: Synthetic oligonucleotide
tctcaggccccgaaggcggtgtatg

SEQ ID NO: 353416 - DNA, 22 bp, Artificial Sequence
  Description of Artificial Sequence: Synthetic oligonucleotide
tgacggagacctggcccggctc

SEQ ID NO: 353417 - DNA, 24 bp, Artificial Sequence
  Description of Artificial Sequence: Synthetic oligonucleotide
ctcaggccccgaaggcggtgtatg

SEQ ID NO: 353418 - DNA, 21 bp, Artificial Sequence
  Description of Artificial Sequence: Synthetic oligonucleotide
gacggagacctggcccggctc

SEQ ID NO: 353419 - DNA, 27 bp, Artificial Sequence
  Description of Artificial Sequence: Synthetic oligonucleotide
tcaggccccgaaggcggtgtatggatt

SEQ ID NO: 353420 - DNA, 21 bp, Artificial Sequence
  Description of Artificial Sequence: Synthetic oligonucleotide
acggagacctggcccggctcc

SEQ ID NO: 353421 - DNA, 26 bp, Artificial Sequence
  Description of Artificial Sequence: Synthetic oligonucleotide
caggccccgaaggcggtgtatggatt

SEQ ID NO: 353422 - DNA, 20 bp, Artificial Sequence
  Description of Artificial Sequence: Synthetic oligonucleotide
cggagacctggcccggctcc

SEQ ID NO: 353423 - DNA, 26 bp, Artificial Sequence
  Description of Artificial Sequence: Synthetic oligonucleotide
aggccccgaaggcggtgtatggattg

SEQ ID NO: 353424 - DNA, 21 bp, Artificial Sequence
  Description of Artificial Sequence: Synthetic oligonucleotide
ggagacctggcccggctccct

SEQ ID NO: 353425 - DNA, 25 bp, Artificial Sequence
  Description of Artificial Sequence: Synthetic oligonucleotide
ggccccgaaggcggtgtatggattg

SEQ ID NO: 353426 - DNA, 22 bp, Artificial Sequence
  Description of Artificial Sequence: Synthetic oligonucleotide
gagacctggcccggctccctct

SEQ ID NO: 353427 - DNA, 25 bp, Artificial Sequence
  Description of Artificial Sequence: Synthetic oligonucleotide
gccccgaaggcggtgtatggattgg

SEQ ID NO: 353428 - DNA, 22 bp, Artificial Sequence
  Description of Artificial Sequence: Synthetic oligonucleotide
agacctggcccggctccctctc

SEQ ID NO: 353429 - DNA, 25 bp, Artificial Sequence
  Description of Artificial Sequence: Synthetic oligonucleotide
ccccgaaggcggtgtatggattggg

SEQ ID NO: 353430 - DNA, 21 bp, Artificial Sequence
  Description of Artificial Sequence: Synthetic oligonucleotide
gacctggcccggctccctctc

SEQ ID NO: 353431 - DNA, 26 bp, Artificial Sequence
  Description of Artificial Sequence: Synthetic oligonucleotide
cccgaaggcggtgtatggattgggga

SEQ ID NO: 353432 - DNA, 23 bp, Artificial Sequence
  Description of Artificial Sequence: Synthetic oligonucleotide
acctggcccggctccctctccat

SEQ ID NO: 353433 - DNA, 27 bp, Artificial Sequence
  Description of Artificial Sequence: Synthetic oligonucleotide
ccgaaggcggtgtatggattggggagt

SEQ ID NO: 353434 - DNA, 22 bp, Artificial Sequence
  Description of Artificial Sequence: Synthetic oligonucleotide
cctggcccggctccctctccat

SEQ ID NO: 353435 - DNA, 27 bp, Artificial Sequence
  Description of Artificial Sequence: Synthetic oligonucleotide
cgaaggcggtgtatggattggggagtc

SEQ ID NO: 353436 - DNA, 23 bp, Artificial Sequence
  Description of Artificial Sequence: Synthetic oligonucleotide
ctggcccggctccctctccatga

SEQ ID NO: 353437 - DNA, 27 bp, Artificial Sequence
  Description of Artificial Sequence: Synthetic oligonucleotide
gaaggcggtgtatggattggggagtcc

SEQ ID NO: 353438 - DNA, 23 bp, Artificial Sequence
  Description of Artificial Sequence: Synthetic oligonucleotide
tggcccggctccctctccatgag

SEQ ID NO: 353439 - DNA, 27 bp, Artificial Sequence
  Description of Artificial Sequence: Synthetic oligonucleotide
aaggcggtgtatggattggggagtccc

SEQ ID NO: 353440 - DNA, 22 bp, Artificial Sequence
  Description of Artificial Sequence: Synthetic oligonucleotide
ggcccggctccctctccatgag

SEQ ID NO: 353441 - DNA, 27 bp, Artificial Sequence
  Description of Artificial Sequence: Synthetic oligonucleotide
aggcggtgtatggattggggagtccca

SEQ ID NO: 353442 - DNA, 27 bp, Artificial Sequence
  Description of Artificial Sequence: Synthetic oligonucleotide
gcccggctccctctccatgagctattt

SEQ ID NO: 353443 - DNA, 26 bp, Artificial Sequence
  Description of Artificial Sequence: Synthetic oligonucleotide
ggcggtgtatggattggggagtccca

SEQ ID NO: 353444 - DNA, 27 bp, Artificial Sequence
  Description of Artificial Sequence: Synthetic oligonucleotide
cccggctccctctccatgagctatttc

SEQ ID NO: 353445 - DNA, 26 bp, Artificial Sequence
  Description of Artificial Sequence: Synthetic oligonucleotide
gcggtgtatggattggggagtcccag

SEQ ID NO: 353446 - DNA, 29 bp, Artificial Sequence
  Description of Artificial Sequence: Synthetic oligonucleotide
ccggctccctctccatgagctatttctag

SEQ ID NO: 353447 - DNA, 26 bp, Artificial Sequence
  Description of Artificial Sequence: Synthetic oligonucleotide
cggtgtatggattggggagtcccagc

SEQ ID NO: 353448 - DNA, 30 bp, Artificial Sequence; identical to SEQ ID NO: 231330
  Description of Artificial Sequence: Synthetic oligonucleotide

SEQ ID NO: 353449 - DNA, 27 bp, Artificial Sequence
  Description of Artificial Sequence: Synthetic oligonucleotide
ggtgtatggattggggagtcccagcct

SEQ ID NO: 353450 - DNA, 30 bp, Artificial Sequence; identical to SEQ ID NO: 231331
  Description of Artificial Sequence: Synthetic oligonucleotide

SEQ ID NO: 353451 - DNA, 28 bp, Artificial Sequence
  Description of Artificial Sequence: Synthetic oligonucleotide
gtgtatggattggggagtcccagccttg

SEQ ID NO: 353452 - DNA, 30 bp, Artificial Sequence; identical to SEQ ID NO: 231332
  Description of Artificial Sequence: Synthetic oligonucleotide

SEQ ID NO: 353453 - DNA, 28 bp, Artificial Sequence
  Description of Artificial Sequence: Synthetic oligonucleotide
tgtatggattggggagtcccagccttgg

SEQ ID NO: 353454 - DNA, 30 bp, Artificial Sequence; identical to SEQ ID NO: 231333
  Description of Artificial Sequence: Synthetic oligonucleotide

SEQ ID NO: 353455 - DNA, 27 bp, Artificial Sequence
  Description of Artificial Sequence: Synthetic oligonucleotide
gtatggattggggagtcccagccttgg

SEQ ID NO: 353456 - DNA, 30 bp, Artificial Sequence; identical to SEQ ID NO: 231334
  Description of Artificial Sequence: Synthetic oligonucleotide

SEQ ID NO: 353457 - DNA, 27 bp, Artificial Sequence
  Description of Artificial Sequence: Synthetic oligonucleotide
tatggattggggagtcccagccttggg

SEQ ID NO: 353458 - DNA, 29 bp, Artificial Sequence
  Description of Artificial Sequence: Synthetic oligonucleotide
ccctctccatgagctatttctagaccgcc

SEQ ID NO: 353459 - DNA, 26 bp, Artificial Sequence
  Description of Artificial Sequence: Synthetic oligonucleotide
atggattggggagtcccagccttggg

SEQ ID NO: 353460 - DNA, 29 bp, Artificial Sequence
  Description of Artificial Sequence: Synthetic oligonucleotide
cctctccatgagctatttctagaccgccg

SEQ ID NO: 353461 - DNA, 25 bp, Artificial Sequence
  Description of Artificial Sequence: Synthetic oligonucleotide
tggattggggagtcccagccttggg

SEQ ID NO: 353462 - DNA, 30 bp, Artificial Sequence; identical to SEQ ID NO: 231337
  Description of Artificial Sequence: Synthetic oligonucleotide

SEQ ID NO: 353463 - DNA, 24 bp, Artificial Sequence
  Description of Artificial Sequence: Synthetic oligonucleotide
ggattggggagtcccagccttggg

SEQ ID NO: 353464 - DNA, 31 bp, Artificial Sequence; identical to SEQ ID NO: 231338
  Description of Artificial Sequence: Synthetic oligonucleotide

SEQ ID NO: 353465 - DNA, 27 bp, Artificial Sequence
  Description of Artificial Sequence: Synthetic oligonucleotide
gattggggagtcccagccttggggatt

SEQ ID NO: 353466 - DNA, 30 bp, Artificial Sequence; identical to SEQ ID NO: 231339
  Description of Artificial Sequence: Synthetic oligonucleotide

SEQ ID NO: 353467 - DNA, 27 bp, Artificial Sequence
  Description of Artificial Sequence: Synthetic oligonucleotide
attggggagtcccagccttggggattc

SEQ ID NO: 353468 - DNA, 30 bp, Artificial Sequence; identical to SEQ ID NO: 231340
  Description of Artificial Sequence: Synthetic oligonucleotide

SEQ ID NO: 353469 - DNA, 26 bp, Artificial Sequence
  Description of Artificial Sequence: Synthetic oligonucleotide
ttggggagtcccagccttggggattc

SEQ ID NO: 353470 - DNA, 29 bp, Artificial Sequence
  Description of Artificial Sequence: Synthetic oligonucleotide
ccatgagctatttctagaccgccgtgtgc

SEQ ID NO: 353471 - DNA, 25 bp, Artificial Sequence
  Description of Artificial Sequence: Synthetic oligonucleotide
tggggagtcccagccttggggattc

SEQ ID NO: 353472 - DNA, 29 bp, Artificial Sequence
  Description of Artificial Sequence: Synthetic oligonucleotide
catgagctatttctagaccgccgtgtgcc

SEQ ID NO: 353473 - DNA, 24 bp, Artificial Sequence
  Description of Artificial Sequence: Synthetic oligonucleotide
ggggagtcccagccttggggattc

SEQ ID NO: 353474 - DNA, 29 bp, Artificial Sequence
  Description of Artificial Sequence: Synthetic oligonucleotide
atgagctatttctagaccgccgtgtgccg

SEQ ID NO: 353475 - DNA, 24 bp, Artificial Sequence
  Description of Artificial Sequence: Synthetic oligonucleotide
gggagtcccagccttggggattcc

SEQ ID NO: 353476 - DNA, 28 bp, Artificial Sequence
  Description of Artificial Sequence: Synthetic oligonucleotide
tgagctatttctagaccgccgtgtgccg

SEQ ID NO: 353477 - DNA, 24 bp, Artificial Sequence
  Description of Artificial Sequence: Synthetic oligonucleotide
ggagtcccagccttggggattccc

SEQ ID NO: 353478 - DNA, 27 bp, Artificial Sequence
  Description of Artificial Sequence: Synthetic oligonucleotide
gagctatttctagaccgccgtgtgccg

SEQ ID NO: 353479 - DNA, 26 bp, Artificial Sequence
  Description of Artificial Sequence: Synthetic oligonucleotide
gagtcccagccttggggattccccaa

SEQ ID NO: 353480 - DNA, 27 bp, Artificial Sequence
  Description of Artificial Sequence: Synthetic oligonucleotide
agctatttctagaccgccgtgtgccgg

SEQ ID NO: 353481 - DNA, 27 bp, Artificial Sequence
  Description of Artificial Sequence: Synthetic oligonucleotide
agtcccagccttggggattccccaact

SEQ ID NO: 353482 - DNA, 26 bp, Artificial Sequence
  Description of Artificial Sequence: Synthetic oligonucleotide
gctatttctagaccgccgtgtgccgg

SEQ ID NO: 353483 - DNA, 26 bp, Artificial Sequence
  Description of Artificial Sequence: Synthetic oligonucleotide
gtcccagccttggggattccccaact

SEQ ID NO: 353484 - DNA, 26 bp, Artificial Sequence
  Description of Artificial Sequence: Synthetic oligonucleotide
ctatttctagaccgccgtgtgccggc

SEQ ID NO: 353485 - DNA, 26 bp, Artificial Sequence
  Description of Artificial Sequence: Synthetic oligonucleotide
tcccagccttggggattccccaactc

SEQ ID NO: 353486 - DNA, 26 bp, Artificial Sequence
  Description of Artificial Sequence: Synthetic oligonucleotide
tatttctagaccgccgtgtgccggcc

SEQ ID NO: 353487 - DNA, 25 bp, Artificial Sequence
  Description of Artificial Sequence: Synthetic oligonucleotide
cccagccttggggattccccaactc

SEQ ID NO: 353488 - DNA, 25 bp, Artificial Sequence
  Description of Artificial Sequence: Synthetic oligonucleotide
atttctagaccgccgtgtgccggcc

SEQ ID NO: 353489 - DNA, 25 bp, Artificial Sequence
  Description of Artificial Sequence: Synthetic oligonucleotide
ccagccttggggattccccaactcc

SEQ ID NO: 353490 - DNA, 24 bp, Artificial Sequence
  Description of Artificial Sequence: Synthetic oligonucleotide
tttctagaccgccgtgtgccggcc

SEQ ID NO: 353491 - DNA, 25 bp, Artificial Sequence
  Description of Artificial Sequence: Synthetic oligonucleotide
cagccttggggattccccaactccg

SEQ ID NO: 353492 - DNA, 23 bp, Artificial Sequence
  Description of Artificial Sequence: Synthetic oligonucleotide
ttctagaccgccgtgtgccggcc

SEQ ID NO: 353493 - DNA, 26 bp, Artificial Sequence
  Description of Artificial Sequence: Synthetic oligonucleotide
agccttggggattccccaactccgca

SEQ ID NO: 353494 - DNA, 22 bp, Artificial Sequence
  Description of Artificial Sequence: Synthetic oligonucleotide
tctagaccgccgtgtgccggcc

SEQ ID NO: 353495 - DNA, 25 bp, Artificial Sequence
  Description of Artificial Sequence: Synthetic oligonucleotide
gccttggggattccccaactccgca

SEQ ID NO: 353496 - DNA, 21 bp, Artificial Sequence
  Description of Artificial Sequence: Synthetic oligonucleotide
ctagaccgccgtgtgccggcc

SEQ ID NO: 353497 - DNA, 27 bp, Artificial Sequence
  Description of Artificial Sequence: Synthetic oligonucleotide
ccttggggattccccaactccgcagtt

SEQ ID NO: 353498 - DNA, 21 bp, Artificial Sequence
  Description of Artificial Sequence: Synthetic oligonucleotide
tagaccgccgtgtgccggccc

SEQ ID NO: 353499 - DNA, 28 bp, Artificial Sequence
  Description of Artificial Sequence: Synthetic oligonucleotide
cttggggattccccaactccgcagtttc

SEQ ID NO: 353500 - DNA, 20 bp, Artificial Sequence
  Description of Artificial Sequence: Synthetic oligonucleotide
agaccgccgtgtgccggccc

SEQ ID NO: 353501 - DNA, 32 bp, Artificial Sequence
  Description of Artificial Sequence: Synthetic oligonucleotide
ttggggattccccaactccgcagtttcttttc

SEQ ID NO: 353502 - DNA, 20 bp, Artificial Sequence
  Description of Artificial Sequence: Synthetic oligonucleotide
gaccgccgtgtgccggccct

SEQ ID NO: 353503 - DNA, 31 bp, Artificial Sequence
  Description of Artificial Sequence: Synthetic oligonucleotide
tggggattccccaactccgcagtttcttttc

SEQ ID NO: 353504 - DNA, 20 bp, Artificial Sequence
  Description of Artificial Sequence: Synthetic oligonucleotide
accgccgtgtgccggcccgt

SEQ ID NO: 353505 - DNA, 30 bp, Artificial Sequence
  Description of Artificial Sequence: Synthetic oligonucleotide
ggggattccccaactccgcagtttcttttc

SEQ ID NO: 353506 - DNA, 20 bp, Artificial Sequence
  Description of Artificial Sequence: Synthetic oligonucleotide
ccgccgtgtgccggcccgtt

SEQ ID NO: 353507 - DNA, 31 bp, Artificial Sequence
  Description of Artificial Sequence: Synthetic oligonucleotide
gggattccccaactccgcagtttcttttctc

SEQ ID NO: 353508 - DNA, 20 bp, Artificial Sequence
  Description of Artificial Sequence: Synthetic oligonucleotide
cgccgtgtgccggcccggtt

SEQ ID NO: 353509 - DNA, 31 bp, Artificial Sequence
  Description of Artificial Sequence: Synthetic oligonucleotide
ggattccccaactccgcagtttcttttctcc

SEQ ID NO: 353510 - DNA, 20 bp, Artificial Sequence
  Description of Artificial Sequence: Synthetic oligonucleotide
gccgtgtgccggcccgggtt

SEQ ID NO: 353511 - DNA, 31 bp, Artificial Sequence
  Description of Artificial Sequence: Synthetic oligonucleotide
gattccccaactccgcagtttcttttctccc

SEQ ID NO: 353512 - DNA, 20 bp, Artificial Sequence
  Description of Artificial Sequence: Synthetic oligonucleotide
ccgtgtgccggcccgggctt

SEQ ID NO: 353513 - DNA, 32 bp, Artificial Sequence
  Description of Artificial Sequence: Synthetic oligonucleotide
attccccaactccgcagtttcttttctccctc

SEQ ID NO: 353514 - DNA, 20 bp, Artificial Sequence
  Description of Artificial Sequence: Synthetic oligonucleotide
cgtgtgccggcccgggcgtt

SEQ ID NO: 353515 - DNA, 31 bp, Artificial Sequence
  Description of Artificial Sequence: Synthetic oligonucleotide
ttccccaactccgcagtttcttttctccctc

SEQ ID NO: 353516 - DNA, 20 bp, Artificial Sequence
  Description of Artificial Sequence: Synthetic oligonucleotide
gtgtgccggcccgggcgctt

SEQ ID NO: 353517 - DNA, 30 bp, Artificial Sequence
  Description of Artificial Sequence: Synthetic oligonucleotide
tccccaactccgcagtttcttttctccctc

SEQ ID NO: 353518 - DNA, 20 bp, Artificial Sequence
  Description of Artificial Sequence: Synthetic oligonucleotide
tgtgccggcccgggcgcgtt

SEQ ID NO: 353519 - DNA, 29 bp, Artificial Sequence
  Description of Artificial Sequence: Synthetic oligonucleotide
ccccaactccgcagtttcttttctccctc

SEQ ID NO: 353520 - DNA, 20 bp, Artificial Sequence
  Description of Artificial Sequence: Synthetic oligonucleotide
gtgccggcccgggcgcgttt

SEQ ID NO: 353521 - DNA, 30 bp, Artificial Sequence
  Description of Artificial Sequence: Synthetic oligonucleotide
cccaactccgcagtttcttttctccctctc

SEQ ID NO: 353522 - DNA, 20 bp, Artificial Sequence
  Description of Artificial Sequence: Synthetic oligonucleotide
tgccggcccgggcgcggttt

SEQ ID NO: 353523 - DNA, 30 bp, Artificial Sequence
  Description of Artificial Sequence: Synthetic oligonucleotide
ccaactccgcagtttcttttctccctctcc

SEQ ID NO: 353524 - DNA, 20 bp, Artificial Sequence
  Description of Artificial Sequence: Synthetic oligonucleotide
gccggcccgggcgcggtttt

SEQ ID NO: 353525 - DNA, 30 bp, Artificial Sequence
  Description of Artificial Sequence: Synthetic oligonucleotide
caactccgcagtttcttttctccctctccc

SEQ ID NO: 353526 - DNA, 20 bp, Artificial Sequence
  Description of Artificial Sequence: Synthetic oligonucleotide
gcccgggcgcggggaggttt

SEQ ID NO: 353527 - DNA, 32 bp, Artificial Sequence
  Description of Artificial Sequence: Synthetic oligonucleotide
aactccgcagtttcttttctccctctcccaac

SEQ ID NO: 353528 - DNA, 20 bp, Artificial Sequence
  Description of Artificial Sequence: Synthetic oligonucleotide
cccgggcgcggggaggcttt

SEQ ID NO: 353529 - DNA, 31 bp, Artificial Sequence
  Description of Artificial Sequence: Synthetic oligonucleotide
actccgcagtttcttttctccctctcccaac

SEQ ID NO: 353530 - DNA, 20 bp, Artificial Sequence
  Description of Artificial Sequence: Synthetic oligonucleotide
ccgggcgcggggaggccttt

SEQ ID NO: 353531 - DNA, 30 bp, Artificial Sequence
  Description of Artificial Sequence: Synthetic oligonucleotide
ctccgcagtttcttttctccctctcccaac

SEQ ID NO: 353532 - DNA, 20 bp, Artificial Sequence
  Description of Artificial Sequence: Synthetic oligonucleotide
cgggcgcggggaggcccttt

SEQ ID NO: 353533 - DNA, 30 bp, Artificial Sequence
  Description of Artificial Sequence: Synthetic oligonucleotide
tccgcagtttcttttctccctctcccaacc

SEQ ID NO: 353534 - DNA, 20 bp, Artificial Sequence
  Description of Artificial Sequence: Synthetic oligonucleotide
gggcgcggggaggcccgttt

SEQ ID NO: 353535 - DNA, 29 bp, Artificial Sequence
  Description of Artificial Sequence: Synthetic oligonucleotide
ccgcagtttcttttctccctctcccaacc

SEQ ID NO: 353536 - DNA, 20 bp, Artificial Sequence
  Description of Artificial Sequence: Synthetic oligonucleotide
ggcgcggggaggcccgcttt

SEQ ID NO: 353537 - DNA, 31 bp, Artificial Sequence
  Description of Artificial Sequence: Synthetic oligonucleotide
cgcagtttcttttctccctctcccaacctac

SEQ ID NO: 353538 - DNA, 21 bp, Artificial Sequence
  Description of Artificial Sequence: Synthetic oligonucleotide
gcgcggggaggcccgcttcaa

SEQ ID NO: 353539 - DNA, 31 bp, Artificial Sequence
  Description of Artificial Sequence: Synthetic oligonucleotide
gcagtttcttttctccctctcccaacctacg

SEQ ID NO: 353540 - DNA, 21 bp, Artificial Sequence
  Description of Artificial Sequence: Synthetic oligonucleotide
cgcggggaggcccgcttcaac

SEQ ID NO: 353541 - DNA, 33 bp, Artificial Sequence
  Description of Artificial Sequence: Synthetic oligonucleotide
cagtttcttttctccctctcccaacctacgtag

SEQ ID NO: 353542 - DNA, 21 bp, Artificial Sequence
  Description of Artificial Sequence: Synthetic oligonucleotide
gcggggaggcccgcttcaacg

SEQ ID NO: 353543 - DNA, 33 bp, Artificial Sequence
  Description of Artificial Sequence: Synthetic oligonucleotide
agtttcttttctccctctcccaacctacgtagg

SEQ ID NO: 353544 - DNA, 22 bp, Artificial Sequence
  Description of Artificial Sequence: Synthetic oligonucleotide
cggggaggcccgcttcaacgca

SEQ ID NO: 353545 - DNA, 32 bp, Artificial Sequence
  Description of Artificial Sequence: Synthetic oligonucleotide
gtttcttttctccctctcccaacctacgtagg

SEQ ID NO: 353546 - DNA, 23 bp, Artificial Sequence
  Description of Artificial Sequence: Synthetic oligonucleotide
ggggaggcccgcttcaacgcagt

SEQ ID NO: 353547 - DNA, 32 bp, Artificial Sequence
  Description of Artificial Sequence: Synthetic oligonucleotide
tttcttttctccctctcccaacctacgtaggg

SEQ ID NO: 353548 - DNA, 23 bp, Artificial Sequence
  Description of Artificial Sequence: Synthetic oligonucleotide
gggaggcccgcttcaacgcagtg

SEQ ID NO: 353549 - DNA, 31 bp, Artificial Sequence
  Description of Artificial Sequence: Synthetic oligonucleotide
ttcttttctccctctcccaacctacgtaggg

SEQ ID NO: 353550 - DNA, 23 bp, Artificial Sequence
  Description of Artificial Sequence: Synthetic oligonucleotide
ggaggcccgcttcaacgcagtgg

SEQ ID NO: 353551 - DNA, 30 bp, Artificial Sequence
  Description of Artificial Sequence: Synthetic oligonucleotide
tcttttctccctctcccaacctacgtaggg

SEQ ID NO: 353552 - DNA, 23 bp, Artificial Sequence
  Description of Artificial Sequence: Synthetic oligonucleotide
gaggcccgcttcaacgcagtggg

SEQ ID NO: 353553 - DNA, 29 bp, Artificial Sequence
  Description of Artificial Sequence: Synthetic oligonucleotide
cttttctccctctcccaacctacgtaggg

SEQ ID NO: 353554 - DNA, 25 bp, Artificial Sequence
  Description of Artificial Sequence: Synthetic oligonucleotide
aggcccgcttcaacgcagtgggcaa

SEQ ID NO: 353555 - DNA, 30 bp, Artificial Sequence
  Description of Artificial Sequence: Synthetic oligonucleotide
ttttctccctctcccaacctacgtagggtc

SEQ ID NO: 353556 - DNA, 24 bp, Artificial Sequence
  Description of Artificial Sequence: Synthetic oligonucleotide
ggcccgcttcaacgcagtgggcaa

SEQ ID NO: 353557 - DNA, 29 bp, Artificial Sequence
  Description of Artificial Sequence: Synthetic oligonucleotide
tttctccctctcccaacctacgtagggtc

SEQ ID NO: 353558 - DNA, 24 bp, Artificial Sequence
  Description of Artificial Sequence: Synthetic oligonucleotide
gcccgcttcaacgcagtgggcaac

SEQ ID NO: 353559 - DNA, 28 bp, Artificial Sequence
  Description of Artificial Sequence: Synthetic oligonucleotide
ttctccctctcccaacctacgtagggtc

SEQ ID NO: 353560 - DNA, 25 bp, Artificial Sequence
  Description of Artificial Sequence: Synthetic oligonucleotide
cccgcttcaacgcagtgggcaacgt

SEQ ID NO: 353561 - DNA, 27 bp, Artificial Sequence
  Description of Artificial Sequence: Synthetic oligonucleotide
tctccctctcccaacctacgtagggtc

SEQ ID NO: 353562 - DNA, 25 bp, Artificial Sequence
  Description of Artificial Sequence: Synthetic oligonucleotide
ccgcttcaacgcagtgggcaacgtg

SEQ ID NO: 353563 - DNA, 26 bp, Artificial Sequence
  Description of Artificial Sequence: Synthetic oligonucleotide
ctccctctcccaacctacgtagggtc

SEQ ID NO: 353564 - DNA, 26 bp, Artificial Sequence
  Description of Artificial Sequence: Synthetic oligonucleotide
cgcttcaacgcagtgggcaacgtgga

SEQ ID NO: 353565 - DNA, 27 bp, Artificial Sequence
  Description of Artificial Sequence: Synthetic oligonucleotide
tccctctcccaacctacgtagggtcct

SEQ ID NO: 353566 - DNA, 26 bp, Artificial Sequence
  Description of Artificial Sequence: Synthetic oligonucleotide
gcttcaacgcagtgggcaacgtggag

SEQ ID NO: 353567 - DNA, 27 bp, Artificial Sequence
  Description of Artificial Sequence: Synthetic oligonucleotide
ccctctcccaacctacgtagggtcctt

SEQ ID NO: 353568 - DNA, 27 bp, Artificial Sequence
  Description of Artificial Sequence: Synthetic oligonucleotide
cttcaacgcagtgggcaacgtggagga

SEQ ID NO: 353569 - DNA, 27 bp, Artificial Sequence
  Description of Artificial Sequence: Synthetic oligonucleotide
cctctcccaacctacgtagggtccttc

SEQ ID NO: 353570 - DNA, 27 bp, Artificial Sequence
  Description of Artificial Sequence: Synthetic oligonucleotide
ttcaacgcagtgggcaacgtggaggac

SEQ ID NO: 353571 - DNA, 29 bp, Artificial Sequence
  Description of Artificial Sequence: Synthetic oligonucleotide
ctctcccaacctacgtagggtccttcatc

SEQ ID NO: 353572 - DNA, 27 bp, Artificial Sequence
  Description of Artificial Sequence: Synthetic oligonucleotide
tcaacgcagtgggcaacgtggaggaca

SEQ ID NO: 353573 - DNA, 29 bp, Artificial Sequence
  Description of Artificial Sequence: Synthetic oligonucleotide
tctcccaacctacgtagggtccttcatcc

SEQ ID NO: 353574 - DNA, 26 bp, Artificial Sequence
  Description of Artificial Sequence: Synthetic oligonucleotide
caacgcagtgggcaacgtggaggaca

SEQ ID NO: 353575 - DNA, 28 bp, Artificial Sequence
  Description of Artificial Sequence: Synthetic oligonucleotide
ctcccaacctacgtagggtccttcatcc

SEQ ID NO: 353576 - DNA, 26 bp, Artificial Sequence
  Description of Artificial Sequence: Synthetic oligonucleotide
aacgcagtgggcaacgtggaggacac

SEQ ID NO: 353577 - DNA, 29 bp, Artificial Sequence
  Description of Artificial Sequence: Synthetic oligonucleotide
tcccaacctacgtagggtccttcatcctg

SEQ ID NO: 353578 - DNA, 25 bp, Artificial Sequence
  Description of Artificial Sequence: Synthetic oligonucleotide
acgcagtgggcaacgtggaggacac

SEQ ID NO: 353579 - DNA, 28 bp, Artificial Sequence
  Description of Artificial Sequence: Synthetic oligonucleotide
cccaacctacgtagggtccttcatcctg

SEQ ID NO: 353580 - DNA, 24 bp, Artificial Sequence
  Description of Artificial Sequence: Synthetic oligonucleotide
cgcagtgggcaacgtggaggacac

SEQ ID NO: 353581 - DNA, 28 bp, Artificial Sequence
  Description of Artificial Sequence: Synthetic oligonucleotide
ccaacctacgtagggtccttcatcctgg

SEQ ID NO: 353582 - DNA, 24 bp, Artificial Sequence
  Description of Artificial Sequence: Synthetic oligonucleotide
gcagtgggcaacgtggaggacacg

SEQ ID NO: 353583 - DNA, 31 bp, Artificial Sequence
  Description of Artificial Sequence: Synthetic oligonucleotide
caacctacgtagggtccttcatcctggatac

SEQ ID NO: 353584 - DNA, 25 bp, Artificial Sequence
  Description of Artificial Sequence: Synthetic oligonucleotide
cagtgggcaacgtggaggacacgca

SEQ ID NO: 353585 - DNA, 32 bp, Artificial Sequence
  Description of Artificial Sequence: Synthetic oligonucleotide
aacctacgtagggtccttcatcctggatactc

SEQ ID NO: 353586 - DNA, 27 bp, Artificial Sequence
  Description of Artificial Sequence: Synthetic oligonucleotide
agtgggcaacgtggaggacacgcagta

SEQ ID NO: 353587 - DNA, 31 bp, Artificial Sequence
  Description of Artificial Sequence: Synthetic oligonucleotide
acctacgtagggtccttcatcctggatactc

SEQ ID NO: 353588 - DNA, 26 bp, Artificial Sequence
  Description of Artificial Sequence: Synthetic oligonucleotide
gtgggcaacgtggaggacacgcagta

SEQ ID NO: 353589 - DNA, 30 bp, Artificial Sequence
  Description of Artificial Sequence: Synthetic oligonucleotide
cctacgtagggtccttcatcctggatactc

SEQ ID NO: 353590 - DNA, 26 bp, Artificial Sequence
  Description of Artificial Sequence: Synthetic oligonucleotide
tgggcaacgtggaggacacgcagtac

SEQ ID NO: 353591 - DNA, 31 bp, Artificial Sequence
  Description of Artificial Sequence: Synthetic oligonucleotide
ctacgtagggtccttcatcctggatactcac

SEQ ID NO: 353592 - DNA, 25 bp, Artificial Sequence
  Description of Artificial Sequence: Synthetic oligonucleotide
gggcaacgtggaggacacgcagtac

SEQ ID NO: 353593 - DNA, 31 bp, Artificial Sequence
  Description of Artificial Sequence: Synthetic oligonucleotide
tacgtagggtccttcatcctggatactcacg

SEQ ID NO: 353594 - DNA, 26 bp, Artificial Sequence
  Description of Artificial Sequence: Synthetic oligonucleotide
ggcaacgtggaggacacgcagtacgt

SEQ ID NO: 353595 - DNA, 30 bp, Artificial Sequence
  Description of Artificial Sequence: Synthetic oligonucleotide
acgtagggtccttcatcctggatactcacg

SEQ ID NO: 353596 - DNA, 26 bp, Artificial Sequence
  Description of Artificial Sequence: Synthetic oligonucleotide
gcaacgtggaggacacgcagtacgtg

SEQ ID NO: 353597 - DNA, 29 bp, Artificial Sequence
  Description of Artificial Sequence: Synthetic oligonucleotide
cgtagggtccttcatcctggatactcacg

SEQ ID NO: 353598 - DNA, 26 bp, Artificial Sequence
  Description of Artificial Sequence: Synthetic oligonucleotide
caacgtggaggacacgcagtacgtgc

SEQ ID NO: 353599 - DNA, 30 bp, Artificial Sequence
  Description of Artificial Sequence: Synthetic oligonucleotide
gtagggtccttcatcctggatactcacgac

SEQ ID NO: 353600 - DNA, 26 bp, Artificial Sequence
  Description of Artificial Sequence: Synthetic oligonucleotide
aacgtggaggacacgcagtacgtgcg

SEQ ID NO: 353601 - DNA, 30 bp, Artificial Sequence
  Description of Artificial Sequence: Synthetic oligonucleotide
tagggtccttcatcctggatactcacgacg

SEQ ID NO: 353602 - DNA, 25 bp, Artificial Sequence
  Description of Artificial Sequence: Synthetic oligonucleotide
acgtggaggacacgcagtacgtgcg

SEQ ID NO: 353603 - DNA, 29 bp, Artificial Sequence
  Description of Artificial Sequence: Synthetic oligonucleotide
agggtccttcatcctggatactcacgacg

SEQ ID NO: 353604 - DNA, 24 bp, Artificial Sequence
  Description of Artificial Sequence: Synthetic oligonucleotide
cgtggaggacacgcagtacgtgcg

SEQ ID NO: 353605 - DNA, 28 bp, Artificial Sequence
  Description of Artificial Sequence: Synthetic oligonucleotide
gggtccttcatcctggatactcacgacg

SEQ ID NO: 353606 - DNA, 26 bp, Artificial Sequence
  Description of Artificial Sequence: Synthetic oligonucleotide
gtggaggacacgcagtacgtgcggta

SEQ ID NO: 353607 - DNA, 28 bp, Artificial Sequence
  Description of Artificial Sequence: Synthetic oligonucleotide
ggtccttcatcctggatactcacgacgc

SEQ ID NO: 353608 - DNA, 26 bp, Artificial Sequence
  Description of Artificial Sequence: Synthetic oligonucleotide
tggaggacacgcagtacgtgcggtac

SEQ ID NO: 353609 - DNA, 28 bp, Artificial Sequence
  Description of Artificial Sequence: Synthetic oligonucleotide
gtccttcatcctggatactcacgacgcg

SEQ ID NO: 353610 - DNA, 25 bp, Artificial Sequence
  Description of Artificial Sequence: Synthetic oligonucleotide
ggaggacacgcagtacgtgcggtac

SEQ ID NO: 353611 - DNA, 28 bp, Artificial Sequence
  Description of Artificial Sequence: Synthetic oligonucleotide
tccttcatcctggatactcacgacgcgg

SEQ ID NO: 353612 - DNA, 26 bp, Artificial Sequence
  Description of Artificial Sequence: Synthetic oligonucleotide
gaggacacgcagtacgtgcggtacga

SEQ ID NO: 353613 - DNA, 27 bp, Artificial Sequence
  Description of Artificial Sequence: Synthetic oligonucleotide
ccttcatcctggatactcacgacgcgg

SEQ ID NO: 353614 - DNA, 27 bp, Artificial Sequence
  Description of Artificial Sequence: Synthetic oligonucleotide
aggacacgcagtacgtgcggtacgaca

SEQ ID NO: 353615 - DNA, 28 bp, Artificial Sequence
  Description of Artificial Sequence: Synthetic oligonucleotide
cttcatcctggatactcacgacgcggac

SEQ ID NO: 353616 - DNA, 26 bp, Artificial Sequence
  Description of Artificial Sequence: Synthetic oligonucleotide
ggacacgcagtacgtgcggtacgaca

SEQ ID NO: 353617 - DNA, 28 bp, Artificial Sequence
  Description of Artificial Sequence: Synthetic oligonucleotide
ttcatcctggatactcacgacgcggacc

SEQ ID NO: 353618 - DNA, 26 bp, Artificial Sequence
  Description of Artificial Sequence: Synthetic oligonucleotide
gacacgcagtacgtgcggtacgacag

SEQ ID NO: 353619 - DNA, 27 bp, Artificial Sequence
  Description of Artificial Sequence: Synthetic oligonucleotide
tcatcctggatactcacgacgcggacc

SEQ ID NO: 353620 - DNA, 26 bp, Artificial Sequence
  Description of Artificial Sequence: Synthetic oligonucleotide
acacgcagtacgtgcggtacgacagc

SEQ ID NO: 353621 - DNA, 26 bp, Artificial Sequence
  Description of Artificial Sequence: Synthetic oligonucleotide
catcctggatactcacgacgcggacc

SEQ ID NO: 353622 - DNA, 25 bp, Artificial Sequence
  Description of Artificial Sequence: Synthetic oligonucleotide
cacgcagtacgtgcggtacgacagc

SEQ ID NO: 353623 - DNA, 27 bp, Artificial Sequence
  Description of Artificial Sequence: Synthetic oligonucleotide
atcctggatactcacgacgcggaccca

SEQ ID NO: 353624 - DNA, 26 bp, Artificial Sequence
  Description of Artificial Sequence: Synthetic oligonucleotide
acgcagtacgtgcggtacgacagcga

SEQ ID NO: 353625 - DNA, 26 bp, Artificial Sequence
  Description of Artificial Sequence: Synthetic oligonucleotide
tcctggatactcacgacgcggaccca

SEQ ID NO: 353626 - DNA, 25 bp, Artificial Sequence
  Description of Artificial Sequence: Synthetic oligonucleotide
cgcagtacgtgcggtacgacagcga

SEQ ID NO: 353627 - DNA, 25 bp, Artificial Sequence
  Description of Artificial Sequence: Synthetic oligonucleotide
cctggatactcacgacgcggaccca

SEQ ID NO: 353628 - DNA, 25 bp, Artificial Sequence
  Description of Artificial Sequence: Synthetic oligonucleotide
gcagtacgtgcggtacgacagcgag

SEQ ID NO: 353629 - DNA, 27 bp, Artificial Sequence
  Description of Artificial Sequence: Synthetic oligonucleotide
ctggatactcacgacgcggacccagtt

SEQ ID NO: 353630 - DNA, 25 bp, Artificial Sequence
  Description of Artificial Sequence: Synthetic oligonucleotide
cagtacgtgcggtacgacagcgagg

SEQ ID NO: 353631 - DNA, 27 bp, Artificial Sequence
  Description of Artificial Sequence: Synthetic oligonucleotide
tggatactcacgacgcggacccagttc

SEQ ID NO: 353632 - DNA, 25 bp, Artificial Sequence
  Description of Artificial Sequence: Synthetic oligonucleotide
agtacgtgcggtacgacagcgaggc

SEQ ID NO: 353633 - DNA, 27 bp, Artificial Sequence
  Description of Artificial Sequence: Synthetic oligonucleotide
ggatactcacgacgcggacccagttct

SEQ ID NO: 353634 - DNA, 24 bp, Artificial Sequence
  Description of Artificial Sequence: Synthetic oligonucleotide
gtacgtgcggtacgacagcgaggc

SEQ ID NO: 353635 - DNA, 27 bp, Artificial Sequence
  Description of Artificial Sequence: Synthetic oligonucleotide
gatactcacgacgcggacccagttctc

SEQ ID NO: 353636 - DNA, 24 bp, Artificial Sequence
  Description of Artificial Sequence: Synthetic oligonucleotide
tacgtgcggtacgacagcgaggcc

SEQ ID NO: 353637 - DNA, 28 bp, Artificial Sequence
  Description of Artificial Sequence: Synthetic oligonucleotide
atactcacgacgcggacccagttctcac

SEQ ID NO: 353638 - DNA, 23 bp, Artificial Sequence
  Description of Artificial Sequence: Synthetic oligonucleotide
acgtgcggtacgacagcgaggcc

SEQ ID NO: 353639 - DNA, 27 bp, Artificial Sequence
  Description of Artificial Sequence: Synthetic oligonucleotide
tactcacgacgcggacccagttctcac

SEQ ID NO: 353640 - DNA, 22 bp, Artificial Sequence
  Description of Artificial Sequence: Synthetic oligonucleotide
cgtgcggtacgacagcgaggcc

SEQ ID NO: 353641 - DNA, 27 bp, Artificial Sequence
  Description of Artificial Sequence: Synthetic oligonucleotide
actcacgacgcggacccagttctcact

SEQ ID NO: 353642 - DNA, 22 bp, Artificial Sequence
  Description of Artificial Sequence: Synthetic oligonucleotide
gtgcggtacgacagcgaggccg

SEQ ID NO: 353643 - DNA, 26 bp, Artificial Sequence
  Description of Artificial Sequence: Synthetic oligonucleotide
ctcacgacgcggacccagttctcact

SEQ ID NO: 353644 - DNA, 22 bp, Artificial Sequence
  Description of Artificial Sequence: Synthetic oligonucleotide
tgcggtacgacagcgaggccgc

SEQ ID NO: 353645 - DNA, 26 bp, Artificial Sequence
  Description of Artificial Sequence: Synthetic oligonucleotide
tcacgacgcggacccagttctcactc

SEQ ID NO: 353646 - DNA, 21 bp, Artificial Sequence
  Description of Artificial Sequence: Synthetic oligonucleotide
gcggtacgacagcgaggccgc

SEQ ID NO: 353647 - DNA, 25 bp, Artificial Sequence
  Description of Artificial Sequence: Synthetic oligonucleotide
cacgacgcggacccagttctcactc

SEQ ID NO: 353648 - DNA, 22 bp, Artificial Sequence
  Description of Artificial Sequence: Synthetic oligonucleotide
cggtacgacagcgaggccgcga

SEQ ID NO: 353649 - DNA, 25 bp, Artificial Sequence
  Description of Artificial Sequence: Synthetic oligonucleotide
acgacgcggacccagttctcactcc

SEQ ID NO: 353650 - DNA, 23 bp, Artificial Sequence
  Description of Artificial Sequence: Synthetic oligonucleotide
ggtacgacagcgaggccgcgagt

SEQ ID NO: 353651 - DNA, 24 bp, Artificial Sequence
  Description of Artificial Sequence: Synthetic oligonucleotide
cgacgcggacccagttctcactcc

SEQ ID NO: 353652 - DNA, 23 bp, Artificial Sequence
  Description of Artificial Sequence: Synthetic oligonucleotide
gtacgacagcgaggccgcgagtg

SEQ ID NO: 353653 - DNA, 27 bp, Artificial Sequence
  Description of Artificial Sequence: Synthetic oligonucleotide
gacgcggacccagttctcactcccatt

SEQ ID NO: 353654 - DNA, 23 bp, Artificial Sequence
  Description of Artificial Sequence: Synthetic oligonucleotide
tacgacagcgaggccgcgagtgc

SEQ ID NO: 353655 - DNA, 27 bp, Artificial Sequence
  Description of Artificial Sequence: Synthetic oligonucleotide
acgcggacccagttctcactcccattg

SEQ ID NO: 353656 - DNA, 22 bp, Artificial Sequence
  Description of Artificial Sequence: Synthetic oligonucleotide
acgacagcgaggccgcgagtgc

SEQ ID NO: 353657 - DNA, 26 bp, Artificial Sequence
  Description of Artificial Sequence: Synthetic oligonucleotide
cgcggacccagttctcactcccattg

SEQ ID NO: 353658 - DNA, 21 bp, Artificial Sequence
  Description of Artificial Sequence: Synthetic oligonucleotide
cgacagcgaggccgcgagtgc

SEQ ID NO: 353659 - DNA, 26 bp, Artificial Sequence
  Description of Artificial Sequence: Synthetic oligonucleotide
gcggacccagttctcactcccattgg

SEQ ID NO: 353660 - DNA, 22 bp, Artificial Sequence
  Description of Artificial Sequence: Synthetic oligonucleotide
gacagcgaggccgcgagtgcga

SEQ ID NO: 353661 - DNA, 27 bp, Artificial Sequence
  Description of Artificial Sequence: Synthetic oligonucleotide
cggacccagttctcactcccattgggt

SEQ ID NO: 353662 - DNA, 22 bp, Artificial Sequence
  Description of Artificial Sequence: Synthetic oligonucleotide
acagcgaggccgcgagtgcgag

SEQ ID NO: 353663 - DNA, 27 bp, Artificial Sequence
  Description of Artificial Sequence: Synthetic oligonucleotide
ggacccagttctcactcccattgggtg

SEQ ID NO: 353664 - DNA, 21 bp, Artificial Sequence
  Description of Artificial Sequence: Synthetic oligonucleotide
cagcgaggccgcgagtgcgag

SEQ ID NO: 353665 - DNA, 28 bp, Artificial Sequence
  Description of Artificial Sequence: Synthetic oligonucleotide
gacccagttctcactcccattgggtgtc

SEQ ID NO: 353666 - DNA, 23 bp, Artificial Sequence
  Description of Artificial Sequence: Synthetic oligonucleotide
agcgaggccgcgagtgcgaggat

SEQ ID NO: 353667 - DNA, 28 bp, Artificial Sequence
  Description of Artificial Sequence: Synthetic oligonucleotide
acccagttctcactcccattgggtgtcg

SEQ ID NO: 353668 - DNA, 22 bp, Artificial Sequence
  Description of Artificial Sequence: Synthetic oligonucleotide
gcgaggccgcgagtgcgaggat

SEQ ID NO: 353669 - DNA, 27 bp, Artificial Sequence
  Description of Artificial Sequence: Synthetic oligonucleotide
cccagttctcactcccattgggtgtcg

SEQ ID NO: 353670 - DNA, 22 bp, Artificial Sequence
  Description of Artificial Sequence: Synthetic oligonucleotide
cgaggccgcgagtgcgaggatg

SEQ ID NO: 353671 - DNA, 27 bp, Artificial Sequence
  Description of Artificial Sequence: Synthetic oligonucleotide
ccagttctcactcccattgggtgtcgg

SEQ ID NO: 353672 - DNA, 23 bp, Artificial Sequence
  Description of Artificial Sequence: Synthetic oligonucleotide
gaggccgcgagtgcgaggatgga

SEQ ID NO: 353673 - DNA, 27 bp, Artificial Sequence
  Description of Artificial Sequence: Synthetic oligonucleotide
cagttctcactcccattgggtgtcggg

SEQ ID NO: 353674 - DNA, 23 bp, Artificial Sequence
  Description of Artificial Sequence: Synthetic oligonucleotide
aggccgcgagtgcgaggatggac

SEQ ID NO: 353675 - DNA, 30 bp, Artificial Sequence
  Description of Artificial Sequence: Synthetic oligonucleotide
agttctcactcccattgggtgtcgggtttc

SEQ ID NO: 353676 - DNA, 22 bp, Artificial Sequence
  Description of Artificial Sequence: Synthetic oligonucleotide
ggccgcgagtgcgaggatggac

SEQ ID NO: 353677 - DNA, 29 bp, Artificial Sequence
  Description of Artificial Sequence: Synthetic oligonucleotide
gttctcactcccattgggtgtcgggtttc

SEQ ID NO: 353678 - DNA, 22 bp, Artificial Sequence
  Description of Artificial Sequence: Synthetic oligonucleotide
gccgcgagtgcgaggatggacc

SEQ ID NO: 353679 - DNA, 29 bp, Artificial Sequence
  Description of Artificial Sequence: Synthetic oligonucleotide
ttctcactcccattgggtgtcgggtttcc

SEQ ID NO: 353680 - DNA, 22 bp, Artificial Sequence
  Description of Artificial Sequence: Synthetic oligonucleotide
ccgcgagtgcgaggatggaccc

SEQ ID NO: 353681 - DNA, 28 bp, Artificial Sequence
  Description of Artificial Sequence: Synthetic oligonucleotide
tctcactcccattgggtgtcgggtttcc

SEQ ID NO: 353682 - DNA, 22 bp, Artificial Sequence
  Description of Artificial Sequence: Synthetic oligonucleotide
cgcgagtgcgaggatggacccg

SEQ ID NO: 353683 - DNA, 27 bp, Artificial Sequence
  Description of Artificial Sequence: Synthetic oligonucleotide
ctcactcccattgggtgtcgggtttcc

SEQ ID NO: 353684 - DNA, 22 bp, Artificial Sequence
  Description of Artificial Sequence: Synthetic oligonucleotide
gcgagtgcgaggatggacccgc

SEQ ID NO: 353685 - DNA, 28 bp, Artificial Sequence
  Description of Artificial Sequence: Synthetic oligonucleotide
tcactcccattgggtgtcgggtttccag

SEQ ID NO: 353686 - DNA, 22 bp, Artificial Sequence
  Description of Artificial Sequence: Synthetic oligonucleotide
cgagtgcgaggatggacccgcg

SEQ ID NO: 353687 - DNA, 27 bp, Artificial Sequence
  Description of Artificial Sequence: Synthetic oligonucleotide
cactcccattgggtgtcgggtttccag

SEQ ID NO: 353688 - DNA, 22 bp, Artificial Sequence
  Description of Artificial Sequence: Synthetic oligonucleotide
gagtgcgaggatggacccgcgg

SEQ ID NO: 353689 - DNA, 28 bp, Artificial Sequence
  Description of Artificial Sequence: Synthetic oligonucleotide
actcccattgggtgtcgggtttccagag

SEQ ID NO: 353690 - DNA, 22 bp, Artificial Sequence
  Description of Artificial Sequence: Synthetic oligonucleotide
agtgcgaggatggacccgcggg

SEQ ID NO: 353691 - DNA, 27 bp, Artificial Sequence
  Description of Artificial Sequence: Synthetic oligonucleotide
ctcccattgggtgtcgggtttccagag

SEQ ID NO: 353692 - DNA, 21 bp, Artificial Sequence
  Description of Artificial Sequence: Synthetic oligonucleotide
gtgcgaggatggacccgcggg

SEQ ID NO: 353693 - DNA, 29 bp, Artificial Sequence
  Description of Artificial Sequence: Synthetic oligonucleotide
tcccattgggtgtcgggtttccagagaag

SEQ ID NO: 353694 - DNA, 21 bp, Artificial Sequence
  Description of Artificial Sequence: Synthetic oligonucleotide
tgcgaggatggacccgcgggc

SEQ ID NO: 353695 - DNA, 28 bp, Artificial Sequence
  Description of Artificial Sequence: Synthetic oligonucleotide
cccattgggtgtcgggtttccagagaag

SEQ ID NO: 353696 - DNA, 20 bp, Artificial Sequence
  Description of Artificial Sequence: Synthetic oligonucleotide
gcgaggatggacccgcgggc

SEQ ID NO: 353697 - DNA, 28 bp, Artificial Sequence
  Description of Artificial Sequence: Synthetic oligonucleotide
ccattgggtgtcgggtttccagagaagc

SEQ ID NO: 353698 - DNA, 20 bp, Artificial Sequence
  Description of Artificial Sequence: Synthetic oligonucleotide
cgaggatggacccgcgggcg

SEQ ID NO: 353699 - DNA, 28 bp, Artificial Sequence
  Description of Artificial Sequence: Synthetic oligonucleotide
cattgggtgtcgggtttccagagaagcc

SEQ ID NO: 353700 - DNA, 20 bp, Artificial Sequence
  Description of Artificial Sequence: Synthetic oligonucleotide
gaggatggacccgcgggcgg

SEQ ID NO: 353701 - DNA, 31 bp, Artificial Sequence
  Description of Artificial Sequence: Synthetic oligonucleotide
attgggtgtcgggtttccagagaagccaatc

SEQ ID NO: 353702 - DNA, 20 bp, Artificial Sequence
  Description of Artificial Sequence: Synthetic oligonucleotide
aggatggacccgcgggcggc

SEQ ID NO: 353703 - DNA, 30 bp, Artificial Sequence
  Description of Artificial Sequence: Synthetic oligonucleotide
ttgggtgtcgggtttccagagaagccaatc

SEQ ID NO: 353704 - DNA, 20 bp, Artificial Sequence
  Description of Artificial Sequence: Synthetic oligonucleotide
ggatggacccgcgggcggct

SEQ ID NO: 353705 - DNA, 29 bp, Artificial Sequence
  Description of Artificial Sequence: Synthetic oligonucleotide
tgggtgtcgggtttccagagaagccaatc

SEQ ID NO: 353706 - DNA, 20 bp, Artificial Sequence
  Description of Artificial Sequence: Synthetic oligonucleotide
gatggacccgcgggcggcgt

SEQ ID NO: 353707 - DNA, 28 bp, Artificial Sequence
  Description of Artificial Sequence: Synthetic oligonucleotide
gggtgtcgggtttccagagaagccaatc

SEQ ID NO: 353708 - DNA, 20 bp, Artificial Sequence
  Description of Artificial Sequence: Synthetic oligonucleotide
atggacccgcgggcggcgtg

SEQ ID NO: 353709 - DNA, 29 bp, Artificial Sequence
  Description of Artificial Sequence: Synthetic oligonucleotide
ggtgtcgggtttccagagaagccaatcag

SEQ ID NO: 353710 - DNA, 20 bp, Artificial Sequence
  Description of Artificial Sequence: Synthetic oligonucleotide
tggacccgcgggcggcgtgt

SEQ ID NO: 353711 - DNA, 30 bp, Artificial Sequence
  Description of Artificial Sequence: Synthetic oligonucleotide
gtgtcgggtttccagagaagccaatcagtg

SEQ ID NO: 353712 - DNA, 20 bp, Artificial Sequence
  Description of Artificial Sequence: Synthetic oligonucleotide
ggacccgcgggcggcgtgtt

SEQ ID NO: 353713 - DNA, 31 bp, Artificial Sequence
  Description of Artificial Sequence: Synthetic oligonucleotide
tgtcgggtttccagagaagccaatcagtgtc

SEQ ID NO: 353714 - DNA, 21 bp, Artificial Sequence
  Description of Artificial Sequence: Synthetic oligonucleotide
gacccgcgggcggcgtggata

SEQ ID NO: 353715 - DNA, 30 bp, Artificial Sequence
  Description of Artificial Sequence: Synthetic oligonucleotide
gtcgggtttccagagaagccaatcagtgtc

SEQ ID NO: 353716 - DNA, 22 bp, Artificial Sequence
  Description of Artificial Sequence: Synthetic oligonucleotide
acccgcgggcggcgtggatagt

SEQ ID NO: 353717 - DNA, 30 bp, Artificial Sequence
  Description of Artificial Sequence: Synthetic oligonucleotide
tcgggtttccagagaagccaatcagtgtcg

SEQ ID NO: 353718 - DNA, 21 bp, Artificial Sequence
  Description of Artificial Sequence: Synthetic oligonucleotide
cccgcgggcggcgtggatagt

SEQ ID NO: 353719 - DNA, 29 bp, Artificial Sequence
  Description of Artificial Sequence: Synthetic oligonucleotide
cgggtttccagagaagccaatcagtgtcg

SEQ ID NO: 353720 - DNA, 21 bp, Artificial Sequence
  Description of Artificial Sequence: Synthetic oligonucleotide
ccgcgggcggcgtggatagtg

SEQ ID NO: 353721 - DNA, 30 bp, Artificial Sequence
  Description of Artificial Sequence: Synthetic oligonucleotide
gggtttccagagaagccaatcagtgtcgtc

SEQ ID NO: 353722 - DNA, 22 bp, Artificial Sequence
  Description of Artificial Sequence: Synthetic oligonucleotide
cgcgggcggcgtggatagtgca

SEQ ID NO: 353723 - DNA, 30 bp, Artificial Sequence
  Description of Artificial Sequence: Synthetic oligonucleotide
ggtttccagagaagccaatcagtgtcgtcg

SEQ ID NO: 353724 - DNA, 22 bp, Artificial Sequence
  Description of Artificial Sequence: Synthetic oligonucleotide
gcgggcggcgtggatagtgcag

SEQ ID NO: 353725 - DNA, 30 bp, Artificial Sequence
  Description of Artificial Sequence: Synthetic oligonucleotide
gtttccagagaagccaatcagtgtcgtcgc

SEQ ID NO: 353726 - DNA, 23 bp, Artificial Sequence
  Description of Artificial Sequence: Synthetic oligonucleotide
cgggcggcgtggatagtgcagga

SEQ ID NO: 353727 - DNA, 30 bp, Artificial Sequence
  Description of Artificial Sequence: Synthetic oligonucleotide
tttccagagaagccaatcagtgtcgtcgcg

SEQ ID NO: 353728 - DNA, 23 bp, Artificial Sequence
  Description of Artificial Sequence: Synthetic oligonucleotide
gggcggcgtggatagtgcaggag

SEQ ID NO: 353729 - DNA, 29 bp, Artificial Sequence
  Description of Artificial Sequence: Synthetic oligonucleotide
ttccagagaagccaatcagtgtcgtcgcg

SEQ ID NO: 353730 - DNA, 23 bp, Artificial Sequence
  Description of Artificial Sequence: Synthetic oligonucleotide
ggcggcgtggatagtgcaggagg

SEQ ID NO: 353731 - DNA, 28 bp, Artificial Sequence
  Description of Artificial Sequence: Synthetic oligonucleotide
tccagagaagccaatcagtgtcgtcgcg

SEQ ID NO: 353732 - DNA, 23 bp, Artificial Sequence
  Description of Artificial Sequence: Synthetic oligonucleotide
gcggcgtggatagtgcaggaggg

SEQ ID NO: 353733 - DNA, 27 bp, Artificial Sequence
  Description of Artificial Sequence: Synthetic oligonucleotide
ccagagaagccaatcagtgtcgtcgcg

SEQ ID NO: 353734 - DNA, 23 bp, Artificial Sequence
  Description of Artificial Sequence: Synthetic oligonucleotide
cggcgtggatagtgcaggagggg

SEQ ID NO: 353735 - DNA, 27 bp, Artificial Sequence
  Description of Artificial Sequence: Synthetic oligonucleotide
cagagaagccaatcagtgtcgtcgcgg

SEQ ID NO: 353736 - DNA, 23 bp, Artificial Sequence
  Description of Artificial Sequence: Synthetic oligonucleotide
ggcgtggatagtgcaggaggggc

SEQ ID NO: 353737 - DNA, 28 bp, Artificial Sequence
  Description of Artificial Sequence: Synthetic oligonucleotide
agagaagccaatcagtgtcgtcgcggtc

SEQ ID NO: 353738 - DNA, 23 bp, Artificial Sequence
  Description of Artificial Sequence: Synthetic oligonucleotide
gcgtggatagtgcaggaggggcg

SEQ ID NO: 353739 - DNA, 27 bp, Artificial Sequence
  Description of Artificial Sequence: Synthetic oligonucleotide
gagaagccaatcagtgtcgtcgcggtc

SEQ ID NO: 353740 - DNA, 23 bp, Artificial Sequence
  Description of Artificial Sequence: Synthetic oligonucleotide
cgtggatagtgcaggaggggcgg

SEQ ID NO: 353741 - DNA, 27 bp, Artificial Sequence
  Description of Artificial Sequence: Synthetic oligonucleotide
agaagccaatcagtgtcgtcgcggtcg

SEQ ID NO: 353742 - DNA, 24 bp, Artificial Sequence
  Description of Artificial Sequence: Synthetic oligonucleotide
gtggatagtgcaggaggggcggga

SEQ ID NO: 353743 - DNA, 26 bp, Artificial Sequence
  Description of Artificial Sequence: Synthetic oligonucleotide
gaagccaatcagtgtcgtcgcggtcg

SEQ ID NO: 353744 - DNA, 27 bp, Artificial Sequence
  Description of Artificial Sequence: Synthetic oligonucleotide
tggatagtgcaggaggggcgggagtat

SEQ ID NO: 353745 - DNA, 27 bp, Artificial Sequence
  Description of Artificial Sequence: Synthetic oligonucleotide
aagccaatcagtgtcgtcgcggtcgct

SEQ ID NO: 353746 - DNA, 27 bp, Artificial Sequence
  Description of Artificial Sequence: Synthetic oligonucleotide
ggatagtgcaggaggggcgggagtata

SEQ ID NO: 353747 - DNA, 26 bp, Artificial Sequence
  Description of Artificial Sequence: Synthetic oligonucleotide
agccaatcagtgtcgtcgcggtcgct

SEQ ID NO: 353748 - DNA, 27 bp, Artificial Sequence
  Description of Artificial Sequence: Synthetic oligonucleotide
gatagtgcaggaggggcgggagtatag

SEQ ID NO: 353749 - DNA, 25 bp, Artificial Sequence
  Description of Artificial Sequence: Synthetic oligonucleotide
gccaatcagtgtcgtcgcggtcgct

SEQ ID NO: 353750 - DNA, 27 bp, Artificial Sequence
  Description of Artificial Sequence: Synthetic oligonucleotide
atagtgcaggaggggcgggagtatagg

SEQ ID NO: 353751 - DNA, 27 bp, Artificial Sequence
  Description of Artificial Sequence: Synthetic oligonucleotide
ccaatcagtgtcgtcgcggtcgctgtt

SEQ ID NO: 353752 - DNA, 26 bp, Artificial Sequence
  Description of Artificial Sequence: Synthetic oligonucleotide
tagtgcaggaggggcgggagtatagg

SEQ ID NO: 353753 - DNA, 27 bp, Artificial Sequence
  Description of Artificial Sequence: Synthetic oligonucleotide
caatcagtgtcgtcgcggtcgctgttc

SEQ ID NO: 353754 - DNA, 25 bp, Artificial Sequence
  Description of Artificial Sequence: Synthetic oligonucleotide
agtgcaggaggggcgggagtatagg

SEQ ID NO: 353755 - DNA, 31 bp, Artificial Sequence
  Description of Artificial Sequence: Synthetic oligonucleotide
aatcagtgtcgtcgcggtcgctgttctaaag

SEQ ID NO: 353756 - DNA, 24 bp, Artificial Sequence
  Description of Artificial Sequence: Synthetic oligonucleotide
gtgcaggaggggcgggagtatagg

SEQ ID NO: 353757 - DNA, 30 bp, Artificial Sequence
  Description of Artificial Sequence: Synthetic oligonucleotide
atcagtgtcgtcgcggtcgctgttctaaag

SEQ ID NO: 353758 - DNA, 25 bp, Artificial Sequence
  Description of Artificial Sequence: Synthetic oligonucleotide
tgcaggaggggcgggagtataggga

SEQ ID NO: 353759 - DNA, 29 bp, Artificial Sequence
  Description of Artificial Sequence: Synthetic oligonucleotide
tcagtgtcgtcgcggtcgctgttctaaag

SEQ ID NO: 353760 - DNA, 24 bp, Artificial Sequence
  Description of Artificial Sequence: Synthetic oligonucleotide
gcaggaggggcgggagtataggga

SEQ ID NO: 353761 - DNA, 28 bp, Artificial Sequence
  Description of Artificial Sequence: Synthetic oligonucleotide
cagtgtcgtcgcggtcgctgttctaaag

SEQ ID NO: 353762 - DNA, 24 bp, Artificial Sequence
  Description of Artificial Sequence: Synthetic oligonucleotide
caggaggggcgggagtatagggac

SEQ ID NO: 353763 - DNA, 29 bp, Artificial Sequence
  Description of Artificial Sequence: Synthetic oligonucleotide
agtgtcgtcgcggtcgctgttctaaagtc

SEQ ID NO: 353764 - DNA, 24 bp, Artificial Sequence
  Description of Artificial Sequence: Synthetic oligonucleotide
aggaggggcgggagtatagggacc

SEQ ID NO: 353765 - DNA, 28 bp, Artificial Sequence
  Description of Artificial Sequence: Synthetic oligonucleotide
gtgtcgtcgcggtcgctgttctaaagtc

SEQ ID NO: 353766 - DNA, 23 bp, Artificial Sequence
  Description of Artificial Sequence: Synthetic oligonucleotide
ggaggggcgggagtatagggacc

SEQ ID NO: 353767 - DNA, 28 bp, Artificial Sequence
  Description of Artificial Sequence: Synthetic oligonucleotide
tgtcgtcgcggtcgctgttctaaagtcc

SEQ ID NO: 353768 - DNA, 23 bp, Artificial Sequence
  Description of Artificial Sequence: Synthetic oligonucleotide
gaggggcgggagtatagggaccg

SEQ ID NO: 353769 - DNA, 27 bp, Artificial Sequence
  Description of Artificial Sequence: Synthetic oligonucleotide
gtcgtcgcggtcgctgttctaaagtcc

SEQ ID NO: 353770 - DNA, 23 bp, Artificial Sequence
  Description of Artificial Sequence: Synthetic oligonucleotide
aggggcgggagtatagggaccgc

SEQ ID NO: 353771 - DNA, 27 bp, Artificial Sequence
  Description of Artificial Sequence: Synthetic oligonucleotide
tcgtcgcggtcgctgttctaaagtccg

SEQ ID NO: 353772 - DNA, 22 bp, Artificial Sequence
  Description of Artificial Sequence: Synthetic oligonucleotide
ggggcgggagtatagggaccgc

SEQ ID NO: 353773 - DNA, 26 bp, Artificial Sequence
  Description of Artificial Sequence: Synthetic oligonucleotide
cgtcgcggtcgctgttctaaagtccg

SEQ ID NO: 353774 - DNA, 23 bp, Artificial Sequence
  Description of Artificial Sequence: Synthetic oligonucleotide
gggcgggagtatagggaccgcga

SEQ ID NO: 353775 - DNA, 27 bp, Artificial Sequence
  Description of Artificial Sequence: Synthetic oligonucleotide
gtcgcggtcgctgttctaaagtccgca

SEQ ID NO: 353776 - DNA, 24 bp, Artificial Sequence
  Description of Artificial Sequence: Synthetic oligonucleotide
ggcgggagtatagggaccgcgaga

SEQ ID NO: 353777 - DNA, 27 bp, Artificial Sequence
  Description of Artificial Sequence: Synthetic oligonucleotide
tcgcggtcgctgttctaaagtccgcac

SEQ ID NO: 353778 - DNA, 25 bp, Artificial Sequence
  Description of Artificial Sequence: Synthetic oligonucleotide
gcgggagtatagggaccgcgagaca

SEQ ID NO: 353779 - DNA, 26 bp, Artificial Sequence
  Description of Artificial Sequence: Synthetic oligonucleotide
cgcggtcgctgttctaaagtccgcac

SEQ ID NO: 353780 - DNA, 26 bp, Artificial Sequence
  Description of Artificial Sequence: Synthetic oligonucleotide
cgggagtatagggaccgcgagacaca

SEQ ID NO: 353781 - DNA, 26 bp, Artificial Sequence
  Description of Artificial Sequence: Synthetic oligonucleotide
gcggtcgctgttctaaagtccgcacg

SEQ ID NO: 353782 - DNA, 27 bp, Artificial Sequence
  Description of Artificial Sequence: Synthetic oligonucleotide
gggagtatagggaccgcgagacacaca

SEQ ID NO: 353783 - DNA, 27 bp, Artificial Sequence
  Description of Artificial Sequence: Synthetic oligonucleotide
cggtcgctgttctaaagtccgcacgca

SEQ ID NO: 353784 - DNA, 28 bp, Artificial Sequence
  Description of Artificial Sequence: Synthetic oligonucleotide
ggagtatagggaccgcgagacacacaac

SEQ ID NO: 353785 - DNA, 27 bp, Artificial Sequence
  Description of Artificial Sequence: Synthetic oligonucleotide
ggtcgctgttctaaagtccgcacgcac

SEQ ID NO: 353786 - DNA, 30 bp, Artificial Sequence; identical to SEQ ID NO: 231499
  Description of Artificial Sequence: Synthetic oligonucleotide

SEQ ID NO: 353787 - DNA, 27 bp, Artificial Sequence
  Description of Artificial Sequence: Synthetic oligonucleotide
gtcgctgttctaaagtccgcacgcacc

SEQ ID NO: 353788 - DNA, 32 bp, Artificial Sequence; identical to SEQ ID NO: 231500
  Description of Artificial Sequence: Synthetic oligonucleotide

SEQ ID NO: 353789 - DNA, 27 bp, Artificial Sequence
  Description of Artificial Sequence: Synthetic oligonucleotide
tcgctgttctaaagtccgcacgcaccc

SEQ ID NO: 353790 - DNA, 31 bp, Artificial Sequence; identical to SEQ ID NO: 231501
  Description of Artificial Sequence: Synthetic oligonucleotide

SEQ ID NO: 353791 - DNA, 27 bp, Artificial Sequence
  Description of Artificial Sequence: Synthetic oligonucleotide
cgctgttctaaagtccgcacgcaccca

SEQ ID NO: 353792 - DNA, 31 bp, Artificial Sequence; identical to SEQ ID NO: 231502
  Description of Artificial Sequence: Synthetic oligonucleotide

SEQ ID NO: 353793 - DNA, 27 bp, Artificial Sequence
  Description of Artificial Sequence: Synthetic oligonucleotide
gctgttctaaagtccgcacgcacccac

SEQ ID NO: 353794 - DNA, 30 bp, Artificial Sequence; identical to SEQ ID NO: 231503
  Description of Artificial Sequence: Synthetic oligonucleotide

SEQ ID NO: 353795 - DNA, 27 bp, Artificial Sequence
  Description of Artificial Sequence: Synthetic oligonucleotide
ctgttctaaagtccgcacgcacccacc

SEQ ID NO: 353796 - DNA, 29 bp, Artificial Sequence
  Description of Artificial Sequence: Synthetic oligonucleotide
tagggaccgcgagacacacaacttcaagg

SEQ ID NO: 353797 - DNA, 27 bp, Artificial Sequence
  Description of Artificial Sequence: Synthetic oligonucleotide
tgttctaaagtccgcacgcacccaccg

SEQ ID NO: 353798 - DNA, 28 bp, Artificial Sequence
  Description of Artificial Sequence: Synthetic oligonucleotide
agggaccgcgagacacacaacttcaagg

SEQ ID NO: 353799 - DNA, 26 bp, Artificial Sequence
  Description of Artificial Sequence: Synthetic oligonucleotide
gttctaaagtccgcacgcacccaccg

SEQ ID NO: 353800 - DNA, 27 bp, Artificial Sequence
  Description of Artificial Sequence: Synthetic oligonucleotide
gggaccgcgagacacacaacttcaagg

SEQ ID NO: 353801 - DNA, 26 bp, Artificial Sequence
  Description of Artificial Sequence: Synthetic oligonucleotide
ttctaaagtccgcacgcacccaccgg

SEQ ID NO: 353802 - DNA, 27 bp, Artificial Sequence
  Description of Artificial Sequence: Synthetic oligonucleotide
ggaccgcgagacacacaacttcaaggc

SEQ ID NO: 353803 - DNA, 25 bp, Artificial Sequence
  Description of Artificial Sequence: Synthetic oligonucleotide
tctaaagtccgcacgcacccaccgg

SEQ ID NO: 353804 - DNA, 27 bp, Artificial Sequence
  Description of Artificial Sequence: Synthetic oligonucleotide
gaccgcgagacacacaacttcaaggcg

SEQ ID NO: 353805 - DNA, 24 bp, Artificial Sequence
  Description of Artificial Sequence: Synthetic oligonucleotide
ctaaagtccgcacgcacccaccgg

SEQ ID NO: 353806 - DNA, 27 bp, Artificial Sequence
  Description of Artificial Sequence: Synthetic oligonucleotide
accgcgagacacacaacttcaaggcgc

SEQ ID NO: 353807 - DNA, 25 bp, Artificial Sequence
  Description of Artificial Sequence: Synthetic oligonucleotide
taaagtccgcacgcacccaccggga

SEQ ID NO: 353808 - DNA, 27 bp, Artificial Sequence
  Description of Artificial Sequence: Synthetic oligonucleotide
ccgcgagacacacaacttcaaggcgca

SEQ ID NO: 353809 - DNA, 24 bp, Artificial Sequence
  Description of Artificial Sequence: Synthetic oligonucleotide
aaagtccgcacgcacccaccggga

SEQ ID NO: 353810 - DNA, 27 bp, Artificial Sequence
  Description of Artificial Sequence: Synthetic oligonucleotide
cgcgagacacacaacttcaaggcgcac

SEQ ID NO: 353811 - DNA, 23 bp, Artificial Sequence
  Description of Artificial Sequence: Synthetic oligonucleotide
aagtccgcacgcacccaccggga

SEQ ID NO: 353812 - DNA, 27 bp, Artificial Sequence
  Description of Artificial Sequence: Synthetic oligonucleotide
gcgagacacacaacttcaaggcgcacg

SEQ ID NO: 353813 - DNA, 22 bp, Artificial Sequence
  Description of Artificial Sequence: Synthetic oligonucleotide
agtccgcacgcacccaccggga

SEQ ID NO: 353814 - DNA, 27 bp, Artificial Sequence
  Description of Artificial Sequence: Synthetic oligonucleotide
cgagacacacaacttcaaggcgcacgc

SEQ ID NO: 353815 - DNA, 21 bp, Artificial Sequence
  Description of Artificial Sequence: Synthetic oligonucleotide
gtccgcacgcacccaccggga

SEQ ID NO: 353816 - DNA, 28 bp, Artificial Sequence
  Description of Artificial Sequence: Synthetic oligonucleotide
gagacacacaacttcaaggcgcacgcac

SEQ ID NO: 353817 - DNA, 22 bp, Artificial Sequence
  Description of Artificial Sequence: Synthetic oligonucleotide
tccgcacgcacccaccgggact

SEQ ID NO: 353818 - DNA, 29 bp, Artificial Sequence
  Description of Artificial Sequence: Synthetic oligonucleotide
agacacacaacttcaaggcgcacgcacag

SEQ ID NO: 353819 - DNA, 21 bp, Artificial Sequence
  Description of Artificial Sequence: Synthetic oligonucleotide
ccgcacgcacccaccgggact

SEQ ID NO: 353820 - DNA, 28 bp, Artificial Sequence
  Description of Artificial Sequence: Synthetic oligonucleotide
gacacacaacttcaaggcgcacgcacag

SEQ ID NO: 353821 - DNA, 22 bp, Artificial Sequence
  Description of Artificial Sequence: Synthetic oligonucleotide
cgcacgcacccaccgggactca

SEQ ID NO: 353822 - DNA, 29 bp, Artificial Sequence
  Description of Artificial Sequence: Synthetic oligonucleotide
acacacaacttcaaggcgcacgcacagac

SEQ ID NO: 353823 - DNA, 25 bp, Artificial Sequence
  Description of Artificial Sequence: Synthetic oligonucleotide
gcacgcacccaccgggactcagatt

SEQ ID NO: 353824 - DNA, 28 bp, Artificial Sequence
  Description of Artificial Sequence: Synthetic oligonucleotide
cacacaacttcaaggcgcacgcacagac

SEQ ID NO: 353825 - DNA, 26 bp, Artificial Sequence
  Description of Artificial Sequence: Synthetic oligonucleotide
cacgcacccaccgggactcagattct

SEQ ID NO: 353826 - DNA, 29 bp, Artificial Sequence
  Description of Artificial Sequence: Synthetic oligonucleotide
acacaacttcaaggcgcacgcacagacag

SEQ ID NO: 353827 - DNA, 26 bp, Artificial Sequence
  Description of Artificial Sequence: Synthetic oligonucleotide
acgcacccaccgggactcagattctc

SEQ ID NO: 353828 - DNA, 28 bp, Artificial Sequence
  Description of Artificial Sequence: Synthetic oligonucleotide
cacaacttcaaggcgcacgcacagacag

SEQ ID NO: 353829 - DNA, 25 bp, Artificial Sequence
  Description of Artificial Sequence: Synthetic oligonucleotide
cgcacccaccgggactcagattctc

SEQ ID NO: 353830 - DNA, 29 bp, Artificial Sequence
  Description of Artificial Sequence: Synthetic oligonucleotide
acaacttcaaggcgcacgcacagacagac

SEQ ID NO: 353831 - DNA, 25 bp, Artificial Sequence
  Description of Artificial Sequence: Synthetic oligonucleotide
gcacccaccgggactcagattctcc

SEQ ID NO: 353832 - DNA, 28 bp, Artificial Sequence
  Description of Artificial Sequence: Synthetic oligonucleotide
caacttcaaggcgcacgcacagacagac

SEQ ID NO: 353833 - DNA, 25 bp, Artificial Sequence
  Description of Artificial Sequence: Synthetic oligonucleotide
cacccaccgggactcagattctccc

SEQ ID NO: 353834 - DNA, 28 bp, Artificial Sequence
  Description of Artificial Sequence: Synthetic oligonucleotide
aacttcaaggcgcacgcacagacagacc

SEQ ID NO: 353835 - DNA, 26 bp, Artificial Sequence
  Description of Artificial Sequence: Synthetic oligonucleotide
acccaccgggactcagattctcccca

SEQ ID NO: 353836 - DNA, 27 bp, Artificial Sequence
  Description of Artificial Sequence: Synthetic oligonucleotide
acttcaaggcgcacgcacagacagacc

SEQ ID NO: 353837 - DNA, 25 bp, Artificial Sequence
  Description of Artificial Sequence: Synthetic oligonucleotide
cccaccgggactcagattctcccca

SEQ ID NO: 353838 - DNA, 26 bp, Artificial Sequence
  Description of Artificial Sequence: Synthetic oligonucleotide
cttcaaggcgcacgcacagacagacc

SEQ ID NO: 353839 - DNA, 26 bp, Artificial Sequence
  Description of Artificial Sequence: Synthetic oligonucleotide
ccaccgggactcagattctccccaga

SEQ ID NO: 353840 - DNA, 27 bp, Artificial Sequence
  Description of Artificial Sequence: Synthetic oligonucleotide
ttcaaggcgcacgcacagacagaccga

SEQ ID NO: 353841 - DNA, 26 bp, Artificial Sequence
  Description of Artificial Sequence: Synthetic oligonucleotide
caccgggactcagattctccccagac

SEQ ID NO: 353842 - DNA, 26 bp, Artificial Sequence
  Description of Artificial Sequence: Synthetic oligonucleotide
tcaaggcgcacgcacagacagaccga

SEQ ID NO: 353843 - DNA, 26 bp, Artificial Sequence
  Description of Artificial Sequence: Synthetic oligonucleotide
accgggactcagattctccccagacg

SEQ ID NO: 353844 - DNA, 25 bp, Artificial Sequence
  Description of Artificial Sequence: Synthetic oligonucleotide
caaggcgcacgcacagacagaccga

SEQ ID NO: 353845 - DNA, 25 bp, Artificial Sequence
  Description of Artificial Sequence: Synthetic oligonucleotide
ccgggactcagattctccccagacg

SEQ ID NO: 353846 - DNA, 26 bp, Artificial Sequence
  Description of Artificial Sequence: Synthetic oligonucleotide
aaggcgcacgcacagacagaccgaga

SEQ ID NO: 353847 - DNA, 25 bp, Artificial Sequence
  Description of Artificial Sequence: Synthetic oligonucleotide
cgggactcagattctccccagacgc

SEQ ID NO: 353848 - DNA, 25 bp, Artificial Sequence
  Description of Artificial Sequence: Synthetic oligonucleotide
aggcgcacgcacagacagaccgaga

SEQ ID NO: 353849 - DNA, 25 bp, Artificial Sequence
  Description of Artificial Sequence: Synthetic oligonucleotide
gggactcagattctccccagacgcc

SEQ ID NO: 353850 - DNA, 24 bp, Artificial Sequence
  Description of Artificial Sequence: Synthetic oligonucleotide
ggcgcacgcacagacagaccgaga

SEQ ID NO: 353851 - DNA, 26 bp, Artificial Sequence
  Description of Artificial Sequence: Synthetic oligonucleotide
ggactcagattctccccagacgccga

SEQ ID NO: 353852 - DNA, 26 bp, Artificial Sequence
  Description of Artificial Sequence: Synthetic oligonucleotide
gcgcacgcacagacagaccgagacaa

SEQ ID NO: 353853 - DNA, 26 bp, Artificial Sequence
  Description of Artificial Sequence: Synthetic oligonucleotide
gactcagattctccccagacgccgag

SEQ ID NO: 353854 - DNA, 26 bp, Artificial Sequence
  Description of Artificial Sequence: Synthetic oligonucleotide
cgcacgcacagacagaccgagacaac

SEQ ID NO: 353855 - DNA, 27 bp, Artificial Sequence
  Description of Artificial Sequence: Synthetic oligonucleotide
actcagattctccccagacgccgagga

SEQ ID NO: 353856 - DNA, 27 bp, Artificial Sequence
  Description of Artificial Sequence: Synthetic oligonucleotide
gcacgcacagacagaccgagacaacct

SEQ ID NO: 353857 - DNA, 27 bp, Artificial Sequence
  Description of Artificial Sequence: Synthetic oligonucleotide
ctcagattctccccagacgccgaggat

SEQ ID NO: 353858 - DNA, 27 bp, Artificial Sequence
  Description of Artificial Sequence: Synthetic oligonucleotide
cacgcacagacagaccgagacaacctg

SEQ ID NO: 353859 - DNA, 27 bp, Artificial Sequence
  Description of Artificial Sequence: Synthetic oligonucleotide
tcagattctccccagacgccgaggatg

SEQ ID NO: 353860 - DNA, 27 bp, Artificial Sequence
  Description of Artificial Sequence: Synthetic oligonucleotide
acgcacagacagaccgagacaacctgc

SEQ ID NO: 353861 - DNA, 26 bp, Artificial Sequence
  Description of Artificial Sequence: Synthetic oligonucleotide
cagattctccccagacgccgaggatg

SEQ ID NO: 353862 - DNA, 26 bp, Artificial Sequence
  Description of Artificial Sequence: Synthetic oligonucleotide
cgcacagacagaccgagacaacctgc

SEQ ID NO: 353863 - DNA, 26 bp, Artificial Sequence
  Description of Artificial Sequence: Synthetic oligonucleotide
agattctccccagacgccgaggatgg

SEQ ID NO: 353864 - DNA, 26 bp, Artificial Sequence
  Description of Artificial Sequence: Synthetic oligonucleotide
gcacagacagaccgagacaacctgcg

SEQ ID NO: 353865 - DNA, 25 bp, Artificial Sequence
  Description of Artificial Sequence: Synthetic oligonucleotide
gattctccccagacgccgaggatgg

SEQ ID NO: 353866 - DNA, 27 bp, Artificial Sequence
  Description of Artificial Sequence: Synthetic oligonucleotide
cacagacagaccgagacaacctgcggt

SEQ ID NO: 353867 - DNA, 25 bp, Artificial Sequence
  Description of Artificial Sequence: Synthetic oligonucleotide
attctccccagacgccgaggatggc

SEQ ID NO: 353868 - DNA, 28 bp, Artificial Sequence
  Description of Artificial Sequence: Synthetic oligonucleotide
acagacagaccgagacaacctgcggtac

SEQ ID NO: 353869 - DNA, 24 bp, Artificial Sequence
  Description of Artificial Sequence: Synthetic oligonucleotide
ttctccccagacgccgaggatggc

SEQ ID NO: 353870 - DNA, 27 bp, Artificial Sequence
  Description of Artificial Sequence: Synthetic oligonucleotide
cagacagaccgagacaacctgcggtac

SEQ ID NO: 353871 - DNA, 23 bp, Artificial Sequence
  Description of Artificial Sequence: Synthetic oligonucleotide
tctccccagacgccgaggatggc

SEQ ID NO: 353872 - DNA, 27 bp, Artificial Sequence
  Description of Artificial Sequence: Synthetic oligonucleotide
agacagaccgagacaacctgcggtacc

SEQ ID NO: 353873 - DNA, 22 bp, Artificial Sequence
  Description of Artificial Sequence: Synthetic oligonucleotide
ctccccagacgccgaggatggc

SEQ ID NO: 353874 - DNA, 27 bp, Artificial Sequence
  Description of Artificial Sequence: Synthetic oligonucleotide
gacagaccgagacaacctgcggtacct

SEQ ID NO: 353875 - DNA, 22 bp, Artificial Sequence
  Description of Artificial Sequence: Synthetic oligonucleotide
tccccagacgccgaggatggcc

SEQ ID NO: 353876 - DNA, 27 bp, Artificial Sequence
  Description of Artificial Sequence: Synthetic oligonucleotide
acagaccgagacaacctgcggtacctg

SEQ ID NO: 353877 - DNA, 21 bp, Artificial Sequence
  Description of Artificial Sequence: Synthetic oligonucleotide
ccccagacgccgaggatggcc

SEQ ID NO: 353878 - DNA, 26 bp, Artificial Sequence
  Description of Artificial Sequence: Synthetic oligonucleotide
cagaccgagacaacctgcggtacctg

SEQ ID NO: 353879 - DNA, 22 bp, Artificial Sequence
  Description of Artificial Sequence: Synthetic oligonucleotide
cccagacgccgaggatggccgt

SEQ ID NO: 353880 - DNA, 26 bp, Artificial Sequence
  Description of Artificial Sequence: Synthetic oligonucleotide
agaccgagacaacctgcggtacctgc

SEQ ID NO: 353881 - DNA, 24 bp, Artificial Sequence
  Description of Artificial Sequence: Synthetic oligonucleotide
ccagacgccgaggatggccgtcat

SEQ ID NO: 353882 - DNA, 25 bp, Artificial Sequence
  Description of Artificial Sequence: Synthetic oligonucleotide
gaccgagacaacctgcggtacctgc

SEQ ID NO: 353883 - DNA, 24 bp, Artificial Sequence
  Description of Artificial Sequence: Synthetic oligonucleotide
cagacgccgaggatggccgtcatg

SEQ ID NO: 353884 - DNA, 25 bp, Artificial Sequence
  Description of Artificial Sequence: Synthetic oligonucleotide
accgagacaacctgcggtacctgcg

SEQ ID NO: 353885 - DNA, 24 bp, Artificial Sequence
  Description of Artificial Sequence: Synthetic oligonucleotide
agacgccgaggatggccgtcatgg

SEQ ID NO: 353886 - DNA, 24 bp, Artificial Sequence
  Description of Artificial Sequence: Synthetic oligonucleotide
ccgagacaacctgcggtacctgcg

SEQ ID NO: 353887 - DNA, 23 bp, Artificial Sequence
  Description of Artificial Sequence: Synthetic oligonucleotide
gacgccgaggatggccgtcatgg

SEQ ID NO: 353888 - DNA, 24 bp, Artificial Sequence
  Description of Artificial Sequence: Synthetic oligonucleotide
cgagacaacctgcggtacctgcgc

SEQ ID NO: 353889 - DNA, 23 bp, Artificial Sequence
  Description of Artificial Sequence: Synthetic oligonucleotide
acgccgaggatggccgtcatggc

SEQ ID NO: 353890 - DNA, 24 bp, Artificial Sequence
  Description of Artificial Sequence: Synthetic oligonucleotide
gagacaacctgcggtacctgcgcg

SEQ ID NO: 353891 - DNA, 22 bp, Artificial Sequence
  Description of Artificial Sequence: Synthetic oligonucleotide
cgccgaggatggccgtcatggc

SEQ ID NO: 353892 - DNA, 24 bp, Artificial Sequence
  Description of Artificial Sequence: Synthetic oligonucleotide
agacaacctgcggtacctgcgcgc

SEQ ID NO: 353893 - DNA, 22 bp, Artificial Sequence
  Description of Artificial Sequence: Synthetic oligonucleotide
gccgaggatggccgtcatggcg

SEQ ID NO: 353894 - DNA, 23 bp, Artificial Sequence
  Description of Artificial Sequence: Synthetic oligonucleotide
gacaacctgcggtacctgcgcgc

SEQ ID NO: 353895 - DNA, 22 bp, Artificial Sequence
  Description of Artificial Sequence: Synthetic oligonucleotide
ccgaggatggccgtcatggcgc

SEQ ID NO: 353896 - DNA, 25 bp, Artificial Sequence
  Description of Artificial Sequence: Synthetic oligonucleotide
acaacctgcggtacctgcgcgccta

SEQ ID NO: 353897 - DNA, 22 bp, Artificial Sequence
  Description of Artificial Sequence: Synthetic oligonucleotide
cgaggatggccgtcatggcgcc

SEQ ID NO: 353898 - DNA, 24 bp, Artificial Sequence
  Description of Artificial Sequence: Synthetic oligonucleotide
caacctgcggtacctgcgcgccta

SEQ ID NO: 353899 - DNA, 22 bp, Artificial Sequence
  Description of Artificial Sequence: Synthetic oligonucleotide
gaggatggccgtcatggcgccc

SEQ ID NO: 353900 - DNA, 26 bp, Artificial Sequence
  Description of Artificial Sequence: Synthetic oligonucleotide
aacctgcggtacctgcgcgcctacta

SEQ ID NO: 353901 - DNA, 22 bp, Artificial Sequence
  Description of Artificial Sequence: Synthetic oligonucleotide
aggatggccgtcatggcgcccc

SEQ ID NO: 353902 - DNA, 25 bp, Artificial Sequence
  Description of Artificial Sequence: Synthetic oligonucleotide
acctgcggtacctgcgcgcctacta

SEQ ID NO: 353903 - DNA, 21 bp, Artificial Sequence
  Description of Artificial Sequence: Synthetic oligonucleotide
ggatggccgtcatggcgcccc

SEQ ID NO: 353904 - DNA, 24 bp, Artificial Sequence
  Description of Artificial Sequence: Synthetic oligonucleotide
cctgcggtacctgcgcgcctacta

SEQ ID NO: 353905 - DNA, 23 bp, Artificial Sequence
  Description of Artificial Sequence: Synthetic oligonucleotide
gatggccgtcatggcgccccgaa

SEQ ID NO: 353906 - DNA, 26 bp, Artificial Sequence
  Description of Artificial Sequence: Synthetic oligonucleotide
ctgcggtacctgcgcgcctactacat

SEQ ID NO: 353907 - DNA, 23 bp, Artificial Sequence
  Description of Artificial Sequence: Synthetic oligonucleotide
atggccgtcatggcgccccgaac

SEQ ID NO: 353908 - DNA, 26 bp, Artificial Sequence
  Description of Artificial Sequence: Synthetic oligonucleotide
tgcggtacctgcgcgcctactacatc

SEQ ID NO: 353909 - DNA, 22 bp, Artificial Sequence
  Description of Artificial Sequence: Synthetic oligonucleotide
tggccgtcatggcgccccgaac

SEQ ID NO: 353910 - DNA, 25 bp, Artificial Sequence
  Description of Artificial Sequence: Synthetic oligonucleotide
gcggtacctgcgcgcctactacatc

SEQ ID NO: 353911 - DNA, 21 bp, Artificial Sequence
  Description of Artificial Sequence: Synthetic oligonucleotide
ggccgtcatggcgccccgaac

SEQ ID NO: 353912 - DNA, 26 bp, Artificial Sequence
  Description of Artificial Sequence: Synthetic oligonucleotide
cggtacctgcgcgcctactacatcca

SEQ ID NO: 353913 - DNA, 21 bp, Artificial Sequence
  Description of Artificial Sequence: Synthetic oligonucleotide
gccgtcatggcgccccgaacc

SEQ ID NO: 353914 - DNA, 27 bp, Artificial Sequence
  Description of Artificial Sequence: Synthetic oligonucleotide
ggtacctgcgcgcctactacatccaga

SEQ ID NO: 353915 - DNA, 22 bp, Artificial Sequence
  Description of Artificial Sequence: Synthetic oligonucleotide
ccgtcatggcgccccgaaccct

SEQ ID NO: 353916 - DNA, 27 bp, Artificial Sequence
  Description of Artificial Sequence: Synthetic oligonucleotide
gtacctgcgcgcctactacatccagag

SEQ ID NO: 353917 - DNA, 22 bp, Artificial Sequence
  Description of Artificial Sequence: Synthetic oligonucleotide
cgtcatggcgccccgaaccctc

SEQ ID NO: 353918 - DNA, 27 bp, Artificial Sequence
  Description of Artificial Sequence: Synthetic oligonucleotide
tacctgcgcgcctactacatccagagc

SEQ ID NO: 353919 - DNA, 23 bp, Artificial Sequence
  Description of Artificial Sequence: Synthetic oligonucleotide
gtcatggcgccccgaaccctcct

SEQ ID NO: 353920 - DNA, 26 bp, Artificial Sequence
  Description of Artificial Sequence: Synthetic oligonucleotide
acctgcgcgcctactacatccagagc

SEQ ID NO: 353921 - DNA, 23 bp, Artificial Sequence
  Description of Artificial Sequence: Synthetic oligonucleotide
tcatggcgccccgaaccctcctc

SEQ ID NO: 353922 - DNA, 25 bp, Artificial Sequence
  Description of Artificial Sequence: Synthetic oligonucleotide
cctgcgcgcctactacatccagagc

SEQ ID NO: 353923 - DNA, 22 bp, Artificial Sequence
  Description of Artificial Sequence: Synthetic oligonucleotide
catggcgccccgaaccctcctc

SEQ ID NO: 353924 - DNA, 26 bp, Artificial Sequence
  Description of Artificial Sequence: Synthetic oligonucleotide
ctgcgcgcctactacatccagagcga

SEQ ID NO: 353925 - DNA, 23 bp, Artificial Sequence
  Description of Artificial Sequence: Synthetic oligonucleotide
atggcgccccgaaccctcctcct

SEQ ID NO: 353926 - DNA, 26 bp, Artificial Sequence
  Description of Artificial Sequence: Synthetic oligonucleotide
tgcgcgcctactacatccagagcgag

SEQ ID NO: 353927 - DNA, 22 bp, Artificial Sequence
  Description of Artificial Sequence: Synthetic oligonucleotide
tggcgccccgaaccctcctcct

SEQ ID NO: 353928 - DNA, 25 bp, Artificial Sequence
  Description of Artificial Sequence: Synthetic oligonucleotide
gcgcgcctactacatccagagcgag

SEQ ID NO: 353929 - DNA, 21 bp, Artificial Sequence
  Description of Artificial Sequence: Synthetic oligonucleotide
ggcgccccgaaccctcctcct

SEQ ID NO: 353930 - DNA, 25 bp, Artificial Sequence
  Description of Artificial Sequence: Synthetic oligonucleotide
cgcgcctactacatccagagcgagc

SEQ ID NO: 353931 - DNA, 21 bp, Artificial Sequence
  Description of Artificial Sequence: Synthetic oligonucleotide
gcgccccgaaccctcctcctg

SEQ ID NO: 353932 - DNA, 25 bp, Artificial Sequence
  Description of Artificial Sequence: Synthetic oligonucleotide
gcgcctactacatccagagcgagcc

SEQ ID NO: 353933 - DNA, 23 bp, Artificial Sequence
  Description of Artificial Sequence: Synthetic oligonucleotide
cgccccgaaccctcctcctgcta

SEQ ID NO: 353934 - DNA, 25 bp, Artificial Sequence
  Description of Artificial Sequence: Synthetic oligonucleotide
cgcctactacatccagagcgagccc

SEQ ID NO: 353935 - DNA, 24 bp, Artificial Sequence
  Description of Artificial Sequence: Synthetic oligonucleotide
gccccgaaccctcctcctgctact

SEQ ID NO: 353936 - DNA, 25 bp, Artificial Sequence
  Description of Artificial Sequence: Synthetic oligonucleotide
gcctactacatccagagcgagcccg

SEQ ID NO: 353937 - DNA, 25 bp, Artificial Sequence
  Description of Artificial Sequence: Synthetic oligonucleotide
ccccgaaccctcctcctgctactct

SEQ ID NO: 353938 - DNA, 25 bp, Artificial Sequence
  Description of Artificial Sequence: Synthetic oligonucleotide
cctactacatccagagcgagcccgg

SEQ ID NO: 353939 - DNA, 25 bp, Artificial Sequence
  Description of Artificial Sequence: Synthetic oligonucleotide
cccgaaccctcctcctgctactctc

SEQ ID NO: 353940 - DNA, 26 bp, Artificial Sequence
  Description of Artificial Sequence: Synthetic oligonucleotide
ctactacatccagagcgagcccgggt

SEQ ID NO: 353941 - DNA, 25 bp, Artificial Sequence
  Description of Artificial Sequence: Synthetic oligonucleotide
ccgaaccctcctcctgctactctcg

SEQ ID NO: 353942 - DNA, 27 bp, Artificial Sequence
  Description of Artificial Sequence: Synthetic oligonucleotide
tactacatccagagcgagcccgggtct

SEQ ID NO: 353943 - DNA, 25 bp, Artificial Sequence
  Description of Artificial Sequence: Synthetic oligonucleotide
cgaaccctcctcctgctactctcgg

SEQ ID NO: 353944 - DNA, 26 bp, Artificial Sequence
  Description of Artificial Sequence: Synthetic oligonucleotide
actacatccagagcgagcccgggtct

SEQ ID NO: 353945 - DNA, 25 bp, Artificial Sequence
  Description of Artificial Sequence: Synthetic oligonucleotide
gaaccctcctcctgctactctcggg

SEQ ID NO: 353946 - DNA, 25 bp, Artificial Sequence
  Description of Artificial Sequence: Synthetic oligonucleotide
ctacatccagagcgagcccgggtct

SEQ ID NO: 353947 - DNA, 25 bp, Artificial Sequence
  Description of Artificial Sequence: Synthetic oligonucleotide
aaccctcctcctgctactctcgggg

SEQ ID NO: 353948 - DNA, 26 bp, Artificial Sequence
  Description of Artificial Sequence: Synthetic oligonucleotide
tacatccagagcgagcccgggtctct

SEQ ID NO: 353949 - DNA, 24 bp, Artificial Sequence
  Description of Artificial Sequence: Synthetic oligonucleotide
accctcctcctgctactctcgggg

SEQ ID NO: 353950 - DNA, 25 bp, Artificial Sequence
  Description of Artificial Sequence: Synthetic oligonucleotide
acatccagagcgagcccgggtctct

SEQ ID NO: 353951 - DNA, 23 bp, Artificial Sequence
  Description of Artificial Sequence: Synthetic oligonucleotide
ccctcctcctgctactctcgggg

SEQ ID NO: 353952 - DNA, 24 bp, Artificial Sequence
  Description of Artificial Sequence: Synthetic oligonucleotide
catccagagcgagcccgggtctct

SEQ ID NO: 353953 - DNA, 23 bp, Artificial Sequence
  Description of Artificial Sequence: Synthetic oligonucleotide
cctcctcctgctactctcggggg

SEQ ID NO: 353954 - DNA, 25 bp, Artificial Sequence
  Description of Artificial Sequence: Synthetic oligonucleotide
atccagagcgagcccgggtctctca

SEQ ID NO: 353955 - DNA, 23 bp, Artificial Sequence
  Description of Artificial Sequence: Synthetic oligonucleotide
ctcctcctgctactctcgggggc

SEQ ID NO: 353956 - DNA, 24 bp, Artificial Sequence
  Description of Artificial Sequence: Synthetic oligonucleotide
tccagagcgagcccgggtctctca

SEQ ID NO: 353957 - DNA, 23 bp, Artificial Sequence
  Description of Artificial Sequence: Synthetic oligonucleotide
tcctcctgctactctcgggggcc

SEQ ID NO: 353958 - DNA, 23 bp, Artificial Sequence
  Description of Artificial Sequence: Synthetic oligonucleotide
ccagagcgagcccgggtctctca

SEQ ID NO: 353959 - DNA, 22 bp, Artificial Sequence
  Description of Artificial Sequence: Synthetic oligonucleotide
cctcctgctactctcgggggcc

SEQ ID NO: 353960 - DNA, 23 bp, Artificial Sequence
  Description of Artificial Sequence: Synthetic oligonucleotide
cagagcgagcccgggtctctcac

SEQ ID NO: 353961 - DNA, 23 bp, Artificial Sequence
  Description of Artificial Sequence: Synthetic oligonucleotide
ctcctgctactctcgggggccct

SEQ ID NO: 353962 - DNA, 23 bp, Artificial Sequence
  Description of Artificial Sequence: Synthetic oligonucleotide
agagcgagcccgggtctctcacc

SEQ ID NO: 353963 - DNA, 23 bp, Artificial Sequence
  Description of Artificial Sequence: Synthetic oligonucleotide
tcctgctactctcgggggccctg

SEQ ID NO: 353964 - DNA, 22 bp, Artificial Sequence
  Description of Artificial Sequence: Synthetic oligonucleotide
gagcgagcccgggtctctcacc

SEQ ID NO: 353965 - DNA, 22 bp, Artificial Sequence
  Description of Artificial Sequence: Synthetic oligonucleotide
cctgctactctcgggggccctg

SEQ ID NO: 353966 - DNA, 23 bp, Artificial Sequence
  Description of Artificial Sequence: Synthetic oligonucleotide
agcgagcccgggtctctcaccct

SEQ ID NO: 353967 - DNA, 22 bp, Artificial Sequence
  Description of Artificial Sequence: Synthetic oligonucleotide
ctgctactctcgggggccctgg

SEQ ID NO: 353968 - DNA, 22 bp, Artificial Sequence
  Description of Artificial Sequence: Synthetic oligonucleotide
gcgagcccgggtctctcaccct

SEQ ID NO: 353969 - DNA, 22 bp, Artificial Sequence
  Description of Artificial Sequence: Synthetic oligonucleotide
tgctactctcgggggccctggc

SEQ ID NO: 353970 - DNA, 22 bp, Artificial Sequence
  Description of Artificial Sequence: Synthetic oligonucleotide
cgagcccgggtctctcaccctc

SEQ ID NO: 353971 - DNA, 21 bp, Artificial Sequence
  Description of Artificial Sequence: Synthetic oligonucleotide
gctactctcgggggccctggc

SEQ ID NO: 353972 - DNA, 23 bp, Artificial Sequence
  Description of Artificial Sequence: Synthetic oligonucleotide
gagcccgggtctctcaccctcca

SEQ ID NO: 353973 - DNA, 21 bp, Artificial Sequence
  Description of Artificial Sequence: Synthetic oligonucleotide
ctactctcgggggccctggcc

SEQ ID NO: 353974 - DNA, 24 bp, Artificial Sequence
  Description of Artificial Sequence: Synthetic oligonucleotide
agcccgggtctctcaccctccaca

SEQ ID NO: 353975 - DNA, 22 bp, Artificial Sequence
  Description of Artificial Sequence: Synthetic oligonucleotide
tactctcgggggccctggccct

SEQ ID NO: 353976 - DNA, 23 bp, Artificial Sequence
  Description of Artificial Sequence: Synthetic oligonucleotide
gcccgggtctctcaccctccaca

SEQ ID NO: 353977 - DNA, 21 bp, Artificial Sequence
  Description of Artificial Sequence: Synthetic oligonucleotide
actctcgggggccctggccct

SEQ ID NO: 353978 - DNA, 23 bp, Artificial Sequence
  Description of Artificial Sequence: Synthetic oligonucleotide
cccgggtctctcaccctccacag

SEQ ID NO: 353979 - DNA, 20 bp, Artificial Sequence
  Description of Artificial Sequence: Synthetic oligonucleotide
ctctcgggggccctggccct

SEQ ID NO: 353980 - DNA, 25 bp, Artificial Sequence
  Description of Artificial Sequence: Synthetic oligonucleotide
ccgggtctctcaccctccacaggat

SEQ ID NO: 353981 - DNA, 21 bp, Artificial Sequence
  Description of Artificial Sequence: Synthetic oligonucleotide
tctcgggggccctggccctga

SEQ ID NO: 353982 - DNA, 27 bp, Artificial Sequence
  Description of Artificial Sequence: Synthetic oligonucleotide
cgggtctctcaccctccacaggatgta

SEQ ID NO: 353983 - DNA, 20 bp, Artificial Sequence
  Description of Artificial Sequence: Synthetic oligonucleotide
ctcgggggccctggccctga

SEQ ID NO: 353984 - DNA, 28 bp, Artificial Sequence
  Description of Artificial Sequence: Synthetic oligonucleotide
gggtctctcaccctccacaggatgtatc

SEQ ID NO: 353985 - DNA, 20 bp, Artificial Sequence
  Description of Artificial Sequence: Synthetic oligonucleotide
tcgggggccctggccctgac

SEQ ID NO: 353986 - DNA, 28 bp, Artificial Sequence
  Description of Artificial Sequence: Synthetic oligonucleotide
ggtctctcaccctccacaggatgtatcg

SEQ ID NO: 353987 - DNA, 20 bp, Artificial Sequence
  Description of Artificial Sequence: Synthetic oligonucleotide
cgggggccctggccctgact

SEQ ID NO: 353988 - DNA, 28 bp, Artificial Sequence
  Description of Artificial Sequence: Synthetic oligonucleotide
gtctctcaccctccacaggatgtatcgc

SEQ ID NO: 353989 - DNA, 20 bp, Artificial Sequence
  Description of Artificial Sequence: Synthetic oligonucleotide
gggggccctggccctgacct

SEQ ID NO: 353990 - DNA, 29 bp, Artificial Sequence
  Description of Artificial Sequence: Synthetic oligonucleotide
tctctcaccctccacaggatgtatcgctg

SEQ ID NO: 353991 - DNA, 20 bp, Artificial Sequence
  Description of Artificial Sequence: Synthetic oligonucleotide
ggggccctggccctgaccca

SEQ ID NO: 353992 - DNA, 28 bp, Artificial Sequence
  Description of Artificial Sequence: Synthetic oligonucleotide
ctctcaccctccacaggatgtatcgctg

SEQ ID NO: 353993 - DNA, 21 bp, Artificial Sequence
  Description of Artificial Sequence: Synthetic oligonucleotide
gggccctggccctgacccaga

SEQ ID NO: 353994 - DNA, 28 bp, Artificial Sequence
  Description of Artificial Sequence: Synthetic oligonucleotide
tctcaccctccacaggatgtatcgctgc

SEQ ID NO: 353995 - DNA, 21 bp, Artificial Sequence
  Description of Artificial Sequence: Synthetic oligonucleotide
ggccctggccctgacccagac

SEQ ID NO: 353996 - DNA, 27 bp, Artificial Sequence
  Description of Artificial Sequence: Synthetic oligonucleotide
ctcaccctccacaggatgtatcgctgc

SEQ ID NO: 353997 - DNA, 22 bp, Artificial Sequence
  Description of Artificial Sequence: Synthetic oligonucleotide
gccctggccctgacccagacct

SEQ ID NO: 353998 - DNA, 27 bp, Artificial Sequence
  Description of Artificial Sequence: Synthetic oligonucleotide
tcaccctccacaggatgtatcgctgcg

SEQ ID NO: 353999 - DNA, 22 bp, Artificial Sequence
  Description of Artificial Sequence: Synthetic oligonucleotide
ccctggccctgacccagacctg

SEQ ID NO: 354000 - DNA, 27 bp, Artificial Sequence
  Description of Artificial Sequence: Synthetic oligonucleotide
caccctccacaggatgtatcgctgcga

SEQ ID NO: 354001 - DNA, 22 bp, Artificial Sequence
  Description of Artificial Sequence: Synthetic oligonucleotide
cctggccctgacccagacctgg

SEQ ID NO: 354002 - DNA, 27 bp, Artificial Sequence
  Description of Artificial Sequence: Synthetic oligonucleotide
accctccacaggatgtatcgctgcgac

SEQ ID NO: 354003 - DNA, 22 bp, Artificial Sequence
  Description of Artificial Sequence: Synthetic oligonucleotide
ctggccctgacccagacctggg

SEQ ID NO: 354004 - DNA, 26 bp, Artificial Sequence
  Description of Artificial Sequence: Synthetic oligonucleotide
ccctccacaggatgtatcgctgcgac

SEQ ID NO: 354005 - DNA, 22 bp, Artificial Sequence
  Description of Artificial Sequence: Synthetic oligonucleotide
tggccctgacccagacctgggc

SEQ ID NO: 354006 - DNA, 27 bp, Artificial Sequence
  Description of Artificial Sequence: Synthetic oligonucleotide
cctccacaggatgtatcgctgcgacga

SEQ ID NO: 354007 - DNA, 21 bp, Artificial Sequence
  Description of Artificial Sequence: Synthetic oligonucleotide
ggccctgacccagacctgggc

SEQ ID NO: 354008 - DNA, 27 bp, Artificial Sequence
  Description of Artificial Sequence: Synthetic oligonucleotide
ctccacaggatgtatcgctgcgacgag

SEQ ID NO: 354009 - DNA, 21 bp, Artificial Sequence
  Description of Artificial Sequence: Synthetic oligonucleotide
gccctgacccagacctgggcg

SEQ ID NO: 354010 - DNA, 27 bp, Artificial Sequence
  Description of Artificial Sequence: Synthetic oligonucleotide
tccacaggatgtatcgctgcgacgagg

SEQ ID NO: 354011 - DNA, 21 bp, Artificial Sequence
  Description of Artificial Sequence: Synthetic oligonucleotide
ccctgacccagacctgggcgg

SEQ ID NO: 354012 - DNA, 26 bp, Artificial Sequence
  Description of Artificial Sequence: Synthetic oligonucleotide
ccacaggatgtatcgctgcgacgagg

SEQ ID NO: 354013 - DNA, 21 bp, Artificial Sequence
  Description of Artificial Sequence: Synthetic oligonucleotide
cctgacccagacctgggcggg

SEQ ID NO: 354014 - DNA, 26 bp, Artificial Sequence
  Description of Artificial Sequence: Synthetic oligonucleotide
cacaggatgtatcgctgcgacgaggg

SEQ ID NO: 354015 - DNA, 22 bp, Artificial Sequence
  Description of Artificial Sequence: Synthetic oligonucleotide
ctgacccagacctgggcgggct

SEQ ID NO: 354016 - DNA, 26 bp, Artificial Sequence
  Description of Artificial Sequence: Synthetic oligonucleotide
acaggatgtatcgctgcgacgagggg

SEQ ID NO: 354017 - DNA, 22 bp, Artificial Sequence
  Description of Artificial Sequence: Synthetic oligonucleotide
tgacccagacctgggcgggctc

SEQ ID NO: 354018 - DNA, 25 bp, Artificial Sequence
  Description of Artificial Sequence: Synthetic oligonucleotide
caggatgtatcgctgcgacgagggg

SEQ ID NO: 354019 - DNA, 21 bp, Artificial Sequence
  Description of Artificial Sequence: Synthetic oligonucleotide
gacccagacctgggcgggctc

SEQ ID NO: 354020 - DNA, 25 bp, Artificial Sequence
  Description of Artificial Sequence: Synthetic oligonucleotide
aggatgtatcgctgcgacgaggggc

SEQ ID NO: 354021 - DNA, 21 bp, Artificial Sequence
  Description of Artificial Sequence: Synthetic oligonucleotide
acccagacctgggcgggctcc

SEQ ID NO: 354022 - DNA, 24 bp, Artificial Sequence
  Description of Artificial Sequence: Synthetic oligonucleotide
ggatgtatcgctgcgacgaggggc

SEQ ID NO: 354023 - DNA, 20 bp, Artificial Sequence
  Description of Artificial Sequence: Synthetic oligonucleotide
cccagacctgggcgggctcc

SEQ ID NO: 354024 - DNA, 24 bp, Artificial Sequence
  Description of Artificial Sequence: Synthetic oligonucleotide
gatgtatcgctgcgacgaggggcc

SEQ ID NO: 354025 - DNA, 21 bp, Artificial Sequence
  Description of Artificial Sequence: Synthetic oligonucleotide
ccagacctgggcgggctccca

SEQ ID NO: 354026 - DNA, 24 bp, Artificial Sequence
  Description of Artificial Sequence: Synthetic oligonucleotide
atgtatcgctgcgacgaggggccg

SEQ ID NO: 354027 - DNA, 22 bp, Artificial Sequence
  Description of Artificial Sequence: Synthetic oligonucleotide
cagacctgggcgggctcccact

SEQ ID NO: 354028 - DNA, 23 bp, Artificial Sequence
  Description of Artificial Sequence: Synthetic oligonucleotide
tgtatcgctgcgacgaggggccg

SEQ ID NO: 354029 - DNA, 22 bp, Artificial Sequence
  Description of Artificial Sequence: Synthetic oligonucleotide
agacctgggcgggctcccactc

SEQ ID NO: 354030 - DNA, 22 bp, Artificial Sequence
  Description of Artificial Sequence: Synthetic oligonucleotide
gtatcgctgcgacgaggggccg

SEQ ID NO: 354031 - DNA, 21 bp, Artificial Sequence
  Description of Artificial Sequence: Synthetic oligonucleotide
gacctgggcgggctcccactc

SEQ ID NO: 354032 - DNA, 23 bp, Artificial Sequence
  Description of Artificial Sequence: Synthetic oligonucleotide
tatcgctgcgacgaggggccgga

SEQ ID NO: 354033 - DNA, 23 bp, Artificial Sequence
  Description of Artificial Sequence: Synthetic oligonucleotide
acctgggcgggctcccactccat

SEQ ID NO: 354034 - DNA, 22 bp, Artificial Sequence
  Description of Artificial Sequence: Synthetic oligonucleotide
atcgctgcgacgaggggccgga

SEQ ID NO: 354035 - DNA, 22 bp, Artificial Sequence
  Description of Artificial Sequence: Synthetic oligonucleotide
cctgggcgggctcccactccat

SEQ ID NO: 354036 - DNA, 21 bp, Artificial Sequence
  Description of Artificial Sequence: Synthetic oligonucleotide
tcgctgcgacgaggggccgga

SEQ ID NO: 354037 - DNA, 23 bp, Artificial Sequence
  Description of Artificial Sequence: Synthetic oligonucleotide
ctgggcgggctcccactccatga

SEQ ID NO: 354038 - DNA, 20 bp, Artificial Sequence
  Description of Artificial Sequence: Synthetic oligonucleotide
cgctgcgacgaggggccgga

SEQ ID NO: 354039 - DNA, 23 bp, Artificial Sequence
  Description of Artificial Sequence: Synthetic oligonucleotide
tgggcgggctcccactccatgag

SEQ ID NO: 354040 - DNA, 20 bp, Artificial Sequence
  Description of Artificial Sequence: Synthetic oligonucleotide
gctgcgacgaggggccggag

SEQ ID NO: 354041 - DNA, 22 bp, Artificial Sequence
  Description of Artificial Sequence: Synthetic oligonucleotide
gggcgggctcccactccatgag

SEQ ID NO: 354042 - DNA, 20 bp, Artificial Sequence
  Description of Artificial Sequence: Synthetic oligonucleotide
ctgcgacgaggggccggagg

SEQ ID NO: 354043 - DNA, 27 bp, Artificial Sequence
  Description of Artificial Sequence: Synthetic oligonucleotide
ggcgggctcccactccatgaggtattt

SEQ ID NO: 354044 - DNA, 20 bp, Artificial Sequence
  Description of Artificial Sequence: Synthetic oligonucleotide
tgcgacgaggggccggaggg

SEQ ID NO: 354045 - DNA, 27 bp, Artificial Sequence
  Description of Artificial Sequence: Synthetic oligonucleotide
gcgggctcccactccatgaggtatttc

SEQ ID NO: 354046 - DNA, 20 bp, Artificial Sequence
  Description of Artificial Sequence: Synthetic oligonucleotide
gcgacgaggggccggagggt

SEQ ID NO: 354047 - DNA, 29 bp, Artificial Sequence
  Description of Artificial Sequence: Synthetic oligonucleotide
cgggctcccactccatgaggtatttcttc

SEQ ID NO: 354048 - DNA, 20 bp, Artificial Sequence
  Description of Artificial Sequence: Synthetic oligonucleotide
cgacgaggggccggaggggt

SEQ ID NO: 354049 - DNA, 30 bp, Artificial Sequence; identical to SEQ ID NO: 75
  Description of Artificial Sequence: Synthetic oligonucleotide

SEQ ID NO: 354050 - DNA, 20 bp, Artificial Sequence
  Description of Artificial Sequence: Synthetic oligonucleotide
gacgaggggccggaggggct

SEQ ID NO: 354051 - DNA, 32 bp, Artificial Sequence; identical to SEQ ID NO: 76
  Description of Artificial Sequence: Synthetic oligonucleotide

SEQ ID NO: 354052 - DNA, 20 bp, Artificial Sequence
  Description of Artificial Sequence: Synthetic oligonucleotide
acgaggggccggaggggcgt

SEQ ID NO: 354053 - DNA, 32 bp, Artificial Sequence; identical to SEQ ID NO: 77
  Description of Artificial Sequence: Synthetic oligonucleotide

SEQ ID NO: 354054 - DNA, 20 bp, Artificial Sequence
  Description of Artificial Sequence: Synthetic oligonucleotide
cgaggggccggaggggcgtt

SEQ ID NO: 354055 - DNA, 32 bp, Artificial Sequence; identical to SEQ ID NO: 78
  Description of Artificial Sequence: Synthetic oligonucleotide

SEQ ID NO: 354056 - DNA, 20 bp, Artificial Sequence
  Description of Artificial Sequence: Synthetic oligonucleotide
gaggggccggaggggcgctt

SEQ ID NO: 354057 - DNA, 33 bp, Artificial Sequence; identical to SEQ ID NO: 79
  Description of Artificial Sequence: Synthetic oligonucleotide

SEQ ID NO: 354058 - DNA, 20 bp, Artificial Sequence
  Description of Artificial Sequence: Synthetic oligonucleotide
aggggccggaggggcgcctt

SEQ ID NO: 354059 - DNA, 32 bp, Artificial Sequence; identical to SEQ ID NO: 80
  Description of Artificial Sequence: Synthetic oligonucleotide

SEQ ID NO: 354060 - DNA, 20 bp, Artificial Sequence
  Description of Artificial Sequence: Synthetic oligonucleotide
ggggccggaggggcgccttt

SEQ ID NO: 354061 - DNA, 33 bp, Artificial Sequence; identical to SEQ ID NO: 81
  Description of Artificial Sequence: Synthetic oligonucleotide

SEQ ID NO: 354062 - DNA, 20 bp, Artificial Sequence
  Description of Artificial Sequence: Synthetic oligonucleotide
gggccggaggggcgcctctt

SEQ ID NO: 354063 - DNA, 33 bp, Artificial Sequence; identical to SEQ ID NO: 82
  Description of Artificial Sequence: Synthetic oligonucleotide

SEQ ID NO: 354064 - DNA, 20 bp, Artificial Sequence
  Description of Artificial Sequence: Synthetic oligonucleotide
ggccggaggggcgcctccat

SEQ ID NO: 354065 - DNA, 33 bp, Artificial Sequence; identical to SEQ ID NO: 83
  Description of Artificial Sequence: Synthetic oligonucleotide

SEQ ID NO: 354066 - DNA, 20 bp, Artificial Sequence
  Description of Artificial Sequence: Synthetic oligonucleotide
gccggaggggcgcctccact

SEQ ID NO: 354067 - DNA, 32 bp, Artificial Sequence; identical to SEQ ID NO: 84
  Description of Artificial Sequence: Synthetic oligonucleotide

SEQ ID NO: 354068 - DNA, 20 bp, Artificial Sequence
  Description of Artificial Sequence: Synthetic oligonucleotide
ccggaggggcgcctccacct

SEQ ID NO: 354069 - DNA, 32 bp, Artificial Sequence; identical to SEQ ID NO: 85
  Description of Artificial Sequence: Synthetic oligonucleotide

SEQ ID NO: 354070 - DNA, 20 bp, Artificial Sequence
  Description of Artificial Sequence: Synthetic oligonucleotide
cggaggggcgcctccaccgt

SEQ ID NO: 354071 - DNA, 31 bp, Artificial Sequence; identical to SEQ ID NO: 86
  Description of Artificial Sequence: Synthetic oligonucleotide

SEQ ID NO: 354072 - DNA, 20 bp, Artificial Sequence
  Description of Artificial Sequence: Synthetic oligonucleotide
ggaggggcgcctccaccgct

SEQ ID NO: 354073 - DNA, 31 bp, Artificial Sequence; identical to SEQ ID NO: 87
  Description of Artificial Sequence: Synthetic oligonucleotide

SEQ ID NO: 354074 - DNA, 20 bp, Artificial Sequence
  Description of Artificial Sequence: Synthetic oligonucleotide
gaggggcgcctccaccgcgt

SEQ ID NO: 354075 - DNA, 31 bp, Artificial Sequence; identical to SEQ ID NO: 88
  Description of Artificial Sequence: Synthetic oligonucleotide

SEQ ID NO: 354076 - DNA, 20 bp, Artificial Sequence
  Description of Artificial Sequence: Synthetic oligonucleotide
aggggcgcctccaccgcggt

SEQ ID NO: 354077 - DNA, 30 bp, Artificial Sequence; identical to SEQ ID NO: 89
  Description of Artificial Sequence: Synthetic oligonucleotide

SEQ ID NO: 354078 - DNA, 20 bp, Artificial Sequence
  Description of Artificial Sequence: Synthetic oligonucleotide
ggggcgcctccaccgcggtt

SEQ ID NO: 354079 - DNA, 29 bp, Artificial Sequence
  Description of Artificial Sequence: Synthetic oligonucleotide
gaggtatttcttcacatccgtgtcccggc

SEQ ID NO: 354080 - DNA, 21 bp, Artificial Sequence
  Description of Artificial Sequence: Synthetic oligonucleotide
gggcgcctccaccgcggctat

SEQ ID NO: 354081 - DNA, 29 bp, Artificial Sequence
  Description of Artificial Sequence: Synthetic oligonucleotide
aggtatttcttcacatccgtgtcccggcc

SEQ ID NO: 354082 - DNA, 22 bp, Artificial Sequence
  Description of Artificial Sequence: Synthetic oligonucleotide
ggcgcctccaccgcggctatga

SEQ ID NO: 354083 - DNA, 28 bp, Artificial Sequence
  Description of Artificial Sequence: Synthetic oligonucleotide
ggtatttcttcacatccgtgtcccggcc

SEQ ID NO: 354084 - DNA, 22 bp, Artificial Sequence
  Description of Artificial Sequence: Synthetic oligonucleotide
gcgcctccaccgcggctatgac

SEQ ID NO: 354085 - DNA, 28 bp, Artificial Sequence
  Description of Artificial Sequence: Synthetic oligonucleotide
gtatttcttcacatccgtgtcccggccc

SEQ ID NO: 354086 - DNA, 23 bp, Artificial Sequence
  Description of Artificial Sequence: Synthetic oligonucleotide
cgcctccaccgcggctatgacca

SEQ ID NO: 354087 - DNA, 28 bp, Artificial Sequence
  Description of Artificial Sequence: Synthetic oligonucleotide
tatttcttcacatccgtgtcccggcccg

SEQ ID NO: 354088 - DNA, 25 bp, Artificial Sequence
  Description of Artificial Sequence: Synthetic oligonucleotide
gcctccaccgcggctatgaccacta

SEQ ID NO: 354089 - DNA, 27 bp, Artificial Sequence
  Description of Artificial Sequence: Synthetic oligonucleotide
atttcttcacatccgtgtcccggcccg

SEQ ID NO: 354090 - DNA, 25 bp, Artificial Sequence
  Description of Artificial Sequence: Synthetic oligonucleotide
cctccaccgcggctatgaccactac

SEQ ID NO: 354091 - DNA, 26 bp, Artificial Sequence
  Description of Artificial Sequence: Synthetic oligonucleotide
tttcttcacatccgtgtcccggcccg

SEQ ID NO: 354092 - DNA, 25 bp, Artificial Sequence
  Description of Artificial Sequence: Synthetic oligonucleotide
ctccaccgcggctatgaccactacg

SEQ ID NO: 354093 - DNA, 25 bp, Artificial Sequence
  Description of Artificial Sequence: Synthetic oligonucleotide
ttcttcacatccgtgtcccggcccg

SEQ ID NO: 354094 - DNA, 25 bp, Artificial Sequence
  Description of Artificial Sequence: Synthetic oligonucleotide
tccaccgcggctatgaccactacgc

SEQ ID NO: 354095 - DNA, 24 bp, Artificial Sequence
  Description of Artificial Sequence: Synthetic oligonucleotide
tcttcacatccgtgtcccggcccg

SEQ ID NO: 354096 - DNA, 24 bp, Artificial Sequence
  Description of Artificial Sequence: Synthetic oligonucleotide
ccaccgcggctatgaccactacgc

SEQ ID NO: 354097 - DNA, 23 bp, Artificial Sequence
  Description of Artificial Sequence: Synthetic oligonucleotide
cttcacatccgtgtcccggcccg

SEQ ID NO: 354098 - DNA, 26 bp, Artificial Sequence
  Description of Artificial Sequence: Synthetic oligonucleotide
caccgcggctatgaccactacgccta

SEQ ID NO: 354099 - DNA, 23 bp, Artificial Sequence
  Description of Artificial Sequence: Synthetic oligonucleotide
ttcacatccgtgtcccggcccgg

SEQ ID NO: 354100 - DNA, 26 bp, Artificial Sequence
  Description of Artificial Sequence: Synthetic oligonucleotide
accgcggctatgaccactacgcctac

SEQ ID NO: 354101 - DNA, 22 bp, Artificial Sequence
  Description of Artificial Sequence: Synthetic oligonucleotide
tcacatccgtgtcccggcccgg

SEQ ID NO: 354102 - DNA, 25 bp, Artificial Sequence
  Description of Artificial Sequence: Synthetic oligonucleotide
ccgcggctatgaccactacgcctac

SEQ ID NO: 354103 - DNA, 21 bp, Artificial Sequence
  Description of Artificial Sequence: Synthetic oligonucleotide
cacatccgtgtcccggcccgg

SEQ ID NO: 354104 - DNA, 26 bp, Artificial Sequence
  Description of Artificial Sequence: Synthetic oligonucleotide
cgcggctatgaccactacgcctacga

SEQ ID NO: 354105 - DNA, 21 bp, Artificial Sequence
  Description of Artificial Sequence: Synthetic oligonucleotide
acatccgtgtcccggcccggc

SEQ ID NO: 354106 - DNA, 26 bp, Artificial Sequence
  Description of Artificial Sequence: Synthetic oligonucleotide
gcggctatgaccactacgcctacgac

SEQ ID NO: 354107 - DNA, 20 bp, Artificial Sequence
  Description of Artificial Sequence: Synthetic oligonucleotide
catccgtgtcccggcccggc

SEQ ID NO: 354108 - DNA, 26 bp, Artificial Sequence
  Description of Artificial Sequence: Synthetic oligonucleotide
cggctatgaccactacgcctacgacc

SEQ ID NO: 354109 - DNA, 20 bp, Artificial Sequence
  Description of Artificial Sequence: Synthetic oligonucleotide
atccgtgtcccggcccggcc

SEQ ID NO: 354110 - DNA, 26 bp, Artificial Sequence
  Description of Artificial Sequence: Synthetic oligonucleotide
ggctatgaccactacgcctacgaccg

SEQ ID NO: 354111 - DNA, 20 bp, Artificial Sequence
  Description of Artificial Sequence: Synthetic oligonucleotide
tccgtgtcccggcccggcct

SEQ ID NO: 354112 - DNA, 27 bp, Artificial Sequence
  Description of Artificial Sequence: Synthetic oligonucleotide
gctatgaccactacgcctacgaccgca

SEQ ID NO: 354113 - DNA, 20 bp, Artificial Sequence
  Description of Artificial Sequence: Synthetic oligonucleotide
ccgtgtcccggcccggcctt

SEQ ID NO: 354114 - DNA, 28 bp, Artificial Sequence
  Description of Artificial Sequence: Synthetic oligonucleotide
ctatgaccactacgcctacgaccgcaag

SEQ ID NO: 354115 - DNA, 20 bp, Artificial Sequence
  Description of Artificial Sequence: Synthetic oligonucleotide
cgtgtcccggcccggccgtt

SEQ ID NO: 354116 - DNA, 28 bp, Artificial Sequence
  Description of Artificial Sequence: Synthetic oligonucleotide
tatgaccactacgcctacgaccgcaagg

SEQ ID NO: 354117 - DNA, 20 bp, Artificial Sequence
  Description of Artificial Sequence: Synthetic oligonucleotide
gtgtcccggcccggccgctt

SEQ ID NO: 354118 - DNA, 27 bp, Artificial Sequence
  Description of Artificial Sequence: Synthetic oligonucleotide
atgaccactacgcctacgaccgcaagg

SEQ ID NO: 354119 - DNA, 20 bp, Artificial Sequence
  Description of Artificial Sequence: Synthetic oligonucleotide
tgtcccggcccggccgcgtt

SEQ ID NO: 354120 - DNA, 27 bp, Artificial Sequence
  Description of Artificial Sequence: Synthetic oligonucleotide
tgaccactacgcctacgaccgcaagga

SEQ ID NO: 354121 - DNA, 20 bp, Artificial Sequence
  Description of Artificial Sequence: Synthetic oligonucleotide
gtcccggcccggccgcgttt

SEQ ID NO: 354122 - DNA, 27 bp, Artificial Sequence
  Description of Artificial Sequence: Synthetic oligonucleotide
gaccactacgcctacgaccgcaaggat

SEQ ID NO: 354123 - DNA, 20 bp, Artificial Sequence
  Description of Artificial Sequence: Synthetic oligonucleotide
tcccggcccggccgcggttt

SEQ ID NO: 354124 - DNA, 29 bp, Artificial Sequence
  Description of Artificial Sequence: Synthetic oligonucleotide
accactacgcctacgaccgcaaggatttc

SEQ ID NO: 354125 - DNA, 20 bp, Artificial Sequence
  Description of Artificial Sequence: Synthetic oligonucleotide
cccggcccggccgcggtttt

SEQ ID NO: 354126 - DNA, 28 bp, Artificial Sequence
  Description of Artificial Sequence: Synthetic oligonucleotide
ccactacgcctacgaccgcaaggatttc

SEQ ID NO: 354127 - DNA, 20 bp, Artificial Sequence
  Description of Artificial Sequence: Synthetic oligonucleotide
ccggcccggccgcgggtttt

SEQ ID NO: 354128 - DNA, 30 bp, Artificial Sequence; identical to SEQ ID NO: 231670
  Description of Artificial Sequence: Synthetic oligonucleotide

SEQ ID NO: 354129 - DNA, 20 bp, Artificial Sequence
  Description of Artificial Sequence: Synthetic oligonucleotide
cggcccggccgcggggattt

SEQ ID NO: 354130 - DNA, 30 bp, Artificial Sequence; identical to SEQ ID NO: 231671
  Description of Artificial Sequence: Synthetic oligonucleotide

SEQ ID NO: 354131 - DNA, 20 bp, Artificial Sequence
  Description of Artificial Sequence: Synthetic oligonucleotide
ggcccggccgcggggagttt

SEQ ID NO: 354132 - DNA, 29 bp, Artificial Sequence
  Description of Artificial Sequence: Synthetic oligonucleotide
ctacgcctacgaccgcaaggatttcatcg

SEQ ID NO: 354133 - DNA, 20 bp, Artificial Sequence
  Description of Artificial Sequence: Synthetic oligonucleotide
gcccggccgcggggagcttt

SEQ ID NO: 354134 - DNA, 29 bp, Artificial Sequence
  Description of Artificial Sequence: Synthetic oligonucleotide
tacgcctacgaccgcaaggatttcatcgc

SEQ ID NO: 354135 - DNA, 20 bp, Artificial Sequence
  Description of Artificial Sequence: Synthetic oligonucleotide
cccggccgcggggagccttt

SEQ ID NO: 354136 - DNA, 28 bp, Artificial Sequence
  Description of Artificial Sequence: Synthetic oligonucleotide
acgcctacgaccgcaaggatttcatcgc

SEQ ID NO: 354137 - DNA, 20 bp, Artificial Sequence
  Description of Artificial Sequence: Synthetic oligonucleotide
ccggccgcggggagcccttt

SEQ ID NO: 354138 - DNA, 27 bp, Artificial Sequence
  Description of Artificial Sequence: Synthetic oligonucleotide
cgcctacgaccgcaaggatttcatcgc

SEQ ID NO: 354139 - DNA, 20 bp, Artificial Sequence
  Description of Artificial Sequence: Synthetic oligonucleotide
cggccgcggggagccccttt

SEQ ID NO: 354140 - DNA, 27 bp, Artificial Sequence
  Description of Artificial Sequence: Synthetic oligonucleotide
gcctacgaccgcaaggatttcatcgcc

SEQ ID NO: 354141 - DNA, 20 bp, Artificial Sequence
  Description of Artificial Sequence: Synthetic oligonucleotide
ggccgcggggagccccgttt

SEQ ID NO: 354142 - DNA, 27 bp, Artificial Sequence
  Description of Artificial Sequence: Synthetic oligonucleotide
cctacgaccgcaaggatttcatcgccc

SEQ ID NO: 354143 - DNA, 20 bp, Artificial Sequence
  Description of Artificial Sequence: Synthetic oligonucleotide
gccgcggggagccccgcttt

SEQ ID NO: 354144 - DNA, 28 bp, Artificial Sequence
  Description of Artificial Sequence: Synthetic oligonucleotide
ctacgaccgcaaggatttcatcgccctc

SEQ ID NO: 354145 - DNA, 21 bp, Artificial Sequence
  Description of Artificial Sequence: Synthetic oligonucleotide
ccgcggggagccccgcttcat

SEQ ID NO: 354146 - DNA, 30 bp, Artificial Sequence; identical to SEQ ID NO: 231679
  Description of Artificial Sequence: Synthetic oligonucleotide

SEQ ID NO: 354147 - DNA, 21 bp, Artificial Sequence
  Description of Artificial Sequence: Synthetic oligonucleotide
cgcggggagccccgcttcatc

SEQ ID NO: 354148 - DNA, 29 bp, Artificial Sequence
  Description of Artificial Sequence: Synthetic oligonucleotide
acgaccgcaaggatttcatcgccctcaac

SEQ ID NO: 354149 - DNA, 21 bp, Artificial Sequence
  Description of Artificial Sequence: Synthetic oligonucleotide
gcggggagccccgcttcatcg

SEQ ID NO: 354150 - DNA, 28 bp, Artificial Sequence
  Description of Artificial Sequence: Synthetic oligonucleotide
cgaccgcaaggatttcatcgccctcaac

SEQ ID NO: 354151 - DNA, 21 bp, Artificial Sequence
  Description of Artificial Sequence: Synthetic oligonucleotide
cggggagccccgcttcatcgc

SEQ ID NO: 354152 - DNA, 28 bp, Artificial Sequence
  Description of Artificial Sequence: Synthetic oligonucleotide
gaccgcaaggatttcatcgccctcaacg

SEQ ID NO: 354153 - DNA, 21 bp, Artificial Sequence
  Description of Artificial Sequence: Synthetic oligonucleotide
ggggagccccgcttcatcgcc

SEQ ID NO: 354154 - DNA, 29 bp, Artificial Sequence
  Description of Artificial Sequence: Synthetic oligonucleotide
accgcaaggatttcatcgccctcaacgag

SEQ ID NO: 354155 - DNA, 22 bp, Artificial Sequence
  Description of Artificial Sequence: Synthetic oligonucleotide
gggagccccgcttcatcgccgt

SEQ ID NO: 354156 - DNA, 28 bp, Artificial Sequence
  Description of Artificial Sequence: Synthetic oligonucleotide
ccgcaaggatttcatcgccctcaacgag

SEQ ID NO: 354157 - DNA, 22 bp, Artificial Sequence
  Description of Artificial Sequence: Synthetic oligonucleotide
ggagccccgcttcatcgccgtg

SEQ ID NO: 354158 - DNA, 28 bp, Artificial Sequence
  Description of Artificial Sequence: Synthetic oligonucleotide
cgcaaggatttcatcgccctcaacgagg

SEQ ID NO: 354159 - DNA, 22 bp, Artificial Sequence
  Description of Artificial Sequence: Synthetic oligonucleotide
gagccccgcttcatcgccgtgg

SEQ ID NO: 354160 - DNA, 29 bp, Artificial Sequence
  Description of Artificial Sequence: Synthetic oligonucleotide
gcaaggatttcatcgccctcaacgaggac

SEQ ID NO: 354161 - DNA, 22 bp, Artificial Sequence
  Description of Artificial Sequence: Synthetic oligonucleotide
agccccgcttcatcgccgtggg

SEQ ID NO: 354162 - DNA, 29 bp, Artificial Sequence
  Description of Artificial Sequence: Synthetic oligonucleotide
caaggatttcatcgccctcaacgaggacc

SEQ ID NO: 354163 - DNA, 21 bp, Artificial Sequence
  Description of Artificial Sequence: Synthetic oligonucleotide
gccccgcttcatcgccgtggg

SEQ ID NO: 354164 - DNA, 30 bp, Artificial Sequence; identical to SEQ ID NO: 231688
  Description of Artificial Sequence: Synthetic oligonucleotide

SEQ ID NO: 354165 - DNA, 23 bp, Artificial Sequence
  Description of Artificial Sequence: Synthetic oligonucleotide
ccccgcttcatcgccgtgggcta

SEQ ID NO: 354166 - DNA, 29 bp, Artificial Sequence
  Description of Artificial Sequence: Synthetic oligonucleotide
aggatttcatcgccctcaacgaggaccag

SEQ ID NO: 354167 - DNA, 23 bp, Artificial Sequence
  Description of Artificial Sequence: Synthetic oligonucleotide
cccgcttcatcgccgtgggctac

SEQ ID NO: 354168 - DNA, 28 bp, Artificial Sequence
  Description of Artificial Sequence: Synthetic oligonucleotide
ggatttcatcgccctcaacgaggaccag

SEQ ID NO: 354169 - DNA, 24 bp, Artificial Sequence
  Description of Artificial Sequence: Synthetic oligonucleotide
ccgcttcatcgccgtgggctacgt

SEQ ID NO: 354170 - DNA, 28 bp, Artificial Sequence
  Description of Artificial Sequence: Synthetic oligonucleotide
gatttcatcgccctcaacgaggaccagc

SEQ ID NO: 354171 - DNA, 24 bp, Artificial Sequence
  Description of Artificial Sequence: Synthetic oligonucleotide
cgcttcatcgccgtgggctacgtg

SEQ ID NO: 354172 - DNA, 28 bp, Artificial Sequence
  Description of Artificial Sequence: Synthetic oligonucleotide
atttcatcgccctcaacgaggaccagcg

SEQ ID NO: 354173 - DNA, 25 bp, Artificial Sequence
  Description of Artificial Sequence: Synthetic oligonucleotide
gcttcatcgccgtgggctacgtgga

SEQ ID NO: 354174 - DNA, 27 bp, Artificial Sequence
  Description of Artificial Sequence: Synthetic oligonucleotide
tttcatcgccctcaacgaggaccagcg

SEQ ID NO: 354175 - DNA, 25 bp, Artificial Sequence
  Description of Artificial Sequence: Synthetic oligonucleotide
cttcatcgccgtgggctacgtggac

SEQ ID NO: 354176 - DNA, 26 bp, Artificial Sequence
  Description of Artificial Sequence: Synthetic oligonucleotide
ttcatcgccctcaacgaggaccagcg

SEQ ID NO: 354177 - DNA, 26 bp, Artificial Sequence
  Description of Artificial Sequence: Synthetic oligonucleotide
ttcatcgccgtgggctacgtggacga

SEQ ID NO: 354178 - DNA, 25 bp, Artificial Sequence
  Description of Artificial Sequence: Synthetic oligonucleotide
tcatcgccctcaacgaggaccagcg

SEQ ID NO: 354179 - DNA, 25 bp, Artificial Sequence
  Description of Artificial Sequence: Synthetic oligonucleotide
tcatcgccgtgggctacgtggacga

SEQ ID NO: 354180 - DNA, 24 bp, Artificial Sequence
  Description of Artificial Sequence: Synthetic oligonucleotide
catcgccctcaacgaggaccagcg

SEQ ID NO: 354181 - DNA, 24 bp, Artificial Sequence
  Description of Artificial Sequence: Synthetic oligonucleotide
catcgccgtgggctacgtggacga

SEQ ID NO: 354182 - DNA, 25 bp, Artificial Sequence
  Description of Artificial Sequence: Synthetic oligonucleotide
atcgccctcaacgaggaccagcgct

SEQ ID NO: 354183 - DNA, 25 bp, Artificial Sequence
  Description of Artificial Sequence: Synthetic oligonucleotide
atcgccgtgggctacgtggacgaca

SEQ ID NO: 354184 - DNA, 24 bp, Artificial Sequence
  Description of Artificial Sequence: Synthetic oligonucleotide
tcgccctcaacgaggaccagcgct

SEQ ID NO: 354185 - DNA, 24 bp, Artificial Sequence
  Description of Artificial Sequence: Synthetic oligonucleotide
tcgccgtgggctacgtggacgaca

SEQ ID NO: 354186 - DNA, 23 bp, Artificial Sequence
  Description of Artificial Sequence: Synthetic oligonucleotide
cgccctcaacgaggaccagcgct

SEQ ID NO: 354187 - DNA, 23 bp, Artificial Sequence
  Description of Artificial Sequence: Synthetic oligonucleotide
cgccgtgggctacgtggacgaca

SEQ ID NO: 354188 - DNA, 23 bp, Artificial Sequence
  Description of Artificial Sequence: Synthetic oligonucleotide
gccctcaacgaggaccagcgctc

SEQ ID NO: 354189 - DNA, 23 bp, Artificial Sequence
  Description of Artificial Sequence: Synthetic oligonucleotide
gccgtgggctacgtggacgacac

SEQ ID NO: 354190 - DNA, 24 bp, Artificial Sequence
  Description of Artificial Sequence: Synthetic oligonucleotide
ccctcaacgaggaccagcgctcct

SEQ ID NO: 354191 - DNA, 23 bp, Artificial Sequence
  Description of Artificial Sequence: Synthetic oligonucleotide
ccgtgggctacgtggacgacacg

SEQ ID NO: 354192 - DNA, 24 bp, Artificial Sequence
  Description of Artificial Sequence: Synthetic oligonucleotide
cctcaacgaggaccagcgctcctc

SEQ ID NO: 354193 - DNA, 24 bp, Artificial Sequence
  Description of Artificial Sequence: Synthetic oligonucleotide
cgtgggctacgtggacgacacgca

SEQ ID NO: 354194 - DNA, 25 bp, Artificial Sequence
  Description of Artificial Sequence: Synthetic oligonucleotide
ctcaacgaggaccagcgctcctcga

SEQ ID NO: 354195 - DNA, 26 bp, Artificial Sequence
  Description of Artificial Sequence: Synthetic oligonucleotide
gtgggctacgtggacgacacgcagtt

SEQ ID NO: 354196 - DNA, 25 bp, Artificial Sequence
  Description of Artificial Sequence: Synthetic oligonucleotide
tcaacgaggaccagcgctcctcgac

SEQ ID NO: 354197 - DNA, 26 bp, Artificial Sequence
  Description of Artificial Sequence: Synthetic oligonucleotide
tgggctacgtggacgacacgcagttc

SEQ ID NO: 354198 - DNA, 24 bp, Artificial Sequence
  Description of Artificial Sequence: Synthetic oligonucleotide
caacgaggaccagcgctcctcgac

SEQ ID NO: 354199 - DNA, 25 bp, Artificial Sequence
  Description of Artificial Sequence: Synthetic oligonucleotide
gggctacgtggacgacacgcagttc

SEQ ID NO: 354200 - DNA, 24 bp, Artificial Sequence
  Description of Artificial Sequence: Synthetic oligonucleotide
aacgaggaccagcgctcctcgacc

SEQ ID NO: 354201 - DNA, 26 bp, Artificial Sequence
  Description of Artificial Sequence: Synthetic oligonucleotide
ggctacgtggacgacacgcagttcgt

SEQ ID NO: 354202 - DNA, 23 bp, Artificial Sequence
  Description of Artificial Sequence: Synthetic oligonucleotide
acgaggaccagcgctcctcgacc

SEQ ID NO: 354203 - DNA, 26 bp, Artificial Sequence
  Description of Artificial Sequence: Synthetic oligonucleotide
gctacgtggacgacacgcagttcgtg

SEQ ID NO: 354204 - DNA, 22 bp, Artificial Sequence
  Description of Artificial Sequence: Synthetic oligonucleotide
cgaggaccagcgctcctcgacc

SEQ ID NO: 354205 - DNA, 26 bp, Artificial Sequence
  Description of Artificial Sequence: Synthetic oligonucleotide
ctacgtggacgacacgcagttcgtgc

SEQ ID NO: 354206 - DNA, 22 bp, Artificial Sequence
  Description of Artificial Sequence: Synthetic oligonucleotide
gaggaccagcgctcctcgaccg

SEQ ID NO: 354207 - DNA, 26 bp, Artificial Sequence
  Description of Artificial Sequence: Synthetic oligonucleotide
tacgtggacgacacgcagttcgtgcg

SEQ ID NO: 354208 - DNA, 22 bp, Artificial Sequence
  Description of Artificial Sequence: Synthetic oligonucleotide
aggaccagcgctcctcgaccgc

SEQ ID NO: 354209 - DNA, 25 bp, Artificial Sequence
  Description of Artificial Sequence: Synthetic oligonucleotide
acgtggacgacacgcagttcgtgcg

SEQ ID NO: 354210 - DNA, 21 bp, Artificial Sequence
  Description of Artificial Sequence: Synthetic oligonucleotide
ggaccagcgctcctcgaccgc

SEQ ID NO: 354211 - DNA, 24 bp, Artificial Sequence
  Description of Artificial Sequence: Synthetic oligonucleotide
cgtggacgacacgcagttcgtgcg

SEQ ID NO: 354212 - DNA, 21 bp, Artificial Sequence
  Description of Artificial Sequence: Synthetic oligonucleotide
gaccagcgctcctcgaccgcg

SEQ ID NO: 354213 - DNA, 26 bp, Artificial Sequence
  Description of Artificial Sequence: Synthetic oligonucleotide
gtggacgacacgcagttcgtgcggtt

SEQ ID NO: 354214 - DNA, 21 bp, Artificial Sequence
  Description of Artificial Sequence: Synthetic oligonucleotide
accagcgctcctcgaccgcgg

SEQ ID NO: 354215 - DNA, 26 bp, Artificial Sequence
  Description of Artificial Sequence: Synthetic oligonucleotide
tggacgacacgcagttcgtgcggttc

SEQ ID NO: 354216 - DNA, 20 bp, Artificial Sequence
  Description of Artificial Sequence: Synthetic oligonucleotide
ccagcgctcctcgaccgcgg

SEQ ID NO: 354217 - DNA, 25 bp, Artificial Sequence
  Description of Artificial Sequence: Synthetic oligonucleotide
ggacgacacgcagttcgtgcggttc

SEQ ID NO: 354218 - DNA, 20 bp, Artificial Sequence
  Description of Artificial Sequence: Synthetic oligonucleotide
cagcgctcctcgaccgcggc

SEQ ID NO: 354219 - DNA, 26 bp, Artificial Sequence
  Description of Artificial Sequence: Synthetic oligonucleotide
gacgacacgcagttcgtgcggttcga

SEQ ID NO: 354220 - DNA, 20 bp, Artificial Sequence
  Description of Artificial Sequence: Synthetic oligonucleotide
agcgctcctcgaccgcggcc

SEQ ID NO: 354221 - DNA, 27 bp, Artificial Sequence
  Description of Artificial Sequence: Synthetic oligonucleotide
acgacacgcagttcgtgcggttcgaca

SEQ ID NO: 354222 - DNA, 20 bp, Artificial Sequence
  Description of Artificial Sequence: Synthetic oligonucleotide
gcgctcctcgaccgcggcct

SEQ ID NO: 354223 - DNA, 26 bp, Artificial Sequence
  Description of Artificial Sequence: Synthetic oligonucleotide
cgacacgcagttcgtgcggttcgaca

SEQ ID NO: 354224 - DNA, 20 bp, Artificial Sequence
  Description of Artificial Sequence: Synthetic oligonucleotide
cgctcctcgaccgcggccga

SEQ ID NO: 354225 - DNA, 26 bp, Artificial Sequence
  Description of Artificial Sequence: Synthetic oligonucleotide
gacacgcagttcgtgcggttcgacag

SEQ ID NO: 354226 - DNA, 21 bp, Artificial Sequence
  Description of Artificial Sequence: Synthetic oligonucleotide
gctcctcgaccgcggccgaca

SEQ ID NO: 354227 - DNA, 26 bp, Artificial Sequence
  Description of Artificial Sequence: Synthetic oligonucleotide
acacgcagttcgtgcggttcgacagc

SEQ ID NO: 354228 - DNA, 21 bp, Artificial Sequence
  Description of Artificial Sequence: Synthetic oligonucleotide
ctcctcgaccgcggccgacac

SEQ ID NO: 354229 - DNA, 25 bp, Artificial Sequence
  Description of Artificial Sequence: Synthetic oligonucleotide
cacgcagttcgtgcggttcgacagc

SEQ ID NO: 354230 - DNA, 21 bp, Artificial Sequence
  Description of Artificial Sequence: Synthetic oligonucleotide
tcctcgaccgcggccgacacg

SEQ ID NO: 354231 - DNA, 26 bp, Artificial Sequence
  Description of Artificial Sequence: Synthetic oligonucleotide
acgcagttcgtgcggttcgacagcga

SEQ ID NO: 354232 - DNA, 20 bp, Artificial Sequence
  Description of Artificial Sequence: Synthetic oligonucleotide
cctcgaccgcggccgacacg

SEQ ID NO: 354233 - DNA, 25 bp, Artificial Sequence
  Description of Artificial Sequence: Synthetic oligonucleotide
cgcagttcgtgcggttcgacagcga

SEQ ID NO: 354234 - DNA, 20 bp, Artificial Sequence
  Description of Artificial Sequence: Synthetic oligonucleotide
ctcgaccgcggccgacacgg

SEQ ID NO: 354235 - DNA, 25 bp, Artificial Sequence
  Description of Artificial Sequence: Synthetic oligonucleotide
gcagttcgtgcggttcgacagcgac

SEQ ID NO: 354236 - DNA, 20 bp, Artificial Sequence
  Description of Artificial Sequence: Synthetic oligonucleotide
tcgaccgcggccgacacggc

SEQ ID NO: 354237 - DNA, 25 bp, Artificial Sequence
  Description of Artificial Sequence: Synthetic oligonucleotide
cagttcgtgcggttcgacagcgacg

SEQ ID NO: 354238 - DNA, 20 bp, Artificial Sequence
  Description of Artificial Sequence: Synthetic oligonucleotide
cgaccgcggccgacacggct

SEQ ID NO: 354239 - DNA, 25 bp, Artificial Sequence
  Description of Artificial Sequence: Synthetic oligonucleotide
agttcgtgcggttcgacagcgacgc

SEQ ID NO: 354240 - DNA, 20 bp, Artificial Sequence
  Description of Artificial Sequence: Synthetic oligonucleotide
gaccgcggccgacacggcgt

SEQ ID NO: 354241 - DNA, 24 bp, Artificial Sequence
  Description of Artificial Sequence: Synthetic oligonucleotide
gttcgtgcggttcgacagcgacgc

SEQ ID NO: 354242 - DNA, 20 bp, Artificial Sequence
  Description of Artificial Sequence: Synthetic oligonucleotide
accgcggccgacacggcgct

SEQ ID NO: 354243 - DNA, 24 bp, Artificial Sequence
  Description of Artificial Sequence: Synthetic oligonucleotide
ttcgtgcggttcgacagcgacgcc

SEQ ID NO: 354244 - DNA, 20 bp, Artificial Sequence
  Description of Artificial Sequence: Synthetic oligonucleotide
ccgcggccgacacggcgctt

SEQ ID NO: 354245 - DNA, 23 bp, Artificial Sequence
  Description of Artificial Sequence: Synthetic oligonucleotide
tcgtgcggttcgacagcgacgcc

SEQ ID NO: 354246 - DNA, 20 bp, Artificial Sequence
  Description of Artificial Sequence: Synthetic oligonucleotide
cgcggccgacacggcgcctt

SEQ ID NO: 354247 - DNA, 22 bp, Artificial Sequence
  Description of Artificial Sequence: Synthetic oligonucleotide
cgtgcggttcgacagcgacgcc

SEQ ID NO: 354248 - DNA, 20 bp, Artificial Sequence
  Description of Artificial Sequence: Synthetic oligonucleotide
gcggccgacacggcgcctca

SEQ ID NO: 354249 - DNA, 22 bp, Artificial Sequence
  Description of Artificial Sequence: Synthetic oligonucleotide
gtgcggttcgacagcgacgccg

SEQ ID NO: 354250 - DNA, 22 bp, Artificial Sequence
  Description of Artificial Sequence: Synthetic oligonucleotide
cggccgacacggcgcctcagat

SEQ ID NO: 354251 - DNA, 22 bp, Artificial Sequence
  Description of Artificial Sequence: Synthetic oligonucleotide
tgcggttcgacagcgacgccgc

SEQ ID NO: 354252 - DNA, 23 bp, Artificial Sequence
  Description of Artificial Sequence: Synthetic oligonucleotide
ggccgacacggcgcctcagatca

SEQ ID NO: 354253 - DNA, 21 bp, Artificial Sequence
  Description of Artificial Sequence: Synthetic oligonucleotide
gcggttcgacagcgacgccgc

SEQ ID NO: 354254 - DNA, 23 bp, Artificial Sequence
  Description of Artificial Sequence: Synthetic oligonucleotide
gccgacacggcgcctcagatcac

SEQ ID NO: 354255 - DNA, 22 bp, Artificial Sequence
  Description of Artificial Sequence: Synthetic oligonucleotide
cggttcgacagcgacgccgcga

SEQ ID NO: 354256 - DNA, 23 bp, Artificial Sequence
  Description of Artificial Sequence: Synthetic oligonucleotide
ccgacacggcgcctcagatcacc

SEQ ID NO: 354257 - DNA, 22 bp, Artificial Sequence
  Description of Artificial Sequence: Synthetic oligonucleotide
ggttcgacagcgacgccgcgag

SEQ ID NO: 354258 - DNA, 24 bp, Artificial Sequence
  Description of Artificial Sequence: Synthetic oligonucleotide
cgacacggcgcctcagatcaccct

SEQ ID NO: 354259 - DNA, 22 bp, Artificial Sequence
  Description of Artificial Sequence: Synthetic oligonucleotide
gttcgacagcgacgccgcgagc

SEQ ID NO: 354260 - DNA, 24 bp, Artificial Sequence
  Description of Artificial Sequence: Synthetic oligonucleotide
gacacggcgcctcagatcaccctg

SEQ ID NO: 354261 - DNA, 23 bp, Artificial Sequence
  Description of Artificial Sequence: Synthetic oligonucleotide
ttcgacagcgacgccgcgagcca

SEQ ID NO: 354262 - DNA, 24 bp, Artificial Sequence
  Description of Artificial Sequence: Synthetic oligonucleotide
acacggcgcctcagatcaccctgc

SEQ ID NO: 354263 - DNA, 22 bp, Artificial Sequence
  Description of Artificial Sequence: Synthetic oligonucleotide
tcgacagcgacgccgcgagcca

SEQ ID NO: 354264 - DNA, 23 bp, Artificial Sequence
  Description of Artificial Sequence: Synthetic oligonucleotide
cacggcgcctcagatcaccctgc

SEQ ID NO: 354265 - DNA, 21 bp, Artificial Sequence
  Description of Artificial Sequence: Synthetic oligonucleotide
cgacagcgacgccgcgagcca

SEQ ID NO: 354266 - DNA, 23 bp, Artificial Sequence
  Description of Artificial Sequence: Synthetic oligonucleotide
acggcgcctcagatcaccctgcg

SEQ ID NO: 354267 - DNA, 23 bp, Artificial Sequence
  Description of Artificial Sequence: Synthetic oligonucleotide
gacagcgacgccgcgagccagaa

SEQ ID NO: 354268 - DNA, 22 bp, Artificial Sequence
  Description of Artificial Sequence: Synthetic oligonucleotide
cggcgcctcagatcaccctgcg

SEQ ID NO: 354269 - DNA, 25 bp, Artificial Sequence
  Description of Artificial Sequence: Synthetic oligonucleotide
acagcgacgccgcgagccagaagat

SEQ ID NO: 354270 - DNA, 24 bp, Artificial Sequence
  Description of Artificial Sequence: Synthetic oligonucleotide
ggcgcctcagatcaccctgcgcaa

SEQ ID NO: 354271 - DNA, 24 bp, Artificial Sequence
  Description of Artificial Sequence: Synthetic oligonucleotide
cagcgacgccgcgagccagaagat

SEQ ID NO: 354272 - DNA, 25 bp, Artificial Sequence
  Description of Artificial Sequence: Synthetic oligonucleotide
gcgcctcagatcaccctgcgcaaga

SEQ ID NO: 354273 - DNA, 24 bp, Artificial Sequence
  Description of Artificial Sequence: Synthetic oligonucleotide
agcgacgccgcgagccagaagatg

SEQ ID NO: 354274 - DNA, 25 bp, Artificial Sequence
  Description of Artificial Sequence: Synthetic oligonucleotide
cgcctcagatcaccctgcgcaagag

SEQ ID NO: 354275 - DNA, 23 bp, Artificial Sequence
  Description of Artificial Sequence: Synthetic oligonucleotide
gcgacgccgcgagccagaagatg

SEQ ID NO: 354276 - DNA, 25 bp, Artificial Sequence
  Description of Artificial Sequence: Synthetic oligonucleotide
gcctcagatcaccctgcgcaagagg

SEQ ID NO: 354277 - DNA, 24 bp, Artificial Sequence
  Description of Artificial Sequence: Synthetic oligonucleotide
cgacgccgcgagccagaagatgga

SEQ ID NO: 354278 - DNA, 26 bp, Artificial Sequence
  Description of Artificial Sequence: Synthetic oligonucleotide
cctcagatcaccctgcgcaagaggga

SEQ ID NO: 354279 - DNA, 24 bp, Artificial Sequence
  Description of Artificial Sequence: Synthetic oligonucleotide
gacgccgcgagccagaagatggag

SEQ ID NO: 354280 - DNA, 26 bp, Artificial Sequence
  Description of Artificial Sequence: Synthetic oligonucleotide
ctcagatcaccctgcgcaagagggag

SEQ ID NO: 354281 - DNA, 24 bp, Artificial Sequence
  Description of Artificial Sequence: Synthetic oligonucleotide
acgccgcgagccagaagatggagc

SEQ ID NO: 354282 - DNA, 26 bp, Artificial Sequence
  Description of Artificial Sequence: Synthetic oligonucleotide
tcagatcaccctgcgcaagagggagg

SEQ ID NO: 354283 - DNA, 23 bp, Artificial Sequence
  Description of Artificial Sequence: Synthetic oligonucleotide
cgccgcgagccagaagatggagc

SEQ ID NO: 354284 - DNA, 25 bp, Artificial Sequence
  Description of Artificial Sequence: Synthetic oligonucleotide
cagatcaccctgcgcaagagggagg

SEQ ID NO: 354285 - DNA, 23 bp, Artificial Sequence
  Description of Artificial Sequence: Synthetic oligonucleotide
gccgcgagccagaagatggagcc

SEQ ID NO: 354286 - DNA, 25 bp, Artificial Sequence
  Description of Artificial Sequence: Synthetic oligonucleotide
agatcaccctgcgcaagagggaggc

SEQ ID NO: 354287 - DNA, 23 bp, Artificial Sequence
  Description of Artificial Sequence: Synthetic oligonucleotide
ccgcgagccagaagatggagccg

SEQ ID NO: 354288 - DNA, 24 bp, Artificial Sequence
  Description of Artificial Sequence: Synthetic oligonucleotide
gatcaccctgcgcaagagggaggc

SEQ ID NO: 354289 - DNA, 23 bp, Artificial Sequence
  Description of Artificial Sequence: Synthetic oligonucleotide
cgcgagccagaagatggagccgc

SEQ ID NO: 354290 - DNA, 24 bp, Artificial Sequence
  Description of Artificial Sequence: Synthetic oligonucleotide
atcaccctgcgcaagagggaggcg

SEQ ID NO: 354291 - DNA, 23 bp, Artificial Sequence
  Description of Artificial Sequence: Synthetic oligonucleotide
gcgagccagaagatggagccgcg

SEQ ID NO: 354292 - DNA, 23 bp, Artificial Sequence
  Description of Artificial Sequence: Synthetic oligonucleotide
tcaccctgcgcaagagggaggcg

SEQ ID NO: 354293 - DNA, 23 bp, Artificial Sequence
  Description of Artificial Sequence: Synthetic oligonucleotide
cgagccagaagatggagccgcgg

SEQ ID NO: 354294 - DNA, 22 bp, Artificial Sequence
  Description of Artificial Sequence: Synthetic oligonucleotide
caccctgcgcaagagggaggcg

SEQ ID NO: 354295 - DNA, 23 bp, Artificial Sequence
  Description of Artificial Sequence: Synthetic oligonucleotide
gagccagaagatggagccgcggg

SEQ ID NO: 354296 - DNA, 22 bp, Artificial Sequence
  Description of Artificial Sequence: Synthetic oligonucleotide
accctgcgcaagagggaggcgc

SEQ ID NO: 354297 - DNA, 23 bp, Artificial Sequence
  Description of Artificial Sequence: Synthetic oligonucleotide
agccagaagatggagccgcgggc

SEQ ID NO: 354298 - DNA, 21 bp, Artificial Sequence
  Description of Artificial Sequence: Synthetic oligonucleotide
ccctgcgcaagagggaggcgc

SEQ ID NO: 354299 - DNA, 22 bp, Artificial Sequence
  Description of Artificial Sequence: Synthetic oligonucleotide
gccagaagatggagccgcgggc

SEQ ID NO: 354300 - DNA, 21 bp, Artificial Sequence
  Description of Artificial Sequence: Synthetic oligonucleotide
cctgcgcaagagggaggcgcc

SEQ ID NO: 354301 - DNA, 22 bp, Artificial Sequence
  Description of Artificial Sequence: Synthetic oligonucleotide
ccagaagatggagccgcgggcg

SEQ ID NO: 354302 - DNA, 21 bp, Artificial Sequence
  Description of Artificial Sequence: Synthetic oligonucleotide
ctgcgcaagagggaggcgccc

SEQ ID NO: 354303 - DNA, 22 bp, Artificial Sequence
  Description of Artificial Sequence: Synthetic oligonucleotide
cagaagatggagccgcgggcgc

SEQ ID NO: 354304 - DNA, 21 bp, Artificial Sequence
  Description of Artificial Sequence: Synthetic oligonucleotide
tgcgcaagagggaggcgcccc

SEQ ID NO: 354305 - DNA, 22 bp, Artificial Sequence
  Description of Artificial Sequence: Synthetic oligonucleotide
agaagatggagccgcgggcgcc

SEQ ID NO: 354306 - DNA, 20 bp, Artificial Sequence
  Description of Artificial Sequence: Synthetic oligonucleotide
gcgcaagagggaggcgcccc

SEQ ID NO: 354307 - DNA, 21 bp, Artificial Sequence
  Description of Artificial Sequence: Synthetic oligonucleotide
gaagatggagccgcgggcgcc

SEQ ID NO: 354308 - DNA, 21 bp, Artificial Sequence
  Description of Artificial Sequence: Synthetic oligonucleotide
cgcaagagggaggcgccccgt

SEQ ID NO: 354309 - DNA, 22 bp, Artificial Sequence
  Description of Artificial Sequence: Synthetic oligonucleotide
aagatggagccgcgggcgccgt

SEQ ID NO: 354310 - DNA, 22 bp, Artificial Sequence
  Description of Artificial Sequence: Synthetic oligonucleotide
gcaagagggaggcgccccgtgt

SEQ ID NO: 354311 - DNA, 21 bp, Artificial Sequence
  Description of Artificial Sequence: Synthetic oligonucleotide
agatggagccgcgggcgccgt

SEQ ID NO: 354312 - DNA, 22 bp, Artificial Sequence
  Description of Artificial Sequence: Synthetic oligonucleotide
caagagggaggcgccccgtgtg

SEQ ID NO: 354313 - DNA, 20 bp, Artificial Sequence
  Description of Artificial Sequence: Synthetic oligonucleotide
gatggagccgcgggcgccgt

SEQ ID NO: 354314 - DNA, 22 bp, Artificial Sequence
  Description of Artificial Sequence: Synthetic oligonucleotide
aagagggaggcgccccgtgtgc

SEQ ID NO: 354315 - DNA, 20 bp, Artificial Sequence
  Description of Artificial Sequence: Synthetic oligonucleotide
atggagccgcgggcgccgtg

SEQ ID NO: 354316 - DNA, 21 bp, Artificial Sequence
  Description of Artificial Sequence: Synthetic oligonucleotide
agagggaggcgccccgtgtgc

SEQ ID NO: 354317 - DNA, 20 bp, Artificial Sequence
  Description of Artificial Sequence: Synthetic oligonucleotide
tggagccgcgggcgccgtgt

SEQ ID NO: 354318 - DNA, 20 bp, Artificial Sequence
  Description of Artificial Sequence: Synthetic oligonucleotide
gagggaggcgccccgtgtgc

SEQ ID NO: 354319 - DNA, 20 bp, Artificial Sequence
  Description of Artificial Sequence: Synthetic oligonucleotide
ggagccgcgggcgccgtgtt

SEQ ID NO: 354320 - DNA, 20 bp, Artificial Sequence
  Description of Artificial Sequence: Synthetic oligonucleotide
agggaggcgccccgtgtgcc

SEQ ID NO: 354321 - DNA, 21 bp, Artificial Sequence
  Description of Artificial Sequence: Synthetic oligonucleotide
gagccgcgggcgccgtggata

SEQ ID NO: 354322 - DNA, 20 bp, Artificial Sequence
  Description of Artificial Sequence: Synthetic oligonucleotide
gggaggcgccccgtgtgcct

SEQ ID NO: 354323 - DNA, 22 bp, Artificial Sequence
  Description of Artificial Sequence: Synthetic oligonucleotide
agccgcgggcgccgtggataga

SEQ ID NO: 354324 - DNA, 20 bp, Artificial Sequence
  Description of Artificial Sequence: Synthetic oligonucleotide
ggaggcgccccgtgtgccgt

SEQ ID NO: 354325 - DNA, 21 bp, Artificial Sequence
  Description of Artificial Sequence: Synthetic oligonucleotide
gccgcgggcgccgtggataga

SEQ ID NO: 354326 - DNA, 20 bp, Artificial Sequence
  Description of Artificial Sequence: Synthetic oligonucleotide
gaggcgccccgtgtgccgga

SEQ ID NO: 354327 - DNA, 21 bp, Artificial Sequence
  Description of Artificial Sequence: Synthetic oligonucleotide
ccgcgggcgccgtggatagag

SEQ ID NO: 354328 - DNA, 20 bp, Artificial Sequence
  Description of Artificial Sequence: Synthetic oligonucleotide
aggcgccccgtgtgccggag

SEQ ID NO: 354329 - DNA, 22 bp, Artificial Sequence
  Description of Artificial Sequence: Synthetic oligonucleotide
cgcgggcgccgtggatagagca

SEQ ID NO: 354330 - DNA, 20 bp, Artificial Sequence
  Description of Artificial Sequence: Synthetic oligonucleotide
ggcgccccgtgtgccggagt

SEQ ID NO: 354331 - DNA, 22 bp, Artificial Sequence
  Description of Artificial Sequence: Synthetic oligonucleotide
gcgggcgccgtggatagagcag

SEQ ID NO: 354332 - DNA, 20 bp, Artificial Sequence
  Description of Artificial Sequence: Synthetic oligonucleotide
gcgccccgtgtgccggagca

SEQ ID NO: 354333 - DNA, 23 bp, Artificial Sequence
  Description of Artificial Sequence: Synthetic oligonucleotide
cgggcgccgtggatagagcagga

SEQ ID NO: 354334 - DNA, 20 bp, Artificial Sequence
  Description of Artificial Sequence: Synthetic oligonucleotide
cgccccgtgtgccggagcag

SEQ ID NO: 354335 - DNA, 23 bp, Artificial Sequence
  Description of Artificial Sequence: Synthetic oligonucleotide
gggcgccgtggatagagcaggag

SEQ ID NO: 354336 - DNA, 21 bp, Artificial Sequence
  Description of Artificial Sequence: Synthetic oligonucleotide
gccccgtgtgccggagcagct

SEQ ID NO: 354337 - DNA, 23 bp, Artificial Sequence
  Description of Artificial Sequence: Synthetic oligonucleotide
ggcgccgtggatagagcaggagg

SEQ ID NO: 354338 - DNA, 22 bp, Artificial Sequence
  Description of Artificial Sequence: Synthetic oligonucleotide
ccccgtgtgccggagcagctgt

SEQ ID NO: 354339 - DNA, 23 bp, Artificial Sequence
  Description of Artificial Sequence: Synthetic oligonucleotide
gcgccgtggatagagcaggaggg

SEQ ID NO: 354340 - DNA, 23 bp, Artificial Sequence
  Description of Artificial Sequence: Synthetic oligonucleotide
cccgtgtgccggagcagctgtga

SEQ ID NO: 354341 - DNA, 23 bp, Artificial Sequence
  Description of Artificial Sequence: Synthetic oligonucleotide
cgccgtggatagagcaggagggg

SEQ ID NO: 354342 - DNA, 23 bp, Artificial Sequence
  Description of Artificial Sequence: Synthetic oligonucleotide
ccgtgtgccggagcagctgtgag

SEQ ID NO: 354343 - DNA, 23 bp, Artificial Sequence
  Description of Artificial Sequence: Synthetic oligonucleotide
gccgtggatagagcaggaggggc

SEQ ID NO: 354344 - DNA, 23 bp, Artificial Sequence
  Description of Artificial Sequence: Synthetic oligonucleotide
cgtgtgccggagcagctgtgagc

SEQ ID NO: 354345 - DNA, 23 bp, Artificial Sequence
  Description of Artificial Sequence: Synthetic oligonucleotide
ccgtggatagagcaggaggggcc

SEQ ID NO: 354346 - DNA, 25 bp, Artificial Sequence
  Description of Artificial Sequence: Synthetic oligonucleotide
gtgtgccggagcagctgtgagccta

SEQ ID NO: 354347 - DNA, 23 bp, Artificial Sequence
  Description of Artificial Sequence: Synthetic oligonucleotide
cgtggatagagcaggaggggccg

SEQ ID NO: 354348 - DNA, 25 bp, Artificial Sequence
  Description of Artificial Sequence: Synthetic oligonucleotide
tgtgccggagcagctgtgagcctac

SEQ ID NO: 354349 - DNA, 24 bp, Artificial Sequence
  Description of Artificial Sequence: Synthetic oligonucleotide
gtggatagagcaggaggggccgga

SEQ ID NO: 354350 - DNA, 24 bp, Artificial Sequence
  Description of Artificial Sequence: Synthetic oligonucleotide
gtgccggagcagctgtgagcctac

SEQ ID NO: 354351 - DNA, 27 bp, Artificial Sequence
  Description of Artificial Sequence: Synthetic oligonucleotide
tggatagagcaggaggggccggagtat

SEQ ID NO: 354352 - DNA, 25 bp, Artificial Sequence
  Description of Artificial Sequence: Synthetic oligonucleotide
tgccggagcagctgtgagcctacgt

SEQ ID NO: 354353 - DNA, 27 bp, Artificial Sequence
  Description of Artificial Sequence: Synthetic oligonucleotide
ggatagagcaggaggggccggagtatt

SEQ ID NO: 354354 - DNA, 24 bp, Artificial Sequence
  Description of Artificial Sequence: Synthetic oligonucleotide
gccggagcagctgtgagcctacgt

SEQ ID NO: 354355 - DNA, 27 bp, Artificial Sequence
  Description of Artificial Sequence: Synthetic oligonucleotide
gatagagcaggaggggccggagtattg

SEQ ID NO: 354356 - DNA, 24 bp, Artificial Sequence
  Description of Artificial Sequence: Synthetic oligonucleotide
ccggagcagctgtgagcctacgtg

SEQ ID NO: 354357 - DNA, 27 bp, Artificial Sequence
  Description of Artificial Sequence: Synthetic oligonucleotide
atagagcaggaggggccggagtattgg

SEQ ID NO: 354358 - DNA, 25 bp, Artificial Sequence
  Description of Artificial Sequence: Synthetic oligonucleotide
cggagcagctgtgagcctacgtgga

SEQ ID NO: 354359 - DNA, 26 bp, Artificial Sequence
  Description of Artificial Sequence: Synthetic oligonucleotide
tagagcaggaggggccggagtattgg

SEQ ID NO: 354360 - DNA, 25 bp, Artificial Sequence
  Description of Artificial Sequence: Synthetic oligonucleotide
ggagcagctgtgagcctacgtggag

SEQ ID NO: 354361 - DNA, 25 bp, Artificial Sequence
  Description of Artificial Sequence: Synthetic oligonucleotide
agagcaggaggggccggagtattgg

SEQ ID NO: 354362 - DNA, 25 bp, Artificial Sequence
  Description of Artificial Sequence: Synthetic oligonucleotide
gagcagctgtgagcctacgtggagg

SEQ ID NO: 354363 - DNA, 24 bp, Artificial Sequence
  Description of Artificial Sequence: Synthetic oligonucleotide
gagcaggaggggccggagtattgg

SEQ ID NO: 354364 - DNA, 25 bp, Artificial Sequence
  Description of Artificial Sequence: Synthetic oligonucleotide
agcagctgtgagcctacgtggaggg

SEQ ID NO: 354365 - DNA, 25 bp, Artificial Sequence
  Description of Artificial Sequence: Synthetic oligonucleotide
agcaggaggggccggagtattggga

SEQ ID NO: 354366 - DNA, 24 bp, Artificial Sequence
  Description of Artificial Sequence: Synthetic oligonucleotide
gcagctgtgagcctacgtggaggg

SEQ ID NO: 354367 - DNA, 24 bp, Artificial Sequence
  Description of Artificial Sequence: Synthetic oligonucleotide
gcaggaggggccggagtattggga

SEQ ID NO: 354368 - DNA, 25 bp, Artificial Sequence
  Description of Artificial Sequence: Synthetic oligonucleotide
cagctgtgagcctacgtggagggca

SEQ ID NO: 354369 - DNA, 24 bp, Artificial Sequence
  Description of Artificial Sequence: Synthetic oligonucleotide
caggaggggccggagtattgggac

SEQ ID NO: 354370 - DNA, 25 bp, Artificial Sequence
  Description of Artificial Sequence: Synthetic oligonucleotide
agctgtgagcctacgtggagggcac

SEQ ID NO: 354371 - DNA, 25 bp, Artificial Sequence
  Description of Artificial Sequence: Synthetic oligonucleotide
aggaggggccggagtattgggacca

SEQ ID NO: 354372 - DNA, 24 bp, Artificial Sequence
  Description of Artificial Sequence: Synthetic oligonucleotide
gctgtgagcctacgtggagggcac

SEQ ID NO: 354373 - DNA, 24 bp, Artificial Sequence
  Description of Artificial Sequence: Synthetic oligonucleotide
ggaggggccggagtattgggacca

SEQ ID NO: 354374 - DNA, 25 bp, Artificial Sequence
  Description of Artificial Sequence: Synthetic oligonucleotide
ctgtgagcctacgtggagggcacga

SEQ ID NO: 354375 - DNA, 24 bp, Artificial Sequence
  Description of Artificial Sequence: Synthetic oligonucleotide
gaggggccggagtattgggaccag

SEQ ID NO: 354376 - DNA, 25 bp, Artificial Sequence
  Description of Artificial Sequence: Synthetic oligonucleotide
tgtgagcctacgtggagggcacgag

SEQ ID NO: 354377 - DNA, 25 bp, Artificial Sequence
  Description of Artificial Sequence: Synthetic oligonucleotide
aggggccggagtattgggaccagga

SEQ ID NO: 354378 - DNA, 24 bp, Artificial Sequence
  Description of Artificial Sequence: Synthetic oligonucleotide
gtgagcctacgtggagggcacgag

SEQ ID NO: 354379 - DNA, 24 bp, Artificial Sequence
  Description of Artificial Sequence: Synthetic oligonucleotide
ggggccggagtattgggaccagga

SEQ ID NO: 354380 - DNA, 24 bp, Artificial Sequence
  Description of Artificial Sequence: Synthetic oligonucleotide
tgagcctacgtggagggcacgagc

SEQ ID NO: 354381 - DNA, 25 bp, Artificial Sequence
  Description of Artificial Sequence: Synthetic oligonucleotide
gggccggagtattgggaccaggaga

SEQ ID NO: 354382 - DNA, 23 bp, Artificial Sequence
  Description of Artificial Sequence: Synthetic oligonucleotide
gagcctacgtggagggcacgagc

SEQ ID NO: 354383 - DNA, 26 bp, Artificial Sequence
  Description of Artificial Sequence: Synthetic oligonucleotide
ggccggagtattgggaccaggagaca

SEQ ID NO: 354384 - DNA, 24 bp, Artificial Sequence
  Description of Artificial Sequence: Synthetic oligonucleotide
agcctacgtggagggcacgagcgt

SEQ ID NO: 354385 - DNA, 26 bp, Artificial Sequence
  Description of Artificial Sequence: Synthetic oligonucleotide
gccggagtattgggaccaggagacac

SEQ ID NO: 354386 - DNA, 23 bp, Artificial Sequence
  Description of Artificial Sequence: Synthetic oligonucleotide
gcctacgtggagggcacgagcgt

SEQ ID NO: 354387 - DNA, 26 bp, Artificial Sequence
  Description of Artificial Sequence: Synthetic oligonucleotide
ccggagtattgggaccaggagacacg

SEQ ID NO: 354388 - DNA, 23 bp, Artificial Sequence
  Description of Artificial Sequence: Synthetic oligonucleotide
cctacgtggagggcacgagcgtg

SEQ ID NO: 354389 - DNA, 27 bp, Artificial Sequence
  Description of Artificial Sequence: Synthetic oligonucleotide
cggagtattgggaccaggagacacgga

SEQ ID NO: 354390 - DNA, 24 bp, Artificial Sequence
  Description of Artificial Sequence: Synthetic oligonucleotide
ctacgtggagggcacgagcgtgca

SEQ ID NO: 354391 - DNA, 31 bp, Artificial Sequence; identical to SEQ ID NO: 246
  Description of Artificial Sequence: Synthetic oligonucleotide

SEQ ID NO: 354392 - DNA, 25 bp, Artificial Sequence
  Description of Artificial Sequence: Synthetic oligonucleotide
tacgtggagggcacgagcgtgcagt

SEQ ID NO: 354393 - DNA, 33 bp, Artificial Sequence; identical to SEQ ID NO: 247
  Description of Artificial Sequence: Synthetic oligonucleotide

SEQ ID NO: 354394 - DNA, 24 bp, Artificial Sequence
  Description of Artificial Sequence: Synthetic oligonucleotide
acgtggagggcacgagcgtgcagt

SEQ ID NO: 354395 - DNA, 33 bp, Artificial Sequence; identical to SEQ ID NO: 248
  Description of Artificial Sequence: Synthetic oligonucleotide

SEQ ID NO: 354396 - DNA, 23 bp, Artificial Sequence
  Description of Artificial Sequence: Synthetic oligonucleotide
cgtggagggcacgagcgtgcagt

SEQ ID NO: 354397 - DNA, 32 bp, Artificial Sequence; identical to SEQ ID NO: 249
  Description of Artificial Sequence: Synthetic oligonucleotide

SEQ ID NO: 354398 - DNA, 23 bp, Artificial Sequence
  Description of Artificial Sequence: Synthetic oligonucleotide
gtggagggcacgagcgtgcagtg

SEQ ID NO: 354399 - DNA, 32 bp, Artificial Sequence; identical to SEQ ID NO: 250
  Description of Artificial Sequence: Synthetic oligonucleotide

SEQ ID NO: 354400 - DNA, 23 bp, Artificial Sequence
  Description of Artificial Sequence: Synthetic oligonucleotide
tggagggcacgagcgtgcagtgg

SEQ ID NO: 354401 - DNA, 31 bp, Artificial Sequence; identical to SEQ ID NO: 251
  Description of Artificial Sequence: Synthetic oligonucleotide

SEQ ID NO: 354402 - DNA, 22 bp, Artificial Sequence
  Description of Artificial Sequence: Synthetic oligonucleotide
ggagggcacgagcgtgcagtgg

SEQ ID NO: 354403 - DNA, 30 bp, Artificial Sequence; identical to SEQ ID NO: 252
  Description of Artificial Sequence: Synthetic oligonucleotide

SEQ ID NO: 354404 - DNA, 23 bp, Artificial Sequence
  Description of Artificial Sequence: Synthetic oligonucleotide
gagggcacgagcgtgcagtggct

SEQ ID NO: 354405 - DNA, 29 bp, Artificial Sequence
  Description of Artificial Sequence: Synthetic oligonucleotide
tgggaccaggagacacggaatatgaaggc

SEQ ID NO: 354406 - DNA, 23 bp, Artificial Sequence
  Description of Artificial Sequence: Synthetic oligonucleotide
agggcacgagcgtgcagtggctc

SEQ ID NO: 354407 - DNA, 28 bp, Artificial Sequence
  Description of Artificial Sequence: Synthetic oligonucleotide
gggaccaggagacacggaatatgaaggc

SEQ ID NO: 354408 - DNA, 22 bp, Artificial Sequence
  Description of Artificial Sequence: Synthetic oligonucleotide
gggcacgagcgtgcagtggctc

SEQ ID NO: 354409 - DNA, 28 bp, Artificial Sequence
  Description of Artificial Sequence: Synthetic oligonucleotide
ggaccaggagacacggaatatgaaggcc

SEQ ID NO: 354410 - DNA, 22 bp, Artificial Sequence
  Description of Artificial Sequence: Synthetic oligonucleotide
ggcacgagcgtgcagtggctcc

SEQ ID NO: 354411 - DNA, 28 bp, Artificial Sequence
  Description of Artificial Sequence: Synthetic oligonucleotide
gaccaggagacacggaatatgaaggccc

SEQ ID NO: 354412 - DNA, 22 bp, Artificial Sequence
  Description of Artificial Sequence: Synthetic oligonucleotide
gcacgagcgtgcagtggctccg

SEQ ID NO: 354413 - DNA, 29 bp, Artificial Sequence
  Description of Artificial Sequence: Synthetic oligonucleotide
accaggagacacggaatatgaaggcccac

SEQ ID NO: 354414 - DNA, 23 bp, Artificial Sequence
  Description of Artificial Sequence: Synthetic oligonucleotide
cacgagcgtgcagtggctccgct

SEQ ID NO: 354415 - DNA, 28 bp, Artificial Sequence
  Description of Artificial Sequence: Synthetic oligonucleotide
ccaggagacacggaatatgaaggcccac

SEQ ID NO: 354416 - DNA, 26 bp, Artificial Sequence
  Description of Artificial Sequence: Synthetic oligonucleotide
acgagcgtgcagtggctccgctgata

SEQ ID NO: 354417 - DNA, 29 bp, Artificial Sequence
  Description of Artificial Sequence: Synthetic oligonucleotide
caggagacacggaatatgaaggcccactc

SEQ ID NO: 354418 - DNA, 25 bp, Artificial Sequence
  Description of Artificial Sequence: Synthetic oligonucleotide
cgagcgtgcagtggctccgctgata

SEQ ID NO: 354419 - DNA, 30 bp, Artificial Sequence; identical to SEQ ID NO: 260
  Description of Artificial Sequence: Synthetic oligonucleotide

SEQ ID NO: 354420 - DNA, 25 bp, Artificial Sequence
  Description of Artificial Sequence: Synthetic oligonucleotide
gagcgtgcagtggctccgctgatac

SEQ ID NO: 354421 - DNA, 29 bp, Artificial Sequence
  Description of Artificial Sequence: Synthetic oligonucleotide
ggagacacggaatatgaaggcccactcac

SEQ ID NO: 354422 - DNA, 26 bp, Artificial Sequence
  Description of Artificial Sequence: Synthetic oligonucleotide
agcgtgcagtggctccgctgatacct

SEQ ID NO: 354423 - DNA, 30 bp, Artificial Sequence; identical to SEQ ID NO: 262
  Description of Artificial Sequence: Synthetic oligonucleotide

SEQ ID NO: 354424 - DNA, 25 bp, Artificial Sequence
  Description of Artificial Sequence: Synthetic oligonucleotide
gcgtgcagtggctccgctgatacct

SEQ ID NO: 354425 - DNA, 31 bp, Artificial Sequence; identical to SEQ ID NO: 263
  Description of Artificial Sequence: Synthetic oligonucleotide

SEQ ID NO: 354426 - DNA, 25 bp, Artificial Sequence
  Description of Artificial Sequence: Synthetic oligonucleotide
cgtgcagtggctccgctgatacctg

SEQ ID NO: 354427 - DNA, 30 bp, Artificial Sequence; identical to SEQ ID NO: 264
  Description of Artificial Sequence: Synthetic oligonucleotide

SEQ ID NO: 354428 - DNA, 26 bp, Artificial Sequence
  Description of Artificial Sequence: Synthetic oligonucleotide
gtgcagtggctccgctgatacctggt

SEQ ID NO: 354429 - DNA, 31 bp, Artificial Sequence; identical to SEQ ID NO: 265
  Description of Artificial Sequence: Synthetic oligonucleotide

SEQ ID NO: 354430 - DNA, 27 bp, Artificial Sequence
  Description of Artificial Sequence: Synthetic oligonucleotide
tgcagtggctccgctgatacctggtga

SEQ ID NO: 354431 - DNA, 30 bp, Artificial Sequence; identical to SEQ ID NO: 266
  Description of Artificial Sequence: Synthetic oligonucleotide

SEQ ID NO: 354432 - DNA, 27 bp, Artificial Sequence
  Description of Artificial Sequence: Synthetic oligonucleotide
gcagtggctccgctgatacctggtgaa

SEQ ID NO: 354433 - DNA, 31 bp, Artificial Sequence; identical to SEQ ID NO: 267
  Description of Artificial Sequence: Synthetic oligonucleotide

SEQ ID NO: 354434 - DNA, 27 bp, Artificial Sequence
  Description of Artificial Sequence: Synthetic oligonucleotide
cagtggctccgctgatacctggtgaac

SEQ ID NO: 354435 - DNA, 30 bp, Artificial Sequence; identical to SEQ ID NO: 268
  Description of Artificial Sequence: Synthetic oligonucleotide

SEQ ID NO: 354436 - DNA, 27 bp, Artificial Sequence
  Description of Artificial Sequence: Synthetic oligonucleotide
agtggctccgctgatacctggtgaacg

SEQ ID NO: 354437 - DNA, 30 bp, Artificial Sequence; identical to SEQ ID NO: 269
  Description of Artificial Sequence: Synthetic oligonucleotide

SEQ ID NO: 354438 - DNA, 26 bp, Artificial Sequence
  Description of Artificial Sequence: Synthetic oligonucleotide
gtggctccgctgatacctggtgaacg

SEQ ID NO: 354439 - DNA, 30 bp, Artificial Sequence; identical to SEQ ID NO: 270
  Description of Artificial Sequence: Synthetic oligonucleotide

SEQ ID NO: 354440 - DNA, 26 bp, Artificial Sequence
  Description of Artificial Sequence: Synthetic oligonucleotide
tggctccgctgatacctggtgaacgg

SEQ ID NO: 354441 - DNA, 31 bp, Artificial Sequence; identical to SEQ ID NO: 271
  Description of Artificial Sequence: Synthetic oligonucleotide

SEQ ID NO: 354442 - DNA, 25 bp, Artificial Sequence
  Description of Artificial Sequence: Synthetic oligonucleotide
ggctccgctgatacctggtgaacgg

SEQ ID NO: 354443 - DNA, 30 bp, Artificial Sequence; identical to SEQ ID NO: 272
  Description of Artificial Sequence: Synthetic oligonucleotide

SEQ ID NO: 354444 - DNA, 27 bp, Artificial Sequence
  Description of Artificial Sequence: Synthetic oligonucleotide
gctccgctgatacctggtgaacgggaa

SEQ ID NO: 354445 - DNA, 29 bp, Artificial Sequence
  Description of Artificial Sequence: Synthetic oligonucleotide
tatgaaggcccactcacagactgaccgag

SEQ ID NO: 354446 - DNA, 27 bp, Artificial Sequence
  Description of Artificial Sequence: Synthetic oligonucleotide
ctccgctgatacctggtgaacgggaac

SEQ ID NO: 354447 - DNA, 28 bp, Artificial Sequence
  Description of Artificial Sequence: Synthetic oligonucleotide
atgaaggcccactcacagactgaccgag

SEQ ID NO: 354448 - DNA, 27 bp, Artificial Sequence
  Description of Artificial Sequence: Synthetic oligonucleotide
tccgctgatacctggtgaacgggaacg

SEQ ID NO: 354449 - DNA, 27 bp, Artificial Sequence
  Description of Artificial Sequence: Synthetic oligonucleotide
tgaaggcccactcacagactgaccgag

SEQ ID NO: 354450 - DNA, 27 bp, Artificial Sequence
  Description of Artificial Sequence: Synthetic oligonucleotide
ccgctgatacctggtgaacgggaacga

SEQ ID NO: 354451 - DNA, 26 bp, Artificial Sequence
  Description of Artificial Sequence: Synthetic oligonucleotide
gaaggcccactcacagactgaccgag

SEQ ID NO: 354452 - DNA, 27 bp, Artificial Sequence
  Description of Artificial Sequence: Synthetic oligonucleotide
cgctgatacctggtgaacgggaacgag

SEQ ID NO: 354453 - DNA, 26 bp, Artificial Sequence
  Description of Artificial Sequence: Synthetic oligonucleotide
aaggcccactcacagactgaccgagc

SEQ ID NO: 354454 - DNA, 28 bp, Artificial Sequence
  Description of Artificial Sequence: Synthetic oligonucleotide
gctgatacctggtgaacgggaacgagac

SEQ ID NO: 354455 - DNA, 25 bp, Artificial Sequence
  Description of Artificial Sequence: Synthetic oligonucleotide
aggcccactcacagactgaccgagc

SEQ ID NO: 354456 - DNA, 28 bp, Artificial Sequence
  Description of Artificial Sequence: Synthetic oligonucleotide
ctgatacctggtgaacgggaacgagacg

SEQ ID NO: 354457 - DNA, 24 bp, Artificial Sequence
  Description of Artificial Sequence: Synthetic oligonucleotide
ggcccactcacagactgaccgagc

SEQ ID NO: 354458 - DNA, 28 bp, Artificial Sequence
  Description of Artificial Sequence: Synthetic oligonucleotide
tgatacctggtgaacgggaacgagacgc

SEQ ID NO: 354459 - DNA, 26 bp, Artificial Sequence
  Description of Artificial Sequence: Synthetic oligonucleotide
gcccactcacagactgaccgagcgaa

SEQ ID NO: 354460 - DNA, 27 bp, Artificial Sequence
  Description of Artificial Sequence: Synthetic oligonucleotide
gatacctggtgaacgggaacgagacgc

SEQ ID NO: 354461 - DNA, 26 bp, Artificial Sequence
  Description of Artificial Sequence: Synthetic oligonucleotide
cccactcacagactgaccgagcgaac

SEQ ID NO: 354462 - DNA, 28 bp, Artificial Sequence
  Description of Artificial Sequence: Synthetic oligonucleotide
atacctggtgaacgggaacgagacgcag

SEQ ID NO: 354463 - DNA, 27 bp, Artificial Sequence
  Description of Artificial Sequence: Synthetic oligonucleotide
ccactcacagactgaccgagcgaacct

SEQ ID NO: 354464 - DNA, 27 bp, Artificial Sequence
  Description of Artificial Sequence: Synthetic oligonucleotide
tacctggtgaacgggaacgagacgcag

SEQ ID NO: 354465 - DNA, 27 bp, Artificial Sequence
  Description of Artificial Sequence: Synthetic oligonucleotide
cactcacagactgaccgagcgaacctg

SEQ ID NO: 354466 - DNA, 26 bp, Artificial Sequence
  Description of Artificial Sequence: Synthetic oligonucleotide
acctggtgaacgggaacgagacgcag

SEQ ID NO: 354467 - DNA, 27 bp, Artificial Sequence
  Description of Artificial Sequence: Synthetic oligonucleotide
actcacagactgaccgagcgaacctgg

SEQ ID NO: 354468 - DNA, 25 bp, Artificial Sequence
  Description of Artificial Sequence: Synthetic oligonucleotide
cctggtgaacgggaacgagacgcag

SEQ ID NO: 354469 - DNA, 26 bp, Artificial Sequence
  Description of Artificial Sequence: Synthetic oligonucleotide
ctcacagactgaccgagcgaacctgg

SEQ ID NO: 354470 - DNA, 26 bp, Artificial Sequence
  Description of Artificial Sequence: Synthetic oligonucleotide
ctggtgaacgggaacgagacgcagca

SEQ ID NO: 354471 - DNA, 26 bp, Artificial Sequence
  Description of Artificial Sequence: Synthetic oligonucleotide
tcacagactgaccgagcgaacctggg

SEQ ID NO: 354472 - DNA, 26 bp, Artificial Sequence
  Description of Artificial Sequence: Synthetic oligonucleotide
tggtgaacgggaacgagacgcagcag

SEQ ID NO: 354473 - DNA, 25 bp, Artificial Sequence
  Description of Artificial Sequence: Synthetic oligonucleotide
cacagactgaccgagcgaacctggg

SEQ ID NO: 354474 - DNA, 25 bp, Artificial Sequence
  Description of Artificial Sequence: Synthetic oligonucleotide
ggtgaacgggaacgagacgcagcag

SEQ ID NO: 354475 - DNA, 26 bp, Artificial Sequence
  Description of Artificial Sequence: Synthetic oligonucleotide
acagactgaccgagcgaacctgggga

SEQ ID NO: 354476 - DNA, 25 bp, Artificial Sequence
  Description of Artificial Sequence: Synthetic oligonucleotide
gtgaacgggaacgagacgcagcagc

SEQ ID NO: 354477 - DNA, 25 bp, Artificial Sequence
  Description of Artificial Sequence: Synthetic oligonucleotide
cagactgaccgagcgaacctgggga

SEQ ID NO: 354478 - DNA, 25 bp, Artificial Sequence
  Description of Artificial Sequence: Synthetic oligonucleotide
tgaacgggaacgagacgcagcagcg

SEQ ID NO: 354479 - DNA, 25 bp, Artificial Sequence
  Description of Artificial Sequence: Synthetic oligonucleotide
agactgaccgagcgaacctggggac

SEQ ID NO: 354480 - DNA, 24 bp, Artificial Sequence
  Description of Artificial Sequence: Synthetic oligonucleotide
gaacgggaacgagacgcagcagcg

SEQ ID NO: 354481 - DNA, 24 bp, Artificial Sequence
  Description of Artificial Sequence: Synthetic oligonucleotide
gactgaccgagcgaacctggggac

SEQ ID NO: 354482 - DNA, 24 bp, Artificial Sequence
  Description of Artificial Sequence: Synthetic oligonucleotide
aacgggaacgagacgcagcagcgc

SEQ ID NO: 354483 - DNA, 24 bp, Artificial Sequence
  Description of Artificial Sequence: Synthetic oligonucleotide
actgaccgagcgaacctggggacc

SEQ ID NO: 354484 - DNA, 23 bp, Artificial Sequence
  Description of Artificial Sequence: Synthetic oligonucleotide
acgggaacgagacgcagcagcgc

SEQ ID NO: 354485 - DNA, 23 bp, Artificial Sequence
  Description of Artificial Sequence: Synthetic oligonucleotide
ctgaccgagcgaacctggggacc

SEQ ID NO: 354486 - DNA, 22 bp, Artificial Sequence
  Description of Artificial Sequence: Synthetic oligonucleotide
cgggaacgagacgcagcagcgc

SEQ ID NO: 354487 - DNA, 24 bp, Artificial Sequence
  Description of Artificial Sequence: Synthetic oligonucleotide
tgaccgagcgaacctggggaccct

SEQ ID NO: 354488 - DNA, 22 bp, Artificial Sequence
  Description of Artificial Sequence: Synthetic oligonucleotide
gggaacgagacgcagcagcgcg

SEQ ID NO: 354489 - DNA, 23 bp, Artificial Sequence
  Description of Artificial Sequence: Synthetic oligonucleotide
gaccgagcgaacctggggaccct

SEQ ID NO: 354490 - DNA, 22 bp, Artificial Sequence
  Description of Artificial Sequence: Synthetic oligonucleotide
ggaacgagacgcagcagcgcgc

SEQ ID NO: 354491 - DNA, 23 bp, Artificial Sequence
  Description of Artificial Sequence: Synthetic oligonucleotide
accgagcgaacctggggaccctg

SEQ ID NO: 354492 - DNA, 22 bp, Artificial Sequence
  Description of Artificial Sequence: Synthetic oligonucleotide
gaacgagacgcagcagcgcgcg

SEQ ID NO: 354493 - DNA, 22 bp, Artificial Sequence
  Description of Artificial Sequence: Synthetic oligonucleotide
ccgagcgaacctggggaccctg

SEQ ID NO: 354494 - DNA, 23 bp, Artificial Sequence
  Description of Artificial Sequence: Synthetic oligonucleotide
aacgagacgcagcagcgcgcggt

SEQ ID NO: 354495 - DNA, 22 bp, Artificial Sequence
  Description of Artificial Sequence: Synthetic oligonucleotide
cgagcgaacctggggaccctgc

SEQ ID NO: 354496 - DNA, 22 bp, Artificial Sequence
  Description of Artificial Sequence: Synthetic oligonucleotide
acgagacgcagcagcgcgcggt

SEQ ID NO: 354497 - DNA, 22 bp, Artificial Sequence
  Description of Artificial Sequence: Synthetic oligonucleotide
gagcgaacctggggaccctgcg

SEQ ID NO: 354498 - DNA, 21 bp, Artificial Sequence
  Description of Artificial Sequence: Synthetic oligonucleotide
cgagacgcagcagcgcgcggt

SEQ ID NO: 354499 - DNA, 22 bp, Artificial Sequence
  Description of Artificial Sequence: Synthetic oligonucleotide
agcgaacctggggaccctgcgc

SEQ ID NO: 354500 - DNA, 21 bp, Artificial Sequence
  Description of Artificial Sequence: Synthetic oligonucleotide
gagacgcagcagcgcgcggtc

SEQ ID NO: 354501 - DNA, 21 bp, Artificial Sequence
  Description of Artificial Sequence: Synthetic oligonucleotide
gcgaacctggggaccctgcgc

SEQ ID NO: 354502 - DNA, 21 bp, Artificial Sequence
  Description of Artificial Sequence: Synthetic oligonucleotide
agacgcagcagcgcgcggtcc

SEQ ID NO: 354503 - DNA, 21 bp, Artificial Sequence
  Description of Artificial Sequence: Synthetic oligonucleotide
cgaacctggggaccctgcgcg

SEQ ID NO: 354504 - DNA, 20 bp, Artificial Sequence
  Description of Artificial Sequence: Synthetic oligonucleotide
gacgcagcagcgcgcggtcc

SEQ ID NO: 354505 - DNA, 21 bp, Artificial Sequence
  Description of Artificial Sequence: Synthetic oligonucleotide
gaacctggggaccctgcgcgg

SEQ ID NO: 354506 - DNA, 20 bp, Artificial Sequence
  Description of Artificial Sequence: Synthetic oligonucleotide
acgcagcagcgcgcggtccc

SEQ ID NO: 354507 - DNA, 23 bp, Artificial Sequence
  Description of Artificial Sequence: Synthetic oligonucleotide
aacctggggaccctgcgcggcta

SEQ ID NO: 354508 - DNA, 20 bp, Artificial Sequence
  Description of Artificial Sequence: Synthetic oligonucleotide
cgcagcagcgcgcggtccct

SEQ ID NO: 354509 - DNA, 22 bp, Artificial Sequence
  Description of Artificial Sequence: Synthetic oligonucleotide
acctggggaccctgcgcggcta

SEQ ID NO: 354510 - DNA, 20 bp, Artificial Sequence
  Description of Artificial Sequence: Synthetic oligonucleotide
gcagcagcgcgcggtcccct

SEQ ID NO: 354511 - DNA, 21 bp, Artificial Sequence
  Description of Artificial Sequence: Synthetic oligonucleotide
cctggggaccctgcgcggcta

SEQ ID NO: 354512 - DNA, 20 bp, Artificial Sequence
  Description of Artificial Sequence: Synthetic oligonucleotide
cagcagcgcgcggtccccct

SEQ ID NO: 354513 - DNA, 23 bp, Artificial Sequence
  Description of Artificial Sequence: Synthetic oligonucleotide
ctggggaccctgcgcggctacta

SEQ ID NO: 354514 - DNA, 22 bp, Artificial Sequence
  Description of Artificial Sequence: Synthetic oligonucleotide
agcagcgcgcggtccccccaat

SEQ ID NO: 354515 - DNA, 25 bp, Artificial Sequence
  Description of Artificial Sequence: Synthetic oligonucleotide
tggggaccctgcgcggctactacaa

SEQ ID NO: 354516 - DNA, 21 bp, Artificial Sequence
  Description of Artificial Sequence: Synthetic oligonucleotide
gcagcgcgcggtccccccaat

SEQ ID NO: 354517 - DNA, 24 bp, Artificial Sequence
  Description of Artificial Sequence: Synthetic oligonucleotide
ggggaccctgcgcggctactacaa

SEQ ID NO: 354518 - DNA, 22 bp, Artificial Sequence
  Description of Artificial Sequence: Synthetic oligonucleotide
cagcgcgcggtccccccaatga

SEQ ID NO: 354519 - DNA, 24 bp, Artificial Sequence
  Description of Artificial Sequence: Synthetic oligonucleotide
gggaccctgcgcggctactacaac

SEQ ID NO: 354520 - DNA, 23 bp, Artificial Sequence
  Description of Artificial Sequence: Synthetic oligonucleotide
agcgcgcggtccccccaatgaca

SEQ ID NO: 354521 - DNA, 25 bp, Artificial Sequence
  Description of Artificial Sequence: Synthetic oligonucleotide
ggaccctgcgcggctactacaacca

SEQ ID NO: 354522 - DNA, 22 bp, Artificial Sequence
  Description of Artificial Sequence: Synthetic oligonucleotide
gcgcgcggtccccccaatgaca

SEQ ID NO: 354523 - DNA, 26 bp, Artificial Sequence
  Description of Artificial Sequence: Synthetic oligonucleotide
gaccctgcgcggctactacaaccaga

SEQ ID NO: 354524 - DNA, 23 bp, Artificial Sequence
  Description of Artificial Sequence: Synthetic oligonucleotide
cgcgcggtccccccaatgacaca

SEQ ID NO: 354525 - DNA, 26 bp, Artificial Sequence
  Description of Artificial Sequence: Synthetic oligonucleotide
accctgcgcggctactacaaccagag

SEQ ID NO: 354526 - DNA, 23 bp, Artificial Sequence
  Description of Artificial Sequence: Synthetic oligonucleotide
gcgcggtccccccaatgacacac

SEQ ID NO: 354527 - DNA, 25 bp, Artificial Sequence
  Description of Artificial Sequence: Synthetic oligonucleotide
ccctgcgcggctactacaaccagag

SEQ ID NO: 354528 - DNA, 24 bp, Artificial Sequence
  Description of Artificial Sequence: Synthetic oligonucleotide
cgcggtccccccaatgacacacgt

SEQ ID NO: 354529 - DNA, 25 bp, Artificial Sequence
  Description of Artificial Sequence: Synthetic oligonucleotide
cctgcgcggctactacaaccagagc

SEQ ID NO: 354530 - DNA, 25 bp, Artificial Sequence
  Description of Artificial Sequence: Synthetic oligonucleotide
gcggtccccccaatgacacacgtga

SEQ ID NO: 354531 - DNA, 26 bp, Artificial Sequence
  Description of Artificial Sequence: Synthetic oligonucleotide
ctgcgcggctactacaaccagagcga

SEQ ID NO: 354532 - DNA, 25 bp, Artificial Sequence
  Description of Artificial Sequence: Synthetic oligonucleotide
cggtccccccaatgacacacgtgag

SEQ ID NO: 354533 - DNA, 26 bp, Artificial Sequence
  Description of Artificial Sequence: Synthetic oligonucleotide
tgcgcggctactacaaccagagcgag

SEQ ID NO: 354534 - DNA, 25 bp, Artificial Sequence
  Description of Artificial Sequence: Synthetic oligonucleotide
ggtccccccaatgacacacgtgagc

SEQ ID NO: 354535 - DNA, 25 bp, Artificial Sequence
  Description of Artificial Sequence: Synthetic oligonucleotide
gcgcggctactacaaccagagcgag

SEQ ID NO: 354536 - DNA, 26 bp, Artificial Sequence
  Description of Artificial Sequence: Synthetic oligonucleotide
gtccccccaatgacacacgtgagcca

SEQ ID NO: 354537 - DNA, 26 bp, Artificial Sequence
  Description of Artificial Sequence: Synthetic oligonucleotide
cgcggctactacaaccagagcgagga

SEQ ID NO: 354538 - DNA, 26 bp, Artificial Sequence
  Description of Artificial Sequence: Synthetic oligonucleotide
tccccccaatgacacacgtgagccac

SEQ ID NO: 354539 - DNA, 26 bp, Artificial Sequence
  Description of Artificial Sequence: Synthetic oligonucleotide
gcggctactacaaccagagcgaggac

SEQ ID NO: 354540 - DNA, 25 bp, Artificial Sequence
  Description of Artificial Sequence: Synthetic oligonucleotide
ccccccaatgacacacgtgagccac

SEQ ID NO: 354541 - DNA, 26 bp, Artificial Sequence
  Description of Artificial Sequence: Synthetic oligonucleotide
cggctactacaaccagagcgaggacg

SEQ ID NO: 354542 - DNA, 26 bp, Artificial Sequence
  Description of Artificial Sequence: Synthetic oligonucleotide
cccccaatgacacacgtgagccacca

SEQ ID NO: 354543 - DNA, 27 bp, Artificial Sequence
  Description of Artificial Sequence: Synthetic oligonucleotide
ggctactacaaccagagcgaggacggt

SEQ ID NO: 354544 - DNA, 26 bp, Artificial Sequence
  Description of Artificial Sequence: Synthetic oligonucleotide
ccccaatgacacacgtgagccaccac

SEQ ID NO: 354545 - DNA, 28 bp, Artificial Sequence
  Description of Artificial Sequence: Synthetic oligonucleotide
gctactacaaccagagcgaggacggttc

SEQ ID NO: 354546 - DNA, 26 bp, Artificial Sequence
  Description of Artificial Sequence: Synthetic oligonucleotide
cccaatgacacacgtgagccaccacc

SEQ ID NO: 354547 - DNA, 29 bp, Artificial Sequence
  Description of Artificial Sequence: Synthetic oligonucleotide
ctactacaaccagagcgaggacggttctc

SEQ ID NO: 354548 - DNA, 26 bp, Artificial Sequence
  Description of Artificial Sequence: Synthetic oligonucleotide
ccaatgacacacgtgagccaccaccg

SEQ ID NO: 354549 - DNA, 30 bp, Artificial Sequence; identical to SEQ ID NO: 325
  Description of Artificial Sequence: Synthetic oligonucleotide

SEQ ID NO: 354550 - DNA, 27 bp, Artificial Sequence
  Description of Artificial Sequence: Synthetic oligonucleotide
caatgacacacgtgagccaccaccgca

SEQ ID NO: 354551 - DNA, 29 bp, Artificial Sequence
  Description of Artificial Sequence: Synthetic oligonucleotide
actacaaccagagcgaggacggttctcac

SEQ ID NO: 354552 - DNA, 28 bp, Artificial Sequence
  Description of Artificial Sequence: Synthetic oligonucleotide
aatgacacacgtgagccaccaccgcatc

SEQ ID NO: 354553 - DNA, 28 bp, Artificial Sequence
  Description of Artificial Sequence: Synthetic oligonucleotide
ctacaaccagagcgaggacggttctcac

SEQ ID NO: 354554 - DNA, 27 bp, Artificial Sequence
  Description of Artificial Sequence: Synthetic oligonucleotide
atgacacacgtgagccaccaccgcatc

SEQ ID NO: 354555 - DNA, 29 bp, Artificial Sequence
  Description of Artificial Sequence: Synthetic oligonucleotide
tacaaccagagcgaggacggttctcacac

SEQ ID NO: 354556 - DNA, 27 bp, Artificial Sequence
  Description of Artificial Sequence: Synthetic oligonucleotide
tgacacacgtgagccaccaccgcatct

SEQ ID NO: 354557 - DNA, 28 bp, Artificial Sequence
  Description of Artificial Sequence: Synthetic oligonucleotide
acaaccagagcgaggacggttctcacac

SEQ ID NO: 354558 - DNA, 26 bp, Artificial Sequence
  Description of Artificial Sequence: Synthetic oligonucleotide
gacacacgtgagccaccaccgcatct

SEQ ID NO: 354559 - DNA, 27 bp, Artificial Sequence
  Description of Artificial Sequence: Synthetic oligonucleotide
caaccagagcgaggacggttctcacac

SEQ ID NO: 354560 - DNA, 27 bp, Artificial Sequence
  Description of Artificial Sequence: Synthetic oligonucleotide
acacacgtgagccaccaccgcatctct

SEQ ID NO: 354561 - DNA, 27 bp, Artificial Sequence
  Description of Artificial Sequence: Synthetic oligonucleotide
aaccagagcgaggacggttctcacacc

SEQ ID NO: 354562 - DNA, 26 bp, Artificial Sequence
  Description of Artificial Sequence: Synthetic oligonucleotide
cacacgtgagccaccaccgcatctct

SEQ ID NO: 354563 - DNA, 27 bp, Artificial Sequence
  Description of Artificial Sequence: Synthetic oligonucleotide
accagagcgaggacggttctcacacca

SEQ ID NO: 354564 - DNA, 27 bp, Artificial Sequence
  Description of Artificial Sequence: Synthetic oligonucleotide
acacgtgagccaccaccgcatctctga

SEQ ID NO: 354565 - DNA, 27 bp, Artificial Sequence
  Description of Artificial Sequence: Synthetic oligonucleotide
ccagagcgaggacggttctcacaccat

SEQ ID NO: 354566 - DNA, 26 bp, Artificial Sequence
  Description of Artificial Sequence: Synthetic oligonucleotide
cacgtgagccaccaccgcatctctga

SEQ ID NO: 354567 - DNA, 27 bp, Artificial Sequence
  Description of Artificial Sequence: Synthetic oligonucleotide
cagagcgaggacggttctcacaccatc

SEQ ID NO: 354568 - DNA, 26 bp, Artificial Sequence
  Description of Artificial Sequence: Synthetic oligonucleotide
acgtgagccaccaccgcatctctgag

SEQ ID NO: 354569 - DNA, 27 bp, Artificial Sequence
  Description of Artificial Sequence: Synthetic oligonucleotide
agagcgaggacggttctcacaccatcc

SEQ ID NO: 354570 - DNA, 25 bp, Artificial Sequence
  Description of Artificial Sequence: Synthetic oligonucleotide
cgtgagccaccaccgcatctctgag

SEQ ID NO: 354571 - DNA, 27 bp, Artificial Sequence
  Description of Artificial Sequence: Synthetic oligonucleotide
gagcgaggacggttctcacaccatcca

SEQ ID NO: 354572 - DNA, 27 bp, Artificial Sequence
  Description of Artificial Sequence: Synthetic oligonucleotide
gtgagccaccaccgcatctctgagcat

SEQ ID NO: 354573 - DNA, 27 bp, Artificial Sequence
  Description of Artificial Sequence: Synthetic oligonucleotide
agcgaggacggttctcacaccatccag

SEQ ID NO: 354574 - DNA, 27 bp, Artificial Sequence
  Description of Artificial Sequence: Synthetic oligonucleotide
tgagccaccaccgcatctctgagcatg

SEQ ID NO: 354575 - DNA, 27 bp, Artificial Sequence
  Description of Artificial Sequence: Synthetic oligonucleotide
gcgaggacggttctcacaccatccaga

SEQ ID NO: 354576 - DNA, 27 bp, Artificial Sequence
  Description of Artificial Sequence: Synthetic oligonucleotide
gagccaccaccgcatctctgagcatga

SEQ ID NO: 354577 - DNA, 31 bp, Artificial Sequence; identical to SEQ ID NO: 339
  Description of Artificial Sequence: Synthetic oligonucleotide

SEQ ID NO: 354578 - DNA, 27 bp, Artificial Sequence
  Description of Artificial Sequence: Synthetic oligonucleotide
agccaccaccgcatctctgagcatgag

SEQ ID NO: 354579 - DNA, 34 bp, Artificial Sequence; identical to SEQ ID NO: 340
  Description of Artificial Sequence: Synthetic oligonucleotide

SEQ ID NO: 354580 - DNA, 26 bp, Artificial Sequence
  Description of Artificial Sequence: Synthetic oligonucleotide
gccaccaccgcatctctgagcatgag

SEQ ID NO: 354581 - DNA, 34 bp, Artificial Sequence; identical to SEQ ID NO: 341
  Description of Artificial Sequence: Synthetic oligonucleotide

SEQ ID NO: 354582 - DNA, 26 bp, Artificial Sequence
  Description of Artificial Sequence: Synthetic oligonucleotide
ccaccaccgcatctctgagcatgagg

SEQ ID NO: 354583 - DNA, 33 bp, Artificial Sequence; identical to SEQ ID NO: 342
  Description of Artificial Sequence: Synthetic oligonucleotide

SEQ ID NO: 354584 - DNA, 26 bp, Artificial Sequence
  Description of Artificial Sequence: Synthetic oligonucleotide
caccaccgcatctctgagcatgaggc

SEQ ID NO: 354585 - DNA, 33 bp, Artificial Sequence; identical to SEQ ID NO: 343
  Description of Artificial Sequence: Synthetic oligonucleotide

SEQ ID NO: 354586 - DNA, 27 bp, Artificial Sequence
  Description of Artificial Sequence: Synthetic oligonucleotide
accaccgcatctctgagcatgaggcct

SEQ ID NO: 354587 - DNA, 34 bp, Artificial Sequence; identical to SEQ ID NO: 344
  Description of Artificial Sequence: Synthetic oligonucleotide

SEQ ID NO: 354588 - DNA, 26 bp, Artificial Sequence
  Description of Artificial Sequence: Synthetic oligonucleotide
ccaccgcatctctgagcatgaggcct

SEQ ID NO: 354589 - DNA, 33 bp, Artificial Sequence; identical to SEQ ID NO: 345
  Description of Artificial Sequence: Synthetic oligonucleotide

SEQ ID NO: 354590 - DNA, 26 bp, Artificial Sequence
  Description of Artificial Sequence: Synthetic oligonucleotide
caccgcatctctgagcatgaggcctc

SEQ ID NO: 354591 - DNA, 33 bp, Artificial Sequence; identical to SEQ ID NO: 346
  Description of Artificial Sequence: Synthetic oligonucleotide

SEQ ID NO: 354592 - DNA, 26 bp, Artificial Sequence
  Description of Artificial Sequence: Synthetic oligonucleotide
accgcatctctgagcatgaggcctcc

SEQ ID NO: 354593 - DNA, 33 bp, Artificial Sequence; identical to SEQ ID NO: 347
  Description of Artificial Sequence: Synthetic oligonucleotide

SEQ ID NO: 354594 - DNA, 25 bp, Artificial Sequence
  Description of Artificial Sequence: Synthetic oligonucleotide
ccgcatctctgagcatgaggcctcc

SEQ ID NO: 354595 - DNA, 34 bp, Artificial Sequence; identical to SEQ ID NO: 348
  Description of Artificial Sequence: Synthetic oligonucleotide

SEQ ID NO: 354596 - DNA, 26 bp, Artificial Sequence
  Description of Artificial Sequence: Synthetic oligonucleotide
cgcatctctgagcatgaggcctccct

SEQ ID NO: 354597 - DNA, 33 bp, Artificial Sequence; identical to SEQ ID NO: 349
  Description of Artificial Sequence: Synthetic oligonucleotide

SEQ ID NO: 354598 - DNA, 27 bp, Artificial Sequence
  Description of Artificial Sequence: Synthetic oligonucleotide
gcatctctgagcatgaggcctccctga

SEQ ID NO: 354599 - DNA, 32 bp, Artificial Sequence; identical to SEQ ID NO: 350
  Description of Artificial Sequence: Synthetic oligonucleotide

SEQ ID NO: 354600 - DNA, 27 bp, Artificial Sequence
  Description of Artificial Sequence: Synthetic oligonucleotide
catctctgagcatgaggcctccctgag

SEQ ID NO: 354601 - DNA, 32 bp, Artificial Sequence; identical to SEQ ID NO: 351
  Description of Artificial Sequence: Synthetic oligonucleotide

SEQ ID NO: 354602 - DNA, 27 bp, Artificial Sequence
  Description of Artificial Sequence: Synthetic oligonucleotide
atctctgagcatgaggcctccctgagg

SEQ ID NO: 354603 - DNA, 31 bp, Artificial Sequence; identical to SEQ ID NO: 352
  Description of Artificial Sequence: Synthetic oligonucleotide

SEQ ID NO: 354604 - DNA, 27 bp, Artificial Sequence
  Description of Artificial Sequence: Synthetic oligonucleotide
tctctgagcatgaggcctccctgaggt

SEQ ID NO: 354605 - DNA, 32 bp, Artificial Sequence; identical to SEQ ID NO: 353
  Description of Artificial Sequence: Synthetic oligonucleotide

SEQ ID NO: 354606 - DNA, 26 bp, Artificial Sequence
  Description of Artificial Sequence: Synthetic oligonucleotide
ctctgagcatgaggcctccctgaggt

SEQ ID NO: 354607 - DNA, 31 bp, Artificial Sequence; identical to SEQ ID NO: 354
  Description of Artificial Sequence: Synthetic oligonucleotide

SEQ ID NO: 354608 - DNA, 26 bp, Artificial Sequence
  Description of Artificial Sequence: Synthetic oligonucleotide
tctgagcatgaggcctccctgaggtc

SEQ ID NO: 354609 - DNA, 31 bp, Artificial Sequence; identical to SEQ ID NO: 355
  Description of Artificial Sequence: Synthetic oligonucleotide

SEQ ID NO: 354610 - DNA, 25 bp, Artificial Sequence
  Description of Artificial Sequence: Synthetic oligonucleotide
ctgagcatgaggcctccctgaggtc

SEQ ID NO: 354611 - DNA, 30 bp, Artificial Sequence; identical to SEQ ID NO: 356
  Description of Artificial Sequence: Synthetic oligonucleotide

SEQ ID NO: 354612 - DNA, 26 bp, Artificial Sequence
  Description of Artificial Sequence: Synthetic oligonucleotide
tgagcatgaggcctccctgaggtcct

SEQ ID NO: 354613 - DNA, 30 bp, Artificial Sequence; identical to SEQ ID NO: 357
  Description of Artificial Sequence: Synthetic oligonucleotide

SEQ ID NO: 354614 - DNA, 25 bp, Artificial Sequence
  Description of Artificial Sequence: Synthetic oligonucleotide
gagcatgaggcctccctgaggtcct

SEQ ID NO: 354615 - DNA, 30 bp, Artificial Sequence; identical to SEQ ID NO: 358
  Description of Artificial Sequence: Synthetic oligonucleotide

SEQ ID NO: 354616 - DNA, 25 bp, Artificial Sequence
  Description of Artificial Sequence: Synthetic oligonucleotide
agcatgaggcctccctgaggtcctg

SEQ ID NO: 354617 - DNA, 29 bp, Artificial Sequence
  Description of Artificial Sequence: Synthetic oligonucleotide
tccagataatgtatggctgcgacgtgggg

SEQ ID NO: 354618 - DNA, 24 bp, Artificial Sequence
  Description of Artificial Sequence: Synthetic oligonucleotide
gcatgaggcctccctgaggtcctg

SEQ ID NO: 354619 - DNA, 28 bp, Artificial Sequence
  Description of Artificial Sequence: Synthetic oligonucleotide
ccagataatgtatggctgcgacgtgggg

SEQ ID NO: 354620 - DNA, 24 bp, Artificial Sequence
  Description of Artificial Sequence: Synthetic oligonucleotide
catgaggcctccctgaggtcctgg

SEQ ID NO: 354621 - DNA, 28 bp, Artificial Sequence
  Description of Artificial Sequence: Synthetic oligonucleotide
cagataatgtatggctgcgacgtggggc

SEQ ID NO: 354622 - DNA, 24 bp, Artificial Sequence
  Description of Artificial Sequence: Synthetic oligonucleotide
atgaggcctccctgaggtcctggg

SEQ ID NO: 354623 - DNA, 28 bp, Artificial Sequence
  Description of Artificial Sequence: Synthetic oligonucleotide
agataatgtatggctgcgacgtggggcc

SEQ ID NO: 354624 - DNA, 23 bp, Artificial Sequence
  Description of Artificial Sequence: Synthetic oligonucleotide
tgaggcctccctgaggtcctggg

SEQ ID NO: 354625 - DNA, 27 bp, Artificial Sequence
  Description of Artificial Sequence: Synthetic oligonucleotide
gataatgtatggctgcgacgtggggcc

SEQ ID NO: 354626 - DNA, 22 bp, Artificial Sequence
  Description of Artificial Sequence: Synthetic oligonucleotide
gaggcctccctgaggtcctggg

SEQ ID NO: 354627 - DNA, 27 bp, Artificial Sequence
  Description of Artificial Sequence: Synthetic oligonucleotide
ataatgtatggctgcgacgtggggccg

SEQ ID NO: 354628 - DNA, 22 bp, Artificial Sequence
  Description of Artificial Sequence: Synthetic oligonucleotide
aggcctccctgaggtcctgggc

SEQ ID NO: 354629 - DNA, 26 bp, Artificial Sequence
  Description of Artificial Sequence: Synthetic oligonucleotide
taatgtatggctgcgacgtggggccg

SEQ ID NO: 354630 - DNA, 21 bp, Artificial Sequence
  Description of Artificial Sequence: Synthetic oligonucleotide
ggcctccctgaggtcctgggc

SEQ ID NO: 354631 - DNA, 25 bp, Artificial Sequence
  Description of Artificial Sequence: Synthetic oligonucleotide
aatgtatggctgcgacgtggggccg

SEQ ID NO: 354632 - DNA, 21 bp, Artificial Sequence
  Description of Artificial Sequence: Synthetic oligonucleotide
gcctccctgaggtcctgggcc

SEQ ID NO: 354633 - DNA, 24 bp, Artificial Sequence
  Description of Artificial Sequence: Synthetic oligonucleotide
atgtatggctgcgacgtggggccg

SEQ ID NO: 354634 - DNA, 22 bp, Artificial Sequence
  Description of Artificial Sequence: Synthetic oligonucleotide
cctccctgaggtcctgggccct

SEQ ID NO: 354635 - DNA, 23 bp, Artificial Sequence
  Description of Artificial Sequence: Synthetic oligonucleotide
tgtatggctgcgacgtggggccg

SEQ ID NO: 354636 - DNA, 22 bp, Artificial Sequence
  Description of Artificial Sequence: Synthetic oligonucleotide
ctccctgaggtcctgggccctc

SEQ ID NO: 354637 - DNA, 22 bp, Artificial Sequence
  Description of Artificial Sequence: Synthetic oligonucleotide
gtatggctgcgacgtggggccg

SEQ ID NO: 354638 - DNA, 22 bp, Artificial Sequence
  Description of Artificial Sequence: Synthetic oligonucleotide
tccctgaggtcctgggccctcg

SEQ ID NO: 354639 - DNA, 23 bp, Artificial Sequence
  Description of Artificial Sequence: Synthetic oligonucleotide
tatggctgcgacgtggggccgga

SEQ ID NO: 354640 - DNA, 21 bp, Artificial Sequence
  Description of Artificial Sequence: Synthetic oligonucleotide
ccctgaggtcctgggccctcg

SEQ ID NO: 354641 - DNA, 22 bp, Artificial Sequence
  Description of Artificial Sequence: Synthetic oligonucleotide
atggctgcgacgtggggccgga

SEQ ID NO: 354642 - DNA, 21 bp, Artificial Sequence
  Description of Artificial Sequence: Synthetic oligonucleotide
cctgaggtcctgggccctcgg

SEQ ID NO: 354643 - DNA, 21 bp, Artificial Sequence
  Description of Artificial Sequence: Synthetic oligonucleotide
tggctgcgacgtggggccgga

SEQ ID NO: 354644 - DNA, 23 bp, Artificial Sequence
  Description of Artificial Sequence: Synthetic oligonucleotide
ctgaggtcctgggccctcggctt

SEQ ID NO: 354645 - DNA, 20 bp, Artificial Sequence
  Description of Artificial Sequence: Synthetic oligonucleotide
ggctgcgacgtggggccgga

SEQ ID NO: 354646 - DNA, 25 bp, Artificial Sequence
  Description of Artificial Sequence: Synthetic oligonucleotide
tgaggtcctgggccctcggcttcta

SEQ ID NO: 354647 - DNA, 20 bp, Artificial Sequence
  Description of Artificial Sequence: Synthetic oligonucleotide
gctgcgacgtggggccggac

SEQ ID NO: 354648 - DNA, 24 bp, Artificial Sequence
  Description of Artificial Sequence: Synthetic oligonucleotide
gaggtcctgggccctcggcttcta

SEQ ID NO: 354649 - DNA, 20 bp, Artificial Sequence
  Description of Artificial Sequence: Synthetic oligonucleotide
ctgcgacgtggggccggacg

SEQ ID NO: 354650 - DNA, 24 bp, Artificial Sequence
  Description of Artificial Sequence: Synthetic oligonucleotide
aggtcctgggccctcggcttctac

SEQ ID NO: 354651 - DNA, 20 bp, Artificial Sequence
  Description of Artificial Sequence: Synthetic oligonucleotide
tgcgacgtggggccggacgg

SEQ ID NO: 354652 - DNA, 23 bp, Artificial Sequence
  Description of Artificial Sequence: Synthetic oligonucleotide
ggtcctgggccctcggcttctac

SEQ ID NO: 354653 - DNA, 20 bp, Artificial Sequence
  Description of Artificial Sequence: Synthetic oligonucleotide
gcgacgtggggccggacggt

SEQ ID NO: 354654 - DNA, 23 bp, Artificial Sequence
  Description of Artificial Sequence: Synthetic oligonucleotide
gtcctgggccctcggcttctacg

SEQ ID NO: 354655 - DNA, 20 bp, Artificial Sequence
  Description of Artificial Sequence: Synthetic oligonucleotide
cgacgtggggccggacgggt

SEQ ID NO: 354656 - DNA, 24 bp, Artificial Sequence
  Description of Artificial Sequence: Synthetic oligonucleotide
tcctgggccctcggcttctacgct

SEQ ID NO: 354657 - DNA, 20 bp, Artificial Sequence
  Description of Artificial Sequence: Synthetic oligonucleotide
gacgtggggccggacgggct

SEQ ID NO: 354658 - DNA, 23 bp, Artificial Sequence
  Description of Artificial Sequence: Synthetic oligonucleotide
cctgggccctcggcttctacgct

SEQ ID NO: 354659 - DNA, 20 bp, Artificial Sequence
  Description of Artificial Sequence: Synthetic oligonucleotide
acgtggggccggacgggcgt

SEQ ID NO: 354660 - DNA, 23 bp, Artificial Sequence
  Description of Artificial Sequence: Synthetic oligonucleotide
ctgggccctcggcttctacgctg

SEQ ID NO: 354661 - DNA, 20 bp, Artificial Sequence
  Description of Artificial Sequence: Synthetic oligonucleotide
cgtggggccggacgggcgtt

SEQ ID NO: 354662 - DNA, 23 bp, Artificial Sequence
  Description of Artificial Sequence: Synthetic oligonucleotide
tgggccctcggcttctacgctgc

SEQ ID NO: 354663 - DNA, 20 bp, Artificial Sequence
  Description of Artificial Sequence: Synthetic oligonucleotide
gtggggccggacgggcgctt

SEQ ID NO: 354664 - DNA, 22 bp, Artificial Sequence
  Description of Artificial Sequence: Synthetic oligonucleotide
gggccctcggcttctacgctgc

SEQ ID NO: 354665 - DNA, 20 bp, Artificial Sequence
  Description of Artificial Sequence: Synthetic oligonucleotide
tggggccggacgggcgcttc

SEQ ID NO: 354666 - DNA, 22 bp, Artificial Sequence
  Description of Artificial Sequence: Synthetic oligonucleotide
ggccctcggcttctacgctgcg

SEQ ID NO: 354667 - DNA, 20 bp, Artificial Sequence
  Description of Artificial Sequence: Synthetic oligonucleotide
ggggccggacgggcgcttct

SEQ ID NO: 354668 - DNA, 23 bp, Artificial Sequence
  Description of Artificial Sequence: Synthetic oligonucleotide
gccctcggcttctacgctgcgga

SEQ ID NO: 354669 - DNA, 20 bp, Artificial Sequence
  Description of Artificial Sequence: Synthetic oligonucleotide
gggccggacgggcgcttcct

SEQ ID NO: 354670 - DNA, 25 bp, Artificial Sequence
  Description of Artificial Sequence: Synthetic oligonucleotide
ccctcggcttctacgctgcggagaa

SEQ ID NO: 354671 - DNA, 20 bp, Artificial Sequence
  Description of Artificial Sequence: Synthetic oligonucleotide
ggccggacgggcgcttcctc

SEQ ID NO: 354672 - DNA, 26 bp, Artificial Sequence
  Description of Artificial Sequence: Synthetic oligonucleotide
cctcggcttctacgctgcggagaaca

SEQ ID NO: 354673 - DNA, 20 bp, Artificial Sequence
  Description of Artificial Sequence: Synthetic oligonucleotide
gccggacgggcgcttcctcc

SEQ ID NO: 354674 - DNA, 27 bp, Artificial Sequence
  Description of Artificial Sequence: Synthetic oligonucleotide
ctcggcttctacgctgcggagaacaca

SEQ ID NO: 354675 - DNA, 20 bp, Artificial Sequence
  Description of Artificial Sequence: Synthetic oligonucleotide
ccggacgggcgcttcctccg

SEQ ID NO: 354676 - DNA, 27 bp, Artificial Sequence
  Description of Artificial Sequence: Synthetic oligonucleotide
tcggcttctacgctgcggagaacacac

SEQ ID NO: 354677 - DNA, 20 bp, Artificial Sequence
  Description of Artificial Sequence: Synthetic oligonucleotide
cggacgggcgcttcctccgc

SEQ ID NO: 354678 - DNA, 27 bp, Artificial Sequence
  Description of Artificial Sequence: Synthetic oligonucleotide
cggcttctacgctgcggagaacacact

SEQ ID NO: 354679 - DNA, 20 bp, Artificial Sequence
  Description of Artificial Sequence: Synthetic oligonucleotide
ggacgggcgcttcctccgcg

SEQ ID NO: 354680 - DNA, 27 bp, Artificial Sequence
  Description of Artificial Sequence: Synthetic oligonucleotide
ggcttctacgctgcggagaacacactg

SEQ ID NO: 354681 - DNA, 20 bp, Artificial Sequence
  Description of Artificial Sequence: Synthetic oligonucleotide
gacgggcgcttcctccgcgg

SEQ ID NO: 354682 - DNA, 28 bp, Artificial Sequence
  Description of Artificial Sequence: Synthetic oligonucleotide
gcttctacgctgcggagaacacactgac

SEQ ID NO: 354683 - DNA, 22 bp, Artificial Sequence
  Description of Artificial Sequence: Synthetic oligonucleotide
acgggcgcttcctccgcgggta

SEQ ID NO: 354684 - DNA, 28 bp, Artificial Sequence
  Description of Artificial Sequence: Synthetic oligonucleotide
cttctacgctgcggagaacacactgacg

SEQ ID NO: 354685 - DNA, 21 bp, Artificial Sequence
  Description of Artificial Sequence: Synthetic oligonucleotide
cgggcgcttcctccgcgggta

SEQ ID NO: 354686 - DNA, 29 bp, Artificial Sequence
  Description of Artificial Sequence: Synthetic oligonucleotide
ttctacgctgcggagaacacactgacgtg

SEQ ID NO: 354687 - DNA, 21 bp, Artificial Sequence
  Description of Artificial Sequence: Synthetic oligonucleotide
gggcgcttcctccgcgggtac

SEQ ID NO: 354688 - DNA, 28 bp, Artificial Sequence
  Description of Artificial Sequence: Synthetic oligonucleotide
tctacgctgcggagaacacactgacgtg

SEQ ID NO: 354689 - DNA, 21 bp, Artificial Sequence
  Description of Artificial Sequence: Synthetic oligonucleotide
ggcgcttcctccgcgggtacc

SEQ ID NO: 354690 - DNA, 27 bp, Artificial Sequence
  Description of Artificial Sequence: Synthetic oligonucleotide
ctacgctgcggagaacacactgacgtg

SEQ ID NO: 354691 - DNA, 21 bp, Artificial Sequence
  Description of Artificial Sequence: Synthetic oligonucleotide
gcgcttcctccgcgggtaccg

SEQ ID NO: 354692 - DNA, 27 bp, Artificial Sequence
  Description of Artificial Sequence: Synthetic oligonucleotide
tacgctgcggagaacacactgacgtgg

SEQ ID NO: 354693 - DNA, 21 bp, Artificial Sequence
  Description of Artificial Sequence: Synthetic oligonucleotide
cgcttcctccgcgggtaccgg

SEQ ID NO: 354694 - DNA, 26 bp, Artificial Sequence
  Description of Artificial Sequence: Synthetic oligonucleotide
acgctgcggagaacacactgacgtgg

SEQ ID NO: 354695 - DNA, 22 bp, Artificial Sequence
  Description of Artificial Sequence: Synthetic oligonucleotide
gcttcctccgcgggtaccggca

SEQ ID NO: 354696 - DNA, 25 bp, Artificial Sequence
  Description of Artificial Sequence: Synthetic oligonucleotide
cgctgcggagaacacactgacgtgg

SEQ ID NO: 354697 - DNA, 22 bp, Artificial Sequence
  Description of Artificial Sequence: Synthetic oligonucleotide
cttcctccgcgggtaccggcag

SEQ ID NO: 354698 - DNA, 26 bp, Artificial Sequence
  Description of Artificial Sequence: Synthetic oligonucleotide
gctgcggagaacacactgacgtggca

SEQ ID NO: 354699 - DNA, 23 bp, Artificial Sequence
  Description of Artificial Sequence: Synthetic oligonucleotide
ttcctccgcgggtaccggcagga

SEQ ID NO: 354700 - DNA, 26 bp, Artificial Sequence
  Description of Artificial Sequence: Synthetic oligonucleotide
ctgcggagaacacactgacgtggcag

SEQ ID NO: 354701 - DNA, 22 bp, Artificial Sequence
  Description of Artificial Sequence: Synthetic oligonucleotide
tcctccgcgggtaccggcagga

SEQ ID NO: 354702 - DNA, 26 bp, Artificial Sequence
  Description of Artificial Sequence: Synthetic oligonucleotide
tgcggagaacacactgacgtggcagc

SEQ ID NO: 354703 - DNA, 21 bp, Artificial Sequence
  Description of Artificial Sequence: Synthetic oligonucleotide
cctccgcgggtaccggcagga

SEQ ID NO: 354704 - DNA, 25 bp, Artificial Sequence
  Description of Artificial Sequence: Synthetic oligonucleotide
gcggagaacacactgacgtggcagc

SEQ ID NO: 354705 - DNA, 21 bp, Artificial Sequence
  Description of Artificial Sequence: Synthetic oligonucleotide
ctccgcgggtaccggcaggac

SEQ ID NO: 354706 - DNA, 25 bp, Artificial Sequence
  Description of Artificial Sequence: Synthetic oligonucleotide
cggagaacacactgacgtggcagcg

SEQ ID NO: 354707 - DNA, 21 bp, Artificial Sequence
  Description of Artificial Sequence: Synthetic oligonucleotide
tccgcgggtaccggcaggacg

SEQ ID NO: 354708 - DNA, 25 bp, Artificial Sequence
  Description of Artificial Sequence: Synthetic oligonucleotide
ggagaacacactgacgtggcagcgg

SEQ ID NO: 354709 - DNA, 20 bp, Artificial Sequence
  Description of Artificial Sequence: Synthetic oligonucleotide
ccgcgggtaccggcaggacg

SEQ ID NO: 354710 - DNA, 27 bp, Artificial Sequence
  Description of Artificial Sequence: Synthetic oligonucleotide
gagaacacactgacgtggcagcggcat

SEQ ID NO: 354711 - DNA, 20 bp, Artificial Sequence
  Description of Artificial Sequence: Synthetic oligonucleotide
cgcgggtaccggcaggacgc

SEQ ID NO: 354712 - DNA, 27 bp, Artificial Sequence
  Description of Artificial Sequence: Synthetic oligonucleotide
agaacacactgacgtggcagcggcatg

SEQ ID NO: 354713 - DNA, 22 bp, Artificial Sequence
  Description of Artificial Sequence: Synthetic oligonucleotide
gcgggtaccggcaggacgccta

SEQ ID NO: 354714 - DNA, 26 bp, Artificial Sequence
  Description of Artificial Sequence: Synthetic oligonucleotide
gaacacactgacgtggcagcggcatg

SEQ ID NO: 354715 - DNA, 22 bp, Artificial Sequence
  Description of Artificial Sequence: Synthetic oligonucleotide
cgggtaccggcaggacgcctac

SEQ ID NO: 354716 - DNA, 26 bp, Artificial Sequence
  Description of Artificial Sequence: Synthetic oligonucleotide
aacacactgacgtggcagcggcatgg

SEQ ID NO: 354717 - DNA, 23 bp, Artificial Sequence
  Description of Artificial Sequence: Synthetic oligonucleotide
gggtaccggcaggacgcctacga

SEQ ID NO: 354718 - DNA, 25 bp, Artificial Sequence
  Description of Artificial Sequence: Synthetic oligonucleotide
acacactgacgtggcagcggcatgg

SEQ ID NO: 354719 - DNA, 23 bp, Artificial Sequence
  Description of Artificial Sequence: Synthetic oligonucleotide
ggtaccggcaggacgcctacgac

SEQ ID NO: 354720 - DNA, 24 bp, Artificial Sequence
  Description of Artificial Sequence: Synthetic oligonucleotide
cacactgacgtggcagcggcatgg

SEQ ID NO: 354721 - DNA, 23 bp, Artificial Sequence
  Description of Artificial Sequence: Synthetic oligonucleotide
gtaccggcaggacgcctacgacg

SEQ ID NO: 354722 - DNA, 24 bp, Artificial Sequence
  Description of Artificial Sequence: Synthetic oligonucleotide
acactgacgtggcagcggcatggc

SEQ ID NO: 354723 - DNA, 23 bp, Artificial Sequence
  Description of Artificial Sequence: Synthetic oligonucleotide
taccggcaggacgcctacgacgg

SEQ ID NO: 354724 - DNA, 23 bp, Artificial Sequence
  Description of Artificial Sequence: Synthetic oligonucleotide
cactgacgtggcagcggcatggc

SEQ ID NO: 354725 - DNA, 22 bp, Artificial Sequence
  Description of Artificial Sequence: Synthetic oligonucleotide
accggcaggacgcctacgacgg

SEQ ID NO: 354726 - DNA, 24 bp, Artificial Sequence
  Description of Artificial Sequence: Synthetic oligonucleotide
actgacgtggcagcggcatggcga

SEQ ID NO: 354727 - DNA, 21 bp, Artificial Sequence
  Description of Artificial Sequence: Synthetic oligonucleotide
ccggcaggacgcctacgacgg

SEQ ID NO: 354728 - DNA, 23 bp, Artificial Sequence
  Description of Artificial Sequence: Synthetic oligonucleotide
ctgacgtggcagcggcatggcga

SEQ ID NO: 354729 - DNA, 23 bp, Artificial Sequence
  Description of Artificial Sequence: Synthetic oligonucleotide
cggcaggacgcctacgacggcaa

SEQ ID NO: 354730 - DNA, 23 bp, Artificial Sequence
  Description of Artificial Sequence: Synthetic oligonucleotide
tgacgtggcagcggcatggcgag

SEQ ID NO: 354731 - DNA, 23 bp, Artificial Sequence
  Description of Artificial Sequence: Synthetic oligonucleotide
ggcaggacgcctacgacggcaag

SEQ ID NO: 354732 - DNA, 22 bp, Artificial Sequence
  Description of Artificial Sequence: Synthetic oligonucleotide
gacgtggcagcggcatggcgag

SEQ ID NO: 354733 - DNA, 27 bp, Artificial Sequence
  Description of Artificial Sequence: Synthetic oligonucleotide
gcaggacgcctacgacggcaaggatta

SEQ ID NO: 354734 - DNA, 23 bp, Artificial Sequence
  Description of Artificial Sequence: Synthetic oligonucleotide
acgtggcagcggcatggcgagca

SEQ ID NO: 354735 - DNA, 27 bp, Artificial Sequence
  Description of Artificial Sequence: Synthetic oligonucleotide
caggacgcctacgacggcaaggattac

SEQ ID NO: 354736 - DNA, 22 bp, Artificial Sequence
  Description of Artificial Sequence: Synthetic oligonucleotide
cgtggcagcggcatggcgagca

SEQ ID NO: 354737 - DNA, 29 bp, Artificial Sequence
  Description of Artificial Sequence: Synthetic oligonucleotide
aggacgcctacgacggcaaggattacatc

SEQ ID NO: 354738 - DNA, 22 bp, Artificial Sequence
  Description of Artificial Sequence: Synthetic oligonucleotide
gtggcagcggcatggcgagcac

SEQ ID NO: 354739 - DNA, 28 bp, Artificial Sequence
  Description of Artificial Sequence: Synthetic oligonucleotide
ggacgcctacgacggcaaggattacatc

SEQ ID NO: 354740 - DNA, 25 bp, Artificial Sequence
  Description of Artificial Sequence: Synthetic oligonucleotide
tggcagcggcatggcgagcaccaaa

SEQ ID NO: 354741 - DNA, 28 bp, Artificial Sequence
  Description of Artificial Sequence: Synthetic oligonucleotide
gacgcctacgacggcaaggattacatcg

SEQ ID NO: 354742 - DNA, 24 bp, Artificial Sequence
  Description of Artificial Sequence: Synthetic oligonucleotide
ggcagcggcatggcgagcaccaaa

SEQ ID NO: 354743 - DNA, 28 bp, Artificial Sequence
  Description of Artificial Sequence: Synthetic oligonucleotide
acgcctacgacggcaaggattacatcgc

SEQ ID NO: 354744 - DNA, 25 bp, Artificial Sequence
  Description of Artificial Sequence: Synthetic oligonucleotide
gcagcggcatggcgagcaccaaact

SEQ ID NO: 354745 - DNA, 27 bp, Artificial Sequence
  Description of Artificial Sequence: Synthetic oligonucleotide
cgcctacgacggcaaggattacatcgc

SEQ ID NO: 354746 - DNA, 26 bp, Artificial Sequence
  Description of Artificial Sequence: Synthetic oligonucleotide
cagcggcatggcgagcaccaaactca

SEQ ID NO: 354747 - DNA, 27 bp, Artificial Sequence
  Description of Artificial Sequence: Synthetic oligonucleotide
gcctacgacggcaaggattacatcgcc

SEQ ID NO: 354748 - DNA, 26 bp, Artificial Sequence
  Description of Artificial Sequence: Synthetic oligonucleotide
agcggcatggcgagcaccaaactcac

SEQ ID NO: 354749 - DNA, 27 bp, Artificial Sequence
  Description of Artificial Sequence: Synthetic oligonucleotide
cctacgacggcaaggattacatcgccc

SEQ ID NO: 354750 - DNA, 25 bp, Artificial Sequence
  Description of Artificial Sequence: Synthetic oligonucleotide
gcggcatggcgagcaccaaactcac

SEQ ID NO: 354751 - DNA, 28 bp, Artificial Sequence
  Description of Artificial Sequence: Synthetic oligonucleotide
ctacgacggcaaggattacatcgccctg

SEQ ID NO: 354752 - DNA, 26 bp, Artificial Sequence
  Description of Artificial Sequence: Synthetic oligonucleotide
cggcatggcgagcaccaaactcacga

SEQ ID NO: 354753 - DNA, 30 bp, Artificial Sequence; identical to SEQ ID NO: 427
  Description of Artificial Sequence: Synthetic oligonucleotide

SEQ ID NO: 354754 - DNA, 27 bp, Artificial Sequence
  Description of Artificial Sequence: Synthetic oligonucleotide
ggcatggcgagcaccaaactcacgaca

SEQ ID NO: 354755 - DNA, 29 bp, Artificial Sequence
  Description of Artificial Sequence: Synthetic oligonucleotide
acgacggcaaggattacatcgccctgaac

SEQ ID NO: 354756 - DNA, 27 bp, Artificial Sequence
  Description of Artificial Sequence: Synthetic oligonucleotide
gcatggcgagcaccaaactcacgacac

SEQ ID NO: 354757 - DNA, 28 bp, Artificial Sequence
  Description of Artificial Sequence: Synthetic oligonucleotide
cgacggcaaggattacatcgccctgaac

SEQ ID NO: 354758 - DNA, 27 bp, Artificial Sequence
  Description of Artificial Sequence: Synthetic oligonucleotide
catggcgagcaccaaactcacgacacc

SEQ ID NO: 354759 - DNA, 28 bp, Artificial Sequence
  Description of Artificial Sequence: Synthetic oligonucleotide
gacggcaaggattacatcgccctgaacg

SEQ ID NO: 354760 - DNA, 27 bp, Artificial Sequence
  Description of Artificial Sequence: Synthetic oligonucleotide
atggcgagcaccaaactcacgacaccg

SEQ ID NO: 354761 - DNA, 29 bp, Artificial Sequence
  Description of Artificial Sequence: Synthetic oligonucleotide
acggcaaggattacatcgccctgaacgag

SEQ ID NO: 354762 - DNA, 27 bp, Artificial Sequence
  Description of Artificial Sequence: Synthetic oligonucleotide
tggcgagcaccaaactcacgacaccga

SEQ ID NO: 354763 - DNA, 28 bp, Artificial Sequence
  Description of Artificial Sequence: Synthetic oligonucleotide
cggcaaggattacatcgccctgaacgag

SEQ ID NO: 354764 - DNA, 26 bp, Artificial Sequence
  Description of Artificial Sequence: Synthetic oligonucleotide
ggcgagcaccaaactcacgacaccga

SEQ ID NO: 354765 - DNA, 28 bp, Artificial Sequence
  Description of Artificial Sequence: Synthetic oligonucleotide
ggcaaggattacatcgccctgaacgagg

SEQ ID NO: 354766 - DNA, 26 bp, Artificial Sequence
  Description of Artificial Sequence: Synthetic oligonucleotide
gcgagcaccaaactcacgacaccgag

SEQ ID NO: 354767 - DNA, 29 bp, Artificial Sequence
  Description of Artificial Sequence: Synthetic oligonucleotide
gcaaggattacatcgccctgaacgaggac

SEQ ID NO: 354768 - DNA, 27 bp, Artificial Sequence
  Description of Artificial Sequence: Synthetic oligonucleotide
cgagcaccaaactcacgacaccgaggt

SEQ ID NO: 354769 - DNA, 29 bp, Artificial Sequence
  Description of Artificial Sequence: Synthetic oligonucleotide
caaggattacatcgccctgaacgaggacc

SEQ ID NO: 354770 - DNA, 28 bp, Artificial Sequence
  Description of Artificial Sequence: Synthetic oligonucleotide
gagcaccaaactcacgacaccgaggttg

SEQ ID NO: 354771 - DNA, 30 bp, Artificial Sequence; identical to SEQ ID NO: 436
  Description of Artificial Sequence: Synthetic oligonucleotide

SEQ ID NO: 354772 - DNA, 29 bp, Artificial Sequence
  Description of Artificial Sequence: Synthetic oligonucleotide
agcaccaaactcacgacaccgaggttgtg

SEQ ID NO: 354773 - DNA, 29 bp, Artificial Sequence
  Description of Artificial Sequence: Synthetic oligonucleotide
aggattacatcgccctgaacgaggacctg

SEQ ID NO: 354774 - DNA, 28 bp, Artificial Sequence
  Description of Artificial Sequence: Synthetic oligonucleotide
gcaccaaactcacgacaccgaggttgtg

SEQ ID NO: 354775 - DNA, 28 bp, Artificial Sequence
  Description of Artificial Sequence: Synthetic oligonucleotide
ggattacatcgccctgaacgaggacctg

SEQ ID NO: 354776 - DNA, 28 bp, Artificial Sequence
  Description of Artificial Sequence: Synthetic oligonucleotide
caccaaactcacgacaccgaggttgtgg

SEQ ID NO: 354777 - DNA, 28 bp, Artificial Sequence
  Description of Artificial Sequence: Synthetic oligonucleotide
gattacatcgccctgaacgaggacctgc

SEQ ID NO: 354778 - DNA, 29 bp, Artificial Sequence
  Description of Artificial Sequence: Synthetic oligonucleotide
accaaactcacgacaccgaggttgtggag

SEQ ID NO: 354779 - DNA, 28 bp, Artificial Sequence
  Description of Artificial Sequence: Synthetic oligonucleotide
attacatcgccctgaacgaggacctgcg

SEQ ID NO: 354780 - DNA, 28 bp, Artificial Sequence
  Description of Artificial Sequence: Synthetic oligonucleotide
ccaaactcacgacaccgaggttgtggag

SEQ ID NO: 354781 - DNA, 27 bp, Artificial Sequence
  Description of Artificial Sequence: Synthetic oligonucleotide
ttacatcgccctgaacgaggacctgcg

SEQ ID NO: 354782 - DNA, 29 bp, Artificial Sequence
  Description of Artificial Sequence: Synthetic oligonucleotide
caaactcacgacaccgaggttgtggagag

SEQ ID NO: 354783 - DNA, 26 bp, Artificial Sequence
  Description of Artificial Sequence: Synthetic oligonucleotide
tacatcgccctgaacgaggacctgcg

SEQ ID NO: 354784 - DNA, 29 bp, Artificial Sequence
  Description of Artificial Sequence: Synthetic oligonucleotide
aaactcacgacaccgaggttgtggagagc

SEQ ID NO: 354785 - DNA, 25 bp, Artificial Sequence
  Description of Artificial Sequence: Synthetic oligonucleotide
acatcgccctgaacgaggacctgcg

SEQ ID NO: 354786 - DNA, 28 bp, Artificial Sequence
  Description of Artificial Sequence: Synthetic oligonucleotide
aactcacgacaccgaggttgtggagagc

SEQ ID NO: 354787 - DNA, 24 bp, Artificial Sequence
  Description of Artificial Sequence: Synthetic oligonucleotide
catcgccctgaacgaggacctgcg

SEQ ID NO: 354788 - DNA, 27 bp, Artificial Sequence
  Description of Artificial Sequence: Synthetic oligonucleotide
actcacgacaccgaggttgtggagagc

SEQ ID NO: 354789 - DNA, 25 bp, Artificial Sequence
  Description of Artificial Sequence: Synthetic oligonucleotide
atcgccctgaacgaggacctgcgct

SEQ ID NO: 354790 - DNA, 27 bp, Artificial Sequence
  Description of Artificial Sequence: Synthetic oligonucleotide
ctcacgacaccgaggttgtggagagca

SEQ ID NO: 354791 - DNA, 24 bp, Artificial Sequence
  Description of Artificial Sequence: Synthetic oligonucleotide
tcgccctgaacgaggacctgcgct

SEQ ID NO: 354792 - DNA, 27 bp, Artificial Sequence
  Description of Artificial Sequence: Synthetic oligonucleotide
tcacgacaccgaggttgtggagagcag

SEQ ID NO: 354793 - DNA, 23 bp, Artificial Sequence
  Description of Artificial Sequence: Synthetic oligonucleotide
cgccctgaacgaggacctgcgct

SEQ ID NO: 354794 - DNA, 26 bp, Artificial Sequence
  Description of Artificial Sequence: Synthetic oligonucleotide
cacgacaccgaggttgtggagagcag

SEQ ID NO: 354795 - DNA, 25 bp, Artificial Sequence
  Description of Artificial Sequence: Synthetic oligonucleotide
gccctgaacgaggacctgcgctctt

SEQ ID NO: 354796 - DNA, 26 bp, Artificial Sequence
  Description of Artificial Sequence: Synthetic oligonucleotide
acgacaccgaggttgtggagagcagg

SEQ ID NO: 354797 - DNA, 25 bp, Artificial Sequence
  Description of Artificial Sequence: Synthetic oligonucleotide
ccctgaacgaggacctgcgctcttg

SEQ ID NO: 354798 - DNA, 25 bp, Artificial Sequence
  Description of Artificial Sequence: Synthetic oligonucleotide
cgacaccgaggttgtggagagcagg

SEQ ID NO: 354799 - DNA, 26 bp, Artificial Sequence
  Description of Artificial Sequence: Synthetic oligonucleotide
cctgaacgaggacctgcgctcttgga

SEQ ID NO: 354800 - DNA, 25 bp, Artificial Sequence
  Description of Artificial Sequence: Synthetic oligonucleotide
gacaccgaggttgtggagagcaggc

SEQ ID NO: 354801 - DNA, 26 bp, Artificial Sequence
  Description of Artificial Sequence: Synthetic oligonucleotide
ctgaacgaggacctgcgctcttggac

SEQ ID NO: 354802 - DNA, 26 bp, Artificial Sequence
  Description of Artificial Sequence: Synthetic oligonucleotide
acaccgaggttgtggagagcaggcca

SEQ ID NO: 354803 - DNA, 26 bp, Artificial Sequence
  Description of Artificial Sequence: Synthetic oligonucleotide
tgaacgaggacctgcgctcttggacc

SEQ ID NO: 354804 - DNA, 25 bp, Artificial Sequence
  Description of Artificial Sequence: Synthetic oligonucleotide
caccgaggttgtggagagcaggcca

SEQ ID NO: 354805 - DNA, 25 bp, Artificial Sequence
  Description of Artificial Sequence: Synthetic oligonucleotide
gaacgaggacctgcgctcttggacc

SEQ ID NO: 354806 - DNA, 25 bp, Artificial Sequence
  Description of Artificial Sequence: Synthetic oligonucleotide
accgaggttgtggagagcaggccag

SEQ ID NO: 354807 - DNA, 25 bp, Artificial Sequence
  Description of Artificial Sequence: Synthetic oligonucleotide
aacgaggacctgcgctcttggaccg

SEQ ID NO: 354808 - DNA, 24 bp, Artificial Sequence
  Description of Artificial Sequence: Synthetic oligonucleotide
ccgaggttgtggagagcaggccag

SEQ ID NO: 354809 - DNA, 24 bp, Artificial Sequence
  Description of Artificial Sequence: Synthetic oligonucleotide
acgaggacctgcgctcttggaccg

SEQ ID NO: 354810 - DNA, 25 bp, Artificial Sequence
  Description of Artificial Sequence: Synthetic oligonucleotide
cgaggttgtggagagcaggccagct

SEQ ID NO: 354811 - DNA, 23 bp, Artificial Sequence
  Description of Artificial Sequence: Synthetic oligonucleotide
cgaggacctgcgctcttggaccg

SEQ ID NO: 354812 - DNA, 25 bp, Artificial Sequence
  Description of Artificial Sequence: Synthetic oligonucleotide
gaggttgtggagagcaggccagctg

SEQ ID NO: 354813 - DNA, 23 bp, Artificial Sequence
  Description of Artificial Sequence: Synthetic oligonucleotide
gaggacctgcgctcttggaccgc

SEQ ID NO: 354814 - DNA, 26 bp, Artificial Sequence
  Description of Artificial Sequence: Synthetic oligonucleotide
aggttgtggagagcaggccagctgga

SEQ ID NO: 354815 - DNA, 23 bp, Artificial Sequence
  Description of Artificial Sequence: Synthetic oligonucleotide
aggacctgcgctcttggaccgcg

SEQ ID NO: 354816 - DNA, 25 bp, Artificial Sequence
  Description of Artificial Sequence: Synthetic oligonucleotide
ggttgtggagagcaggccagctgga

SEQ ID NO: 354817 - DNA, 22 bp, Artificial Sequence
  Description of Artificial Sequence: Synthetic oligonucleotide
ggacctgcgctcttggaccgcg

SEQ ID NO: 354818 - DNA, 27 bp, Artificial Sequence
  Description of Artificial Sequence: Synthetic oligonucleotide
gttgtggagagcaggccagctggagat

SEQ ID NO: 354819 - DNA, 22 bp, Artificial Sequence
  Description of Artificial Sequence: Synthetic oligonucleotide
gacctgcgctcttggaccgcgg

SEQ ID NO: 354820 - DNA, 27 bp, Artificial Sequence
  Description of Artificial Sequence: Synthetic oligonucleotide
ttgtggagagcaggccagctggagatg

SEQ ID NO: 354821 - DNA, 22 bp, Artificial Sequence
  Description of Artificial Sequence: Synthetic oligonucleotide
acctgcgctcttggaccgcggc

SEQ ID NO: 354822 - DNA, 26 bp, Artificial Sequence
  Description of Artificial Sequence: Synthetic oligonucleotide
tgtggagagcaggccagctggagatg

SEQ ID NO: 354823 - DNA, 21 bp, Artificial Sequence
  Description of Artificial Sequence: Synthetic oligonucleotide
cctgcgctcttggaccgcggc

SEQ ID NO: 354824 - DNA, 25 bp, Artificial Sequence
  Description of Artificial Sequence: Synthetic oligonucleotide
gtggagagcaggccagctggagatg

SEQ ID NO: 354825 - DNA, 21 bp, Artificial Sequence
  Description of Artificial Sequence: Synthetic oligonucleotide
ctgcgctcttggaccgcggcg

SEQ ID NO: 354826 - DNA, 27 bp, Artificial Sequence
  Description of Artificial Sequence: Synthetic oligonucleotide
tggagagcaggccagctggagatggat

SEQ ID NO: 354827 - DNA, 22 bp, Artificial Sequence
  Description of Artificial Sequence: Synthetic oligonucleotide
tgcgctcttggaccgcggcgga

SEQ ID NO: 354828 - DNA, 26 bp, Artificial Sequence
  Description of Artificial Sequence: Synthetic oligonucleotide
ggagagcaggccagctggagatggat

SEQ ID NO: 354829 - DNA, 21 bp, Artificial Sequence
  Description of Artificial Sequence: Synthetic oligonucleotide
gcgctcttggaccgcggcgga

SEQ ID NO: 354830 - DNA, 26 bp, Artificial Sequence
  Description of Artificial Sequence: Synthetic oligonucleotide
gagagcaggccagctggagatggatc

SEQ ID NO: 354831 - DNA, 23 bp, Artificial Sequence
  Description of Artificial Sequence: Synthetic oligonucleotide
cgctcttggaccgcggcggacat

SEQ ID NO: 354832 - DNA, 27 bp, Artificial Sequence
  Description of Artificial Sequence: Synthetic oligonucleotide
agagcaggccagctggagatggatcct

SEQ ID NO: 354833 - DNA, 23 bp, Artificial Sequence
  Description of Artificial Sequence: Synthetic oligonucleotide
gctcttggaccgcggcggacatg

SEQ ID NO: 354834 - DNA, 27 bp, Artificial Sequence
  Description of Artificial Sequence: Synthetic oligonucleotide
gagcaggccagctggagatggatcctt

SEQ ID NO: 354835 - DNA, 23 bp, Artificial Sequence
  Description of Artificial Sequence: Synthetic oligonucleotide
ctcttggaccgcggcggacatgg

SEQ ID NO: 354836 - DNA, 27 bp, Artificial Sequence
  Description of Artificial Sequence: Synthetic oligonucleotide
agcaggccagctggagatggatccttc

SEQ ID NO: 354837 - DNA, 24 bp, Artificial Sequence
  Description of Artificial Sequence: Synthetic oligonucleotide
tcttggaccgcggcggacatggca

SEQ ID NO: 354838 - DNA, 26 bp, Artificial Sequence
  Description of Artificial Sequence: Synthetic oligonucleotide
gcaggccagctggagatggatccttc

SEQ ID NO: 354839 - DNA, 23 bp, Artificial Sequence
  Description of Artificial Sequence: Synthetic oligonucleotide
cttggaccgcggcggacatggca

SEQ ID NO: 354840 - DNA, 27 bp, Artificial Sequence
  Description of Artificial Sequence: Synthetic oligonucleotide
caggccagctggagatggatccttcca

SEQ ID NO: 354841 - DNA, 23 bp, Artificial Sequence
  Description of Artificial Sequence: Synthetic oligonucleotide
ttggaccgcggcggacatggcag

SEQ ID NO: 354842 - DNA, 27 bp, Artificial Sequence
  Description of Artificial Sequence: Synthetic oligonucleotide
aggccagctggagatggatccttccag

SEQ ID NO: 354843 - DNA, 22 bp, Artificial Sequence
  Description of Artificial Sequence: Synthetic oligonucleotide
tggaccgcggcggacatggcag

SEQ ID NO: 354844 - DNA, 27 bp, Artificial Sequence
  Description of Artificial Sequence: Synthetic oligonucleotide
ggccagctggagatggatccttccaga

SEQ ID NO: 354845 - DNA, 21 bp, Artificial Sequence
  Description of Artificial Sequence: Synthetic oligonucleotide
ggaccgcggcggacatggcag

SEQ ID NO: 354846 - DNA, 28 bp, Artificial Sequence
  Description of Artificial Sequence: Synthetic oligonucleotide
gccagctggagatggatccttccagatg

SEQ ID NO: 354847 - DNA, 22 bp, Artificial Sequence
  Description of Artificial Sequence: Synthetic oligonucleotide
gaccgcggcggacatggcagct

SEQ ID NO: 354848 - DNA, 29 bp, Artificial Sequence
  Description of Artificial Sequence: Synthetic oligonucleotide
ccagctggagatggatccttccagatgtg

SEQ ID NO: 354849 - DNA, 23 bp, Artificial Sequence
  Description of Artificial Sequence: Synthetic oligonucleotide
accgcggcggacatggcagctca

SEQ ID NO: 354850 - DNA, 29 bp, Artificial Sequence
  Description of Artificial Sequence: Synthetic oligonucleotide
cagctggagatggatccttccagatgtgg

SEQ ID NO: 354851 - DNA, 22 bp, Artificial Sequence
  Description of Artificial Sequence: Synthetic oligonucleotide
ccgcggcggacatggcagctca

SEQ ID NO: 354852 - DNA, 29 bp, Artificial Sequence
  Description of Artificial Sequence: Synthetic oligonucleotide
agctggagatggatccttccagatgtggg

SEQ ID NO: 354853 - DNA, 24 bp, Artificial Sequence
  Description of Artificial Sequence: Synthetic oligonucleotide
cgcggcggacatggcagctcagat

SEQ ID NO: 354854 - DNA, 28 bp, Artificial Sequence
  Description of Artificial Sequence: Synthetic oligonucleotide
gctggagatggatccttccagatgtggg

SEQ ID NO: 354855 - DNA, 25 bp, Artificial Sequence
  Description of Artificial Sequence: Synthetic oligonucleotide
gcggcggacatggcagctcagatca

SEQ ID NO: 354856 - DNA, 28 bp, Artificial Sequence
  Description of Artificial Sequence: Synthetic oligonucleotide
ctggagatggatccttccagatgtgggc

SEQ ID NO: 354857 - DNA, 25 bp, Artificial Sequence
  Description of Artificial Sequence: Synthetic oligonucleotide
cggcggacatggcagctcagatcac

SEQ ID NO: 354858 - DNA, 29 bp, Artificial Sequence
  Description of Artificial Sequence: Synthetic oligonucleotide
tggagatggatccttccagatgtgggcag

SEQ ID NO: 354859 - DNA, 27 bp, Artificial Sequence
  Description of Artificial Sequence: Synthetic oligonucleotide
ggcggacatggcagctcagatcaccaa

SEQ ID NO: 354860 - DNA, 28 bp, Artificial Sequence
  Description of Artificial Sequence: Synthetic oligonucleotide
ggagatggatccttccagatgtgggcag

SEQ ID NO: 354861 - DNA, 27 bp, Artificial Sequence
  Description of Artificial Sequence: Synthetic oligonucleotide
gcggacatggcagctcagatcaccaag

SEQ ID NO: 354862 - DNA, 28 bp, Artificial Sequence
  Description of Artificial Sequence: Synthetic oligonucleotide
gagatggatccttccagatgtgggcagc

SEQ ID NO: 354863 - DNA, 27 bp, Artificial Sequence
  Description of Artificial Sequence: Synthetic oligonucleotide
cggacatggcagctcagatcaccaagc

SEQ ID NO: 354864 - DNA, 29 bp, Artificial Sequence
  Description of Artificial Sequence: Synthetic oligonucleotide
agatggatccttccagatgtgggcagcag

SEQ ID NO: 354865 - DNA, 27 bp, Artificial Sequence
  Description of Artificial Sequence: Synthetic oligonucleotide
ggacatggcagctcagatcaccaagcg

SEQ ID NO: 354866 - DNA, 28 bp, Artificial Sequence
  Description of Artificial Sequence: Synthetic oligonucleotide
gatggatccttccagatgtgggcagcag

SEQ ID NO: 354867 - DNA, 27 bp, Artificial Sequence
  Description of Artificial Sequence: Synthetic oligonucleotide
gacatggcagctcagatcaccaagcgc

SEQ ID NO: 354868 - DNA, 29 bp, Artificial Sequence
  Description of Artificial Sequence: Synthetic oligonucleotide
atggatccttccagatgtgggcagcagtg

SEQ ID NO: 354869 - DNA, 29 bp, Artificial Sequence
  Description of Artificial Sequence: Synthetic oligonucleotide
acatggcagctcagatcaccaagcgcaag

SEQ ID NO: 354870 - DNA, 28 bp, Artificial Sequence
  Description of Artificial Sequence: Synthetic oligonucleotide
tggatccttccagatgtgggcagcagtg

SEQ ID NO: 354871 - DNA, 28 bp, Artificial Sequence
  Description of Artificial Sequence: Synthetic oligonucleotide
catggcagctcagatcaccaagcgcaag

SEQ ID NO: 354872 - DNA, 27 bp, Artificial Sequence
  Description of Artificial Sequence: Synthetic oligonucleotide
ggatccttccagatgtgggcagcagtg

SEQ ID NO: 354873 - DNA, 29 bp, Artificial Sequence
  Description of Artificial Sequence: Synthetic oligonucleotide
atggcagctcagatcaccaagcgcaagtg

SEQ ID NO: 354874 - DNA, 27 bp, Artificial Sequence
  Description of Artificial Sequence: Synthetic oligonucleotide
gatccttccagatgtgggcagcagtgg

SEQ ID NO: 354875 - DNA, 28 bp, Artificial Sequence
  Description of Artificial Sequence: Synthetic oligonucleotide
tggcagctcagatcaccaagcgcaagtg

SEQ ID NO: 354876 - DNA, 28 bp, Artificial Sequence
  Description of Artificial Sequence: Synthetic oligonucleotide
atccttccagatgtgggcagcagtggtg

SEQ ID NO: 354877 - DNA, 27 bp, Artificial Sequence
  Description of Artificial Sequence: Synthetic oligonucleotide
ggcagctcagatcaccaagcgcaagtg

SEQ ID NO: 354878 - DNA, 27 bp, Artificial Sequence
  Description of Artificial Sequence: Synthetic oligonucleotide
tccttccagatgtgggcagcagtggtg

SEQ ID NO: 354879 - DNA, 27 bp, Artificial Sequence
  Description of Artificial Sequence: Synthetic oligonucleotide
gcagctcagatcaccaagcgcaagtgg

SEQ ID NO: 354880 - DNA, 26 bp, Artificial Sequence
  Description of Artificial Sequence: Synthetic oligonucleotide
ccttccagatgtgggcagcagtggtg

SEQ ID NO: 354881 - DNA, 27 bp, Artificial Sequence
  Description of Artificial Sequence: Synthetic oligonucleotide
cagctcagatcaccaagcgcaagtggg

SEQ ID NO: 354882 - DNA, 27 bp, Artificial Sequence
  Description of Artificial Sequence: Synthetic oligonucleotide
cttccagatgtgggcagcagtggtggt

SEQ ID NO: 354883 - DNA, 28 bp, Artificial Sequence
  Description of Artificial Sequence: Synthetic oligonucleotide
agctcagatcaccaagcgcaagtgggag

SEQ ID NO: 354884 - DNA, 27 bp, Artificial Sequence
  Description of Artificial Sequence: Synthetic oligonucleotide
ttccagatgtgggcagcagtggtggtg

SEQ ID NO: 354885 - DNA, 27 bp, Artificial Sequence
  Description of Artificial Sequence: Synthetic oligonucleotide
gctcagatcaccaagcgcaagtgggag

SEQ ID NO: 354886 - DNA, 26 bp, Artificial Sequence
  Description of Artificial Sequence: Synthetic oligonucleotide
tccagatgtgggcagcagtggtggtg

SEQ ID NO: 354887 - DNA, 27 bp, Artificial Sequence
  Description of Artificial Sequence: Synthetic oligonucleotide
ctcagatcaccaagcgcaagtgggagg

SEQ ID NO: 354888 - DNA, 25 bp, Artificial Sequence
  Description of Artificial Sequence: Synthetic oligonucleotide
ccagatgtgggcagcagtggtggtg

SEQ ID NO: 354889 - DNA, 27 bp, Artificial Sequence
  Description of Artificial Sequence: Synthetic oligonucleotide
tcagatcaccaagcgcaagtgggaggc

SEQ ID NO: 354890 - DNA, 25 bp, Artificial Sequence
  Description of Artificial Sequence: Synthetic oligonucleotide
cagatgtgggcagcagtggtggtgg

SEQ ID NO: 354891 - DNA, 26 bp, Artificial Sequence
  Description of Artificial Sequence: Synthetic oligonucleotide
cagatcaccaagcgcaagtgggaggc

SEQ ID NO: 354892 - DNA, 27 bp, Artificial Sequence
  Description of Artificial Sequence: Synthetic oligonucleotide
agatgtgggcagcagtggtggtggctt

SEQ ID NO: 354893 - DNA, 26 bp, Artificial Sequence
  Description of Artificial Sequence: Synthetic oligonucleotide
agatcaccaagcgcaagtgggaggcg

SEQ ID NO: 354894 - DNA, 26 bp, Artificial Sequence
  Description of Artificial Sequence: Synthetic oligonucleotide
gatgtgggcagcagtggtggtggctt

SEQ ID NO: 354895 - DNA, 25 bp, Artificial Sequence
  Description of Artificial Sequence: Synthetic oligonucleotide
gatcaccaagcgcaagtgggaggcg

SEQ ID NO: 354896 - DNA, 27 bp, Artificial Sequence
  Description of Artificial Sequence: Synthetic oligonucleotide
atgtgggcagcagtggtggtggcttct

SEQ ID NO: 354897 - DNA, 26 bp, Artificial Sequence
  Description of Artificial Sequence: Synthetic oligonucleotide
atcaccaagcgcaagtgggaggcggt

SEQ ID NO: 354898 - DNA, 26 bp, Artificial Sequence
  Description of Artificial Sequence: Synthetic oligonucleotide
tgtgggcagcagtggtggtggcttct

SEQ ID NO: 354899 - DNA, 25 bp, Artificial Sequence
  Description of Artificial Sequence: Synthetic oligonucleotide
tcaccaagcgcaagtgggaggcggt

SEQ ID NO: 354900 - DNA, 25 bp, Artificial Sequence
  Description of Artificial Sequence: Synthetic oligonucleotide
gtgggcagcagtggtggtggcttct

SEQ ID NO: 354901 - DNA, 24 bp, Artificial Sequence
  Description of Artificial Sequence: Synthetic oligonucleotide
caccaagcgcaagtgggaggcggt

SEQ ID NO: 354902 - DNA, 25 bp, Artificial Sequence
  Description of Artificial Sequence: Synthetic oligonucleotide
tgggcagcagtggtggtggcttctg

SEQ ID NO: 354903 - DNA, 24 bp, Artificial Sequence
  Description of Artificial Sequence: Synthetic oligonucleotide
accaagcgcaagtgggaggcggtc

SEQ ID NO: 354904 - DNA, 24 bp, Artificial Sequence
  Description of Artificial Sequence: Synthetic oligonucleotide
gggcagcagtggtggtggcttctg

SEQ ID NO: 354905 - DNA, 23 bp, Artificial Sequence
  Description of Artificial Sequence: Synthetic oligonucleotide
ccaagcgcaagtgggaggcggtc

SEQ ID NO: 354906 - DNA, 25 bp, Artificial Sequence
  Description of Artificial Sequence: Synthetic oligonucleotide
ggcagcagtggtggtggcttctgga

SEQ ID NO: 354907 - DNA, 25 bp, Artificial Sequence
  Description of Artificial Sequence: Synthetic oligonucleotide
caagcgcaagtgggaggcggtccat

SEQ ID NO: 354908 - DNA, 27 bp, Artificial Sequence
  Description of Artificial Sequence: Synthetic oligonucleotide
gcagcagtggtggtggcttctggagta

SEQ ID NO: 354909 - DNA, 25 bp, Artificial Sequence
  Description of Artificial Sequence: Synthetic oligonucleotide
aagcgcaagtgggaggcggtccatg

SEQ ID NO: 354910 - DNA, 27 bp, Artificial Sequence
  Description of Artificial Sequence: Synthetic oligonucleotide
cagcagtggtggtggcttctggagtag

SEQ ID NO: 354911 - DNA, 24 bp, Artificial Sequence
  Description of Artificial Sequence: Synthetic oligonucleotide
agcgcaagtgggaggcggtccatg

SEQ ID NO: 354912 - DNA, 28 bp, Artificial Sequence
  Description of Artificial Sequence: Synthetic oligonucleotide
agcagtggtggtggcttctggagtagag

SEQ ID NO: 354913 - DNA, 23 bp, Artificial Sequence
  Description of Artificial Sequence: Synthetic oligonucleotide
gcgcaagtgggaggcggtccatg

SEQ ID NO: 354914 - DNA, 27 bp, Artificial Sequence
  Description of Artificial Sequence: Synthetic oligonucleotide
gcagtggtggtggcttctggagtagag

SEQ ID NO: 354915 - DNA, 23 bp, Artificial Sequence
  Description of Artificial Sequence: Synthetic oligonucleotide
cgcaagtgggaggcggtccatgc

SEQ ID NO: 354916 - DNA, 27 bp, Artificial Sequence
  Description of Artificial Sequence: Synthetic oligonucleotide
cagtggtggtggcttctggagtagagc

SEQ ID NO: 354917 - DNA, 23 bp, Artificial Sequence
  Description of Artificial Sequence: Synthetic oligonucleotide
gcaagtgggaggcggtccatgcg

SEQ ID NO: 354918 - DNA, 28 bp, Artificial Sequence
  Description of Artificial Sequence: Synthetic oligonucleotide
agtggtggtggcttctggagtagagcag

SEQ ID NO: 354919 - DNA, 23 bp, Artificial Sequence
  Description of Artificial Sequence: Synthetic oligonucleotide
caagtgggaggcggtccatgcgg

SEQ ID NO: 354920 - DNA, 27 bp, Artificial Sequence
  Description of Artificial Sequence: Synthetic oligonucleotide
gtggtggtggcttctggagtagagcag

SEQ ID NO: 354921 - DNA, 23 bp, Artificial Sequence
  Description of Artificial Sequence: Synthetic oligonucleotide
aagtgggaggcggtccatgcggc

SEQ ID NO: 354922 - DNA, 28 bp, Artificial Sequence
  Description of Artificial Sequence: Synthetic oligonucleotide
tggtggtggcttctggagtagagcagag

SEQ ID NO: 354923 - DNA, 22 bp, Artificial Sequence
  Description of Artificial Sequence: Synthetic oligonucleotide
agtgggaggcggtccatgcggc

SEQ ID NO: 354924 - DNA, 27 bp, Artificial Sequence
  Description of Artificial Sequence: Synthetic oligonucleotide
ggtggtggcttctggagtagagcagag

SEQ ID NO: 354925 - DNA, 21 bp, Artificial Sequence
  Description of Artificial Sequence: Synthetic oligonucleotide
gtgggaggcggtccatgcggc

SEQ ID NO: 354926 - DNA, 30 bp, Artificial Sequence; identical to SEQ ID NO: 232069
  Description of Artificial Sequence: Synthetic oligonucleotide

SEQ ID NO: 354927 - DNA, 21 bp, Artificial Sequence
  Description of Artificial Sequence: Synthetic oligonucleotide
tgggaggcggtccatgcggcg

SEQ ID NO: 354928 - DNA, 31 bp, Artificial Sequence; identical to SEQ ID NO: 232070
  Description of Artificial Sequence: Synthetic oligonucleotide

SEQ ID NO: 354929 - DNA, 20 bp, Artificial Sequence
  Description of Artificial Sequence: Synthetic oligonucleotide
gggaggcggtccatgcggcg

SEQ ID NO: 354930 - DNA, 30 bp, Artificial Sequence; identical to SEQ ID NO: 232071
  Description of Artificial Sequence: Synthetic oligonucleotide

SEQ ID NO: 354931 - DNA, 21 bp, Artificial Sequence
  Description of Artificial Sequence: Synthetic oligonucleotide
ggaggcggtccatgcggcgga

SEQ ID NO: 354932 - DNA, 32 bp, Artificial Sequence; identical to SEQ ID NO: 232072
  Description of Artificial Sequence: Synthetic oligonucleotide

SEQ ID NO: 354933 - DNA, 21 bp, Artificial Sequence
  Description of Artificial Sequence: Synthetic oligonucleotide
gaggcggtccatgcggcggag

SEQ ID NO: 354934 - DNA, 32 bp, Artificial Sequence; identical to SEQ ID NO: 232073
  Description of Artificial Sequence: Synthetic oligonucleotide

SEQ ID NO: 354935 - DNA, 22 bp, Artificial Sequence
  Description of Artificial Sequence: Synthetic oligonucleotide
aggcggtccatgcggcggagca

SEQ ID NO: 354936 - DNA, 31 bp, Artificial Sequence; identical to SEQ ID NO: 232074
  Description of Artificial Sequence: Synthetic oligonucleotide

SEQ ID NO: 354937 - DNA, 21 bp, Artificial Sequence
  Description of Artificial Sequence: Synthetic oligonucleotide
ggcggtccatgcggcggagca

SEQ ID NO: 354938 - DNA, 31 bp, Artificial Sequence; identical to SEQ ID NO: 232075
  Description of Artificial Sequence: Synthetic oligonucleotide

SEQ ID NO: 354939 - DNA, 21 bp, Artificial Sequence
  Description of Artificial Sequence: Synthetic oligonucleotide
gcggtccatgcggcggagcag

SEQ ID NO: 354940 - DNA, 33 bp, Artificial Sequence; identical to SEQ ID NO: 232076
  Description of Artificial Sequence: Synthetic oligonucleotide

SEQ ID NO: 354941 - DNA, 21 bp, Artificial Sequence
  Description of Artificial Sequence: Synthetic oligonucleotide
cggtccatgcggcggagcagc

SEQ ID NO: 354942 - DNA, 34 bp, Artificial Sequence; identical to SEQ ID NO: 232077
  Description of Artificial Sequence: Synthetic oligonucleotide

SEQ ID NO: 354943 - DNA, 21 bp, Artificial Sequence
  Description of Artificial Sequence: Synthetic oligonucleotide
ggtccatgcggcggagcagcg

SEQ ID NO: 354944 - DNA, 33 bp, Artificial Sequence; identical to SEQ ID NO: 232078
  Description of Artificial Sequence: Synthetic oligonucleotide

SEQ ID NO: 354945 - DNA, 22 bp, Artificial Sequence
  Description of Artificial Sequence: Synthetic oligonucleotide
gtccatgcggcggagcagcgga

SEQ ID NO: 354946 - DNA, 32 bp, Artificial Sequence; identical to SEQ ID NO: 232079
  Description of Artificial Sequence: Synthetic oligonucleotide

SEQ ID NO: 354947 - DNA, 23 bp, Artificial Sequence
  Description of Artificial Sequence: Synthetic oligonucleotide
tccatgcggcggagcagcggaga

SEQ ID NO: 354948 - DNA, 32 bp, Artificial Sequence; identical to SEQ ID NO: 232080
  Description of Artificial Sequence: Synthetic oligonucleotide

SEQ ID NO: 354949 - DNA, 22 bp, Artificial Sequence
  Description of Artificial Sequence: Synthetic oligonucleotide
ccatgcggcggagcagcggaga

SEQ ID NO: 354950 - DNA, 31 bp, Artificial Sequence; identical to SEQ ID NO: 232081
  Description of Artificial Sequence: Synthetic oligonucleotide

SEQ ID NO: 354951 - DNA, 23 bp, Artificial Sequence
  Description of Artificial Sequence: Synthetic oligonucleotide
catgcggcggagcagcggagagt

SEQ ID NO: 354952 - DNA, 32 bp, Artificial Sequence; identical to SEQ ID NO: 232082
  Description of Artificial Sequence: Synthetic oligonucleotide

SEQ ID NO: 354953 - DNA, 25 bp, Artificial Sequence
  Description of Artificial Sequence: Synthetic oligonucleotide
atgcggcggagcagcggagagtcta

SEQ ID NO: 354954 - DNA, 32 bp, Artificial Sequence; identical to SEQ ID NO: 232083
  Description of Artificial Sequence: Synthetic oligonucleotide

SEQ ID NO: 354955 - DNA, 24 bp, Artificial Sequence
  Description of Artificial Sequence: Synthetic oligonucleotide
tgcggcggagcagcggagagtcta

SEQ ID NO: 354956 - DNA, 31 bp, Artificial Sequence; identical to SEQ ID NO: 232084
  Description of Artificial Sequence: Synthetic oligonucleotide

SEQ ID NO: 354957 - DNA, 23 bp, Artificial Sequence
  Description of Artificial Sequence: Synthetic oligonucleotide
gcggcggagcagcggagagtcta

SEQ ID NO: 354958 - DNA, 33 bp, Artificial Sequence; identical to SEQ ID NO: 232085
  Description of Artificial Sequence: Synthetic oligonucleotide

SEQ ID NO: 354959 - DNA, 23 bp, Artificial Sequence
  Description of Artificial Sequence: Synthetic oligonucleotide
cggcggagcagcggagagtctac

SEQ ID NO: 354960 - DNA, 32 bp, Artificial Sequence; identical to SEQ ID NO: 232086
  Description of Artificial Sequence: Synthetic oligonucleotide

SEQ ID NO: 354961 - DNA, 24 bp, Artificial Sequence
  Description of Artificial Sequence: Synthetic oligonucleotide
ggcggagcagcggagagtctacct

SEQ ID NO: 354962 - DNA, 31 bp, Artificial Sequence; identical to SEQ ID NO: 232087
  Description of Artificial Sequence: Synthetic oligonucleotide

SEQ ID NO: 354963 - DNA, 24 bp, Artificial Sequence
  Description of Artificial Sequence: Synthetic oligonucleotide
gcggagcagcggagagtctacctg

SEQ ID NO: 354964 - DNA, 32 bp, Artificial Sequence; identical to SEQ ID NO: 232088
  Description of Artificial Sequence: Synthetic oligonucleotide

SEQ ID NO: 354965 - DNA, 25 bp, Artificial Sequence
  Description of Artificial Sequence: Synthetic oligonucleotide
cggagcagcggagagtctacctgga

SEQ ID NO: 354966 - DNA, 31 bp, Artificial Sequence; identical to SEQ ID NO: 232089
  Description of Artificial Sequence: Synthetic oligonucleotide

SEQ ID NO: 354967 - DNA, 25 bp, Artificial Sequence
  Description of Artificial Sequence: Synthetic oligonucleotide
ggagcagcggagagtctacctggag

SEQ ID NO: 354968 - DNA, 31 bp, Artificial Sequence; identical to SEQ ID NO: 232090
  Description of Artificial Sequence: Synthetic oligonucleotide

SEQ ID NO: 354969 - DNA, 25 bp, Artificial Sequence
  Description of Artificial Sequence: Synthetic oligonucleotide
gagcagcggagagtctacctggagg

SEQ ID NO: 354970 - DNA, 31 bp, Artificial Sequence; identical to SEQ ID NO: 232091
  Description of Artificial Sequence: Synthetic oligonucleotide

SEQ ID NO: 354971 - DNA, 25 bp, Artificial Sequence
  Description of Artificial Sequence: Synthetic oligonucleotide
agcagcggagagtctacctggaggg

SEQ ID NO: 354972 - DNA, 30 bp, Artificial Sequence; identical to SEQ ID NO: 232092
  Description of Artificial Sequence: Synthetic oligonucleotide

SEQ ID NO: 354973 - DNA, 24 bp, Artificial Sequence
  Description of Artificial Sequence: Synthetic oligonucleotide
gcagcggagagtctacctggaggg

SEQ ID NO: 354974 - DNA, 30 bp, Artificial Sequence; identical to SEQ ID NO: 232093
  Description of Artificial Sequence: Synthetic oligonucleotide

SEQ ID NO: 354975 - DNA, 24 bp, Artificial Sequence
  Description of Artificial Sequence: Synthetic oligonucleotide
cagcggagagtctacctggagggc

SEQ ID NO: 354976 - DNA, 29 bp, Artificial Sequence
  Description of Artificial Sequence: Synthetic oligonucleotide
gttacacatgcgatgtgcagcttgagggg

SEQ ID NO: 354977 - DNA, 24 bp, Artificial Sequence
  Description of Artificial Sequence: Synthetic oligonucleotide
agcggagagtctacctggagggcc

SEQ ID NO: 354978 - DNA, 29 bp, Artificial Sequence
  Description of Artificial Sequence: Synthetic oligonucleotide
ttacacatgcgatgtgcagcttgaggggc

SEQ ID NO: 354979 - DNA, 23 bp, Artificial Sequence
  Description of Artificial Sequence: Synthetic oligonucleotide
gcggagagtctacctggagggcc

SEQ ID NO: 354980 - DNA, 28 bp, Artificial Sequence
  Description of Artificial Sequence: Synthetic oligonucleotide
tacacatgcgatgtgcagcttgaggggc

SEQ ID NO: 354981 - DNA, 23 bp, Artificial Sequence
  Description of Artificial Sequence: Synthetic oligonucleotide
cggagagtctacctggagggccg

SEQ ID NO: 354982 - DNA, 27 bp, Artificial Sequence
  Description of Artificial Sequence: Synthetic oligonucleotide
acacatgcgatgtgcagcttgaggggc

SEQ ID NO: 354983 - DNA, 24 bp, Artificial Sequence
  Description of Artificial Sequence: Synthetic oligonucleotide
ggagagtctacctggagggccggt

SEQ ID NO: 354984 - DNA, 27 bp, Artificial Sequence
  Description of Artificial Sequence: Synthetic oligonucleotide
cacatgcgatgtgcagcttgaggggca

SEQ ID NO: 354985 - DNA, 24 bp, Artificial Sequence
  Description of Artificial Sequence: Synthetic oligonucleotide
gagagtctacctggagggccggtg

SEQ ID NO: 354986 - DNA, 27 bp, Artificial Sequence
  Description of Artificial Sequence: Synthetic oligonucleotide
acatgcgatgtgcagcttgaggggcag

SEQ ID NO: 354987 - DNA, 24 bp, Artificial Sequence
  Description of Artificial Sequence: Synthetic oligonucleotide
agagtctacctggagggccggtgc

SEQ ID NO: 354988 - DNA, 26 bp, Artificial Sequence
  Description of Artificial Sequence: Synthetic oligonucleotide
catgcgatgtgcagcttgaggggcag

SEQ ID NO: 354989 - DNA, 23 bp, Artificial Sequence
  Description of Artificial Sequence: Synthetic oligonucleotide
gagtctacctggagggccggtgc

SEQ ID NO: 354990 - DNA, 26 bp, Artificial Sequence
  Description of Artificial Sequence: Synthetic oligonucleotide
atgcgatgtgcagcttgaggggcagc

SEQ ID NO: 354991 - DNA, 24 bp, Artificial Sequence
  Description of Artificial Sequence: Synthetic oligonucleotide
agtctacctggagggccggtgcgt

SEQ ID NO: 354992 - DNA, 25 bp, Artificial Sequence
  Description of Artificial Sequence: Synthetic oligonucleotide
tgcgatgtgcagcttgaggggcagc

SEQ ID NO: 354993 - DNA, 23 bp, Artificial Sequence
  Description of Artificial Sequence: Synthetic oligonucleotide
gtctacctggagggccggtgcgt

SEQ ID NO: 354994 - DNA, 24 bp, Artificial Sequence
  Description of Artificial Sequence: Synthetic oligonucleotide
gcgatgtgcagcttgaggggcagc

SEQ ID NO: 354995 - DNA, 23 bp, Artificial Sequence
  Description of Artificial Sequence: Synthetic oligonucleotide
tctacctggagggccggtgcgtg

SEQ ID NO: 354996 - DNA, 24 bp, Artificial Sequence
  Description of Artificial Sequence: Synthetic oligonucleotide
cgatgtgcagcttgaggggcagcc

SEQ ID NO: 354997 - DNA, 22 bp, Artificial Sequence
  Description of Artificial Sequence: Synthetic oligonucleotide
ctacctggagggccggtgcgtg

SEQ ID NO: 354998 - DNA, 26 bp, Artificial Sequence
  Description of Artificial Sequence: Synthetic oligonucleotide
gatgtgcagcttgaggggcagccgaa

SEQ ID NO: 354999 - DNA, 23 bp, Artificial Sequence
  Description of Artificial Sequence: Synthetic oligonucleotide
tacctggagggccggtgcgtgga

SEQ ID NO: 355000 - DNA, 26 bp, Artificial Sequence
  Description of Artificial Sequence: Synthetic oligonucleotide
atgtgcagcttgaggggcagccgaag

SEQ ID NO: 355001 - DNA, 22 bp, Artificial Sequence
  Description of Artificial Sequence: Synthetic oligonucleotide
acctggagggccggtgcgtgga

SEQ ID NO: 355002 - DNA, 25 bp, Artificial Sequence
  Description of Artificial Sequence: Synthetic oligonucleotide
tgtgcagcttgaggggcagccgaag

SEQ ID NO: 355003 - DNA, 21 bp, Artificial Sequence
  Description of Artificial Sequence: Synthetic oligonucleotide
cctggagggccggtgcgtgga

SEQ ID NO: 355004 - DNA, 24 bp, Artificial Sequence
  Description of Artificial Sequence: Synthetic oligonucleotide
gtgcagcttgaggggcagccgaag

SEQ ID NO: 355005 - DNA, 21 bp, Artificial Sequence
  Description of Artificial Sequence: Synthetic oligonucleotide
ctggagggccggtgcgtggac

SEQ ID NO: 355006 - DNA, 24 bp, Artificial Sequence
  Description of Artificial Sequence: Synthetic oligonucleotide
tgcagcttgaggggcagccgaagc

SEQ ID NO: 355007 - DNA, 21 bp, Artificial Sequence
  Description of Artificial Sequence: Synthetic oligonucleotide
tggagggccggtgcgtggacg

SEQ ID NO: 355008 - DNA, 23 bp, Artificial Sequence
  Description of Artificial Sequence: Synthetic oligonucleotide
gcagcttgaggggcagccgaagc

SEQ ID NO: 355009 - DNA, 20 bp, Artificial Sequence
  Description of Artificial Sequence: Synthetic oligonucleotide
ggagggccggtgcgtggacg

SEQ ID NO: 355010 - DNA, 23 bp, Artificial Sequence
  Description of Artificial Sequence: Synthetic oligonucleotide
cagcttgaggggcagccgaagcc

SEQ ID NO: 355011 - DNA, 20 bp, Artificial Sequence
  Description of Artificial Sequence: Synthetic oligonucleotide
gagggccggtgcgtggacgg

SEQ ID NO: 355012 - DNA, 23 bp, Artificial Sequence
  Description of Artificial Sequence: Synthetic oligonucleotide
agcttgaggggcagccgaagccg

SEQ ID NO: 355013 - DNA, 20 bp, Artificial Sequence
  Description of Artificial Sequence: Synthetic oligonucleotide
agggccggtgcgtggacggg

SEQ ID NO: 355014 - DNA, 22 bp, Artificial Sequence
  Description of Artificial Sequence: Synthetic oligonucleotide
gcttgaggggcagccgaagccg

SEQ ID NO: 355015 - DNA, 20 bp, Artificial Sequence
  Description of Artificial Sequence: Synthetic oligonucleotide
gggccggtgcgtggacgggt

SEQ ID NO: 355016 - DNA, 23 bp, Artificial Sequence
  Description of Artificial Sequence: Synthetic oligonucleotide
cttgaggggcagccgaagccgct

SEQ ID NO: 355017 - DNA, 20 bp, Artificial Sequence
  Description of Artificial Sequence: Synthetic oligonucleotide
ggccggtgcgtggacgggct

SEQ ID NO: 355018 - DNA, 24 bp, Artificial Sequence
  Description of Artificial Sequence: Synthetic oligonucleotide
ttgaggggcagccgaagccgctca

SEQ ID NO: 355019 - DNA, 20 bp, Artificial Sequence
  Description of Artificial Sequence: Synthetic oligonucleotide
gccggtgcgtggacgggctc

SEQ ID NO: 355020 - DNA, 23 bp, Artificial Sequence
  Description of Artificial Sequence: Synthetic oligonucleotide
tgaggggcagccgaagccgctca

SEQ ID NO: 355021 - DNA, 20 bp, Artificial Sequence
  Description of Artificial Sequence: Synthetic oligonucleotide
ccggtgcgtggacgggctcc

SEQ ID NO: 355022 - DNA, 22 bp, Artificial Sequence
  Description of Artificial Sequence: Synthetic oligonucleotide
gaggggcagccgaagccgctca

SEQ ID NO: 355023 - DNA, 20 bp, Artificial Sequence
  Description of Artificial Sequence: Synthetic oligonucleotide
cggtgcgtggacgggctccg

SEQ ID NO: 355024 - DNA, 22 bp, Artificial Sequence
  Description of Artificial Sequence: Synthetic oligonucleotide
aggggcagccgaagccgctcac

SEQ ID NO: 355025 - DNA, 21 bp, Artificial Sequence
  Description of Artificial Sequence: Synthetic oligonucleotide
ggtgcgtggacgggctccgca

SEQ ID NO: 355026 - DNA, 21 bp, Artificial Sequence
  Description of Artificial Sequence: Synthetic oligonucleotide
ggggcagccgaagccgctcac

SEQ ID NO: 355027 - DNA, 24 bp, Artificial Sequence
  Description of Artificial Sequence: Synthetic oligonucleotide
gtgcgtggacgggctccgcagata

SEQ ID NO: 355028 - DNA, 21 bp, Artificial Sequence
  Description of Artificial Sequence: Synthetic oligonucleotide
gggcagccgaagccgctcacc

SEQ ID NO: 355029 - DNA, 24 bp, Artificial Sequence
  Description of Artificial Sequence: Synthetic oligonucleotide
tgcgtggacgggctccgcagatac

SEQ ID NO: 355030 - DNA, 22 bp, Artificial Sequence
  Description of Artificial Sequence: Synthetic oligonucleotide
ggcagccgaagccgctcaccct

SEQ ID NO: 355031 - DNA, 23 bp, Artificial Sequence
  Description of Artificial Sequence: Synthetic oligonucleotide
gcgtggacgggctccgcagatac

SEQ ID NO: 355032 - DNA, 23 bp, Artificial Sequence
  Description of Artificial Sequence: Synthetic oligonucleotide
gcagccgaagccgctcaccctga

SEQ ID NO: 355033 - DNA, 24 bp, Artificial Sequence
  Description of Artificial Sequence: Synthetic oligonucleotide
cgtggacgggctccgcagatacct

SEQ ID NO: 355034 - DNA, 25 bp, Artificial Sequence
  Description of Artificial Sequence: Synthetic oligonucleotide
cagccgaagccgctcaccctgacat

SEQ ID NO: 355035 - DNA, 24 bp, Artificial Sequence
  Description of Artificial Sequence: Synthetic oligonucleotide
gtggacgggctccgcagatacctg

SEQ ID NO: 355036 - DNA, 25 bp, Artificial Sequence
  Description of Artificial Sequence: Synthetic oligonucleotide
agccgaagccgctcaccctgacatg

SEQ ID NO: 355037 - DNA, 25 bp, Artificial Sequence
  Description of Artificial Sequence: Synthetic oligonucleotide
tggacgggctccgcagatacctgga

SEQ ID NO: 355038 - DNA, 24 bp, Artificial Sequence
  Description of Artificial Sequence: Synthetic oligonucleotide
gccgaagccgctcaccctgacatg

SEQ ID NO: 355039 - DNA, 24 bp, Artificial Sequence
  Description of Artificial Sequence: Synthetic oligonucleotide
ggacgggctccgcagatacctgga

SEQ ID NO: 355040 - DNA, 24 bp, Artificial Sequence
  Description of Artificial Sequence: Synthetic oligonucleotide
ccgaagccgctcaccctgacatgg

SEQ ID NO: 355041 - DNA, 26 bp, Artificial Sequence
  Description of Artificial Sequence: Synthetic oligonucleotide
gacgggctccgcagatacctggagaa

SEQ ID NO: 355042 - DNA, 25 bp, Artificial Sequence
  Description of Artificial Sequence: Synthetic oligonucleotide
cgaagccgctcaccctgacatggga

SEQ ID NO: 355043 - DNA, 26 bp, Artificial Sequence
  Description of Artificial Sequence: Synthetic oligonucleotide
acgggctccgcagatacctggagaac

SEQ ID NO: 355044 - DNA, 25 bp, Artificial Sequence
  Description of Artificial Sequence: Synthetic oligonucleotide
gaagccgctcaccctgacatgggag

SEQ ID NO: 355045 - DNA, 25 bp, Artificial Sequence
  Description of Artificial Sequence: Synthetic oligonucleotide
cgggctccgcagatacctggagaac

SEQ ID NO: 355046 - DNA, 25 bp, Artificial Sequence
  Description of Artificial Sequence: Synthetic oligonucleotide
aagccgctcaccctgacatgggagg

SEQ ID NO: 355047 - DNA, 25 bp, Artificial Sequence
  Description of Artificial Sequence: Synthetic oligonucleotide
gggctccgcagatacctggagaacg

SEQ ID NO: 355048 - DNA, 24 bp, Artificial Sequence
  Description of Artificial Sequence: Synthetic oligonucleotide
agccgctcaccctgacatgggagg

SEQ ID NO: 355049 - DNA, 25 bp, Artificial Sequence
  Description of Artificial Sequence: Synthetic oligonucleotide
ggctccgcagatacctggagaacgg

SEQ ID NO: 355050 - DNA, 23 bp, Artificial Sequence
  Description of Artificial Sequence: Synthetic oligonucleotide
gccgctcaccctgacatgggagg

SEQ ID NO: 355051 - DNA, 27 bp, Artificial Sequence
  Description of Artificial Sequence: Synthetic oligonucleotide
gctccgcagatacctggagaacgggaa

SEQ ID NO: 355052 - DNA, 23 bp, Artificial Sequence
  Description of Artificial Sequence: Synthetic oligonucleotide
ccgctcaccctgacatgggaggc

SEQ ID NO: 355053 - DNA, 27 bp, Artificial Sequence
  Description of Artificial Sequence: Synthetic oligonucleotide
ctccgcagatacctggagaacgggaag

SEQ ID NO: 355054 - DNA, 24 bp, Artificial Sequence
  Description of Artificial Sequence: Synthetic oligonucleotide
cgctcaccctgacatgggaggcgt

SEQ ID NO: 355055 - DNA, 27 bp, Artificial Sequence
  Description of Artificial Sequence: Synthetic oligonucleotide
tccgcagatacctggagaacgggaagg

SEQ ID NO: 355056 - DNA, 26 bp, Artificial Sequence
  Description of Artificial Sequence: Synthetic oligonucleotide
gctcaccctgacatgggaggcgtctt

SEQ ID NO: 355057 - DNA, 27 bp, Artificial Sequence
  Description of Artificial Sequence: Synthetic oligonucleotide
ccgcagatacctggagaacgggaagga

SEQ ID NO: 355058 - DNA, 26 bp, Artificial Sequence
  Description of Artificial Sequence: Synthetic oligonucleotide
ctcaccctgacatgggaggcgtcttc

SEQ ID NO: 355059 - DNA, 27 bp, Artificial Sequence
  Description of Artificial Sequence: Synthetic oligonucleotide
cgcagatacctggagaacgggaaggag

SEQ ID NO: 355060 - DNA, 26 bp, Artificial Sequence
  Description of Artificial Sequence: Synthetic oligonucleotide
tcaccctgacatgggaggcgtcttcc

SEQ ID NO: 355061 - DNA, 28 bp, Artificial Sequence
  Description of Artificial Sequence: Synthetic oligonucleotide
gcagatacctggagaacgggaaggagac

SEQ ID NO: 355062 - DNA, 25 bp, Artificial Sequence
  Description of Artificial Sequence: Synthetic oligonucleotide
caccctgacatgggaggcgtcttcc

SEQ ID NO: 355063 - DNA, 28 bp, Artificial Sequence
  Description of Artificial Sequence: Synthetic oligonucleotide
cagatacctggagaacgggaaggagacg

SEQ ID NO: 355064 - DNA, 26 bp, Artificial Sequence
  Description of Artificial Sequence: Synthetic oligonucleotide
accctgacatgggaggcgtcttccca

SEQ ID NO: 355065 - DNA, 28 bp, Artificial Sequence
  Description of Artificial Sequence: Synthetic oligonucleotide
agatacctggagaacgggaaggagacgc

SEQ ID NO: 355066 - DNA, 25 bp, Artificial Sequence
  Description of Artificial Sequence: Synthetic oligonucleotide
ccctgacatgggaggcgtcttccca

SEQ ID NO: 355067 - DNA, 27 bp, Artificial Sequence
  Description of Artificial Sequence: Synthetic oligonucleotide
gatacctggagaacgggaaggagacgc

SEQ ID NO: 355068 - DNA, 25 bp, Artificial Sequence
  Description of Artificial Sequence: Synthetic oligonucleotide
cctgacatgggaggcgtcttcccag

SEQ ID NO: 355069 - DNA, 28 bp, Artificial Sequence
  Description of Artificial Sequence: Synthetic oligonucleotide
atacctggagaacgggaaggagacgctg

SEQ ID NO: 355070 - DNA, 25 bp, Artificial Sequence
  Description of Artificial Sequence: Synthetic oligonucleotide
ctgacatgggaggcgtcttcccagc

SEQ ID NO: 355071 - DNA, 27 bp, Artificial Sequence
  Description of Artificial Sequence: Synthetic oligonucleotide
tacctggagaacgggaaggagacgctg

SEQ ID NO: 355072 - DNA, 25 bp, Artificial Sequence
  Description of Artificial Sequence: Synthetic oligonucleotide
tgacatgggaggcgtcttcccagcg

SEQ ID NO: 355073 - DNA, 26 bp, Artificial Sequence
  Description of Artificial Sequence: Synthetic oligonucleotide
acctggagaacgggaaggagacgctg

SEQ ID NO: 355074 - DNA, 24 bp, Artificial Sequence
  Description of Artificial Sequence: Synthetic oligonucleotide
gacatgggaggcgtcttcccagcg

SEQ ID NO: 355075 - DNA, 25 bp, Artificial Sequence
  Description of Artificial Sequence: Synthetic oligonucleotide
cctggagaacgggaaggagacgctg

SEQ ID NO: 355076 - DNA, 25 bp, Artificial Sequence
  Description of Artificial Sequence: Synthetic oligonucleotide
acatgggaggcgtcttcccagcgca

SEQ ID NO: 355077 - DNA, 26 bp, Artificial Sequence
  Description of Artificial Sequence: Synthetic oligonucleotide
ctggagaacgggaaggagacgctgca

SEQ ID NO: 355078 - DNA, 24 bp, Artificial Sequence
  Description of Artificial Sequence: Synthetic oligonucleotide
catgggaggcgtcttcccagcgca

SEQ ID NO: 355079 - DNA, 26 bp, Artificial Sequence
  Description of Artificial Sequence: Synthetic oligonucleotide
tggagaacgggaaggagacgctgcag

SEQ ID NO: 355080 - DNA, 24 bp, Artificial Sequence
  Description of Artificial Sequence: Synthetic oligonucleotide
atgggaggcgtcttcccagcgcac

SEQ ID NO: 355081 - DNA, 25 bp, Artificial Sequence
  Description of Artificial Sequence: Synthetic oligonucleotide
ggagaacgggaaggagacgctgcag

SEQ ID NO: 355082 - DNA, 23 bp, Artificial Sequence
  Description of Artificial Sequence: Synthetic oligonucleotide
tgggaggcgtcttcccagcgcac

SEQ ID NO: 355083 - DNA, 25 bp, Artificial Sequence
  Description of Artificial Sequence: Synthetic oligonucleotide
gagaacgggaaggagacgctgcagc

SEQ ID NO: 355084 - DNA, 22 bp, Artificial Sequence
  Description of Artificial Sequence: Synthetic oligonucleotide
gggaggcgtcttcccagcgcac

SEQ ID NO: 355085 - DNA, 25 bp, Artificial Sequence
  Description of Artificial Sequence: Synthetic oligonucleotide
agaacgggaaggagacgctgcagcg

SEQ ID NO: 355086 - DNA, 24 bp, Artificial Sequence
  Description of Artificial Sequence: Synthetic oligonucleotide
ggaggcgtcttcccagcgcaccat

SEQ ID NO: 355087 - DNA, 24 bp, Artificial Sequence
  Description of Artificial Sequence: Synthetic oligonucleotide
gaacgggaaggagacgctgcagcg

SEQ ID NO: 355088 - DNA, 24 bp, Artificial Sequence
  Description of Artificial Sequence: Synthetic oligonucleotide
gaggcgtcttcccagcgcaccatc

SEQ ID NO: 355089 - DNA, 25 bp, Artificial Sequence
  Description of Artificial Sequence: Synthetic oligonucleotide
aacgggaaggagacgctgcagcgca

SEQ ID NO: 355090 - DNA, 24 bp, Artificial Sequence
  Description of Artificial Sequence: Synthetic oligonucleotide
aggcgtcttcccagcgcaccatcc

SEQ ID NO: 355091 - DNA, 24 bp, Artificial Sequence
  Description of Artificial Sequence: Synthetic oligonucleotide
acgggaaggagacgctgcagcgca

SEQ ID NO: 355092 - DNA, 23 bp, Artificial Sequence
  Description of Artificial Sequence: Synthetic oligonucleotide
ggcgtcttcccagcgcaccatcc

SEQ ID NO: 355093 - DNA, 23 bp, Artificial Sequence
  Description of Artificial Sequence: Synthetic oligonucleotide
cgggaaggagacgctgcagcgca

SEQ ID NO: 355094 - DNA, 23 bp, Artificial Sequence
  Description of Artificial Sequence: Synthetic oligonucleotide
gcgtcttcccagcgcaccatccc

SEQ ID NO: 355095 - DNA, 23 bp, Artificial Sequence
  Description of Artificial Sequence: Synthetic oligonucleotide
gggaaggagacgctgcagcgcac

SEQ ID NO: 355096 - DNA, 25 bp, Artificial Sequence
  Description of Artificial Sequence: Synthetic oligonucleotide
cgtcttcccagcgcaccatcccgat

SEQ ID NO: 355097 - DNA, 23 bp, Artificial Sequence
  Description of Artificial Sequence: Synthetic oligonucleotide
ggaaggagacgctgcagcgcacg

SEQ ID NO: 355098 - DNA, 25 bp, Artificial Sequence
  Description of Artificial Sequence: Synthetic oligonucleotide
gtcttcccagcgcaccatcccgatc

SEQ ID NO: 355099 - DNA, 24 bp, Artificial Sequence
  Description of Artificial Sequence: Synthetic oligonucleotide
gaaggagacgctgcagcgcacgga

SEQ ID NO: 355100 - DNA, 26 bp, Artificial Sequence
  Description of Artificial Sequence: Synthetic oligonucleotide
tcttcccagcgcaccatcccgatcgt

SEQ ID NO: 355101 - DNA, 24 bp, Artificial Sequence
  Description of Artificial Sequence: Synthetic oligonucleotide
aaggagacgctgcagcgcacggac

SEQ ID NO: 355102 - DNA, 25 bp, Artificial Sequence
  Description of Artificial Sequence: Synthetic oligonucleotide
cttcccagcgcaccatcccgatcgt

SEQ ID NO: 355103 - DNA, 23 bp, Artificial Sequence
  Description of Artificial Sequence: Synthetic oligonucleotide
aggagacgctgcagcgcacggac

SEQ ID NO: 355104 - DNA, 25 bp, Artificial Sequence
  Description of Artificial Sequence: Synthetic oligonucleotide
ttcccagcgcaccatcccgatcgtg

SEQ ID NO: 355105 - DNA, 22 bp, Artificial Sequence
  Description of Artificial Sequence: Synthetic oligonucleotide
ggagacgctgcagcgcacggac

SEQ ID NO: 355106 - DNA, 24 bp, Artificial Sequence
  Description of Artificial Sequence: Synthetic oligonucleotide
tcccagcgcaccatcccgatcgtg

SEQ ID NO: 355107 - DNA, 22 bp, Artificial Sequence
  Description of Artificial Sequence: Synthetic oligonucleotide
gagacgctgcagcgcacggacc

SEQ ID NO: 355108 - DNA, 23 bp, Artificial Sequence
  Description of Artificial Sequence: Synthetic oligonucleotide
cccagcgcaccatcccgatcgtg

SEQ ID NO: 355109 - DNA, 22 bp, Artificial Sequence
  Description of Artificial Sequence: Synthetic oligonucleotide
agacgctgcagcgcacggaccc

SEQ ID NO: 355110 - DNA, 23 bp, Artificial Sequence
  Description of Artificial Sequence: Synthetic oligonucleotide
ccagcgcaccatcccgatcgtgg

SEQ ID NO: 355111 - DNA, 21 bp, Artificial Sequence
  Description of Artificial Sequence: Synthetic oligonucleotide
gacgctgcagcgcacggaccc

SEQ ID NO: 355112 - DNA, 23 bp, Artificial Sequence
  Description of Artificial Sequence: Synthetic oligonucleotide
cagcgcaccatcccgatcgtggg

SEQ ID NO: 355113 - DNA, 21 bp, Artificial Sequence
  Description of Artificial Sequence: Synthetic oligonucleotide
acgctgcagcgcacggacccc

SEQ ID NO: 355114 - DNA, 25 bp, Artificial Sequence
  Description of Artificial Sequence: Synthetic oligonucleotide
agcgcaccatcccgatcgtgggctt

SEQ ID NO: 355115 - DNA, 20 bp, Artificial Sequence
  Description of Artificial Sequence: Synthetic oligonucleotide
cgctgcagcgcacggacccc

SEQ ID NO: 355116 - DNA, 24 bp, Artificial Sequence
  Description of Artificial Sequence: Synthetic oligonucleotide
gcgcaccatcccgatcgtgggctt

SEQ ID NO: 355117 - DNA, 20 bp, Artificial Sequence
  Description of Artificial Sequence: Synthetic oligonucleotide
gctgcagcgcacggaccccc

SEQ ID NO: 355118 - DNA, 24 bp, Artificial Sequence
  Description of Artificial Sequence: Synthetic oligonucleotide
cgcaccatcccgatcgtgggcttc

SEQ ID NO: 355119 - DNA, 20 bp, Artificial Sequence
  Description of Artificial Sequence: Synthetic oligonucleotide
ctgcagcgcacggacccccc

SEQ ID NO: 355120 - DNA, 26 bp, Artificial Sequence
  Description of Artificial Sequence: Synthetic oligonucleotide
gcaccatcccgatcgtgggcttcgtt

SEQ ID NO: 355121 - DNA, 22 bp, Artificial Sequence
  Description of Artificial Sequence: Synthetic oligonucleotide
tgcagcgcacggacccccccaa

SEQ ID NO: 355122 - DNA, 26 bp, Artificial Sequence
  Description of Artificial Sequence: Synthetic oligonucleotide
caccatcccgatcgtgggcttcgttg

SEQ ID NO: 355123 - DNA, 21 bp, Artificial Sequence
  Description of Artificial Sequence: Synthetic oligonucleotide
gcagcgcacggacccccccaa

SEQ ID NO: 355124 - DNA, 27 bp, Artificial Sequence
  Description of Artificial Sequence: Synthetic oligonucleotide
accatcccgatcgtgggcttcgttgct

SEQ ID NO: 355125 - DNA, 22 bp, Artificial Sequence
  Description of Artificial Sequence: Synthetic oligonucleotide
cagcgcacggacccccccaaga

SEQ ID NO: 355126 - DNA, 26 bp, Artificial Sequence
  Description of Artificial Sequence: Synthetic oligonucleotide
ccatcccgatcgtgggcttcgttgct

SEQ ID NO: 355127 - DNA, 23 bp, Artificial Sequence
  Description of Artificial Sequence: Synthetic oligonucleotide
agcgcacggacccccccaagaca

SEQ ID NO: 355128 - DNA, 26 bp, Artificial Sequence
  Description of Artificial Sequence: Synthetic oligonucleotide
catcccgatcgtgggcttcgttgctc

SEQ ID NO: 355129 - DNA, 22 bp, Artificial Sequence
  Description of Artificial Sequence: Synthetic oligonucleotide
gcgcacggacccccccaagaca

SEQ ID NO: 355130 - DNA, 26 bp, Artificial Sequence
  Description of Artificial Sequence: Synthetic oligonucleotide
atcccgatcgtgggcttcgttgctcg

SEQ ID NO: 355131 - DNA, 26 bp, Artificial Sequence
  Description of Artificial Sequence: Synthetic oligonucleotide
cgcacggacccccccaagacacatat

SEQ ID NO: 355132 - DNA, 25 bp, Artificial Sequence
  Description of Artificial Sequence: Synthetic oligonucleotide
tcccgatcgtgggcttcgttgctcg

SEQ ID NO: 355133 - DNA, 27 bp, Artificial Sequence
  Description of Artificial Sequence: Synthetic oligonucleotide
gcacggacccccccaagacacatatga

SEQ ID NO: 355134 - DNA, 24 bp, Artificial Sequence
  Description of Artificial Sequence: Synthetic oligonucleotide
cccgatcgtgggcttcgttgctcg

SEQ ID NO: 355135 - DNA, 27 bp, Artificial Sequence
  Description of Artificial Sequence: Synthetic oligonucleotide
cacggacccccccaagacacatatgac

SEQ ID NO: 355136 - DNA, 24 bp, Artificial Sequence
  Description of Artificial Sequence: Synthetic oligonucleotide
ccgatcgtgggcttcgttgctcgc

SEQ ID NO: 355137 - DNA, 27 bp, Artificial Sequence
  Description of Artificial Sequence: Synthetic oligonucleotide
acggacccccccaagacacatatgacc

SEQ ID NO: 355138 - DNA, 25 bp, Artificial Sequence
  Description of Artificial Sequence: Synthetic oligonucleotide
cgatcgtgggcttcgttgctcgcct

SEQ ID NO: 355139 - DNA, 26 bp, Artificial Sequence
  Description of Artificial Sequence: Synthetic oligonucleotide
cggacccccccaagacacatatgacc

SEQ ID NO: 355140 - DNA, 25 bp, Artificial Sequence
  Description of Artificial Sequence: Synthetic oligonucleotide
gatcgtgggcttcgttgctcgcctg

SEQ ID NO: 355141 - DNA, 27 bp, Artificial Sequence
  Description of Artificial Sequence: Synthetic oligonucleotide
ggacccccccaagacacatatgaccca

SEQ ID NO: 355142 - DNA, 25 bp, Artificial Sequence
  Description of Artificial Sequence: Synthetic oligonucleotide
atcgtgggcttcgttgctcgcctgg

SEQ ID NO: 355143 - DNA, 27 bp, Artificial Sequence
  Description of Artificial Sequence: Synthetic oligonucleotide
gacccccccaagacacatatgacccac

SEQ ID NO: 355144 - DNA, 24 bp, Artificial Sequence
  Description of Artificial Sequence: Synthetic oligonucleotide
tcgtgggcttcgttgctcgcctgg

SEQ ID NO: 355145 - DNA, 27 bp, Artificial Sequence
  Description of Artificial Sequence: Synthetic oligonucleotide
acccccccaagacacatatgacccacc

SEQ ID NO: 355146 - DNA, 23 bp, Artificial Sequence
  Description of Artificial Sequence: Synthetic oligonucleotide
cgtgggcttcgttgctcgcctgg

SEQ ID NO: 355147 - DNA, 27 bp, Artificial Sequence
  Description of Artificial Sequence: Synthetic oligonucleotide
cccccccaagacacatatgacccacca

SEQ ID NO: 355148 - DNA, 24 bp, Artificial Sequence
  Description of Artificial Sequence: Synthetic oligonucleotide
gtgggcttcgttgctcgcctggct

SEQ ID NO: 355149 - DNA, 27 bp, Artificial Sequence
  Description of Artificial Sequence: Synthetic oligonucleotide
ccccccaagacacatatgacccaccac

SEQ ID NO: 355150 - DNA, 25 bp, Artificial Sequence
  Description of Artificial Sequence: Synthetic oligonucleotide
tgggcttcgttgctcgcctggctga

SEQ ID NO: 355151 - DNA, 27 bp, Artificial Sequence
  Description of Artificial Sequence: Synthetic oligonucleotide
cccccaagacacatatgacccaccacc

SEQ ID NO: 355152 - DNA, 24 bp, Artificial Sequence
  Description of Artificial Sequence: Synthetic oligonucleotide
gggcttcgttgctcgcctggctga

SEQ ID NO: 355153 - DNA, 27 bp, Artificial Sequence
  Description of Artificial Sequence: Synthetic oligonucleotide
ccccaagacacatatgacccaccaccc

SEQ ID NO: 355154 - DNA, 24 bp, Artificial Sequence
  Description of Artificial Sequence: Synthetic oligonucleotide
ggcttcgttgctcgcctggctgac

SEQ ID NO: 355155 - DNA, 27 bp, Artificial Sequence
  Description of Artificial Sequence: Synthetic oligonucleotide
cccaagacacatatgacccaccacccc

SEQ ID NO: 355156 - DNA, 26 bp, Artificial Sequence
  Description of Artificial Sequence: Synthetic oligonucleotide
gcttcgttgctcgcctggctgaccta

SEQ ID NO: 355157 - DNA, 29 bp, Artificial Sequence
  Description of Artificial Sequence: Synthetic oligonucleotide
ccaagacacatatgacccaccaccccatc

SEQ ID NO: 355158 - DNA, 26 bp, Artificial Sequence
  Description of Artificial Sequence: Synthetic oligonucleotide
cttcgttgctcgcctggctgacctag

SEQ ID NO: 355159 - DNA, 30 bp, Artificial Sequence; identical to SEQ ID NO: 630
  Description of Artificial Sequence: Synthetic oligonucleotide

SEQ ID NO: 355160 - DNA, 27 bp, Artificial Sequence
  Description of Artificial Sequence: Synthetic oligonucleotide
ttcgttgctcgcctggctgacctagca

SEQ ID NO: 355161 - DNA, 31 bp, Artificial Sequence; identical to SEQ ID NO: 631
  Description of Artificial Sequence: Synthetic oligonucleotide

SEQ ID NO: 355162 - DNA, 26 bp, Artificial Sequence
  Description of Artificial Sequence: Synthetic oligonucleotide
tcgttgctcgcctggctgacctagca

SEQ ID NO: 355163 - DNA, 30 bp, Artificial Sequence; identical to SEQ ID NO: 632
  Description of Artificial Sequence: Synthetic oligonucleotide

SEQ ID NO: 355164 - DNA, 25 bp, Artificial Sequence
  Description of Artificial Sequence: Synthetic oligonucleotide
cgttgctcgcctggctgacctagca

SEQ ID NO: 355165 - DNA, 29 bp, Artificial Sequence
  Description of Artificial Sequence: Synthetic oligonucleotide
gacacatatgacccaccaccccatctctg

SEQ ID NO: 355166 - DNA, 27 bp, Artificial Sequence
  Description of Artificial Sequence: Synthetic oligonucleotide
gttgctcgcctggctgacctagcagtt

SEQ ID NO: 355167 - DNA, 30 bp, Artificial Sequence; identical to SEQ ID NO: 634
  Description of Artificial Sequence: Synthetic oligonucleotide

SEQ ID NO: 355168 - DNA, 27 bp, Artificial Sequence
  Description of Artificial Sequence: Synthetic oligonucleotide
ttgctcgcctggctgacctagcagttg

SEQ ID NO: 355169 - DNA, 29 bp, Artificial Sequence
  Description of Artificial Sequence: Synthetic oligonucleotide
cacatatgacccaccaccccatctctgac

SEQ ID NO: 355170 - DNA, 27 bp, Artificial Sequence
  Description of Artificial Sequence: Synthetic oligonucleotide
tgctcgcctggctgacctagcagttga

SEQ ID NO: 355171 - DNA, 29 bp, Artificial Sequence
  Description of Artificial Sequence: Synthetic oligonucleotide
acatatgacccaccaccccatctctgacc

SEQ ID NO: 355172 - DNA, 26 bp, Artificial Sequence
  Description of Artificial Sequence: Synthetic oligonucleotide
gctcgcctggctgacctagcagttga

SEQ ID NO: 355173 - DNA, 28 bp, Artificial Sequence
  Description of Artificial Sequence: Synthetic oligonucleotide
catatgacccaccaccccatctctgacc

SEQ ID NO: 355174 - DNA, 26 bp, Artificial Sequence
  Description of Artificial Sequence: Synthetic oligonucleotide
ctcgcctggctgacctagcagttgag

SEQ ID NO: 355175 - DNA, 30 bp, Artificial Sequence; identical to SEQ ID NO: 638
  Description of Artificial Sequence: Synthetic oligonucleotide

SEQ ID NO: 355176 - DNA, 27 bp, Artificial Sequence
  Description of Artificial Sequence: Synthetic oligonucleotide
tcgcctggctgacctagcagttgaggt

SEQ ID NO: 355177 - DNA, 29 bp, Artificial Sequence
  Description of Artificial Sequence: Synthetic oligonucleotide
tatgacccaccaccccatctctgaccatg

SEQ ID NO: 355178 - DNA, 26 bp, Artificial Sequence
  Description of Artificial Sequence: Synthetic oligonucleotide
cgcctggctgacctagcagttgaggt

SEQ ID NO: 355179 - DNA, 28 bp, Artificial Sequence
  Description of Artificial Sequence: Synthetic oligonucleotide
atgacccaccaccccatctctgaccatg

SEQ ID NO: 355180 - DNA, 27 bp, Artificial Sequence
  Description of Artificial Sequence: Synthetic oligonucleotide
gcctggctgacctagcagttgaggtca

SEQ ID NO: 355181 - DNA, 27 bp, Artificial Sequence
  Description of Artificial Sequence: Synthetic oligonucleotide
tgacccaccaccccatctctgaccatg

SEQ ID NO: 355182 - DNA, 28 bp, Artificial Sequence
  Description of Artificial Sequence: Synthetic oligonucleotide
cctggctgacctagcagttgaggtcatc

SEQ ID NO: 355183 - DNA, 27 bp, Artificial Sequence
  Description of Artificial Sequence: Synthetic oligonucleotide
gacccaccaccccatctctgaccatga

SEQ ID NO: 355184 - DNA, 28 bp, Artificial Sequence
  Description of Artificial Sequence: Synthetic oligonucleotide
ctggctgacctagcagttgaggtcatcc

SEQ ID NO: 355185 - DNA, 27 bp, Artificial Sequence
  Description of Artificial Sequence: Synthetic oligonucleotide
acccaccaccccatctctgaccatgag

SEQ ID NO: 355186 - DNA, 30 bp, Artificial Sequence; identical to SEQ ID NO: 232199
  Description of Artificial Sequence: Synthetic oligonucleotide

SEQ ID NO: 355187 - DNA, 26 bp, Artificial Sequence
  Description of Artificial Sequence: Synthetic oligonucleotide
cccaccaccccatctctgaccatgag

SEQ ID NO: 355188 - DNA, 29 bp, Artificial Sequence
  Description of Artificial Sequence: Synthetic oligonucleotide
ggctgacctagcagttgaggtcatcctac

SEQ ID NO: 355189 - DNA, 26 bp, Artificial Sequence
  Description of Artificial Sequence: Synthetic oligonucleotide
ccaccaccccatctctgaccatgagg

SEQ ID NO: 355190 - DNA, 29 bp, Artificial Sequence
  Description of Artificial Sequence: Synthetic oligonucleotide
gctgacctagcagttgaggtcatcctacg

SEQ ID NO: 355191 - DNA, 26 bp, Artificial Sequence
  Description of Artificial Sequence: Synthetic oligonucleotide
caccaccccatctctgaccatgaggc

SEQ ID NO: 355192 - DNA, 30 bp, Artificial Sequence; identical to SEQ ID NO: 232202
  Description of Artificial Sequence: Synthetic oligonucleotide

SEQ ID NO: 355193 - DNA, 27 bp, Artificial Sequence
  Description of Artificial Sequence: Synthetic oligonucleotide
accaccccatctctgaccatgaggcca

SEQ ID NO: 355194 - DNA, 30 bp, Artificial Sequence; identical to SEQ ID NO: 232203
  Description of Artificial Sequence: Synthetic oligonucleotide

SEQ ID NO: 355195 - DNA, 26 bp, Artificial Sequence
  Description of Artificial Sequence: Synthetic oligonucleotide
ccaccccatctctgaccatgaggcca

SEQ ID NO: 355196 - DNA, 29 bp, Artificial Sequence
  Description of Artificial Sequence: Synthetic oligonucleotide
gacctagcagttgaggtcatcctacgagc

SEQ ID NO: 355197 - DNA, 26 bp, Artificial Sequence
  Description of Artificial Sequence: Synthetic oligonucleotide
caccccatctctgaccatgaggccac

SEQ ID NO: 355198 - DNA, 30 bp, Artificial Sequence; identical to SEQ ID NO: 232205
  Description of Artificial Sequence: Synthetic oligonucleotide

SEQ ID NO: 355199 - DNA, 26 bp, Artificial Sequence
  Description of Artificial Sequence: Synthetic oligonucleotide
accccatctctgaccatgaggccacc

SEQ ID NO: 355200 - DNA, 29 bp, Artificial Sequence
  Description of Artificial Sequence: Synthetic oligonucleotide
cctagcagttgaggtcatcctacgagctg

SEQ ID NO: 355201 - DNA, 25 bp, Artificial Sequence
  Description of Artificial Sequence: Synthetic oligonucleotide
ccccatctctgaccatgaggccacc

SEQ ID NO: 355202 - DNA, 30 bp, Artificial Sequence; identical to SEQ ID NO: 232207
  Description of Artificial Sequence: Synthetic oligonucleotide

SEQ ID NO: 355203 - DNA, 26 bp, Artificial Sequence
  Description of Artificial Sequence: Synthetic oligonucleotide
cccatctctgaccatgaggccaccct

SEQ ID NO: 355204 - DNA, 30 bp, Artificial Sequence; identical to SEQ ID NO: 232208
  Description of Artificial Sequence: Synthetic oligonucleotide

SEQ ID NO: 355205 - DNA, 27 bp, Artificial Sequence
  Description of Artificial Sequence: Synthetic oligonucleotide
ccatctctgaccatgaggccaccctga

SEQ ID NO: 355206 - DNA, 29 bp, Artificial Sequence
  Description of Artificial Sequence: Synthetic oligonucleotide
agcagttgaggtcatcctacgagctgtcg

SEQ ID NO: 355207 - DNA, 27 bp, Artificial Sequence
  Description of Artificial Sequence: Synthetic oligonucleotide
catctctgaccatgaggccaccctgag

SEQ ID NO: 355208 - DNA, 28 bp, Artificial Sequence
  Description of Artificial Sequence: Synthetic oligonucleotide
gcagttgaggtcatcctacgagctgtcg

SEQ ID NO: 355209 - DNA, 27 bp, Artificial Sequence
  Description of Artificial Sequence: Synthetic oligonucleotide
atctctgaccatgaggccaccctgagg

SEQ ID NO: 355210 - DNA, 29 bp, Artificial Sequence
  Description of Artificial Sequence: Synthetic oligonucleotide
cagttgaggtcatcctacgagctgtcgtc

SEQ ID NO: 355211 - DNA, 27 bp, Artificial Sequence
  Description of Artificial Sequence: Synthetic oligonucleotide
tctctgaccatgaggccaccctgaggt

SEQ ID NO: 355212 - DNA, 29 bp, Artificial Sequence
  Description of Artificial Sequence: Synthetic oligonucleotide
agttgaggtcatcctacgagctgtcgtcg

SEQ ID NO: 355213 - DNA, 26 bp, Artificial Sequence
  Description of Artificial Sequence: Synthetic oligonucleotide
ctctgaccatgaggccaccctgaggt

SEQ ID NO: 355214 - DNA, 28 bp, Artificial Sequence
  Description of Artificial Sequence: Synthetic oligonucleotide
gttgaggtcatcctacgagctgtcgtcg

SEQ ID NO: 355215 - DNA, 26 bp, Artificial Sequence
  Description of Artificial Sequence: Synthetic oligonucleotide
tctgaccatgaggccaccctgaggtg

SEQ ID NO: 355216 - DNA, 28 bp, Artificial Sequence
  Description of Artificial Sequence: Synthetic oligonucleotide
ttgaggtcatcctacgagctgtcgtcgc

SEQ ID NO: 355217 - DNA, 25 bp, Artificial Sequence
  Description of Artificial Sequence: Synthetic oligonucleotide
ctgaccatgaggccaccctgaggtg

SEQ ID NO: 355218 - DNA, 27 bp, Artificial Sequence
  Description of Artificial Sequence: Synthetic oligonucleotide
tgaggtcatcctacgagctgtcgtcgc

SEQ ID NO: 355219 - DNA, 26 bp, Artificial Sequence
  Description of Artificial Sequence: Synthetic oligonucleotide
tgaccatgaggccaccctgaggtgct

SEQ ID NO: 355220 - DNA, 27 bp, Artificial Sequence
  Description of Artificial Sequence: Synthetic oligonucleotide
gaggtcatcctacgagctgtcgtcgct

SEQ ID NO: 355221 - DNA, 25 bp, Artificial Sequence
  Description of Artificial Sequence: Synthetic oligonucleotide
gaccatgaggccaccctgaggtgct

SEQ ID NO: 355222 - DNA, 27 bp, Artificial Sequence
  Description of Artificial Sequence: Synthetic oligonucleotide
aggtcatcctacgagctgtcgtcgctg

SEQ ID NO: 355223 - DNA, 25 bp, Artificial Sequence
  Description of Artificial Sequence: Synthetic oligonucleotide
accatgaggccaccctgaggtgctg

SEQ ID NO: 355224 - DNA, 26 bp, Artificial Sequence
  Description of Artificial Sequence: Synthetic oligonucleotide
ggtcatcctacgagctgtcgtcgctg

SEQ ID NO: 355225 - DNA, 24 bp, Artificial Sequence
  Description of Artificial Sequence: Synthetic oligonucleotide
ccatgaggccaccctgaggtgctg

SEQ ID NO: 355226 - DNA, 27 bp, Artificial Sequence
  Description of Artificial Sequence: Synthetic oligonucleotide
gtcatcctacgagctgtcgtcgctgct

SEQ ID NO: 355227 - DNA, 24 bp, Artificial Sequence
  Description of Artificial Sequence: Synthetic oligonucleotide
catgaggccaccctgaggtgctgg

SEQ ID NO: 355228 - DNA, 27 bp, Artificial Sequence
  Description of Artificial Sequence: Synthetic oligonucleotide
tcatcctacgagctgtcgtcgctgctg

SEQ ID NO: 355229 - DNA, 24 bp, Artificial Sequence
  Description of Artificial Sequence: Synthetic oligonucleotide
atgaggccaccctgaggtgctggg

SEQ ID NO: 355230 - DNA, 27 bp, Artificial Sequence
  Description of Artificial Sequence: Synthetic oligonucleotide
catcctacgagctgtcgtcgctgctgt

SEQ ID NO: 355231 - DNA, 23 bp, Artificial Sequence
  Description of Artificial Sequence: Synthetic oligonucleotide
tgaggccaccctgaggtgctggg

SEQ ID NO: 355232 - DNA, 27 bp, Artificial Sequence
  Description of Artificial Sequence: Synthetic oligonucleotide
atcctacgagctgtcgtcgctgctgtc

SEQ ID NO: 355233 - DNA, 22 bp, Artificial Sequence
  Description of Artificial Sequence: Synthetic oligonucleotide
gaggccaccctgaggtgctggg

SEQ ID NO: 355234 - DNA, 27 bp, Artificial Sequence
  Description of Artificial Sequence: Synthetic oligonucleotide
tcctacgagctgtcgtcgctgctgtca

SEQ ID NO: 355235 - DNA, 22 bp, Artificial Sequence
  Description of Artificial Sequence: Synthetic oligonucleotide
aggccaccctgaggtgctgggc

SEQ ID NO: 355236 - DNA, 27 bp, Artificial Sequence
  Description of Artificial Sequence: Synthetic oligonucleotide
cctacgagctgtcgtcgctgctgtcat

SEQ ID NO: 355237 - DNA, 21 bp, Artificial Sequence
  Description of Artificial Sequence: Synthetic oligonucleotide
ggccaccctgaggtgctgggc

SEQ ID NO: 355238 - DNA, 27 bp, Artificial Sequence
  Description of Artificial Sequence: Synthetic oligonucleotide
ctacgagctgtcgtcgctgctgtcatg

SEQ ID NO: 355239 - DNA, 21 bp, Artificial Sequence
  Description of Artificial Sequence: Synthetic oligonucleotide
gccaccctgaggtgctgggcc

SEQ ID NO: 355240 - DNA, 28 bp, Artificial Sequence
  Description of Artificial Sequence: Synthetic oligonucleotide
tacgagctgtcgtcgctgctgtcatgtg

SEQ ID NO: 355241 - DNA, 22 bp, Artificial Sequence
  Description of Artificial Sequence: Synthetic oligonucleotide
ccaccctgaggtgctgggccct

SEQ ID NO: 355242 - DNA, 27 bp, Artificial Sequence
  Description of Artificial Sequence: Synthetic oligonucleotide
acgagctgtcgtcgctgctgtcatgtg

SEQ ID NO: 355243 - DNA, 22 bp, Artificial Sequence
  Description of Artificial Sequence: Synthetic oligonucleotide
caccctgaggtgctgggccctg

SEQ ID NO: 355244 - DNA, 27 bp, Artificial Sequence
  Description of Artificial Sequence: Synthetic oligonucleotide
cgagctgtcgtcgctgctgtcatgtgt

SEQ ID NO: 355245 - DNA, 22 bp, Artificial Sequence
  Description of Artificial Sequence: Synthetic oligonucleotide
accctgaggtgctgggccctgg

SEQ ID NO: 355246 - DNA, 28 bp, Artificial Sequence
  Description of Artificial Sequence: Synthetic oligonucleotide
gagctgtcgtcgctgctgtcatgtgttg

SEQ ID NO: 355247 - DNA, 21 bp, Artificial Sequence
  Description of Artificial Sequence: Synthetic oligonucleotide
ccctgaggtgctgggccctgg

SEQ ID NO: 355248 - DNA, 28 bp, Artificial Sequence
  Description of Artificial Sequence: Synthetic oligonucleotide
agctgtcgtcgctgctgtcatgtgttgg

SEQ ID NO: 355249 - DNA, 21 bp, Artificial Sequence
  Description of Artificial Sequence: Synthetic oligonucleotide
cctgaggtgctgggccctggg

SEQ ID NO: 355250 - DNA, 27 bp, Artificial Sequence
  Description of Artificial Sequence: Synthetic oligonucleotide
gctgtcgtcgctgctgtcatgtgttgg

SEQ ID NO: 355251 - DNA, 23 bp, Artificial Sequence
  Description of Artificial Sequence: Synthetic oligonucleotide
ctgaggtgctgggccctgggctt

SEQ ID NO: 355252 - DNA, 28 bp, Artificial Sequence
  Description of Artificial Sequence: Synthetic oligonucleotide
ctgtcgtcgctgctgtcatgtgttggag

SEQ ID NO: 355253 - DNA, 25 bp, Artificial Sequence
  Description of Artificial Sequence: Synthetic oligonucleotide
tgaggtgctgggccctgggcttcta

SEQ ID NO: 355254 - DNA, 28 bp, Artificial Sequence
  Description of Artificial Sequence: Synthetic oligonucleotide
tgtcgtcgctgctgtcatgtgttggagg

SEQ ID NO: 355255 - DNA, 24 bp, Artificial Sequence
  Description of Artificial Sequence: Synthetic oligonucleotide
gaggtgctgggccctgggcttcta

SEQ ID NO: 355256 - DNA, 27 bp, Artificial Sequence
  Description of Artificial Sequence: Synthetic oligonucleotide
gtcgtcgctgctgtcatgtgttggagg

SEQ ID NO: 355257 - DNA, 24 bp, Artificial Sequence
  Description of Artificial Sequence: Synthetic oligonucleotide
aggtgctgggccctgggcttctac

SEQ ID NO: 355258 - DNA, 29 bp, Artificial Sequence
  Description of Artificial Sequence: Synthetic oligonucleotide
tcgtcgctgctgtcatgtgttggaggaag

SEQ ID NO: 355259 - DNA, 23 bp, Artificial Sequence
  Description of Artificial Sequence: Synthetic oligonucleotide
ggtgctgggccctgggcttctac

SEQ ID NO: 355260 - DNA, 28 bp, Artificial Sequence
  Description of Artificial Sequence: Synthetic oligonucleotide
cgtcgctgctgtcatgtgttggaggaag

SEQ ID NO: 355261 - DNA, 23 bp, Artificial Sequence
  Description of Artificial Sequence: Synthetic oligonucleotide
gtgctgggccctgggcttctacc

SEQ ID NO: 355262 - DNA, 29 bp, Artificial Sequence
  Description of Artificial Sequence: Synthetic oligonucleotide
gtcgctgctgtcatgtgttggaggaagac

SEQ ID NO: 355263 - DNA, 24 bp, Artificial Sequence
  Description of Artificial Sequence: Synthetic oligonucleotide
tgctgggccctgggcttctaccct

SEQ ID NO: 355264 - DNA, 29 bp, Artificial Sequence
  Description of Artificial Sequence: Synthetic oligonucleotide
tcgctgctgtcatgtgttggaggaagacc

SEQ ID NO: 355265 - DNA, 23 bp, Artificial Sequence
  Description of Artificial Sequence: Synthetic oligonucleotide
gctgggccctgggcttctaccct

SEQ ID NO: 355266 - DNA, 28 bp, Artificial Sequence
  Description of Artificial Sequence: Synthetic oligonucleotide
cgctgctgtcatgtgttggaggaagacc

SEQ ID NO: 355267 - DNA, 23 bp, Artificial Sequence
  Description of Artificial Sequence: Synthetic oligonucleotide
ctgggccctgggcttctaccctg

SEQ ID NO: 355268 - DNA, 29 bp, Artificial Sequence
  Description of Artificial Sequence: Synthetic oligonucleotide
gctgctgtcatgtgttggaggaagacctc

SEQ ID NO: 355269 - DNA, 23 bp, Artificial Sequence
  Description of Artificial Sequence: Synthetic oligonucleotide
tgggccctgggcttctaccctgc

SEQ ID NO: 355270 - DNA, 30 bp, Artificial Sequence; identical to SEQ ID NO: 232241
  Description of Artificial Sequence: Synthetic oligonucleotide

SEQ ID NO: 355271 - DNA, 22 bp, Artificial Sequence
  Description of Artificial Sequence: Synthetic oligonucleotide
gggccctgggcttctaccctgc

SEQ ID NO: 355272 - DNA, 30 bp, Artificial Sequence; identical to SEQ ID NO: 232242
  Description of Artificial Sequence: Synthetic oligonucleotide

SEQ ID NO: 355273 - DNA, 22 bp, Artificial Sequence
  Description of Artificial Sequence: Synthetic oligonucleotide
ggccctgggcttctaccctgcg

SEQ ID NO: 355274 - DNA, 29 bp, Artificial Sequence
  Description of Artificial Sequence: Synthetic oligonucleotide
gctgtcatgtgttggaggaagacctcagg

SEQ ID NO: 355275 - DNA, 23 bp, Artificial Sequence
  Description of Artificial Sequence: Synthetic oligonucleotide
gccctgggcttctaccctgcgga

SEQ ID NO: 355276 - DNA, 30 bp, Artificial Sequence; identical to SEQ ID NO: 232244
  Description of Artificial Sequence: Synthetic oligonucleotide

SEQ ID NO: 355277 - DNA, 25 bp, Artificial Sequence
  Description of Artificial Sequence: Synthetic oligonucleotide
ccctgggcttctaccctgcggagat

SEQ ID NO: 355278 - DNA, 30 bp, Artificial Sequence; identical to SEQ ID NO: 232245
  Description of Artificial Sequence: Synthetic oligonucleotide

SEQ ID NO: 355279 - DNA, 26 bp, Artificial Sequence
  Description of Artificial Sequence: Synthetic oligonucleotide
cctgggcttctaccctgcggagatca

SEQ ID NO: 355280 - DNA, 29 bp, Artificial Sequence
  Description of Artificial Sequence: Synthetic oligonucleotide
gtcatgtgttggaggaagacctcaggtgg

SEQ ID NO: 355281 - DNA, 27 bp, Artificial Sequence
  Description of Artificial Sequence: Synthetic oligonucleotide
ctgggcttctaccctgcggagatcaca

SEQ ID NO: 355282 - DNA, 33 bp, Artificial Sequence; identical to SEQ ID NO: 232247
  Description of Artificial Sequence: Synthetic oligonucleotide

SEQ ID NO: 355283 - DNA, 27 bp, Artificial Sequence
  Description of Artificial Sequence: Synthetic oligonucleotide
tgggcttctaccctgcggagatcacac

SEQ ID NO: 355284 - DNA, 32 bp, Artificial Sequence; identical to SEQ ID NO: 232248
  Description of Artificial Sequence: Synthetic oligonucleotide

SEQ ID NO: 355285 - DNA, 27 bp, Artificial Sequence
  Description of Artificial Sequence: Synthetic oligonucleotide
gggcttctaccctgcggagatcacact

SEQ ID NO: 355286 - DNA, 32 bp, Artificial Sequence; identical to SEQ ID NO: 232249
  Description of Artificial Sequence: Synthetic oligonucleotide

SEQ ID NO: 355287 - DNA, 27 bp, Artificial Sequence
  Description of Artificial Sequence: Synthetic oligonucleotide
ggcttctaccctgcggagatcacactg

SEQ ID NO: 355288 - DNA, 31 bp, Artificial Sequence; identical to SEQ ID NO: 232250
  Description of Artificial Sequence: Synthetic oligonucleotide

SEQ ID NO: 355289 - DNA, 28 bp, Artificial Sequence
  Description of Artificial Sequence: Synthetic oligonucleotide
gcttctaccctgcggagatcacactgac

SEQ ID NO: 355290 - DNA, 30 bp, Artificial Sequence; identical to SEQ ID NO: 232251
  Description of Artificial Sequence: Synthetic oligonucleotide

SEQ ID NO: 355291 - DNA, 28 bp, Artificial Sequence
  Description of Artificial Sequence: Synthetic oligonucleotide
cttctaccctgcggagatcacactgacc

SEQ ID NO: 355292 - DNA, 31 bp, Artificial Sequence; identical to SEQ ID NO: 232252
  Description of Artificial Sequence: Synthetic oligonucleotide

SEQ ID NO: 355293 - DNA, 29 bp, Artificial Sequence
  Description of Artificial Sequence: Synthetic oligonucleotide
ttctaccctgcggagatcacactgacctg

SEQ ID NO: 355294 - DNA, 30 bp, Artificial Sequence; identical to SEQ ID NO: 232253
  Description of Artificial Sequence: Synthetic oligonucleotide

SEQ ID NO: 355295 - DNA, 28 bp, Artificial Sequence
  Description of Artificial Sequence: Synthetic oligonucleotide
tctaccctgcggagatcacactgacctg

SEQ ID NO: 355296 - DNA, 30 bp, Artificial Sequence; identical to SEQ ID NO: 232254
  Description of Artificial Sequence: Synthetic oligonucleotide

SEQ ID NO: 355297 - DNA, 27 bp, Artificial Sequence
  Description of Artificial Sequence: Synthetic oligonucleotide
ctaccctgcggagatcacactgacctg

SEQ ID NO: 355298 - DNA, 29 bp, Artificial Sequence
  Description of Artificial Sequence: Synthetic oligonucleotide
tggaggaagacctcaggtggtaaaggagg

SEQ ID NO: 355299 - DNA, 27 bp, Artificial Sequence
  Description of Artificial Sequence: Synthetic oligonucleotide
taccctgcggagatcacactgacctgg

SEQ ID NO: 355300 - DNA, 28 bp, Artificial Sequence
  Description of Artificial Sequence: Synthetic oligonucleotide
ggaggaagacctcaggtggtaaaggagg

SEQ ID NO: 355301 - DNA, 26 bp, Artificial Sequence
  Description of Artificial Sequence: Synthetic oligonucleotide
accctgcggagatcacactgacctgg

SEQ ID NO: 355302 - DNA, 28 bp, Artificial Sequence
  Description of Artificial Sequence: Synthetic oligonucleotide
gaggaagacctcaggtggtaaaggaggg

SEQ ID NO: 355303 - DNA, 25 bp, Artificial Sequence
  Description of Artificial Sequence: Synthetic oligonucleotide
ccctgcggagatcacactgacctgg

SEQ ID NO: 355304 - DNA, 29 bp, Artificial Sequence
  Description of Artificial Sequence: Synthetic oligonucleotide
aggaagacctcaggtggtaaaggagggtg

SEQ ID NO: 355305 - DNA, 26 bp, Artificial Sequence
  Description of Artificial Sequence: Synthetic oligonucleotide
cctgcggagatcacactgacctggca

SEQ ID NO: 355306 - DNA, 28 bp, Artificial Sequence
  Description of Artificial Sequence: Synthetic oligonucleotide
ggaagacctcaggtggtaaaggagggtg

SEQ ID NO: 355307 - DNA, 26 bp, Artificial Sequence
  Description of Artificial Sequence: Synthetic oligonucleotide
ctgcggagatcacactgacctggcag

SEQ ID NO: 355308 - DNA, 28 bp, Artificial Sequence
  Description of Artificial Sequence: Synthetic oligonucleotide
gaagacctcaggtggtaaaggagggtgc

SEQ ID NO: 355309 - DNA, 26 bp, Artificial Sequence
  Description of Artificial Sequence: Synthetic oligonucleotide
tgcggagatcacactgacctggcagc

SEQ ID NO: 355310 - DNA, 30 bp, Artificial Sequence; identical to SEQ ID NO: 232261
  Description of Artificial Sequence: Synthetic oligonucleotide

SEQ ID NO: 355311 - DNA, 25 bp, Artificial Sequence
  Description of Artificial Sequence: Synthetic oligonucleotide
gcggagatcacactgacctggcagc

SEQ ID NO: 355312 - DNA, 29 bp, Artificial Sequence
  Description of Artificial Sequence: Synthetic oligonucleotide
agacctcaggtggtaaaggagggtgctac

SEQ ID NO: 355313 - DNA, 25 bp, Artificial Sequence
  Description of Artificial Sequence: Synthetic oligonucleotide
cggagatcacactgacctggcagcg

SEQ ID NO: 355314 - DNA, 28 bp, Artificial Sequence
  Description of Artificial Sequence: Synthetic oligonucleotide
gacctcaggtggtaaaggagggtgctac

SEQ ID NO: 355315 - DNA, 25 bp, Artificial Sequence
  Description of Artificial Sequence: Synthetic oligonucleotide
ggagatcacactgacctggcagcgg

SEQ ID NO: 355316 - DNA, 29 bp, Artificial Sequence
  Description of Artificial Sequence: Synthetic oligonucleotide
acctcaggtggtaaaggagggtgctactc

SEQ ID NO: 355317 - DNA, 27 bp, Artificial Sequence
  Description of Artificial Sequence: Synthetic oligonucleotide
gagatcacactgacctggcagcgggat

SEQ ID NO: 355318 - DNA, 28 bp, Artificial Sequence
  Description of Artificial Sequence: Synthetic oligonucleotide
cctcaggtggtaaaggagggtgctactc

SEQ ID NO: 355319 - DNA, 27 bp, Artificial Sequence
  Description of Artificial Sequence: Synthetic oligonucleotide
agatcacactgacctggcagcgggatg

SEQ ID NO: 355320 - DNA, 29 bp, Artificial Sequence
  Description of Artificial Sequence: Synthetic oligonucleotide
ctcaggtggtaaaggagggtgctactctc

SEQ ID NO: 355321 - DNA, 26 bp, Artificial Sequence
  Description of Artificial Sequence: Synthetic oligonucleotide
gatcacactgacctggcagcgggatg

SEQ ID NO: 355322 - DNA, 30 bp, Artificial Sequence; identical to SEQ ID NO: 232267
  Description of Artificial Sequence: Synthetic oligonucleotide

SEQ ID NO: 355323 - DNA, 26 bp, Artificial Sequence
  Description of Artificial Sequence: Synthetic oligonucleotide
atcacactgacctggcagcgggatgg

SEQ ID NO: 355324 - DNA, 29 bp, Artificial Sequence
  Description of Artificial Sequence: Synthetic oligonucleotide
caggtggtaaaggagggtgctactctctg

SEQ ID NO: 355325 - DNA, 25 bp, Artificial Sequence
  Description of Artificial Sequence: Synthetic oligonucleotide
tcacactgacctggcagcgggatgg

SEQ ID NO: 355326 - DNA, 29 bp, Artificial Sequence
  Description of Artificial Sequence: Synthetic oligonucleotide
aggtggtaaaggagggtgctactctctgg

SEQ ID NO: 355327 - DNA, 24 bp, Artificial Sequence
  Description of Artificial Sequence: Synthetic oligonucleotide
cacactgacctggcagcgggatgg

SEQ ID NO: 355328 - DNA, 28 bp, Artificial Sequence
  Description of Artificial Sequence: Synthetic oligonucleotide
ggtggtaaaggagggtgctactctctgg

SEQ ID NO: 355329 - DNA, 24 bp, Artificial Sequence
  Description of Artificial Sequence: Synthetic oligonucleotide
acactgacctggcagcgggatggg

SEQ ID NO: 355330 - DNA, 28 bp, Artificial Sequence
  Description of Artificial Sequence: Synthetic oligonucleotide
gtggtaaaggagggtgctactctctggc

SEQ ID NO: 355331 - DNA, 23 bp, Artificial Sequence
  Description of Artificial Sequence: Synthetic oligonucleotide
cactgacctggcagcgggatggg

SEQ ID NO: 355332 - DNA, 29 bp, Artificial Sequence
  Description of Artificial Sequence: Synthetic oligonucleotide
tggtaaaggagggtgctactctctggctg

SEQ ID NO: 355333 - DNA, 24 bp, Artificial Sequence
  Description of Artificial Sequence: Synthetic oligonucleotide
actgacctggcagcgggatgggga

SEQ ID NO: 355334 - DNA, 28 bp, Artificial Sequence
  Description of Artificial Sequence: Synthetic oligonucleotide
ggtaaaggagggtgctactctctggctg

SEQ ID NO: 355335 - DNA, 23 bp, Artificial Sequence
  Description of Artificial Sequence: Synthetic oligonucleotide
ctgacctggcagcgggatgggga

SEQ ID NO: 355336 - DNA, 28 bp, Artificial Sequence
  Description of Artificial Sequence: Synthetic oligonucleotide
gtaaaggagggtgctactctctggctgc

SEQ ID NO: 355337 - DNA, 23 bp, Artificial Sequence
  Description of Artificial Sequence: Synthetic oligonucleotide
tgacctggcagcgggatggggag

SEQ ID NO: 355338 - DNA, 28 bp, Artificial Sequence
  Description of Artificial Sequence: Synthetic oligonucleotide
taaaggagggtgctactctctggctgcg

SEQ ID NO: 355339 - DNA, 22 bp, Artificial Sequence
  Description of Artificial Sequence: Synthetic oligonucleotide
gacctggcagcgggatggggag

SEQ ID NO: 355340 - DNA, 27 bp, Artificial Sequence
  Description of Artificial Sequence: Synthetic oligonucleotide
aaaggagggtgctactctctggctgcg

SEQ ID NO: 355341 - DNA, 23 bp, Artificial Sequence
  Description of Artificial Sequence: Synthetic oligonucleotide
acctggcagcgggatggggagga

SEQ ID NO: 355342 - DNA, 27 bp, Artificial Sequence
  Description of Artificial Sequence: Synthetic oligonucleotide
aaggagggtgctactctctggctgcgt

SEQ ID NO: 355343 - DNA, 22 bp, Artificial Sequence
  Description of Artificial Sequence: Synthetic oligonucleotide
cctggcagcgggatggggagga

SEQ ID NO: 355344 - DNA, 26 bp, Artificial Sequence
  Description of Artificial Sequence: Synthetic oligonucleotide
aggagggtgctactctctggctgcgt

SEQ ID NO: 355345 - DNA, 22 bp, Artificial Sequence
  Description of Artificial Sequence: Synthetic oligonucleotide
ctggcagcgggatggggaggac

SEQ ID NO: 355346 - DNA, 25 bp, Artificial Sequence
  Description of Artificial Sequence: Synthetic oligonucleotide
ggagggtgctactctctggctgcgt

SEQ ID NO: 355347 - DNA, 23 bp, Artificial Sequence
  Description of Artificial Sequence: Synthetic oligonucleotide
tggcagcgggatggggaggacca

SEQ ID NO: 355348 - DNA, 25 bp, Artificial Sequence
  Description of Artificial Sequence: Synthetic oligonucleotide
gagggtgctactctctggctgcgtg

SEQ ID NO: 355349 - DNA, 22 bp, Artificial Sequence
  Description of Artificial Sequence: Synthetic oligonucleotide
ggcagcgggatggggaggacca

SEQ ID NO: 355350 - DNA, 26 bp, Artificial Sequence
  Description of Artificial Sequence: Synthetic oligonucleotide
agggtgctactctctggctgcgtgct

SEQ ID NO: 355351 - DNA, 23 bp, Artificial Sequence
  Description of Artificial Sequence: Synthetic oligonucleotide
gcagcgggatggggaggaccaga

SEQ ID NO: 355352 - DNA, 25 bp, Artificial Sequence
  Description of Artificial Sequence: Synthetic oligonucleotide
gggtgctactctctggctgcgtgct

SEQ ID NO: 355353 - DNA, 23 bp, Artificial Sequence
  Description of Artificial Sequence: Synthetic oligonucleotide
cagcgggatggggaggaccagac

SEQ ID NO: 355354 - DNA, 25 bp, Artificial Sequence
  Description of Artificial Sequence: Synthetic oligonucleotide
ggtgctactctctggctgcgtgctg

SEQ ID NO: 355355 - DNA, 23 bp, Artificial Sequence
  Description of Artificial Sequence: Synthetic oligonucleotide
agcgggatggggaggaccagacc

SEQ ID NO: 355356 - DNA, 25 bp, Artificial Sequence
  Description of Artificial Sequence: Synthetic oligonucleotide
gtgctactctctggctgcgtgctgc

SEQ ID NO: 355357 - DNA, 22 bp, Artificial Sequence
  Description of Artificial Sequence: Synthetic oligonucleotide
gcgggatggggaggaccagacc

SEQ ID NO: 355358 - DNA, 26 bp, Artificial Sequence
  Description of Artificial Sequence: Synthetic oligonucleotide
tgctactctctggctgcgtgctgcga

SEQ ID NO: 355359 - DNA, 23 bp, Artificial Sequence
  Description of Artificial Sequence: Synthetic oligonucleotide
cgggatggggaggaccagaccca

SEQ ID NO: 355360 - DNA, 25 bp, Artificial Sequence
  Description of Artificial Sequence: Synthetic oligonucleotide
gctactctctggctgcgtgctgcga

SEQ ID NO: 355361 - DNA, 23 bp, Artificial Sequence
  Description of Artificial Sequence: Synthetic oligonucleotide
gggatggggaggaccagacccag

SEQ ID NO: 355362 - DNA, 26 bp, Artificial Sequence
  Description of Artificial Sequence: Synthetic oligonucleotide
ctactctctggctgcgtgctgcgaca

SEQ ID NO: 355363 - DNA, 24 bp, Artificial Sequence
  Description of Artificial Sequence: Synthetic oligonucleotide
ggatggggaggaccagacccagga

SEQ ID NO: 355364 - DNA, 27 bp, Artificial Sequence
  Description of Artificial Sequence: Synthetic oligonucleotide
tactctctggctgcgtgctgcgacagt

SEQ ID NO: 355365 - DNA, 25 bp, Artificial Sequence
  Description of Artificial Sequence: Synthetic oligonucleotide
gatggggaggaccagacccaggaca

SEQ ID NO: 355366 - DNA, 26 bp, Artificial Sequence
  Description of Artificial Sequence: Synthetic oligonucleotide
actctctggctgcgtgctgcgacagt

SEQ ID NO: 355367 - DNA, 25 bp, Artificial Sequence
  Description of Artificial Sequence: Synthetic oligonucleotide
atggggaggaccagacccaggacac

SEQ ID NO: 355368 - DNA, 25 bp, Artificial Sequence
  Description of Artificial Sequence: Synthetic oligonucleotide
ctctctggctgcgtgctgcgacagt

SEQ ID NO: 355369 - DNA, 24 bp, Artificial Sequence
  Description of Artificial Sequence: Synthetic oligonucleotide
tggggaggaccagacccaggacac

SEQ ID NO: 355370 - DNA, 25 bp, Artificial Sequence
  Description of Artificial Sequence: Synthetic oligonucleotide
tctctggctgcgtgctgcgacagtc

SEQ ID NO: 355371 - DNA, 23 bp, Artificial Sequence
  Description of Artificial Sequence: Synthetic oligonucleotide
ggggaggaccagacccaggacac

SEQ ID NO: 355372 - DNA, 24 bp, Artificial Sequence
  Description of Artificial Sequence: Synthetic oligonucleotide
ctctggctgcgtgctgcgacagtc

SEQ ID NO: 355373 - DNA, 23 bp, Artificial Sequence
  Description of Artificial Sequence: Synthetic oligonucleotide
gggaggaccagacccaggacacg

SEQ ID NO: 355374 - DNA, 24 bp, Artificial Sequence
  Description of Artificial Sequence: Synthetic oligonucleotide
tctggctgcgtgctgcgacagtcc

SEQ ID NO: 355375 - DNA, 24 bp, Artificial Sequence
  Description of Artificial Sequence: Synthetic oligonucleotide
ggaggaccagacccaggacacgga

SEQ ID NO: 355376 - DNA, 23 bp, Artificial Sequence
  Description of Artificial Sequence: Synthetic oligonucleotide
ctggctgcgtgctgcgacagtcc

SEQ ID NO: 355377 - DNA, 24 bp, Artificial Sequence
  Description of Artificial Sequence: Synthetic oligonucleotide
gaggaccagacccaggacacggag

SEQ ID NO: 355378 - DNA, 23 bp, Artificial Sequence
  Description of Artificial Sequence: Synthetic oligonucleotide
tggctgcgtgctgcgacagtccc

SEQ ID NO: 355379 - DNA, 25 bp, Artificial Sequence
  Description of Artificial Sequence: Synthetic oligonucleotide
aggaccagacccaggacacggagct

SEQ ID NO: 355380 - DNA, 22 bp, Artificial Sequence
  Description of Artificial Sequence: Synthetic oligonucleotide
ggctgcgtgctgcgacagtccc

SEQ ID NO: 355381 - DNA, 24 bp, Artificial Sequence
  Description of Artificial Sequence: Synthetic oligonucleotide
ggaccagacccaggacacggagct

SEQ ID NO: 355382 - DNA, 23 bp, Artificial Sequence
  Description of Artificial Sequence: Synthetic oligonucleotide
gctgcgtgctgcgacagtcccca

SEQ ID NO: 355383 - DNA, 24 bp, Artificial Sequence
  Description of Artificial Sequence: Synthetic oligonucleotide
gaccagacccaggacacggagctc

SEQ ID NO: 355384 - DNA, 23 bp, Artificial Sequence
  Description of Artificial Sequence: Synthetic oligonucleotide
ctgcgtgctgcgacagtccccag

SEQ ID NO: 355385 - DNA, 25 bp, Artificial Sequence
  Description of Artificial Sequence: Synthetic oligonucleotide
accagacccaggacacggagctcgt

SEQ ID NO: 355386 - DNA, 23 bp, Artificial Sequence
  Description of Artificial Sequence: Synthetic oligonucleotide
tgcgtgctgcgacagtccccagg

SEQ ID NO: 355387 - DNA, 24 bp, Artificial Sequence
  Description of Artificial Sequence: Synthetic oligonucleotide
ccagacccaggacacggagctcgt

SEQ ID NO: 355388 - DNA, 22 bp, Artificial Sequence
  Description of Artificial Sequence: Synthetic oligonucleotide
gcgtgctgcgacagtccccagg

SEQ ID NO: 355389 - DNA, 24 bp, Artificial Sequence
  Description of Artificial Sequence: Synthetic oligonucleotide
cagacccaggacacggagctcgtg

SEQ ID NO: 355390 - DNA, 22 bp, Artificial Sequence
  Description of Artificial Sequence: Synthetic oligonucleotide
cgtgctgcgacagtccccaggg

SEQ ID NO: 355391 - DNA, 25 bp, Artificial Sequence
  Description of Artificial Sequence: Synthetic oligonucleotide
agacccaggacacggagctcgtgga

SEQ ID NO: 355392 - DNA, 23 bp, Artificial Sequence
  Description of Artificial Sequence: Synthetic oligonucleotide
gtgctgcgacagtccccagggct

SEQ ID NO: 355393 - DNA, 24 bp, Artificial Sequence
  Description of Artificial Sequence: Synthetic oligonucleotide
gacccaggacacggagctcgtgga

SEQ ID NO: 355394 - DNA, 24 bp, Artificial Sequence
  Description of Artificial Sequence: Synthetic oligonucleotide
tgctgcgacagtccccagggctgt

SEQ ID NO: 355395 - DNA, 25 bp, Artificial Sequence
  Description of Artificial Sequence: Synthetic oligonucleotide
acccaggacacggagctcgtggaga

SEQ ID NO: 355396 - DNA, 23 bp, Artificial Sequence
  Description of Artificial Sequence: Synthetic oligonucleotide
gctgcgacagtccccagggctgt

SEQ ID NO: 355397 - DNA, 24 bp, Artificial Sequence
  Description of Artificial Sequence: Synthetic oligonucleotide
cccaggacacggagctcgtggaga

SEQ ID NO: 355398 - DNA, 25 bp, Artificial Sequence
  Description of Artificial Sequence: Synthetic oligonucleotide
ctgcgacagtccccagggctgtgat

SEQ ID NO: 355399 - DNA, 24 bp, Artificial Sequence
  Description of Artificial Sequence: Synthetic oligonucleotide
ccaggacacggagctcgtggagac

SEQ ID NO: 355400 - DNA, 26 bp, Artificial Sequence
  Description of Artificial Sequence: Synthetic oligonucleotide
tgcgacagtccccagggctgtgatgt

SEQ ID NO: 355401 - DNA, 25 bp, Artificial Sequence
  Description of Artificial Sequence: Synthetic oligonucleotide
caggacacggagctcgtggagacca

SEQ ID NO: 355402 - DNA, 25 bp, Artificial Sequence
  Description of Artificial Sequence: Synthetic oligonucleotide
gcgacagtccccagggctgtgatgt

SEQ ID NO: 355403 - DNA, 25 bp, Artificial Sequence
  Description of Artificial Sequence: Synthetic oligonucleotide
aggacacggagctcgtggagaccag

SEQ ID NO: 355404 - DNA, 26 bp, Artificial Sequence
  Description of Artificial Sequence: Synthetic oligonucleotide
cgacagtccccagggctgtgatgtgt

SEQ ID NO: 355405 - DNA, 24 bp, Artificial Sequence
  Description of Artificial Sequence: Synthetic oligonucleotide
ggacacggagctcgtggagaccag

SEQ ID NO: 355406 - DNA, 27 bp, Artificial Sequence
  Description of Artificial Sequence: Synthetic oligonucleotide
gacagtccccagggctgtgatgtgtgt

SEQ ID NO: 355407 - DNA, 24 bp, Artificial Sequence
  Description of Artificial Sequence: Synthetic oligonucleotide
gacacggagctcgtggagaccagg

SEQ ID NO: 355408 - DNA, 27 bp, Artificial Sequence
  Description of Artificial Sequence: Synthetic oligonucleotide
acagtccccagggctgtgatgtgtgtc

SEQ ID NO: 355409 - DNA, 24 bp, Artificial Sequence
  Description of Artificial Sequence: Synthetic oligonucleotide
acacggagctcgtggagaccaggc

SEQ ID NO: 355410 - DNA, 27 bp, Artificial Sequence
  Description of Artificial Sequence: Synthetic oligonucleotide
cagtccccagggctgtgatgtgtgtct

SEQ ID NO: 355411 - DNA, 23 bp, Artificial Sequence
  Description of Artificial Sequence: Synthetic oligonucleotide
cacggagctcgtggagaccaggc

SEQ ID NO: 355412 - DNA, 27 bp, Artificial Sequence
  Description of Artificial Sequence: Synthetic oligonucleotide
agtccccagggctgtgatgtgtgtctc

SEQ ID NO: 355413 - DNA, 24 bp, Artificial Sequence
  Description of Artificial Sequence: Synthetic oligonucleotide
acggagctcgtggagaccaggcct

SEQ ID NO: 355414 - DNA, 27 bp, Artificial Sequence
  Description of Artificial Sequence: Synthetic oligonucleotide
gtccccagggctgtgatgtgtgtctca

SEQ ID NO: 355415 - DNA, 23 bp, Artificial Sequence
  Description of Artificial Sequence: Synthetic oligonucleotide
cggagctcgtggagaccaggcct

SEQ ID NO: 355416 - DNA, 27 bp, Artificial Sequence
  Description of Artificial Sequence: Synthetic oligonucleotide
tccccagggctgtgatgtgtgtctcac

SEQ ID NO: 355417 - DNA, 23 bp, Artificial Sequence
  Description of Artificial Sequence: Synthetic oligonucleotide
ggagctcgtggagaccaggcctg

SEQ ID NO: 355418 - DNA, 27 bp, Artificial Sequence
  Description of Artificial Sequence: Synthetic oligonucleotide
ccccagggctgtgatgtgtgtctcaca

SEQ ID NO: 355419 - DNA, 24 bp, Artificial Sequence
  Description of Artificial Sequence: Synthetic oligonucleotide
gagctcgtggagaccaggcctgca

SEQ ID NO: 355420 - DNA, 27 bp, Artificial Sequence
  Description of Artificial Sequence: Synthetic oligonucleotide
cccagggctgtgatgtgtgtctcacag

SEQ ID NO: 355421 - DNA, 24 bp, Artificial Sequence
  Description of Artificial Sequence: Synthetic oligonucleotide
agctcgtggagaccaggcctgcag

SEQ ID NO: 355422 - DNA, 27 bp, Artificial Sequence
  Description of Artificial Sequence: Synthetic oligonucleotide
ccagggctgtgatgtgtgtctcacagc

SEQ ID NO: 355423 - DNA, 23 bp, Artificial Sequence
  Description of Artificial Sequence: Synthetic oligonucleotide
gctcgtggagaccaggcctgcag

SEQ ID NO: 355424 - DNA, 29 bp, Artificial Sequence
  Description of Artificial Sequence: Synthetic oligonucleotide
cagggctgtgatgtgtgtctcacagcatg

SEQ ID NO: 355425 - DNA, 23 bp, Artificial Sequence
  Description of Artificial Sequence: Synthetic oligonucleotide
ctcgtggagaccaggcctgcagg

SEQ ID NO: 355426 - DNA, 33 bp, Artificial Sequence; identical to SEQ ID NO: 232319
  Description of Artificial Sequence: Synthetic oligonucleotide

SEQ ID NO: 355427 - DNA, 23 bp, Artificial Sequence
  Description of Artificial Sequence: Synthetic oligonucleotide
tcgtggagaccaggcctgcaggg

SEQ ID NO: 355428 - DNA, 32 bp, Artificial Sequence; identical to SEQ ID NO: 232320
  Description of Artificial Sequence: Synthetic oligonucleotide

SEQ ID NO: 355429 - DNA, 22 bp, Artificial Sequence
  Description of Artificial Sequence: Synthetic oligonucleotide
cgtggagaccaggcctgcaggg

SEQ ID NO: 355430 - DNA, 32 bp, Artificial Sequence; identical to SEQ ID NO: 232321
  Description of Artificial Sequence: Synthetic oligonucleotide

SEQ ID NO: 355431 - DNA, 24 bp, Artificial Sequence
  Description of Artificial Sequence: Synthetic oligonucleotide
gtggagaccaggcctgcaggggat

SEQ ID NO: 355432 - DNA, 34 bp, Artificial Sequence; identical to SEQ ID NO: 232322
  Description of Artificial Sequence: Synthetic oligonucleotide

SEQ ID NO: 355433 - DNA, 24 bp, Artificial Sequence
  Description of Artificial Sequence: Synthetic oligonucleotide
tggagaccaggcctgcaggggatg

SEQ ID NO: 355434 - DNA, 29 bp, Artificial Sequence
  Description of Artificial Sequence: Synthetic oligonucleotide
atggccatatgtggagtccgtgtgctagg

SEQ ID NO: 355435 - DNA, 23 bp, Artificial Sequence
  Description of Artificial Sequence: Synthetic oligonucleotide
ggagaccaggcctgcaggggatg

SEQ ID NO: 355436 - DNA, 28 bp, Artificial Sequence
  Description of Artificial Sequence: Synthetic oligonucleotide
tggccatatgtggagtccgtgtgctagg

SEQ ID NO: 355437 - DNA, 25 bp, Artificial Sequence
  Description of Artificial Sequence: Synthetic oligonucleotide
gagaccaggcctgcaggggatggaa

SEQ ID NO: 355438 - DNA, 27 bp, Artificial Sequence
  Description of Artificial Sequence: Synthetic oligonucleotide
ggccatatgtggagtccgtgtgctagg

SEQ ID NO: 355439 - DNA, 25 bp, Artificial Sequence
  Description of Artificial Sequence: Synthetic oligonucleotide
agaccaggcctgcaggggatggaac

SEQ ID NO: 355440 - DNA, 33 bp, Artificial Sequence; identical to SEQ ID NO: 232326
  Description of Artificial Sequence: Synthetic oligonucleotide

SEQ ID NO: 355441 - DNA, 24 bp, Artificial Sequence
  Description of Artificial Sequence: Synthetic oligonucleotide
gaccaggcctgcaggggatggaac

SEQ ID NO: 355442 - DNA, 35 bp, Artificial Sequence; identical to SEQ ID NO: 232327
  Description of Artificial Sequence: Synthetic oligonucleotide

SEQ ID NO: 355443 - DNA, 26 bp, Artificial Sequence
  Description of Artificial Sequence: Synthetic oligonucleotide
accaggcctgcaggggatggaacctt

SEQ ID NO: 355444 - DNA, 38 bp, Artificial Sequence; identical to SEQ ID NO: 232328
  Description of Artificial Sequence: Synthetic oligonucleotide

SEQ ID NO: 355445 - DNA, 25 bp, Artificial Sequence
  Description of Artificial Sequence: Synthetic oligonucleotide
ccaggcctgcaggggatggaacctt

SEQ ID NO: 355446 - DNA, 38 bp, Artificial Sequence; identical to SEQ ID NO: 232329
  Description of Artificial Sequence: Synthetic oligonucleotide

SEQ ID NO: 355447 - DNA, 25 bp, Artificial Sequence
  Description of Artificial Sequence: Synthetic oligonucleotide
caggcctgcaggggatggaaccttc

SEQ ID NO: 355448 - DNA, 37 bp, Artificial Sequence; identical to SEQ ID NO: 232330
  Description of Artificial Sequence: Synthetic oligonucleotide

SEQ ID NO: 355449 - DNA, 26 bp, Artificial Sequence
  Description of Artificial Sequence: Synthetic oligonucleotide
aggcctgcaggggatggaaccttcca

SEQ ID NO: 355450 - DNA, 36 bp, Artificial Sequence; identical to SEQ ID NO: 232331
  Description of Artificial Sequence: Synthetic oligonucleotide

SEQ ID NO: 355451 - DNA, 25 bp, Artificial Sequence
  Description of Artificial Sequence: Synthetic oligonucleotide
ggcctgcaggggatggaaccttcca

SEQ ID NO: 355452 - DNA, 35 bp, Artificial Sequence; identical to SEQ ID NO: 232332
  Description of Artificial Sequence: Synthetic oligonucleotide

SEQ ID NO: 355453 - DNA, 27 bp, Artificial Sequence
  Description of Artificial Sequence: Synthetic oligonucleotide
gcctgcaggggatggaaccttccagaa

SEQ ID NO: 355454 - DNA, 34 bp, Artificial Sequence; identical to SEQ ID NO: 232333
  Description of Artificial Sequence: Synthetic oligonucleotide

SEQ ID NO: 355455 - DNA, 27 bp, Artificial Sequence
  Description of Artificial Sequence: Synthetic oligonucleotide
cctgcaggggatggaaccttccagaag

SEQ ID NO: 355456 - DNA, 35 bp, Artificial Sequence; identical to SEQ ID NO: 232334
  Description of Artificial Sequence: Synthetic oligonucleotide

SEQ ID NO: 355457 - DNA, 28 bp, Artificial Sequence
  Description of Artificial Sequence: Synthetic oligonucleotide
ctgcaggggatggaaccttccagaagtg

SEQ ID NO: 355458 - DNA, 34 bp, Artificial Sequence; identical to SEQ ID NO: 232335
  Description of Artificial Sequence: Synthetic oligonucleotide

SEQ ID NO: 355459 - DNA, 28 bp, Artificial Sequence
  Description of Artificial Sequence: Synthetic oligonucleotide
tgcaggggatggaaccttccagaagtgg

SEQ ID NO: 355460 - DNA, 35 bp, Artificial Sequence; identical to SEQ ID NO: 232336
  Description of Artificial Sequence: Synthetic oligonucleotide

SEQ ID NO: 355461 - DNA, 27 bp, Artificial Sequence
  Description of Artificial Sequence: Synthetic oligonucleotide
gcaggggatggaaccttccagaagtgg

SEQ ID NO: 355462 - DNA, 35 bp, Artificial Sequence; identical to SEQ ID NO: 232337
  Description of Artificial Sequence: Synthetic oligonucleotide

SEQ ID NO: 355463 - DNA, 27 bp, Artificial Sequence
  Description of Artificial Sequence: Synthetic oligonucleotide
caggggatggaaccttccagaagtggg

SEQ ID NO: 355464 - DNA, 34 bp, Artificial Sequence; identical to SEQ ID NO: 232338
  Description of Artificial Sequence: Synthetic oligonucleotide

SEQ ID NO: 355465 - DNA, 27 bp, Artificial Sequence
  Description of Artificial Sequence: Synthetic oligonucleotide
aggggatggaaccttccagaagtgggc

SEQ ID NO: 355466 - DNA, 35 bp, Artificial Sequence; identical to SEQ ID NO: 232339
  Description of Artificial Sequence: Synthetic oligonucleotide

SEQ ID NO: 355467 - DNA, 26 bp, Artificial Sequence
  Description of Artificial Sequence: Synthetic oligonucleotide
ggggatggaaccttccagaagtgggc

SEQ ID NO: 355468 - DNA, 34 bp, Artificial Sequence; identical to SEQ ID NO: 232340
  Description of Artificial Sequence: Synthetic oligonucleotide

SEQ ID NO: 355469 - DNA, 26 bp, Artificial Sequence
  Description of Artificial Sequence: Synthetic oligonucleotide
gggatggaaccttccagaagtgggcg

SEQ ID NO: 355470 - DNA, 36 bp, Artificial Sequence; identical to SEQ ID NO: 232341
  Description of Artificial Sequence: Synthetic oligonucleotide

SEQ ID NO: 355471 - DNA, 26 bp, Artificial Sequence
  Description of Artificial Sequence: Synthetic oligonucleotide
ggatggaaccttccagaagtgggcgg

SEQ ID NO: 355472 - DNA, 37 bp, Artificial Sequence; identical to SEQ ID NO: 232342
  Description of Artificial Sequence: Synthetic oligonucleotide

SEQ ID NO: 355473 - DNA, 27 bp, Artificial Sequence
  Description of Artificial Sequence: Synthetic oligonucleotide
gatggaaccttccagaagtgggcggct

SEQ ID NO: 355474 - DNA, 37 bp, Artificial Sequence; identical to SEQ ID NO: 232343
  Description of Artificial Sequence: Synthetic oligonucleotide

SEQ ID NO: 355475 - DNA, 27 bp, Artificial Sequence
  Description of Artificial Sequence: Synthetic oligonucleotide
atggaaccttccagaagtgggcggctg

SEQ ID NO: 355476 - DNA, 36 bp, Artificial Sequence; identical to SEQ ID NO: 232344
  Description of Artificial Sequence: Synthetic oligonucleotide

SEQ ID NO: 355477 - DNA, 27 bp, Artificial Sequence
  Description of Artificial Sequence: Synthetic oligonucleotide
tggaaccttccagaagtgggcggctgt

SEQ ID NO: 355478 - DNA, 36 bp, Artificial Sequence; identical to SEQ ID NO: 232345
  Description of Artificial Sequence: Synthetic oligonucleotide

SEQ ID NO: 355479 - DNA, 26 bp, Artificial Sequence
  Description of Artificial Sequence: Synthetic oligonucleotide
ggaaccttccagaagtgggcggctgt

SEQ ID NO: 355480 - DNA, 35 bp, Artificial Sequence; identical to SEQ ID NO: 232346
  Description of Artificial Sequence: Synthetic oligonucleotide

SEQ ID NO: 355481 - DNA, 26 bp, Artificial Sequence
  Description of Artificial Sequence: Synthetic oligonucleotide
gaaccttccagaagtgggcggctgtg

SEQ ID NO: 355482 - DNA, 35 bp, Artificial Sequence; identical to SEQ ID NO: 232347
  Description of Artificial Sequence: Synthetic oligonucleotide

SEQ ID NO: 355483 - DNA, 27 bp, Artificial Sequence
  Description of Artificial Sequence: Synthetic oligonucleotide
aaccttccagaagtgggcggctgtggt

SEQ ID NO: 355484 - DNA, 36 bp, Artificial Sequence; identical to SEQ ID NO: 232348
  Description of Artificial Sequence: Synthetic oligonucleotide

SEQ ID NO: 355485 - DNA, 26 bp, Artificial Sequence
  Description of Artificial Sequence: Synthetic oligonucleotide
accttccagaagtgggcggctgtggt

SEQ ID NO: 355486 - DNA, 35 bp, Artificial Sequence; identical to SEQ ID NO: 232349
  Description of Artificial Sequence: Synthetic oligonucleotide

SEQ ID NO: 355487 - DNA, 25 bp, Artificial Sequence
  Description of Artificial Sequence: Synthetic oligonucleotide
ccttccagaagtgggcggctgtggt

SEQ ID NO: 355488 - DNA, 34 bp, Artificial Sequence; identical to SEQ ID NO: 232350
  Description of Artificial Sequence: Synthetic oligonucleotide

SEQ ID NO: 355489 - DNA, 25 bp, Artificial Sequence
  Description of Artificial Sequence: Synthetic oligonucleotide
cttccagaagtgggcggctgtggtg

SEQ ID NO: 355490 - DNA, 35 bp, Artificial Sequence; identical to SEQ ID NO: 232351
  Description of Artificial Sequence: Synthetic oligonucleotide

SEQ ID NO: 355491 - DNA, 26 bp, Artificial Sequence
  Description of Artificial Sequence: Synthetic oligonucleotide
ttccagaagtgggcggctgtggtggt

SEQ ID NO: 355492 - DNA, 35 bp, Artificial Sequence; identical to SEQ ID NO: 232352
  Description of Artificial Sequence: Synthetic oligonucleotide

SEQ ID NO: 355493 - DNA, 25 bp, Artificial Sequence
  Description of Artificial Sequence: Synthetic oligonucleotide
tccagaagtgggcggctgtggtggt

SEQ ID NO: 355494 - DNA, 34 bp, Artificial Sequence; identical to SEQ ID NO: 232353
  Description of Artificial Sequence: Synthetic oligonucleotide

SEQ ID NO: 355495 - DNA, 24 bp, Artificial Sequence
  Description of Artificial Sequence: Synthetic oligonucleotide
ccagaagtgggcggctgtggtggt

SEQ ID NO: 355496 - DNA, 33 bp, Artificial Sequence; identical to SEQ ID NO: 232354
  Description of Artificial Sequence: Synthetic oligonucleotide

SEQ ID NO: 355497 - DNA, 24 bp, Artificial Sequence
  Description of Artificial Sequence: Synthetic oligonucleotide
cagaagtgggcggctgtggtggtg

SEQ ID NO: 355498 - DNA, 32 bp, Artificial Sequence; identical to SEQ ID NO: 232355
  Description of Artificial Sequence: Synthetic oligonucleotide

SEQ ID NO: 355499 - DNA, 24 bp, Artificial Sequence
  Description of Artificial Sequence: Synthetic oligonucleotide
agaagtgggcggctgtggtggtgc

SEQ ID NO: 355500 - DNA, 31 bp, Artificial Sequence; identical to SEQ ID NO: 232356
  Description of Artificial Sequence: Synthetic oligonucleotide

SEQ ID NO: 355501 - DNA, 23 bp, Artificial Sequence
  Description of Artificial Sequence: Synthetic oligonucleotide
gaagtgggcggctgtggtggtgc

SEQ ID NO: 355502 - DNA, 30 bp, Artificial Sequence; identical to SEQ ID NO: 232357
  Description of Artificial Sequence: Synthetic oligonucleotide

SEQ ID NO: 355503 - DNA, 25 bp, Artificial Sequence
  Description of Artificial Sequence: Synthetic oligonucleotide
aagtgggcggctgtggtggtgcctt

SEQ ID NO: 355504 - DNA, 29 bp, Artificial Sequence
  Description of Artificial Sequence: Synthetic oligonucleotide
catcttagctgtgcagatgagcgcacagg

SEQ ID NO: 355505 - DNA, 24 bp, Artificial Sequence
  Description of Artificial Sequence: Synthetic oligonucleotide
agtgggcggctgtggtggtgcctt

SEQ ID NO: 355506 - DNA, 32 bp, Artificial Sequence; identical to SEQ ID NO: 232359
  Description of Artificial Sequence: Synthetic oligonucleotide

SEQ ID NO: 355507 - DNA, 23 bp, Artificial Sequence
  Description of Artificial Sequence: Synthetic oligonucleotide
gtgggcggctgtggtggtgcctt

SEQ ID NO: 355508 - DNA, 31 bp, Artificial Sequence; identical to SEQ ID NO: 232360
  Description of Artificial Sequence: Synthetic oligonucleotide

SEQ ID NO: 355509 - DNA, 24 bp, Artificial Sequence
  Description of Artificial Sequence: Synthetic oligonucleotide
tgggcggctgtggtggtgccttct

SEQ ID NO: 355510 - DNA, 30 bp, Artificial Sequence; identical to SEQ ID NO: 232361
  Description of Artificial Sequence: Synthetic oligonucleotide

SEQ ID NO: 355511 - DNA, 23 bp, Artificial Sequence
  Description of Artificial Sequence: Synthetic oligonucleotide
gggcggctgtggtggtgccttct

SEQ ID NO: 355512 - DNA, 32 bp, Artificial Sequence; identical to SEQ ID NO: 232362
  Description of Artificial Sequence: Synthetic oligonucleotide

SEQ ID NO: 355513 - DNA, 23 bp, Artificial Sequence
  Description of Artificial Sequence: Synthetic oligonucleotide
ggcggctgtggtggtgccttctg

SEQ ID NO: 355514 - DNA, 31 bp, Artificial Sequence; identical to SEQ ID NO: 232363
  Description of Artificial Sequence: Synthetic oligonucleotide

SEQ ID NO: 355515 - DNA, 24 bp, Artificial Sequence
  Description of Artificial Sequence: Synthetic oligonucleotide
gcggctgtggtggtgccttctgga

SEQ ID NO: 355516 - DNA, 30 bp, Artificial Sequence; identical to SEQ ID NO: 232364
  Description of Artificial Sequence: Synthetic oligonucleotide

SEQ ID NO: 355517 - DNA, 25 bp, Artificial Sequence
  Description of Artificial Sequence: Synthetic oligonucleotide
cggctgtggtggtgccttctggaga

SEQ ID NO: 355518 - DNA, 29 bp, Artificial Sequence
  Description of Artificial Sequence: Synthetic oligonucleotide
gctgtgcagatgagcgcacaggaatcaag

SEQ ID NO: 355519 - DNA, 25 bp, Artificial Sequence
  Description of Artificial Sequence: Synthetic oligonucleotide
ggctgtggtggtgccttctggagag

SEQ ID NO: 355520 - DNA, 29 bp, Artificial Sequence
  Description of Artificial Sequence: Synthetic oligonucleotide
ctgtgcagatgagcgcacaggaatcaagg

SEQ ID NO: 355521 - DNA, 26 bp, Artificial Sequence
  Description of Artificial Sequence: Synthetic oligonucleotide
gctgtggtggtgccttctggagagga

SEQ ID NO: 355522 - DNA, 29 bp, Artificial Sequence
  Description of Artificial Sequence: Synthetic oligonucleotide
tgtgcagatgagcgcacaggaatcaaggg

SEQ ID NO: 355523 - DNA, 26 bp, Artificial Sequence
  Description of Artificial Sequence: Synthetic oligonucleotide
ctgtggtggtgccttctggagaggag

SEQ ID NO: 355524 - DNA, 28 bp, Artificial Sequence
  Description of Artificial Sequence: Synthetic oligonucleotide
gtgcagatgagcgcacaggaatcaaggg

SEQ ID NO: 355525 - DNA, 27 bp, Artificial Sequence
  Description of Artificial Sequence: Synthetic oligonucleotide
tgtggtggtgccttctggagaggagca

SEQ ID NO: 355526 - DNA, 28 bp, Artificial Sequence
  Description of Artificial Sequence: Synthetic oligonucleotide
tgcagatgagcgcacaggaatcaagggc

SEQ ID NO: 355527 - DNA, 26 bp, Artificial Sequence
  Description of Artificial Sequence: Synthetic oligonucleotide
gtggtggtgccttctggagaggagca

SEQ ID NO: 355528 - DNA, 27 bp, Artificial Sequence
  Description of Artificial Sequence: Synthetic oligonucleotide
gcagatgagcgcacaggaatcaagggc

SEQ ID NO: 355529 - DNA, 27 bp, Artificial Sequence
  Description of Artificial Sequence: Synthetic oligonucleotide
tggtggtgccttctggagaggagcaga

SEQ ID NO: 355530 - DNA, 30 bp, Artificial Sequence; identical to SEQ ID NO: 232371
  Description of Artificial Sequence: Synthetic oligonucleotide

SEQ ID NO: 355531 - DNA, 26 bp, Artificial Sequence
  Description of Artificial Sequence: Synthetic oligonucleotide
ggtggtgccttctggagaggagcaga

SEQ ID NO: 355532 - DNA, 33 bp, Artificial Sequence; identical to SEQ ID NO: 232372
  Description of Artificial Sequence: Synthetic oligonucleotide

SEQ ID NO: 355533 - DNA, 27 bp, Artificial Sequence
  Description of Artificial Sequence: Synthetic oligonucleotide
gtggtgccttctggagaggagcagaga

SEQ ID NO: 355534 - DNA, 32 bp, Artificial Sequence; identical to SEQ ID NO: 232373
  Description of Artificial Sequence: Synthetic oligonucleotide

SEQ ID NO: 355535 - DNA, 29 bp, Artificial Sequence
  Description of Artificial Sequence: Synthetic oligonucleotide
tggtgccttctggagaggagcagagatac

SEQ ID NO: 355536 - DNA, 34 bp, Artificial Sequence; identical to SEQ ID NO: 232374
  Description of Artificial Sequence: Synthetic oligonucleotide

SEQ ID NO: 355537 - DNA, 28 bp, Artificial Sequence
  Description of Artificial Sequence: Synthetic oligonucleotide
ggtgccttctggagaggagcagagatac

SEQ ID NO: 355538 - DNA, 33 bp, Artificial Sequence; identical to SEQ ID NO: 232375
  Description of Artificial Sequence: Synthetic oligonucleotide

SEQ ID NO: 355539 - DNA, 29 bp, Artificial Sequence
  Description of Artificial Sequence: Synthetic oligonucleotide
gtgccttctggagaggagcagagatacac

SEQ ID NO: 355540 - DNA, 32 bp, Artificial Sequence; identical to SEQ ID NO: 232376
  Description of Artificial Sequence: Synthetic oligonucleotide

SEQ ID NO: 355541 - DNA, 29 bp, Artificial Sequence
  Description of Artificial Sequence: Synthetic oligonucleotide
tgccttctggagaggagcagagatacacc

SEQ ID NO: 355542 - DNA, 34 bp, Artificial Sequence; identical to SEQ ID NO: 232377
  Description of Artificial Sequence: Synthetic oligonucleotide

SEQ ID NO: 355543 - DNA, 28 bp, Artificial Sequence
  Description of Artificial Sequence: Synthetic oligonucleotide
gccttctggagaggagcagagatacacc

SEQ ID NO: 355544 - DNA, 33 bp, Artificial Sequence; identical to SEQ ID NO: 232378
  Description of Artificial Sequence: Synthetic oligonucleotide

SEQ ID NO: 355545 - DNA, 29 bp, Artificial Sequence
  Description of Artificial Sequence: Synthetic oligonucleotide
ccttctggagaggagcagagatacacctg

SEQ ID NO: 355546 - DNA, 35 bp, Artificial Sequence; identical to SEQ ID NO: 232379
  Description of Artificial Sequence: Synthetic oligonucleotide

SEQ ID NO: 355547 - DNA, 29 bp, Artificial Sequence
  Description of Artificial Sequence: Synthetic oligonucleotide
cttctggagaggagcagagatacacctgc

SEQ ID NO: 355548 - DNA, 36 bp, Artificial Sequence; identical to SEQ ID NO: 232380
  Description of Artificial Sequence: Synthetic oligonucleotide

SEQ ID NO: 355549 - DNA, 29 bp, Artificial Sequence
  Description of Artificial Sequence: Synthetic oligonucleotide
ttctggagaggagcagagatacacctgcc

SEQ ID NO: 355550 - DNA, 38 bp, Artificial Sequence; identical to SEQ ID NO: 232381
  Description of Artificial Sequence: Synthetic oligonucleotide

SEQ ID NO: 355551 - DNA, 28 bp, Artificial Sequence
  Description of Artificial Sequence: Synthetic oligonucleotide
tctggagaggagcagagatacacctgcc

SEQ ID NO: 355552 - DNA, 40 bp, Artificial Sequence; identical to SEQ ID NO: 232382
  Description of Artificial Sequence: Synthetic oligonucleotide

SEQ ID NO: 355553 - DNA, 27 bp, Artificial Sequence
  Description of Artificial Sequence: Synthetic oligonucleotide
ctggagaggagcagagatacacctgcc

SEQ ID NO: 355554 - DNA, 39 bp, Artificial Sequence; identical to SEQ ID NO: 232383
  Description of Artificial Sequence: Synthetic oligonucleotide

SEQ ID NO: 355555 - DNA, 29 bp, Artificial Sequence
  Description of Artificial Sequence: Synthetic oligonucleotide
tggagaggagcagagatacacctgccatg

SEQ ID NO: 355556 - DNA, 39 bp, Artificial Sequence; identical to SEQ ID NO: 232384
  Description of Artificial Sequence: Synthetic oligonucleotide

SEQ ID NO: 355557 - DNA, 28 bp, Artificial Sequence
  Description of Artificial Sequence: Synthetic oligonucleotide
ggagaggagcagagatacacctgccatg

SEQ ID NO: 355558 - DNA, 38 bp, Artificial Sequence; identical to SEQ ID NO: 232385
  Description of Artificial Sequence: Synthetic oligonucleotide

SEQ ID NO: 355559 - DNA, 29 bp, Artificial Sequence
  Description of Artificial Sequence: Synthetic oligonucleotide
gagaggagcagagatacacctgccatgtg

SEQ ID NO: 355560 - DNA, 39 bp, Artificial Sequence; identical to SEQ ID NO: 232386
  Description of Artificial Sequence: Synthetic oligonucleotide

SEQ ID NO: 355561 - DNA, 29 bp, Artificial Sequence
  Description of Artificial Sequence: Synthetic oligonucleotide
agaggagcagagatacacctgccatgtgc

SEQ ID NO: 355562 - DNA, 39 bp, Artificial Sequence; identical to SEQ ID NO: 232387
  Description of Artificial Sequence: Synthetic oligonucleotide

SEQ ID NO: 355563 - DNA, 28 bp, Artificial Sequence
  Description of Artificial Sequence: Synthetic oligonucleotide
gaggagcagagatacacctgccatgtgc

SEQ ID NO: 355564 - DNA, 38 bp, Artificial Sequence; identical to SEQ ID NO: 232388
  Description of Artificial Sequence: Synthetic oligonucleotide

SEQ ID NO: 355565 - DNA, 29 bp, Artificial Sequence
  Description of Artificial Sequence: Synthetic oligonucleotide
aggagcagagatacacctgccatgtgcag

SEQ ID NO: 355566 - DNA, 37 bp, Artificial Sequence; identical to SEQ ID NO: 232389
  Description of Artificial Sequence: Synthetic oligonucleotide

SEQ ID NO: 355567 - DNA, 28 bp, Artificial Sequence
  Description of Artificial Sequence: Synthetic oligonucleotide
ggagcagagatacacctgccatgtgcag

SEQ ID NO: 355568 - DNA, 36 bp, Artificial Sequence; identical to SEQ ID NO: 232390
  Description of Artificial Sequence: Synthetic oligonucleotide

SEQ ID NO: 355569 - DNA, 28 bp, Artificial Sequence
  Description of Artificial Sequence: Synthetic oligonucleotide
gagcagagatacacctgccatgtgcagc

SEQ ID NO: 355570 - DNA, 36 bp, Artificial Sequence; identical to SEQ ID NO: 232391
  Description of Artificial Sequence: Synthetic oligonucleotide

SEQ ID NO: 355571 - DNA, 30 bp, Artificial Sequence; identical to SEQ ID NO: 836
  Description of Artificial Sequence: Synthetic oligonucleotide

SEQ ID NO: 355572 - DNA, 35 bp, Artificial Sequence; identical to SEQ ID NO: 232392
  Description of Artificial Sequence: Synthetic oligonucleotide

SEQ ID NO: 355573 - DNA, 29 bp, Artificial Sequence
  Description of Artificial Sequence: Synthetic oligonucleotide
gcagagatacacctgccatgtgcagcatg

SEQ ID NO: 355574 - DNA, 34 bp, Artificial Sequence; identical to SEQ ID NO: 232393
  Description of Artificial Sequence: Synthetic oligonucleotide

SEQ ID NO: 355575 - DNA, 30 bp, Artificial Sequence; identical to SEQ ID NO: 838
  Description of Artificial Sequence: Synthetic oligonucleotide

SEQ ID NO: 355576 - DNA, 34 bp, Artificial Sequence; identical to SEQ ID NO: 232394
  Description of Artificial Sequence: Synthetic oligonucleotide

SEQ ID NO: 355577 - DNA, 30 bp, Artificial Sequence; identical to SEQ ID NO: 839
  Description of Artificial Sequence: Synthetic oligonucleotide

SEQ ID NO: 355578 - DNA, 34 bp, Artificial Sequence; identical to SEQ ID NO: 232395
  Description of Artificial Sequence: Synthetic oligonucleotide

SEQ ID NO: 355579 - DNA, 29 bp, Artificial Sequence
  Description of Artificial Sequence: Synthetic oligonucleotide
gagatacacctgccatgtgcagcatgagg

SEQ ID NO: 355580 - DNA, 35 bp, Artificial Sequence; identical to SEQ ID NO: 232396
  Description of Artificial Sequence: Synthetic oligonucleotide

SEQ ID NO: 355581 - DNA, 29 bp, Artificial Sequence
  Description of Artificial Sequence: Synthetic oligonucleotide
agatacacctgccatgtgcagcatgaggg

SEQ ID NO: 355582 - DNA, 37 bp, Artificial Sequence; identical to SEQ ID NO: 232397
  Description of Artificial Sequence: Synthetic oligonucleotide

SEQ ID NO: 355583 - DNA, 28 bp, Artificial Sequence
  Description of Artificial Sequence: Synthetic oligonucleotide
gatacacctgccatgtgcagcatgaggg

SEQ ID NO: 355584 - DNA, 36 bp, Artificial Sequence; identical to SEQ ID NO: 232398
  Description of Artificial Sequence: Synthetic oligonucleotide

SEQ ID NO: 355585 - DNA, 29 bp, Artificial Sequence
  Description of Artificial Sequence: Synthetic oligonucleotide
atacacctgccatgtgcagcatgagggtc

SEQ ID NO: 355586 - DNA, 35 bp, Artificial Sequence; identical to SEQ ID NO: 232399
  Description of Artificial Sequence: Synthetic oligonucleotide

SEQ ID NO: 355587 - DNA, 28 bp, Artificial Sequence
  Description of Artificial Sequence: Synthetic oligonucleotide
tacacctgccatgtgcagcatgagggtc

SEQ ID NO: 355588 - DNA, 34 bp, Artificial Sequence; identical to SEQ ID NO: 232400
  Description of Artificial Sequence: Synthetic oligonucleotide

SEQ ID NO: 355589 - DNA, 27 bp, Artificial Sequence
  Description of Artificial Sequence: Synthetic oligonucleotide
acacctgccatgtgcagcatgagggtc

SEQ ID NO: 355590 - DNA, 37 bp, Artificial Sequence; identical to SEQ ID NO: 232401
  Description of Artificial Sequence: Synthetic oligonucleotide

SEQ ID NO: 355591 - DNA, 27 bp, Artificial Sequence
  Description of Artificial Sequence: Synthetic oligonucleotide
cacctgccatgtgcagcatgagggtct

SEQ ID NO: 355592 - DNA, 36 bp, Artificial Sequence; identical to SEQ ID NO: 232402
  Description of Artificial Sequence: Synthetic oligonucleotide

SEQ ID NO: 355593 - DNA, 27 bp, Artificial Sequence
  Description of Artificial Sequence: Synthetic oligonucleotide
acctgccatgtgcagcatgagggtctg

SEQ ID NO: 355594 - DNA, 35 bp, Artificial Sequence; identical to SEQ ID NO: 232403
  Description of Artificial Sequence: Synthetic oligonucleotide

SEQ ID NO: 355595 - DNA, 26 bp, Artificial Sequence
  Description of Artificial Sequence: Synthetic oligonucleotide
cctgccatgtgcagcatgagggtctg

SEQ ID NO: 355596 - DNA, 34 bp, Artificial Sequence; identical to SEQ ID NO: 232404
  Description of Artificial Sequence: Synthetic oligonucleotide

SEQ ID NO: 355597 - DNA, 26 bp, Artificial Sequence
  Description of Artificial Sequence: Synthetic oligonucleotide
ctgccatgtgcagcatgagggtctgc

SEQ ID NO: 355598 - DNA, 35 bp, Artificial Sequence; identical to SEQ ID NO: 232405
  Description of Artificial Sequence: Synthetic oligonucleotide

SEQ ID NO: 355599 - DNA, 26 bp, Artificial Sequence
  Description of Artificial Sequence: Synthetic oligonucleotide
tgccatgtgcagcatgagggtctgcc

SEQ ID NO: 355600 - DNA, 34 bp, Artificial Sequence; identical to SEQ ID NO: 232406
  Description of Artificial Sequence: Synthetic oligonucleotide

SEQ ID NO: 355601 - DNA, 25 bp, Artificial Sequence
  Description of Artificial Sequence: Synthetic oligonucleotide
gccatgtgcagcatgagggtctgcc

SEQ ID NO: 355602 - DNA, 33 bp, Artificial Sequence; identical to SEQ ID NO: 232407
  Description of Artificial Sequence: Synthetic oligonucleotide

SEQ ID NO: 355603 - DNA, 27 bp, Artificial Sequence
  Description of Artificial Sequence: Synthetic oligonucleotide
ccatgtgcagcatgagggtctgcccaa

SEQ ID NO: 355604 - DNA, 36 bp, Artificial Sequence; identical to SEQ ID NO: 232408
  Description of Artificial Sequence: Synthetic oligonucleotide

SEQ ID NO: 355605 - DNA, 27 bp, Artificial Sequence
  Description of Artificial Sequence: Synthetic oligonucleotide
catgtgcagcatgagggtctgcccaag

SEQ ID NO: 355606 - DNA, 35 bp, Artificial Sequence; identical to SEQ ID NO: 232409
  Description of Artificial Sequence: Synthetic oligonucleotide

SEQ ID NO: 355607 - DNA, 27 bp, Artificial Sequence
  Description of Artificial Sequence: Synthetic oligonucleotide
atgtgcagcatgagggtctgcccaagc

SEQ ID NO: 355608 - DNA, 34 bp, Artificial Sequence; identical to SEQ ID NO: 232410
  Description of Artificial Sequence: Synthetic oligonucleotide

SEQ ID NO: 355609 - DNA, 26 bp, Artificial Sequence
  Description of Artificial Sequence: Synthetic oligonucleotide
tgtgcagcatgagggtctgcccaagc

SEQ ID NO: 355610 - DNA, 34 bp, Artificial Sequence; identical to SEQ ID NO: 232411
  Description of Artificial Sequence: Synthetic oligonucleotide

SEQ ID NO: 355611 - DNA, 25 bp, Artificial Sequence
  Description of Artificial Sequence: Synthetic oligonucleotide
gtgcagcatgagggtctgcccaagc

SEQ ID NO: 355612 - DNA, 33 bp, Artificial Sequence; identical to SEQ ID NO: 232412
  Description of Artificial Sequence: Synthetic oligonucleotide

SEQ ID NO: 355613 - DNA, 25 bp, Artificial Sequence
  Description of Artificial Sequence: Synthetic oligonucleotide
tgcagcatgagggtctgcccaagcc

SEQ ID NO: 355614 - DNA, 32 bp, Artificial Sequence; identical to SEQ ID NO: 232413
  Description of Artificial Sequence: Synthetic oligonucleotide

SEQ ID NO: 355615 - DNA, 24 bp, Artificial Sequence
  Description of Artificial Sequence: Synthetic oligonucleotide
gcagcatgagggtctgcccaagcc

SEQ ID NO: 355616 - DNA, 33 bp, Artificial Sequence; identical to SEQ ID NO: 232414
  Description of Artificial Sequence: Synthetic oligonucleotide

SEQ ID NO: 355617 - DNA, 24 bp, Artificial Sequence
  Description of Artificial Sequence: Synthetic oligonucleotide
cagcatgagggtctgcccaagccc

SEQ ID NO: 355618 - DNA, 32 bp, Artificial Sequence; identical to SEQ ID NO: 232415
  Description of Artificial Sequence: Synthetic oligonucleotide

SEQ ID NO: 355619 - DNA, 25 bp, Artificial Sequence
  Description of Artificial Sequence: Synthetic oligonucleotide
agcatgagggtctgcccaagcccct

SEQ ID NO: 355620 - DNA, 33 bp, Artificial Sequence; identical to SEQ ID NO: 232416
  Description of Artificial Sequence: Synthetic oligonucleotide

SEQ ID NO: 355621 - DNA, 24 bp, Artificial Sequence
  Description of Artificial Sequence: Synthetic oligonucleotide
gcatgagggtctgcccaagcccct

SEQ ID NO: 355622 - DNA, 32 bp, Artificial Sequence; identical to SEQ ID NO: 232417
  Description of Artificial Sequence: Synthetic oligonucleotide

SEQ ID NO: 355623 - DNA, 25 bp, Artificial Sequence
  Description of Artificial Sequence: Synthetic oligonucleotide
catgagggtctgcccaagcccctca

SEQ ID NO: 355624 - DNA, 31 bp, Artificial Sequence; identical to SEQ ID NO: 232418
  Description of Artificial Sequence: Synthetic oligonucleotide

SEQ ID NO: 355625 - DNA, 25 bp, Artificial Sequence
  Description of Artificial Sequence: Synthetic oligonucleotide
atgagggtctgcccaagcccctcac

SEQ ID NO: 355626 - DNA, 31 bp, Artificial Sequence; identical to SEQ ID NO: 232419
  Description of Artificial Sequence: Synthetic oligonucleotide

SEQ ID NO: 355627 - DNA, 24 bp, Artificial Sequence
  Description of Artificial Sequence: Synthetic oligonucleotide
tgagggtctgcccaagcccctcac

SEQ ID NO: 355628 - DNA, 30 bp, Artificial Sequence; identical to SEQ ID NO: 232420
  Description of Artificial Sequence: Synthetic oligonucleotide

SEQ ID NO: 355629 - DNA, 23 bp, Artificial Sequence
  Description of Artificial Sequence: Synthetic oligonucleotide
gagggtctgcccaagcccctcac

SEQ ID NO: 355630 - DNA, 29 bp, Artificial Sequence
  Description of Artificial Sequence: Synthetic oligonucleotide
cgaggccgagtactatctgaaacctgacc

SEQ ID NO: 355631 - DNA, 23 bp, Artificial Sequence
  Description of Artificial Sequence: Synthetic oligonucleotide
agggtctgcccaagcccctcacc

SEQ ID NO: 355632 - DNA, 32 bp, Artificial Sequence; identical to SEQ ID NO: 232422
  Description of Artificial Sequence: Synthetic oligonucleotide

SEQ ID NO: 355633 - DNA, 22 bp, Artificial Sequence
  Description of Artificial Sequence: Synthetic oligonucleotide
gggtctgcccaagcccctcacc

SEQ ID NO: 355634 - DNA, 33 bp, Artificial Sequence; identical to SEQ ID NO: 232423
  Description of Artificial Sequence: Synthetic oligonucleotide

SEQ ID NO: 355635 - DNA, 23 bp, Artificial Sequence
  Description of Artificial Sequence: Synthetic oligonucleotide
ggtctgcccaagcccctcaccct

SEQ ID NO: 355636 - DNA, 32 bp, Artificial Sequence; identical to SEQ ID NO: 232424
  Description of Artificial Sequence: Synthetic oligonucleotide

SEQ ID NO: 355637 - DNA, 24 bp, Artificial Sequence
  Description of Artificial Sequence: Synthetic oligonucleotide
gtctgcccaagcccctcaccctga

SEQ ID NO: 355638 - DNA, 32 bp, Artificial Sequence; identical to SEQ ID NO: 232425
  Description of Artificial Sequence: Synthetic oligonucleotide

SEQ ID NO: 355639 - DNA, 26 bp, Artificial Sequence
  Description of Artificial Sequence: Synthetic oligonucleotide
tctgcccaagcccctcaccctgagat

SEQ ID NO: 355640 - DNA, 32 bp, Artificial Sequence; identical to SEQ ID NO: 232426
  Description of Artificial Sequence: Synthetic oligonucleotide

SEQ ID NO: 355641 - DNA, 25 bp, Artificial Sequence
  Description of Artificial Sequence: Synthetic oligonucleotide
ctgcccaagcccctcaccctgagat

SEQ ID NO: 355642 - DNA, 32 bp, Artificial Sequence; identical to SEQ ID NO: 232427
  Description of Artificial Sequence: Synthetic oligonucleotide

SEQ ID NO: 355643 - DNA, 25 bp, Artificial Sequence
  Description of Artificial Sequence: Synthetic oligonucleotide
tgcccaagcccctcaccctgagatg

SEQ ID NO: 355644 - DNA, 33 bp, Artificial Sequence; identical to SEQ ID NO: 232428
  Description of Artificial Sequence: Synthetic oligonucleotide

SEQ ID NO: 355645 - DNA, 24 bp, Artificial Sequence
  Description of Artificial Sequence: Synthetic oligonucleotide
gcccaagcccctcaccctgagatg

SEQ ID NO: 355646 - DNA, 38 bp, Artificial Sequence; identical to SEQ ID NO: 232429
  Description of Artificial Sequence: Synthetic oligonucleotide

SEQ ID NO: 355647 - DNA, 24 bp, Artificial Sequence
  Description of Artificial Sequence: Synthetic oligonucleotide
cccaagcccctcaccctgagatgg

SEQ ID NO: 355648 - DNA, 37 bp, Artificial Sequence; identical to SEQ ID NO: 232430
  Description of Artificial Sequence: Synthetic oligonucleotide

SEQ ID NO: 355649 - DNA, 25 bp, Artificial Sequence
  Description of Artificial Sequence: Synthetic oligonucleotide
ccaagcccctcaccctgagatggga

SEQ ID NO: 355650 - DNA, 40 bp, Artificial Sequence; identical to SEQ ID NO: 232431
  Description of Artificial Sequence: Synthetic oligonucleotide

SEQ ID NO: 355651 - DNA, 25 bp, Artificial Sequence
  Description of Artificial Sequence: Synthetic oligonucleotide
caagcccctcaccctgagatgggag

SEQ ID NO: 355652 - DNA, 39 bp, Artificial Sequence; identical to SEQ ID NO: 232432
  Description of Artificial Sequence: Synthetic oligonucleotide

SEQ ID NO: 355653 - DNA, 26 bp, Artificial Sequence
  Description of Artificial Sequence: Synthetic oligonucleotide
aagcccctcaccctgagatgggagct

SEQ ID NO: 355654 - DNA, 38 bp, Artificial Sequence; identical to SEQ ID NO: 232433
  Description of Artificial Sequence: Synthetic oligonucleotide

SEQ ID NO: 355655 - DNA, 25 bp, Artificial Sequence
  Description of Artificial Sequence: Synthetic oligonucleotide
agcccctcaccctgagatgggagct

SEQ ID NO: 355656 - DNA, 39 bp, Artificial Sequence; identical to SEQ ID NO: 232434
  Description of Artificial Sequence: Synthetic oligonucleotide

SEQ ID NO: 355657 - DNA, 24 bp, Artificial Sequence
  Description of Artificial Sequence: Synthetic oligonucleotide
gcccctcaccctgagatgggagct

SEQ ID NO: 355658 - DNA, 38 bp, Artificial Sequence; identical to SEQ ID NO: 232435
  Description of Artificial Sequence: Synthetic oligonucleotide

SEQ ID NO: 355659 - DNA, 25 bp, Artificial Sequence
  Description of Artificial Sequence: Synthetic oligonucleotide
cccctcaccctgagatgggagctgt

SEQ ID NO: 355660 - DNA, 37 bp, Artificial Sequence; identical to SEQ ID NO: 232436
  Description of Artificial Sequence: Synthetic oligonucleotide

SEQ ID NO: 355661 - DNA, 27 bp, Artificial Sequence
  Description of Artificial Sequence: Synthetic oligonucleotide
ccctcaccctgagatgggagctgtctt

SEQ ID NO: 355662 - DNA, 36 bp, Artificial Sequence; identical to SEQ ID NO: 232437
  Description of Artificial Sequence: Synthetic oligonucleotide

SEQ ID NO: 355663 - DNA, 27 bp, Artificial Sequence
  Description of Artificial Sequence: Synthetic oligonucleotide
cctcaccctgagatgggagctgtcttc

SEQ ID NO: 355664 - DNA, 39 bp, Artificial Sequence; identical to SEQ ID NO: 232438
  Description of Artificial Sequence: Synthetic oligonucleotide

SEQ ID NO: 355665 - DNA, 27 bp, Artificial Sequence
  Description of Artificial Sequence: Synthetic oligonucleotide
ctcaccctgagatgggagctgtcttcc

SEQ ID NO: 355666 - DNA, 38 bp, Artificial Sequence; identical to SEQ ID NO: 232439
  Description of Artificial Sequence: Synthetic oligonucleotide

SEQ ID NO: 355667 - DNA, 27 bp, Artificial Sequence
  Description of Artificial Sequence: Synthetic oligonucleotide
tcaccctgagatgggagctgtcttccc

SEQ ID NO: 355668 - DNA, 40 bp, Artificial Sequence; identical to SEQ ID NO: 232440
  Description of Artificial Sequence: Synthetic oligonucleotide

SEQ ID NO: 355669 - DNA, 27 bp, Artificial Sequence
  Description of Artificial Sequence: Synthetic oligonucleotide
caccctgagatgggagctgtcttccca

SEQ ID NO: 355670 - DNA, 39 bp, Artificial Sequence; identical to SEQ ID NO: 232441
  Description of Artificial Sequence: Synthetic oligonucleotide

SEQ ID NO: 355671 - DNA, 27 bp, Artificial Sequence
  Description of Artificial Sequence: Synthetic oligonucleotide
accctgagatgggagctgtcttcccag

SEQ ID NO: 355672 - DNA, 38 bp, Artificial Sequence; identical to SEQ ID NO: 232442
  Description of Artificial Sequence: Synthetic oligonucleotide

SEQ ID NO: 355673 - DNA, 26 bp, Artificial Sequence
  Description of Artificial Sequence: Synthetic oligonucleotide
ccctgagatgggagctgtcttcccag

SEQ ID NO: 355674 - DNA, 37 bp, Artificial Sequence; identical to SEQ ID NO: 232443
  Description of Artificial Sequence: Synthetic oligonucleotide

SEQ ID NO: 355675 - DNA, 26 bp, Artificial Sequence
  Description of Artificial Sequence: Synthetic oligonucleotide
cctgagatgggagctgtcttcccagc

SEQ ID NO: 355676 - DNA, 37 bp, Artificial Sequence; identical to SEQ ID NO: 232444
  Description of Artificial Sequence: Synthetic oligonucleotide

SEQ ID NO: 355677 - DNA, 26 bp, Artificial Sequence
  Description of Artificial Sequence: Synthetic oligonucleotide
ctgagatgggagctgtcttcccagcc

SEQ ID NO: 355678 - DNA, 38 bp, Artificial Sequence; identical to SEQ ID NO: 232445
  Description of Artificial Sequence: Synthetic oligonucleotide

SEQ ID NO: 355679 - DNA, 27 bp, Artificial Sequence
  Description of Artificial Sequence: Synthetic oligonucleotide
tgagatgggagctgtcttcccagccca

SEQ ID NO: 355680 - DNA, 37 bp, Artificial Sequence; identical to SEQ ID NO: 232446
  Description of Artificial Sequence: Synthetic oligonucleotide

SEQ ID NO: 355681 - DNA, 26 bp, Artificial Sequence
  Description of Artificial Sequence: Synthetic oligonucleotide
gagatgggagctgtcttcccagccca

SEQ ID NO: 355682 - DNA, 39 bp, Artificial Sequence; identical to SEQ ID NO: 232447
  Description of Artificial Sequence: Synthetic oligonucleotide

SEQ ID NO: 355683 - DNA, 26 bp, Artificial Sequence
  Description of Artificial Sequence: Synthetic oligonucleotide
agatgggagctgtcttcccagcccac

SEQ ID NO: 355684 - DNA, 38 bp, Artificial Sequence; identical to SEQ ID NO: 232448
  Description of Artificial Sequence: Synthetic oligonucleotide

SEQ ID NO: 355685 - DNA, 25 bp, Artificial Sequence
  Description of Artificial Sequence: Synthetic oligonucleotide
gatgggagctgtcttcccagcccac

SEQ ID NO: 355686 - DNA, 39 bp, Artificial Sequence; identical to SEQ ID NO: 232449
  Description of Artificial Sequence: Synthetic oligonucleotide

SEQ ID NO: 355687 - DNA, 27 bp, Artificial Sequence
  Description of Artificial Sequence: Synthetic oligonucleotide
atgggagctgtcttcccagcccaccat

SEQ ID NO: 355688 - DNA, 44 bp, Artificial Sequence; identical to SEQ ID NO: 232450
  Description of Artificial Sequence: Synthetic oligonucleotide

SEQ ID NO: 355689 - DNA, 26 bp, Artificial Sequence
  Description of Artificial Sequence: Synthetic oligonucleotide
tgggagctgtcttcccagcccaccat

SEQ ID NO: 355690 - DNA, 43 bp, Artificial Sequence; identical to SEQ ID NO: 232451
  Description of Artificial Sequence: Synthetic oligonucleotide

SEQ ID NO: 355691 - DNA, 25 bp, Artificial Sequence
  Description of Artificial Sequence: Synthetic oligonucleotide
gggagctgtcttcccagcccaccat

SEQ ID NO: 355692 - DNA, 42 bp, Artificial Sequence; identical to SEQ ID NO: 232452
  Description of Artificial Sequence: Synthetic oligonucleotide

SEQ ID NO: 355693 - DNA, 25 bp, Artificial Sequence
  Description of Artificial Sequence: Synthetic oligonucleotide
ggagctgtcttcccagcccaccatc

SEQ ID NO: 355694 - DNA, 41 bp, Artificial Sequence; identical to SEQ ID NO: 232453
  Description of Artificial Sequence: Synthetic oligonucleotide

SEQ ID NO: 355695 - DNA, 25 bp, Artificial Sequence
  Description of Artificial Sequence: Synthetic oligonucleotide
gagctgtcttcccagcccaccatcc

SEQ ID NO: 355696 - DNA, 41 bp, Artificial Sequence; identical to SEQ ID NO: 232454
  Description of Artificial Sequence: Synthetic oligonucleotide

SEQ ID NO: 355697 - DNA, 25 bp, Artificial Sequence
  Description of Artificial Sequence: Synthetic oligonucleotide
agctgtcttcccagcccaccatccc

SEQ ID NO: 355698 - DNA, 40 bp, Artificial Sequence; identical to SEQ ID NO: 232455
  Description of Artificial Sequence: Synthetic oligonucleotide

SEQ ID NO: 355699 - DNA, 24 bp, Artificial Sequence
  Description of Artificial Sequence: Synthetic oligonucleotide
gctgtcttcccagcccaccatccc

SEQ ID NO: 355700 - DNA, 42 bp, Artificial Sequence; identical to SEQ ID NO: 232456
  Description of Artificial Sequence: Synthetic oligonucleotide

SEQ ID NO: 355701 - DNA, 26 bp, Artificial Sequence
  Description of Artificial Sequence: Synthetic oligonucleotide
ctgtcttcccagcccaccatccccat

SEQ ID NO: 355702 - DNA, 43 bp, Artificial Sequence; identical to SEQ ID NO: 232457
  Description of Artificial Sequence: Synthetic oligonucleotide

SEQ ID NO: 355703 - DNA, 26 bp, Artificial Sequence
  Description of Artificial Sequence: Synthetic oligonucleotide
tgtcttcccagcccaccatccccatc

SEQ ID NO: 355704 - DNA, 43 bp, Artificial Sequence; identical to SEQ ID NO: 232458
  Description of Artificial Sequence: Synthetic oligonucleotide

SEQ ID NO: 355705 - DNA, 25 bp, Artificial Sequence
  Description of Artificial Sequence: Synthetic oligonucleotide
gtcttcccagcccaccatccccatc

SEQ ID NO: 355706 - DNA, 47 bp, Artificial Sequence; identical to SEQ ID NO: 232459
  Description of Artificial Sequence: Synthetic oligonucleotide

SEQ ID NO: 355707 - DNA, 26 bp, Artificial Sequence
  Description of Artificial Sequence: Synthetic oligonucleotide
tcttcccagcccaccatccccatcgt

SEQ ID NO: 355708 - DNA, 46 bp, Artificial Sequence; identical to SEQ ID NO: 232460
  Description of Artificial Sequence: Synthetic oligonucleotide

SEQ ID NO: 355709 - DNA, 25 bp, Artificial Sequence
  Description of Artificial Sequence: Synthetic oligonucleotide
cttcccagcccaccatccccatcgt

SEQ ID NO: 355710 - DNA, 46 bp, Artificial Sequence; identical to SEQ ID NO: 232461
  Description of Artificial Sequence: Synthetic oligonucleotide

SEQ ID NO: 355711 - DNA, 25 bp, Artificial Sequence
  Description of Artificial Sequence: Synthetic oligonucleotide
ttcccagcccaccatccccatcgtg

SEQ ID NO: 355712 - DNA, 45 bp, Artificial Sequence; identical to SEQ ID NO: 232462
  Description of Artificial Sequence: Synthetic oligonucleotide

SEQ ID NO: 355713 - DNA, 24 bp, Artificial Sequence
  Description of Artificial Sequence: Synthetic oligonucleotide
tcccagcccaccatccccatcgtg

SEQ ID NO: 355714 - DNA, 44 bp, Artificial Sequence; identical to SEQ ID NO: 232463
  Description of Artificial Sequence: Synthetic oligonucleotide

SEQ ID NO: 355715 - DNA, 23 bp, Artificial Sequence
  Description of Artificial Sequence: Synthetic oligonucleotide
cccagcccaccatccccatcgtg

SEQ ID NO: 355716 - DNA, 43 bp, Artificial Sequence; identical to SEQ ID NO: 232464
  Description of Artificial Sequence: Synthetic oligonucleotide

SEQ ID NO: 355717 - DNA, 23 bp, Artificial Sequence
  Description of Artificial Sequence: Synthetic oligonucleotide
ccagcccaccatccccatcgtgg

SEQ ID NO: 355718 - DNA, 42 bp, Artificial Sequence; identical to SEQ ID NO: 232465
  Description of Artificial Sequence: Synthetic oligonucleotide

SEQ ID NO: 355719 - DNA, 23 bp, Artificial Sequence
  Description of Artificial Sequence: Synthetic oligonucleotide
cagcccaccatccccatcgtggg

SEQ ID NO: 355720 - DNA, 41 bp, Artificial Sequence; identical to SEQ ID NO: 232466
  Description of Artificial Sequence: Synthetic oligonucleotide

SEQ ID NO: 355721 - DNA, 25 bp, Artificial Sequence
  Description of Artificial Sequence: Synthetic oligonucleotide
agcccaccatccccatcgtgggcat

SEQ ID NO: 355722 - DNA, 41 bp, Artificial Sequence; identical to SEQ ID NO: 232467
  Description of Artificial Sequence: Synthetic oligonucleotide

SEQ ID NO: 355723 - DNA, 24 bp, Artificial Sequence
  Description of Artificial Sequence: Synthetic oligonucleotide
gcccaccatccccatcgtgggcat

SEQ ID NO: 355724 - DNA, 40 bp, Artificial Sequence; identical to SEQ ID NO: 232468
  Description of Artificial Sequence: Synthetic oligonucleotide

SEQ ID NO: 355725 - DNA, 27 bp, Artificial Sequence
  Description of Artificial Sequence: Synthetic oligonucleotide
cccaccatccccatcgtgggcatcatt

SEQ ID NO: 355726 - DNA, 39 bp, Artificial Sequence; identical to SEQ ID NO: 232469
  Description of Artificial Sequence: Synthetic oligonucleotide

SEQ ID NO: 355727 - DNA, 27 bp, Artificial Sequence
  Description of Artificial Sequence: Synthetic oligonucleotide
ccaccatccccatcgtgggcatcattg

SEQ ID NO: 355728 - DNA, 38 bp, Artificial Sequence; identical to SEQ ID NO: 232470
  Description of Artificial Sequence: Synthetic oligonucleotide

SEQ ID NO: 355729 - DNA, 27 bp, Artificial Sequence
  Description of Artificial Sequence: Synthetic oligonucleotide
caccatccccatcgtgggcatcattgc

SEQ ID NO: 355730 - DNA, 41 bp, Artificial Sequence; identical to SEQ ID NO: 232471
  Description of Artificial Sequence: Synthetic oligonucleotide

SEQ ID NO: 355731 - DNA, 28 bp, Artificial Sequence
  Description of Artificial Sequence: Synthetic oligonucleotide
accatccccatcgtgggcatcattgctg

SEQ ID NO: 355732 - DNA, 40 bp, Artificial Sequence; identical to SEQ ID NO: 232472
  Description of Artificial Sequence: Synthetic oligonucleotide

SEQ ID NO: 355733 - DNA, 27 bp, Artificial Sequence
  Description of Artificial Sequence: Synthetic oligonucleotide
ccatccccatcgtgggcatcattgctg

SEQ ID NO: 355734 - DNA, 42 bp, Artificial Sequence; identical to SEQ ID NO: 232473
  Description of Artificial Sequence: Synthetic oligonucleotide

SEQ ID NO: 355735 - DNA, 27 bp, Artificial Sequence
  Description of Artificial Sequence: Synthetic oligonucleotide
catccccatcgtgggcatcattgctgg

SEQ ID NO: 355736 - DNA, 41 bp, Artificial Sequence; identical to SEQ ID NO: 232474
  Description of Artificial Sequence: Synthetic oligonucleotide

SEQ ID NO: 355737 - DNA, 27 bp, Artificial Sequence
  Description of Artificial Sequence: Synthetic oligonucleotide
atccccatcgtgggcatcattgctggc

SEQ ID NO: 355738 - DNA, 40 bp, Artificial Sequence; identical to SEQ ID NO: 232475
  Description of Artificial Sequence: Synthetic oligonucleotide

SEQ ID NO: 355739 - DNA, 26 bp, Artificial Sequence
  Description of Artificial Sequence: Synthetic oligonucleotide
tccccatcgtgggcatcattgctggc

SEQ ID NO: 355740 - DNA, 39 bp, Artificial Sequence; identical to SEQ ID NO: 232476
  Description of Artificial Sequence: Synthetic oligonucleotide

SEQ ID NO: 355741 - DNA, 25 bp, Artificial Sequence
  Description of Artificial Sequence: Synthetic oligonucleotide
ccccatcgtgggcatcattgctggc

SEQ ID NO: 355742 - DNA, 39 bp, Artificial Sequence; identical to SEQ ID NO: 232477
  Description of Artificial Sequence: Synthetic oligonucleotide

SEQ ID NO: 355743 - DNA, 26 bp, Artificial Sequence
  Description of Artificial Sequence: Synthetic oligonucleotide
cccatcgtgggcatcattgctggcct

SEQ ID NO: 355744 - DNA, 38 bp, Artificial Sequence; identical to SEQ ID NO: 232478
  Description of Artificial Sequence: Synthetic oligonucleotide

SEQ ID NO: 355745 - DNA, 26 bp, Artificial Sequence
  Description of Artificial Sequence: Synthetic oligonucleotide
ccatcgtgggcatcattgctggcctg

SEQ ID NO: 355746 - DNA, 37 bp, Artificial Sequence; identical to SEQ ID NO: 232479
  Description of Artificial Sequence: Synthetic oligonucleotide

SEQ ID NO: 355747 - DNA, 27 bp, Artificial Sequence
  Description of Artificial Sequence: Synthetic oligonucleotide
catcgtgggcatcattgctggcctggt

SEQ ID NO: 355748 - DNA, 38 bp, Artificial Sequence; identical to SEQ ID NO: 232480
  Description of Artificial Sequence: Synthetic oligonucleotide

SEQ ID NO: 355749 - DNA, 28 bp, Artificial Sequence
  Description of Artificial Sequence: Synthetic oligonucleotide
atcgtgggcatcattgctggcctggttc

SEQ ID NO: 355750 - DNA, 39 bp, Artificial Sequence; identical to SEQ ID NO: 232481
  Description of Artificial Sequence: Synthetic oligonucleotide

SEQ ID NO: 355751 - DNA, 27 bp, Artificial Sequence
  Description of Artificial Sequence: Synthetic oligonucleotide
tcgtgggcatcattgctggcctggttc

SEQ ID NO: 355752 - DNA, 38 bp, Artificial Sequence; identical to SEQ ID NO: 232482
  Description of Artificial Sequence: Synthetic oligonucleotide

SEQ ID NO: 355753 - DNA, 27 bp, Artificial Sequence
  Description of Artificial Sequence: Synthetic oligonucleotide
cgtgggcatcattgctggcctggttct

SEQ ID NO: 355754 - DNA, 38 bp, Artificial Sequence; identical to SEQ ID NO: 232483
  Description of Artificial Sequence: Synthetic oligonucleotide

SEQ ID NO: 355755 - DNA, 27 bp, Artificial Sequence
  Description of Artificial Sequence: Synthetic oligonucleotide
gtgggcatcattgctggcctggttctc

SEQ ID NO: 355756 - DNA, 37 bp, Artificial Sequence; identical to SEQ ID NO: 232484
  Description of Artificial Sequence: Synthetic oligonucleotide

SEQ ID NO: 355757 - DNA, 27 bp, Artificial Sequence
  Description of Artificial Sequence: Synthetic oligonucleotide
tgggcatcattgctggcctggttctcc

SEQ ID NO: 355758 - DNA, 36 bp, Artificial Sequence; identical to SEQ ID NO: 232485
  Description of Artificial Sequence: Synthetic oligonucleotide

SEQ ID NO: 355759 - DNA, 27 bp, Artificial Sequence
  Description of Artificial Sequence: Synthetic oligonucleotide
gggcatcattgctggcctggttctcct

SEQ ID NO: 355760 - DNA, 36 bp, Artificial Sequence; identical to SEQ ID NO: 232486
  Description of Artificial Sequence: Synthetic oligonucleotide

SEQ ID NO: 355761 - DNA, 28 bp, Artificial Sequence
  Description of Artificial Sequence: Synthetic oligonucleotide
ggcatcattgctggcctggttctccttg

SEQ ID NO: 355762 - DNA, 35 bp, Artificial Sequence; identical to SEQ ID NO: 232487
  Description of Artificial Sequence: Synthetic oligonucleotide

SEQ ID NO: 355763 - DNA, 28 bp, Artificial Sequence
  Description of Artificial Sequence: Synthetic oligonucleotide
gcatcattgctggcctggttctccttgg

SEQ ID NO: 355764 - DNA, 36 bp, Artificial Sequence; identical to SEQ ID NO: 232488
  Description of Artificial Sequence: Synthetic oligonucleotide

SEQ ID NO: 355765 - DNA, 29 bp, Artificial Sequence
  Description of Artificial Sequence: Synthetic oligonucleotide
catcattgctggcctggttctccttggag

SEQ ID NO: 355766 - DNA, 35 bp, Artificial Sequence; identical to SEQ ID NO: 232489
  Description of Artificial Sequence: Synthetic oligonucleotide

SEQ ID NO: 355767 - DNA, 29 bp, Artificial Sequence
  Description of Artificial Sequence: Synthetic oligonucleotide
atcattgctggcctggttctccttggagc

SEQ ID NO: 355768 - DNA, 34 bp, Artificial Sequence; identical to SEQ ID NO: 232490
  Description of Artificial Sequence: Synthetic oligonucleotide

SEQ ID NO: 355769 - DNA, 28 bp, Artificial Sequence
  Description of Artificial Sequence: Synthetic oligonucleotide
tcattgctggcctggttctccttggagc

SEQ ID NO: 355770 - DNA, 33 bp, Artificial Sequence; identical to SEQ ID NO: 232491
  Description of Artificial Sequence: Synthetic oligonucleotide

SEQ ID NO: 355771 - DNA, 27 bp, Artificial Sequence
  Description of Artificial Sequence: Synthetic oligonucleotide
cattgctggcctggttctccttggagc

SEQ ID NO: 355772 - DNA, 32 bp, Artificial Sequence; identical to SEQ ID NO: 232492
  Description of Artificial Sequence: Synthetic oligonucleotide

SEQ ID NO: 355773 - DNA, 28 bp, Artificial Sequence
  Description of Artificial Sequence: Synthetic oligonucleotide
attgctggcctggttctccttggagctg

SEQ ID NO: 355774 - DNA, 31 bp, Artificial Sequence; identical to SEQ ID NO: 232493
  Description of Artificial Sequence: Synthetic oligonucleotide

SEQ ID NO: 355775 - DNA, 27 bp, Artificial Sequence
  Description of Artificial Sequence: Synthetic oligonucleotide
ttgctggcctggttctccttggagctg

SEQ ID NO: 355776 - DNA, 32 bp, Artificial Sequence; identical to SEQ ID NO: 232494
  Description of Artificial Sequence: Synthetic oligonucleotide

SEQ ID NO: 355777 - DNA, 27 bp, Artificial Sequence
  Description of Artificial Sequence: Synthetic oligonucleotide
tgctggcctggttctccttggagctgt

SEQ ID NO: 355778 - DNA, 32 bp, Artificial Sequence; identical to SEQ ID NO: 232495
  Description of Artificial Sequence: Synthetic oligonucleotide

SEQ ID NO: 355779 - DNA, 26 bp, Artificial Sequence
  Description of Artificial Sequence: Synthetic oligonucleotide
gctggcctggttctccttggagctgt

SEQ ID NO: 355780 - DNA, 31 bp, Artificial Sequence; identical to SEQ ID NO: 232496
  Description of Artificial Sequence: Synthetic oligonucleotide

SEQ ID NO: 355781 - DNA, 27 bp, Artificial Sequence
  Description of Artificial Sequence: Synthetic oligonucleotide
ctggcctggttctccttggagctgtga

SEQ ID NO: 355782 - DNA, 30 bp, Artificial Sequence; identical to SEQ ID NO: 232497
  Description of Artificial Sequence: Synthetic oligonucleotide

SEQ ID NO: 355783 - DNA, 28 bp, Artificial Sequence
  Description of Artificial Sequence: Synthetic oligonucleotide
tggcctggttctccttggagctgtgatc

SEQ ID NO: 355784 - DNA, 30 bp, Artificial Sequence; identical to SEQ ID NO: 232498
  Description of Artificial Sequence: Synthetic oligonucleotide

SEQ ID NO: 355785 - DNA, 27 bp, Artificial Sequence
  Description of Artificial Sequence: Synthetic oligonucleotide
ggcctggttctccttggagctgtgatc

SEQ ID NO: 355786 - DNA, 29 bp, Artificial Sequence
  Description of Artificial Sequence: Synthetic oligonucleotide
ggaaatggcaaagtaggagacggactggc

SEQ ID NO: 355787 - DNA, 28 bp, Artificial Sequence
  Description of Artificial Sequence: Synthetic oligonucleotide
gcctggttctccttggagctgtgatcac

SEQ ID NO: 355788 - DNA, 29 bp, Artificial Sequence
  Description of Artificial Sequence: Synthetic oligonucleotide
gaaatggcaaagtaggagacggactggcg

SEQ ID NO: 355789 - DNA, 29 bp, Artificial Sequence
  Description of Artificial Sequence: Synthetic oligonucleotide
cctggttctccttggagctgtgatcactg

SEQ ID NO: 355790 - DNA, 29 bp, Artificial Sequence
  Description of Artificial Sequence: Synthetic oligonucleotide
aaatggcaaagtaggagacggactggcgg

SEQ ID NO: 355791 - DNA, 29 bp, Artificial Sequence
  Description of Artificial Sequence: Synthetic oligonucleotide
ctggttctccttggagctgtgatcactgg

SEQ ID NO: 355792 - DNA, 28 bp, Artificial Sequence
  Description of Artificial Sequence: Synthetic oligonucleotide
aatggcaaagtaggagacggactggcgg

SEQ ID NO: 355793 - DNA, 30 bp, Artificial Sequence; identical to SEQ ID NO: 947
  Description of Artificial Sequence: Synthetic oligonucleotide

SEQ ID NO: 355794 - DNA, 27 bp, Artificial Sequence
  Description of Artificial Sequence: Synthetic oligonucleotide
atggcaaagtaggagacggactggcgg

SEQ ID NO: 355795 - DNA, 29 bp, Artificial Sequence
  Description of Artificial Sequence: Synthetic oligonucleotide
ggttctccttggagctgtgatcactggag

SEQ ID NO: 355796 - DNA, 26 bp, Artificial Sequence
  Description of Artificial Sequence: Synthetic oligonucleotide
tggcaaagtaggagacggactggcgg

SEQ ID NO: 355797 - DNA, 29 bp, Artificial Sequence
  Description of Artificial Sequence: Synthetic oligonucleotide
gttctccttggagctgtgatcactggagc

SEQ ID NO: 355798 - DNA, 25 bp, Artificial Sequence
  Description of Artificial Sequence: Synthetic oligonucleotide
ggcaaagtaggagacggactggcgg

SEQ ID NO: 355799 - DNA, 30 bp, Artificial Sequence; identical to SEQ ID NO: 950
  Description of Artificial Sequence: Synthetic oligonucleotide

SEQ ID NO: 355800 - DNA, 27 bp, Artificial Sequence
  Description of Artificial Sequence: Synthetic oligonucleotide
gcaaagtaggagacggactggcggcta

SEQ ID NO: 355801 - DNA, 29 bp, Artificial Sequence
  Description of Artificial Sequence: Synthetic oligonucleotide
tctccttggagctgtgatcactggagctg

SEQ ID NO: 355802 - DNA, 27 bp, Artificial Sequence
  Description of Artificial Sequence: Synthetic oligonucleotide
caaagtaggagacggactggcggctag

SEQ ID NO: 355803 - DNA, 28 bp, Artificial Sequence
  Description of Artificial Sequence: Synthetic oligonucleotide
ctccttggagctgtgatcactggagctg

SEQ ID NO: 355804 - DNA, 29 bp, Artificial Sequence
  Description of Artificial Sequence: Synthetic oligonucleotide
aaagtaggagacggactggcggctagaag

SEQ ID NO: 355805 - DNA, 29 bp, Artificial Sequence
  Description of Artificial Sequence: Synthetic oligonucleotide
tccttggagctgtgatcactggagctgtg

SEQ ID NO: 355806 - DNA, 28 bp, Artificial Sequence
  Description of Artificial Sequence: Synthetic oligonucleotide
aagtaggagacggactggcggctagaag

SEQ ID NO: 355807 - DNA, 28 bp, Artificial Sequence
  Description of Artificial Sequence: Synthetic oligonucleotide
ccttggagctgtgatcactggagctgtg

SEQ ID NO: 355808 - DNA, 27 bp, Artificial Sequence
  Description of Artificial Sequence: Synthetic oligonucleotide
agtaggagacggactggcggctagaag

SEQ ID NO: 355809 - DNA, 28 bp, Artificial Sequence
  Description of Artificial Sequence: Synthetic oligonucleotide
cttggagctgtgatcactggagctgtgg

SEQ ID NO: 355810 - DNA, 27 bp, Artificial Sequence
  Description of Artificial Sequence: Synthetic oligonucleotide
gtaggagacggactggcggctagaaga

SEQ ID NO: 355811 - DNA, 29 bp, Artificial Sequence
  Description of Artificial Sequence: Synthetic oligonucleotide
ttggagctgtgatcactggagctgtggtc

SEQ ID NO: 355812 - DNA, 31 bp, Artificial Sequence; identical to SEQ ID NO: 232512
  Description of Artificial Sequence: Synthetic oligonucleotide

SEQ ID NO: 355813 - DNA, 28 bp, Artificial Sequence
  Description of Artificial Sequence: Synthetic oligonucleotide
tggagctgtgatcactggagctgtggtc

SEQ ID NO: 355814 - DNA, 30 bp, Artificial Sequence; identical to SEQ ID NO: 232513
  Description of Artificial Sequence: Synthetic oligonucleotide

SEQ ID NO: 355815 - DNA, 27 bp, Artificial Sequence
  Description of Artificial Sequence: Synthetic oligonucleotide
ggagctgtgatcactggagctgtggtc

SEQ ID NO: 355816 - DNA, 29 bp, Artificial Sequence
  Description of Artificial Sequence: Synthetic oligonucleotide
ggagacggactggcggctagaagaatttc

SEQ ID NO: 355817 - DNA, 27 bp, Artificial Sequence
  Description of Artificial Sequence: Synthetic oligonucleotide
gagctgtgatcactggagctgtggtcg

SEQ ID NO: 355818 - DNA, 29 bp, Artificial Sequence
  Description of Artificial Sequence: Synthetic oligonucleotide
gagacggactggcggctagaagaatttcg

SEQ ID NO: 355819 - DNA, 27 bp, Artificial Sequence
  Description of Artificial Sequence: Synthetic oligonucleotide
agctgtgatcactggagctgtggtcgc

SEQ ID NO: 355820 - DNA, 30 bp, Artificial Sequence; identical to SEQ ID NO: 232516
  Description of Artificial Sequence: Synthetic oligonucleotide

SEQ ID NO: 355821 - DNA, 27 bp, Artificial Sequence
  Description of Artificial Sequence: Synthetic oligonucleotide
gctgtgatcactggagctgtggtcgct

SEQ ID NO: 355822 - DNA, 29 bp, Artificial Sequence
  Description of Artificial Sequence: Synthetic oligonucleotide
gacggactggcggctagaagaatttcgac

SEQ ID NO: 355823 - DNA, 27 bp, Artificial Sequence
  Description of Artificial Sequence: Synthetic oligonucleotide
ctgtgatcactggagctgtggtcgctg

SEQ ID NO: 355824 - DNA, 29 bp, Artificial Sequence
  Description of Artificial Sequence: Synthetic oligonucleotide
acggactggcggctagaagaatttcgacg

SEQ ID NO: 355825 - DNA, 27 bp, Artificial Sequence
  Description of Artificial Sequence: Synthetic oligonucleotide
tgtgatcactggagctgtggtcgctgc

SEQ ID NO: 355826 - DNA, 28 bp, Artificial Sequence
  Description of Artificial Sequence: Synthetic oligonucleotide
cggactggcggctagaagaatttcgacg

SEQ ID NO: 355827 - DNA, 26 bp, Artificial Sequence
  Description of Artificial Sequence: Synthetic oligonucleotide
gtgatcactggagctgtggtcgctgc

SEQ ID NO: 355828 - DNA, 32 bp, Artificial Sequence; identical to SEQ ID NO: 232520
  Description of Artificial Sequence: Synthetic oligonucleotide

SEQ ID NO: 355829 - DNA, 26 bp, Artificial Sequence
  Description of Artificial Sequence: Synthetic oligonucleotide
tgatcactggagctgtggtcgctgcc

SEQ ID NO: 355830 - DNA, 32 bp, Artificial Sequence; identical to SEQ ID NO: 232521
  Description of Artificial Sequence: Synthetic oligonucleotide

SEQ ID NO: 355831 - DNA, 25 bp, Artificial Sequence
  Description of Artificial Sequence: Synthetic oligonucleotide
gatcactggagctgtggtcgctgcc

SEQ ID NO: 355832 - DNA, 32 bp, Artificial Sequence; identical to SEQ ID NO: 232522
  Description of Artificial Sequence: Synthetic oligonucleotide

SEQ ID NO: 355833 - DNA, 26 bp, Artificial Sequence
  Description of Artificial Sequence: Synthetic oligonucleotide
atcactggagctgtggtcgctgccgt

SEQ ID NO: 355834 - DNA, 31 bp, Artificial Sequence; identical to SEQ ID NO: 232523
  Description of Artificial Sequence: Synthetic oligonucleotide

SEQ ID NO: 355835 - DNA, 25 bp, Artificial Sequence
  Description of Artificial Sequence: Synthetic oligonucleotide
tcactggagctgtggtcgctgccgt

SEQ ID NO: 355836 - DNA, 32 bp, Artificial Sequence; identical to SEQ ID NO: 232524
  Description of Artificial Sequence: Synthetic oligonucleotide

SEQ ID NO: 355837 - DNA, 24 bp, Artificial Sequence
  Description of Artificial Sequence: Synthetic oligonucleotide
cactggagctgtggtcgctgccgt

SEQ ID NO: 355838 - DNA, 31 bp, Artificial Sequence; identical to SEQ ID NO: 232525
  Description of Artificial Sequence: Synthetic oligonucleotide

SEQ ID NO: 355839 - DNA, 26 bp, Artificial Sequence
  Description of Artificial Sequence: Synthetic oligonucleotide
actggagctgtggtcgctgccgtgat

SEQ ID NO: 355840 - DNA, 31 bp, Artificial Sequence; identical to SEQ ID NO: 232526
  Description of Artificial Sequence: Synthetic oligonucleotide

SEQ ID NO: 355841 - DNA, 25 bp, Artificial Sequence
  Description of Artificial Sequence: Synthetic oligonucleotide
ctggagctgtggtcgctgccgtgat

SEQ ID NO: 355842 - DNA, 34 bp, Artificial Sequence; identical to SEQ ID NO: 232527
  Description of Artificial Sequence: Synthetic oligonucleotide

SEQ ID NO: 355843 - DNA, 26 bp, Artificial Sequence
  Description of Artificial Sequence: Synthetic oligonucleotide
tggagctgtggtcgctgccgtgatgt

SEQ ID NO: 355844 - DNA, 35 bp, Artificial Sequence; identical to SEQ ID NO: 232528
  Description of Artificial Sequence: Synthetic oligonucleotide

SEQ ID NO: 355845 - DNA, 25 bp, Artificial Sequence
  Description of Artificial Sequence: Synthetic oligonucleotide
ggagctgtggtcgctgccgtgatgt

SEQ ID NO: 355846 - DNA, 35 bp, Artificial Sequence; identical to SEQ ID NO: 232529
  Description of Artificial Sequence: Synthetic oligonucleotide

SEQ ID NO: 355847 - DNA, 25 bp, Artificial Sequence
  Description of Artificial Sequence: Synthetic oligonucleotide
gagctgtggtcgctgccgtgatgtg

SEQ ID NO: 355848 - DNA, 35 bp, Artificial Sequence; identical to SEQ ID NO: 232530
  Description of Artificial Sequence: Synthetic oligonucleotide

SEQ ID NO: 355849 - DNA, 26 bp, Artificial Sequence
  Description of Artificial Sequence: Synthetic oligonucleotide
agctgtggtcgctgccgtgatgtgga

SEQ ID NO: 355850 - DNA, 36 bp, Artificial Sequence; identical to SEQ ID NO: 232531
  Description of Artificial Sequence: Synthetic oligonucleotide

SEQ ID NO: 355851 - DNA, 25 bp, Artificial Sequence
  Description of Artificial Sequence: Synthetic oligonucleotide
gctgtggtcgctgccgtgatgtgga

SEQ ID NO: 355852 - DNA, 35 bp, Artificial Sequence; identical to SEQ ID NO: 232532
  Description of Artificial Sequence: Synthetic oligonucleotide

SEQ ID NO: 355853 - DNA, 25 bp, Artificial Sequence
  Description of Artificial Sequence: Synthetic oligonucleotide
ctgtggtcgctgccgtgatgtggag

SEQ ID NO: 355854 - DNA, 34 bp, Artificial Sequence; identical to SEQ ID NO: 232533
  Description of Artificial Sequence: Synthetic oligonucleotide

SEQ ID NO: 355855 - DNA, 26 bp, Artificial Sequence
  Description of Artificial Sequence: Synthetic oligonucleotide
tgtggtcgctgccgtgatgtggagga

SEQ ID NO: 355856 - DNA, 36 bp, Artificial Sequence; identical to SEQ ID NO: 232534
  Description of Artificial Sequence: Synthetic oligonucleotide

SEQ ID NO: 355857 - DNA, 25 bp, Artificial Sequence
  Description of Artificial Sequence: Synthetic oligonucleotide
gtggtcgctgccgtgatgtggagga

SEQ ID NO: 355858 - DNA, 35 bp, Artificial Sequence; identical to SEQ ID NO: 232535
  Description of Artificial Sequence: Synthetic oligonucleotide

SEQ ID NO: 355859 - DNA, 25 bp, Artificial Sequence
  Description of Artificial Sequence: Synthetic oligonucleotide
tggtcgctgccgtgatgtggaggag

SEQ ID NO: 355860 - DNA, 34 bp, Artificial Sequence; identical to SEQ ID NO: 232536
  Description of Artificial Sequence: Synthetic oligonucleotide

SEQ ID NO: 355861 - DNA, 24 bp, Artificial Sequence
  Description of Artificial Sequence: Synthetic oligonucleotide
ggtcgctgccgtgatgtggaggag

SEQ ID NO: 355862 - DNA, 34 bp, Artificial Sequence; identical to SEQ ID NO: 232537
  Description of Artificial Sequence: Synthetic oligonucleotide

SEQ ID NO: 355863 - DNA, 26 bp, Artificial Sequence
  Description of Artificial Sequence: Synthetic oligonucleotide
gtcgctgccgtgatgtggaggaggaa

SEQ ID NO: 355864 - DNA, 33 bp, Artificial Sequence; identical to SEQ ID NO: 232538
  Description of Artificial Sequence: Synthetic oligonucleotide

SEQ ID NO: 355865 - DNA, 27 bp, Artificial Sequence
  Description of Artificial Sequence: Synthetic oligonucleotide
tcgctgccgtgatgtggaggaggaaga

SEQ ID NO: 355866 - DNA, 32 bp, Artificial Sequence; identical to SEQ ID NO: 232539
  Description of Artificial Sequence: Synthetic oligonucleotide

SEQ ID NO: 355867 - DNA, 26 bp, Artificial Sequence
  Description of Artificial Sequence: Synthetic oligonucleotide
cgctgccgtgatgtggaggaggaaga

SEQ ID NO: 355868 - DNA, 31 bp, Artificial Sequence; identical to SEQ ID NO: 232540
  Description of Artificial Sequence: Synthetic oligonucleotide

SEQ ID NO: 355869 - DNA, 26 bp, Artificial Sequence
  Description of Artificial Sequence: Synthetic oligonucleotide
gctgccgtgatgtggaggaggaagag

SEQ ID NO: 355870 - DNA, 30 bp, Artificial Sequence; identical to SEQ ID NO: 232541
  Description of Artificial Sequence: Synthetic oligonucleotide

SEQ ID NO: 355871 - DNA, 27 bp, Artificial Sequence
  Description of Artificial Sequence: Synthetic oligonucleotide
ctgccgtgatgtggaggaggaagagct

SEQ ID NO: 355872 - DNA, 29 bp, Artificial Sequence
  Description of Artificial Sequence: Synthetic oligonucleotide
cgacgatttggcagctttgacgctcaagg

SEQ ID NO: 355873 - DNA, 27 bp, Artificial Sequence
  Description of Artificial Sequence: Synthetic oligonucleotide
tgccgtgatgtggaggaggaagagctc

SEQ ID NO: 355874 - DNA, 30 bp, Artificial Sequence; identical to SEQ ID NO: 232543
  Description of Artificial Sequence: Synthetic oligonucleotide

SEQ ID NO: 355875 - DNA, 27 bp, Artificial Sequence
  Description of Artificial Sequence: Synthetic oligonucleotide
gccgtgatgtggaggaggaagagctca

SEQ ID NO: 355876 - DNA, 30 bp, Artificial Sequence; identical to SEQ ID NO: 232544
  Description of Artificial Sequence: Synthetic oligonucleotide

SEQ ID NO: 355877 - DNA, 27 bp, Artificial Sequence
  Description of Artificial Sequence: Synthetic oligonucleotide
ccgtgatgtggaggaggaagagctcag

SEQ ID NO: 355878 - DNA, 29 bp, Artificial Sequence
  Description of Artificial Sequence: Synthetic oligonucleotide
cgatttggcagctttgacgctcaaggtcc

SEQ ID NO: 355879 - DNA, 30 bp, Artificial Sequence; identical to SEQ ID NO: 990
  Description of Artificial Sequence: Synthetic oligonucleotide

SEQ ID NO: 355880 - DNA, 32 bp, Artificial Sequence; identical to SEQ ID NO: 232546
  Description of Artificial Sequence: Synthetic oligonucleotide

SEQ ID NO: 355881 - DNA, 34 bp, Artificial Sequence; identical to SEQ ID NO: 991
  Description of Artificial Sequence: Synthetic oligonucleotide

SEQ ID NO: 355882 - DNA, 32 bp, Artificial Sequence; identical to SEQ ID NO: 232547
  Description of Artificial Sequence: Synthetic oligonucleotide

SEQ ID NO: 355883 - DNA, 34 bp, Artificial Sequence; identical to SEQ ID NO: 992
  Description of Artificial Sequence: Synthetic oligonucleotide

SEQ ID NO: 355884 - DNA, 31 bp, Artificial Sequence; identical to SEQ ID NO: 232548
  Description of Artificial Sequence: Synthetic oligonucleotide

SEQ ID NO: 355885 - DNA, 33 bp, Artificial Sequence; identical to SEQ ID NO: 993
  Description of Artificial Sequence: Synthetic oligonucleotide

SEQ ID NO: 355886 - DNA, 30 bp, Artificial Sequence; identical to SEQ ID NO: 232549
  Description of Artificial Sequence: Synthetic oligonucleotide

SEQ ID NO: 355887 - DNA, 34 bp, Artificial Sequence; identical to SEQ ID NO: 994
  Description of Artificial Sequence: Synthetic oligonucleotide

SEQ ID NO: 355888 - DNA, 29 bp, Artificial Sequence
  Description of Artificial Sequence: Synthetic oligonucleotide
tggcagctttgacgctcaaggtccattgg

SEQ ID NO: 355889 - DNA, 33 bp, Artificial Sequence; identical to SEQ ID NO: 995
  Description of Artificial Sequence: Synthetic oligonucleotide

SEQ ID NO: 355890 - DNA, 28 bp, Artificial Sequence
  Description of Artificial Sequence: Synthetic oligonucleotide
ggcagctttgacgctcaaggtccattgg

SEQ ID NO: 355891 - DNA, 32 bp, Artificial Sequence; identical to SEQ ID NO: 996
  Description of Artificial Sequence: Synthetic oligonucleotide

SEQ ID NO: 355892 - DNA, 28 bp, Artificial Sequence
  Description of Artificial Sequence: Synthetic oligonucleotide
gcagctttgacgctcaaggtccattggc

SEQ ID NO: 355893 - DNA, 32 bp, Artificial Sequence; identical to SEQ ID NO: 997
  Description of Artificial Sequence: Synthetic oligonucleotide

SEQ ID NO: 355894 - DNA, 28 bp, Artificial Sequence
  Description of Artificial Sequence: Synthetic oligonucleotide
cagctttgacgctcaaggtccattggcc

SEQ ID NO: 355895 - DNA, 31 bp, Artificial Sequence; identical to SEQ ID NO: 998
  Description of Artificial Sequence: Synthetic oligonucleotide

SEQ ID NO: 355896 - DNA, 30 bp, Artificial Sequence; identical to SEQ ID NO: 232554
  Description of Artificial Sequence: Synthetic oligonucleotide

SEQ ID NO: 355897 - DNA, 31 bp, Artificial Sequence; identical to SEQ ID NO: 999
  Description of Artificial Sequence: Synthetic oligonucleotide

SEQ ID NO: 355898 - DNA, 29 bp, Artificial Sequence
  Description of Artificial Sequence: Synthetic oligonucleotide
gctttgacgctcaaggtccattggccatc

SEQ ID NO: 355899 - DNA, 32 bp, Artificial Sequence; identical to SEQ ID NO: 1000
  Description of Artificial Sequence: Synthetic oligonucleotide

SEQ ID NO: 355900 - DNA, 32 bp, Artificial Sequence; identical to SEQ ID NO: 232556
  Description of Artificial Sequence: Synthetic oligonucleotide

SEQ ID NO: 355901 - DNA, 31 bp, Artificial Sequence; identical to SEQ ID NO: 1001
  Description of Artificial Sequence: Synthetic oligonucleotide

SEQ ID NO: 355902 - DNA, 32 bp, Artificial Sequence; identical to SEQ ID NO: 232557
  Description of Artificial Sequence: Synthetic oligonucleotide

SEQ ID NO: 355903 - DNA, 34 bp, Artificial Sequence; identical to SEQ ID NO: 1002
  Description of Artificial Sequence: Synthetic oligonucleotide

SEQ ID NO: 355904 - DNA, 31 bp, Artificial Sequence; identical to SEQ ID NO: 232558
  Description of Artificial Sequence: Synthetic oligonucleotide

SEQ ID NO: 355905 - DNA, 35 bp, Artificial Sequence; identical to SEQ ID NO: 1003
  Description of Artificial Sequence: Synthetic oligonucleotide

SEQ ID NO: 355906 - DNA, 30 bp, Artificial Sequence; identical to SEQ ID NO: 232559
  Description of Artificial Sequence: Synthetic oligonucleotide

SEQ ID NO: 355907 - DNA, 34 bp, Artificial Sequence; identical to SEQ ID NO: 1004
  Description of Artificial Sequence: Synthetic oligonucleotide

SEQ ID NO: 355908 - DNA, 29 bp, Artificial Sequence
  Description of Artificial Sequence: Synthetic oligonucleotide
gacgctcaaggtccattggccatcatagc

SEQ ID NO: 355909 - DNA, 35 bp, Artificial Sequence; identical to SEQ ID NO: 1005
  Description of Artificial Sequence: Synthetic oligonucleotide

SEQ ID NO: 355910 - DNA, 30 bp, Artificial Sequence; identical to SEQ ID NO: 232561
  Description of Artificial Sequence: Synthetic oligonucleotide

SEQ ID NO: 355911 - DNA, 36 bp, Artificial Sequence; identical to SEQ ID NO: 1006
  Description of Artificial Sequence: Synthetic oligonucleotide

SEQ ID NO: 355912 - DNA, 29 bp, Artificial Sequence
  Description of Artificial Sequence: Synthetic oligonucleotide
cgctcaaggtccattggccatcatagctg

SEQ ID NO: 355913 - DNA, 35 bp, Artificial Sequence; identical to SEQ ID NO: 1007
  Description of Artificial Sequence: Synthetic oligonucleotide

SEQ ID NO: 355914 - DNA, 30 bp, Artificial Sequence; identical to SEQ ID NO: 232563
  Description of Artificial Sequence: Synthetic oligonucleotide

SEQ ID NO: 355915 - DNA, 34 bp, Artificial Sequence; identical to SEQ ID NO: 1008
  Description of Artificial Sequence: Synthetic oligonucleotide

SEQ ID NO: 355916 - DNA, 30 bp, Artificial Sequence; identical to SEQ ID NO: 232564
  Description of Artificial Sequence: Synthetic oligonucleotide

SEQ ID NO: 355917 - DNA, 34 bp, Artificial Sequence; identical to SEQ ID NO: 1009
  Description of Artificial Sequence: Synthetic oligonucleotide

SEQ ID NO: 355918 - DNA, 31 bp, Artificial Sequence; identical to SEQ ID NO: 232565
  Description of Artificial Sequence: Synthetic oligonucleotide

SEQ ID NO: 355919 - DNA, 33 bp, Artificial Sequence; identical to SEQ ID NO: 1010
  Description of Artificial Sequence: Synthetic oligonucleotide

SEQ ID NO: 355920 - DNA, 30 bp, Artificial Sequence; identical to SEQ ID NO: 232566
  Description of Artificial Sequence: Synthetic oligonucleotide

SEQ ID NO: 355921 - DNA, 33 bp, Artificial Sequence; identical to SEQ ID NO: 1011
  Description of Artificial Sequence: Synthetic oligonucleotide

SEQ ID NO: 355922 - DNA, 33 bp, Artificial Sequence; identical to SEQ ID NO: 232567
  Description of Artificial Sequence: Synthetic oligonucleotide

SEQ ID NO: 355923 - DNA, 34 bp, Artificial Sequence; identical to SEQ ID NO: 1012
  Description of Artificial Sequence: Synthetic oligonucleotide

SEQ ID NO: 355924 - DNA, 32 bp, Artificial Sequence; identical to SEQ ID NO: 232568
  Description of Artificial Sequence: Synthetic oligonucleotide

SEQ ID NO: 355925 - DNA, 33 bp, Artificial Sequence; identical to SEQ ID NO: 1013
  Description of Artificial Sequence: Synthetic oligonucleotide

SEQ ID NO: 355926 - DNA, 31 bp, Artificial Sequence; identical to SEQ ID NO: 232569
  Description of Artificial Sequence: Synthetic oligonucleotide

SEQ ID NO: 355927 - DNA, 33 bp, Artificial Sequence; identical to SEQ ID NO: 1014
  Description of Artificial Sequence: Synthetic oligonucleotide

SEQ ID NO: 355928 - DNA, 31 bp, Artificial Sequence; identical to SEQ ID NO: 232570
  Description of Artificial Sequence: Synthetic oligonucleotide

SEQ ID NO: 355929 - DNA, 32 bp, Artificial Sequence; identical to SEQ ID NO: 1015
  Description of Artificial Sequence: Synthetic oligonucleotide

SEQ ID NO: 355930 - DNA, 31 bp, Artificial Sequence; identical to SEQ ID NO: 232571
  Description of Artificial Sequence: Synthetic oligonucleotide

SEQ ID NO: 355931 - DNA, 34 bp, Artificial Sequence; identical to SEQ ID NO: 1016
  Description of Artificial Sequence: Synthetic oligonucleotide

SEQ ID NO: 355932 - DNA, 30 bp, Artificial Sequence; identical to SEQ ID NO: 232572
  Description of Artificial Sequence: Synthetic oligonucleotide

SEQ ID NO: 355933 - DNA, 33 bp, Artificial Sequence; identical to SEQ ID NO: 1017
  Description of Artificial Sequence: Synthetic oligonucleotide

SEQ ID NO: 355934 - DNA, 32 bp, Artificial Sequence; identical to SEQ ID NO: 232573
  Description of Artificial Sequence: Synthetic oligonucleotide

SEQ ID NO: 355935 - DNA, 32 bp, Artificial Sequence; identical to SEQ ID NO: 1018
  Description of Artificial Sequence: Synthetic oligonucleotide

SEQ ID NO: 355936 - DNA, 32 bp, Artificial Sequence; identical to SEQ ID NO: 232574
  Description of Artificial Sequence: Synthetic oligonucleotide

SEQ ID NO: 355937 - DNA, 31 bp, Artificial Sequence; identical to SEQ ID NO: 1019
  Description of Artificial Sequence: Synthetic oligonucleotide

SEQ ID NO: 355938 - DNA, 31 bp, Artificial Sequence; identical to SEQ ID NO: 232575
  Description of Artificial Sequence: Synthetic oligonucleotide

SEQ ID NO: 355939 - DNA, 31 bp, Artificial Sequence; identical to SEQ ID NO: 1020
  Description of Artificial Sequence: Synthetic oligonucleotide

SEQ ID NO: 355940 - DNA, 30 bp, Artificial Sequence; identical to SEQ ID NO: 232576
  Description of Artificial Sequence: Synthetic oligonucleotide

SEQ ID NO: 355941 - DNA, 30 bp, Artificial Sequence; identical to SEQ ID NO: 1021
  Description of Artificial Sequence: Synthetic oligonucleotide

SEQ ID NO: 355942 - DNA, 29 bp, Artificial Sequence
  Description of Artificial Sequence: Synthetic oligonucleotide
ggccatcatagctgtcgacaaagcctacc

SEQ ID NO: 355943 - DNA, 29 bp, Artificial Sequence
  Description of Artificial Sequence: Synthetic oligonucleotide
aaggagggagttacactcaggctgcaagc

SEQ ID NO: 355944 - DNA, 30 bp, Artificial Sequence; identical to SEQ ID NO: 232578
  Description of Artificial Sequence: Synthetic oligonucleotide

SEQ ID NO: 355945 - DNA, 28 bp, Artificial Sequence
  Description of Artificial Sequence: Synthetic oligonucleotide
aggagggagttacactcaggctgcaagc

SEQ ID NO: 355946 - DNA, 30 bp, Artificial Sequence; identical to SEQ ID NO: 232579
  Description of Artificial Sequence: Synthetic oligonucleotide

SEQ ID NO: 355947 - DNA, 27 bp, Artificial Sequence
  Description of Artificial Sequence: Synthetic oligonucleotide
ggagggagttacactcaggctgcaagc

SEQ ID NO: 355948 - DNA, 34 bp, Artificial Sequence; identical to SEQ ID NO: 232580
  Description of Artificial Sequence: Synthetic oligonucleotide

SEQ ID NO: 355949 - DNA, 28 bp, Artificial Sequence
  Description of Artificial Sequence: Synthetic oligonucleotide
gagggagttacactcaggctgcaagcag

SEQ ID NO: 355950 - DNA, 36 bp, Artificial Sequence; identical to SEQ ID NO: 232581
  Description of Artificial Sequence: Synthetic oligonucleotide

SEQ ID NO: 355951 - DNA, 29 bp, Artificial Sequence
  Description of Artificial Sequence: Synthetic oligonucleotide
agggagttacactcaggctgcaagcagtg

SEQ ID NO: 355952 - DNA, 35 bp, Artificial Sequence; identical to SEQ ID NO: 232582
  Description of Artificial Sequence: Synthetic oligonucleotide

SEQ ID NO: 355953 - DNA, 28 bp, Artificial Sequence
  Description of Artificial Sequence: Synthetic oligonucleotide
gggagttacactcaggctgcaagcagtg

SEQ ID NO: 355954 - DNA, 34 bp, Artificial Sequence; identical to SEQ ID NO: 232583
  Description of Artificial Sequence: Synthetic oligonucleotide

SEQ ID NO: 355955 - DNA, 29 bp, Artificial Sequence
  Description of Artificial Sequence: Synthetic oligonucleotide
ggagttacactcaggctgcaagcagtgac

SEQ ID NO: 355956 - DNA, 35 bp, Artificial Sequence; identical to SEQ ID NO: 232584
  Description of Artificial Sequence: Synthetic oligonucleotide

SEQ ID NO: 355957 - DNA, 30 bp, Artificial Sequence; identical to SEQ ID NO: 1029
  Description of Artificial Sequence: Synthetic oligonucleotide

SEQ ID NO: 355958 - DNA, 34 bp, Artificial Sequence; identical to SEQ ID NO: 232585
  Description of Artificial Sequence: Synthetic oligonucleotide

SEQ ID NO: 355959 - DNA, 31 bp, Artificial Sequence; identical to SEQ ID NO: 1030
  Description of Artificial Sequence: Synthetic oligonucleotide

SEQ ID NO: 355960 - DNA, 33 bp, Artificial Sequence; identical to SEQ ID NO: 232586
  Description of Artificial Sequence: Synthetic oligonucleotide

SEQ ID NO: 355961 - DNA, 30 bp, Artificial Sequence; identical to SEQ ID NO: 1031
  Description of Artificial Sequence: Synthetic oligonucleotide

SEQ ID NO: 355962 - DNA, 32 bp, Artificial Sequence; identical to SEQ ID NO: 232587
  Description of Artificial Sequence: Synthetic oligonucleotide

SEQ ID NO: 355963 - DNA, 30 bp, Artificial Sequence; identical to SEQ ID NO: 1032
  Description of Artificial Sequence: Synthetic oligonucleotide

SEQ ID NO: 355964 - DNA, 35 bp, Artificial Sequence; identical to SEQ ID NO: 232588
  Description of Artificial Sequence: Synthetic oligonucleotide

SEQ ID NO: 355965 - DNA, 29 bp, Artificial Sequence
  Description of Artificial Sequence: Synthetic oligonucleotide
tacactcaggctgcaagcagtgacagtgc

SEQ ID NO: 355966 - DNA, 35 bp, Artificial Sequence; identical to SEQ ID NO: 232589
  Description of Artificial Sequence: Synthetic oligonucleotide

SEQ ID NO: 355967 - DNA, 28 bp, Artificial Sequence
  Description of Artificial Sequence: Synthetic oligonucleotide
acactcaggctgcaagcagtgacagtgc

SEQ ID NO: 355968 - DNA, 34 bp, Artificial Sequence; identical to SEQ ID NO: 232590
  Description of Artificial Sequence: Synthetic oligonucleotide

SEQ ID NO: 355969 - DNA, 27 bp, Artificial Sequence
  Description of Artificial Sequence: Synthetic oligonucleotide
cactcaggctgcaagcagtgacagtgc

SEQ ID NO: 355970 - DNA, 34 bp, Artificial Sequence; identical to SEQ ID NO: 232591
  Description of Artificial Sequence: Synthetic oligonucleotide

SEQ ID NO: 355971 - DNA, 27 bp, Artificial Sequence
  Description of Artificial Sequence: Synthetic oligonucleotide
actcaggctgcaagcagtgacagtgcc

SEQ ID NO: 355972 - DNA, 33 bp, Artificial Sequence; identical to SEQ ID NO: 232592
  Description of Artificial Sequence: Synthetic oligonucleotide

SEQ ID NO: 355973 - DNA, 26 bp, Artificial Sequence
  Description of Artificial Sequence: Synthetic oligonucleotide
ctcaggctgcaagcagtgacagtgcc

SEQ ID NO: 355974 - DNA, 33 bp, Artificial Sequence; identical to SEQ ID NO: 232593
  Description of Artificial Sequence: Synthetic oligonucleotide

SEQ ID NO: 355975 - DNA, 27 bp, Artificial Sequence
  Description of Artificial Sequence: Synthetic oligonucleotide
tcaggctgcaagcagtgacagtgccca

SEQ ID NO: 355976 - DNA, 34 bp, Artificial Sequence; identical to SEQ ID NO: 232594
  Description of Artificial Sequence: Synthetic oligonucleotide

SEQ ID NO: 355977 - DNA, 26 bp, Artificial Sequence
  Description of Artificial Sequence: Synthetic oligonucleotide
caggctgcaagcagtgacagtgccca

SEQ ID NO: 355978 - DNA, 33 bp, Artificial Sequence; identical to SEQ ID NO: 232595
  Description of Artificial Sequence: Synthetic oligonucleotide

SEQ ID NO: 355979 - DNA, 26 bp, Artificial Sequence
  Description of Artificial Sequence: Synthetic oligonucleotide
aggctgcaagcagtgacagtgcccag

SEQ ID NO: 355980 - DNA, 33 bp, Artificial Sequence; identical to SEQ ID NO: 232596
  Description of Artificial Sequence: Synthetic oligonucleotide

SEQ ID NO: 355981 - DNA, 25 bp, Artificial Sequence
  Description of Artificial Sequence: Synthetic oligonucleotide
ggctgcaagcagtgacagtgcccag

SEQ ID NO: 355982 - DNA, 32 bp, Artificial Sequence; identical to SEQ ID NO: 232597
  Description of Artificial Sequence: Synthetic oligonucleotide

SEQ ID NO: 355983 - DNA, 25 bp, Artificial Sequence
  Description of Artificial Sequence: Synthetic oligonucleotide
gctgcaagcagtgacagtgcccagg

SEQ ID NO: 355984 - DNA, 31 bp, Artificial Sequence; identical to SEQ ID NO: 232598
  Description of Artificial Sequence: Synthetic oligonucleotide

SEQ ID NO: 355985 - DNA, 25 bp, Artificial Sequence
  Description of Artificial Sequence: Synthetic oligonucleotide
ctgcaagcagtgacagtgcccaggg

SEQ ID NO: 355986 - DNA, 30 bp, Artificial Sequence; identical to SEQ ID NO: 232599
  Description of Artificial Sequence: Synthetic oligonucleotide

SEQ ID NO: 355987 - DNA, 26 bp, Artificial Sequence
  Description of Artificial Sequence: Synthetic oligonucleotide
tgcaagcagtgacagtgcccagggct

SEQ ID NO: 355988 - DNA, 32 bp, Artificial Sequence; identical to SEQ ID NO: 232600
  Description of Artificial Sequence: Synthetic oligonucleotide

SEQ ID NO: 355989 - DNA, 25 bp, Artificial Sequence
  Description of Artificial Sequence: Synthetic oligonucleotide
gcaagcagtgacagtgcccagggct

SEQ ID NO: 355990 - DNA, 36 bp, Artificial Sequence; identical to SEQ ID NO: 232601
  Description of Artificial Sequence: Synthetic oligonucleotide

SEQ ID NO: 355991 - DNA, 26 bp, Artificial Sequence
  Description of Artificial Sequence: Synthetic oligonucleotide
caagcagtgacagtgcccagggctct

SEQ ID NO: 355992 - DNA, 37 bp, Artificial Sequence; identical to SEQ ID NO: 232602
  Description of Artificial Sequence: Synthetic oligonucleotide

SEQ ID NO: 355993 - DNA, 27 bp, Artificial Sequence
  Description of Artificial Sequence: Synthetic oligonucleotide
aagcagtgacagtgcccagggctctga

SEQ ID NO: 355994 - DNA, 36 bp, Artificial Sequence; identical to SEQ ID NO: 232603
  Description of Artificial Sequence: Synthetic oligonucleotide

SEQ ID NO: 355995 - DNA, 27 bp, Artificial Sequence
  Description of Artificial Sequence: Synthetic oligonucleotide
agcagtgacagtgcccagggctctgat

SEQ ID NO: 355996 - DNA, 35 bp, Artificial Sequence; identical to SEQ ID NO: 232604
  Description of Artificial Sequence: Synthetic oligonucleotide

SEQ ID NO: 355997 - DNA, 26 bp, Artificial Sequence
  Description of Artificial Sequence: Synthetic oligonucleotide
gcagtgacagtgcccagggctctgat

SEQ ID NO: 355998 - DNA, 35 bp, Artificial Sequence; identical to SEQ ID NO: 232605
  Description of Artificial Sequence: Synthetic oligonucleotide

SEQ ID NO: 355999 - DNA, 27 bp, Artificial Sequence
  Description of Artificial Sequence: Synthetic oligonucleotide
cagtgacagtgcccagggctctgatgt

SEQ ID NO: 356000 - DNA, 35 bp, Artificial Sequence; identical to SEQ ID NO: 232606
  Description of Artificial Sequence: Synthetic oligonucleotide

SEQ ID NO: 356001 - DNA, 27 bp, Artificial Sequence
  Description of Artificial Sequence: Synthetic oligonucleotide
agtgacagtgcccagggctctgatgtg

SEQ ID NO: 356002 - DNA, 34 bp, Artificial Sequence; identical to SEQ ID NO: 232607
  Description of Artificial Sequence: Synthetic oligonucleotide

SEQ ID NO: 356003 - DNA, 27 bp, Artificial Sequence
  Description of Artificial Sequence: Synthetic oligonucleotide
gtgacagtgcccagggctctgatgtgt

SEQ ID NO: 356004 - DNA, 36 bp, Artificial Sequence; identical to SEQ ID NO: 232608
  Description of Artificial Sequence: Synthetic oligonucleotide

SEQ ID NO: 356005 - DNA, 27 bp, Artificial Sequence
  Description of Artificial Sequence: Synthetic oligonucleotide
tgacagtgcccagggctctgatgtgtc

SEQ ID NO: 356006 - DNA, 37 bp, Artificial Sequence; identical to SEQ ID NO: 232609
  Description of Artificial Sequence: Synthetic oligonucleotide

SEQ ID NO: 356007 - DNA, 27 bp, Artificial Sequence
  Description of Artificial Sequence: Synthetic oligonucleotide
gacagtgcccagggctctgatgtgtct

SEQ ID NO: 356008 - DNA, 36 bp, Artificial Sequence; identical to SEQ ID NO: 232610
  Description of Artificial Sequence: Synthetic oligonucleotide

SEQ ID NO: 356009 - DNA, 27 bp, Artificial Sequence
  Description of Artificial Sequence: Synthetic oligonucleotide
acagtgcccagggctctgatgtgtctc

SEQ ID NO: 356010 - DNA, 35 bp, Artificial Sequence; identical to SEQ ID NO: 232611
  Description of Artificial Sequence: Synthetic oligonucleotide

SEQ ID NO: 356011 - DNA, 27 bp, Artificial Sequence
  Description of Artificial Sequence: Synthetic oligonucleotide
cagtgcccagggctctgatgtgtctct

SEQ ID NO: 356012 - DNA, 34 bp, Artificial Sequence; identical to SEQ ID NO: 232612
  Description of Artificial Sequence: Synthetic oligonucleotide

SEQ ID NO: 356013 - DNA, 27 bp, Artificial Sequence
  Description of Artificial Sequence: Synthetic oligonucleotide
agtgcccagggctctgatgtgtctctc

SEQ ID NO: 356014 - DNA, 33 bp, Artificial Sequence; identical to SEQ ID NO: 232613
  Description of Artificial Sequence: Synthetic oligonucleotide

SEQ ID NO: 356015 - DNA, 27 bp, Artificial Sequence
  Description of Artificial Sequence: Synthetic oligonucleotide
gtgcccagggctctgatgtgtctctca

SEQ ID NO: 356016 - DNA, 33 bp, Artificial Sequence; identical to SEQ ID NO: 232614
  Description of Artificial Sequence: Synthetic oligonucleotide

SEQ ID NO: 356017 - DNA, 27 bp, Artificial Sequence
  Description of Artificial Sequence: Synthetic oligonucleotide
tgcccagggctctgatgtgtctctcac

SEQ ID NO: 356018 - DNA, 32 bp, Artificial Sequence; identical to SEQ ID NO: 232615
  Description of Artificial Sequence: Synthetic oligonucleotide

SEQ ID NO: 356019 - DNA, 27 bp, Artificial Sequence
  Description of Artificial Sequence: Synthetic oligonucleotide
gcccagggctctgatgtgtctctcaca

SEQ ID NO: 356020 - DNA, 31 bp, Artificial Sequence; identical to SEQ ID NO: 232616
  Description of Artificial Sequence: Synthetic oligonucleotide

SEQ ID NO: 356021 - DNA, 27 bp, Artificial Sequence
  Description of Artificial Sequence: Synthetic oligonucleotide
cccagggctctgatgtgtctctcacag

SEQ ID NO: 356022 - DNA, 34 bp, Artificial Sequence; identical to SEQ ID NO: 232617
  Description of Artificial Sequence: Synthetic oligonucleotide

SEQ ID NO: 356023 - DNA, 27 bp, Artificial Sequence
  Description of Artificial Sequence: Synthetic oligonucleotide
ccagggctctgatgtgtctctcacagc

SEQ ID NO: 356024 - DNA, 33 bp, Artificial Sequence; identical to SEQ ID NO: 232618
  Description of Artificial Sequence: Synthetic oligonucleotide

SEQ ID NO: 356025 - DNA, 29 bp, Artificial Sequence
  Description of Artificial Sequence: Synthetic oligonucleotide
cagggctctgatgtgtctctcacagcttg

SEQ ID NO: 356026 - DNA, 35 bp, Artificial Sequence; identical to SEQ ID NO: 232619
  Description of Artificial Sequence: Synthetic oligonucleotide

SEQ ID NO: 356027 - DNA, 33 bp, Artificial Sequence; identical to SEQ ID NO: 1064
  Description of Artificial Sequence: Synthetic oligonucleotide

SEQ ID NO: 356028 - DNA, 34 bp, Artificial Sequence; identical to SEQ ID NO: 232620
  Description of Artificial Sequence: Synthetic oligonucleotide

SEQ ID NO: 356029 - DNA, 32 bp, Artificial Sequence; identical to SEQ ID NO: 1065
  Description of Artificial Sequence: Synthetic oligonucleotide

SEQ ID NO: 356030 - DNA, 33 bp, Artificial Sequence; identical to SEQ ID NO: 232621
  Description of Artificial Sequence: Synthetic oligonucleotide

SEQ ID NO: 356031 - DNA, 33 bp, Artificial Sequence; identical to SEQ ID NO: 1066
  Description of Artificial Sequence: Synthetic oligonucleotide

SEQ ID NO: 356032 - DNA, 32 bp, Artificial Sequence; identical to SEQ ID NO: 232622
  Description of Artificial Sequence: Synthetic oligonucleotide

SEQ ID NO: 356033 - DNA, 34 bp, Artificial Sequence; identical to SEQ ID NO: 1067
  Description of Artificial Sequence: Synthetic oligonucleotide

SEQ ID NO: 356034 - DNA, 32 bp, Artificial Sequence; identical to SEQ ID NO: 232623
  Description of Artificial Sequence: Synthetic oligonucleotide

SEQ ID NO: 356035 - DNA, 26 bp, Artificial Sequence
  Description of Artificial Sequence: Synthetic oligonucleotide
cgcggcggacatggcagctcagatta

SEQ ID NO: 356036 - DNA, 33 bp, Artificial Sequence; identical to SEQ ID NO: 232624
  Description of Artificial Sequence: Synthetic oligonucleotide

SEQ ID NO: 356037 - DNA, 26 bp, Artificial Sequence
  Description of Artificial Sequence: Synthetic oligonucleotide
gcggcggacatggcagctcagattac

SEQ ID NO: 356038 - DNA, 33 bp, Artificial Sequence; identical to SEQ ID NO: 232625
  Description of Artificial Sequence: Synthetic oligonucleotide

SEQ ID NO: 356039 - DNA, 27 bp, Artificial Sequence
  Description of Artificial Sequence: Synthetic oligonucleotide
cggcggacatggcagctcagattacca

SEQ ID NO: 356040 - DNA, 34 bp, Artificial Sequence; identical to SEQ ID NO: 232626
  Description of Artificial Sequence: Synthetic oligonucleotide

SEQ ID NO: 356041 - DNA, 28 bp, Artificial Sequence
  Description of Artificial Sequence: Synthetic oligonucleotide
ggcggacatggcagctcagattaccaag

SEQ ID NO: 356042 - DNA, 33 bp, Artificial Sequence; identical to SEQ ID NO: 232627
  Description of Artificial Sequence: Synthetic oligonucleotide

SEQ ID NO: 356043 - DNA, 28 bp, Artificial Sequence
  Description of Artificial Sequence: Synthetic oligonucleotide
gcggacatggcagctcagattaccaagc

SEQ ID NO: 356044 - DNA, 34 bp, Artificial Sequence; identical to SEQ ID NO: 232628
  Description of Artificial Sequence: Synthetic oligonucleotide

SEQ ID NO: 356045 - DNA, 28 bp, Artificial Sequence
  Description of Artificial Sequence: Synthetic oligonucleotide
cggacatggcagctcagattaccaagcg

SEQ ID NO: 356046 - DNA, 34 bp, Artificial Sequence; identical to SEQ ID NO: 232629
  Description of Artificial Sequence: Synthetic oligonucleotide

SEQ ID NO: 356047 - DNA, 28 bp, Artificial Sequence
  Description of Artificial Sequence: Synthetic oligonucleotide
ggacatggcagctcagattaccaagcgc

SEQ ID NO: 356048 - DNA, 33 bp, Artificial Sequence; identical to SEQ ID NO: 232630
  Description of Artificial Sequence: Synthetic oligonucleotide

SEQ ID NO: 356049 - DNA, 30 bp, Artificial Sequence; identical to SEQ ID NO: 1075
  Description of Artificial Sequence: Synthetic oligonucleotide

SEQ ID NO: 356050 - DNA, 32 bp, Artificial Sequence; identical to SEQ ID NO: 232631
  Description of Artificial Sequence: Synthetic oligonucleotide

SEQ ID NO: 356051 - DNA, 31 bp, Artificial Sequence; identical to SEQ ID NO: 1076
  Description of Artificial Sequence: Synthetic oligonucleotide

SEQ ID NO: 356052 - DNA, 35 bp, Artificial Sequence; identical to SEQ ID NO: 232632
  Description of Artificial Sequence: Synthetic oligonucleotide

SEQ ID NO: 356053 - DNA, 30 bp, Artificial Sequence; identical to SEQ ID NO: 1077
  Description of Artificial Sequence: Synthetic oligonucleotide

SEQ ID NO: 356054 - DNA, 34 bp, Artificial Sequence; identical to SEQ ID NO: 232633
  Description of Artificial Sequence: Synthetic oligonucleotide

SEQ ID NO: 356055 - DNA, 30 bp, Artificial Sequence; identical to SEQ ID NO: 1078
  Description of Artificial Sequence: Synthetic oligonucleotide

SEQ ID NO: 356056 - DNA, 33 bp, Artificial Sequence; identical to SEQ ID NO: 232634
  Description of Artificial Sequence: Synthetic oligonucleotide

SEQ ID NO: 356057 - DNA, 29 bp, Artificial Sequence
  Description of Artificial Sequence: Synthetic oligonucleotide
tggcagctcagattaccaagcgcaagtgg

SEQ ID NO: 356058 - DNA, 32 bp, Artificial Sequence; identical to SEQ ID NO: 232635
  Description of Artificial Sequence: Synthetic oligonucleotide

SEQ ID NO: 356059 - DNA, 28 bp, Artificial Sequence
  Description of Artificial Sequence: Synthetic oligonucleotide
ggcagctcagattaccaagcgcaagtgg

SEQ ID NO: 356060 - DNA, 31 bp, Artificial Sequence; identical to SEQ ID NO: 232636
  Description of Artificial Sequence: Synthetic oligonucleotide

SEQ ID NO: 356061 - DNA, 28 bp, Artificial Sequence
  Description of Artificial Sequence: Synthetic oligonucleotide
gcagctcagattaccaagcgcaagtggg

SEQ ID NO: 356062 - DNA, 32 bp, Artificial Sequence; identical to SEQ ID NO: 232637
  Description of Artificial Sequence: Synthetic oligonucleotide

SEQ ID NO: 356063 - DNA, 29 bp, Artificial Sequence
  Description of Artificial Sequence: Synthetic oligonucleotide
cagctcagattaccaagcgcaagtgggag

SEQ ID NO: 356064 - DNA, 31 bp, Artificial Sequence; identical to SEQ ID NO: 232638
  Description of Artificial Sequence: Synthetic oligonucleotide

SEQ ID NO: 356065 - DNA, 29 bp, Artificial Sequence
  Description of Artificial Sequence: Synthetic oligonucleotide
agctcagattaccaagcgcaagtgggagg

SEQ ID NO: 356066 - DNA, 32 bp, Artificial Sequence; identical to SEQ ID NO: 232639
  Description of Artificial Sequence: Synthetic oligonucleotide

SEQ ID NO: 356067 - DNA, 28 bp, Artificial Sequence
  Description of Artificial Sequence: Synthetic oligonucleotide
gctcagattaccaagcgcaagtgggagg

SEQ ID NO: 356068 - DNA, 32 bp, Artificial Sequence; identical to SEQ ID NO: 232640
  Description of Artificial Sequence: Synthetic oligonucleotide

SEQ ID NO: 356069 - DNA, 28 bp, Artificial Sequence
  Description of Artificial Sequence: Synthetic oligonucleotide
ctcagattaccaagcgcaagtgggaggc

SEQ ID NO: 356070 - DNA, 33 bp, Artificial Sequence; identical to SEQ ID NO: 232641
  Description of Artificial Sequence: Synthetic oligonucleotide

SEQ ID NO: 356071 - DNA, 28 bp, Artificial Sequence
  Description of Artificial Sequence: Synthetic oligonucleotide
tcagattaccaagcgcaagtgggaggcg

SEQ ID NO: 356072 - DNA, 32 bp, Artificial Sequence; identical to SEQ ID NO: 232642
  Description of Artificial Sequence: Synthetic oligonucleotide

SEQ ID NO: 356073 - DNA, 27 bp, Artificial Sequence
  Description of Artificial Sequence: Synthetic oligonucleotide
cagattaccaagcgcaagtgggaggcg

SEQ ID NO: 356074 - DNA, 31 bp, Artificial Sequence; identical to SEQ ID NO: 232643
  Description of Artificial Sequence: Synthetic oligonucleotide

SEQ ID NO: 356075 - DNA, 27 bp, Artificial Sequence
  Description of Artificial Sequence: Synthetic oligonucleotide
agattaccaagcgcaagtgggaggcgg

SEQ ID NO: 356076 - DNA, 32 bp, Artificial Sequence; identical to SEQ ID NO: 232644
  Description of Artificial Sequence: Synthetic oligonucleotide

SEQ ID NO: 356077 - DNA, 27 bp, Artificial Sequence
  Description of Artificial Sequence: Synthetic oligonucleotide
gattaccaagcgcaagtgggaggcggt

SEQ ID NO: 356078 - DNA, 31 bp, Artificial Sequence; identical to SEQ ID NO: 232645
  Description of Artificial Sequence: Synthetic oligonucleotide

SEQ ID NO: 356079 - DNA, 27 bp, Artificial Sequence
  Description of Artificial Sequence: Synthetic oligonucleotide
attaccaagcgcaagtgggaggcggtc

SEQ ID NO: 356080 - DNA, 31 bp, Artificial Sequence; identical to SEQ ID NO: 232646
  Description of Artificial Sequence: Synthetic oligonucleotide

SEQ ID NO: 356081 - DNA, 26 bp, Artificial Sequence
  Description of Artificial Sequence: Synthetic oligonucleotide
ttaccaagcgcaagtgggaggcggtc

SEQ ID NO: 356082 - DNA, 33 bp, Artificial Sequence; identical to SEQ ID NO: 232647
  Description of Artificial Sequence: Synthetic oligonucleotide

SEQ ID NO: 356083 - DNA, 25 bp, Artificial Sequence
  Description of Artificial Sequence: Synthetic oligonucleotide
taccaagcgcaagtgggaggcggtc

SEQ ID NO: 356084 - DNA, 32 bp, Artificial Sequence; identical to SEQ ID NO: 232648
  Description of Artificial Sequence: Synthetic oligonucleotide

SEQ ID NO: 356085 - DNA, 23 bp, Artificial Sequence
  Description of Artificial Sequence: Synthetic oligonucleotide
gaaggagacgctgcagcgcacgg

SEQ ID NO: 356086 - DNA, 31 bp, Artificial Sequence; identical to SEQ ID NO: 232649
  Description of Artificial Sequence: Synthetic oligonucleotide

SEQ ID NO: 356087 - DNA, 24 bp, Artificial Sequence
  Description of Artificial Sequence: Synthetic oligonucleotide
gggaaggagacgctgcagcgcact

SEQ ID NO: 356088 - DNA, 30 bp, Artificial Sequence; identical to SEQ ID NO: 232650
  Description of Artificial Sequence: Synthetic oligonucleotide

SEQ ID NO: 356089 - DNA, 25 bp, Artificial Sequence
  Description of Artificial Sequence: Synthetic oligonucleotide
ggaaggagacgctgcagcgcactga

SEQ ID NO: 356090 - DNA, 31 bp, Artificial Sequence; identical to SEQ ID NO: 232651
  Description of Artificial Sequence: Synthetic oligonucleotide

SEQ ID NO: 356091 - DNA, 25 bp, Artificial Sequence
  Description of Artificial Sequence: Synthetic oligonucleotide
gaaggagacgctgcagcgcactgac

SEQ ID NO: 356092 - DNA, 30 bp, Artificial Sequence; identical to SEQ ID NO: 232652
  Description of Artificial Sequence: Synthetic oligonucleotide

SEQ ID NO: 356093 - DNA, 25 bp, Artificial Sequence
  Description of Artificial Sequence: Synthetic oligonucleotide
aaggagacgctgcagcgcactgacc

SEQ ID NO: 356094 - DNA, 29 bp, Artificial Sequence
  Description of Artificial Sequence: Synthetic oligonucleotide
cctccagagctaactgtgcacacgaacag

SEQ ID NO: 356095 - DNA, 24 bp, Artificial Sequence
  Description of Artificial Sequence: Synthetic oligonucleotide
aggagacgctgcagcgcactgacc

SEQ ID NO: 356096 - DNA, 29 bp, Artificial Sequence
  Description of Artificial Sequence: Synthetic oligonucleotide
ctccagagctaactgtgcacacgaacagg

SEQ ID NO: 356097 - DNA, 23 bp, Artificial Sequence
  Description of Artificial Sequence: Synthetic oligonucleotide
ggagacgctgcagcgcactgacc

SEQ ID NO: 356098 - DNA, 29 bp, Artificial Sequence
  Description of Artificial Sequence: Synthetic oligonucleotide
tccagagctaactgtgcacacgaacaggc

SEQ ID NO: 356099 - DNA, 23 bp, Artificial Sequence
  Description of Artificial Sequence: Synthetic oligonucleotide
gagacgctgcagcgcactgaccc

SEQ ID NO: 356100 - DNA, 28 bp, Artificial Sequence
  Description of Artificial Sequence: Synthetic oligonucleotide
ccagagctaactgtgcacacgaacaggc

SEQ ID NO: 356101 - DNA, 23 bp, Artificial Sequence
  Description of Artificial Sequence: Synthetic oligonucleotide
agacgctgcagcgcactgacccc

SEQ ID NO: 356102 - DNA, 28 bp, Artificial Sequence
  Description of Artificial Sequence: Synthetic oligonucleotide
cagagctaactgtgcacacgaacaggcc

SEQ ID NO: 356103 - DNA, 22 bp, Artificial Sequence
  Description of Artificial Sequence: Synthetic oligonucleotide
gacgctgcagcgcactgacccc

SEQ ID NO: 356104 - DNA, 29 bp, Artificial Sequence
  Description of Artificial Sequence: Synthetic oligonucleotide
agagctaactgtgcacacgaacaggcctg

SEQ ID NO: 356105 - DNA, 22 bp, Artificial Sequence
  Description of Artificial Sequence: Synthetic oligonucleotide
acgctgcagcgcactgaccccc

SEQ ID NO: 356106 - DNA, 28 bp, Artificial Sequence
  Description of Artificial Sequence: Synthetic oligonucleotide
gagctaactgtgcacacgaacaggcctg

SEQ ID NO: 356107 - DNA, 21 bp, Artificial Sequence
  Description of Artificial Sequence: Synthetic oligonucleotide
cgctgcagcgcactgaccccc

SEQ ID NO: 356108 - DNA, 29 bp, Artificial Sequence
  Description of Artificial Sequence: Synthetic oligonucleotide
agctaactgtgcacacgaacaggcctgtg

SEQ ID NO: 356109 - DNA, 21 bp, Artificial Sequence
  Description of Artificial Sequence: Synthetic oligonucleotide
gctgcagcgcactgacccccc

SEQ ID NO: 356110 - DNA, 28 bp, Artificial Sequence
  Description of Artificial Sequence: Synthetic oligonucleotide
gctaactgtgcacacgaacaggcctgtg

SEQ ID NO: 356111 - DNA, 23 bp, Artificial Sequence
  Description of Artificial Sequence: Synthetic oligonucleotide
ctgcagcgcactgacccccccaa

SEQ ID NO: 356112 - DNA, 28 bp, Artificial Sequence
  Description of Artificial Sequence: Synthetic oligonucleotide
ctaactgtgcacacgaacaggcctgtgg

SEQ ID NO: 356113 - DNA, 24 bp, Artificial Sequence
  Description of Artificial Sequence: Synthetic oligonucleotide
tgcagcgcactgacccccccaaga

SEQ ID NO: 356114 - DNA, 30 bp, Artificial Sequence; identical to SEQ ID NO: 232663
  Description of Artificial Sequence: Synthetic oligonucleotide

SEQ ID NO: 356115 - DNA, 23 bp, Artificial Sequence
  Description of Artificial Sequence: Synthetic oligonucleotide
gcagcgcactgacccccccaaga

SEQ ID NO: 356116 - DNA, 29 bp, Artificial Sequence
  Description of Artificial Sequence: Synthetic oligonucleotide
aactgtgcacacgaacaggcctgtggaag

SEQ ID NO: 356117 - DNA, 24 bp, Artificial Sequence
  Description of Artificial Sequence: Synthetic oligonucleotide
cagcgcactgacccccccaagaca

SEQ ID NO: 356118 - DNA, 28 bp, Artificial Sequence
  Description of Artificial Sequence: Synthetic oligonucleotide
actgtgcacacgaacaggcctgtggaag

SEQ ID NO: 356119 - DNA, 27 bp, Artificial Sequence
  Description of Artificial Sequence: Synthetic oligonucleotide
agcgcactgacccccccaagacacata

SEQ ID NO: 356120 - DNA, 27 bp, Artificial Sequence
  Description of Artificial Sequence: Synthetic oligonucleotide
ctgtgcacacgaacaggcctgtggaag

SEQ ID NO: 356121 - DNA, 27 bp, Artificial Sequence
  Description of Artificial Sequence: Synthetic oligonucleotide
gcgcactgacccccccaagacacatat

SEQ ID NO: 356122 - DNA, 28 bp, Artificial Sequence
  Description of Artificial Sequence: Synthetic oligonucleotide
tgtgcacacgaacaggcctgtggaagtg

SEQ ID NO: 356123 - DNA, 27 bp, Artificial Sequence
  Description of Artificial Sequence: Synthetic oligonucleotide
cgcactgacccccccaagacacatatg

SEQ ID NO: 356124 - DNA, 27 bp, Artificial Sequence
  Description of Artificial Sequence: Synthetic oligonucleotide
gtgcacacgaacaggcctgtggaagtg

SEQ ID NO: 356125 - DNA, 28 bp, Artificial Sequence
  Description of Artificial Sequence: Synthetic oligonucleotide
gcactgacccccccaagacacatatgac

SEQ ID NO: 356126 - DNA, 28 bp, Artificial Sequence
  Description of Artificial Sequence: Synthetic oligonucleotide
tgcacacgaacaggcctgtggaagtgag

SEQ ID NO: 356127 - DNA, 28 bp, Artificial Sequence
  Description of Artificial Sequence: Synthetic oligonucleotide
cactgacccccccaagacacatatgacc

SEQ ID NO: 356128 - DNA, 27 bp, Artificial Sequence
  Description of Artificial Sequence: Synthetic oligonucleotide
gcacacgaacaggcctgtggaagtgag

SEQ ID NO: 356129 - DNA, 28 bp, Artificial Sequence
  Description of Artificial Sequence: Synthetic oligonucleotide
actgacccccccaagacacatatgaccc

SEQ ID NO: 356130 - DNA, 28 bp, Artificial Sequence
  Description of Artificial Sequence: Synthetic oligonucleotide
cacacgaacaggcctgtggaagtgagag

SEQ ID NO: 356131 - DNA, 27 bp, Artificial Sequence
  Description of Artificial Sequence: Synthetic oligonucleotide
ctgacccccccaagacacatatgaccc

SEQ ID NO: 356132 - DNA, 29 bp, Artificial Sequence
  Description of Artificial Sequence: Synthetic oligonucleotide
acacgaacaggcctgtggaagtgagagag

SEQ ID NO: 356133 - DNA, 28 bp, Artificial Sequence
  Description of Artificial Sequence: Synthetic oligonucleotide
tgacccccccaagacacatatgacccac

SEQ ID NO: 356134 - DNA, 28 bp, Artificial Sequence
  Description of Artificial Sequence: Synthetic oligonucleotide
cacgaacaggcctgtggaagtgagagag

SEQ ID NO: 356135 - DNA, 24 bp, Artificial Sequence
  Description of Artificial Sequence: Synthetic oligonucleotide
ccaagcccctcaccctgagatggg

SEQ ID NO: 356136 - DNA, 28 bp, Artificial Sequence
  Description of Artificial Sequence: Synthetic oligonucleotide
acgaacaggcctgtggaagtgagagagc

SEQ ID NO: 356137 - DNA, 27 bp, Artificial Sequence
  Description of Artificial Sequence: Synthetic oligonucleotide
gcccactcacagactgaccgagcgaat

SEQ ID NO: 356138 - DNA, 27 bp, Artificial Sequence
  Description of Artificial Sequence: Synthetic oligonucleotide
cgaacaggcctgtggaagtgagagagc

SEQ ID NO: 356139 - DNA, 27 bp, Artificial Sequence
  Description of Artificial Sequence: Synthetic oligonucleotide
cccactcacagactgaccgagcgaatc

SEQ ID NO: 356140 - DNA, 27 bp, Artificial Sequence
  Description of Artificial Sequence: Synthetic oligonucleotide
gaacaggcctgtggaagtgagagagcg

SEQ ID NO: 356141 - DNA, 28 bp, Artificial Sequence
  Description of Artificial Sequence: Synthetic oligonucleotide
ccactcacagactgaccgagcgaatctg

SEQ ID NO: 356142 - DNA, 27 bp, Artificial Sequence
  Description of Artificial Sequence: Synthetic oligonucleotide
aacaggcctgtggaagtgagagagcgc

SEQ ID NO: 356143 - DNA, 28 bp, Artificial Sequence
  Description of Artificial Sequence: Synthetic oligonucleotide
cactcacagactgaccgagcgaatctgg

SEQ ID NO: 356144 - DNA, 27 bp, Artificial Sequence
  Description of Artificial Sequence: Synthetic oligonucleotide
acaggcctgtggaagtgagagagcgca

SEQ ID NO: 356145 - DNA, 28 bp, Artificial Sequence
  Description of Artificial Sequence: Synthetic oligonucleotide
actcacagactgaccgagcgaatctggg

SEQ ID NO: 356146 - DNA, 27 bp, Artificial Sequence
  Description of Artificial Sequence: Synthetic oligonucleotide
caggcctgtggaagtgagagagcgcaa

SEQ ID NO: 356147 - DNA, 27 bp, Artificial Sequence
  Description of Artificial Sequence: Synthetic oligonucleotide
ctcacagactgaccgagcgaatctggg

SEQ ID NO: 356148 - DNA, 27 bp, Artificial Sequence
  Description of Artificial Sequence: Synthetic oligonucleotide
aggcctgtggaagtgagagagcgcaac

SEQ ID NO: 356149 - DNA, 27 bp, Artificial Sequence
  Description of Artificial Sequence: Synthetic oligonucleotide
tcacagactgaccgagcgaatctgggg

SEQ ID NO: 356150 - DNA, 26 bp, Artificial Sequence
  Description of Artificial Sequence: Synthetic oligonucleotide
ggcctgtggaagtgagagagcgcaac

SEQ ID NO: 356151 - DNA, 27 bp, Artificial Sequence
  Description of Artificial Sequence: Synthetic oligonucleotide
cacagactgaccgagcgaatctgggga

SEQ ID NO: 356152 - DNA, 27 bp, Artificial Sequence
  Description of Artificial Sequence: Synthetic oligonucleotide
gcctgtggaagtgagagagcgcaacgt

SEQ ID NO: 356153 - DNA, 27 bp, Artificial Sequence
  Description of Artificial Sequence: Synthetic oligonucleotide
acagactgaccgagcgaatctggggac

SEQ ID NO: 356154 - DNA, 27 bp, Artificial Sequence
  Description of Artificial Sequence: Synthetic oligonucleotide
cctgtggaagtgagagagcgcaacgtc

SEQ ID NO: 356155 - DNA, 26 bp, Artificial Sequence
  Description of Artificial Sequence: Synthetic oligonucleotide
cagactgaccgagcgaatctggggac

SEQ ID NO: 356156 - DNA, 27 bp, Artificial Sequence
  Description of Artificial Sequence: Synthetic oligonucleotide
ctgtggaagtgagagagcgcaacgtcc

SEQ ID NO: 356157 - DNA, 26 bp, Artificial Sequence
  Description of Artificial Sequence: Synthetic oligonucleotide
agactgaccgagcgaatctggggacc

SEQ ID NO: 356158 - DNA, 28 bp, Artificial Sequence
  Description of Artificial Sequence: Synthetic oligonucleotide
tgtggaagtgagagagcgcaacgtcctg

SEQ ID NO: 356159 - DNA, 25 bp, Artificial Sequence
  Description of Artificial Sequence: Synthetic oligonucleotide
gactgaccgagcgaatctggggacc

SEQ ID NO: 356160 - DNA, 27 bp, Artificial Sequence
  Description of Artificial Sequence: Synthetic oligonucleotide
gtggaagtgagagagcgcaacgtcctg

SEQ ID NO: 356161 - DNA, 26 bp, Artificial Sequence
  Description of Artificial Sequence: Synthetic oligonucleotide
actgaccgagcgaatctggggaccct

SEQ ID NO: 356162 - DNA, 29 bp, Artificial Sequence
  Description of Artificial Sequence: Synthetic oligonucleotide
tggaagtgagagagcgcaacgtcctgatc

SEQ ID NO: 356163 - DNA, 25 bp, Artificial Sequence
  Description of Artificial Sequence: Synthetic oligonucleotide
ctgaccgagcgaatctggggaccct

SEQ ID NO: 356164 - DNA, 28 bp, Artificial Sequence
  Description of Artificial Sequence: Synthetic oligonucleotide
ggaagtgagagagcgcaacgtcctgatc

SEQ ID NO: 356165 - DNA, 25 bp, Artificial Sequence
  Description of Artificial Sequence: Synthetic oligonucleotide
tgaccgagcgaatctggggaccctg

SEQ ID NO: 356166 - DNA, 29 bp, Artificial Sequence
  Description of Artificial Sequence: Synthetic oligonucleotide
gaagtgagagagcgcaacgtcctgatctg

SEQ ID NO: 356167 - DNA, 24 bp, Artificial Sequence
  Description of Artificial Sequence: Synthetic oligonucleotide
gaccgagcgaatctggggaccctg

SEQ ID NO: 356168 - DNA, 32 bp, Artificial Sequence; identical to SEQ ID NO: 232690
  Description of Artificial Sequence: Synthetic oligonucleotide

SEQ ID NO: 356169 - DNA, 24 bp, Artificial Sequence
  Description of Artificial Sequence: Synthetic oligonucleotide
accgagcgaatctggggaccctgc

SEQ ID NO: 356170 - DNA, 31 bp, Artificial Sequence; identical to SEQ ID NO: 232691
  Description of Artificial Sequence: Synthetic oligonucleotide

SEQ ID NO: 356171 - DNA, 23 bp, Artificial Sequence
  Description of Artificial Sequence: Synthetic oligonucleotide
ccgagcgaatctggggaccctgc

SEQ ID NO: 356172 - DNA, 30 bp, Artificial Sequence; identical to SEQ ID NO: 232692
  Description of Artificial Sequence: Synthetic oligonucleotide

SEQ ID NO: 356173 - DNA, 23 bp, Artificial Sequence
  Description of Artificial Sequence: Synthetic oligonucleotide
cgagcgaatctggggaccctgcg

SEQ ID NO: 356174 - DNA, 33 bp, Artificial Sequence; identical to SEQ ID NO: 232693
  Description of Artificial Sequence: Synthetic oligonucleotide

SEQ ID NO: 356175 - DNA, 23 bp, Artificial Sequence
  Description of Artificial Sequence: Synthetic oligonucleotide
gagcgaatctggggaccctgcgc

SEQ ID NO: 356176 - DNA, 32 bp, Artificial Sequence; identical to SEQ ID NO: 232694
  Description of Artificial Sequence: Synthetic oligonucleotide

SEQ ID NO: 356177 - DNA, 23 bp, Artificial Sequence
  Description of Artificial Sequence: Synthetic oligonucleotide
agcgaatctggggaccctgcgcg

SEQ ID NO: 356178 - DNA, 33 bp, Artificial Sequence; identical to SEQ ID NO: 232695
  Description of Artificial Sequence: Synthetic oligonucleotide

SEQ ID NO: 356179 - DNA, 22 bp, Artificial Sequence
  Description of Artificial Sequence: Synthetic oligonucleotide
gcgaatctggggaccctgcgcg

SEQ ID NO: 356180 - DNA, 32 bp, Artificial Sequence; identical to SEQ ID NO: 232696
  Description of Artificial Sequence: Synthetic oligonucleotide

SEQ ID NO: 356181 - DNA, 22 bp, Artificial Sequence
  Description of Artificial Sequence: Synthetic oligonucleotide
cgaatctggggaccctgcgcgg

SEQ ID NO: 356182 - DNA, 34 bp, Artificial Sequence; identical to SEQ ID NO: 232697
  Description of Artificial Sequence: Synthetic oligonucleotide

SEQ ID NO: 356183 - DNA, 24 bp, Artificial Sequence
  Description of Artificial Sequence: Synthetic oligonucleotide
gaatctggggaccctgcgcggcta

SEQ ID NO: 356184 - DNA, 33 bp, Artificial Sequence; identical to SEQ ID NO: 232698
  Description of Artificial Sequence: Synthetic oligonucleotide

SEQ ID NO: 356185 - DNA, 26 bp, Artificial Sequence
  Description of Artificial Sequence: Synthetic oligonucleotide
aatctggggaccctgcgcggctacta

SEQ ID NO: 356186 - DNA, 35 bp, Artificial Sequence; identical to SEQ ID NO: 232699
  Description of Artificial Sequence: Synthetic oligonucleotide

SEQ ID NO: 356187 - DNA, 25 bp, Artificial Sequence
  Description of Artificial Sequence: Synthetic oligonucleotide
atctggggaccctgcgcggctacta

SEQ ID NO: 356188 - DNA, 34 bp, Artificial Sequence; identical to SEQ ID NO: 232700
  Description of Artificial Sequence: Synthetic oligonucleotide

SEQ ID NO: 356189 - DNA, 24 bp, Artificial Sequence
  Description of Artificial Sequence: Synthetic oligonucleotide
tctggggaccctgcgcggctacta

SEQ ID NO: 356190 - DNA, 35 bp, Artificial Sequence; identical to SEQ ID NO: 232701
  Description of Artificial Sequence: Synthetic oligonucleotide

SEQ ID NO: 356191 - DNA, 21 bp, Artificial Sequence
  Description of Artificial Sequence: Synthetic oligonucleotide
ggggagccccgcttcatcgcg

SEQ ID NO: 356192 - DNA, 35 bp, Artificial Sequence; identical to SEQ ID NO: 232702
  Description of Artificial Sequence: Synthetic oligonucleotide

SEQ ID NO: 356193 - DNA, 22 bp, Artificial Sequence
  Description of Artificial Sequence: Synthetic oligonucleotide
gggagccccgcttcatcgcggt

SEQ ID NO: 356194 - DNA, 35 bp, Artificial Sequence; identical to SEQ ID NO: 232703
  Description of Artificial Sequence: Synthetic oligonucleotide

SEQ ID NO: 356195 - DNA, 22 bp, Artificial Sequence
  Description of Artificial Sequence: Synthetic oligonucleotide
ggagccccgcttcatcgcggtg

SEQ ID NO: 356196 - DNA, 35 bp, Artificial Sequence; identical to SEQ ID NO: 232704
  Description of Artificial Sequence: Synthetic oligonucleotide

SEQ ID NO: 356197 - DNA, 22 bp, Artificial Sequence
  Description of Artificial Sequence: Synthetic oligonucleotide
gagccccgcttcatcgcggtgg

SEQ ID NO: 356198 - DNA, 34 bp, Artificial Sequence; identical to SEQ ID NO: 232705
  Description of Artificial Sequence: Synthetic oligonucleotide

SEQ ID NO: 356199 - DNA, 22 bp, Artificial Sequence
  Description of Artificial Sequence: Synthetic oligonucleotide
agccccgcttcatcgcggtggg

SEQ ID NO: 356200 - DNA, 33 bp, Artificial Sequence; identical to SEQ ID NO: 232706
  Description of Artificial Sequence: Synthetic oligonucleotide

SEQ ID NO: 356201 - DNA, 21 bp, Artificial Sequence
  Description of Artificial Sequence: Synthetic oligonucleotide
gccccgcttcatcgcggtggg

SEQ ID NO: 356202 - DNA, 34 bp, Artificial Sequence; identical to SEQ ID NO: 232707
  Description of Artificial Sequence: Synthetic oligonucleotide

SEQ ID NO: 356203 - DNA, 23 bp, Artificial Sequence
  Description of Artificial Sequence: Synthetic oligonucleotide
ccccgcttcatcgcggtgggcta

SEQ ID NO: 356204 - DNA, 34 bp, Artificial Sequence; identical to SEQ ID NO: 232708
  Description of Artificial Sequence: Synthetic oligonucleotide

SEQ ID NO: 356205 - DNA, 23 bp, Artificial Sequence
  Description of Artificial Sequence: Synthetic oligonucleotide
cccgcttcatcgcggtgggctac

SEQ ID NO: 356206 - DNA, 33 bp, Artificial Sequence; identical to SEQ ID NO: 232709
  Description of Artificial Sequence: Synthetic oligonucleotide

SEQ ID NO: 356207 - DNA, 24 bp, Artificial Sequence
  Description of Artificial Sequence: Synthetic oligonucleotide
ccgcttcatcgcggtgggctacgt

SEQ ID NO: 356208 - DNA, 34 bp, Artificial Sequence; identical to SEQ ID NO: 232710
  Description of Artificial Sequence: Synthetic oligonucleotide

SEQ ID NO: 356209 - DNA, 24 bp, Artificial Sequence
  Description of Artificial Sequence: Synthetic oligonucleotide
cgcttcatcgcggtgggctacgtg

SEQ ID NO: 356210 - DNA, 35 bp, Artificial Sequence; identical to SEQ ID NO: 232711
  Description of Artificial Sequence: Synthetic oligonucleotide

SEQ ID NO: 356211 - DNA, 25 bp, Artificial Sequence
  Description of Artificial Sequence: Synthetic oligonucleotide
gcttcatcgcggtgggctacgtgga

SEQ ID NO: 356212 - DNA, 34 bp, Artificial Sequence; identical to SEQ ID NO: 232712
  Description of Artificial Sequence: Synthetic oligonucleotide

SEQ ID NO: 356213 - DNA, 25 bp, Artificial Sequence
  Description of Artificial Sequence: Synthetic oligonucleotide
cttcatcgcggtgggctacgtggac

SEQ ID NO: 356214 - DNA, 34 bp, Artificial Sequence; identical to SEQ ID NO: 232713
  Description of Artificial Sequence: Synthetic oligonucleotide

SEQ ID NO: 356215 - DNA, 26 bp, Artificial Sequence
  Description of Artificial Sequence: Synthetic oligonucleotide
ttcatcgcggtgggctacgtggacga

SEQ ID NO: 356216 - DNA, 33 bp, Artificial Sequence; identical to SEQ ID NO: 232714
  Description of Artificial Sequence: Synthetic oligonucleotide

SEQ ID NO: 356217 - DNA, 25 bp, Artificial Sequence
  Description of Artificial Sequence: Synthetic oligonucleotide
tcatcgcggtgggctacgtggacga

SEQ ID NO: 356218 - DNA, 32 bp, Artificial Sequence; identical to SEQ ID NO: 232715
  Description of Artificial Sequence: Synthetic oligonucleotide

SEQ ID NO: 356219 - DNA, 24 bp, Artificial Sequence
  Description of Artificial Sequence: Synthetic oligonucleotide
catcgcggtgggctacgtggacga

SEQ ID NO: 356220 - DNA, 33 bp, Artificial Sequence; identical to SEQ ID NO: 232716
  Description of Artificial Sequence: Synthetic oligonucleotide

SEQ ID NO: 356221 - DNA, 25 bp, Artificial Sequence
  Description of Artificial Sequence: Synthetic oligonucleotide
atcgcggtgggctacgtggacgaca

SEQ ID NO: 356222 - DNA, 32 bp, Artificial Sequence; identical to SEQ ID NO: 232717
  Description of Artificial Sequence: Synthetic oligonucleotide

SEQ ID NO: 356223 - DNA, 24 bp, Artificial Sequence
  Description of Artificial Sequence: Synthetic oligonucleotide
tcgcggtgggctacgtggacgaca

SEQ ID NO: 356224 - DNA, 35 bp, Artificial Sequence; identical to SEQ ID NO: 232718
  Description of Artificial Sequence: Synthetic oligonucleotide

SEQ ID NO: 356225 - DNA, 23 bp, Artificial Sequence
  Description of Artificial Sequence: Synthetic oligonucleotide
cgcggtgggctacgtggacgaca

SEQ ID NO: 356226 - DNA, 34 bp, Artificial Sequence; identical to SEQ ID NO: 232719
  Description of Artificial Sequence: Synthetic oligonucleotide

SEQ ID NO: 356227 - DNA, 23 bp, Artificial Sequence
  Description of Artificial Sequence: Synthetic oligonucleotide
gcggtgggctacgtggacgacac

SEQ ID NO: 356228 - DNA, 33 bp, Artificial Sequence; identical to SEQ ID NO: 232720
  Description of Artificial Sequence: Synthetic oligonucleotide

SEQ ID NO: 356229 - DNA, 23 bp, Artificial Sequence
  Description of Artificial Sequence: Synthetic oligonucleotide
cggtgggctacgtggacgacacg

SEQ ID NO: 356230 - DNA, 32 bp, Artificial Sequence; identical to SEQ ID NO: 232721
  Description of Artificial Sequence: Synthetic oligonucleotide

SEQ ID NO: 356231 - DNA, 24 bp, Artificial Sequence
  Description of Artificial Sequence: Synthetic oligonucleotide
ggtgggctacgtggacgacacgca

SEQ ID NO: 356232 - DNA, 33 bp, Artificial Sequence; identical to SEQ ID NO: 232722
  Description of Artificial Sequence: Synthetic oligonucleotide

SEQ ID NO: 356233 - DNA, 31 bp, Artificial Sequence; identical to SEQ ID NO: 1167
  Description of Artificial Sequence: Synthetic oligonucleotide

SEQ ID NO: 356234 - DNA, 32 bp, Artificial Sequence; identical to SEQ ID NO: 232723
  Description of Artificial Sequence: Synthetic oligonucleotide

SEQ ID NO: 356235 - DNA, 30 bp, Artificial Sequence; identical to SEQ ID NO: 1168
  Description of Artificial Sequence: Synthetic oligonucleotide

SEQ ID NO: 356236 - DNA, 31 bp, Artificial Sequence; identical to SEQ ID NO: 232724
  Description of Artificial Sequence: Synthetic oligonucleotide

SEQ ID NO: 356237 - DNA, 29 bp, Artificial Sequence
  Description of Artificial Sequence: Synthetic oligonucleotide
cgacggcaaggattacatcgccctgaatg

SEQ ID NO: 356238 - DNA, 30 bp, Artificial Sequence; identical to SEQ ID NO: 232725
  Description of Artificial Sequence: Synthetic oligonucleotide

SEQ ID NO: 356239 - DNA, 30 bp, Artificial Sequence; identical to SEQ ID NO: 1170
  Description of Artificial Sequence: Synthetic oligonucleotide

SEQ ID NO: 356240 - DNA, 31 bp, Artificial Sequence; identical to SEQ ID NO: 232726
  Description of Artificial Sequence: Synthetic oligonucleotide

SEQ ID NO: 356241 - DNA, 30 bp, Artificial Sequence; identical to SEQ ID NO: 1171
  Description of Artificial Sequence: Synthetic oligonucleotide

SEQ ID NO: 356242 - DNA, 30 bp, Artificial Sequence; identical to SEQ ID NO: 232727
  Description of Artificial Sequence: Synthetic oligonucleotide

SEQ ID NO: 356243 - DNA, 29 bp, Artificial Sequence
  Description of Artificial Sequence: Synthetic oligonucleotide
cggcaaggattacatcgccctgaatgagg

SEQ ID NO: 356244 - DNA, 30 bp, Artificial Sequence; identical to SEQ ID NO: 232728
  Description of Artificial Sequence: Synthetic oligonucleotide

SEQ ID NO: 356245 - DNA, 30 bp, Artificial Sequence; identical to SEQ ID NO: 1173
  Description of Artificial Sequence: Synthetic oligonucleotide

SEQ ID NO: 356246 - DNA, 29 bp, Artificial Sequence
  Description of Artificial Sequence: Synthetic oligonucleotide
agtacaccccacctgtggtcaatctcacg

SEQ ID NO: 356247 - DNA, 30 bp, Artificial Sequence; identical to SEQ ID NO: 1174
  Description of Artificial Sequence: Synthetic oligonucleotide

SEQ ID NO: 356248 - DNA, 28 bp, Artificial Sequence
  Description of Artificial Sequence: Synthetic oligonucleotide
gtacaccccacctgtggtcaatctcacg

SEQ ID NO: 356249 - DNA, 31 bp, Artificial Sequence; identical to SEQ ID NO: 1175
  Description of Artificial Sequence: Synthetic oligonucleotide

SEQ ID NO: 356250 - DNA, 29 bp, Artificial Sequence
  Description of Artificial Sequence: Synthetic oligonucleotide
tacaccccacctgtggtcaatctcacgtg

SEQ ID NO: 356251 - DNA, 31 bp, Artificial Sequence; identical to SEQ ID NO: 1176
  Description of Artificial Sequence: Synthetic oligonucleotide

SEQ ID NO: 356252 - DNA, 28 bp, Artificial Sequence
  Description of Artificial Sequence: Synthetic oligonucleotide
acaccccacctgtggtcaatctcacgtg

SEQ ID NO: 356253 - DNA, 30 bp, Artificial Sequence; identical to SEQ ID NO: 1177
  Description of Artificial Sequence: Synthetic oligonucleotide

SEQ ID NO: 356254 - DNA, 27 bp, Artificial Sequence
  Description of Artificial Sequence: Synthetic oligonucleotide
caccccacctgtggtcaatctcacgtg

SEQ ID NO: 356255 - DNA, 29 bp, Artificial Sequence
  Description of Artificial Sequence: Synthetic oligonucleotide
ggattacatcgccctgaatgaggacctgc

SEQ ID NO: 356256 - DNA, 27 bp, Artificial Sequence
  Description of Artificial Sequence: Synthetic oligonucleotide
accccacctgtggtcaatctcacgtgg

SEQ ID NO: 356257 - DNA, 29 bp, Artificial Sequence
  Description of Artificial Sequence: Synthetic oligonucleotide
gattacatcgccctgaatgaggacctgcg

SEQ ID NO: 356258 - DNA, 26 bp, Artificial Sequence
  Description of Artificial Sequence: Synthetic oligonucleotide
ccccacctgtggtcaatctcacgtgg

SEQ ID NO: 356259 - DNA, 29 bp, Artificial Sequence
  Description of Artificial Sequence: Synthetic oligonucleotide
attacatcgccctgaatgaggacctgcgc

SEQ ID NO: 356260 - DNA, 27 bp, Artificial Sequence
  Description of Artificial Sequence: Synthetic oligonucleotide
cccacctgtggtcaatctcacgtggca

SEQ ID NO: 356261 - DNA, 28 bp, Artificial Sequence
  Description of Artificial Sequence: Synthetic oligonucleotide
ttacatcgccctgaatgaggacctgcgc

SEQ ID NO: 356262 - DNA, 28 bp, Artificial Sequence
  Description of Artificial Sequence: Synthetic oligonucleotide
ccacctgtggtcaatctcacgtggcatc

SEQ ID NO: 356263 - DNA, 27 bp, Artificial Sequence
  Description of Artificial Sequence: Synthetic oligonucleotide
tacatcgccctgaatgaggacctgcgc

SEQ ID NO: 356264 - DNA, 28 bp, Artificial Sequence
  Description of Artificial Sequence: Synthetic oligonucleotide
cacctgtggtcaatctcacgtggcatcg

SEQ ID NO: 356265 - DNA, 27 bp, Artificial Sequence
  Description of Artificial Sequence: Synthetic oligonucleotide
acatcgccctgaatgaggacctgcgct

SEQ ID NO: 356266 - DNA, 32 bp, Artificial Sequence; identical to SEQ ID NO: 232739
  Description of Artificial Sequence: Synthetic oligonucleotide

SEQ ID NO: 356267 - DNA, 26 bp, Artificial Sequence
  Description of Artificial Sequence: Synthetic oligonucleotide
catcgccctgaatgaggacctgcgct

SEQ ID NO: 356268 - DNA, 31 bp, Artificial Sequence; identical to SEQ ID NO: 232740
  Description of Artificial Sequence: Synthetic oligonucleotide

SEQ ID NO: 356269 - DNA, 27 bp, Artificial Sequence
  Description of Artificial Sequence: Synthetic oligonucleotide
atcgccctgaatgaggacctgcgctct

SEQ ID NO: 356270 - DNA, 31 bp, Artificial Sequence; identical to SEQ ID NO: 232741
  Description of Artificial Sequence: Synthetic oligonucleotide

SEQ ID NO: 356271 - DNA, 27 bp, Artificial Sequence
  Description of Artificial Sequence: Synthetic oligonucleotide
tcgccctgaatgaggacctgcgctctt

SEQ ID NO: 356272 - DNA, 35 bp, Artificial Sequence; identical to SEQ ID NO: 232742
  Description of Artificial Sequence: Synthetic oligonucleotide

SEQ ID NO: 356273 - DNA, 26 bp, Artificial Sequence
  Description of Artificial Sequence: Synthetic oligonucleotide
cgccctgaatgaggacctgcgctctt

SEQ ID NO: 356274 - DNA, 34 bp, Artificial Sequence; identical to SEQ ID NO: 232743
  Description of Artificial Sequence: Synthetic oligonucleotide

SEQ ID NO: 356275 - DNA, 26 bp, Artificial Sequence
  Description of Artificial Sequence: Synthetic oligonucleotide
gccctgaatgaggacctgcgctcttg

SEQ ID NO: 356276 - DNA, 34 bp, Artificial Sequence; identical to SEQ ID NO: 232744
  Description of Artificial Sequence: Synthetic oligonucleotide

SEQ ID NO: 356277 - DNA, 27 bp, Artificial Sequence
  Description of Artificial Sequence: Synthetic oligonucleotide
ccctgaatgaggacctgcgctcttgga

SEQ ID NO: 356278 - DNA, 33 bp, Artificial Sequence; identical to SEQ ID NO: 232745
  Description of Artificial Sequence: Synthetic oligonucleotide

SEQ ID NO: 356279 - DNA, 27 bp, Artificial Sequence
  Description of Artificial Sequence: Synthetic oligonucleotide
cctgaatgaggacctgcgctcttggac

SEQ ID NO: 356280 - DNA, 34 bp, Artificial Sequence; identical to SEQ ID NO: 232746
  Description of Artificial Sequence: Synthetic oligonucleotide

SEQ ID NO: 356281 - DNA, 27 bp, Artificial Sequence
  Description of Artificial Sequence: Synthetic oligonucleotide
ctgaatgaggacctgcgctcttggacc

SEQ ID NO: 356282 - DNA, 35 bp, Artificial Sequence; identical to SEQ ID NO: 232747
  Description of Artificial Sequence: Synthetic oligonucleotide

SEQ ID NO: 356283 - DNA, 27 bp, Artificial Sequence
  Description of Artificial Sequence: Synthetic oligonucleotide
tgaatgaggacctgcgctcttggaccg

SEQ ID NO: 356284 - DNA, 34 bp, Artificial Sequence; identical to SEQ ID NO: 232748
  Description of Artificial Sequence: Synthetic oligonucleotide

SEQ ID NO: 356285 - DNA, 26 bp, Artificial Sequence
  Description of Artificial Sequence: Synthetic oligonucleotide
gaatgaggacctgcgctcttggaccg

SEQ ID NO: 356286 - DNA, 35 bp, Artificial Sequence; identical to SEQ ID NO: 232749
  Description of Artificial Sequence: Synthetic oligonucleotide

SEQ ID NO: 356287 - DNA, 26 bp, Artificial Sequence
  Description of Artificial Sequence: Synthetic oligonucleotide
aatgaggacctgcgctcttggaccgc

SEQ ID NO: 356288 - DNA, 34 bp, Artificial Sequence; identical to SEQ ID NO: 232750
  Description of Artificial Sequence: Synthetic oligonucleotide

SEQ ID NO: 356289 - DNA, 25 bp, Artificial Sequence
  Description of Artificial Sequence: Synthetic oligonucleotide
atgaggacctgcgctcttggaccgc

SEQ ID NO: 356290 - DNA, 33 bp, Artificial Sequence; identical to SEQ ID NO: 232751
  Description of Artificial Sequence: Synthetic oligonucleotide

SEQ ID NO: 356291 - DNA, 24 bp, Artificial Sequence
  Description of Artificial Sequence: Synthetic oligonucleotide
tgaggacctgcgctcttggaccgc

SEQ ID NO: 356292 - DNA, 32 bp, Artificial Sequence; identical to SEQ ID NO: 232752
  Description of Artificial Sequence: Synthetic oligonucleotide

SEQ ID NO: 356293 - DNA, 27 bp, Artificial Sequence
  Description of Artificial Sequence: Synthetic oligonucleotide
gtggatagagcaggaggggccggaata

SEQ ID NO: 356294 - DNA, 32 bp, Artificial Sequence; identical to SEQ ID NO: 232753
  Description of Artificial Sequence: Synthetic oligonucleotide

SEQ ID NO: 356295 - DNA, 29 bp, Artificial Sequence
  Description of Artificial Sequence: Synthetic oligonucleotide
tggatagagcaggaggggccggaatattg

SEQ ID NO: 356296 - DNA, 31 bp, Artificial Sequence; identical to SEQ ID NO: 232754
  Description of Artificial Sequence: Synthetic oligonucleotide

SEQ ID NO: 356297 - DNA, 28 bp, Artificial Sequence
  Description of Artificial Sequence: Synthetic oligonucleotide
ggatagagcaggaggggccggaatattg

SEQ ID NO: 356298 - DNA, 32 bp, Artificial Sequence; identical to SEQ ID NO: 232755
  Description of Artificial Sequence: Synthetic oligonucleotide

SEQ ID NO: 356299 - DNA, 28 bp, Artificial Sequence
  Description of Artificial Sequence: Synthetic oligonucleotide
gatagagcaggaggggccggaatattgg

SEQ ID NO: 356300 - DNA, 31 bp, Artificial Sequence; identical to SEQ ID NO: 232756
  Description of Artificial Sequence: Synthetic oligonucleotide

SEQ ID NO: 356301 - DNA, 28 bp, Artificial Sequence
  Description of Artificial Sequence: Synthetic oligonucleotide
atagagcaggaggggccggaatattggg

SEQ ID NO: 356302 - DNA, 32 bp, Artificial Sequence; identical to SEQ ID NO: 232757
  Description of Artificial Sequence: Synthetic oligonucleotide

SEQ ID NO: 356303 - DNA, 27 bp, Artificial Sequence
  Description of Artificial Sequence: Synthetic oligonucleotide
tagagcaggaggggccggaatattggg

SEQ ID NO: 356304 - DNA, 32 bp, Artificial Sequence; identical to SEQ ID NO: 232758
  Description of Artificial Sequence: Synthetic oligonucleotide

SEQ ID NO: 356305 - DNA, 27 bp, Artificial Sequence
  Description of Artificial Sequence: Synthetic oligonucleotide
agagcaggaggggccggaatattggga

SEQ ID NO: 356306 - DNA, 31 bp, Artificial Sequence; identical to SEQ ID NO: 232759
  Description of Artificial Sequence: Synthetic oligonucleotide

SEQ ID NO: 356307 - DNA, 26 bp, Artificial Sequence
  Description of Artificial Sequence: Synthetic oligonucleotide
gagcaggaggggccggaatattggga

SEQ ID NO: 356308 - DNA, 32 bp, Artificial Sequence; identical to SEQ ID NO: 232760
  Description of Artificial Sequence: Synthetic oligonucleotide

SEQ ID NO: 356309 - DNA, 26 bp, Artificial Sequence
  Description of Artificial Sequence: Synthetic oligonucleotide
agcaggaggggccggaatattgggac

SEQ ID NO: 356310 - DNA, 33 bp, Artificial Sequence; identical to SEQ ID NO: 232761
  Description of Artificial Sequence: Synthetic oligonucleotide

SEQ ID NO: 356311 - DNA, 25 bp, Artificial Sequence
  Description of Artificial Sequence: Synthetic oligonucleotide
gcaggaggggccggaatattgggac

SEQ ID NO: 356312 - DNA, 34 bp, Artificial Sequence; identical to SEQ ID NO: 232762
  Description of Artificial Sequence: Synthetic oligonucleotide

SEQ ID NO: 356313 - DNA, 26 bp, Artificial Sequence
  Description of Artificial Sequence: Synthetic oligonucleotide
caggaggggccggaatattgggacca

SEQ ID NO: 356314 - DNA, 33 bp, Artificial Sequence; identical to SEQ ID NO: 232763
  Description of Artificial Sequence: Synthetic oligonucleotide

SEQ ID NO: 356315 - DNA, 26 bp, Artificial Sequence
  Description of Artificial Sequence: Synthetic oligonucleotide
aggaggggccggaatattgggaccag

SEQ ID NO: 356316 - DNA, 32 bp, Artificial Sequence; identical to SEQ ID NO: 232764
  Description of Artificial Sequence: Synthetic oligonucleotide

SEQ ID NO: 356317 - DNA, 25 bp, Artificial Sequence
  Description of Artificial Sequence: Synthetic oligonucleotide
ggaggggccggaatattgggaccag

SEQ ID NO: 356318 - DNA, 33 bp, Artificial Sequence; identical to SEQ ID NO: 232765
  Description of Artificial Sequence: Synthetic oligonucleotide

SEQ ID NO: 356319 - DNA, 26 bp, Artificial Sequence
  Description of Artificial Sequence: Synthetic oligonucleotide
gaggggccggaatattgggaccagga

SEQ ID NO: 356320 - DNA, 34 bp, Artificial Sequence; identical to SEQ ID NO: 232766
  Description of Artificial Sequence: Synthetic oligonucleotide

SEQ ID NO: 356321 - DNA, 27 bp, Artificial Sequence
  Description of Artificial Sequence: Synthetic oligonucleotide
aggggccggaatattgggaccaggaga

SEQ ID NO: 356322 - DNA, 33 bp, Artificial Sequence; identical to SEQ ID NO: 232767
  Description of Artificial Sequence: Synthetic oligonucleotide

SEQ ID NO: 356323 - DNA, 26 bp, Artificial Sequence
  Description of Artificial Sequence: Synthetic oligonucleotide
ggggccggaatattgggaccaggaga

SEQ ID NO: 356324 - DNA, 32 bp, Artificial Sequence; identical to SEQ ID NO: 232768
  Description of Artificial Sequence: Synthetic oligonucleotide

SEQ ID NO: 356325 - DNA, 27 bp, Artificial Sequence
  Description of Artificial Sequence: Synthetic oligonucleotide
gggccggaatattgggaccaggagaca

SEQ ID NO: 356326 - DNA, 31 bp, Artificial Sequence; identical to SEQ ID NO: 232769
  Description of Artificial Sequence: Synthetic oligonucleotide

SEQ ID NO: 356327 - DNA, 27 bp, Artificial Sequence
  Description of Artificial Sequence: Synthetic oligonucleotide
ggccggaatattgggaccaggagacac

SEQ ID NO: 356328 - DNA, 30 bp, Artificial Sequence; identical to SEQ ID NO: 232770
  Description of Artificial Sequence: Synthetic oligonucleotide

SEQ ID NO: 356329 - DNA, 27 bp, Artificial Sequence
  Description of Artificial Sequence: Synthetic oligonucleotide
gccggaatattgggaccaggagacacg

SEQ ID NO: 356330 - DNA, 31 bp, Artificial Sequence; identical to SEQ ID NO: 232771
  Description of Artificial Sequence: Synthetic oligonucleotide

SEQ ID NO: 356331 - DNA, 27 bp, Artificial Sequence
  Description of Artificial Sequence: Synthetic oligonucleotide
ccggaatattgggaccaggagacacgg

SEQ ID NO: 356332 - DNA, 32 bp, Artificial Sequence; identical to SEQ ID NO: 232772
  Description of Artificial Sequence: Synthetic oligonucleotide

SEQ ID NO: 356333 - DNA, 32 bp, Artificial Sequence; identical to SEQ ID NO: 1217
  Description of Artificial Sequence: Synthetic oligonucleotide

SEQ ID NO: 356334 - DNA, 31 bp, Artificial Sequence; identical to SEQ ID NO: 232773
  Description of Artificial Sequence: Synthetic oligonucleotide

SEQ ID NO: 356335 - DNA, 34 bp, Artificial Sequence; identical to SEQ ID NO: 1218
  Description of Artificial Sequence: Synthetic oligonucleotide

SEQ ID NO: 356336 - DNA, 30 bp, Artificial Sequence; identical to SEQ ID NO: 232774
  Description of Artificial Sequence: Synthetic oligonucleotide

SEQ ID NO: 356337 - DNA, 34 bp, Artificial Sequence; identical to SEQ ID NO: 1219
  Description of Artificial Sequence: Synthetic oligonucleotide

SEQ ID NO: 356338 - DNA, 29 bp, Artificial Sequence
  Description of Artificial Sequence: Synthetic oligonucleotide
acctgtctccacaggagagtcagagactg

SEQ ID NO: 356339 - DNA, 34 bp, Artificial Sequence; identical to SEQ ID NO: 1220
  Description of Artificial Sequence: Synthetic oligonucleotide

SEQ ID NO: 356340 - DNA, 28 bp, Artificial Sequence
  Description of Artificial Sequence: Synthetic oligonucleotide
cctgtctccacaggagagtcagagactg

SEQ ID NO: 356341 - DNA, 33 bp, Artificial Sequence; identical to SEQ ID NO: 1221
  Description of Artificial Sequence: Synthetic oligonucleotide

SEQ ID NO: 356342 - DNA, 29 bp, Artificial Sequence
  Description of Artificial Sequence: Synthetic oligonucleotide
ctgtctccacaggagagtcagagactgtc

SEQ ID NO: 356343 - DNA, 26 bp, Artificial Sequence
  Description of Artificial Sequence: Synthetic oligonucleotide
tgcgtggacgggctccgcagatactt

SEQ ID NO: 356344 - DNA, 31 bp, Artificial Sequence; identical to SEQ ID NO: 232778
  Description of Artificial Sequence: Synthetic oligonucleotide

SEQ ID NO: 356345 - DNA, 25 bp, Artificial Sequence
  Description of Artificial Sequence: Synthetic oligonucleotide
gcgtggacgggctccgcagatactt

SEQ ID NO: 356346 - DNA, 30 bp, Artificial Sequence; identical to SEQ ID NO: 232779
  Description of Artificial Sequence: Synthetic oligonucleotide

SEQ ID NO: 356347 - DNA, 25 bp, Artificial Sequence
  Description of Artificial Sequence: Synthetic oligonucleotide
cgtggacgggctccgcagatacttg

SEQ ID NO: 356348 - DNA, 30 bp, Artificial Sequence; identical to SEQ ID NO: 232780
  Description of Artificial Sequence: Synthetic oligonucleotide

SEQ ID NO: 356349 - DNA, 26 bp, Artificial Sequence
  Description of Artificial Sequence: Synthetic oligonucleotide
gtggacgggctccgcagatacttgga

SEQ ID NO: 356350 - DNA, 29 bp, Artificial Sequence
  Description of Artificial Sequence: Synthetic oligonucleotide
ctccacaggagagtcagagactgtcttcc

SEQ ID NO: 356351 - DNA, 27 bp, Artificial Sequence
  Description of Artificial Sequence: Synthetic oligonucleotide
tggacgggctccgcagatacttggaga

SEQ ID NO: 356352 - DNA, 30 bp, Artificial Sequence; identical to SEQ ID NO: 232782
  Description of Artificial Sequence: Synthetic oligonucleotide

SEQ ID NO: 356353 - DNA, 27 bp, Artificial Sequence
  Description of Artificial Sequence: Synthetic oligonucleotide
ggacgggctccgcagatacttggagaa

SEQ ID NO: 356354 - DNA, 29 bp, Artificial Sequence
  Description of Artificial Sequence: Synthetic oligonucleotide
ccacaggagagtcagagactgtcttcctg

SEQ ID NO: 356355 - DNA, 27 bp, Artificial Sequence
  Description of Artificial Sequence: Synthetic oligonucleotide
gacgggctccgcagatacttggagaac

SEQ ID NO: 356356 - DNA, 29 bp, Artificial Sequence
  Description of Artificial Sequence: Synthetic oligonucleotide
cacaggagagtcagagactgtcttcctgg

SEQ ID NO: 356357 - DNA, 27 bp, Artificial Sequence
  Description of Artificial Sequence: Synthetic oligonucleotide
acgggctccgcagatacttggagaacg

SEQ ID NO: 356358 - DNA, 29 bp, Artificial Sequence
  Description of Artificial Sequence: Synthetic oligonucleotide
acaggagagtcagagactgtcttcctggc

SEQ ID NO: 356359 - DNA, 26 bp, Artificial Sequence
  Description of Artificial Sequence: Synthetic oligonucleotide
cgggctccgcagatacttggagaacg

SEQ ID NO: 356360 - DNA, 28 bp, Artificial Sequence
  Description of Artificial Sequence: Synthetic oligonucleotide
caggagagtcagagactgtcttcctggc

SEQ ID NO: 356361 - DNA, 26 bp, Artificial Sequence
  Description of Artificial Sequence: Synthetic oligonucleotide
gggctccgcagatacttggagaacgg

SEQ ID NO: 356362 - DNA, 28 bp, Artificial Sequence
  Description of Artificial Sequence: Synthetic oligonucleotide
aggagagtcagagactgtcttcctggcc

SEQ ID NO: 356363 - DNA, 27 bp, Artificial Sequence
  Description of Artificial Sequence: Synthetic oligonucleotide
ggctccgcagatacttggagaacggga

SEQ ID NO: 356364 - DNA, 27 bp, Artificial Sequence
  Description of Artificial Sequence: Synthetic oligonucleotide
ggagagtcagagactgtcttcctggcc

SEQ ID NO: 356365 - DNA, 28 bp, Artificial Sequence
  Description of Artificial Sequence: Synthetic oligonucleotide
gctccgcagatacttggagaacgggaag

SEQ ID NO: 356366 - DNA, 28 bp, Artificial Sequence
  Description of Artificial Sequence: Synthetic oligonucleotide
gagagtcagagactgtcttcctggccag

SEQ ID NO: 356367 - DNA, 28 bp, Artificial Sequence
  Description of Artificial Sequence: Synthetic oligonucleotide
ctccgcagatacttggagaacgggaagg

SEQ ID NO: 356368 - DNA, 28 bp, Artificial Sequence
  Description of Artificial Sequence: Synthetic oligonucleotide
agagtcagagactgtcttcctggccagg

SEQ ID NO: 356369 - DNA, 29 bp, Artificial Sequence
  Description of Artificial Sequence: Synthetic oligonucleotide
tccgcagatacttggagaacgggaaggag

SEQ ID NO: 356370 - DNA, 27 bp, Artificial Sequence
  Description of Artificial Sequence: Synthetic oligonucleotide
gagtcagagactgtcttcctggccagg

SEQ ID NO: 356371 - DNA, 28 bp, Artificial Sequence
  Description of Artificial Sequence: Synthetic oligonucleotide
ccgcagatacttggagaacgggaaggag

SEQ ID NO: 356372 - DNA, 27 bp, Artificial Sequence
  Description of Artificial Sequence: Synthetic oligonucleotide
agtcagagactgtcttcctggccaggg

SEQ ID NO: 356373 - DNA, 29 bp, Artificial Sequence
  Description of Artificial Sequence: Synthetic oligonucleotide
cgcagatacttggagaacgggaaggagac

SEQ ID NO: 356374 - DNA, 27 bp, Artificial Sequence
  Description of Artificial Sequence: Synthetic oligonucleotide
gtcagagactgtcttcctggccaggga

SEQ ID NO: 356375 - DNA, 29 bp, Artificial Sequence
  Description of Artificial Sequence: Synthetic oligonucleotide
gcagatacttggagaacgggaaggagacg

SEQ ID NO: 356376 - DNA, 28 bp, Artificial Sequence
  Description of Artificial Sequence: Synthetic oligonucleotide
tcagagactgtcttcctggccagggaag

SEQ ID NO: 356377 - DNA, 29 bp, Artificial Sequence
  Description of Artificial Sequence: Synthetic oligonucleotide
cagatacttggagaacgggaaggagacgc

SEQ ID NO: 356378 - DNA, 27 bp, Artificial Sequence
  Description of Artificial Sequence: Synthetic oligonucleotide
cagagactgtcttcctggccagggaag

SEQ ID NO: 356379 - DNA, 30 bp, Artificial Sequence; identical to SEQ ID NO: 1240
  Description of Artificial Sequence: Synthetic oligonucleotide

SEQ ID NO: 356380 - DNA, 28 bp, Artificial Sequence
  Description of Artificial Sequence: Synthetic oligonucleotide
agagactgtcttcctggccagggaagtc

SEQ ID NO: 356381 - DNA, 29 bp, Artificial Sequence
  Description of Artificial Sequence: Synthetic oligonucleotide
gatacttggagaacgggaaggagacgctg

SEQ ID NO: 356382 - DNA, 27 bp, Artificial Sequence
  Description of Artificial Sequence: Synthetic oligonucleotide
gagactgtcttcctggccagggaagtc

SEQ ID NO: 356383 - DNA, 29 bp, Artificial Sequence
  Description of Artificial Sequence: Synthetic oligonucleotide
atacttggagaacgggaaggagacgctgc

SEQ ID NO: 356384 - DNA, 27 bp, Artificial Sequence
  Description of Artificial Sequence: Synthetic oligonucleotide
agactgtcttcctggccagggaagtcc

SEQ ID NO: 356385 - DNA, 28 bp, Artificial Sequence
  Description of Artificial Sequence: Synthetic oligonucleotide
tacttggagaacgggaaggagacgctgc

SEQ ID NO: 356386 - DNA, 27 bp, Artificial Sequence
  Description of Artificial Sequence: Synthetic oligonucleotide
gactgtcttcctggccagggaagtcca

SEQ ID NO: 356387 - DNA, 27 bp, Artificial Sequence
  Description of Artificial Sequence: Synthetic oligonucleotide
acttggagaacgggaaggagacgctgc

SEQ ID NO: 356388 - DNA, 27 bp, Artificial Sequence
  Description of Artificial Sequence: Synthetic oligonucleotide
actgtcttcctggccagggaagtccac

SEQ ID NO: 356389 - DNA, 27 bp, Artificial Sequence
  Description of Artificial Sequence: Synthetic oligonucleotide
cttggagaacgggaaggagacgctgca

SEQ ID NO: 356390 - DNA, 26 bp, Artificial Sequence
  Description of Artificial Sequence: Synthetic oligonucleotide
ctgtcttcctggccagggaagtccac

SEQ ID NO: 356391 - DNA, 27 bp, Artificial Sequence
  Description of Artificial Sequence: Synthetic oligonucleotide
ttggagaacgggaaggagacgctgcag

SEQ ID NO: 356392 - DNA, 27 bp, Artificial Sequence
  Description of Artificial Sequence: Synthetic oligonucleotide
tgtcttcctggccagggaagtccacct

SEQ ID NO: 356393 - DNA, 21 bp, Artificial Sequence
  Description of Artificial Sequence: Synthetic oligonucleotide
acatccgtgtcccggcccggg

SEQ ID NO: 356394 - DNA, 27 bp, Artificial Sequence
  Description of Artificial Sequence: Synthetic oligonucleotide
gtcttcctggccagggaagtccacctt

SEQ ID NO: 356395 - DNA, 20 bp, Artificial Sequence
  Description of Artificial Sequence: Synthetic oligonucleotide
catccgtgtcccggcccggg

SEQ ID NO: 356396 - DNA, 29 bp, Artificial Sequence
  Description of Artificial Sequence: Synthetic oligonucleotide
tcttcctggccagggaagtccaccttttg

SEQ ID NO: 356397 - DNA, 20 bp, Artificial Sequence
  Description of Artificial Sequence: Synthetic oligonucleotide
atccgtgtcccggcccgggc

SEQ ID NO: 356398 - DNA, 28 bp, Artificial Sequence
  Description of Artificial Sequence: Synthetic oligonucleotide
cttcctggccagggaagtccaccttttg

SEQ ID NO: 356399 - DNA, 20 bp, Artificial Sequence
  Description of Artificial Sequence: Synthetic oligonucleotide
tccgtgtcccggcccgggct

SEQ ID NO: 356400 - DNA, 28 bp, Artificial Sequence
  Description of Artificial Sequence: Synthetic oligonucleotide
ttcctggccagggaagtccaccttttgc

SEQ ID NO: 356401 - DNA, 20 bp, Artificial Sequence
  Description of Artificial Sequence: Synthetic oligonucleotide
ccgtgtcccggcccgggctt

SEQ ID NO: 356402 - DNA, 27 bp, Artificial Sequence
  Description of Artificial Sequence: Synthetic oligonucleotide
tcctggccagggaagtccaccttttgc

SEQ ID NO: 356403 - DNA, 20 bp, Artificial Sequence
  Description of Artificial Sequence: Synthetic oligonucleotide
cgtgtcccggcccgggcgtt

SEQ ID NO: 356404 - DNA, 26 bp, Artificial Sequence
  Description of Artificial Sequence: Synthetic oligonucleotide
cctggccagggaagtccaccttttgc

SEQ ID NO: 356405 - DNA, 20 bp, Artificial Sequence
  Description of Artificial Sequence: Synthetic oligonucleotide
gtgtcccggcccgggcgctt

SEQ ID NO: 356406 - DNA, 26 bp, Artificial Sequence
  Description of Artificial Sequence: Synthetic oligonucleotide
ctggccagggaagtccaccttttgcg

SEQ ID NO: 356407 - DNA, 20 bp, Artificial Sequence
  Description of Artificial Sequence: Synthetic oligonucleotide
tgtcccggcccgggcgcgtt

SEQ ID NO: 356408 - DNA, 27 bp, Artificial Sequence
  Description of Artificial Sequence: Synthetic oligonucleotide
tggccagggaagtccaccttttgcgca

SEQ ID NO: 356409 - DNA, 20 bp, Artificial Sequence
  Description of Artificial Sequence: Synthetic oligonucleotide
gtcccggcccgggcgcgttt

SEQ ID NO: 356410 - DNA, 27 bp, Artificial Sequence
  Description of Artificial Sequence: Synthetic oligonucleotide
ggccagggaagtccaccttttgcgcaa

SEQ ID NO: 356411 - DNA, 20 bp, Artificial Sequence
  Description of Artificial Sequence: Synthetic oligonucleotide
tcccggcccgggcgcggttt

SEQ ID NO: 356412 - DNA, 27 bp, Artificial Sequence
  Description of Artificial Sequence: Synthetic oligonucleotide
gccagggaagtccaccttttgcgcaag

SEQ ID NO: 356413 - DNA, 20 bp, Artificial Sequence
  Description of Artificial Sequence: Synthetic oligonucleotide
cccggcccgggcgcggtttt

SEQ ID NO: 356414 - DNA, 29 bp, Artificial Sequence
  Description of Artificial Sequence: Synthetic oligonucleotide
ccagggaagtccaccttttgcgcaagttc

SEQ ID NO: 356415 - DNA, 20 bp, Artificial Sequence
  Description of Artificial Sequence: Synthetic oligonucleotide
ccggcccgggcgcgggtttt

SEQ ID NO: 356416 - DNA, 29 bp, Artificial Sequence
  Description of Artificial Sequence: Synthetic oligonucleotide
cagggaagtccaccttttgcgcaagttcg

SEQ ID NO: 356417 - DNA, 20 bp, Artificial Sequence
  Description of Artificial Sequence: Synthetic oligonucleotide
cggcccgggcgcggggattt

SEQ ID NO: 356418 - DNA, 30 bp, Artificial Sequence; identical to SEQ ID NO: 232815
  Description of Artificial Sequence: Synthetic oligonucleotide

SEQ ID NO: 356419 - DNA, 20 bp, Artificial Sequence
  Description of Artificial Sequence: Synthetic oligonucleotide
ggcccgggcgcggggagttt

SEQ ID NO: 356420 - DNA, 29 bp, Artificial Sequence
  Description of Artificial Sequence: Synthetic oligonucleotide
gggaagtccaccttttgcgcaagttcgac

SEQ ID NO: 356421 - DNA, 20 bp, Artificial Sequence
  Description of Artificial Sequence: Synthetic oligonucleotide
gcccgggcgcggggagcttt

SEQ ID NO: 356422 - DNA, 32 bp, Artificial Sequence; identical to SEQ ID NO: 232817
  Description of Artificial Sequence: Synthetic oligonucleotide

SEQ ID NO: 356423 - DNA, 20 bp, Artificial Sequence
  Description of Artificial Sequence: Synthetic oligonucleotide
cccgggcgcggggagccttt

SEQ ID NO: 356424 - DNA, 33 bp, Artificial Sequence; identical to SEQ ID NO: 232818
  Description of Artificial Sequence: Synthetic oligonucleotide

SEQ ID NO: 356425 - DNA, 20 bp, Artificial Sequence
  Description of Artificial Sequence: Synthetic oligonucleotide
ccgggcgcggggagcccttt

SEQ ID NO: 356426 - DNA, 33 bp, Artificial Sequence; identical to SEQ ID NO: 232819
  Description of Artificial Sequence: Synthetic oligonucleotide

SEQ ID NO: 356427 - DNA, 20 bp, Artificial Sequence
  Description of Artificial Sequence: Synthetic oligonucleotide
cgggcgcggggagccccttt

SEQ ID NO: 356428 - DNA, 32 bp, Artificial Sequence; identical to SEQ ID NO: 232820
  Description of Artificial Sequence: Synthetic oligonucleotide

SEQ ID NO: 356429 - DNA, 20 bp, Artificial Sequence
  Description of Artificial Sequence: Synthetic oligonucleotide
gggcgcggggagccccgttt

SEQ ID NO: 356430 - DNA, 31 bp, Artificial Sequence; identical to SEQ ID NO: 232821
  Description of Artificial Sequence: Synthetic oligonucleotide

SEQ ID NO: 356431 - DNA, 20 bp, Artificial Sequence
  Description of Artificial Sequence: Synthetic oligonucleotide
ggcgcggggagccccgcttt

SEQ ID NO: 356432 - DNA, 31 bp, Artificial Sequence; identical to SEQ ID NO: 232822
  Description of Artificial Sequence: Synthetic oligonucleotide

SEQ ID NO: 356433 - DNA, 21 bp, Artificial Sequence
  Description of Artificial Sequence: Synthetic oligonucleotide
gcgcggggagccccgcttcat

SEQ ID NO: 356434 - DNA, 30 bp, Artificial Sequence; identical to SEQ ID NO: 232823
  Description of Artificial Sequence: Synthetic oligonucleotide

SEQ ID NO: 356435 - DNA, 24 bp, Artificial Sequence
  Description of Artificial Sequence: Synthetic oligonucleotide
gaggacctgcgctcttggaccgca

SEQ ID NO: 356436 - DNA, 30 bp, Artificial Sequence; identical to SEQ ID NO: 232824
  Description of Artificial Sequence: Synthetic oligonucleotide

SEQ ID NO: 356437 - DNA, 24 bp, Artificial Sequence
  Description of Artificial Sequence: Synthetic oligonucleotide
aggacctgcgctcttggaccgcag

SEQ ID NO: 356438 - DNA, 32 bp, Artificial Sequence; identical to SEQ ID NO: 232825
  Description of Artificial Sequence: Synthetic oligonucleotide

SEQ ID NO: 356439 - DNA, 23 bp, Artificial Sequence
  Description of Artificial Sequence: Synthetic oligonucleotide
ggacctgcgctcttggaccgcag

SEQ ID NO: 356440 - DNA, 31 bp, Artificial Sequence; identical to SEQ ID NO: 232826
  Description of Artificial Sequence: Synthetic oligonucleotide

SEQ ID NO: 356441 - DNA, 23 bp, Artificial Sequence
  Description of Artificial Sequence: Synthetic oligonucleotide
gacctgcgctcttggaccgcagc

SEQ ID NO: 356442 - DNA, 31 bp, Artificial Sequence; identical to SEQ ID NO: 232827
  Description of Artificial Sequence: Synthetic oligonucleotide

SEQ ID NO: 356443 - DNA, 23 bp, Artificial Sequence
  Description of Artificial Sequence: Synthetic oligonucleotide
acctgcgctcttggaccgcagcg

SEQ ID NO: 356444 - DNA, 32 bp, Artificial Sequence; identical to SEQ ID NO: 232828
  Description of Artificial Sequence: Synthetic oligonucleotide

SEQ ID NO: 356445 - DNA, 22 bp, Artificial Sequence
  Description of Artificial Sequence: Synthetic oligonucleotide
cctgcgctcttggaccgcagcg

SEQ ID NO: 356446 - DNA, 31 bp, Artificial Sequence; identical to SEQ ID NO: 232829
  Description of Artificial Sequence: Synthetic oligonucleotide

SEQ ID NO: 356447 - DNA, 23 bp, Artificial Sequence
  Description of Artificial Sequence: Synthetic oligonucleotide
ctgcgctcttggaccgcagcgga

SEQ ID NO: 356448 - DNA, 30 bp, Artificial Sequence; identical to SEQ ID NO: 232830
  Description of Artificial Sequence: Synthetic oligonucleotide

SEQ ID NO: 356449 - DNA, 25 bp, Artificial Sequence
  Description of Artificial Sequence: Synthetic oligonucleotide
tgcgctcttggaccgcagcggacat

SEQ ID NO: 356450 - DNA, 29 bp, Artificial Sequence
  Description of Artificial Sequence: Synthetic oligonucleotide
tgcgcaagttcgactatctccgcttcctg

SEQ ID NO: 356451 - DNA, 24 bp, Artificial Sequence
  Description of Artificial Sequence: Synthetic oligonucleotide
gcgctcttggaccgcagcggacat

SEQ ID NO: 356452 - DNA, 28 bp, Artificial Sequence
  Description of Artificial Sequence: Synthetic oligonucleotide
gcgcaagttcgactatctccgcttcctg

SEQ ID NO: 356453 - DNA, 24 bp, Artificial Sequence
  Description of Artificial Sequence: Synthetic oligonucleotide
cgctcttggaccgcagcggacatg

SEQ ID NO: 356454 - DNA, 28 bp, Artificial Sequence
  Description of Artificial Sequence: Synthetic oligonucleotide
cgcaagttcgactatctccgcttcctgc

SEQ ID NO: 356455 - DNA, 24 bp, Artificial Sequence
  Description of Artificial Sequence: Synthetic oligonucleotide
gctcttggaccgcagcggacatgg

SEQ ID NO: 356456 - DNA, 28 bp, Artificial Sequence
  Description of Artificial Sequence: Synthetic oligonucleotide
gcaagttcgactatctccgcttcctgcc

SEQ ID NO: 356457 - DNA, 25 bp, Artificial Sequence
  Description of Artificial Sequence: Synthetic oligonucleotide
ctcttggaccgcagcggacatggca

SEQ ID NO: 356458 - DNA, 28 bp, Artificial Sequence
  Description of Artificial Sequence: Synthetic oligonucleotide
caagttcgactatctccgcttcctgccg

SEQ ID NO: 356459 - DNA, 25 bp, Artificial Sequence
  Description of Artificial Sequence: Synthetic oligonucleotide
tcttggaccgcagcggacatggcag

SEQ ID NO: 356460 - DNA, 29 bp, Artificial Sequence
  Description of Artificial Sequence: Synthetic oligonucleotide
aagttcgactatctccgcttcctgccgtc

SEQ ID NO: 356461 - DNA, 24 bp, Artificial Sequence
  Description of Artificial Sequence: Synthetic oligonucleotide
cttggaccgcagcggacatggcag

SEQ ID NO: 356462 - DNA, 28 bp, Artificial Sequence
  Description of Artificial Sequence: Synthetic oligonucleotide
agttcgactatctccgcttcctgccgtc

SEQ ID NO: 356463 - DNA, 25 bp, Artificial Sequence
  Description of Artificial Sequence: Synthetic oligonucleotide
ttggaccgcagcggacatggcagct

SEQ ID NO: 356464 - DNA, 27 bp, Artificial Sequence
  Description of Artificial Sequence: Synthetic oligonucleotide
gttcgactatctccgcttcctgccgtc

SEQ ID NO: 356465 - DNA, 24 bp, Artificial Sequence
  Description of Artificial Sequence: Synthetic oligonucleotide
tggaccgcagcggacatggcagct

SEQ ID NO: 356466 - DNA, 29 bp, Artificial Sequence
  Description of Artificial Sequence: Synthetic oligonucleotide
ttcgactatctccgcttcctgccgtcaac

SEQ ID NO: 356467 - DNA, 23 bp, Artificial Sequence
  Description of Artificial Sequence: Synthetic oligonucleotide
ggaccgcagcggacatggcagct

SEQ ID NO: 356468 - DNA, 28 bp, Artificial Sequence
  Description of Artificial Sequence: Synthetic oligonucleotide
tcgactatctccgcttcctgccgtcaac

SEQ ID NO: 356469 - DNA, 24 bp, Artificial Sequence
  Description of Artificial Sequence: Synthetic oligonucleotide
gaccgcagcggacatggcagctca

SEQ ID NO: 356470 - DNA, 27 bp, Artificial Sequence
  Description of Artificial Sequence: Synthetic oligonucleotide
cgactatctccgcttcctgccgtcaac

SEQ ID NO: 356471 - DNA, 26 bp, Artificial Sequence
  Description of Artificial Sequence: Synthetic oligonucleotide
accgcagcggacatggcagctcagat

SEQ ID NO: 356472 - DNA, 28 bp, Artificial Sequence
  Description of Artificial Sequence: Synthetic oligonucleotide
gactatctccgcttcctgccgtcaactg

SEQ ID NO: 356473 - DNA, 25 bp, Artificial Sequence
  Description of Artificial Sequence: Synthetic oligonucleotide
ccgcagcggacatggcagctcagat

SEQ ID NO: 356474 - DNA, 29 bp, Artificial Sequence
  Description of Artificial Sequence: Synthetic oligonucleotide
actatctccgcttcctgccgtcaactgag

SEQ ID NO: 356475 - DNA, 26 bp, Artificial Sequence
  Description of Artificial Sequence: Synthetic oligonucleotide
cgcagcggacatggcagctcagatca

SEQ ID NO: 356476 - DNA, 28 bp, Artificial Sequence
  Description of Artificial Sequence: Synthetic oligonucleotide
ctatctccgcttcctgccgtcaactgag

SEQ ID NO: 356477 - DNA, 26 bp, Artificial Sequence
  Description of Artificial Sequence: Synthetic oligonucleotide
gcagcggacatggcagctcagatcac

SEQ ID NO: 356478 - DNA, 28 bp, Artificial Sequence
  Description of Artificial Sequence: Synthetic oligonucleotide
tatctccgcttcctgccgtcaactgagc

SEQ ID NO: 356479 - DNA, 27 bp, Artificial Sequence
  Description of Artificial Sequence: Synthetic oligonucleotide
cagcggacatggcagctcagatcacca

SEQ ID NO: 356480 - DNA, 27 bp, Artificial Sequence
  Description of Artificial Sequence: Synthetic oligonucleotide
atctccgcttcctgccgtcaactgagc

SEQ ID NO: 356481 - DNA, 28 bp, Artificial Sequence
  Description of Artificial Sequence: Synthetic oligonucleotide
agcggacatggcagctcagatcaccaag

SEQ ID NO: 356482 - DNA, 27 bp, Artificial Sequence
  Description of Artificial Sequence: Synthetic oligonucleotide
tctccgcttcctgccgtcaactgagca

SEQ ID NO: 356483 - DNA, 22 bp, Artificial Sequence
  Description of Artificial Sequence: Synthetic oligonucleotide
cggttcgacagcgacgccgcca

SEQ ID NO: 356484 - DNA, 26 bp, Artificial Sequence
  Description of Artificial Sequence: Synthetic oligonucleotide
ctccgcttcctgccgtcaactgagca

SEQ ID NO: 356485 - DNA, 22 bp, Artificial Sequence
  Description of Artificial Sequence: Synthetic oligonucleotide
ggttcgacagcgacgccgccag

SEQ ID NO: 356486 - DNA, 26 bp, Artificial Sequence
  Description of Artificial Sequence: Synthetic oligonucleotide
tccgcttcctgccgtcaactgagcac

SEQ ID NO: 356487 - DNA, 22 bp, Artificial Sequence
  Description of Artificial Sequence: Synthetic oligonucleotide
gttcgacagcgacgccgccagc

SEQ ID NO: 356488 - DNA, 25 bp, Artificial Sequence
  Description of Artificial Sequence: Synthetic oligonucleotide
ccgcttcctgccgtcaactgagcac

SEQ ID NO: 356489 - DNA, 23 bp, Artificial Sequence
  Description of Artificial Sequence: Synthetic oligonucleotide
ttcgacagcgacgccgccagcca

SEQ ID NO: 356490 - DNA, 27 bp, Artificial Sequence
  Description of Artificial Sequence: Synthetic oligonucleotide
cgcttcctgccgtcaactgagcacgtt

SEQ ID NO: 356491 - DNA, 22 bp, Artificial Sequence
  Description of Artificial Sequence: Synthetic oligonucleotide
tcgacagcgacgccgccagcca

SEQ ID NO: 356492 - DNA, 29 bp, Artificial Sequence
  Description of Artificial Sequence: Synthetic oligonucleotide
gcttcctgccgtcaactgagcacgtttac

SEQ ID NO: 356493 - DNA, 21 bp, Artificial Sequence
  Description of Artificial Sequence: Synthetic oligonucleotide
cgacagcgacgccgccagcca

SEQ ID NO: 356494 - DNA, 29 bp, Artificial Sequence
  Description of Artificial Sequence: Synthetic oligonucleotide
cttcctgccgtcaactgagcacgtttacg

SEQ ID NO: 356495 - DNA, 23 bp, Artificial Sequence
  Description of Artificial Sequence: Synthetic oligonucleotide
gacagcgacgccgccagccagaa

SEQ ID NO: 356496 - DNA, 30 bp, Artificial Sequence; identical to SEQ ID NO: 232854
  Description of Artificial Sequence: Synthetic oligonucleotide

SEQ ID NO: 356497 - DNA, 25 bp, Artificial Sequence
  Description of Artificial Sequence: Synthetic oligonucleotide
acagcgacgccgccagccagaagat

SEQ ID NO: 356498 - DNA, 29 bp, Artificial Sequence
  Description of Artificial Sequence: Synthetic oligonucleotide
tcctgccgtcaactgagcacgtttacgtc

SEQ ID NO: 356499 - DNA, 24 bp, Artificial Sequence
  Description of Artificial Sequence: Synthetic oligonucleotide
cagcgacgccgccagccagaagat

SEQ ID NO: 356500 - DNA, 28 bp, Artificial Sequence
  Description of Artificial Sequence: Synthetic oligonucleotide
cctgccgtcaactgagcacgtttacgtc

SEQ ID NO: 356501 - DNA, 24 bp, Artificial Sequence
  Description of Artificial Sequence: Synthetic oligonucleotide
agcgacgccgccagccagaagatg

SEQ ID NO: 356502 - DNA, 29 bp, Artificial Sequence
  Description of Artificial Sequence: Synthetic oligonucleotide
ctgccgtcaactgagcacgtttacgtctg

SEQ ID NO: 356503 - DNA, 23 bp, Artificial Sequence
  Description of Artificial Sequence: Synthetic oligonucleotide
gcgacgccgccagccagaagatg

SEQ ID NO: 356504 - DNA, 29 bp, Artificial Sequence
  Description of Artificial Sequence: Synthetic oligonucleotide
tgccgtcaactgagcacgtttacgtctgc

SEQ ID NO: 356505 - DNA, 24 bp, Artificial Sequence
  Description of Artificial Sequence: Synthetic oligonucleotide
cgacgccgccagccagaagatgga

SEQ ID NO: 356506 - DNA, 28 bp, Artificial Sequence
  Description of Artificial Sequence: Synthetic oligonucleotide
gccgtcaactgagcacgtttacgtctgc

SEQ ID NO: 356507 - DNA, 24 bp, Artificial Sequence
  Description of Artificial Sequence: Synthetic oligonucleotide
gacgccgccagccagaagatggag

SEQ ID NO: 356508 - DNA, 29 bp, Artificial Sequence
  Description of Artificial Sequence: Synthetic oligonucleotide
ccgtcaactgagcacgtttacgtctgcag

SEQ ID NO: 356509 - DNA, 24 bp, Artificial Sequence
  Description of Artificial Sequence: Synthetic oligonucleotide
acgccgccagccagaagatggagc

SEQ ID NO: 356510 - DNA, 29 bp, Artificial Sequence
  Description of Artificial Sequence: Synthetic oligonucleotide
cgtcaactgagcacgtttacgtctgcagg

SEQ ID NO: 356511 - DNA, 23 bp, Artificial Sequence
  Description of Artificial Sequence: Synthetic oligonucleotide
cgccgccagccagaagatggagc

SEQ ID NO: 356512 - DNA, 29 bp, Artificial Sequence
  Description of Artificial Sequence: Synthetic oligonucleotide
gtcaactgagcacgtttacgtctgcaggg

SEQ ID NO: 356513 - DNA, 23 bp, Artificial Sequence
  Description of Artificial Sequence: Synthetic oligonucleotide
gccgccagccagaagatggagcc

SEQ ID NO: 356514 - DNA, 30 bp, Artificial Sequence; identical to SEQ ID NO: 232863
  Description of Artificial Sequence: Synthetic oligonucleotide

SEQ ID NO: 356515 - DNA, 23 bp, Artificial Sequence
  Description of Artificial Sequence: Synthetic oligonucleotide
ccgccagccagaagatggagccg

SEQ ID NO: 356516 - DNA, 29 bp, Artificial Sequence
  Description of Artificial Sequence: Synthetic oligonucleotide
caactgagcacgtttacgtctgcagggtc

SEQ ID NO: 356517 - DNA, 23 bp, Artificial Sequence
  Description of Artificial Sequence: Synthetic oligonucleotide
cgccagccagaagatggagccgc

SEQ ID NO: 356518 - DNA, 29 bp, Artificial Sequence
  Description of Artificial Sequence: Synthetic oligonucleotide
aactgagcacgtttacgtctgcagggtcg

SEQ ID NO: 356519 - DNA, 23 bp, Artificial Sequence
  Description of Artificial Sequence: Synthetic oligonucleotide
gccagccagaagatggagccgcg

SEQ ID NO: 356520 - DNA, 28 bp, Artificial Sequence
  Description of Artificial Sequence: Synthetic oligonucleotide
actgagcacgtttacgtctgcagggtcg

SEQ ID NO: 356521 - DNA, 23 bp, Artificial Sequence
  Description of Artificial Sequence: Synthetic oligonucleotide
ccagccagaagatggagccgcgg

SEQ ID NO: 356522 - DNA, 27 bp, Artificial Sequence
  Description of Artificial Sequence: Synthetic oligonucleotide
ctgagcacgtttacgtctgcagggtcg

SEQ ID NO: 356523 - DNA, 23 bp, Artificial Sequence
  Description of Artificial Sequence: Synthetic oligonucleotide
cagccagaagatggagccgcggg

SEQ ID NO: 356524 - DNA, 28 bp, Artificial Sequence
  Description of Artificial Sequence: Synthetic oligonucleotide
tgagcacgtttacgtctgcagggtcgag

SEQ ID NO: 356525 - DNA, 27 bp, Artificial Sequence
  Description of Artificial Sequence: Synthetic oligonucleotide
atcaccaagcgcaagtgggaggcggtt

SEQ ID NO: 356526 - DNA, 27 bp, Artificial Sequence
  Description of Artificial Sequence: Synthetic oligonucleotide
gagcacgtttacgtctgcagggtcgag

SEQ ID NO: 356527 - DNA, 26 bp, Artificial Sequence
  Description of Artificial Sequence: Synthetic oligonucleotide
tcaccaagcgcaagtgggaggcggtt

SEQ ID NO: 356528 - DNA, 27 bp, Artificial Sequence
  Description of Artificial Sequence: Synthetic oligonucleotide
agcacgtttacgtctgcagggtcgagc

SEQ ID NO: 356529 - DNA, 25 bp, Artificial Sequence
  Description of Artificial Sequence: Synthetic oligonucleotide
caccaagcgcaagtgggaggcggtt

SEQ ID NO: 356530 - DNA, 27 bp, Artificial Sequence
  Description of Artificial Sequence: Synthetic oligonucleotide
gcacgtttacgtctgcagggtcgagca

SEQ ID NO: 356531 - DNA, 27 bp, Artificial Sequence
  Description of Artificial Sequence: Synthetic oligonucleotide
accaagcgcaagtgggaggcggttcat

SEQ ID NO: 356532 - DNA, 27 bp, Artificial Sequence
  Description of Artificial Sequence: Synthetic oligonucleotide
cacgtttacgtctgcagggtcgagcac

SEQ ID NO: 356533 - DNA, 26 bp, Artificial Sequence
  Description of Artificial Sequence: Synthetic oligonucleotide
ccaagcgcaagtgggaggcggttcat

SEQ ID NO: 356534 - DNA, 28 bp, Artificial Sequence
  Description of Artificial Sequence: Synthetic oligonucleotide
acgtttacgtctgcagggtcgagcactg

SEQ ID NO: 356535 - DNA, 26 bp, Artificial Sequence
  Description of Artificial Sequence: Synthetic oligonucleotide
caagcgcaagtgggaggcggttcatg

SEQ ID NO: 356536 - DNA, 27 bp, Artificial Sequence
  Description of Artificial Sequence: Synthetic oligonucleotide
cgtttacgtctgcagggtcgagcactg

SEQ ID NO: 356537 - DNA, 26 bp, Artificial Sequence
  Description of Artificial Sequence: Synthetic oligonucleotide
aagcgcaagtgggaggcggttcatgc

SEQ ID NO: 356538 - DNA, 27 bp, Artificial Sequence
  Description of Artificial Sequence: Synthetic oligonucleotide
gtttacgtctgcagggtcgagcactgg

SEQ ID NO: 356539 - DNA, 25 bp, Artificial Sequence
  Description of Artificial Sequence: Synthetic oligonucleotide
agcgcaagtgggaggcggttcatgc

SEQ ID NO: 356540 - DNA, 27 bp, Artificial Sequence
  Description of Artificial Sequence: Synthetic oligonucleotide
tttacgtctgcagggtcgagcactggc

SEQ ID NO: 356541 - DNA, 24 bp, Artificial Sequence
  Description of Artificial Sequence: Synthetic oligonucleotide
gcgcaagtgggaggcggttcatgc

SEQ ID NO: 356542 - DNA, 26 bp, Artificial Sequence
  Description of Artificial Sequence: Synthetic oligonucleotide
ttacgtctgcagggtcgagcactggc

SEQ ID NO: 356543 - DNA, 24 bp, Artificial Sequence
  Description of Artificial Sequence: Synthetic oligonucleotide
cgcaagtgggaggcggttcatgcg

SEQ ID NO: 356544 - DNA, 25 bp, Artificial Sequence
  Description of Artificial Sequence: Synthetic oligonucleotide
tacgtctgcagggtcgagcactggc

SEQ ID NO: 356545 - DNA, 24 bp, Artificial Sequence
  Description of Artificial Sequence: Synthetic oligonucleotide
gcaagtgggaggcggttcatgcgg

SEQ ID NO: 356546 - DNA, 24 bp, Artificial Sequence
  Description of Artificial Sequence: Synthetic oligonucleotide
acgtctgcagggtcgagcactggc

SEQ ID NO: 356547 - DNA, 24 bp, Artificial Sequence
  Description of Artificial Sequence: Synthetic oligonucleotide
caagtgggaggcggttcatgcggc

SEQ ID NO: 356548 - DNA, 23 bp, Artificial Sequence
  Description of Artificial Sequence: Synthetic oligonucleotide
cgtctgcagggtcgagcactggc

SEQ ID NO: 356549 - DNA, 24 bp, Artificial Sequence
  Description of Artificial Sequence: Synthetic oligonucleotide
aagtgggaggcggttcatgcggcg

SEQ ID NO: 356550 - DNA, 23 bp, Artificial Sequence
  Description of Artificial Sequence: Synthetic oligonucleotide
gtctgcagggtcgagcactggcg

SEQ ID NO: 356551 - DNA, 23 bp, Artificial Sequence
  Description of Artificial Sequence: Synthetic oligonucleotide
agtgggaggcggttcatgcggcg

SEQ ID NO: 356552 - DNA, 25 bp, Artificial Sequence
  Description of Artificial Sequence: Synthetic oligonucleotide
tctgcagggtcgagcactggcgctt

SEQ ID NO: 356553 - DNA, 22 bp, Artificial Sequence
  Description of Artificial Sequence: Synthetic oligonucleotide
gtgggaggcggttcatgcggcg

SEQ ID NO: 356554 - DNA, 24 bp, Artificial Sequence
  Description of Artificial Sequence: Synthetic oligonucleotide
ctgcagggtcgagcactggcgctt

SEQ ID NO: 356555 - DNA, 23 bp, Artificial Sequence
  Description of Artificial Sequence: Synthetic oligonucleotide
tgggaggcggttcatgcggcgga

SEQ ID NO: 356556 - DNA, 24 bp, Artificial Sequence
  Description of Artificial Sequence: Synthetic oligonucleotide
tgcagggtcgagcactggcgcttg

SEQ ID NO: 356557 - DNA, 22 bp, Artificial Sequence
  Description of Artificial Sequence: Synthetic oligonucleotide
gggaggcggttcatgcggcgga

SEQ ID NO: 356558 - DNA, 23 bp, Artificial Sequence
  Description of Artificial Sequence: Synthetic oligonucleotide
gcagggtcgagcactggcgcttg

SEQ ID NO: 356559 - DNA, 22 bp, Artificial Sequence
  Description of Artificial Sequence: Synthetic oligonucleotide
ggaggcggttcatgcggcggag

SEQ ID NO: 356560 - DNA, 25 bp, Artificial Sequence
  Description of Artificial Sequence: Synthetic oligonucleotide
cagggtcgagcactggcgcttggat

SEQ ID NO: 356561 - DNA, 23 bp, Artificial Sequence
  Description of Artificial Sequence: Synthetic oligonucleotide
gaggcggttcatgcggcggagca

SEQ ID NO: 356562 - DNA, 26 bp, Artificial Sequence
  Description of Artificial Sequence: Synthetic oligonucleotide
agggtcgagcactggcgcttggatgt

SEQ ID NO: 356563 - DNA, 23 bp, Artificial Sequence
  Description of Artificial Sequence: Synthetic oligonucleotide
aggcggttcatgcggcggagcag

SEQ ID NO: 356564 - DNA, 25 bp, Artificial Sequence
  Description of Artificial Sequence: Synthetic oligonucleotide
gggtcgagcactggcgcttggatgt

SEQ ID NO: 356565 - DNA, 22 bp, Artificial Sequence
  Description of Artificial Sequence: Synthetic oligonucleotide
ggcggttcatgcggcggagcag

SEQ ID NO: 356566 - DNA, 25 bp, Artificial Sequence
  Description of Artificial Sequence: Synthetic oligonucleotide
ggtcgagcactggcgcttggatgtg

SEQ ID NO: 356567 - DNA, 22 bp, Artificial Sequence
  Description of Artificial Sequence: Synthetic oligonucleotide
gcggttcatgcggcggagcagc

SEQ ID NO: 356568 - DNA, 25 bp, Artificial Sequence
  Description of Artificial Sequence: Synthetic oligonucleotide
gtcgagcactggcgcttggatgtgc

SEQ ID NO: 356569 - DNA, 22 bp, Artificial Sequence
  Description of Artificial Sequence: Synthetic oligonucleotide
cggttcatgcggcggagcagcg

SEQ ID NO: 356570 - DNA, 26 bp, Artificial Sequence
  Description of Artificial Sequence: Synthetic oligonucleotide
tcgagcactggcgcttggatgtgcct

SEQ ID NO: 356571 - DNA, 23 bp, Artificial Sequence
  Description of Artificial Sequence: Synthetic oligonucleotide
ggttcatgcggcggagcagcgga

SEQ ID NO: 356572 - DNA, 25 bp, Artificial Sequence
  Description of Artificial Sequence: Synthetic oligonucleotide
cgagcactggcgcttggatgtgcct

SEQ ID NO: 356573 - DNA, 24 bp, Artificial Sequence
  Description of Artificial Sequence: Synthetic oligonucleotide
gttcatgcggcggagcagcggaga

SEQ ID NO: 356574 - DNA, 27 bp, Artificial Sequence
  Description of Artificial Sequence: Synthetic oligonucleotide
gagcactggcgcttggatgtgcctctt

SEQ ID NO: 356575 - DNA, 25 bp, Artificial Sequence
  Description of Artificial Sequence: Synthetic oligonucleotide
ttcatgcggcggagcagcggagagt

SEQ ID NO: 356576 - DNA, 27 bp, Artificial Sequence
  Description of Artificial Sequence: Synthetic oligonucleotide
agcactggcgcttggatgtgcctcttc

SEQ ID NO: 356577 - DNA, 24 bp, Artificial Sequence
  Description of Artificial Sequence: Synthetic oligonucleotide
tcatgcggcggagcagcggagagt

SEQ ID NO: 356578 - DNA, 27 bp, Artificial Sequence
  Description of Artificial Sequence: Synthetic oligonucleotide
gcactggcgcttggatgtgcctcttct

SEQ ID NO: 356579 - DNA, 33 bp, Artificial Sequence; identical to SEQ ID NO: 1340
  Description of Artificial Sequence: Synthetic oligonucleotide

SEQ ID NO: 356580 - DNA, 27 bp, Artificial Sequence
  Description of Artificial Sequence: Synthetic oligonucleotide
cactggcgcttggatgtgcctcttctg

SEQ ID NO: 356581 - DNA, 34 bp, Artificial Sequence; identical to SEQ ID NO: 1341
  Description of Artificial Sequence: Synthetic oligonucleotide

SEQ ID NO: 356582 - DNA, 29 bp, Artificial Sequence
  Description of Artificial Sequence: Synthetic oligonucleotide
actggcgcttggatgtgcctcttctgaag

SEQ ID NO: 356583 - DNA, 35 bp, Artificial Sequence; identical to SEQ ID NO: 1342
  Description of Artificial Sequence: Synthetic oligonucleotide

SEQ ID NO: 356584 - DNA, 28 bp, Artificial Sequence
  Description of Artificial Sequence: Synthetic oligonucleotide
ctggcgcttggatgtgcctcttctgaag

SEQ ID NO: 356585 - DNA, 34 bp, Artificial Sequence; identical to SEQ ID NO: 1343
  Description of Artificial Sequence: Synthetic oligonucleotide

SEQ ID NO: 356586 - DNA, 28 bp, Artificial Sequence
  Description of Artificial Sequence: Synthetic oligonucleotide
tggcgcttggatgtgcctcttctgaagc

SEQ ID NO: 356587 - DNA, 34 bp, Artificial Sequence; identical to SEQ ID NO: 1344
  Description of Artificial Sequence: Synthetic oligonucleotide

SEQ ID NO: 356588 - DNA, 27 bp, Artificial Sequence
  Description of Artificial Sequence: Synthetic oligonucleotide
ggcgcttggatgtgcctcttctgaagc

SEQ ID NO: 356589 - DNA, 27 bp, Artificial Sequence
  Description of Artificial Sequence: Synthetic oligonucleotide
agaacgggaaggagacgctgcagcgta

SEQ ID NO: 356590 - DNA, 28 bp, Artificial Sequence
  Description of Artificial Sequence: Synthetic oligonucleotide
gcgcttggatgtgcctcttctgaagcac

SEQ ID NO: 356591 - DNA, 26 bp, Artificial Sequence
  Description of Artificial Sequence: Synthetic oligonucleotide
gaacgggaaggagacgctgcagcgta

SEQ ID NO: 356592 - DNA, 29 bp, Artificial Sequence
  Description of Artificial Sequence: Synthetic oligonucleotide
cgcttggatgtgcctcttctgaagcactg

SEQ ID NO: 356593 - DNA, 26 bp, Artificial Sequence
  Description of Artificial Sequence: Synthetic oligonucleotide
aacgggaaggagacgctgcagcgtac

SEQ ID NO: 356594 - DNA, 29 bp, Artificial Sequence
  Description of Artificial Sequence: Synthetic oligonucleotide
gcttggatgtgcctcttctgaagcactgg

SEQ ID NO: 356595 - DNA, 25 bp, Artificial Sequence
  Description of Artificial Sequence: Synthetic oligonucleotide
acgggaaggagacgctgcagcgtac

SEQ ID NO: 356596 - DNA, 29 bp, Artificial Sequence
  Description of Artificial Sequence: Synthetic oligonucleotide
cttggatgtgcctcttctgaagcactggc

SEQ ID NO: 356597 - DNA, 24 bp, Artificial Sequence
  Description of Artificial Sequence: Synthetic oligonucleotide
cgggaaggagacgctgcagcgtac

SEQ ID NO: 356598 - DNA, 30 bp, Artificial Sequence; identical to SEQ ID NO: 232905
  Description of Artificial Sequence: Synthetic oligonucleotide

SEQ ID NO: 356599 - DNA, 24 bp, Artificial Sequence
  Description of Artificial Sequence: Synthetic oligonucleotide
gggaaggagacgctgcagcgtacg

SEQ ID NO: 356600 - DNA, 29 bp, Artificial Sequence
  Description of Artificial Sequence: Synthetic oligonucleotide
tggatgtgcctcttctgaagcactggcag

SEQ ID NO: 356601 - DNA, 24 bp, Artificial Sequence
  Description of Artificial Sequence: Synthetic oligonucleotide
ggaaggagacgctgcagcgtacgg

SEQ ID NO: 356602 - DNA, 28 bp, Artificial Sequence
  Description of Artificial Sequence: Synthetic oligonucleotide
ggatgtgcctcttctgaagcactggcag

SEQ ID NO: 356603 - DNA, 24 bp, Artificial Sequence
  Description of Artificial Sequence: Synthetic oligonucleotide
tgcggttcgacagcgacgccgcaa

SEQ ID NO: 356604 - DNA, 31 bp, Artificial Sequence; identical to SEQ ID NO: 232908
  Description of Artificial Sequence: Synthetic oligonucleotide

SEQ ID NO: 356605 - DNA, 23 bp, Artificial Sequence
  Description of Artificial Sequence: Synthetic oligonucleotide
gcggttcgacagcgacgccgcaa

SEQ ID NO: 356606 - DNA, 33 bp, Artificial Sequence; identical to SEQ ID NO: 232909
  Description of Artificial Sequence: Synthetic oligonucleotide

SEQ ID NO: 356607 - DNA, 23 bp, Artificial Sequence
  Description of Artificial Sequence: Synthetic oligonucleotide
cggttcgacagcgacgccgcaag

SEQ ID NO: 356608 - DNA, 32 bp, Artificial Sequence; identical to SEQ ID NO: 232910
  Description of Artificial Sequence: Synthetic oligonucleotide

SEQ ID NO: 356609 - DNA, 23 bp, Artificial Sequence
  Description of Artificial Sequence: Synthetic oligonucleotide
ggttcgacagcgacgccgcaagc

SEQ ID NO: 356610 - DNA, 31 bp, Artificial Sequence; identical to SEQ ID NO: 232911
  Description of Artificial Sequence: Synthetic oligonucleotide

SEQ ID NO: 356611 - DNA, 24 bp, Artificial Sequence
  Description of Artificial Sequence: Synthetic oligonucleotide
gttcgacagcgacgccgcaagcca

SEQ ID NO: 356612 - DNA, 31 bp, Artificial Sequence; identical to SEQ ID NO: 232912
  Description of Artificial Sequence: Synthetic oligonucleotide

SEQ ID NO: 356613 - DNA, 26 bp, Artificial Sequence
  Description of Artificial Sequence: Synthetic oligonucleotide
ttcgacagcgacgccgcaagccagaa

SEQ ID NO: 356614 - DNA, 30 bp, Artificial Sequence; identical to SEQ ID NO: 232913
  Description of Artificial Sequence: Synthetic oligonucleotide

SEQ ID NO: 356615 - DNA, 25 bp, Artificial Sequence
  Description of Artificial Sequence: Synthetic oligonucleotide
tcgacagcgacgccgcaagccagaa

SEQ ID NO: 356616 - DNA, 31 bp, Artificial Sequence; identical to SEQ ID NO: 232914
  Description of Artificial Sequence: Synthetic oligonucleotide

SEQ ID NO: 356617 - DNA, 24 bp, Artificial Sequence
  Description of Artificial Sequence: Synthetic oligonucleotide
cgacagcgacgccgcaagccagaa

SEQ ID NO: 356618 - DNA, 31 bp, Artificial Sequence; identical to SEQ ID NO: 232915
  Description of Artificial Sequence: Synthetic oligonucleotide

SEQ ID NO: 356619 - DNA, 26 bp, Artificial Sequence
  Description of Artificial Sequence: Synthetic oligonucleotide
gacagcgacgccgcaagccagaagat

SEQ ID NO: 356620 - DNA, 33 bp, Artificial Sequence; identical to SEQ ID NO: 232916
  Description of Artificial Sequence: Synthetic oligonucleotide

SEQ ID NO: 356621 - DNA, 26 bp, Artificial Sequence
  Description of Artificial Sequence: Synthetic oligonucleotide
acagcgacgccgcaagccagaagatg

SEQ ID NO: 356622 - DNA, 32 bp, Artificial Sequence; identical to SEQ ID NO: 232917
  Description of Artificial Sequence: Synthetic oligonucleotide

SEQ ID NO: 356623 - DNA, 25 bp, Artificial Sequence
  Description of Artificial Sequence: Synthetic oligonucleotide
cagcgacgccgcaagccagaagatg

SEQ ID NO: 356624 - DNA, 32 bp, Artificial Sequence; identical to SEQ ID NO: 232918
  Description of Artificial Sequence: Synthetic oligonucleotide

SEQ ID NO: 356625 - DNA, 26 bp, Artificial Sequence
  Description of Artificial Sequence: Synthetic oligonucleotide
agcgacgccgcaagccagaagatgga

SEQ ID NO: 356626 - DNA, 31 bp, Artificial Sequence; identical to SEQ ID NO: 232919
  Description of Artificial Sequence: Synthetic oligonucleotide

SEQ ID NO: 356627 - DNA, 25 bp, Artificial Sequence
  Description of Artificial Sequence: Synthetic oligonucleotide
gcgacgccgcaagccagaagatgga

SEQ ID NO: 356628 - DNA, 30 bp, Artificial Sequence; identical to SEQ ID NO: 232920
  Description of Artificial Sequence: Synthetic oligonucleotide

SEQ ID NO: 356629 - DNA, 25 bp, Artificial Sequence
  Description of Artificial Sequence: Synthetic oligonucleotide
cgacgccgcaagccagaagatggag

SEQ ID NO: 356630 - DNA, 30 bp, Artificial Sequence; identical to SEQ ID NO: 232921
  Description of Artificial Sequence: Synthetic oligonucleotide

SEQ ID NO: 356631 - DNA, 25 bp, Artificial Sequence
  Description of Artificial Sequence: Synthetic oligonucleotide
gacgccgcaagccagaagatggagc

SEQ ID NO: 356632 - DNA, 29 bp, Artificial Sequence
  Description of Artificial Sequence: Synthetic oligonucleotide
gaagcactggcagtttgatggtccaagcc

SEQ ID NO: 356633 - DNA, 25 bp, Artificial Sequence
  Description of Artificial Sequence: Synthetic oligonucleotide
acgccgcaagccagaagatggagcc

SEQ ID NO: 356634 - DNA, 29 bp, Artificial Sequence
  Description of Artificial Sequence: Synthetic oligonucleotide
aagcactggcagtttgatggtccaagccc

SEQ ID NO: 356635 - DNA, 24 bp, Artificial Sequence
  Description of Artificial Sequence: Synthetic oligonucleotide
cgccgcaagccagaagatggagcc

SEQ ID NO: 356636 - DNA, 28 bp, Artificial Sequence
  Description of Artificial Sequence: Synthetic oligonucleotide
agcactggcagtttgatggtccaagccc

SEQ ID NO: 356637 - DNA, 24 bp, Artificial Sequence
  Description of Artificial Sequence: Synthetic oligonucleotide
gccgcaagccagaagatggagccg

SEQ ID NO: 356638 - DNA, 27 bp, Artificial Sequence
  Description of Artificial Sequence: Synthetic oligonucleotide
gcactggcagtttgatggtccaagccc

SEQ ID NO: 356639 - DNA, 24 bp, Artificial Sequence
  Description of Artificial Sequence: Synthetic oligonucleotide
ccgcaagccagaagatggagccgc

SEQ ID NO: 356640 - DNA, 28 bp, Artificial Sequence
  Description of Artificial Sequence: Synthetic oligonucleotide
cactggcagtttgatggtccaagcccac

SEQ ID NO: 356641 - DNA, 24 bp, Artificial Sequence
  Description of Artificial Sequence: Synthetic oligonucleotide
cgcaagccagaagatggagccgcg

SEQ ID NO: 356642 - DNA, 29 bp, Artificial Sequence
  Description of Artificial Sequence: Synthetic oligonucleotide
actggcagtttgatggtccaagcccactc

SEQ ID NO: 356643 - DNA, 24 bp, Artificial Sequence
  Description of Artificial Sequence: Synthetic oligonucleotide
gcaagccagaagatggagccgcgg

SEQ ID NO: 356644 - DNA, 28 bp, Artificial Sequence
  Description of Artificial Sequence: Synthetic oligonucleotide
ctggcagtttgatggtccaagcccactc

SEQ ID NO: 356645 - DNA, 24 bp, Artificial Sequence
  Description of Artificial Sequence: Synthetic oligonucleotide
caagccagaagatggagccgcggg

SEQ ID NO: 356646 - DNA, 28 bp, Artificial Sequence
  Description of Artificial Sequence: Synthetic oligonucleotide
tggcagtttgatggtccaagcccactcc

SEQ ID NO: 356647 - DNA, 24 bp, Artificial Sequence
  Description of Artificial Sequence: Synthetic oligonucleotide
aagccagaagatggagccgcgggc

SEQ ID NO: 356648 - DNA, 27 bp, Artificial Sequence
  Description of Artificial Sequence: Synthetic oligonucleotide
ggcagtttgatggtccaagcccactcc

SEQ ID NO: 356649 - DNA, 24 bp, Artificial Sequence
  Description of Artificial Sequence: Synthetic oligonucleotide
aagtgggaggcggtccatgcggca

SEQ ID NO: 356650 - DNA, 27 bp, Artificial Sequence
  Description of Artificial Sequence: Synthetic oligonucleotide
gcagtttgatggtccaagcccactccc

SEQ ID NO: 356651 - DNA, 23 bp, Artificial Sequence
  Description of Artificial Sequence: Synthetic oligonucleotide
agtgggaggcggtccatgcggca

SEQ ID NO: 356652 - DNA, 28 bp, Artificial Sequence
  Description of Artificial Sequence: Synthetic oligonucleotide
cagtttgatggtccaagcccactcccag

SEQ ID NO: 356653 - DNA, 22 bp, Artificial Sequence
  Description of Artificial Sequence: Synthetic oligonucleotide
gtgggaggcggtccatgcggca

SEQ ID NO: 356654 - DNA, 29 bp, Artificial Sequence
  Description of Artificial Sequence: Synthetic oligonucleotide
agtttgatggtccaagcccactcccagag

SEQ ID NO: 356655 - DNA, 23 bp, Artificial Sequence
  Description of Artificial Sequence: Synthetic oligonucleotide
tgggaggcggtccatgcggcaga

SEQ ID NO: 356656 - DNA, 28 bp, Artificial Sequence
  Description of Artificial Sequence: Synthetic oligonucleotide
gtttgatggtccaagcccactcccagag

SEQ ID NO: 356657 - DNA, 22 bp, Artificial Sequence
  Description of Artificial Sequence: Synthetic oligonucleotide
gggaggcggtccatgcggcaga

SEQ ID NO: 356658 - DNA, 29 bp, Artificial Sequence
  Description of Artificial Sequence: Synthetic oligonucleotide
tttgatggtccaagcccactcccagagtc

SEQ ID NO: 356659 - DNA, 22 bp, Artificial Sequence
  Description of Artificial Sequence: Synthetic oligonucleotide
ggaggcggtccatgcggcagag

SEQ ID NO: 356660 - DNA, 28 bp, Artificial Sequence
  Description of Artificial Sequence: Synthetic oligonucleotide
ttgatggtccaagcccactcccagagtc

SEQ ID NO: 356661 - DNA, 23 bp, Artificial Sequence
  Description of Artificial Sequence: Synthetic oligonucleotide
gaggcggtccatgcggcagagca

SEQ ID NO: 356662 - DNA, 27 bp, Artificial Sequence
  Description of Artificial Sequence: Synthetic oligonucleotide
tgatggtccaagcccactcccagagtc

SEQ ID NO: 356663 - DNA, 23 bp, Artificial Sequence
  Description of Artificial Sequence: Synthetic oligonucleotide
aggcggtccatgcggcagagcag

SEQ ID NO: 356664 - DNA, 27 bp, Artificial Sequence
  Description of Artificial Sequence: Synthetic oligonucleotide
gatggtccaagcccactcccagagtct

SEQ ID NO: 356665 - DNA, 22 bp, Artificial Sequence
  Description of Artificial Sequence: Synthetic oligonucleotide
ggcggtccatgcggcagagcag

SEQ ID NO: 356666 - DNA, 28 bp, Artificial Sequence
  Description of Artificial Sequence: Synthetic oligonucleotide
atggtccaagcccactcccagagtctac

SEQ ID NO: 356667 - DNA, 22 bp, Artificial Sequence
  Description of Artificial Sequence: Synthetic oligonucleotide
gcggtccatgcggcagagcagc

SEQ ID NO: 356668 - DNA, 27 bp, Artificial Sequence
  Description of Artificial Sequence: Synthetic oligonucleotide
tggtccaagcccactcccagagtctac

SEQ ID NO: 356669 - DNA, 22 bp, Artificial Sequence
  Description of Artificial Sequence: Synthetic oligonucleotide
cggtccatgcggcagagcagcg

SEQ ID NO: 356670 - DNA, 27 bp, Artificial Sequence
  Description of Artificial Sequence: Synthetic oligonucleotide
ggtccaagcccactcccagagtctaca

SEQ ID NO: 356671 - DNA, 23 bp, Artificial Sequence
  Description of Artificial Sequence: Synthetic oligonucleotide
ggtccatgcggcagagcagcgga

SEQ ID NO: 356672 - DNA, 27 bp, Artificial Sequence
  Description of Artificial Sequence: Synthetic oligonucleotide
gtccaagcccactcccagagtctacag

SEQ ID NO: 356673 - DNA, 24 bp, Artificial Sequence
  Description of Artificial Sequence: Synthetic oligonucleotide
gtccatgcggcagagcagcggaga

SEQ ID NO: 356674 - DNA, 28 bp, Artificial Sequence
  Description of Artificial Sequence: Synthetic oligonucleotide
tccaagcccactcccagagtctacagag

SEQ ID NO: 356675 - DNA, 25 bp, Artificial Sequence
  Description of Artificial Sequence: Synthetic oligonucleotide
tccatgcggcagagcagcggagagt

SEQ ID NO: 356676 - DNA, 27 bp, Artificial Sequence
  Description of Artificial Sequence: Synthetic oligonucleotide
ccaagcccactcccagagtctacagag

SEQ ID NO: 356677 - DNA, 24 bp, Artificial Sequence
  Description of Artificial Sequence: Synthetic oligonucleotide
ccatgcggcagagcagcggagagt

SEQ ID NO: 356678 - DNA, 29 bp, Artificial Sequence
  Description of Artificial Sequence: Synthetic oligonucleotide
caagcccactcccagagtctacagagatc

SEQ ID NO: 356679 - DNA, 26 bp, Artificial Sequence
  Description of Artificial Sequence: Synthetic oligonucleotide
catgcggcagagcagcggagagtcta

SEQ ID NO: 356680 - DNA, 29 bp, Artificial Sequence
  Description of Artificial Sequence: Synthetic oligonucleotide
aagcccactcccagagtctacagagatcg

SEQ ID NO: 356681 - DNA, 26 bp, Artificial Sequence
  Description of Artificial Sequence: Synthetic oligonucleotide
atgcggcagagcagcggagagtctac

SEQ ID NO: 356682 - DNA, 28 bp, Artificial Sequence
  Description of Artificial Sequence: Synthetic oligonucleotide
agcccactcccagagtctacagagatcg

SEQ ID NO: 356683 - DNA, 25 bp, Artificial Sequence
  Description of Artificial Sequence: Synthetic oligonucleotide
tgcggcagagcagcggagagtctac

SEQ ID NO: 356684 - DNA, 27 bp, Artificial Sequence
  Description of Artificial Sequence: Synthetic oligonucleotide
gcccactcccagagtctacagagatcg

SEQ ID NO: 356685 - DNA, 24 bp, Artificial Sequence
  Description of Artificial Sequence: Synthetic oligonucleotide
gcggcagagcagcggagagtctac

SEQ ID NO: 356686 - DNA, 28 bp, Artificial Sequence
  Description of Artificial Sequence: Synthetic oligonucleotide
cccactcccagagtctacagagatcgtg

SEQ ID NO: 356687 - DNA, 25 bp, Artificial Sequence
  Description of Artificial Sequence: Synthetic oligonucleotide
cggcagagcagcggagagtctacct

SEQ ID NO: 356688 - DNA, 28 bp, Artificial Sequence
  Description of Artificial Sequence: Synthetic oligonucleotide
ccactcccagagtctacagagatcgtgg

SEQ ID NO: 356689 - DNA, 25 bp, Artificial Sequence
  Description of Artificial Sequence: Synthetic oligonucleotide
ggcagagcagcggagagtctacctg

SEQ ID NO: 356690 - DNA, 29 bp, Artificial Sequence
  Description of Artificial Sequence: Synthetic oligonucleotide
cactcccagagtctacagagatcgtggtg

SEQ ID NO: 356691 - DNA, 26 bp, Artificial Sequence
  Description of Artificial Sequence: Synthetic oligonucleotide
gcagagcagcggagagtctacctgga

SEQ ID NO: 356692 - DNA, 30 bp, Artificial Sequence; identical to SEQ ID NO: 232952
  Description of Artificial Sequence: Synthetic oligonucleotide

SEQ ID NO: 356693 - DNA, 26 bp, Artificial Sequence
  Description of Artificial Sequence: Synthetic oligonucleotide
cagagcagcggagagtctacctggag

SEQ ID NO: 356694 - DNA, 29 bp, Artificial Sequence
  Description of Artificial Sequence: Synthetic oligonucleotide
ctcccagagtctacagagatcgtggtgtg

SEQ ID NO: 356695 - DNA, 26 bp, Artificial Sequence
  Description of Artificial Sequence: Synthetic oligonucleotide
agagcagcggagagtctacctggagg

SEQ ID NO: 356696 - DNA, 30 bp, Artificial Sequence; identical to SEQ ID NO: 232954
  Description of Artificial Sequence: Synthetic oligonucleotide

SEQ ID NO: 356697 - DNA, 24 bp, Artificial Sequence
  Description of Artificial Sequence: Synthetic oligonucleotide
tatggctgcgacgtggggccggat

SEQ ID NO: 356698 - DNA, 29 bp, Artificial Sequence
  Description of Artificial Sequence: Synthetic oligonucleotide
cccagagtctacagagatcgtggtgtgag

SEQ ID NO: 356699 - DNA, 23 bp, Artificial Sequence
  Description of Artificial Sequence: Synthetic oligonucleotide
atggctgcgacgtggggccggat

SEQ ID NO: 356700 - DNA, 29 bp, Artificial Sequence
  Description of Artificial Sequence: Synthetic oligonucleotide
ccagagtctacagagatcgtggtgtgagc

SEQ ID NO: 356701 - DNA, 22 bp, Artificial Sequence
  Description of Artificial Sequence: Synthetic oligonucleotide
tggctgcgacgtggggccggat

SEQ ID NO: 356702 - DNA, 29 bp, Artificial Sequence
  Description of Artificial Sequence: Synthetic oligonucleotide
cagagtctacagagatcgtggtgtgagcc

SEQ ID NO: 356703 - DNA, 21 bp, Artificial Sequence
  Description of Artificial Sequence: Synthetic oligonucleotide
ggctgcgacgtggggccggat

SEQ ID NO: 356704 - DNA, 29 bp, Artificial Sequence
  Description of Artificial Sequence: Synthetic oligonucleotide
agagtctacagagatcgtggtgtgagccc

SEQ ID NO: 356705 - DNA, 21 bp, Artificial Sequence
  Description of Artificial Sequence: Synthetic oligonucleotide
gctgcgacgtggggccggatg

SEQ ID NO: 356706 - DNA, 28 bp, Artificial Sequence
  Description of Artificial Sequence: Synthetic oligonucleotide
gagtctacagagatcgtggtgtgagccc

SEQ ID NO: 356707 - DNA, 21 bp, Artificial Sequence
  Description of Artificial Sequence: Synthetic oligonucleotide
ctgcgacgtggggccggatgg

SEQ ID NO: 356708 - DNA, 29 bp, Artificial Sequence
  Description of Artificial Sequence: Synthetic oligonucleotide
agtctacagagatcgtggtgtgagccctg

SEQ ID NO: 356709 - DNA, 21 bp, Artificial Sequence
  Description of Artificial Sequence: Synthetic oligonucleotide
tgcgacgtggggccggatggg

SEQ ID NO: 356710 - DNA, 28 bp, Artificial Sequence
  Description of Artificial Sequence: Synthetic oligonucleotide
gtctacagagatcgtggtgtgagccctg

SEQ ID NO: 356711 - DNA, 20 bp, Artificial Sequence
  Description of Artificial Sequence: Synthetic oligonucleotide
gcgacgtggggccggatggg

SEQ ID NO: 356712 - DNA, 28 bp, Artificial Sequence
  Description of Artificial Sequence: Synthetic oligonucleotide
tctacagagatcgtggtgtgagccctgg

SEQ ID NO: 356713 - DNA, 20 bp, Artificial Sequence
  Description of Artificial Sequence: Synthetic oligonucleotide
cgacgtggggccggatgggc

SEQ ID NO: 356714 - DNA, 27 bp, Artificial Sequence
  Description of Artificial Sequence: Synthetic oligonucleotide
ctacagagatcgtggtgtgagccctgg

SEQ ID NO: 356715 - DNA, 20 bp, Artificial Sequence
  Description of Artificial Sequence: Synthetic oligonucleotide
gacgtggggccggatgggcg

SEQ ID NO: 356716 - DNA, 27 bp, Artificial Sequence
  Description of Artificial Sequence: Synthetic oligonucleotide
tacagagatcgtggtgtgagccctggg

SEQ ID NO: 356717 - DNA, 22 bp, Artificial Sequence
  Description of Artificial Sequence: Synthetic oligonucleotide
acgtggggccggatgggcgctt

SEQ ID NO: 356718 - DNA, 26 bp, Artificial Sequence
  Description of Artificial Sequence: Synthetic oligonucleotide
acagagatcgtggtgtgagccctggg

SEQ ID NO: 356719 - DNA, 21 bp, Artificial Sequence
  Description of Artificial Sequence: Synthetic oligonucleotide
cgtggggccggatgggcgctt

SEQ ID NO: 356720 - DNA, 25 bp, Artificial Sequence
  Description of Artificial Sequence: Synthetic oligonucleotide
cagagatcgtggtgtgagccctggg

SEQ ID NO: 356721 - DNA, 21 bp, Artificial Sequence
  Description of Artificial Sequence: Synthetic oligonucleotide
gtggggccggatgggcgcttc

SEQ ID NO: 356722 - DNA, 25 bp, Artificial Sequence
  Description of Artificial Sequence: Synthetic oligonucleotide
agagatcgtggtgtgagccctgggc

SEQ ID NO: 356723 - DNA, 22 bp, Artificial Sequence
  Description of Artificial Sequence: Synthetic oligonucleotide
tggggccggatgggcgcttcct

SEQ ID NO: 356724 - DNA, 24 bp, Artificial Sequence
  Description of Artificial Sequence: Synthetic oligonucleotide
gagatcgtggtgtgagccctgggc

SEQ ID NO: 356725 - DNA, 21 bp, Artificial Sequence
  Description of Artificial Sequence: Synthetic oligonucleotide
ggggccggatgggcgcttcct

SEQ ID NO: 356726 - DNA, 25 bp, Artificial Sequence
  Description of Artificial Sequence: Synthetic oligonucleotide
agatcgtggtgtgagccctgggcgt

SEQ ID NO: 356727 - DNA, 21 bp, Artificial Sequence
  Description of Artificial Sequence: Synthetic oligonucleotide
gggccggatgggcgcttcctc

SEQ ID NO: 356728 - DNA, 24 bp, Artificial Sequence
  Description of Artificial Sequence: Synthetic oligonucleotide
gatcgtggtgtgagccctgggcgt

SEQ ID NO: 356729 - DNA, 21 bp, Artificial Sequence
  Description of Artificial Sequence: Synthetic oligonucleotide
ggccggatgggcgcttcctcc

SEQ ID NO: 356730 - DNA, 25 bp, Artificial Sequence
  Description of Artificial Sequence: Synthetic oligonucleotide
atcgtggtgtgagccctgggcgtga

SEQ ID NO: 356731 - DNA, 21 bp, Artificial Sequence
  Description of Artificial Sequence: Synthetic oligonucleotide
gccggatgggcgcttcctccg

SEQ ID NO: 356732 - DNA, 24 bp, Artificial Sequence
  Description of Artificial Sequence: Synthetic oligonucleotide
tcgtggtgtgagccctgggcgtga

SEQ ID NO: 356733 - DNA, 21 bp, Artificial Sequence
  Description of Artificial Sequence: Synthetic oligonucleotide
ccggatgggcgcttcctccgc

SEQ ID NO: 356734 - DNA, 23 bp, Artificial Sequence
  Description of Artificial Sequence: Synthetic oligonucleotide
cgtggtgtgagccctgggcgtga

SEQ ID NO: 356735 - DNA, 21 bp, Artificial Sequence
  Description of Artificial Sequence: Synthetic oligonucleotide
cggatgggcgcttcctccgcg

SEQ ID NO: 356736 - DNA, 24 bp, Artificial Sequence
  Description of Artificial Sequence: Synthetic oligonucleotide
gtggtgtgagccctgggcgtgact

SEQ ID NO: 356737 - DNA, 21 bp, Artificial Sequence
  Description of Artificial Sequence: Synthetic oligonucleotide
ggatgggcgcttcctccgcgg

SEQ ID NO: 356738 - DNA, 25 bp, Artificial Sequence
  Description of Artificial Sequence: Synthetic oligonucleotide
tggtgtgagccctgggcgtgactgt

SEQ ID NO: 356739 - DNA, 23 bp, Artificial Sequence
  Description of Artificial Sequence: Synthetic oligonucleotide
gatgggcgcttcctccgcgggta

SEQ ID NO: 356740 - DNA, 24 bp, Artificial Sequence
  Description of Artificial Sequence: Synthetic oligonucleotide
ggtgtgagccctgggcgtgactgt

SEQ ID NO: 356741 - DNA, 23 bp, Artificial Sequence
  Description of Artificial Sequence: Synthetic oligonucleotide
atgggcgcttcctccgcgggtac

SEQ ID NO: 356742 - DNA, 24 bp, Artificial Sequence
  Description of Artificial Sequence: Synthetic oligonucleotide
gtgtgagccctgggcgtgactgtg

SEQ ID NO: 356743 - DNA, 22 bp, Artificial Sequence
  Description of Artificial Sequence: Synthetic oligonucleotide
tgggcgcttcctccgcgggtac

SEQ ID NO: 356744 - DNA, 24 bp, Artificial Sequence
  Description of Artificial Sequence: Synthetic oligonucleotide
tgtgagccctgggcgtgactgtgg

SEQ ID NO: 356745 - DNA, 34 bp, Artificial Sequence; identical to SEQ ID NO: 1423
  Description of Artificial Sequence: Synthetic oligonucleotide

SEQ ID NO: 356746 - DNA, 23 bp, Artificial Sequence
  Description of Artificial Sequence: Synthetic oligonucleotide
gtgagccctgggcgtgactgtgg

SEQ ID NO: 356747 - DNA, 33 bp, Artificial Sequence; identical to SEQ ID NO: 1424
  Description of Artificial Sequence: Synthetic oligonucleotide

SEQ ID NO: 356748 - DNA, 24 bp, Artificial Sequence
  Description of Artificial Sequence: Synthetic oligonucleotide
tgagccctgggcgtgactgtggct

SEQ ID NO: 356749 - DNA, 33 bp, Artificial Sequence; identical to SEQ ID NO: 1425
  Description of Artificial Sequence: Synthetic oligonucleotide

SEQ ID NO: 356750 - DNA, 23 bp, Artificial Sequence
  Description of Artificial Sequence: Synthetic oligonucleotide
gagccctgggcgtgactgtggct

SEQ ID NO: 356751 - DNA, 32 bp, Artificial Sequence; identical to SEQ ID NO: 1426
  Description of Artificial Sequence: Synthetic oligonucleotide

SEQ ID NO: 356752 - DNA, 24 bp, Artificial Sequence
  Description of Artificial Sequence: Synthetic oligonucleotide
agccctgggcgtgactgtggctct

SEQ ID NO: 356753 - DNA, 32 bp, Artificial Sequence; identical to SEQ ID NO: 1427
  Description of Artificial Sequence: Synthetic oligonucleotide

SEQ ID NO: 356754 - DNA, 23 bp, Artificial Sequence
  Description of Artificial Sequence: Synthetic oligonucleotide
gccctgggcgtgactgtggctct

SEQ ID NO: 356755 - DNA, 32 bp, Artificial Sequence; identical to SEQ ID NO: 1428
  Description of Artificial Sequence: Synthetic oligonucleotide

SEQ ID NO: 356756 - DNA, 23 bp, Artificial Sequence
  Description of Artificial Sequence: Synthetic oligonucleotide
ccctgggcgtgactgtggctctg

SEQ ID NO: 356757 - DNA, 31 bp, Artificial Sequence; identical to SEQ ID NO: 1429
  Description of Artificial Sequence: Synthetic oligonucleotide

SEQ ID NO: 356758 - DNA, 24 bp, Artificial Sequence
  Description of Artificial Sequence: Synthetic oligonucleotide
cctgggcgtgactgtggctctggt

SEQ ID NO: 356759 - DNA, 30 bp, Artificial Sequence; identical to SEQ ID NO: 1430
  Description of Artificial Sequence: Synthetic oligonucleotide

SEQ ID NO: 356760 - DNA, 24 bp, Artificial Sequence
  Description of Artificial Sequence: Synthetic oligonucleotide
ctgggcgtgactgtggctctggtg

SEQ ID NO: 356761 - DNA, 30 bp, Artificial Sequence; identical to SEQ ID NO: 1431
  Description of Artificial Sequence: Synthetic oligonucleotide

SEQ ID NO: 356762 - DNA, 24 bp, Artificial Sequence
  Description of Artificial Sequence: Synthetic oligonucleotide
tgggcgtgactgtggctctggtgg

SEQ ID NO: 356763 - DNA, 29 bp, Artificial Sequence
  Description of Artificial Sequence: Synthetic oligonucleotide
ggtatttcttcacatccgtgtccaggccc

SEQ ID NO: 356764 - DNA, 23 bp, Artificial Sequence
  Description of Artificial Sequence: Synthetic oligonucleotide
gggcgtgactgtggctctggtgg

SEQ ID NO: 356765 - DNA, 29 bp, Artificial Sequence
  Description of Artificial Sequence: Synthetic oligonucleotide
gtatttcttcacatccgtgtccaggcccg

SEQ ID NO: 356766 - DNA, 23 bp, Artificial Sequence
  Description of Artificial Sequence: Synthetic oligonucleotide
ggcgtgactgtggctctggtggg

SEQ ID NO: 356767 - DNA, 29 bp, Artificial Sequence
  Description of Artificial Sequence: Synthetic oligonucleotide
tatttcttcacatccgtgtccaggcccgg

SEQ ID NO: 356768 - DNA, 25 bp, Artificial Sequence
  Description of Artificial Sequence: Synthetic oligonucleotide
gcgtgactgtggctctggtggggat

SEQ ID NO: 356769 - DNA, 28 bp, Artificial Sequence
  Description of Artificial Sequence: Synthetic oligonucleotide
atttcttcacatccgtgtccaggcccgg

SEQ ID NO: 356770 - DNA, 27 bp, Artificial Sequence
  Description of Artificial Sequence: Synthetic oligonucleotide
cgtgactgtggctctggtggggatcat

SEQ ID NO: 356771 - DNA, 27 bp, Artificial Sequence
  Description of Artificial Sequence: Synthetic oligonucleotide
tttcttcacatccgtgtccaggcccgg

SEQ ID NO: 356772 - DNA, 31 bp, Artificial Sequence; identical to SEQ ID NO: 232992
  Description of Artificial Sequence: Synthetic oligonucleotide

SEQ ID NO: 356773 - DNA, 26 bp, Artificial Sequence
  Description of Artificial Sequence: Synthetic oligonucleotide
ttcttcacatccgtgtccaggcccgg

SEQ ID NO: 356774 - DNA, 31 bp, Artificial Sequence; identical to SEQ ID NO: 232993
  Description of Artificial Sequence: Synthetic oligonucleotide

SEQ ID NO: 356775 - DNA, 25 bp, Artificial Sequence
  Description of Artificial Sequence: Synthetic oligonucleotide
tcttcacatccgtgtccaggcccgg

SEQ ID NO: 356776 - DNA, 30 bp, Artificial Sequence; identical to SEQ ID NO: 232994
  Description of Artificial Sequence: Synthetic oligonucleotide

SEQ ID NO: 356777 - DNA, 24 bp, Artificial Sequence
  Description of Artificial Sequence: Synthetic oligonucleotide
cttcacatccgtgtccaggcccgg

SEQ ID NO: 356778 - DNA, 30 bp, Artificial Sequence; identical to SEQ ID NO: 232995
  Description of Artificial Sequence: Synthetic oligonucleotide

SEQ ID NO: 356779 - DNA, 24 bp, Artificial Sequence
  Description of Artificial Sequence: Synthetic oligonucleotide
ttcacatccgtgtccaggcccggc

SEQ ID NO: 356780 - DNA, 29 bp, Artificial Sequence
  Description of Artificial Sequence: Synthetic oligonucleotide
ctgtggctctggtggggatcattattcgg

SEQ ID NO: 356781 - DNA, 23 bp, Artificial Sequence
  Description of Artificial Sequence: Synthetic oligonucleotide
tcacatccgtgtccaggcccggc

SEQ ID NO: 356782 - DNA, 30 bp, Artificial Sequence; identical to SEQ ID NO: 232997
  Description of Artificial Sequence: Synthetic oligonucleotide

SEQ ID NO: 356783 - DNA, 22 bp, Artificial Sequence
  Description of Artificial Sequence: Synthetic oligonucleotide
cacatccgtgtccaggcccggc

SEQ ID NO: 356784 - DNA, 29 bp, Artificial Sequence
  Description of Artificial Sequence: Synthetic oligonucleotide
gtggctctggtggggatcattattcggac

SEQ ID NO: 356785 - DNA, 22 bp, Artificial Sequence
  Description of Artificial Sequence: Synthetic oligonucleotide
acatccgtgtccaggcccggcc

SEQ ID NO: 356786 - DNA, 29 bp, Artificial Sequence
  Description of Artificial Sequence: Synthetic oligonucleotide
tggctctggtggggatcattattcggacc

SEQ ID NO: 356787 - DNA, 21 bp, Artificial Sequence
  Description of Artificial Sequence: Synthetic oligonucleotide
catccgtgtccaggcccggcc

SEQ ID NO: 356788 - DNA, 28 bp, Artificial Sequence
  Description of Artificial Sequence: Synthetic oligonucleotide
ggctctggtggggatcattattcggacc

SEQ ID NO: 356789 - DNA, 21 bp, Artificial Sequence
  Description of Artificial Sequence: Synthetic oligonucleotide
atccgtgtccaggcccggccg

SEQ ID NO: 356790 - DNA, 30 bp, Artificial Sequence; identical to SEQ ID NO: 233001
  Description of Artificial Sequence: Synthetic oligonucleotide

SEQ ID NO: 356791 - DNA, 20 bp, Artificial Sequence
  Description of Artificial Sequence: Synthetic oligonucleotide
tccgtgtccaggcccggccg

SEQ ID NO: 356792 - DNA, 32 bp, Artificial Sequence; identical to SEQ ID NO: 233002
  Description of Artificial Sequence: Synthetic oligonucleotide

SEQ ID NO: 356793 - DNA, 20 bp, Artificial Sequence
  Description of Artificial Sequence: Synthetic oligonucleotide
ccgtgtccaggcccggccgt

SEQ ID NO: 356794 - DNA, 34 bp, Artificial Sequence; identical to SEQ ID NO: 233003
  Description of Artificial Sequence: Synthetic oligonucleotide

SEQ ID NO: 356795 - DNA, 20 bp, Artificial Sequence
  Description of Artificial Sequence: Synthetic oligonucleotide
cgtgtccaggcccggccgct

SEQ ID NO: 356796 - DNA, 33 bp, Artificial Sequence; identical to SEQ ID NO: 233004
  Description of Artificial Sequence: Synthetic oligonucleotide

SEQ ID NO: 356797 - DNA, 20 bp, Artificial Sequence
  Description of Artificial Sequence: Synthetic oligonucleotide
gtgtccaggcccggccgcgt

SEQ ID NO: 356798 - DNA, 35 bp, Artificial Sequence; identical to SEQ ID NO: 233005
  Description of Artificial Sequence: Synthetic oligonucleotide

SEQ ID NO: 356799 - DNA, 20 bp, Artificial Sequence
  Description of Artificial Sequence: Synthetic oligonucleotide
tgtccaggcccggccgcggt

SEQ ID NO: 356800 - DNA, 34 bp, Artificial Sequence; identical to SEQ ID NO: 233006
  Description of Artificial Sequence: Synthetic oligonucleotide

SEQ ID NO: 356801 - DNA, 20 bp, Artificial Sequence
  Description of Artificial Sequence: Synthetic oligonucleotide
gtccaggcccggccgcggtt

SEQ ID NO: 356802 - DNA, 36 bp, Artificial Sequence; identical to SEQ ID NO: 233007
  Description of Artificial Sequence: Synthetic oligonucleotide

SEQ ID NO: 356803 - DNA, 20 bp, Artificial Sequence
  Description of Artificial Sequence: Synthetic oligonucleotide
tccaggcccggccgcgggtt

SEQ ID NO: 356804 - DNA, 36 bp, Artificial Sequence; identical to SEQ ID NO: 233008
  Description of Artificial Sequence: Synthetic oligonucleotide

SEQ ID NO: 356805 - DNA, 20 bp, Artificial Sequence
  Description of Artificial Sequence: Synthetic oligonucleotide
ccaggcccggccgcgggttt

SEQ ID NO: 356806 - DNA, 35 bp, Artificial Sequence; identical to SEQ ID NO: 233009
  Description of Artificial Sequence: Synthetic oligonucleotide

SEQ ID NO: 356807 - DNA, 20 bp, Artificial Sequence
  Description of Artificial Sequence: Synthetic oligonucleotide
caggcccggccgcggggatt

SEQ ID NO: 356808 - DNA, 35 bp, Artificial Sequence; identical to SEQ ID NO: 233010
  Description of Artificial Sequence: Synthetic oligonucleotide

SEQ ID NO: 356809 - DNA, 20 bp, Artificial Sequence
  Description of Artificial Sequence: Synthetic oligonucleotide
aggcccggccgcggggagtt

SEQ ID NO: 356810 - DNA, 38 bp, Artificial Sequence; identical to SEQ ID NO: 233011
  Description of Artificial Sequence: Synthetic oligonucleotide

SEQ ID NO: 356811 - DNA, 23 bp, Artificial Sequence
  Description of Artificial Sequence: Synthetic oligonucleotide
aggacctgcgctcttggaccgcc

SEQ ID NO: 356812 - DNA, 38 bp, Artificial Sequence; identical to SEQ ID NO: 233012
  Description of Artificial Sequence: Synthetic oligonucleotide

SEQ ID NO: 356813 - DNA, 22 bp, Artificial Sequence
  Description of Artificial Sequence: Synthetic oligonucleotide
ggacctgcgctcttggaccgcc

SEQ ID NO: 356814 - DNA, 38 bp, Artificial Sequence; identical to SEQ ID NO: 233013
  Description of Artificial Sequence: Synthetic oligonucleotide

SEQ ID NO: 356815 - DNA, 22 bp, Artificial Sequence
  Description of Artificial Sequence: Synthetic oligonucleotide
gacctgcgctcttggaccgccg

SEQ ID NO: 356816 - DNA, 37 bp, Artificial Sequence; identical to SEQ ID NO: 233014
  Description of Artificial Sequence: Synthetic oligonucleotide

SEQ ID NO: 356817 - DNA, 22 bp, Artificial Sequence
  Description of Artificial Sequence: Synthetic oligonucleotide
acctgcgctcttggaccgccgc

SEQ ID NO: 356818 - DNA, 36 bp, Artificial Sequence; identical to SEQ ID NO: 233015
  Description of Artificial Sequence: Synthetic oligonucleotide

SEQ ID NO: 356819 - DNA, 21 bp, Artificial Sequence
  Description of Artificial Sequence: Synthetic oligonucleotide
cctgcgctcttggaccgccgc

SEQ ID NO: 356820 - DNA, 36 bp, Artificial Sequence; identical to SEQ ID NO: 233016
  Description of Artificial Sequence: Synthetic oligonucleotide

SEQ ID NO: 356821 - DNA, 21 bp, Artificial Sequence
  Description of Artificial Sequence: Synthetic oligonucleotide
ctgcgctcttggaccgccgcg

SEQ ID NO: 356822 - DNA, 35 bp, Artificial Sequence; identical to SEQ ID NO: 233017
  Description of Artificial Sequence: Synthetic oligonucleotide

SEQ ID NO: 356823 - DNA, 22 bp, Artificial Sequence
  Description of Artificial Sequence: Synthetic oligonucleotide
tgcgctcttggaccgccgcgga

SEQ ID NO: 356824 - DNA, 34 bp, Artificial Sequence; identical to SEQ ID NO: 233018
  Description of Artificial Sequence: Synthetic oligonucleotide

SEQ ID NO: 356825 - DNA, 21 bp, Artificial Sequence
  Description of Artificial Sequence: Synthetic oligonucleotide
gcgctcttggaccgccgcgga

SEQ ID NO: 356826 - DNA, 33 bp, Artificial Sequence; identical to SEQ ID NO: 233019
  Description of Artificial Sequence: Synthetic oligonucleotide

SEQ ID NO: 356827 - DNA, 23 bp, Artificial Sequence
  Description of Artificial Sequence: Synthetic oligonucleotide
cgctcttggaccgccgcggacat

SEQ ID NO: 356828 - DNA, 32 bp, Artificial Sequence; identical to SEQ ID NO: 233020
  Description of Artificial Sequence: Synthetic oligonucleotide

SEQ ID NO: 356829 - DNA, 23 bp, Artificial Sequence
  Description of Artificial Sequence: Synthetic oligonucleotide
gctcttggaccgccgcggacatg

SEQ ID NO: 356830 - DNA, 31 bp, Artificial Sequence; identical to SEQ ID NO: 233021
  Description of Artificial Sequence: Synthetic oligonucleotide

SEQ ID NO: 356831 - DNA, 23 bp, Artificial Sequence
  Description of Artificial Sequence: Synthetic oligonucleotide
ctcttggaccgccgcggacatgg

SEQ ID NO: 356832 - DNA, 30 bp, Artificial Sequence; identical to SEQ ID NO: 233022
  Description of Artificial Sequence: Synthetic oligonucleotide

SEQ ID NO: 356833 - DNA, 24 bp, Artificial Sequence
  Description of Artificial Sequence: Synthetic oligonucleotide
tcttggaccgccgcggacatggca

SEQ ID NO: 356834 - DNA, 34 bp, Artificial Sequence; identical to SEQ ID NO: 233023
  Description of Artificial Sequence: Synthetic oligonucleotide

SEQ ID NO: 356835 - DNA, 23 bp, Artificial Sequence
  Description of Artificial Sequence: Synthetic oligonucleotide
cttggaccgccgcggacatggca

SEQ ID NO: 356836 - DNA, 34 bp, Artificial Sequence; identical to SEQ ID NO: 233024
  Description of Artificial Sequence: Synthetic oligonucleotide

SEQ ID NO: 356837 - DNA, 23 bp, Artificial Sequence
  Description of Artificial Sequence: Synthetic oligonucleotide
ttggaccgccgcggacatggcag

SEQ ID NO: 356838 - DNA, 37 bp, Artificial Sequence; identical to SEQ ID NO: 233025
  Description of Artificial Sequence: Synthetic oligonucleotide

SEQ ID NO: 356839 - DNA, 22 bp, Artificial Sequence
  Description of Artificial Sequence: Synthetic oligonucleotide
tggaccgccgcggacatggcag

SEQ ID NO: 356840 - DNA, 36 bp, Artificial Sequence; identical to SEQ ID NO: 233026
  Description of Artificial Sequence: Synthetic oligonucleotide

SEQ ID NO: 356841 - DNA, 21 bp, Artificial Sequence
  Description of Artificial Sequence: Synthetic oligonucleotide
ggaccgccgcggacatggcag

SEQ ID NO: 356842 - DNA, 36 bp, Artificial Sequence; identical to SEQ ID NO: 233027
  Description of Artificial Sequence: Synthetic oligonucleotide

SEQ ID NO: 356843 - DNA, 22 bp, Artificial Sequence
  Description of Artificial Sequence: Synthetic oligonucleotide
gaccgccgcggacatggcagct

SEQ ID NO: 356844 - DNA, 37 bp, Artificial Sequence; identical to SEQ ID NO: 233028
  Description of Artificial Sequence: Synthetic oligonucleotide

SEQ ID NO: 356845 - DNA, 23 bp, Artificial Sequence
  Description of Artificial Sequence: Synthetic oligonucleotide
accgccgcggacatggcagctca

SEQ ID NO: 356846 - DNA, 36 bp, Artificial Sequence; identical to SEQ ID NO: 233029
  Description of Artificial Sequence: Synthetic oligonucleotide

SEQ ID NO: 356847 - DNA, 22 bp, Artificial Sequence
  Description of Artificial Sequence: Synthetic oligonucleotide
ccgccgcggacatggcagctca

SEQ ID NO: 356848 - DNA, 35 bp, Artificial Sequence; identical to SEQ ID NO: 233030
  Description of Artificial Sequence: Synthetic oligonucleotide

SEQ ID NO: 356849 - DNA, 24 bp, Artificial Sequence
  Description of Artificial Sequence: Synthetic oligonucleotide
cgccgcggacatggcagctcagat

SEQ ID NO: 356850 - DNA, 35 bp, Artificial Sequence; identical to SEQ ID NO: 233031
  Description of Artificial Sequence: Synthetic oligonucleotide

SEQ ID NO: 356851 - DNA, 25 bp, Artificial Sequence
  Description of Artificial Sequence: Synthetic oligonucleotide
gccgcggacatggcagctcagatca

SEQ ID NO: 356852 - DNA, 34 bp, Artificial Sequence; identical to SEQ ID NO: 233032
  Description of Artificial Sequence: Synthetic oligonucleotide

SEQ ID NO: 356853 - DNA, 25 bp, Artificial Sequence
  Description of Artificial Sequence: Synthetic oligonucleotide
ccgcggacatggcagctcagatcac

SEQ ID NO: 356854 - DNA, 33 bp, Artificial Sequence; identical to SEQ ID NO: 233033
  Description of Artificial Sequence: Synthetic oligonucleotide

SEQ ID NO: 356855 - DNA, 27 bp, Artificial Sequence
  Description of Artificial Sequence: Synthetic oligonucleotide
cgcggacatggcagctcagatcaccaa

SEQ ID NO: 356856 - DNA, 34 bp, Artificial Sequence; identical to SEQ ID NO: 233034
  Description of Artificial Sequence: Synthetic oligonucleotide

SEQ ID NO: 356857 - DNA, 27 bp, Artificial Sequence
  Description of Artificial Sequence: Synthetic oligonucleotide
ggctccgcagatacctggagaacggaa

SEQ ID NO: 356858 - DNA, 33 bp, Artificial Sequence; identical to SEQ ID NO: 233035
  Description of Artificial Sequence: Synthetic oligonucleotide

SEQ ID NO: 356859 - DNA, 28 bp, Artificial Sequence
  Description of Artificial Sequence: Synthetic oligonucleotide
gctccgcagatacctggagaacggaaag

SEQ ID NO: 356860 - DNA, 32 bp, Artificial Sequence; identical to SEQ ID NO: 233036
  Description of Artificial Sequence: Synthetic oligonucleotide

SEQ ID NO: 356861 - DNA, 28 bp, Artificial Sequence
  Description of Artificial Sequence: Synthetic oligonucleotide
ctccgcagatacctggagaacggaaagg

SEQ ID NO: 356862 - DNA, 34 bp, Artificial Sequence; identical to SEQ ID NO: 233037
  Description of Artificial Sequence: Synthetic oligonucleotide

SEQ ID NO: 356863 - DNA, 29 bp, Artificial Sequence
  Description of Artificial Sequence: Synthetic oligonucleotide
tccgcagatacctggagaacggaaaggag

SEQ ID NO: 356864 - DNA, 33 bp, Artificial Sequence; identical to SEQ ID NO: 233038
  Description of Artificial Sequence: Synthetic oligonucleotide

SEQ ID NO: 356865 - DNA, 28 bp, Artificial Sequence
  Description of Artificial Sequence: Synthetic oligonucleotide
ccgcagatacctggagaacggaaaggag

SEQ ID NO: 356866 - DNA, 32 bp, Artificial Sequence; identical to SEQ ID NO: 233039
  Description of Artificial Sequence: Synthetic oligonucleotide

SEQ ID NO: 356867 - DNA, 29 bp, Artificial Sequence
  Description of Artificial Sequence: Synthetic oligonucleotide
cgcagatacctggagaacggaaaggagac

SEQ ID NO: 356868 - DNA, 32 bp, Artificial Sequence; identical to SEQ ID NO: 233040
  Description of Artificial Sequence: Synthetic oligonucleotide

SEQ ID NO: 356869 - DNA, 29 bp, Artificial Sequence
  Description of Artificial Sequence: Synthetic oligonucleotide
gcagatacctggagaacggaaaggagacg

SEQ ID NO: 356870 - DNA, 31 bp, Artificial Sequence; identical to SEQ ID NO: 233041
  Description of Artificial Sequence: Synthetic oligonucleotide

SEQ ID NO: 356871 - DNA, 29 bp, Artificial Sequence
  Description of Artificial Sequence: Synthetic oligonucleotide
cagatacctggagaacggaaaggagacgc

SEQ ID NO: 356872 - DNA, 30 bp, Artificial Sequence; identical to SEQ ID NO: 233042
  Description of Artificial Sequence: Synthetic oligonucleotide

SEQ ID NO: 356873 - DNA, 30 bp, Artificial Sequence
  Description of Artificial Sequence: Synthetic oligonucleotide
agatacctggagaacggaaaggagacgctg

SEQ ID NO: 356874 - DNA, 30 bp, Artificial Sequence; identical to SEQ ID NO: 233043
  Description of Artificial Sequence: Synthetic oligonucleotide

SEQ ID NO: 356875 - DNA, 29 bp, Artificial Sequence
  Description of Artificial Sequence: Synthetic oligonucleotide
gatacctggagaacggaaaggagacgctg

SEQ ID NO: 356876 - DNA, 31 bp, Artificial Sequence; identical to SEQ ID NO: 233044
  Description of Artificial Sequence: Synthetic oligonucleotide

SEQ ID NO: 356877 - DNA, 29 bp, Artificial Sequence
  Description of Artificial Sequence: Synthetic oligonucleotide
atacctggagaacggaaaggagacgctgc

SEQ ID NO: 356878 - DNA, 31 bp, Artificial Sequence; identical to SEQ ID NO: 233045
  Description of Artificial Sequence: Synthetic oligonucleotide

SEQ ID NO: 356879 - DNA, 28 bp, Artificial Sequence
  Description of Artificial Sequence: Synthetic oligonucleotide
tacctggagaacggaaaggagacgctgc

SEQ ID NO: 356880 - DNA, 30 bp, Artificial Sequence; identical to SEQ ID NO: 233046
  Description of Artificial Sequence: Synthetic oligonucleotide

SEQ ID NO: 356881 - DNA, 27 bp, Artificial Sequence
  Description of Artificial Sequence: Synthetic oligonucleotide
acctggagaacggaaaggagacgctgc

SEQ ID NO: 356882 - DNA, 29 bp, Artificial Sequence
  Description of Artificial Sequence: Synthetic oligonucleotide
tgcgctaaagcaatggagcagaacggagg

SEQ ID NO: 356883 - DNA, 27 bp, Artificial Sequence
  Description of Artificial Sequence: Synthetic oligonucleotide
cctggagaacggaaaggagacgctgca

SEQ ID NO: 356884 - DNA, 28 bp, Artificial Sequence
  Description of Artificial Sequence: Synthetic oligonucleotide
gcgctaaagcaatggagcagaacggagg

SEQ ID NO: 356885 - DNA, 27 bp, Artificial Sequence
  Description of Artificial Sequence: Synthetic oligonucleotide
ctggagaacggaaaggagacgctgcag

SEQ ID NO: 356886 - DNA, 28 bp, Artificial Sequence
  Description of Artificial Sequence: Synthetic oligonucleotide
cgctaaagcaatggagcagaacggaggg

SEQ ID NO: 356887 - DNA, 27 bp, Artificial Sequence
  Description of Artificial Sequence: Synthetic oligonucleotide
tggagaacggaaaggagacgctgcagc

SEQ ID NO: 356888 - DNA, 28 bp, Artificial Sequence
  Description of Artificial Sequence: Synthetic oligonucleotide
gctaaagcaatggagcagaacggagggg

SEQ ID NO: 356889 - DNA, 26 bp, Artificial Sequence
  Description of Artificial Sequence: Synthetic oligonucleotide
ggagaacggaaaggagacgctgcagc

SEQ ID NO: 356890 - DNA, 28 bp, Artificial Sequence
  Description of Artificial Sequence: Synthetic oligonucleotide
ctaaagcaatggagcagaacggaggggg

SEQ ID NO: 356891 - DNA, 26 bp, Artificial Sequence
  Description of Artificial Sequence: Synthetic oligonucleotide
gagaacggaaaggagacgctgcagcg

SEQ ID NO: 356892 - DNA, 28 bp, Artificial Sequence
  Description of Artificial Sequence: Synthetic oligonucleotide
taaagcaatggagcagaacggagggggc

SEQ ID NO: 356893 - DNA, 27 bp, Artificial Sequence
  Description of Artificial Sequence: Synthetic oligonucleotide
agaacggaaaggagacgctgcagcgca

SEQ ID NO: 356894 - DNA, 27 bp, Artificial Sequence
  Description of Artificial Sequence: Synthetic oligonucleotide
aaagcaatggagcagaacggagggggc

SEQ ID NO: 356895 - DNA, 26 bp, Artificial Sequence
  Description of Artificial Sequence: Synthetic oligonucleotide
gaacggaaaggagacgctgcagcgca

SEQ ID NO: 356896 - DNA, 26 bp, Artificial Sequence
  Description of Artificial Sequence: Synthetic oligonucleotide
aagcaatggagcagaacggagggggc

SEQ ID NO: 356897 - DNA, 26 bp, Artificial Sequence
  Description of Artificial Sequence: Synthetic oligonucleotide
aacggaaaggagacgctgcagcgcac

SEQ ID NO: 356898 - DNA, 25 bp, Artificial Sequence
  Description of Artificial Sequence: Synthetic oligonucleotide
agcaatggagcagaacggagggggc

SEQ ID NO: 356899 - DNA, 25 bp, Artificial Sequence
  Description of Artificial Sequence: Synthetic oligonucleotide
acggaaaggagacgctgcagcgcac

SEQ ID NO: 356900 - DNA, 24 bp, Artificial Sequence
  Description of Artificial Sequence: Synthetic oligonucleotide
gcaatggagcagaacggagggggc

SEQ ID NO: 356901 - DNA, 24 bp, Artificial Sequence
  Description of Artificial Sequence: Synthetic oligonucleotide
cggaaaggagacgctgcagcgcac

SEQ ID NO: 356902 - DNA, 25 bp, Artificial Sequence
  Description of Artificial Sequence: Synthetic oligonucleotide
caatggagcagaacggagggggcct

SEQ ID NO: 356903 - DNA, 24 bp, Artificial Sequence
  Description of Artificial Sequence: Synthetic oligonucleotide
ggaaaggagacgctgcagcgcacg

SEQ ID NO: 356904 - DNA, 26 bp, Artificial Sequence
  Description of Artificial Sequence: Synthetic oligonucleotide
aatggagcagaacggagggggcctgt

SEQ ID NO: 356905 - DNA, 24 bp, Artificial Sequence
  Description of Artificial Sequence: Synthetic oligonucleotide
gaaaggagacgctgcagcgcacgg

SEQ ID NO: 356906 - DNA, 25 bp, Artificial Sequence
  Description of Artificial Sequence: Synthetic oligonucleotide
atggagcagaacggagggggcctgt

SEQ ID NO: 356907 - DNA, 22 bp, Artificial Sequence
  Description of Artificial Sequence: Synthetic oligonucleotide
cggggagccccgcttcatcgca

SEQ ID NO: 356908 - DNA, 24 bp, Artificial Sequence
  Description of Artificial Sequence: Synthetic oligonucleotide
tggagcagaacggagggggcctgt

SEQ ID NO: 356909 - DNA, 23 bp, Artificial Sequence
  Description of Artificial Sequence: Synthetic oligonucleotide
ggggagccccgcttcatcgcagt

SEQ ID NO: 356910 - DNA, 23 bp, Artificial Sequence
  Description of Artificial Sequence: Synthetic oligonucleotide
ggagcagaacggagggggcctgt

SEQ ID NO: 356911 - DNA, 23 bp, Artificial Sequence
  Description of Artificial Sequence: Synthetic oligonucleotide
gggagccccgcttcatcgcagtg

SEQ ID NO: 356912 - DNA, 26 bp, Artificial Sequence
  Description of Artificial Sequence: Synthetic oligonucleotide
gagcagaacggagggggcctgtgtaa

SEQ ID NO: 356913 - DNA, 23 bp, Artificial Sequence
  Description of Artificial Sequence: Synthetic oligonucleotide
ggagccccgcttcatcgcagtgg

SEQ ID NO: 356914 - DNA, 27 bp, Artificial Sequence
  Description of Artificial Sequence: Synthetic oligonucleotide
atggtgtgtgtgaagctccgtggaggc

SEQ ID NO: 356915 - DNA, 23 bp, Artificial Sequence
  Description of Artificial Sequence: Synthetic oligonucleotide
gagccccgcttcatcgcagtggg

SEQ ID NO: 356916 - DNA, 27 bp, Artificial Sequence
  Description of Artificial Sequence: Synthetic oligonucleotide
tggtgtgtgtgaagctccgtggaggct

SEQ ID NO: 356917 - DNA, 25 bp, Artificial Sequence
  Description of Artificial Sequence: Synthetic oligonucleotide
agccccgcttcatcgcagtgggcta

SEQ ID NO: 356918 - DNA, 26 bp, Artificial Sequence
  Description of Artificial Sequence: Synthetic oligonucleotide
ggtgtgtgtgaagctccgtggaggct

SEQ ID NO: 356919 - DNA, 24 bp, Artificial Sequence
  Description of Artificial Sequence: Synthetic oligonucleotide
gccccgcttcatcgcagtgggcta

SEQ ID NO: 356920 - DNA, 26 bp, Artificial Sequence
  Description of Artificial Sequence: Synthetic oligonucleotide
gtgtgtgtgaagctccgtggaggctc

SEQ ID NO: 356921 - DNA, 24 bp, Artificial Sequence
  Description of Artificial Sequence: Synthetic oligonucleotide
ccccgcttcatcgcagtgggctac

SEQ ID NO: 356922 - DNA, 27 bp, Artificial Sequence
  Description of Artificial Sequence: Synthetic oligonucleotide
tgtgtgtgaagctccgtggaggctcgt

SEQ ID NO: 356923 - DNA, 25 bp, Artificial Sequence
  Description of Artificial Sequence: Synthetic oligonucleotide
cccgcttcatcgcagtgggctacgt

SEQ ID NO: 356924 - DNA, 26 bp, Artificial Sequence
  Description of Artificial Sequence: Synthetic oligonucleotide
gtgtgtgaagctccgtggaggctcgt

SEQ ID NO: 356925 - DNA, 25 bp, Artificial Sequence
  Description of Artificial Sequence: Synthetic oligonucleotide
ccgcttcatcgcagtgggctacgtg

SEQ ID NO: 356926 - DNA, 26 bp, Artificial Sequence
  Description of Artificial Sequence: Synthetic oligonucleotide
tgtgtgaagctccgtggaggctcgtg

SEQ ID NO: 356927 - DNA, 26 bp, Artificial Sequence
  Description of Artificial Sequence: Synthetic oligonucleotide
cgcttcatcgcagtgggctacgtgga

SEQ ID NO: 356928 - DNA, 25 bp, Artificial Sequence
  Description of Artificial Sequence: Synthetic oligonucleotide
gtgtgaagctccgtggaggctcgtg

SEQ ID NO: 356929 - DNA, 26 bp, Artificial Sequence
  Description of Artificial Sequence: Synthetic oligonucleotide
gcttcatcgcagtgggctacgtggac

SEQ ID NO: 356930 - DNA, 27 bp, Artificial Sequence
  Description of Artificial Sequence: Synthetic oligonucleotide
tgtgaagctccgtggaggctcgtgcat

SEQ ID NO: 356931 - DNA, 27 bp, Artificial Sequence
  Description of Artificial Sequence: Synthetic oligonucleotide
cttcatcgcagtgggctacgtggacga

SEQ ID NO: 356932 - DNA, 26 bp, Artificial Sequence
  Description of Artificial Sequence: Synthetic oligonucleotide
gtgaagctccgtggaggctcgtgcat

SEQ ID NO: 356933 - DNA, 27 bp, Artificial Sequence
  Description of Artificial Sequence: Synthetic oligonucleotide
ttcatcgcagtgggctacgtggacgac

SEQ ID NO: 356934 - DNA, 26 bp, Artificial Sequence
  Description of Artificial Sequence: Synthetic oligonucleotide
tgaagctccgtggaggctcgtgcatg

SEQ ID NO: 356935 - DNA, 27 bp, Artificial Sequence
  Description of Artificial Sequence: Synthetic oligonucleotide
tcatcgcagtgggctacgtggacgaca

SEQ ID NO: 356936 - DNA, 25 bp, Artificial Sequence
  Description of Artificial Sequence: Synthetic oligonucleotide
gaagctccgtggaggctcgtgcatg

SEQ ID NO: 356937 - DNA, 26 bp, Artificial Sequence
  Description of Artificial Sequence: Synthetic oligonucleotide
catcgcagtgggctacgtggacgaca

SEQ ID NO: 356938 - DNA, 25 bp, Artificial Sequence
  Description of Artificial Sequence: Synthetic oligonucleotide
aagctccgtggaggctcgtgcatgg

SEQ ID NO: 356939 - DNA, 26 bp, Artificial Sequence
  Description of Artificial Sequence: Synthetic oligonucleotide
atcgcagtgggctacgtggacgacac

SEQ ID NO: 356940 - DNA, 24 bp, Artificial Sequence
  Description of Artificial Sequence: Synthetic oligonucleotide
agctccgtggaggctcgtgcatgg

SEQ ID NO: 356941 - DNA, 25 bp, Artificial Sequence
  Description of Artificial Sequence: Synthetic oligonucleotide
tcgcagtgggctacgtggacgacac

SEQ ID NO: 356942 - DNA, 23 bp, Artificial Sequence
  Description of Artificial Sequence: Synthetic oligonucleotide
gctccgtggaggctcgtgcatgg

SEQ ID NO: 356943 - DNA, 24 bp, Artificial Sequence
  Description of Artificial Sequence: Synthetic oligonucleotide
cgcagtgggctacgtggacgacac

SEQ ID NO: 356944 - DNA, 24 bp, Artificial Sequence
  Description of Artificial Sequence: Synthetic oligonucleotide
ctccgtggaggctcgtgcatggct

SEQ ID NO: 356945 - DNA, 24 bp, Artificial Sequence
  Description of Artificial Sequence: Synthetic oligonucleotide
gcagtgggctacgtggacgacacg

SEQ ID NO: 356946 - DNA, 24 bp, Artificial Sequence
  Description of Artificial Sequence: Synthetic oligonucleotide
tccgtggaggctcgtgcatggctg

SEQ ID NO: 356947 - DNA, 25 bp, Artificial Sequence
  Description of Artificial Sequence: Synthetic oligonucleotide
cagtgggctacgtggacgacacgca

SEQ ID NO: 356948 - DNA, 23 bp, Artificial Sequence
  Description of Artificial Sequence: Synthetic oligonucleotide
ccgtggaggctcgtgcatggctg

SEQ ID NO: 356949 - DNA, 27 bp, Artificial Sequence
  Description of Artificial Sequence: Synthetic oligonucleotide
agtgggctacgtggacgacacgcagtt

SEQ ID NO: 356950 - DNA, 24 bp, Artificial Sequence
  Description of Artificial Sequence: Synthetic oligonucleotide
cgtggaggctcgtgcatggctgct

SEQ ID NO: 356951 - DNA, 26 bp, Artificial Sequence
  Description of Artificial Sequence: Synthetic oligonucleotide
gtggacgacacgcagttcgtgcgctt

SEQ ID NO: 356952 - DNA, 25 bp, Artificial Sequence
  Description of Artificial Sequence: Synthetic oligonucleotide
gtggaggctcgtgcatggctgctct

SEQ ID NO: 356953 - DNA, 26 bp, Artificial Sequence
  Description of Artificial Sequence: Synthetic oligonucleotide
tggacgacacgcagttcgtgcgcttc

SEQ ID NO: 356954 - DNA, 26 bp, Artificial Sequence
  Description of Artificial Sequence: Synthetic oligonucleotide
tggaggctcgtgcatggctgctctga

SEQ ID NO: 356955 - DNA, 25 bp, Artificial Sequence
  Description of Artificial Sequence: Synthetic oligonucleotide
ggacgacacgcagttcgtgcgcttc

SEQ ID NO: 356956 - DNA, 25 bp, Artificial Sequence
  Description of Artificial Sequence: Synthetic oligonucleotide
ggaggctcgtgcatggctgctctga

SEQ ID NO: 356957 - DNA, 26 bp, Artificial Sequence
  Description of Artificial Sequence: Synthetic oligonucleotide
gacgacacgcagttcgtgcgcttcga

SEQ ID NO: 356958 - DNA, 26 bp, Artificial Sequence
  Description of Artificial Sequence: Synthetic oligonucleotide
gaggctcgtgcatggctgctctgaca

SEQ ID NO: 356959 - DNA, 27 bp, Artificial Sequence
  Description of Artificial Sequence: Synthetic oligonucleotide
acgacacgcagttcgtgcgcttcgaca

SEQ ID NO: 356960 - DNA, 27 bp, Artificial Sequence
  Description of Artificial Sequence: Synthetic oligonucleotide
aggctcgtgcatggctgctctgacaga

SEQ ID NO: 356961 - DNA, 26 bp, Artificial Sequence
  Description of Artificial Sequence: Synthetic oligonucleotide
cgacacgcagttcgtgcgcttcgaca

SEQ ID NO: 356962 - DNA, 26 bp, Artificial Sequence
  Description of Artificial Sequence: Synthetic oligonucleotide
ggctcgtgcatggctgctctgacaga

SEQ ID NO: 356963 - DNA, 26 bp, Artificial Sequence
  Description of Artificial Sequence: Synthetic oligonucleotide
gacacgcagttcgtgcgcttcgacag

SEQ ID NO: 356964 - DNA, 27 bp, Artificial Sequence
  Description of Artificial Sequence: Synthetic oligonucleotide
gctcgtgcatggctgctctgacagaga

SEQ ID NO: 356965 - DNA, 26 bp, Artificial Sequence
  Description of Artificial Sequence: Synthetic oligonucleotide
acacgcagttcgtgcgcttcgacagc

SEQ ID NO: 356966 - DNA, 27 bp, Artificial Sequence
  Description of Artificial Sequence: Synthetic oligonucleotide
ctcgtgcatggctgctctgacagagac

SEQ ID NO: 356967 - DNA, 25 bp, Artificial Sequence
  Description of Artificial Sequence: Synthetic oligonucleotide
cacgcagttcgtgcgcttcgacagc

SEQ ID NO: 356968 - DNA, 28 bp, Artificial Sequence
  Description of Artificial Sequence: Synthetic oligonucleotide
tcgtgcatggctgctctgacagagacac

SEQ ID NO: 356969 - DNA, 26 bp, Artificial Sequence
  Description of Artificial Sequence: Synthetic oligonucleotide
acgcagttcgtgcgcttcgacagcga

SEQ ID NO: 356970 - DNA, 27 bp, Artificial Sequence
  Description of Artificial Sequence: Synthetic oligonucleotide
cgtgcatggctgctctgacagagacac

SEQ ID NO: 356971 - DNA, 25 bp, Artificial Sequence
  Description of Artificial Sequence: Synthetic oligonucleotide
cgcagttcgtgcgcttcgacagcga

SEQ ID NO: 356972 - DNA, 28 bp, Artificial Sequence
  Description of Artificial Sequence: Synthetic oligonucleotide
gtgcatggctgctctgacagagacactg

SEQ ID NO: 356973 - DNA, 25 bp, Artificial Sequence
  Description of Artificial Sequence: Synthetic oligonucleotide
gcagttcgtgcgcttcgacagcgac

SEQ ID NO: 356974 - DNA, 30 bp, Artificial Sequence; identical to SEQ ID NO: 233093
  Description of Artificial Sequence: Synthetic oligonucleotide

SEQ ID NO: 356975 - DNA, 25 bp, Artificial Sequence
  Description of Artificial Sequence: Synthetic oligonucleotide
cagttcgtgcgcttcgacagcgacg

SEQ ID NO: 356976 - DNA, 29 bp, Artificial Sequence
  Description of Artificial Sequence: Synthetic oligonucleotide
gcatggctgctctgacagagacactgatc

SEQ ID NO: 356977 - DNA, 25 bp, Artificial Sequence
  Description of Artificial Sequence: Synthetic oligonucleotide
agttcgtgcgcttcgacagcgacgc

SEQ ID NO: 356978 - DNA, 29 bp, Artificial Sequence
  Description of Artificial Sequence: Synthetic oligonucleotide
catggctgctctgacagagacactgatcg

SEQ ID NO: 356979 - DNA, 24 bp, Artificial Sequence
  Description of Artificial Sequence: Synthetic oligonucleotide
gttcgtgcgcttcgacagcgacgc

SEQ ID NO: 356980 - DNA, 30 bp, Artificial Sequence; identical to SEQ ID NO: 233096
  Description of Artificial Sequence: Synthetic oligonucleotide

SEQ ID NO: 356981 - DNA, 24 bp, Artificial Sequence
  Description of Artificial Sequence: Synthetic oligonucleotide
ttcgtgcgcttcgacagcgacgcc

SEQ ID NO: 356982 - DNA, 29 bp, Artificial Sequence
  Description of Artificial Sequence: Synthetic oligonucleotide
tggctgctctgacagagacactgatcgtg

SEQ ID NO: 356983 - DNA, 23 bp, Artificial Sequence
  Description of Artificial Sequence: Synthetic oligonucleotide
tcgtgcgcttcgacagcgacgcc

SEQ ID NO: 356984 - DNA, 28 bp, Artificial Sequence
  Description of Artificial Sequence: Synthetic oligonucleotide
ggctgctctgacagagacactgatcgtg

SEQ ID NO: 356985 - DNA, 22 bp, Artificial Sequence
  Description of Artificial Sequence: Synthetic oligonucleotide
cgtgcgcttcgacagcgacgcc

SEQ ID NO: 356986 - DNA, 28 bp, Artificial Sequence
  Description of Artificial Sequence: Synthetic oligonucleotide
gctgctctgacagagacactgatcgtgc

SEQ ID NO: 356987 - DNA, 22 bp, Artificial Sequence
  Description of Artificial Sequence: Synthetic oligonucleotide
gtgcgcttcgacagcgacgccg

SEQ ID NO: 356988 - DNA, 29 bp, Artificial Sequence
  Description of Artificial Sequence: Synthetic oligonucleotide
ctgctctgacagagacactgatcgtgctg

SEQ ID NO: 356989 - DNA, 22 bp, Artificial Sequence
  Description of Artificial Sequence: Synthetic oligonucleotide
tgcgcttcgacagcgacgccgc

SEQ ID NO: 356990 - DNA, 30 bp, Artificial Sequence; identical to SEQ ID NO: 233101
  Description of Artificial Sequence: Synthetic oligonucleotide

SEQ ID NO: 356991 - DNA, 21 bp, Artificial Sequence
  Description of Artificial Sequence: Synthetic oligonucleotide
gcgcttcgacagcgacgccgc

SEQ ID NO: 356992 - DNA, 29 bp, Artificial Sequence
  Description of Artificial Sequence: Synthetic oligonucleotide
gctctgacagagacactgatcgtgctgag

SEQ ID NO: 356993 - DNA, 22 bp, Artificial Sequence
  Description of Artificial Sequence: Synthetic oligonucleotide
cgcttcgacagcgacgccgcga

SEQ ID NO: 356994 - DNA, 29 bp, Artificial Sequence
  Description of Artificial Sequence: Synthetic oligonucleotide
ctctgacagagacactgatcgtgctgagc

SEQ ID NO: 356995 - DNA, 22 bp, Artificial Sequence
  Description of Artificial Sequence: Synthetic oligonucleotide
gcttcgacagcgacgccgcgag

SEQ ID NO: 356996 - DNA, 30 bp, Artificial Sequence; identical to SEQ ID NO: 233104
  Description of Artificial Sequence: Synthetic oligonucleotide

SEQ ID NO: 356997 - DNA, 22 bp, Artificial Sequence
  Description of Artificial Sequence: Synthetic oligonucleotide
cttcgacagcgacgccgcgagc

SEQ ID NO: 356998 - DNA, 29 bp, Artificial Sequence
  Description of Artificial Sequence: Synthetic oligonucleotide
ctgacagagacactgatcgtgctgagcac

SEQ ID NO: 356999 - DNA, 25 bp, Artificial Sequence
  Description of Artificial Sequence: Synthetic oligonucleotide
cggagagtctacctggagggccgtt

SEQ ID NO: 357000 - DNA, 29 bp, Artificial Sequence
  Description of Artificial Sequence: Synthetic oligonucleotide
tgacagagacactgatcgtgctgagcacc

SEQ ID NO: 357001 - DNA, 25 bp, Artificial Sequence
  Description of Artificial Sequence: Synthetic oligonucleotide
ggagagtctacctggagggccgttg

SEQ ID NO: 357002 - DNA, 28 bp, Artificial Sequence
  Description of Artificial Sequence: Synthetic oligonucleotide
gacagagacactgatcgtgctgagcacc

SEQ ID NO: 357003 - DNA, 25 bp, Artificial Sequence
  Description of Artificial Sequence: Synthetic oligonucleotide
gagagtctacctggagggccgttgc

SEQ ID NO: 357004 - DNA, 28 bp, Artificial Sequence
  Description of Artificial Sequence: Synthetic oligonucleotide
acagagacactgatcgtgctgagcaccc

SEQ ID NO: 357005 - DNA, 26 bp, Artificial Sequence
  Description of Artificial Sequence: Synthetic oligonucleotide
agagtctacctggagggccgttgcgt

SEQ ID NO: 357006 - DNA, 27 bp, Artificial Sequence
  Description of Artificial Sequence: Synthetic oligonucleotide
cagagacactgatcgtgctgagcaccc

SEQ ID NO: 357007 - DNA, 25 bp, Artificial Sequence
  Description of Artificial Sequence: Synthetic oligonucleotide
gagtctacctggagggccgttgcgt

SEQ ID NO: 357008 - DNA, 27 bp, Artificial Sequence
  Description of Artificial Sequence: Synthetic oligonucleotide
agagacactgatcgtgctgagcacccc

SEQ ID NO: 357009 - DNA, 25 bp, Artificial Sequence
  Description of Artificial Sequence: Synthetic oligonucleotide
agtctacctggagggccgttgcgtg

SEQ ID NO: 357010 - DNA, 27 bp, Artificial Sequence
  Description of Artificial Sequence: Synthetic oligonucleotide
gagacactgatcgtgctgagcacccca

SEQ ID NO: 357011 - DNA, 24 bp, Artificial Sequence
  Description of Artificial Sequence: Synthetic oligonucleotide
gtctacctggagggccgttgcgtg

SEQ ID NO: 357012 - DNA, 27 bp, Artificial Sequence
  Description of Artificial Sequence: Synthetic oligonucleotide
agacactgatcgtgctgagcaccccac

SEQ ID NO: 357013 - DNA, 25 bp, Artificial Sequence
  Description of Artificial Sequence: Synthetic oligonucleotide
tctacctggagggccgttgcgtgga

SEQ ID NO: 357014 - DNA, 27 bp, Artificial Sequence
  Description of Artificial Sequence: Synthetic oligonucleotide
gacactgatcgtgctgagcaccccact

SEQ ID NO: 357015 - DNA, 24 bp, Artificial Sequence
  Description of Artificial Sequence: Synthetic oligonucleotide
ctacctggagggccgttgcgtgga

SEQ ID NO: 357016 - DNA, 27 bp, Artificial Sequence
  Description of Artificial Sequence: Synthetic oligonucleotide
acactgatcgtgctgagcaccccactg

SEQ ID NO: 357017 - DNA, 24 bp, Artificial Sequence
  Description of Artificial Sequence: Synthetic oligonucleotide
tacctggagggccgttgcgtggac

SEQ ID NO: 357018 - DNA, 26 bp, Artificial Sequence
  Description of Artificial Sequence: Synthetic oligonucleotide
cactgatcgtgctgagcaccccactg

SEQ ID NO: 357019 - DNA, 23 bp, Artificial Sequence
  Description of Artificial Sequence: Synthetic oligonucleotide
acctggagggccgttgcgtggac

SEQ ID NO: 357020 - DNA, 26 bp, Artificial Sequence
  Description of Artificial Sequence: Synthetic oligonucleotide
actgatcgtgctgagcaccccactgg

SEQ ID NO: 357021 - DNA, 22 bp, Artificial Sequence
  Description of Artificial Sequence: Synthetic oligonucleotide
cctggagggccgttgcgtggac

SEQ ID NO: 357022 - DNA, 25 bp, Artificial Sequence
  Description of Artificial Sequence: Synthetic oligonucleotide
ctgatcgtgctgagcaccccactgg

SEQ ID NO: 357023 - DNA, 22 bp, Artificial Sequence
  Description of Artificial Sequence: Synthetic oligonucleotide
ctggagggccgttgcgtggacg

SEQ ID NO: 357024 - DNA, 27 bp, Artificial Sequence
  Description of Artificial Sequence: Synthetic oligonucleotide
tgatcgtgctgagcaccccactgggtt

SEQ ID NO: 357025 - DNA, 22 bp, Artificial Sequence
  Description of Artificial Sequence: Synthetic oligonucleotide
tggagggccgttgcgtggacgg

SEQ ID NO: 357026 - DNA, 27 bp, Artificial Sequence
  Description of Artificial Sequence: Synthetic oligonucleotide
gatcgtgctgagcaccccactgggttt

SEQ ID NO: 357027 - DNA, 21 bp, Artificial Sequence
  Description of Artificial Sequence: Synthetic oligonucleotide
ggagggccgttgcgtggacgg

SEQ ID NO: 357028 - DNA, 27 bp, Artificial Sequence
  Description of Artificial Sequence: Synthetic oligonucleotide
atcgtgctgagcaccccactgggtttg

SEQ ID NO: 357029 - DNA, 21 bp, Artificial Sequence
  Description of Artificial Sequence: Synthetic oligonucleotide
gagggccgttgcgtggacggg

SEQ ID NO: 357030 - DNA, 26 bp, Artificial Sequence
  Description of Artificial Sequence: Synthetic oligonucleotide
tcgtgctgagcaccccactgggtttg

SEQ ID NO: 357031 - DNA, 22 bp, Artificial Sequence
  Description of Artificial Sequence: Synthetic oligonucleotide
agggccgttgcgtggacgggct

SEQ ID NO: 357032 - DNA, 25 bp, Artificial Sequence
  Description of Artificial Sequence: Synthetic oligonucleotide
cgtgctgagcaccccactgggtttg

SEQ ID NO: 357033 - DNA, 21 bp, Artificial Sequence
  Description of Artificial Sequence: Synthetic oligonucleotide
gggccgttgcgtggacgggct

SEQ ID NO: 357034 - DNA, 25 bp, Artificial Sequence
  Description of Artificial Sequence: Synthetic oligonucleotide
gtgctgagcaccccactgggtttgg

SEQ ID NO: 357035 - DNA, 21 bp, Artificial Sequence
  Description of Artificial Sequence: Synthetic oligonucleotide
ggccgttgcgtggacgggctc

SEQ ID NO: 357036 - DNA, 26 bp, Artificial Sequence
  Description of Artificial Sequence: Synthetic oligonucleotide
tgctgagcaccccactgggtttggct

SEQ ID NO: 357037 - DNA, 21 bp, Artificial Sequence
  Description of Artificial Sequence: Synthetic oligonucleotide
gccgttgcgtggacgggctcc

SEQ ID NO: 357038 - DNA, 25 bp, Artificial Sequence
  Description of Artificial Sequence: Synthetic oligonucleotide
gctgagcaccccactgggtttggct

SEQ ID NO: 357039 - DNA, 21 bp, Artificial Sequence
  Description of Artificial Sequence: Synthetic oligonucleotide
ccgttgcgtggacgggctccg

SEQ ID NO: 357040 - DNA, 25 bp, Artificial Sequence
  Description of Artificial Sequence: Synthetic oligonucleotide
ctgagcaccccactgggtttggctg

SEQ ID NO: 357041 - DNA, 22 bp, Artificial Sequence
  Description of Artificial Sequence: Synthetic oligonucleotide
cgttgcgtggacgggctccgca

SEQ ID NO: 357042 - DNA, 25 bp, Artificial Sequence
  Description of Artificial Sequence: Synthetic oligonucleotide
tgagcaccccactgggtttggctgg

SEQ ID NO: 357043 - DNA, 25 bp, Artificial Sequence
  Description of Artificial Sequence: Synthetic oligonucleotide
gttgcgtggacgggctccgcagata

SEQ ID NO: 357044 - DNA, 24 bp, Artificial Sequence
  Description of Artificial Sequence: Synthetic oligonucleotide
gagcaccccactgggtttggctgg

SEQ ID NO: 357045 - DNA, 25 bp, Artificial Sequence
  Description of Artificial Sequence: Synthetic oligonucleotide
ttgcgtggacgggctccgcagatac

SEQ ID NO: 357046 - DNA, 24 bp, Artificial Sequence
  Description of Artificial Sequence: Synthetic oligonucleotide
agcaccccactgggtttggctggc

SEQ ID NO: 357047 - DNA, 27 bp, Artificial Sequence
  Description of Artificial Sequence: Synthetic oligonucleotide
tacgtggacgacacgcagttcgtgcgt

SEQ ID NO: 357048 - DNA, 23 bp, Artificial Sequence
  Description of Artificial Sequence: Synthetic oligonucleotide
gcaccccactgggtttggctggc

SEQ ID NO: 357049 - DNA, 27 bp, Artificial Sequence
  Description of Artificial Sequence: Synthetic oligonucleotide
acgtggacgacacgcagttcgtgcgtt

SEQ ID NO: 357050 - DNA, 24 bp, Artificial Sequence
  Description of Artificial Sequence: Synthetic oligonucleotide
caccccactgggtttggctggcga

SEQ ID NO: 357051 - DNA, 27 bp, Artificial Sequence
  Description of Artificial Sequence: Synthetic oligonucleotide
cgtggacgacacgcagttcgtgcgttt

SEQ ID NO: 357052 - DNA, 25 bp, Artificial Sequence
  Description of Artificial Sequence: Synthetic oligonucleotide
accccactgggtttggctggcgaca

SEQ ID NO: 357053 - DNA, 27 bp, Artificial Sequence
  Description of Artificial Sequence: Synthetic oligonucleotide
gtggacgacacgcagttcgtgcgtttc

SEQ ID NO: 357054 - DNA, 24 bp, Artificial Sequence
  Description of Artificial Sequence: Synthetic oligonucleotide
ccccactgggtttggctggcgaca

SEQ ID NO: 357055 - DNA, 27 bp, Artificial Sequence
  Description of Artificial Sequence: Synthetic oligonucleotide
tggacgacacgcagttcgtgcgtttcg

SEQ ID NO: 357056 - DNA, 24 bp, Artificial Sequence
  Description of Artificial Sequence: Synthetic oligonucleotide
cccactgggtttggctggcgacac

SEQ ID NO: 357057 - DNA, 27 bp, Artificial Sequence
  Description of Artificial Sequence: Synthetic oligonucleotide
ggacgacacgcagttcgtgcgtttcga

SEQ ID NO: 357058 - DNA, 24 bp, Artificial Sequence
  Description of Artificial Sequence: Synthetic oligonucleotide
ccactgggtttggctggcgacacc

SEQ ID NO: 357059 - DNA, 27 bp, Artificial Sequence
  Description of Artificial Sequence: Synthetic oligonucleotide
gacgacacgcagttcgtgcgtttcgac

SEQ ID NO: 357060 - DNA, 24 bp, Artificial Sequence
  Description of Artificial Sequence: Synthetic oligonucleotide
cactgggtttggctggcgacaccc

SEQ ID NO: 357061 - DNA, 28 bp, Artificial Sequence
  Description of Artificial Sequence: Synthetic oligonucleotide
acgacacgcagttcgtgcgtttcgacag

SEQ ID NO: 357062 - DNA, 25 bp, Artificial Sequence
  Description of Artificial Sequence: Synthetic oligonucleotide
actgggtttggctggcgacacccga

SEQ ID NO: 357063 - DNA, 27 bp, Artificial Sequence
  Description of Artificial Sequence: Synthetic oligonucleotide
cgacacgcagttcgtgcgtttcgacag

SEQ ID NO: 357064 - DNA, 24 bp, Artificial Sequence
  Description of Artificial Sequence: Synthetic oligonucleotide
ctgggtttggctggcgacacccga

SEQ ID NO: 357065 - DNA, 27 bp, Artificial Sequence
  Description of Artificial Sequence: Synthetic oligonucleotide
gacacgcagttcgtgcgtttcgacagc

SEQ ID NO: 357066 - DNA, 24 bp, Artificial Sequence
  Description of Artificial Sequence: Synthetic oligonucleotide
tgggtttggctggcgacacccgag

SEQ ID NO: 357067 - DNA, 27 bp, Artificial Sequence
  Description of Artificial Sequence: Synthetic oligonucleotide
acacgcagttcgtgcgtttcgacagcg

SEQ ID NO: 357068 - DNA, 23 bp, Artificial Sequence
  Description of Artificial Sequence: Synthetic oligonucleotide
gggtttggctggcgacacccgag

SEQ ID NO: 357069 - DNA, 27 bp, Artificial Sequence
  Description of Artificial Sequence: Synthetic oligonucleotide
cacgcagttcgtgcgtttcgacagcga

SEQ ID NO: 357070 - DNA, 24 bp, Artificial Sequence
  Description of Artificial Sequence: Synthetic oligonucleotide
ggtttggctggcgacacccgagca

SEQ ID NO: 357071 - DNA, 27 bp, Artificial Sequence
  Description of Artificial Sequence: Synthetic oligonucleotide
acgcagttcgtgcgtttcgacagcgac

SEQ ID NO: 357072 - DNA, 24 bp, Artificial Sequence
  Description of Artificial Sequence: Synthetic oligonucleotide
gtttggctggcgacacccgagcac

SEQ ID NO: 357073 - DNA, 26 bp, Artificial Sequence
  Description of Artificial Sequence: Synthetic oligonucleotide
cgcagttcgtgcgtttcgacagcgac

SEQ ID NO: 357074 - DNA, 27 bp, Artificial Sequence
  Description of Artificial Sequence: Synthetic oligonucleotide
tttggctggcgacacccgagcacgttt

SEQ ID NO: 357075 - DNA, 26 bp, Artificial Sequence
  Description of Artificial Sequence: Synthetic oligonucleotide
gcagttcgtgcgtttcgacagcgacg

SEQ ID NO: 357076 - DNA, 26 bp, Artificial Sequence
  Description of Artificial Sequence: Synthetic oligonucleotide
ttggctggcgacacccgagcacgttt

SEQ ID NO: 357077 - DNA, 26 bp, Artificial Sequence
  Description of Artificial Sequence: Synthetic oligonucleotide
cagttcgtgcgtttcgacagcgacgc

SEQ ID NO: 357078 - DNA, 25 bp, Artificial Sequence
  Description of Artificial Sequence: Synthetic oligonucleotide
tggctggcgacacccgagcacgttt

SEQ ID NO: 357079 - DNA, 26 bp, Artificial Sequence
  Description of Artificial Sequence: Synthetic oligonucleotide
agttcgtgcgtttcgacagcgacgcc

SEQ ID NO: 357080 - DNA, 24 bp, Artificial Sequence
  Description of Artificial Sequence: Synthetic oligonucleotide
ggctggcgacacccgagcacgttt

SEQ ID NO: 357081 - DNA, 25 bp, Artificial Sequence
  Description of Artificial Sequence: Synthetic oligonucleotide
gttcgtgcgtttcgacagcgacgcc

SEQ ID NO: 357082 - DNA, 26 bp, Artificial Sequence
  Description of Artificial Sequence: Synthetic oligonucleotide
gctggcgacacccgagcacgtttcta

SEQ ID NO: 357083 - DNA, 25 bp, Artificial Sequence
  Description of Artificial Sequence: Synthetic oligonucleotide
ttcgtgcgtttcgacagcgacgccg

SEQ ID NO: 357084 - DNA, 26 bp, Artificial Sequence
  Description of Artificial Sequence: Synthetic oligonucleotide
ctggcgacacccgagcacgtttctag

SEQ ID NO: 357085 - DNA, 24 bp, Artificial Sequence
  Description of Artificial Sequence: Synthetic oligonucleotide
tcgtgcgtttcgacagcgacgccg

SEQ ID NO: 357086 - DNA, 27 bp, Artificial Sequence
  Description of Artificial Sequence: Synthetic oligonucleotide
tggcgacacccgagcacgtttctagga

SEQ ID NO: 357087 - DNA, 23 bp, Artificial Sequence
  Description of Artificial Sequence: Synthetic oligonucleotide
cgtgcgtttcgacagcgacgccg

SEQ ID NO: 357088 - DNA, 26 bp, Artificial Sequence
  Description of Artificial Sequence: Synthetic oligonucleotide
ggcgacacccgagcacgtttctagga

SEQ ID NO: 357089 - DNA, 23 bp, Artificial Sequence
  Description of Artificial Sequence: Synthetic oligonucleotide
gtgcgtttcgacagcgacgccgc

SEQ ID NO: 357090 - DNA, 26 bp, Artificial Sequence
  Description of Artificial Sequence: Synthetic oligonucleotide
gcgacacccgagcacgtttctaggag

SEQ ID NO: 357091 - DNA, 24 bp, Artificial Sequence
  Description of Artificial Sequence: Synthetic oligonucleotide
tgcgtttcgacagcgacgccgcga

SEQ ID NO: 357092 - DNA, 27 bp, Artificial Sequence
  Description of Artificial Sequence: Synthetic oligonucleotide
cgacacccgagcacgtttctaggagca

SEQ ID NO: 357093 - DNA, 23 bp, Artificial Sequence
  Description of Artificial Sequence: Synthetic oligonucleotide
gcgtttcgacagcgacgccgcga

SEQ ID NO: 357094 - DNA, 27 bp, Artificial Sequence
  Description of Artificial Sequence: Synthetic oligonucleotide
gacacccgagcacgtttctaggagcag

SEQ ID NO: 357095 - DNA, 23 bp, Artificial Sequence
  Description of Artificial Sequence: Synthetic oligonucleotide
cgtttcgacagcgacgccgcgag

SEQ ID NO: 357096 - DNA, 28 bp, Artificial Sequence
  Description of Artificial Sequence: Synthetic oligonucleotide
acacccgagcacgtttctaggagcagtc

SEQ ID NO: 357097 - DNA, 23 bp, Artificial Sequence
  Description of Artificial Sequence: Synthetic oligonucleotide
gtttcgacagcgacgccgcgagc

SEQ ID NO: 357098 - DNA, 27 bp, Artificial Sequence
  Description of Artificial Sequence: Synthetic oligonucleotide
cacccgagcacgtttctaggagcagtc

SEQ ID NO: 357099 - DNA, 24 bp, Artificial Sequence
  Description of Artificial Sequence: Synthetic oligonucleotide
tttcgacagcgacgccgcgagcca

SEQ ID NO: 357100 - DNA, 30 bp, Artificial Sequence; identical to SEQ ID NO: 233156
  Description of Artificial Sequence: Synthetic oligonucleotide

SEQ ID NO: 357101 - DNA, 23 bp, Artificial Sequence
  Description of Artificial Sequence: Synthetic oligonucleotide
acctgcgctcttggaccgcggca

SEQ ID NO: 357102 - DNA, 29 bp, Artificial Sequence
  Description of Artificial Sequence: Synthetic oligonucleotide
cccgagcacgtttctaggagcagtcaaag

SEQ ID NO: 357103 - DNA, 22 bp, Artificial Sequence
  Description of Artificial Sequence: Synthetic oligonucleotide
cctgcgctcttggaccgcggca

SEQ ID NO: 357104 - DNA, 30 bp, Artificial Sequence; identical to SEQ ID NO: 233158
  Description of Artificial Sequence: Synthetic oligonucleotide

SEQ ID NO: 357105 - DNA, 23 bp, Artificial Sequence
  Description of Artificial Sequence: Synthetic oligonucleotide
ctgcgctcttggaccgcggcaga

SEQ ID NO: 357106 - DNA, 31 bp, Artificial Sequence; identical to SEQ ID NO: 233159
  Description of Artificial Sequence: Synthetic oligonucleotide

SEQ ID NO: 357107 - DNA, 25 bp, Artificial Sequence
  Description of Artificial Sequence: Synthetic oligonucleotide
tgcgctcttggaccgcggcagacat

SEQ ID NO: 357108 - DNA, 32 bp, Artificial Sequence; identical to SEQ ID NO: 233160
  Description of Artificial Sequence: Synthetic oligonucleotide

SEQ ID NO: 357109 - DNA, 24 bp, Artificial Sequence
  Description of Artificial Sequence: Synthetic oligonucleotide
gcgctcttggaccgcggcagacat

SEQ ID NO: 357110 - DNA, 33 bp, Artificial Sequence; identical to SEQ ID NO: 233161
  Description of Artificial Sequence: Synthetic oligonucleotide

SEQ ID NO: 357111 - DNA, 24 bp, Artificial Sequence
  Description of Artificial Sequence: Synthetic oligonucleotide
cgctcttggaccgcggcagacatg

SEQ ID NO: 357112 - DNA, 32 bp, Artificial Sequence; identical to SEQ ID NO: 233162
  Description of Artificial Sequence: Synthetic oligonucleotide

SEQ ID NO: 357113 - DNA, 24 bp, Artificial Sequence
  Description of Artificial Sequence: Synthetic oligonucleotide
gctcttggaccgcggcagacatgg

SEQ ID NO: 357114 - DNA, 33 bp, Artificial Sequence; identical to SEQ ID NO: 233163
  Description of Artificial Sequence: Synthetic oligonucleotide

SEQ ID NO: 357115 - DNA, 25 bp, Artificial Sequence
  Description of Artificial Sequence: Synthetic oligonucleotide
ctcttggaccgcggcagacatggca

SEQ ID NO: 357116 - DNA, 37 bp, Artificial Sequence; identical to SEQ ID NO: 233164
  Description of Artificial Sequence: Synthetic oligonucleotide

SEQ ID NO: 357117 - DNA, 25 bp, Artificial Sequence
  Description of Artificial Sequence: Synthetic oligonucleotide
tcttggaccgcggcagacatggcag

SEQ ID NO: 357118 - DNA, 36 bp, Artificial Sequence; identical to SEQ ID NO: 233165
  Description of Artificial Sequence: Synthetic oligonucleotide

SEQ ID NO: 357119 - DNA, 24 bp, Artificial Sequence
  Description of Artificial Sequence: Synthetic oligonucleotide
cttggaccgcggcagacatggcag

SEQ ID NO: 357120 - DNA, 38 bp, Artificial Sequence; identical to SEQ ID NO: 233166
  Description of Artificial Sequence: Synthetic oligonucleotide

SEQ ID NO: 357121 - DNA, 25 bp, Artificial Sequence
  Description of Artificial Sequence: Synthetic oligonucleotide
ttggaccgcggcagacatggcagct

SEQ ID NO: 357122 - DNA, 41 bp, Artificial Sequence; identical to SEQ ID NO: 233167
  Description of Artificial Sequence: Synthetic oligonucleotide

SEQ ID NO: 357123 - DNA, 24 bp, Artificial Sequence
  Description of Artificial Sequence: Synthetic oligonucleotide
tggaccgcggcagacatggcagct

SEQ ID NO: 357124 - DNA, 40 bp, Artificial Sequence; identical to SEQ ID NO: 233168
  Description of Artificial Sequence: Synthetic oligonucleotide

SEQ ID NO: 357125 - DNA, 23 bp, Artificial Sequence
  Description of Artificial Sequence: Synthetic oligonucleotide
ggaccgcggcagacatggcagct

SEQ ID NO: 357126 - DNA, 39 bp, Artificial Sequence; identical to SEQ ID NO: 233169
  Description of Artificial Sequence: Synthetic oligonucleotide

SEQ ID NO: 357127 - DNA, 24 bp, Artificial Sequence
  Description of Artificial Sequence: Synthetic oligonucleotide
gaccgcggcagacatggcagctca

SEQ ID NO: 357128 - DNA, 38 bp, Artificial Sequence; identical to SEQ ID NO: 233170
  Description of Artificial Sequence: Synthetic oligonucleotide

SEQ ID NO: 357129 - DNA, 26 bp, Artificial Sequence
  Description of Artificial Sequence: Synthetic oligonucleotide
accgcggcagacatggcagctcagat

SEQ ID NO: 357130 - DNA, 38 bp, Artificial Sequence; identical to SEQ ID NO: 233171
  Description of Artificial Sequence: Synthetic oligonucleotide

SEQ ID NO: 357131 - DNA, 25 bp, Artificial Sequence
  Description of Artificial Sequence: Synthetic oligonucleotide
ccgcggcagacatggcagctcagat

SEQ ID NO: 357132 - DNA, 37 bp, Artificial Sequence; identical to SEQ ID NO: 233172
  Description of Artificial Sequence: Synthetic oligonucleotide

SEQ ID NO: 357133 - DNA, 26 bp, Artificial Sequence
  Description of Artificial Sequence: Synthetic oligonucleotide
cgcggcagacatggcagctcagatca

SEQ ID NO: 357134 - DNA, 36 bp, Artificial Sequence; identical to SEQ ID NO: 233173
  Description of Artificial Sequence: Synthetic oligonucleotide

SEQ ID NO: 357135 - DNA, 26 bp, Artificial Sequence
  Description of Artificial Sequence: Synthetic oligonucleotide
gcggcagacatggcagctcagatcac

SEQ ID NO: 357136 - DNA, 36 bp, Artificial Sequence; identical to SEQ ID NO: 233174
  Description of Artificial Sequence: Synthetic oligonucleotide

SEQ ID NO: 357137 - DNA, 27 bp, Artificial Sequence
  Description of Artificial Sequence: Synthetic oligonucleotide
cggcagacatggcagctcagatcacca

SEQ ID NO: 357138 - DNA, 37 bp, Artificial Sequence; identical to SEQ ID NO: 233175
  Description of Artificial Sequence: Synthetic oligonucleotide

SEQ ID NO: 357139 - DNA, 28 bp, Artificial Sequence
  Description of Artificial Sequence: Synthetic oligonucleotide
ggcagacatggcagctcagatcaccaag

SEQ ID NO: 357140 - DNA, 36 bp, Artificial Sequence; identical to SEQ ID NO: 233176
  Description of Artificial Sequence: Synthetic oligonucleotide

SEQ ID NO: 357141 - DNA, 28 bp, Artificial Sequence
  Description of Artificial Sequence: Synthetic oligonucleotide
gcagacatggcagctcagatcaccaagc

SEQ ID NO: 357142 - DNA, 36 bp, Artificial Sequence; identical to SEQ ID NO: 233177
  Description of Artificial Sequence: Synthetic oligonucleotide

SEQ ID NO: 357143 - DNA, 28 bp, Artificial Sequence
  Description of Artificial Sequence: Synthetic oligonucleotide
cagacatggcagctcagatcaccaagcg

SEQ ID NO: 357144 - DNA, 36 bp, Artificial Sequence; identical to SEQ ID NO: 233178
  Description of Artificial Sequence: Synthetic oligonucleotide

SEQ ID NO: 357145 - DNA, 28 bp, Artificial Sequence
  Description of Artificial Sequence: Synthetic oligonucleotide
agacatggcagctcagatcaccaagcgc

SEQ ID NO: 357146 - DNA, 35 bp, Artificial Sequence; identical to SEQ ID NO: 233179
  Description of Artificial Sequence: Synthetic oligonucleotide

SEQ ID NO: 357147 - DNA, 23 bp, Artificial Sequence
  Description of Artificial Sequence: Synthetic oligonucleotide
tcttggaccgcggcggacatggc

SEQ ID NO: 357148 - DNA, 36 bp, Artificial Sequence; identical to SEQ ID NO: 233180
  Description of Artificial Sequence: Synthetic oligonucleotide

SEQ ID NO: 357149 - DNA, 22 bp, Artificial Sequence
  Description of Artificial Sequence: Synthetic oligonucleotide
cttggaccgcggcggacatggc

SEQ ID NO: 357150 - DNA, 35 bp, Artificial Sequence; identical to SEQ ID NO: 233181
  Description of Artificial Sequence: Synthetic oligonucleotide

SEQ ID NO: 357151 - DNA, 22 bp, Artificial Sequence
  Description of Artificial Sequence: Synthetic oligonucleotide
ttggaccgcggcggacatggcg

SEQ ID NO: 357152 - DNA, 35 bp, Artificial Sequence; identical to SEQ ID NO: 233182
  Description of Artificial Sequence: Synthetic oligonucleotide

SEQ ID NO: 357153 - DNA, 21 bp, Artificial Sequence
  Description of Artificial Sequence: Synthetic oligonucleotide
tggaccgcggcggacatggcg

SEQ ID NO: 357154 - DNA, 34 bp, Artificial Sequence; identical to SEQ ID NO: 233183
  Description of Artificial Sequence: Synthetic oligonucleotide

SEQ ID NO: 357155 - DNA, 20 bp, Artificial Sequence
  Description of Artificial Sequence: Synthetic oligonucleotide
ggaccgcggcggacatggcg

SEQ ID NO: 357156 - DNA, 33 bp, Artificial Sequence; identical to SEQ ID NO: 233184
  Description of Artificial Sequence: Synthetic oligonucleotide

SEQ ID NO: 357157 - DNA, 20 bp, Artificial Sequence
  Description of Artificial Sequence: Synthetic oligonucleotide
gaccgcggcggacatggcgg

SEQ ID NO: 357158 - DNA, 32 bp, Artificial Sequence; identical to SEQ ID NO: 233185
  Description of Artificial Sequence: Synthetic oligonucleotide

SEQ ID NO: 357159 - DNA, 21 bp, Artificial Sequence
  Description of Artificial Sequence: Synthetic oligonucleotide
accgcggcggacatggcggct

SEQ ID NO: 357160 - DNA, 32 bp, Artificial Sequence; identical to SEQ ID NO: 233186
  Description of Artificial Sequence: Synthetic oligonucleotide

SEQ ID NO: 357161 - DNA, 20 bp, Artificial Sequence
  Description of Artificial Sequence: Synthetic oligonucleotide
ccgcggcggacatggcggct

SEQ ID NO: 357162 - DNA, 31 bp, Artificial Sequence; identical to SEQ ID NO: 233187
  Description of Artificial Sequence: Synthetic oligonucleotide

SEQ ID NO: 357163 - DNA, 21 bp, Artificial Sequence
  Description of Artificial Sequence: Synthetic oligonucleotide
cgcggcggacatggcggctca

SEQ ID NO: 357164 - DNA, 31 bp, Artificial Sequence; identical to SEQ ID NO: 233188
  Description of Artificial Sequence: Synthetic oligonucleotide

SEQ ID NO: 357165 - DNA, 23 bp, Artificial Sequence
  Description of Artificial Sequence: Synthetic oligonucleotide
gcggcggacatggcggctcagat

SEQ ID NO: 357166 - DNA, 30 bp, Artificial Sequence; identical to SEQ ID NO: 233189
  Description of Artificial Sequence: Synthetic oligonucleotide

SEQ ID NO: 357167 - DNA, 24 bp, Artificial Sequence
  Description of Artificial Sequence: Synthetic oligonucleotide
cggcggacatggcggctcagatca

SEQ ID NO: 357168 - DNA, 30 bp, Artificial Sequence; identical to SEQ ID NO: 233190
  Description of Artificial Sequence: Synthetic oligonucleotide

SEQ ID NO: 357169 - DNA, 24 bp, Artificial Sequence
  Description of Artificial Sequence: Synthetic oligonucleotide
ggcggacatggcggctcagatcac

SEQ ID NO: 357170 - DNA, 29 bp, Artificial Sequence
  Description of Artificial Sequence: Synthetic oligonucleotide
gagtcatttctacaatgggaccgagcggg

SEQ ID NO: 357171 - DNA, 26 bp, Artificial Sequence
  Description of Artificial Sequence: Synthetic oligonucleotide
gcggacatggcggctcagatcaccaa

SEQ ID NO: 357172 - DNA, 30 bp, Artificial Sequence; identical to SEQ ID NO: 233192
  Description of Artificial Sequence: Synthetic oligonucleotide

SEQ ID NO: 357173 - DNA, 26 bp, Artificial Sequence
  Description of Artificial Sequence: Synthetic oligonucleotide
cggacatggcggctcagatcaccaag

SEQ ID NO: 357174 - DNA, 29 bp, Artificial Sequence
  Description of Artificial Sequence: Synthetic oligonucleotide
gtcatttctacaatgggaccgagcgggtc

SEQ ID NO: 357175 - DNA, 26 bp, Artificial Sequence
  Description of Artificial Sequence: Synthetic oligonucleotide
ggacatggcggctcagatcaccaagc

SEQ ID NO: 357176 - DNA, 29 bp, Artificial Sequence
  Description of Artificial Sequence: Synthetic oligonucleotide
tcatttctacaatgggaccgagcgggtcc

SEQ ID NO: 357177 - DNA, 26 bp, Artificial Sequence
  Description of Artificial Sequence: Synthetic oligonucleotide
gacatggcggctcagatcaccaagcg

SEQ ID NO: 357178 - DNA, 28 bp, Artificial Sequence
  Description of Artificial Sequence: Synthetic oligonucleotide
catttctacaatgggaccgagcgggtcc

SEQ ID NO: 357179 - DNA, 27 bp, Artificial Sequence
  Description of Artificial Sequence: Synthetic oligonucleotide
acatggcggctcagatcaccaagcgca

SEQ ID NO: 357180 - DNA, 28 bp, Artificial Sequence
  Description of Artificial Sequence: Synthetic oligonucleotide
atttctacaatgggaccgagcgggtccg

SEQ ID NO: 357181 - DNA, 27 bp, Artificial Sequence
  Description of Artificial Sequence: Synthetic oligonucleotide
catggcggctcagatcaccaagcgcaa

SEQ ID NO: 357182 - DNA, 27 bp, Artificial Sequence
  Description of Artificial Sequence: Synthetic oligonucleotide
tttctacaatgggaccgagcgggtccg

SEQ ID NO: 357183 - DNA, 27 bp, Artificial Sequence
  Description of Artificial Sequence: Synthetic oligonucleotide
atggcggctcagatcaccaagcgcaag

SEQ ID NO: 357184 - DNA, 26 bp, Artificial Sequence
  Description of Artificial Sequence: Synthetic oligonucleotide
ttctacaatgggaccgagcgggtccg

SEQ ID NO: 357185 - DNA, 27 bp, Artificial Sequence
  Description of Artificial Sequence: Synthetic oligonucleotide
tggcggctcagatcaccaagcgcaagt

SEQ ID NO: 357186 - DNA, 25 bp, Artificial Sequence
  Description of Artificial Sequence: Synthetic oligonucleotide
tctacaatgggaccgagcgggtccg

SEQ ID NO: 357187 - DNA, 26 bp, Artificial Sequence
  Description of Artificial Sequence: Synthetic oligonucleotide
ggcggctcagatcaccaagcgcaagt

SEQ ID NO: 357188 - DNA, 24 bp, Artificial Sequence
  Description of Artificial Sequence: Synthetic oligonucleotide
ctacaatgggaccgagcgggtccg

SEQ ID NO: 357189 - DNA, 26 bp, Artificial Sequence
  Description of Artificial Sequence: Synthetic oligonucleotide
gcggctcagatcaccaagcgcaagtg

SEQ ID NO: 357190 - DNA, 26 bp, Artificial Sequence
  Description of Artificial Sequence: Synthetic oligonucleotide
tacaatgggaccgagcgggtccggtt

SEQ ID NO: 357191 - DNA, 26 bp, Artificial Sequence
  Description of Artificial Sequence: Synthetic oligonucleotide
cggctcagatcaccaagcgcaagtgg

SEQ ID NO: 357192 - DNA, 25 bp, Artificial Sequence
  Description of Artificial Sequence: Synthetic oligonucleotide
acaatgggaccgagcgggtccggtt

SEQ ID NO: 357193 - DNA, 27 bp, Artificial Sequence
  Description of Artificial Sequence: Synthetic oligonucleotide
ggctcagatcaccaagcgcaagtggga

SEQ ID NO: 357194 - DNA, 24 bp, Artificial Sequence
  Description of Artificial Sequence: Synthetic oligonucleotide
caatgggaccgagcgggtccggtt

SEQ ID NO: 357195 - DNA, 23 bp, Artificial Sequence
  Description of Artificial Sequence: Synthetic oligonucleotide
gccctgaacgaggacctgcgctc

SEQ ID NO: 357196 - DNA, 24 bp, Artificial Sequence
  Description of Artificial Sequence: Synthetic oligonucleotide
aatgggaccgagcgggtccggttc

SEQ ID NO: 357197 - DNA, 24 bp, Artificial Sequence
  Description of Artificial Sequence: Synthetic oligonucleotide
ccctgaacgaggacctgcgctcct

SEQ ID NO: 357198 - DNA, 23 bp, Artificial Sequence
  Description of Artificial Sequence: Synthetic oligonucleotide
atgggaccgagcgggtccggttc

SEQ ID NO: 357199 - DNA, 24 bp, Artificial Sequence
  Description of Artificial Sequence: Synthetic oligonucleotide
cctgaacgaggacctgcgctcctg

SEQ ID NO: 357200 - DNA, 22 bp, Artificial Sequence
  Description of Artificial Sequence: Synthetic oligonucleotide
tgggaccgagcgggtccggttc

SEQ ID NO: 357201 - DNA, 25 bp, Artificial Sequence
  Description of Artificial Sequence: Synthetic oligonucleotide
ctgaacgaggacctgcgctcctgga

SEQ ID NO: 357202 - DNA, 21 bp, Artificial Sequence
  Description of Artificial Sequence: Synthetic oligonucleotide
gggaccgagcgggtccggttc

SEQ ID NO: 357203 - DNA, 25 bp, Artificial Sequence
  Description of Artificial Sequence: Synthetic oligonucleotide
tgaacgaggacctgcgctcctggac

SEQ ID NO: 357204 - DNA, 22 bp, Artificial Sequence
  Description of Artificial Sequence: Synthetic oligonucleotide
ggaccgagcgggtccggttcct

SEQ ID NO: 357205 - DNA, 24 bp, Artificial Sequence
  Description of Artificial Sequence: Synthetic oligonucleotide
gaacgaggacctgcgctcctggac

SEQ ID NO: 357206 - DNA, 22 bp, Artificial Sequence
  Description of Artificial Sequence: Synthetic oligonucleotide
gaccgagcgggtccggttcctc

SEQ ID NO: 357207 - DNA, 24 bp, Artificial Sequence
  Description of Artificial Sequence: Synthetic oligonucleotide
aacgaggacctgcgctcctggacc

SEQ ID NO: 357208 - DNA, 23 bp, Artificial Sequence
  Description of Artificial Sequence: Synthetic oligonucleotide
accgagcgggtccggttcctcga

SEQ ID NO: 357209 - DNA, 23 bp, Artificial Sequence
  Description of Artificial Sequence: Synthetic oligonucleotide
acgaggacctgcgctcctggacc

SEQ ID NO: 357210 - DNA, 22 bp, Artificial Sequence
  Description of Artificial Sequence: Synthetic oligonucleotide
ccgagcgggtccggttcctcga

SEQ ID NO: 357211 - DNA, 22 bp, Artificial Sequence
  Description of Artificial Sequence: Synthetic oligonucleotide
cgaggacctgcgctcctggacc

SEQ ID NO: 357212 - DNA, 23 bp, Artificial Sequence
  Description of Artificial Sequence: Synthetic oligonucleotide
cgagcgggtccggttcctcgaca

SEQ ID NO: 357213 - DNA, 22 bp, Artificial Sequence
  Description of Artificial Sequence: Synthetic oligonucleotide
gaggacctgcgctcctggaccg

SEQ ID NO: 357214 - DNA, 26 bp, Artificial Sequence
  Description of Artificial Sequence: Synthetic oligonucleotide
gagcgggtccggttcctcgacagata

SEQ ID NO: 357215 - DNA, 22 bp, Artificial Sequence
  Description of Artificial Sequence: Synthetic oligonucleotide
aggacctgcgctcctggaccgc

SEQ ID NO: 357216 - DNA, 27 bp, Artificial Sequence
  Description of Artificial Sequence: Synthetic oligonucleotide
agcgggtccggttcctcgacagatact

SEQ ID NO: 357217 - DNA, 21 bp, Artificial Sequence
  Description of Artificial Sequence: Synthetic oligonucleotide
ggacctgcgctcctggaccgc

SEQ ID NO: 357218 - DNA, 27 bp, Artificial Sequence
  Description of Artificial Sequence: Synthetic oligonucleotide
gcgggtccggttcctcgacagatactt

SEQ ID NO: 357219 - DNA, 21 bp, Artificial Sequence
  Description of Artificial Sequence: Synthetic oligonucleotide
gacctgcgctcctggaccgcg

SEQ ID NO: 357220 - DNA, 27 bp, Artificial Sequence
  Description of Artificial Sequence: Synthetic oligonucleotide
cgggtccggttcctcgacagatacttg

SEQ ID NO: 357221 - DNA, 21 bp, Artificial Sequence
  Description of Artificial Sequence: Synthetic oligonucleotide
acctgcgctcctggaccgcgg

SEQ ID NO: 357222 - DNA, 29 bp, Artificial Sequence
  Description of Artificial Sequence: Synthetic oligonucleotide
gggtccggttcctcgacagatacttgatg

SEQ ID NO: 357223 - DNA, 20 bp, Artificial Sequence
  Description of Artificial Sequence: Synthetic oligonucleotide
cctgcgctcctggaccgcgg

SEQ ID NO: 357224 - DNA, 29 bp, Artificial Sequence
  Description of Artificial Sequence: Synthetic oligonucleotide
ggtccggttcctcgacagatacttgatgc

SEQ ID NO: 357225 - DNA, 20 bp, Artificial Sequence
  Description of Artificial Sequence: Synthetic oligonucleotide
ctgcgctcctggaccgcggc

SEQ ID NO: 357226 - DNA, 29 bp, Artificial Sequence
  Description of Artificial Sequence: Synthetic oligonucleotide
gtccggttcctcgacagatacttgatgcg

SEQ ID NO: 357227 - DNA, 20 bp, Artificial Sequence
  Description of Artificial Sequence: Synthetic oligonucleotide
tgcgctcctggaccgcggcg

SEQ ID NO: 357228 - DNA, 29 bp, Artificial Sequence
  Description of Artificial Sequence: Synthetic oligonucleotide
tccggttcctcgacagatacttgatgcgg

SEQ ID NO: 357229 - DNA, 20 bp, Artificial Sequence
  Description of Artificial Sequence: Synthetic oligonucleotide
gcgctcctggaccgcggcgt

SEQ ID NO: 357230 - DNA, 28 bp, Artificial Sequence
  Description of Artificial Sequence: Synthetic oligonucleotide
ccggttcctcgacagatacttgatgcgg

SEQ ID NO: 357231 - DNA, 20 bp, Artificial Sequence
  Description of Artificial Sequence: Synthetic oligonucleotide
cgctcctggaccgcggcgga

SEQ ID NO: 357232 - DNA, 28 bp, Artificial Sequence
  Description of Artificial Sequence: Synthetic oligonucleotide
cggttcctcgacagatacttgatgcggg

SEQ ID NO: 357233 - DNA, 22 bp, Artificial Sequence
  Description of Artificial Sequence: Synthetic oligonucleotide
gctcctggaccgcggcggacat

SEQ ID NO: 357234 - DNA, 29 bp, Artificial Sequence
  Description of Artificial Sequence: Synthetic oligonucleotide
ggttcctcgacagatacttgatgcgggtc

SEQ ID NO: 357235 - DNA, 22 bp, Artificial Sequence
  Description of Artificial Sequence: Synthetic oligonucleotide
ctcctggaccgcggcggacatg

SEQ ID NO: 357236 - DNA, 31 bp, Artificial Sequence; identical to SEQ ID NO: 233224
  Description of Artificial Sequence: Synthetic oligonucleotide

SEQ ID NO: 357237 - DNA, 22 bp, Artificial Sequence
  Description of Artificial Sequence: Synthetic oligonucleotide
tcctggaccgcggcggacatgg

SEQ ID NO: 357238 - DNA, 31 bp, Artificial Sequence; identical to SEQ ID NO: 233225
  Description of Artificial Sequence: Synthetic oligonucleotide

SEQ ID NO: 357239 - DNA, 21 bp, Artificial Sequence
  Description of Artificial Sequence: Synthetic oligonucleotide
cctggaccgcggcggacatgg

SEQ ID NO: 357240 - DNA, 30 bp, Artificial Sequence; identical to SEQ ID NO: 233226
  Description of Artificial Sequence: Synthetic oligonucleotide

SEQ ID NO: 357241 - DNA, 22 bp, Artificial Sequence
  Description of Artificial Sequence: Synthetic oligonucleotide
ctggaccgcggcggacatggca

SEQ ID NO: 357242 - DNA, 29 bp, Artificial Sequence
  Description of Artificial Sequence: Synthetic oligonucleotide
cctcgacagatacttgatgcgggtcatcg

SEQ ID NO: 357243 - DNA, 29 bp, Artificial Sequence
  Description of Artificial Sequence: Synthetic oligonucleotide
ggaccaggagacacggaatatgaaggctc

SEQ ID NO: 357244 - DNA, 29 bp, Artificial Sequence
  Description of Artificial Sequence: Synthetic oligonucleotide
ctcgacagatacttgatgcgggtcatcgc

SEQ ID NO: 357245 - DNA, 30 bp, Artificial Sequence
  Description of Artificial Sequence: Synthetic oligonucleotide
gaccaggagacacggaatatgaaggctcac

SEQ ID NO: 357246 - DNA, 29 bp, Artificial Sequence
  Description of Artificial Sequence: Synthetic oligonucleotide
tcgacagatacttgatgcgggtcatcgcg

SEQ ID NO: 357247 - DNA, 31 bp, Artificial Sequence
  Description of Artificial Sequence: Synthetic oligonucleotide
accaggagacacggaatatgaaggctcactc

SEQ ID NO: 357248 - DNA, 28 bp, Artificial Sequence
  Description of Artificial Sequence: Synthetic oligonucleotide
cgacagatacttgatgcgggtcatcgcg

SEQ ID NO: 357249 - DNA, 30 bp, Artificial Sequence
  Description of Artificial Sequence: Synthetic oligonucleotide
ccaggagacacggaatatgaaggctcactc

SEQ ID NO: 357250 - DNA, 28 bp, Artificial Sequence
  Description of Artificial Sequence: Synthetic oligonucleotide
gacagatacttgatgcgggtcatcgcgc

SEQ ID NO: 357251 - DNA, 31 bp, Artificial Sequence
  Description of Artificial Sequence: Synthetic oligonucleotide
caggagacacggaatatgaaggctcactcac

SEQ ID NO: 357252 - DNA, 28 bp, Artificial Sequence
  Description of Artificial Sequence: Synthetic oligonucleotide
acagatacttgatgcgggtcatcgcgcc

SEQ ID NO: 357253 - DNA, 32 bp, Artificial Sequence
  Description of Artificial Sequence: Synthetic oligonucleotide
aggagacacggaatatgaaggctcactcacag

SEQ ID NO: 357254 - DNA, 27 bp, Artificial Sequence
  Description of Artificial Sequence: Synthetic oligonucleotide
cagatacttgatgcgggtcatcgcgcc

SEQ ID NO: 357255 - DNA, 31 bp, Artificial Sequence
  Description of Artificial Sequence: Synthetic oligonucleotide
ggagacacggaatatgaaggctcactcacag

SEQ ID NO: 357256 - DNA, 27 bp, Artificial Sequence
  Description of Artificial Sequence: Synthetic oligonucleotide
agatacttgatgcgggtcatcgcgccc

SEQ ID NO: 357257 - DNA, 32 bp, Artificial Sequence
  Description of Artificial Sequence: Synthetic oligonucleotide
gagacacggaatatgaaggctcactcacagac

SEQ ID NO: 357258 - DNA, 26 bp, Artificial Sequence
  Description of Artificial Sequence: Synthetic oligonucleotide
gatacttgatgcgggtcatcgcgccc

SEQ ID NO: 357259 - DNA, 33 bp, Artificial Sequence
  Description of Artificial Sequence: Synthetic oligonucleotide
agacacggaatatgaaggctcactcacagactg

SEQ ID NO: 357260 - DNA, 26 bp, Artificial Sequence
  Description of Artificial Sequence: Synthetic oligonucleotide
atacttgatgcgggtcatcgcgcccc

SEQ ID NO: 357261 - DNA, 32 bp, Artificial Sequence
  Description of Artificial Sequence: Synthetic oligonucleotide
gacacggaatatgaaggctcactcacagactg

SEQ ID NO: 357262 - DNA, 25 bp, Artificial Sequence
  Description of Artificial Sequence: Synthetic oligonucleotide
tacttgatgcgggtcatcgcgcccc

SEQ ID NO: 357263 - DNA, 33 bp, Artificial Sequence
  Description of Artificial Sequence: Synthetic oligonucleotide
acacggaatatgaaggctcactcacagactgac

SEQ ID NO: 357264 - DNA, 24 bp, Artificial Sequence
  Description of Artificial Sequence: Synthetic oligonucleotide
acttgatgcgggtcatcgcgcccc

SEQ ID NO: 357265 - DNA, 32 bp, Artificial Sequence
  Description of Artificial Sequence: Synthetic oligonucleotide
cacggaatatgaaggctcactcacagactgac

SEQ ID NO: 357266 - DNA, 23 bp, Artificial Sequence
  Description of Artificial Sequence: Synthetic oligonucleotide
cttgatgcgggtcatcgcgcccc

SEQ ID NO: 357267 - DNA, 32 bp, Artificial Sequence
  Description of Artificial Sequence: Synthetic oligonucleotide
acggaatatgaaggctcactcacagactgacc

SEQ ID NO: 357268 - DNA, 25 bp, Artificial Sequence
  Description of Artificial Sequence: Synthetic oligonucleotide
ttgatgcgggtcatcgcgcccccaa

SEQ ID NO: 357269 - DNA, 31 bp, Artificial Sequence
  Description of Artificial Sequence: Synthetic oligonucleotide
cggaatatgaaggctcactcacagactgacc

SEQ ID NO: 357270 - DNA, 24 bp, Artificial Sequence
  Description of Artificial Sequence: Synthetic oligonucleotide
tgatgcgggtcatcgcgcccccaa

SEQ ID NO: 357271 - DNA, 31 bp, Artificial Sequence
  Description of Artificial Sequence: Synthetic oligonucleotide
ggaatatgaaggctcactcacagactgaccg

SEQ ID NO: 357272 - DNA, 23 bp, Artificial Sequence
  Description of Artificial Sequence: Synthetic oligonucleotide
gatgcgggtcatcgcgcccccaa

SEQ ID NO: 357273 - DNA, 32 bp, Artificial Sequence
  Description of Artificial Sequence: Synthetic oligonucleotide
gaatatgaaggctcactcacagactgaccgag

SEQ ID NO: 357274 - DNA, 20 bp, Artificial Sequence
  Description of Artificial Sequence: Synthetic oligonucleotide
gggcccaggccctgacggag

SEQ ID NO: 357275 - DNA, 32 bp, Artificial Sequence
  Description of Artificial Sequence: Synthetic oligonucleotide
aatatgaaggctcactcacagactgaccgagc

SEQ ID NO: 357276 - DNA, 21 bp, Artificial Sequence
  Description of Artificial Sequence: Synthetic oligonucleotide
ggcccaggccctgacggagct

SEQ ID NO: 357277 - DNA, 31 bp, Artificial Sequence
  Description of Artificial Sequence: Synthetic oligonucleotide
atatgaaggctcactcacagactgaccgagc

SEQ ID NO: 357278 - DNA, 21 bp, Artificial Sequence
  Description of Artificial Sequence: Synthetic oligonucleotide
gcccaggccctgacggagctg

SEQ ID NO: 357279 - DNA, 30 bp, Artificial Sequence
  Description of Artificial Sequence: Synthetic oligonucleotide
tatgaaggctcactcacagactgaccgagc

SEQ ID NO: 357280 - DNA, 21 bp, Artificial Sequence
  Description of Artificial Sequence: Synthetic oligonucleotide
cccaggccctgacggagctgg

SEQ ID NO: 357281 - DNA, 29 bp, Artificial Sequence
  Description of Artificial Sequence: Synthetic oligonucleotide
atgaaggctcactcacagactgaccgagc

SEQ ID NO: 357282 - DNA, 21 bp, Artificial Sequence
  Description of Artificial Sequence: Synthetic oligonucleotide
ccaggccctgacggagctggg

SEQ ID NO: 357283 - DNA, 28 bp, Artificial Sequence
  Description of Artificial Sequence: Synthetic oligonucleotide
tgaaggctcactcacagactgaccgagc

SEQ ID NO: 357284 - DNA, 21 bp, Artificial Sequence
  Description of Artificial Sequence: Synthetic oligonucleotide
caggccctgacggagctgggg

SEQ ID NO: 357285 - DNA, 27 bp, Artificial Sequence
  Description of Artificial Sequence: Synthetic oligonucleotide
gaaggctcactcacagactgaccgagc

SEQ ID NO: 357286 - DNA, 21 bp, Artificial Sequence
  Description of Artificial Sequence: Synthetic oligonucleotide
aggccctgacggagctggggg

SEQ ID NO: 357287 - DNA, 27 bp, Artificial Sequence
  Description of Artificial Sequence: Synthetic oligonucleotide
aaggctcactcacagactgaccgagcg

SEQ ID NO: 357288 - DNA, 20 bp, Artificial Sequence
  Description of Artificial Sequence: Synthetic oligonucleotide
ggccctgacggagctggggg

SEQ ID NO: 357289 - DNA, 27 bp, Artificial Sequence
  Description of Artificial Sequence: Synthetic oligonucleotide
aggctcactcacagactgaccgagcga

SEQ ID NO: 357290 - DNA, 20 bp, Artificial Sequence
  Description of Artificial Sequence: Synthetic oligonucleotide
gccctgacggagctgggggg

SEQ ID NO: 357291 - DNA, 27 bp, Artificial Sequence
  Description of Artificial Sequence: Synthetic oligonucleotide
ggctcactcacagactgaccgagcgaa

SEQ ID NO: 357292 - DNA, 20 bp, Artificial Sequence
  Description of Artificial Sequence: Synthetic oligonucleotide
ccctgacggagctggggggg

SEQ ID NO: 357293 - DNA, 27 bp, Artificial Sequence
  Description of Artificial Sequence: Synthetic oligonucleotide
gctcactcacagactgaccgagcgaac

SEQ ID NO: 357294 - DNA, 20 bp, Artificial Sequence
  Description of Artificial Sequence: Synthetic oligonucleotide
cctgacggagctgggggggc

SEQ ID NO: 357295 - DNA, 27 bp, Artificial Sequence
  Description of Artificial Sequence: Synthetic oligonucleotide
ctcactcacagactgaccgagcgaacc

SEQ ID NO: 357296 - DNA, 21 bp, Artificial Sequence
  Description of Artificial Sequence: Synthetic oligonucleotide
ctgacggagctgggggggcct

SEQ ID NO: 357297 - DNA, 28 bp, Artificial Sequence
  Description of Artificial Sequence: Synthetic oligonucleotide
tcactcacagactgaccgagcgaacctg

SEQ ID NO: 357298 - DNA, 23 bp, Artificial Sequence
  Description of Artificial Sequence: Synthetic oligonucleotide
tgacggagctgggggggcctgat

SEQ ID NO: 357299 - DNA, 33 bp, Artificial Sequence
  Description of Artificial Sequence: Synthetic oligonucleotide
gctcccattccatgaggtatttcttcacatccg

SEQ ID NO: 357300 - DNA, 22 bp, Artificial Sequence
  Description of Artificial Sequence: Synthetic oligonucleotide
gacggagctgggggggcctgat

SEQ ID NO: 357301 - DNA, 34 bp, Artificial Sequence
  Description of Artificial Sequence: Synthetic oligonucleotide
ctcccattccatgaggtatttcttcacatccgtg

SEQ ID NO: 357302 - DNA, 22 bp, Artificial Sequence
  Description of Artificial Sequence: Synthetic oligonucleotide
acggagctgggggggcctgatg

SEQ ID NO: 357303 - DNA, 35 bp, Artificial Sequence
  Description of Artificial Sequence: Synthetic oligonucleotide
tcccattccatgaggtatttcttcacatccgtgtc

SEQ ID NO: 357304 - DNA, 21 bp, Artificial Sequence
  Description of Artificial Sequence: Synthetic oligonucleotide
cggagctgggggggcctgatg

SEQ ID NO: 357305 - DNA, 34 bp, Artificial Sequence
  Description of Artificial Sequence: Synthetic oligonucleotide
cccattccatgaggtatttcttcacatccgtgtc

SEQ ID NO: 357306 - DNA, 21 bp, Artificial Sequence
  Description of Artificial Sequence: Synthetic oligonucleotide
ggagctgggggggcctgatgg

SEQ ID NO: 357307 - DNA, 34 bp, Artificial Sequence
  Description of Artificial Sequence: Synthetic oligonucleotide
ccattccatgaggtatttcttcacatccgtgtcc

SEQ ID NO: 357308 - DNA, 21 bp, Artificial Sequence
  Description of Artificial Sequence: Synthetic oligonucleotide
gagctgggggggcctgatggc

SEQ ID NO: 357309 - DNA, 34 bp, Artificial Sequence; identical to SEQ ID NO: 4518
  Description of Artificial Sequence: Synthetic oligonucleotide

SEQ ID NO: 357310 - DNA, 22 bp, Artificial Sequence
  Description of Artificial Sequence: Synthetic oligonucleotide
agctgggggggcctgatggcga

SEQ ID NO: 357311 - DNA, 34 bp, Artificial Sequence; identical to SEQ ID NO: 4519
  Description of Artificial Sequence: Synthetic oligonucleotide

SEQ ID NO: 357312 - DNA, 21 bp, Artificial Sequence
  Description of Artificial Sequence: Synthetic oligonucleotide
gctgggggggcctgatggcga

SEQ ID NO: 357313 - DNA, 33 bp, Artificial Sequence; identical to SEQ ID NO: 4520
  Description of Artificial Sequence: Synthetic oligonucleotide

SEQ ID NO: 357314 - DNA, 23 bp, Artificial Sequence
  Description of Artificial Sequence: Synthetic oligonucleotide
ctgggggggcctgatggcgagta

SEQ ID NO: 357315 - DNA, 27 bp, Artificial Sequence
  Description of Artificial Sequence: Synthetic oligonucleotide
cagatcaccaagcgcaagtgggaggct

SEQ ID NO: 357316 - DNA, 24 bp, Artificial Sequence
  Description of Artificial Sequence: Synthetic oligonucleotide
tgggggggcctgatggcgagtact

SEQ ID NO: 357317 - DNA, 27 bp, Artificial Sequence
  Description of Artificial Sequence: Synthetic oligonucleotide
agatcaccaagcgcaagtgggaggctg

SEQ ID NO: 357318 - DNA, 23 bp, Artificial Sequence
  Description of Artificial Sequence: Synthetic oligonucleotide
gggggggcctgatggcgagtact

SEQ ID NO: 357319 - DNA, 27 bp, Artificial Sequence
  Description of Artificial Sequence: Synthetic oligonucleotide
gatcaccaagcgcaagtgggaggctgt

SEQ ID NO: 357320 - DNA, 23 bp, Artificial Sequence
  Description of Artificial Sequence: Synthetic oligonucleotide
ggggggcctgatggcgagtactg

SEQ ID NO: 357321 - DNA, 27 bp, Artificial Sequence
  Description of Artificial Sequence: Synthetic oligonucleotide
atcaccaagcgcaagtgggaggctgtc

SEQ ID NO: 357322 - DNA, 25 bp, Artificial Sequence
  Description of Artificial Sequence: Synthetic oligonucleotide
gggggcctgatggcgagtactgcaa

SEQ ID NO: 357323 - DNA, 26 bp, Artificial Sequence
  Description of Artificial Sequence: Synthetic oligonucleotide
tcaccaagcgcaagtgggaggctgtc

SEQ ID NO: 357324 - DNA, 26 bp, Artificial Sequence
  Description of Artificial Sequence: Synthetic oligonucleotide
ggggcctgatggcgagtactgcaaca

SEQ ID NO: 357325 - DNA, 25 bp, Artificial Sequence
  Description of Artificial Sequence: Synthetic oligonucleotide
caccaagcgcaagtgggaggctgtc

SEQ ID NO: 357326 - DNA, 26 bp, Artificial Sequence
  Description of Artificial Sequence: Synthetic oligonucleotide
gggcctgatggcgagtactgcaacag

SEQ ID NO: 357327 - DNA, 27 bp, Artificial Sequence
  Description of Artificial Sequence: Synthetic oligonucleotide
accaagcgcaagtgggaggctgtccat

SEQ ID NO: 357328 - DNA, 26 bp, Artificial Sequence
  Description of Artificial Sequence: Synthetic oligonucleotide
ggcctgatggcgagtactgcaacagc

SEQ ID NO: 357329 - DNA, 26 bp, Artificial Sequence
  Description of Artificial Sequence: Synthetic oligonucleotide
ccaagcgcaagtgggaggctgtccat

SEQ ID NO: 357330 - DNA, 27 bp, Artificial Sequence
  Description of Artificial Sequence: Synthetic oligonucleotide
gcctgatggcgagtactgcaacagcca

SEQ ID NO: 357331 - DNA, 26 bp, Artificial Sequence
  Description of Artificial Sequence: Synthetic oligonucleotide
caagcgcaagtgggaggctgtccatg

SEQ ID NO: 357332 - DNA, 27 bp, Artificial Sequence
  Description of Artificial Sequence: Synthetic oligonucleotide
cctgatggcgagtactgcaacagccag

SEQ ID NO: 357333 - DNA, 26 bp, Artificial Sequence
  Description of Artificial Sequence: Synthetic oligonucleotide
aagcgcaagtgggaggctgtccatgc

SEQ ID NO: 357334 - DNA, 29 bp, Artificial Sequence
  Description of Artificial Sequence: Synthetic oligonucleotide
ctgatggcgagtactgcaacagccagtag

SEQ ID NO: 357335 - DNA, 25 bp, Artificial Sequence
  Description of Artificial Sequence: Synthetic oligonucleotide
agcgcaagtgggaggctgtccatgc

SEQ ID NO: 357336 - DNA, 29 bp, Artificial Sequence
  Description of Artificial Sequence: Synthetic oligonucleotide
tgatggcgagtactgcaacagccagtagg

SEQ ID NO: 357337 - DNA, 24 bp, Artificial Sequence
  Description of Artificial Sequence: Synthetic oligonucleotide
gcgcaagtgggaggctgtccatgc

SEQ ID NO: 357338 - DNA, 28 bp, Artificial Sequence
  Description of Artificial Sequence: Synthetic oligonucleotide
gatggcgagtactgcaacagccagtagg

SEQ ID NO: 357339 - DNA, 24 bp, Artificial Sequence
  Description of Artificial Sequence: Synthetic oligonucleotide
cgcaagtgggaggctgtccatgcg

SEQ ID NO: 357340 - DNA, 29 bp, Artificial Sequence
  Description of Artificial Sequence: Synthetic oligonucleotide
atggcgagtactgcaacagccagtaggac

SEQ ID NO: 357341 - DNA, 24 bp, Artificial Sequence
  Description of Artificial Sequence: Synthetic oligonucleotide
gcaagtgggaggctgtccatgcgg

SEQ ID NO: 357342 - DNA, 28 bp, Artificial Sequence
  Description of Artificial Sequence: Synthetic oligonucleotide
tggcgagtactgcaacagccagtaggac

SEQ ID NO: 357343 - DNA, 24 bp, Artificial Sequence
  Description of Artificial Sequence: Synthetic oligonucleotide
caagtgggaggctgtccatgcggc

SEQ ID NO: 357344 - DNA, 27 bp, Artificial Sequence
  Description of Artificial Sequence: Synthetic oligonucleotide
ggcgagtactgcaacagccagtaggac

SEQ ID NO: 357345 - DNA, 24 bp, Artificial Sequence
  Description of Artificial Sequence: Synthetic oligonucleotide
aagtgggaggctgtccatgcggcg

SEQ ID NO: 357346 - DNA, 27 bp, Artificial Sequence
  Description of Artificial Sequence: Synthetic oligonucleotide
gcgagtactgcaacagccagtaggacc

SEQ ID NO: 357347 - DNA, 23 bp, Artificial Sequence
  Description of Artificial Sequence: Synthetic oligonucleotide
agtgggaggctgtccatgcggcg

SEQ ID NO: 357348 - DNA, 28 bp, Artificial Sequence
  Description of Artificial Sequence: Synthetic oligonucleotide
cgagtactgcaacagccagtaggacctc

SEQ ID NO: 357349 - DNA, 22 bp, Artificial Sequence
  Description of Artificial Sequence: Synthetic oligonucleotide
gtgggaggctgtccatgcggcg

SEQ ID NO: 357350 - DNA, 28 bp, Artificial Sequence
  Description of Artificial Sequence: Synthetic oligonucleotide
gagtactgcaacagccagtaggacctcc

SEQ ID NO: 357351 - DNA, 23 bp, Artificial Sequence
  Description of Artificial Sequence: Synthetic oligonucleotide
tgggaggctgtccatgcggcgga

SEQ ID NO: 357352 - DNA, 29 bp, Artificial Sequence
  Description of Artificial Sequence: Synthetic oligonucleotide
agtactgcaacagccagtaggacctccag

SEQ ID NO: 357353 - DNA, 22 bp, Artificial Sequence
  Description of Artificial Sequence: Synthetic oligonucleotide
gggaggctgtccatgcggcgga

SEQ ID NO: 357354 - DNA, 28 bp, Artificial Sequence
  Description of Artificial Sequence: Synthetic oligonucleotide
gtactgcaacagccagtaggacctccag

SEQ ID NO: 357355 - DNA, 22 bp, Artificial Sequence
  Description of Artificial Sequence: Synthetic oligonucleotide
ggaggctgtccatgcggcggag

SEQ ID NO: 357356 - DNA, 28 bp, Artificial Sequence
  Description of Artificial Sequence: Synthetic oligonucleotide
tactgcaacagccagtaggacctccagg

SEQ ID NO: 357357 - DNA, 23 bp, Artificial Sequence
  Description of Artificial Sequence: Synthetic oligonucleotide
gaggctgtccatgcggcggagca

SEQ ID NO: 357358 - DNA, 27 bp, Artificial Sequence
  Description of Artificial Sequence: Synthetic oligonucleotide
actgcaacagccagtaggacctccagg

SEQ ID NO: 357359 - DNA, 23 bp, Artificial Sequence
  Description of Artificial Sequence: Synthetic oligonucleotide
aggctgtccatgcggcggagcag

SEQ ID NO: 357360 - DNA, 27 bp, Artificial Sequence
  Description of Artificial Sequence: Synthetic oligonucleotide
ctgcaacagccagtaggacctccagga

SEQ ID NO: 357361 - DNA, 22 bp, Artificial Sequence
  Description of Artificial Sequence: Synthetic oligonucleotide
ggctgtccatgcggcggagcag

SEQ ID NO: 357362 - DNA, 27 bp, Artificial Sequence
  Description of Artificial Sequence: Synthetic oligonucleotide
tgcaacagccagtaggacctccaggag

SEQ ID NO: 357363 - DNA, 22 bp, Artificial Sequence
  Description of Artificial Sequence: Synthetic oligonucleotide
gctgtccatgcggcggagcagc

SEQ ID NO: 357364 - DNA, 26 bp, Artificial Sequence
  Description of Artificial Sequence: Synthetic oligonucleotide
gcaacagccagtaggacctccaggag

SEQ ID NO: 357365 - DNA, 22 bp, Artificial Sequence
  Description of Artificial Sequence: Synthetic oligonucleotide
ctgtccatgcggcggagcagcg

SEQ ID NO: 357366 - DNA, 27 bp, Artificial Sequence
  Description of Artificial Sequence: Synthetic oligonucleotide
caacagccagtaggacctccaggagca

SEQ ID NO: 357367 - DNA, 23 bp, Artificial Sequence
  Description of Artificial Sequence: Synthetic oligonucleotide
tgtccatgcggcggagcagcgga

SEQ ID NO: 357368 - DNA, 27 bp, Artificial Sequence
  Description of Artificial Sequence: Synthetic oligonucleotide
aacagccagtaggacctccaggagcag

SEQ ID NO: 357369 - DNA, 28 bp, Artificial Sequence
  Description of Artificial Sequence: Synthetic oligonucleotide
gcctacgacggcaaggattacatcgctc

SEQ ID NO: 357370 - DNA, 27 bp, Artificial Sequence
  Description of Artificial Sequence: Synthetic oligonucleotide
acagccagtaggacctccaggagcaga

SEQ ID NO: 357371 - DNA, 29 bp, Artificial Sequence
  Description of Artificial Sequence: Synthetic oligonucleotide
cctacgacggcaaggattacatcgctctg

SEQ ID NO: 357372 - DNA, 26 bp, Artificial Sequence
  Description of Artificial Sequence: Synthetic oligonucleotide
cagccagtaggacctccaggagcaga

SEQ ID NO: 357373 - DNA, 31 bp, Artificial Sequence; identical to SEQ ID NO: 34375
  Description of Artificial Sequence: Synthetic oligonucleotide

SEQ ID NO: 357374 - DNA, 26 bp, Artificial Sequence
  Description of Artificial Sequence: Synthetic oligonucleotide
agccagtaggacctccaggagcagag

SEQ ID NO: 357375 - DNA, 31 bp, Artificial Sequence; identical to SEQ ID NO: 34376
  Description of Artificial Sequence: Synthetic oligonucleotide

SEQ ID NO: 357376 - DNA, 25 bp, Artificial Sequence
  Description of Artificial Sequence: Synthetic oligonucleotide
gccagtaggacctccaggagcagag

SEQ ID NO: 357377 - DNA, 30 bp, Artificial Sequence; identical to SEQ ID NO: 34377
  Description of Artificial Sequence: Synthetic oligonucleotide

SEQ ID NO: 357378 - DNA, 25 bp, Artificial Sequence
  Description of Artificial Sequence: Synthetic oligonucleotide
ccagtaggacctccaggagcagagc

SEQ ID NO: 357379 - DNA, 29 bp, Artificial Sequence
  Description of Artificial Sequence: Synthetic oligonucleotide
cgacggcaaggattacatcgctctgaacg

SEQ ID NO: 357380 - DNA, 25 bp, Artificial Sequence
  Description of Artificial Sequence: Synthetic oligonucleotide
cagtaggacctccaggagcagagcc

SEQ ID NO: 357381 - DNA, 30 bp, Artificial Sequence; identical to SEQ ID NO: 34379
  Description of Artificial Sequence: Synthetic oligonucleotide

SEQ ID NO: 357382 - DNA, 25 bp, Artificial Sequence
  Description of Artificial Sequence: Synthetic oligonucleotide
agtaggacctccaggagcagagccg

SEQ ID NO: 357383 - DNA, 30 bp, Artificial Sequence; identical to SEQ ID NO: 34380
  Description of Artificial Sequence: Synthetic oligonucleotide

SEQ ID NO: 357384 - DNA, 24 bp, Artificial Sequence
  Description of Artificial Sequence: Synthetic oligonucleotide
gtaggacctccaggagcagagccg

SEQ ID NO: 357385 - DNA, 29 bp, Artificial Sequence
  Description of Artificial Sequence: Synthetic oligonucleotide
cggcaaggattacatcgctctgaacgagg

SEQ ID NO: 357386 - DNA, 24 bp, Artificial Sequence
  Description of Artificial Sequence: Synthetic oligonucleotide
taggacctccaggagcagagccgg

SEQ ID NO: 357387 - DNA, 30 bp, Artificial Sequence; identical to SEQ ID NO: 34382
  Description of Artificial Sequence: Synthetic oligonucleotide

SEQ ID NO: 357388 - DNA, 23 bp, Artificial Sequence
  Description of Artificial Sequence: Synthetic oligonucleotide
aggacctccaggagcagagccgg

SEQ ID NO: 357389 - DNA, 30 bp, Artificial Sequence; identical to SEQ ID NO: 34383
  Description of Artificial Sequence: Synthetic oligonucleotide

SEQ ID NO: 357390 - DNA, 22 bp, Artificial Sequence
  Description of Artificial Sequence: Synthetic oligonucleotide
ggacctccaggagcagagccgg

SEQ ID NO: 357391 - DNA, 31 bp, Artificial Sequence; identical to SEQ ID NO: 34384
  Description of Artificial Sequence: Synthetic oligonucleotide

SEQ ID NO: 357392 - DNA, 22 bp, Artificial Sequence
  Description of Artificial Sequence: Synthetic oligonucleotide
gacctccaggagcagagccggg

SEQ ID NO: 357393 - DNA, 31 bp, Artificial Sequence; identical to SEQ ID NO: 34385
  Description of Artificial Sequence: Synthetic oligonucleotide

SEQ ID NO: 357394 - DNA, 22 bp, Artificial Sequence
  Description of Artificial Sequence: Synthetic oligonucleotide
acctccaggagcagagccgggc

SEQ ID NO: 357395 - DNA, 30 bp, Artificial Sequence; identical to SEQ ID NO: 34386
  Description of Artificial Sequence: Synthetic oligonucleotide

SEQ ID NO: 357396 - DNA, 21 bp, Artificial Sequence
  Description of Artificial Sequence: Synthetic oligonucleotide
cctccaggagcagagccgggc

SEQ ID NO: 357397 - DNA, 29 bp, Artificial Sequence
  Description of Artificial Sequence: Synthetic oligonucleotide
ggattacatcgctctgaacgaggacctgc

SEQ ID NO: 357398 - DNA, 21 bp, Artificial Sequence
  Description of Artificial Sequence: Synthetic oligonucleotide
ctccaggagcagagccgggcc

SEQ ID NO: 357399 - DNA, 29 bp, Artificial Sequence
  Description of Artificial Sequence: Synthetic oligonucleotide
gattacatcgctctgaacgaggacctgcg

SEQ ID NO: 357400 - DNA, 21 bp, Artificial Sequence
  Description of Artificial Sequence: Synthetic oligonucleotide
tccaggagcagagccgggccg

SEQ ID NO: 357401 - DNA, 29 bp, Artificial Sequence
  Description of Artificial Sequence: Synthetic oligonucleotide
attacatcgctctgaacgaggacctgcgc

SEQ ID NO: 357402 - DNA, 20 bp, Artificial Sequence
  Description of Artificial Sequence: Synthetic oligonucleotide
ccaggagcagagccgggccg

SEQ ID NO: 357403 - DNA, 28 bp, Artificial Sequence
  Description of Artificial Sequence: Synthetic oligonucleotide
ttacatcgctctgaacgaggacctgcgc

SEQ ID NO: 357404 - DNA, 20 bp, Artificial Sequence
  Description of Artificial Sequence: Synthetic oligonucleotide
caggagcagagccgggccgc

SEQ ID NO: 357405 - DNA, 27 bp, Artificial Sequence
  Description of Artificial Sequence: Synthetic oligonucleotide
tacatcgctctgaacgaggacctgcgc

SEQ ID NO: 357406 - DNA, 20 bp, Artificial Sequence
  Description of Artificial Sequence: Synthetic oligonucleotide
aggagcagagccgggccgcg

SEQ ID NO: 357407 - DNA, 27 bp, Artificial Sequence
  Description of Artificial Sequence: Synthetic oligonucleotide
acatcgctctgaacgaggacctgcgct

SEQ ID NO: 357408 - DNA, 20 bp, Artificial Sequence
  Description of Artificial Sequence: Synthetic oligonucleotide
ggagcagagccgggccgcgt

SEQ ID NO: 357409 - DNA, 26 bp, Artificial Sequence
  Description of Artificial Sequence: Synthetic oligonucleotide
catcgctctgaacgaggacctgcgct

SEQ ID NO: 357410 - DNA, 20 bp, Artificial Sequence
  Description of Artificial Sequence: Synthetic oligonucleotide
gagcagagccgggccgcgct

SEQ ID NO: 357411 - DNA, 26 bp, Artificial Sequence
  Description of Artificial Sequence: Synthetic oligonucleotide
atcgctctgaacgaggacctgcgctc

SEQ ID NO: 357412 - DNA, 20 bp, Artificial Sequence
  Description of Artificial Sequence: Synthetic oligonucleotide
agcagagccgggccgcgctg

SEQ ID NO: 357413 - DNA, 25 bp, Artificial Sequence
  Description of Artificial Sequence: Synthetic oligonucleotide
tcgctctgaacgaggacctgcgctc

SEQ ID NO: 357414 - DNA, 20 bp, Artificial Sequence
  Description of Artificial Sequence: Synthetic oligonucleotide
gcagagccgggccgcgctgt

SEQ ID NO: 357415 - DNA, 24 bp, Artificial Sequence
  Description of Artificial Sequence: Synthetic oligonucleotide
cgctctgaacgaggacctgcgctc

SEQ ID NO: 357416 - DNA, 20 bp, Artificial Sequence
  Description of Artificial Sequence: Synthetic oligonucleotide
cagagccgggccgcgctgga

SEQ ID NO: 357417 - DNA, 25 bp, Artificial Sequence
  Description of Artificial Sequence: Synthetic oligonucleotide
gctctgaacgaggacctgcgctcct

SEQ ID NO: 357418 - DNA, 21 bp, Artificial Sequence
  Description of Artificial Sequence: Synthetic oligonucleotide
agagccgggccgcgctggaca

SEQ ID NO: 357419 - DNA, 25 bp, Artificial Sequence
  Description of Artificial Sequence: Synthetic oligonucleotide
ctctgaacgaggacctgcgctcctg

SEQ ID NO: 357420 - DNA, 20 bp, Artificial Sequence
  Description of Artificial Sequence: Synthetic oligonucleotide
gagccgggccgcgctggaca

SEQ ID NO: 357421 - DNA, 26 bp, Artificial Sequence
  Description of Artificial Sequence: Synthetic oligonucleotide
tctgaacgaggacctgcgctcctgga

SEQ ID NO: 357422 - DNA, 20 bp, Artificial Sequence
  Description of Artificial Sequence: Synthetic oligonucleotide
agccgggccgcgctggacac

SEQ ID NO: 357423 - DNA, 31 bp, Artificial Sequence
  Description of Artificial Sequence: Synthetic oligonucleotide
gctcccactccatgaggtacttcttcacatc

SEQ ID NO: 357424 - DNA, 20 bp, Artificial Sequence
  Description of Artificial Sequence: Synthetic oligonucleotide
gccgggccgcgctggacact

SEQ ID NO: 357425 - DNA, 31 bp, Artificial Sequence
  Description of Artificial Sequence: Synthetic oligonucleotide
ctcccactccatgaggtacttcttcacatcc

SEQ ID NO: 357426 - DNA, 21 bp, Artificial Sequence
  Description of Artificial Sequence: Synthetic oligonucleotide
ccgggccgcgctggacacctt

SEQ ID NO: 357427 - DNA, 31 bp, Artificial Sequence
  Description of Artificial Sequence: Synthetic oligonucleotide
tcccactccatgaggtacttcttcacatccg

SEQ ID NO: 357428 - DNA, 22 bp, Artificial Sequence
  Description of Artificial Sequence: Synthetic oligonucleotide
cgggccgcgctggacaccttct

SEQ ID NO: 357429 - DNA, 30 bp, Artificial Sequence
  Description of Artificial Sequence: Synthetic oligonucleotide
cccactccatgaggtacttcttcacatccg

SEQ ID NO: 357430 - DNA, 22 bp, Artificial Sequence
  Description of Artificial Sequence: Synthetic oligonucleotide
gggccgcgctggacaccttctg

SEQ ID NO: 357431 - DNA, 31 bp, Artificial Sequence
  Description of Artificial Sequence: Synthetic oligonucleotide
ccactccatgaggtacttcttcacatccgtg

SEQ ID NO: 357432 - DNA, 23 bp, Artificial Sequence
  Description of Artificial Sequence: Synthetic oligonucleotide
ggccgcgctggacaccttctgca

SEQ ID NO: 357433 - DNA, 32 bp, Artificial Sequence
  Description of Artificial Sequence: Synthetic oligonucleotide
cactccatgaggtacttcttcacatccgtgtc

SEQ ID NO: 357434 - DNA, 24 bp, Artificial Sequence
  Description of Artificial Sequence: Synthetic oligonucleotide
gccgcgctggacaccttctgcaga

SEQ ID NO: 357435 - DNA, 32 bp, Artificial Sequence
  Description of Artificial Sequence: Synthetic oligonucleotide
actccatgaggtacttcttcacatccgtgtcc

SEQ ID NO: 357436 - DNA, 25 bp, Artificial Sequence
  Description of Artificial Sequence: Synthetic oligonucleotide
ccgcgctggacaccttctgcagaca

SEQ ID NO: 357437 - DNA, 31 bp, Artificial Sequence
  Description of Artificial Sequence: Synthetic oligonucleotide
ctccatgaggtacttcttcacatccgtgtcc

SEQ ID NO: 357438 - DNA, 27 bp, Artificial Sequence
  Description of Artificial Sequence: Synthetic oligonucleotide
cgcgctggacaccttctgcagacagaa

SEQ ID NO: 357439 - DNA, 31 bp, Artificial Sequence
  Description of Artificial Sequence: Synthetic oligonucleotide
tccatgaggtacttcttcacatccgtgtccc

SEQ ID NO: 357440 - DNA, 27 bp, Artificial Sequence
  Description of Artificial Sequence: Synthetic oligonucleotide
gcgctggacaccttctgcagacagaac

SEQ ID NO: 357441 - DNA, 30 bp, Artificial Sequence
  Description of Artificial Sequence: Synthetic oligonucleotide
ccatgaggtacttcttcacatccgtgtccc

SEQ ID NO: 357442 - DNA, 29 bp, Artificial Sequence
  Description of Artificial Sequence: Synthetic oligonucleotide
cgctggacaccttctgcagacagaactac

SEQ ID NO: 357443 - DNA, 30 bp, Artificial Sequence
  Description of Artificial Sequence: Synthetic oligonucleotide
catgaggtacttcttcacatccgtgtcccg

SEQ ID NO: 357444 - DNA, 29 bp, Artificial Sequence
  Description of Artificial Sequence: Synthetic oligonucleotide
gctggacaccttctgcagacagaactacg

SEQ ID NO: 357445 - DNA, 30 bp, Artificial Sequence
  Description of Artificial Sequence: Synthetic oligonucleotide
atgaggtacttcttcacatccgtgtcccgg

SEQ ID NO: 357446 - DNA, 29 bp, Artificial Sequence
  Description of Artificial Sequence: Synthetic oligonucleotide
ctggacaccttctgcagacagaactacgg

SEQ ID NO: 357447 - DNA, 29 bp, Artificial Sequence
  Description of Artificial Sequence: Synthetic oligonucleotide
tgaggtacttcttcacatccgtgtcccgg

SEQ ID NO: 357448 - DNA, 29 bp, Artificial Sequence
  Description of Artificial Sequence: Synthetic oligonucleotide
tggacaccttctgcagacagaactacggg

SEQ ID NO: 357449 - DNA, 28 bp, Artificial Sequence
  Description of Artificial Sequence: Synthetic oligonucleotide
gaggtacttcttcacatccgtgtcccgg

SEQ ID NO: 357450 - DNA, 28 bp, Artificial Sequence
  Description of Artificial Sequence: Synthetic oligonucleotide
ggacaccttctgcagacagaactacggg

SEQ ID NO: 357451 - DNA, 28 bp, Artificial Sequence
  Description of Artificial Sequence: Synthetic oligonucleotide
aggtacttcttcacatccgtgtcccggc

SEQ ID NO: 357452 - DNA, 28 bp, Artificial Sequence
  Description of Artificial Sequence: Synthetic oligonucleotide
gacaccttctgcagacagaactacgggc

SEQ ID NO: 357453 - DNA, 27 bp, Artificial Sequence
  Description of Artificial Sequence: Synthetic oligonucleotide
ggtacttcttcacatccgtgtcccggc

SEQ ID NO: 357454 - DNA, 30 bp, Artificial Sequence; identical to SEQ ID NO: 233333
  Description of Artificial Sequence: Synthetic oligonucleotide

SEQ ID NO: 357455 - DNA, 27 bp, Artificial Sequence
  Description of Artificial Sequence: Synthetic oligonucleotide
gtacttcttcacatccgtgtcccggcc

SEQ ID NO: 357456 - DNA, 29 bp, Artificial Sequence
  Description of Artificial Sequence: Synthetic oligonucleotide
caccttctgcagacagaactacgggcttg

SEQ ID NO: 357457 - DNA, 27 bp, Artificial Sequence
  Description of Artificial Sequence: Synthetic oligonucleotide
tacttcttcacatccgtgtcccggccc

SEQ ID NO: 357458 - DNA, 30 bp, Artificial Sequence; identical to SEQ ID NO: 233335
  Description of Artificial Sequence: Synthetic oligonucleotide

SEQ ID NO: 357459 - DNA, 26 bp, Artificial Sequence
  Description of Artificial Sequence: Synthetic oligonucleotide
acttcttcacatccgtgtcccggccc

SEQ ID NO: 357460 - DNA, 29 bp, Artificial Sequence
  Description of Artificial Sequence: Synthetic oligonucleotide
ccttctgcagacagaactacgggcttgtg

SEQ ID NO: 357461 - DNA, 25 bp, Artificial Sequence
  Description of Artificial Sequence: Synthetic oligonucleotide
cttcttcacatccgtgtcccggccc

SEQ ID NO: 357462 - DNA, 29 bp, Artificial Sequence
  Description of Artificial Sequence: Synthetic oligonucleotide
cttctgcagacagaactacgggcttgtgg

SEQ ID NO: 357463 - DNA, 29 bp, Artificial Sequence
  Description of Artificial Sequence: Synthetic oligonucleotide
gtatttcttcacatccgtgtcccggcctg

SEQ ID NO: 357464 - DNA, 30 bp, Artificial Sequence; identical to SEQ ID NO: 233338
  Description of Artificial Sequence: Synthetic oligonucleotide

SEQ ID NO: 357465 - DNA, 29 bp, Artificial Sequence
  Description of Artificial Sequence: Synthetic oligonucleotide
tatttcttcacatccgtgtcccggcctgg

SEQ ID NO: 357466 - DNA, 29 bp, Artificial Sequence
  Description of Artificial Sequence: Synthetic oligonucleotide
tctgcagacagaactacgggcttgtggag

SEQ ID NO: 357467 - DNA, 28 bp, Artificial Sequence
  Description of Artificial Sequence: Synthetic oligonucleotide
atttcttcacatccgtgtcccggcctgg

SEQ ID NO: 357468 - DNA, 28 bp, Artificial Sequence
  Description of Artificial Sequence: Synthetic oligonucleotide
ctgcagacagaactacgggcttgtggag

SEQ ID NO: 357469 - DNA, 27 bp, Artificial Sequence
  Description of Artificial Sequence: Synthetic oligonucleotide
tttcttcacatccgtgtcccggcctgg

SEQ ID NO: 357470 - DNA, 29 bp, Artificial Sequence
  Description of Artificial Sequence: Synthetic oligonucleotide
tgcagacagaactacgggcttgtggagac

SEQ ID NO: 357471 - DNA, 26 bp, Artificial Sequence
  Description of Artificial Sequence: Synthetic oligonucleotide
ttcttcacatccgtgtcccggcctgg

SEQ ID NO: 357472 - DNA, 28 bp, Artificial Sequence
  Description of Artificial Sequence: Synthetic oligonucleotide
gcagacagaactacgggcttgtggagac

SEQ ID NO: 357473 - DNA, 25 bp, Artificial Sequence
  Description of Artificial Sequence: Synthetic oligonucleotide
tcttcacatccgtgtcccggcctgg

SEQ ID NO: 357474 - DNA, 28 bp, Artificial Sequence
  Description of Artificial Sequence: Synthetic oligonucleotide
cagacagaactacgggcttgtggagacc

SEQ ID NO: 357475 - DNA, 24 bp, Artificial Sequence
  Description of Artificial Sequence: Synthetic oligonucleotide
cttcacatccgtgtcccggcctgg

SEQ ID NO: 357476 - DNA, 30 bp, Artificial Sequence; identical to SEQ ID NO: 233344
  Description of Artificial Sequence: Synthetic oligonucleotide

SEQ ID NO: 357477 - DNA, 24 bp, Artificial Sequence
  Description of Artificial Sequence: Synthetic oligonucleotide
ttcacatccgtgtcccggcctggc

SEQ ID NO: 357478 - DNA, 29 bp, Artificial Sequence
  Description of Artificial Sequence: Synthetic oligonucleotide
gacagaactacgggcttgtggagaccttc

SEQ ID NO: 357479 - DNA, 23 bp, Artificial Sequence
  Description of Artificial Sequence: Synthetic oligonucleotide
tcacatccgtgtcccggcctggc

SEQ ID NO: 357480 - DNA, 30 bp, Artificial Sequence; identical to SEQ ID NO: 233346
  Description of Artificial Sequence: Synthetic oligonucleotide

SEQ ID NO: 357481 - DNA, 22 bp, Artificial Sequence
  Description of Artificial Sequence: Synthetic oligonucleotide
cacatccgtgtcccggcctggc

SEQ ID NO: 357482 - DNA, 29 bp, Artificial Sequence
  Description of Artificial Sequence: Synthetic oligonucleotide
cagaactacgggcttgtggagaccttcac

SEQ ID NO: 357483 - DNA, 22 bp, Artificial Sequence
  Description of Artificial Sequence: Synthetic oligonucleotide
acatccgtgtcccggcctggcc

SEQ ID NO: 357484 - DNA, 30 bp, Artificial Sequence; identical to SEQ ID NO: 233348
  Description of Artificial Sequence: Synthetic oligonucleotide

SEQ ID NO: 357485 - DNA, 21 bp, Artificial Sequence
  Description of Artificial Sequence: Synthetic oligonucleotide
catccgtgtcccggcctggcc

SEQ ID NO: 357486 - DNA, 29 bp, Artificial Sequence
  Description of Artificial Sequence: Synthetic oligonucleotide
gaactacgggcttgtggagaccttcacag

SEQ ID NO: 357487 - DNA, 21 bp, Artificial Sequence
  Description of Artificial Sequence: Synthetic oligonucleotide
atccgtgtcccggcctggccg

SEQ ID NO: 357488 - DNA, 30 bp, Artificial Sequence; identical to SEQ ID NO: 233350
  Description of Artificial Sequence: Synthetic oligonucleotide

SEQ ID NO: 357489 - DNA, 20 bp, Artificial Sequence
  Description of Artificial Sequence: Synthetic oligonucleotide
tccgtgtcccggcctggccg

SEQ ID NO: 357490 - DNA, 29 bp, Artificial Sequence
  Description of Artificial Sequence: Synthetic oligonucleotide
actacgggcttgtggagaccttcacagtc

SEQ ID NO: 357491 - DNA, 20 bp, Artificial Sequence
  Description of Artificial Sequence: Synthetic oligonucleotide
ccgtgtcccggcctggccgt

SEQ ID NO: 357492 - DNA, 28 bp, Artificial Sequence
  Description of Artificial Sequence: Synthetic oligonucleotide
ctacgggcttgtggagaccttcacagtc

SEQ ID NO: 357493 - DNA, 20 bp, Artificial Sequence
  Description of Artificial Sequence: Synthetic oligonucleotide
cgtgtcccggcctggccgct

SEQ ID NO: 357494 - DNA, 28 bp, Artificial Sequence
  Description of Artificial Sequence: Synthetic oligonucleotide
tacgggcttgtggagaccttcacagtcc

SEQ ID NO: 357495 - DNA, 20 bp, Artificial Sequence
  Description of Artificial Sequence: Synthetic oligonucleotide
gtgtcccggcctggccgcgt

SEQ ID NO: 357496 - DNA, 27 bp, Artificial Sequence
  Description of Artificial Sequence: Synthetic oligonucleotide
acgggcttgtggagaccttcacagtcc

SEQ ID NO: 357497 - DNA, 20 bp, Artificial Sequence
  Description of Artificial Sequence: Synthetic oligonucleotide
tgtcccggcctggccgcggt

SEQ ID NO: 357498 - DNA, 27 bp, Artificial Sequence
  Description of Artificial Sequence: Synthetic oligonucleotide
cgggcttgtggagaccttcacagtcca

SEQ ID NO: 357499 - DNA, 20 bp, Artificial Sequence
  Description of Artificial Sequence: Synthetic oligonucleotide
gtcccggcctggccgcggtt

SEQ ID NO: 357500 - DNA, 27 bp, Artificial Sequence
  Description of Artificial Sequence: Synthetic oligonucleotide
gggcttgtggagaccttcacagtccag

SEQ ID NO: 357501 - DNA, 20 bp, Artificial Sequence
  Description of Artificial Sequence: Synthetic oligonucleotide
tcccggcctggccgcgggtt

SEQ ID NO: 357502 - DNA, 27 bp, Artificial Sequence
  Description of Artificial Sequence: Synthetic oligonucleotide
ggcttgtggagaccttcacagtccagc

SEQ ID NO: 357503 - DNA, 20 bp, Artificial Sequence
  Description of Artificial Sequence: Synthetic oligonucleotide
cccggcctggccgcgggttt

SEQ ID NO: 357504 - DNA, 27 bp, Artificial Sequence
  Description of Artificial Sequence: Synthetic oligonucleotide
gcttgtggagaccttcacagtccagcg

SEQ ID NO: 357505 - DNA, 20 bp, Artificial Sequence
  Description of Artificial Sequence: Synthetic oligonucleotide
ccggcctggccgcggggatt

SEQ ID NO: 357506 - DNA, 27 bp, Artificial Sequence
  Description of Artificial Sequence: Synthetic oligonucleotide
cttgtggagaccttcacagtccagcgg

SEQ ID NO: 357507 - DNA, 20 bp, Artificial Sequence
  Description of Artificial Sequence: Synthetic oligonucleotide
cggcctggccgcggggagtt

SEQ ID NO: 357508 - DNA, 27 bp, Artificial Sequence
  Description of Artificial Sequence: Synthetic oligonucleotide
ttgtggagaccttcacagtccagcggc

SEQ ID NO: 357509 - DNA, 20 bp, Artificial Sequence
  Description of Artificial Sequence: Synthetic oligonucleotide
ggcctggccgcggggagctt

SEQ ID NO: 357510 - DNA, 26 bp, Artificial Sequence
  Description of Artificial Sequence: Synthetic oligonucleotide
tgtggagaccttcacagtccagcggc

SEQ ID NO: 357511 - DNA, 20 bp, Artificial Sequence
  Description of Artificial Sequence: Synthetic oligonucleotide
gcctggccgcggggagcctt

SEQ ID NO: 357512 - DNA, 25 bp, Artificial Sequence
  Description of Artificial Sequence: Synthetic oligonucleotide
gtggagaccttcacagtccagcggc

SEQ ID NO: 357513 - DNA, 20 bp, Artificial Sequence
  Description of Artificial Sequence: Synthetic oligonucleotide
cctggccgcggggagccctt

SEQ ID NO: 357514 - DNA, 26 bp, Artificial Sequence
  Description of Artificial Sequence: Synthetic oligonucleotide
tggagaccttcacagtccagcggcga

SEQ ID NO: 357515 - DNA, 20 bp, Artificial Sequence
  Description of Artificial Sequence: Synthetic oligonucleotide
ctggccgcggggagcccctt

SEQ ID NO: 357516 - DNA, 25 bp, Artificial Sequence
  Description of Artificial Sequence: Synthetic oligonucleotide
ggagaccttcacagtccagcggcga

SEQ ID NO: 357517 - DNA, 20 bp, Artificial Sequence
  Description of Artificial Sequence: Synthetic oligonucleotide
tggccgcggggagccccgtt

SEQ ID NO: 357518 - DNA, 26 bp, Artificial Sequence
  Description of Artificial Sequence: Synthetic oligonucleotide
gagaccttcacagtccagcggcgact

SEQ ID NO: 357519 - DNA, 33 bp, Artificial Sequence
  Description of Artificial Sequence: Synthetic oligonucleotide
gaggacggttctcacaccatccagataatgtac

SEQ ID NO: 357520 - DNA, 26 bp, Artificial Sequence
  Description of Artificial Sequence: Synthetic oligonucleotide
agaccttcacagtccagcggcgactc

SEQ ID NO: 357521 - DNA, 33 bp, Artificial Sequence
  Description of Artificial Sequence: Synthetic oligonucleotide
aggacggttctcacaccatccagataatgtacg

SEQ ID NO: 357522 - DNA, 25 bp, Artificial Sequence
  Description of Artificial Sequence: Synthetic oligonucleotide
gaccttcacagtccagcggcgactc

SEQ ID NO: 357523 - DNA, 32 bp, Artificial Sequence
  Description of Artificial Sequence: Synthetic oligonucleotide
ggacggttctcacaccatccagataatgtacg

SEQ ID NO: 357524 - DNA, 27 bp, Artificial Sequence
  Description of Artificial Sequence: Synthetic oligonucleotide
accttcacagtccagcggcgactccat

SEQ ID NO: 357525 - DNA, 32 bp, Artificial Sequence
  Description of Artificial Sequence: Synthetic oligonucleotide
gacggttctcacaccatccagataatgtacgg

SEQ ID NO: 357526 - DNA, 26 bp, Artificial Sequence
  Description of Artificial Sequence: Synthetic oligonucleotide
ccttcacagtccagcggcgactccat

SEQ ID NO: 357527 - DNA, 32 bp, Artificial Sequence
  Description of Artificial Sequence: Synthetic oligonucleotide
acggttctcacaccatccagataatgtacggc

SEQ ID NO: 357528 - DNA, 26 bp, Artificial Sequence
  Description of Artificial Sequence: Synthetic oligonucleotide
cttcacagtccagcggcgactccatc

SEQ ID NO: 357529 - DNA, 31 bp, Artificial Sequence
  Description of Artificial Sequence: Synthetic oligonucleotide
cggttctcacaccatccagataatgtacggc

SEQ ID NO: 357530 - DNA, 27 bp, Artificial Sequence
  Description of Artificial Sequence: Synthetic oligonucleotide
ttcacagtccagcggcgactccatcct

SEQ ID NO: 357531 - DNA, 32 bp, Artificial Sequence
  Description of Artificial Sequence: Synthetic oligonucleotide
ggttctcacaccatccagataatgtacggctg

SEQ ID NO: 357532 - DNA, 27 bp, Artificial Sequence
  Description of Artificial Sequence: Synthetic oligonucleotide
tcacagtccagcggcgactccatccta

SEQ ID NO: 357533 - DNA, 32 bp, Artificial Sequence
  Description of Artificial Sequence: Synthetic oligonucleotide
gttctcacaccatccagataatgtacggctgc

SEQ ID NO: 357534 - DNA, 27 bp, Artificial Sequence
  Description of Artificial Sequence: Synthetic oligonucleotide
cacagtccagcggcgactccatcctat

SEQ ID NO: 357535 - DNA, 32 bp, Artificial Sequence
  Description of Artificial Sequence: Synthetic oligonucleotide
ttctcacaccatccagataatgtacggctgcg

SEQ ID NO: 357536 - DNA, 27 bp, Artificial Sequence
  Description of Artificial Sequence: Synthetic oligonucleotide
acagtccagcggcgactccatcctatg

SEQ ID NO: 357537 - DNA, 31 bp, Artificial Sequence
  Description of Artificial Sequence: Synthetic oligonucleotide
tctcacaccatccagataatgtacggctgcg

SEQ ID NO: 357538 - DNA, 26 bp, Artificial Sequence
  Description of Artificial Sequence: Synthetic oligonucleotide
cagtccagcggcgactccatcctatg

SEQ ID NO: 357539 - DNA, 30 bp, Artificial Sequence
  Description of Artificial Sequence: Synthetic oligonucleotide
ctcacaccatccagataatgtacggctgcg

SEQ ID NO: 357540 - DNA, 27 bp, Artificial Sequence
  Description of Artificial Sequence: Synthetic oligonucleotide
agtccagcggcgactccatcctatggt

SEQ ID NO: 357541 - DNA, 31 bp, Artificial Sequence
  Description of Artificial Sequence: Synthetic oligonucleotide
tcacaccatccagataatgtacggctgcgac

SEQ ID NO: 357542 - DNA, 26 bp, Artificial Sequence
  Description of Artificial Sequence: Synthetic oligonucleotide
gtccagcggcgactccatcctatggt

SEQ ID NO: 357543 - DNA, 30 bp, Artificial Sequence
  Description of Artificial Sequence: Synthetic oligonucleotide
cacaccatccagataatgtacggctgcgac

SEQ ID NO: 357544 - DNA, 27 bp, Artificial Sequence
  Description of Artificial Sequence: Synthetic oligonucleotide
tccagcggcgactccatcctatggtga

SEQ ID NO: 357545 - DNA, 30 bp, Artificial Sequence
  Description of Artificial Sequence: Synthetic oligonucleotide
acaccatccagataatgtacggctgcgacg

SEQ ID NO: 357546 - DNA, 26 bp, Artificial Sequence
  Description of Artificial Sequence: Synthetic oligonucleotide
ccagcggcgactccatcctatggtga

SEQ ID NO: 357547 - DNA, 29 bp, Artificial Sequence
  Description of Artificial Sequence: Synthetic oligonucleotide
caccatccagataatgtacggctgcgacg

SEQ ID NO: 357548 - DNA, 27 bp, Artificial Sequence
  Description of Artificial Sequence: Synthetic oligonucleotide
cagcggcgactccatcctatggtgact

SEQ ID NO: 357549 - DNA, 30 bp, Artificial Sequence
  Description of Artificial Sequence: Synthetic oligonucleotide
accatccagataatgtacggctgcgacgtg

SEQ ID NO: 357550 - DNA, 27 bp, Artificial Sequence
  Description of Artificial Sequence: Synthetic oligonucleotide
agcggcgactccatcctatggtgactg

SEQ ID NO: 357551 - DNA, 29 bp, Artificial Sequence
  Description of Artificial Sequence: Synthetic oligonucleotide
ccatccagataatgtacggctgcgacgtg

SEQ ID NO: 357552 - DNA, 27 bp, Artificial Sequence
  Description of Artificial Sequence: Synthetic oligonucleotide
gcggcgactccatcctatggtgactga

SEQ ID NO: 357553 - DNA, 29 bp, Artificial Sequence
  Description of Artificial Sequence: Synthetic oligonucleotide
catccagataatgtacggctgcgacgtgg

SEQ ID NO: 357554 - DNA, 27 bp, Artificial Sequence
  Description of Artificial Sequence: Synthetic oligonucleotide
cggcgactccatcctatggtgactgag

SEQ ID NO: 357555 - DNA, 29 bp, Artificial Sequence
  Description of Artificial Sequence: Synthetic oligonucleotide
atccagataatgtacggctgcgacgtggg

SEQ ID NO: 357556 - DNA, 30 bp, Artificial Sequence; identical to SEQ ID NO: 233384
  Description of Artificial Sequence: Synthetic oligonucleotide

SEQ ID NO: 357557 - DNA, 28 bp, Artificial Sequence
  Description of Artificial Sequence: Synthetic oligonucleotide
tccagataatgtacggctgcgacgtggg

SEQ ID NO: 357558 - DNA, 30 bp, Artificial Sequence; identical to SEQ ID NO: 233385
  Description of Artificial Sequence: Synthetic oligonucleotide

SEQ ID NO: 357559 - DNA, 27 bp, Artificial Sequence
  Description of Artificial Sequence: Synthetic oligonucleotide
ccagataatgtacggctgcgacgtggg

SEQ ID NO: 357560 - DNA, 32 bp, Artificial Sequence; identical to SEQ ID NO: 233386
  Description of Artificial Sequence: Synthetic oligonucleotide

SEQ ID NO: 357561 - DNA, 27 bp, Artificial Sequence
  Description of Artificial Sequence: Synthetic oligonucleotide
cagataatgtacggctgcgacgtgggg

SEQ ID NO: 357562 - DNA, 35 bp, Artificial Sequence; identical to SEQ ID NO: 233387
  Description of Artificial Sequence: Synthetic oligonucleotide

SEQ ID NO: 357563 - DNA, 27 bp, Artificial Sequence
  Description of Artificial Sequence: Synthetic oligonucleotide
agataatgtacggctgcgacgtggggc

SEQ ID NO: 357564 - DNA, 36 bp, Artificial Sequence; identical to SEQ ID NO: 233388
  Description of Artificial Sequence: Synthetic oligonucleotide

SEQ ID NO: 357565 - DNA, 26 bp, Artificial Sequence
  Description of Artificial Sequence: Synthetic oligonucleotide
gataatgtacggctgcgacgtggggc

SEQ ID NO: 357566 - DNA, 35 bp, Artificial Sequence; identical to SEQ ID NO: 233389
  Description of Artificial Sequence: Synthetic oligonucleotide

SEQ ID NO: 357567 - DNA, 26 bp, Artificial Sequence
  Description of Artificial Sequence: Synthetic oligonucleotide
ataatgtacggctgcgacgtggggcc

SEQ ID NO: 357568 - DNA, 35 bp, Artificial Sequence; identical to SEQ ID NO: 233390
  Description of Artificial Sequence: Synthetic oligonucleotide

SEQ ID NO: 357569 - DNA, 25 bp, Artificial Sequence
  Description of Artificial Sequence: Synthetic oligonucleotide
taatgtacggctgcgacgtggggcc

SEQ ID NO: 357570 - DNA, 34 bp, Artificial Sequence; identical to SEQ ID NO: 233391
  Description of Artificial Sequence: Synthetic oligonucleotide

SEQ ID NO: 357571 - DNA, 24 bp, Artificial Sequence
  Description of Artificial Sequence: Synthetic oligonucleotide
aatgtacggctgcgacgtggggcc

SEQ ID NO: 357572 - DNA, 34 bp, Artificial Sequence; identical to SEQ ID NO: 233392
  Description of Artificial Sequence: Synthetic oligonucleotide

SEQ ID NO: 357573 - DNA, 23 bp, Artificial Sequence
  Description of Artificial Sequence: Synthetic oligonucleotide
atgtacggctgcgacgtggggcc

SEQ ID NO: 357574 - DNA, 35 bp, Artificial Sequence; identical to SEQ ID NO: 233393
  Description of Artificial Sequence: Synthetic oligonucleotide

SEQ ID NO: 357575 - DNA, 22 bp, Artificial Sequence
  Description of Artificial Sequence: Synthetic oligonucleotide
tgtacggctgcgacgtggggcc

SEQ ID NO: 357576 - DNA, 34 bp, Artificial Sequence; identical to SEQ ID NO: 233394
  Description of Artificial Sequence: Synthetic oligonucleotide

SEQ ID NO: 357577 - DNA, 21 bp, Artificial Sequence
  Description of Artificial Sequence: Synthetic oligonucleotide
gtacggctgcgacgtggggcc

SEQ ID NO: 357578 - DNA, 33 bp, Artificial Sequence; identical to SEQ ID NO: 233395
  Description of Artificial Sequence: Synthetic oligonucleotide

SEQ ID NO: 357579 - DNA, 21 bp, Artificial Sequence
  Description of Artificial Sequence: Synthetic oligonucleotide
tacggctgcgacgtggggccg

SEQ ID NO: 357580 - DNA, 33 bp, Artificial Sequence; identical to SEQ ID NO: 233396
  Description of Artificial Sequence: Synthetic oligonucleotide

SEQ ID NO: 357581 - DNA, 20 bp, Artificial Sequence
  Description of Artificial Sequence: Synthetic oligonucleotide
acggctgcgacgtggggccg

SEQ ID NO: 357582 - DNA, 33 bp, Artificial Sequence; identical to SEQ ID NO: 233397
  Description of Artificial Sequence: Synthetic oligonucleotide

SEQ ID NO: 357583 - DNA, 20 bp, Artificial Sequence
  Description of Artificial Sequence: Synthetic oligonucleotide
cggctgcgacgtggggccgt

SEQ ID NO: 357584 - DNA, 32 bp, Artificial Sequence; identical to SEQ ID NO: 233398
  Description of Artificial Sequence: Synthetic oligonucleotide

SEQ ID NO: 357585 - DNA, 33 bp, Artificial Sequence
  Description of Artificial Sequence: Synthetic oligonucleotide
gctcccactctatgaggtatttcttcacatccg

SEQ ID NO: 357586 - DNA, 31 bp, Artificial Sequence; identical to SEQ ID NO: 233399
  Description of Artificial Sequence: Synthetic oligonucleotide

SEQ ID NO: 357587 - DNA, 34 bp, Artificial Sequence
  Description of Artificial Sequence: Synthetic oligonucleotide
ctcccactctatgaggtatttcttcacatccgtg

SEQ ID NO: 357588 - DNA, 30 bp, Artificial Sequence; identical to SEQ ID NO: 233400
  Description of Artificial Sequence: Synthetic oligonucleotide

SEQ ID NO: 357589 - DNA, 35 bp, Artificial Sequence
  Description of Artificial Sequence: Synthetic oligonucleotide
tcccactctatgaggtatttcttcacatccgtgtc

SEQ ID NO: 357590 - DNA, 30 bp, Artificial Sequence; identical to SEQ ID NO: 233401
  Description of Artificial Sequence: Synthetic oligonucleotide

SEQ ID NO: 357591 - DNA, 34 bp, Artificial Sequence
  Description of Artificial Sequence: Synthetic oligonucleotide
cccactctatgaggtatttcttcacatccgtgtc

SEQ ID NO: 357592 - DNA, 30 bp, Artificial Sequence; identical to SEQ ID NO: 233402
  Description of Artificial Sequence: Synthetic oligonucleotide

SEQ ID NO: 357593 - DNA, 34 bp, Artificial Sequence
  Description of Artificial Sequence: Synthetic oligonucleotide
ccactctatgaggtatttcttcacatccgtgtcc

SEQ ID NO: 357594 - DNA, 29 bp, Artificial Sequence
  Description of Artificial Sequence: Synthetic oligonucleotide
gactgagtatccttcatagacccagcgcc

SEQ ID NO: 357595 - DNA, 34 bp, Artificial Sequence
  Description of Artificial Sequence: Synthetic oligonucleotide
cactctatgaggtatttcttcacatccgtgtccc

SEQ ID NO: 357596 - DNA, 30 bp, Artificial Sequence; identical to SEQ ID NO: 233404
  Description of Artificial Sequence: Synthetic oligonucleotide

SEQ ID NO: 357597 - DNA, 34 bp, Artificial Sequence
  Description of Artificial Sequence: Synthetic oligonucleotide
actctatgaggtatttcttcacatccgtgtcccg

SEQ ID NO: 357598 - DNA, 29 bp, Artificial Sequence
  Description of Artificial Sequence: Synthetic oligonucleotide
ctgagtatccttcatagacccagcgcctg

SEQ ID NO: 357599 - DNA, 33 bp, Artificial Sequence
  Description of Artificial Sequence: Synthetic oligonucleotide
ctctatgaggtatttcttcacatccgtgtcccg

SEQ ID NO: 357600 - DNA, 29 bp, Artificial Sequence
  Description of Artificial Sequence: Synthetic oligonucleotide
tgagtatccttcatagacccagcgcctgc

SEQ ID NO: 357601 - DNA, 33 bp, Artificial Sequence
  Description of Artificial Sequence: Synthetic oligonucleotide
tctatgaggtatttcttcacatccgtgtcccgg

SEQ ID NO: 357602 - DNA, 28 bp, Artificial Sequence
  Description of Artificial Sequence: Synthetic oligonucleotide
gagtatccttcatagacccagcgcctgc

SEQ ID NO: 357603 - DNA, 32 bp, Artificial Sequence
  Description of Artificial Sequence: Synthetic oligonucleotide
ctatgaggtatttcttcacatccgtgtcccgg

SEQ ID NO: 357604 - DNA, 29 bp, Artificial Sequence
  Description of Artificial Sequence: Synthetic oligonucleotide
agtatccttcatagacccagcgcctgcag

SEQ ID NO: 357605 - DNA, 32 bp, Artificial Sequence
  Description of Artificial Sequence: Synthetic oligonucleotide
tatgaggtatttcttcacatccgtgtcccggc

SEQ ID NO: 357606 - DNA, 28 bp, Artificial Sequence
  Description of Artificial Sequence: Synthetic oligonucleotide
gtatccttcatagacccagcgcctgcag

SEQ ID NO: 357607 - DNA, 27 bp, Artificial Sequence
  Description of Artificial Sequence: Synthetic oligonucleotide
ctgaacgaggacctgcgctcttggaca

SEQ ID NO: 357608 - DNA, 28 bp, Artificial Sequence
  Description of Artificial Sequence: Synthetic oligonucleotide
tatccttcatagacccagcgcctgcagc

SEQ ID NO: 357609 - DNA, 27 bp, Artificial Sequence
  Description of Artificial Sequence: Synthetic oligonucleotide
tgaacgaggacctgcgctcttggacag

SEQ ID NO: 357610 - DNA, 27 bp, Artificial Sequence
  Description of Artificial Sequence: Synthetic oligonucleotide
atccttcatagacccagcgcctgcagc

SEQ ID NO: 357611 - DNA, 26 bp, Artificial Sequence
  Description of Artificial Sequence: Synthetic oligonucleotide
gaacgaggacctgcgctcttggacag

SEQ ID NO: 357612 - DNA, 27 bp, Artificial Sequence
  Description of Artificial Sequence: Synthetic oligonucleotide
tccttcatagacccagcgcctgcagca

SEQ ID NO: 357613 - DNA, 26 bp, Artificial Sequence
  Description of Artificial Sequence: Synthetic oligonucleotide
aacgaggacctgcgctcttggacagc

SEQ ID NO: 357614 - DNA, 26 bp, Artificial Sequence
  Description of Artificial Sequence: Synthetic oligonucleotide
ccttcatagacccagcgcctgcagca

SEQ ID NO: 357615 - DNA, 25 bp, Artificial Sequence
  Description of Artificial Sequence: Synthetic oligonucleotide
acgaggacctgcgctcttggacagc

SEQ ID NO: 357616 - DNA, 26 bp, Artificial Sequence
  Description of Artificial Sequence: Synthetic oligonucleotide
cttcatagacccagcgcctgcagcag

SEQ ID NO: 357617 - DNA, 24 bp, Artificial Sequence
  Description of Artificial Sequence: Synthetic oligonucleotide
cgaggacctgcgctcttggacagc

SEQ ID NO: 357618 - DNA, 27 bp, Artificial Sequence
  Description of Artificial Sequence: Synthetic oligonucleotide
ttcatagacccagcgcctgcagcagca

SEQ ID NO: 357619 - DNA, 24 bp, Artificial Sequence
  Description of Artificial Sequence: Synthetic oligonucleotide
gaggacctgcgctcttggacagcg

SEQ ID NO: 357620 - DNA, 26 bp, Artificial Sequence
  Description of Artificial Sequence: Synthetic oligonucleotide
tcatagacccagcgcctgcagcagca

SEQ ID NO: 357621 - DNA, 24 bp, Artificial Sequence
  Description of Artificial Sequence: Synthetic oligonucleotide
aggacctgcgctcttggacagcgg

SEQ ID NO: 357622 - DNA, 25 bp, Artificial Sequence
  Description of Artificial Sequence: Synthetic oligonucleotide
catagacccagcgcctgcagcagca

SEQ ID NO: 357623 - DNA, 23 bp, Artificial Sequence
  Description of Artificial Sequence: Synthetic oligonucleotide
ggacctgcgctcttggacagcgg

SEQ ID NO: 357624 - DNA, 27 bp, Artificial Sequence
  Description of Artificial Sequence: Synthetic oligonucleotide
atagacccagcgcctgcagcagcacaa

SEQ ID NO: 357625 - DNA, 23 bp, Artificial Sequence
  Description of Artificial Sequence: Synthetic oligonucleotide
gacctgcgctcttggacagcggc

SEQ ID NO: 357626 - DNA, 26 bp, Artificial Sequence
  Description of Artificial Sequence: Synthetic oligonucleotide
tagacccagcgcctgcagcagcacaa

SEQ ID NO: 357627 - DNA, 23 bp, Artificial Sequence
  Description of Artificial Sequence: Synthetic oligonucleotide
acctgcgctcttggacagcggcg

SEQ ID NO: 357628 - DNA, 25 bp, Artificial Sequence
  Description of Artificial Sequence: Synthetic oligonucleotide
agacccagcgcctgcagcagcacaa

SEQ ID NO: 357629 - DNA, 22 bp, Artificial Sequence
  Description of Artificial Sequence: Synthetic oligonucleotide
cctgcgctcttggacagcggcg

SEQ ID NO: 357630 - DNA, 24 bp, Artificial Sequence
  Description of Artificial Sequence: Synthetic oligonucleotide
gacccagcgcctgcagcagcacaa

SEQ ID NO: 357631 - DNA, 23 bp, Artificial Sequence
  Description of Artificial Sequence: Synthetic oligonucleotide
ctgcgctcttggacagcggcgga

SEQ ID NO: 357632 - DNA, 24 bp, Artificial Sequence
  Description of Artificial Sequence: Synthetic oligonucleotide
acccagcgcctgcagcagcacaac

SEQ ID NO: 357633 - DNA, 25 bp, Artificial Sequence
  Description of Artificial Sequence: Synthetic oligonucleotide
tgcgctcttggacagcggcggacat

SEQ ID NO: 357634 - DNA, 23 bp, Artificial Sequence
  Description of Artificial Sequence: Synthetic oligonucleotide
cccagcgcctgcagcagcacaac

SEQ ID NO: 357635 - DNA, 24 bp, Artificial Sequence
  Description of Artificial Sequence: Synthetic oligonucleotide
gcgctcttggacagcggcggacat

SEQ ID NO: 357636 - DNA, 24 bp, Artificial Sequence
  Description of Artificial Sequence: Synthetic oligonucleotide
ccagcgcctgcagcagcacaacct

SEQ ID NO: 357637 - DNA, 24 bp, Artificial Sequence
  Description of Artificial Sequence: Synthetic oligonucleotide
cgctcttggacagcggcggacatg

SEQ ID NO: 357638 - DNA, 24 bp, Artificial Sequence
  Description of Artificial Sequence: Synthetic oligonucleotide
cagcgcctgcagcagcacaacctc

SEQ ID NO: 357639 - DNA, 24 bp, Artificial Sequence
  Description of Artificial Sequence: Synthetic oligonucleotide
gctcttggacagcggcggacatgg

SEQ ID NO: 357640 - DNA, 25 bp, Artificial Sequence
  Description of Artificial Sequence: Synthetic oligonucleotide
agcgcctgcagcagcacaacctcgt

SEQ ID NO: 357641 - DNA, 25 bp, Artificial Sequence
  Description of Artificial Sequence: Synthetic oligonucleotide
ctcttggacagcggcggacatggca

SEQ ID NO: 357642 - DNA, 24 bp, Artificial Sequence
  Description of Artificial Sequence: Synthetic oligonucleotide
gcgcctgcagcagcacaacctcgt

SEQ ID NO: 357643 - DNA, 25 bp, Artificial Sequence
  Description of Artificial Sequence: Synthetic oligonucleotide
tcttggacagcggcggacatggcag

SEQ ID NO: 357644 - DNA, 24 bp, Artificial Sequence
  Description of Artificial Sequence: Synthetic oligonucleotide
cgcctgcagcagcacaacctcgtg

SEQ ID NO: 357645 - DNA, 24 bp, Artificial Sequence
  Description of Artificial Sequence: Synthetic oligonucleotide
cttggacagcggcggacatggcag

SEQ ID NO: 357646 - DNA, 25 bp, Artificial Sequence
  Description of Artificial Sequence: Synthetic oligonucleotide
gcctgcagcagcacaacctcgtggt

SEQ ID NO: 357647 - DNA, 25 bp, Artificial Sequence
  Description of Artificial Sequence: Synthetic oligonucleotide
ttggacagcggcggacatggcagct

SEQ ID NO: 357648 - DNA, 26 bp, Artificial Sequence
  Description of Artificial Sequence: Synthetic oligonucleotide
cctgcagcagcacaacctcgtggtct

SEQ ID NO: 357649 - DNA, 24 bp, Artificial Sequence
  Description of Artificial Sequence: Synthetic oligonucleotide
tggacagcggcggacatggcagct

SEQ ID NO: 357650 - DNA, 26 bp, Artificial Sequence
  Description of Artificial Sequence: Synthetic oligonucleotide
ctgcagcagcacaacctcgtggtctg

SEQ ID NO: 357651 - DNA, 23 bp, Artificial Sequence
  Description of Artificial Sequence: Synthetic oligonucleotide
ggacagcggcggacatggcagct

SEQ ID NO: 357652 - DNA, 27 bp, Artificial Sequence
  Description of Artificial Sequence: Synthetic oligonucleotide
tgcagcagcacaacctcgtggtctgct

SEQ ID NO: 357653 - DNA, 24 bp, Artificial Sequence
  Description of Artificial Sequence: Synthetic oligonucleotide
gacagcggcggacatggcagctca

SEQ ID NO: 357654 - DNA, 26 bp, Artificial Sequence
  Description of Artificial Sequence: Synthetic oligonucleotide
gcagcagcacaacctcgtggtctgct

SEQ ID NO: 357655 - DNA, 26 bp, Artificial Sequence
  Description of Artificial Sequence: Synthetic oligonucleotide
acagcggcggacatggcagctcagat

SEQ ID NO: 357656 - DNA, 27 bp, Artificial Sequence
  Description of Artificial Sequence: Synthetic oligonucleotide
cagcagcacaacctcgtggtctgctgt

SEQ ID NO: 357657 - DNA, 25 bp, Artificial Sequence
  Description of Artificial Sequence: Synthetic oligonucleotide
cagcggcggacatggcagctcagat

SEQ ID NO: 357658 - DNA, 27 bp, Artificial Sequence
  Description of Artificial Sequence: Synthetic oligonucleotide
agcagcacaacctcgtggtctgctgtg

SEQ ID NO: 357659 - DNA, 26 bp, Artificial Sequence
  Description of Artificial Sequence: Synthetic oligonucleotide
agcggcggacatggcagctcagatca

SEQ ID NO: 357660 - DNA, 27 bp, Artificial Sequence
  Description of Artificial Sequence: Synthetic oligonucleotide
gcagcacaacctcgtggtctgctgtgt

SEQ ID NO: 357661 - DNA, 33 bp, Artificial Sequence
  Description of Artificial Sequence: Synthetic oligonucleotide
gctcccactccatgaggtatttcttcacatctg

SEQ ID NO: 357662 - DNA, 27 bp, Artificial Sequence
  Description of Artificial Sequence: Synthetic oligonucleotide
cagcacaacctcgtggtctgctgtgtg

SEQ ID NO: 357663 - DNA, 34 bp, Artificial Sequence
  Description of Artificial Sequence: Synthetic oligonucleotide
ctcccactccatgaggtatttcttcacatctgtg

SEQ ID NO: 357664 - DNA, 28 bp, Artificial Sequence
  Description of Artificial Sequence: Synthetic oligonucleotide
agcacaacctcgtggtctgctgtgtgag

SEQ ID NO: 357665 - DNA, 35 bp, Artificial Sequence
  Description of Artificial Sequence: Synthetic oligonucleotide
tcccactccatgaggtatttcttcacatctgtgtc

SEQ ID NO: 357666 - DNA, 27 bp, Artificial Sequence
  Description of Artificial Sequence: Synthetic oligonucleotide
gcacaacctcgtggtctgctgtgtgag

SEQ ID NO: 357667 - DNA, 34 bp, Artificial Sequence
  Description of Artificial Sequence: Synthetic oligonucleotide
cccactccatgaggtatttcttcacatctgtgtc

SEQ ID NO: 357668 - DNA, 28 bp, Artificial Sequence
  Description of Artificial Sequence: Synthetic oligonucleotide
cacaacctcgtggtctgctgtgtgagtg

SEQ ID NO: 357669 - DNA, 34 bp, Artificial Sequence
  Description of Artificial Sequence: Synthetic oligonucleotide
ccactccatgaggtatttcttcacatctgtgtcc

SEQ ID NO: 357670 - DNA, 28 bp, Artificial Sequence
  Description of Artificial Sequence: Synthetic oligonucleotide
acaacctcgtggtctgctgtgtgagtgg

SEQ ID NO: 357671 - DNA, 34 bp, Artificial Sequence; identical to SEQ ID NO: 4604
  Description of Artificial Sequence: Synthetic oligonucleotide

SEQ ID NO: 357672 - DNA, 27 bp, Artificial Sequence
  Description of Artificial Sequence: Synthetic oligonucleotide
caacctcgtggtctgctgtgtgagtgg

SEQ ID NO: 357673 - DNA, 34 bp, Artificial Sequence; identical to SEQ ID NO: 4605
  Description of Artificial Sequence: Synthetic oligonucleotide

SEQ ID NO: 357674 - DNA, 30 bp, Artificial Sequence; identical to SEQ ID NO: 233443
  Description of Artificial Sequence: Synthetic oligonucleotide

SEQ ID NO: 357675 - DNA, 33 bp, Artificial Sequence; identical to SEQ ID NO: 4606
  Description of Artificial Sequence: Synthetic oligonucleotide

SEQ ID NO: 357676 - DNA, 29 bp, Artificial Sequence
  Description of Artificial Sequence: Synthetic oligonucleotide
acctcgtggtctgctgtgtgagtggattc

SEQ ID NO: 357677 - DNA, 33 bp, Artificial Sequence; identical to SEQ ID NO: 4607
  Description of Artificial Sequence: Synthetic oligonucleotide

SEQ ID NO: 357678 - DNA, 28 bp, Artificial Sequence
  Description of Artificial Sequence: Synthetic oligonucleotide
cctcgtggtctgctgtgtgagtggattc

SEQ ID NO: 357679 - DNA, 32 bp, Artificial Sequence; identical to SEQ ID NO: 4608
  Description of Artificial Sequence: Synthetic oligonucleotide

SEQ ID NO: 357680 - DNA, 31 bp, Artificial Sequence; identical to SEQ ID NO: 233446
  Description of Artificial Sequence: Synthetic oligonucleotide

SEQ ID NO: 357681 - DNA, 32 bp, Artificial Sequence; identical to SEQ ID NO: 4609
  Description of Artificial Sequence: Synthetic oligonucleotide

SEQ ID NO: 357682 - DNA, 31 bp, Artificial Sequence; identical to SEQ ID NO: 233447
  Description of Artificial Sequence: Synthetic oligonucleotide

SEQ ID NO: 357683 - DNA, 32 bp, Artificial Sequence; identical to SEQ ID NO: 4610
  Description of Artificial Sequence: Synthetic oligonucleotide

SEQ ID NO: 357684 - DNA, 30 bp, Artificial Sequence; identical to SEQ ID NO: 233448
  Description of Artificial Sequence: Synthetic oligonucleotide

SEQ ID NO: 357685 - DNA, 31 bp, Artificial Sequence; identical to SEQ ID NO: 4611
  Description of Artificial Sequence: Synthetic oligonucleotide

SEQ ID NO: 357686 - DNA, 31 bp, Artificial Sequence; identical to SEQ ID NO: 233449
  Description of Artificial Sequence: Synthetic oligonucleotide

SEQ ID NO: 357687 - DNA, 30 bp, Artificial Sequence; identical to SEQ ID NO: 4612
  Description of Artificial Sequence: Synthetic oligonucleotide

SEQ ID NO: 357688 - DNA, 31 bp, Artificial Sequence; identical to SEQ ID NO: 233450
  Description of Artificial Sequence: Synthetic oligonucleotide

SEQ ID NO: 357689 - DNA, 30 bp, Artificial Sequence; identical to SEQ ID NO: 4613
  Description of Artificial Sequence: Synthetic oligonucleotide

SEQ ID NO: 357690 - DNA, 30 bp, Artificial Sequence; identical to SEQ ID NO: 233451
  Description of Artificial Sequence: Synthetic oligonucleotide

SEQ ID NO: 357691 - DNA, 29 bp, Artificial Sequence
  Description of Artificial Sequence: Synthetic oligonucleotide
ggtatttcttcacatctgtgtcccggccc

SEQ ID NO: 357692 - DNA, 30 bp, Artificial Sequence; identical to SEQ ID NO: 233452
  Description of Artificial Sequence: Synthetic oligonucleotide

SEQ ID NO: 357693 - DNA, 29 bp, Artificial Sequence
  Description of Artificial Sequence: Synthetic oligonucleotide
gtatttcttcacatctgtgtcccggcccg

SEQ ID NO: 357694 - DNA, 31 bp, Artificial Sequence; identical to SEQ ID NO: 233453
  Description of Artificial Sequence: Synthetic oligonucleotide

SEQ ID NO: 357695 - DNA, 29 bp, Artificial Sequence
  Description of Artificial Sequence: Synthetic oligonucleotide
tatttcttcacatctgtgtcccggcccgg

SEQ ID NO: 357696 - DNA, 30 bp, Artificial Sequence; identical to SEQ ID NO: 233454
  Description of Artificial Sequence: Synthetic oligonucleotide

SEQ ID NO: 357697 - DNA, 28 bp, Artificial Sequence
  Description of Artificial Sequence: Synthetic oligonucleotide
atttcttcacatctgtgtcccggcccgg

SEQ ID NO: 357698 - DNA, 30 bp, Artificial Sequence; identical to SEQ ID NO: 233455
  Description of Artificial Sequence: Synthetic oligonucleotide

SEQ ID NO: 357699 - DNA, 27 bp, Artificial Sequence
  Description of Artificial Sequence: Synthetic oligonucleotide
tttcttcacatctgtgtcccggcccgg

SEQ ID NO: 357700 - DNA, 29 bp, Artificial Sequence
  Description of Artificial Sequence: Synthetic oligonucleotide
gctgtgtgagtggattctatccacgcagc

SEQ ID NO: 357701 - DNA, 26 bp, Artificial Sequence
  Description of Artificial Sequence: Synthetic oligonucleotide
ttcttcacatctgtgtcccggcccgg

SEQ ID NO: 357702 - DNA, 32 bp, Artificial Sequence; identical to SEQ ID NO: 233457
  Description of Artificial Sequence: Synthetic oligonucleotide

SEQ ID NO: 357703 - DNA, 25 bp, Artificial Sequence
  Description of Artificial Sequence: Synthetic oligonucleotide
tcttcacatctgtgtcccggcccgg

SEQ ID NO: 357704 - DNA, 34 bp, Artificial Sequence; identical to SEQ ID NO: 233458
  Description of Artificial Sequence: Synthetic oligonucleotide

SEQ ID NO: 357705 - DNA, 24 bp, Artificial Sequence
  Description of Artificial Sequence: Synthetic oligonucleotide
cttcacatctgtgtcccggcccgg

SEQ ID NO: 357706 - DNA, 33 bp, Artificial Sequence; identical to SEQ ID NO: 233459
  Description of Artificial Sequence: Synthetic oligonucleotide

SEQ ID NO: 357707 - DNA, 24 bp, Artificial Sequence
  Description of Artificial Sequence: Synthetic oligonucleotide
ttcacatctgtgtcccggcccggc

SEQ ID NO: 357708 - DNA, 34 bp, Artificial Sequence; identical to SEQ ID NO: 233460
  Description of Artificial Sequence: Synthetic oligonucleotide

SEQ ID NO: 357709 - DNA, 23 bp, Artificial Sequence
  Description of Artificial Sequence: Synthetic oligonucleotide
tcacatctgtgtcccggcccggc

SEQ ID NO: 357710 - DNA, 33 bp, Artificial Sequence; identical to SEQ ID NO: 233461
  Description of Artificial Sequence: Synthetic oligonucleotide

SEQ ID NO: 357711 - DNA, 22 bp, Artificial Sequence
  Description of Artificial Sequence: Synthetic oligonucleotide
cacatctgtgtcccggcccggc

SEQ ID NO: 357712 - DNA, 34 bp, Artificial Sequence; identical to SEQ ID NO: 233462
  Description of Artificial Sequence: Synthetic oligonucleotide

SEQ ID NO: 357713 - DNA, 22 bp, Artificial Sequence
  Description of Artificial Sequence: Synthetic oligonucleotide
acatctgtgtcccggcccggcc

SEQ ID NO: 357714 - DNA, 33 bp, Artificial Sequence; identical to SEQ ID NO: 233463
  Description of Artificial Sequence: Synthetic oligonucleotide

SEQ ID NO: 357715 - DNA, 21 bp, Artificial Sequence
  Description of Artificial Sequence: Synthetic oligonucleotide
catctgtgtcccggcccggcc

SEQ ID NO: 357716 - DNA, 33 bp, Artificial Sequence; identical to SEQ ID NO: 233464
  Description of Artificial Sequence: Synthetic oligonucleotide

SEQ ID NO: 357717 - DNA, 21 bp, Artificial Sequence
  Description of Artificial Sequence: Synthetic oligonucleotide
atctgtgtcccggcccggccg

SEQ ID NO: 357718 - DNA, 32 bp, Artificial Sequence; identical to SEQ ID NO: 233465
  Description of Artificial Sequence: Synthetic oligonucleotide

SEQ ID NO: 357719 - DNA, 20 bp, Artificial Sequence
  Description of Artificial Sequence: Synthetic oligonucleotide
tctgtgtcccggcccggccg

SEQ ID NO: 357720 - DNA, 33 bp, Artificial Sequence; identical to SEQ ID NO: 233466
  Description of Artificial Sequence: Synthetic oligonucleotide

SEQ ID NO: 357721 - DNA, 20 bp, Artificial Sequence
  Description of Artificial Sequence: Synthetic oligonucleotide
ctgtgtcccggcccggccgt

SEQ ID NO: 357722 - DNA, 32 bp, Artificial Sequence; identical to SEQ ID NO: 233467
  Description of Artificial Sequence: Synthetic oligonucleotide

SEQ ID NO: 357723 - DNA, 20 bp, Artificial Sequence
  Description of Artificial Sequence: Synthetic oligonucleotide
tgtgtcccggcccggccgct

SEQ ID NO: 357724 - DNA, 32 bp, Artificial Sequence; identical to SEQ ID NO: 233468
  Description of Artificial Sequence: Synthetic oligonucleotide

SEQ ID NO: 357725 - DNA, 21 bp, Artificial Sequence
  Description of Artificial Sequence: Synthetic oligonucleotide
tgcgacgtggggccggacgga

SEQ ID NO: 357726 - DNA, 34 bp, Artificial Sequence; identical to SEQ ID NO: 233469
  Description of Artificial Sequence: Synthetic oligonucleotide

SEQ ID NO: 357727 - DNA, 20 bp, Artificial Sequence
  Description of Artificial Sequence: Synthetic oligonucleotide
gcgacgtggggccggacgga

SEQ ID NO: 357728 - DNA, 33 bp, Artificial Sequence; identical to SEQ ID NO: 233470
  Description of Artificial Sequence: Synthetic oligonucleotide

SEQ ID NO: 357729 - DNA, 20 bp, Artificial Sequence
  Description of Artificial Sequence: Synthetic oligonucleotide
cgacgtggggccggacggac

SEQ ID NO: 357730 - DNA, 32 bp, Artificial Sequence; identical to SEQ ID NO: 233471
  Description of Artificial Sequence: Synthetic oligonucleotide

SEQ ID NO: 357731 - DNA, 20 bp, Artificial Sequence
  Description of Artificial Sequence: Synthetic oligonucleotide
gacgtggggccggacggacg

SEQ ID NO: 357732 - DNA, 31 bp, Artificial Sequence; identical to SEQ ID NO: 233472
  Description of Artificial Sequence: Synthetic oligonucleotide

SEQ ID NO: 357733 - DNA, 22 bp, Artificial Sequence
  Description of Artificial Sequence: Synthetic oligonucleotide
acgtggggccggacggacgctt

SEQ ID NO: 357734 - DNA, 31 bp, Artificial Sequence; identical to SEQ ID NO: 233473
  Description of Artificial Sequence: Synthetic oligonucleotide

SEQ ID NO: 357735 - DNA, 21 bp, Artificial Sequence
  Description of Artificial Sequence: Synthetic oligonucleotide
cgtggggccggacggacgctt

SEQ ID NO: 357736 - DNA, 30 bp, Artificial Sequence; identical to SEQ ID NO: 233474
  Description of Artificial Sequence: Synthetic oligonucleotide

SEQ ID NO: 357737 - DNA, 21 bp, Artificial Sequence
  Description of Artificial Sequence: Synthetic oligonucleotide
gtggggccggacggacgcttc

SEQ ID NO: 357738 - DNA, 29 bp, Artificial Sequence
  Description of Artificial Sequence: Synthetic oligonucleotide
tccacgcagcattgtagtcaggtgcttcc

SEQ ID NO: 357739 - DNA, 22 bp, Artificial Sequence
  Description of Artificial Sequence: Synthetic oligonucleotide
tggggccggacggacgcttcct

SEQ ID NO: 357740 - DNA, 28 bp, Artificial Sequence
  Description of Artificial Sequence: Synthetic oligonucleotide
ccacgcagcattgtagtcaggtgcttcc

SEQ ID NO: 357741 - DNA, 21 bp, Artificial Sequence
  Description of Artificial Sequence: Synthetic oligonucleotide
ggggccggacggacgcttcct

SEQ ID NO: 357742 - DNA, 28 bp, Artificial Sequence
  Description of Artificial Sequence: Synthetic oligonucleotide
cacgcagcattgtagtcaggtgcttccg

SEQ ID NO: 357743 - DNA, 21 bp, Artificial Sequence
  Description of Artificial Sequence: Synthetic oligonucleotide
gggccggacggacgcttcctc

SEQ ID NO: 357744 - DNA, 28 bp, Artificial Sequence
  Description of Artificial Sequence: Synthetic oligonucleotide
acgcagcattgtagtcaggtgcttccgg

SEQ ID NO: 357745 - DNA, 21 bp, Artificial Sequence
  Description of Artificial Sequence: Synthetic oligonucleotide
ggccggacggacgcttcctcc

SEQ ID NO: 357746 - DNA, 27 bp, Artificial Sequence
  Description of Artificial Sequence: Synthetic oligonucleotide
cgcagcattgtagtcaggtgcttccgg

SEQ ID NO: 357747 - DNA, 21 bp, Artificial Sequence
  Description of Artificial Sequence: Synthetic oligonucleotide
gccggacggacgcttcctccg

SEQ ID NO: 357748 - DNA, 29 bp, Artificial Sequence
  Description of Artificial Sequence: Synthetic oligonucleotide
gcagcattgtagtcaggtgcttccggaac

SEQ ID NO: 357749 - DNA, 21 bp, Artificial Sequence
  Description of Artificial Sequence: Synthetic oligonucleotide
ccggacggacgcttcctccgc

SEQ ID NO: 357750 - DNA, 29 bp, Artificial Sequence
  Description of Artificial Sequence: Synthetic oligonucleotide
cagcattgtagtcaggtgcttccggaacc

SEQ ID NO: 357751 - DNA, 21 bp, Artificial Sequence
  Description of Artificial Sequence: Synthetic oligonucleotide
cggacggacgcttcctccgcg

SEQ ID NO: 357752 - DNA, 29 bp, Artificial Sequence
  Description of Artificial Sequence: Synthetic oligonucleotide
agcattgtagtcaggtgcttccggaaccg

SEQ ID NO: 357753 - DNA, 21 bp, Artificial Sequence
  Description of Artificial Sequence: Synthetic oligonucleotide
ggacggacgcttcctccgcgg

SEQ ID NO: 357754 - DNA, 28 bp, Artificial Sequence
  Description of Artificial Sequence: Synthetic oligonucleotide
gcattgtagtcaggtgcttccggaaccg

SEQ ID NO: 357755 - DNA, 23 bp, Artificial Sequence
  Description of Artificial Sequence: Synthetic oligonucleotide
gacggacgcttcctccgcgggta

SEQ ID NO: 357756 - DNA, 28 bp, Artificial Sequence
  Description of Artificial Sequence: Synthetic oligonucleotide
cattgtagtcaggtgcttccggaaccgc

SEQ ID NO: 357757 - DNA, 23 bp, Artificial Sequence
  Description of Artificial Sequence: Synthetic oligonucleotide
acggacgcttcctccgcgggtac

SEQ ID NO: 357758 - DNA, 28 bp, Artificial Sequence
  Description of Artificial Sequence: Synthetic oligonucleotide
attgtagtcaggtgcttccggaaccgcc

SEQ ID NO: 357759 - DNA, 22 bp, Artificial Sequence
  Description of Artificial Sequence: Synthetic oligonucleotide
cggacgcttcctccgcgggtac

SEQ ID NO: 357760 - DNA, 27 bp, Artificial Sequence
  Description of Artificial Sequence: Synthetic oligonucleotide
ttgtagtcaggtgcttccggaaccgcc

SEQ ID NO: 357761 - DNA, 22 bp, Artificial Sequence
  Description of Artificial Sequence: Synthetic oligonucleotide
ggacgcttcctccgcgggtacc

SEQ ID NO: 357762 - DNA, 27 bp, Artificial Sequence
  Description of Artificial Sequence: Synthetic oligonucleotide
tgtagtcaggtgcttccggaaccgcca

SEQ ID NO: 357763 - DNA, 22 bp, Artificial Sequence
  Description of Artificial Sequence: Synthetic oligonucleotide
gacgcttcctccgcgggtaccg

SEQ ID NO: 357764 - DNA, 26 bp, Artificial Sequence
  Description of Artificial Sequence: Synthetic oligonucleotide
gtagtcaggtgcttccggaaccgcca

SEQ ID NO: 357765 - DNA, 22 bp, Artificial Sequence
  Description of Artificial Sequence: Synthetic oligonucleotide
acgcttcctccgcgggtaccgg

SEQ ID NO: 357766 - DNA, 26 bp, Artificial Sequence
  Description of Artificial Sequence: Synthetic oligonucleotide
tagtcaggtgcttccggaaccgccag

SEQ ID NO: 357767 - DNA, 27 bp, Artificial Sequence
  Description of Artificial Sequence: Synthetic oligonucleotide
ataatgtatggctgcgacgtggggccc

SEQ ID NO: 357768 - DNA, 25 bp, Artificial Sequence
  Description of Artificial Sequence: Synthetic oligonucleotide
agtcaggtgcttccggaaccgccag

SEQ ID NO: 357769 - DNA, 26 bp, Artificial Sequence
  Description of Artificial Sequence: Synthetic oligonucleotide
taatgtatggctgcgacgtggggccc

SEQ ID NO: 357770 - DNA, 24 bp, Artificial Sequence
  Description of Artificial Sequence: Synthetic oligonucleotide
gtcaggtgcttccggaaccgccag

SEQ ID NO: 357771 - DNA, 25 bp, Artificial Sequence
  Description of Artificial Sequence: Synthetic oligonucleotide
aatgtatggctgcgacgtggggccc

SEQ ID NO: 357772 - DNA, 26 bp, Artificial Sequence
  Description of Artificial Sequence: Synthetic oligonucleotide
tcaggtgcttccggaaccgccaggaa

SEQ ID NO: 357773 - DNA, 24 bp, Artificial Sequence
  Description of Artificial Sequence: Synthetic oligonucleotide
atgtatggctgcgacgtggggccc

SEQ ID NO: 357774 - DNA, 25 bp, Artificial Sequence
  Description of Artificial Sequence: Synthetic oligonucleotide
caggtgcttccggaaccgccaggaa

SEQ ID NO: 357775 - DNA, 23 bp, Artificial Sequence
  Description of Artificial Sequence: Synthetic oligonucleotide
tgtatggctgcgacgtggggccc

SEQ ID NO: 357776 - DNA, 26 bp, Artificial Sequence
  Description of Artificial Sequence: Synthetic oligonucleotide
aggtgcttccggaaccgccaggaagt

SEQ ID NO: 357777 - DNA, 22 bp, Artificial Sequence
  Description of Artificial Sequence: Synthetic oligonucleotide
gtatggctgcgacgtggggccc

SEQ ID NO: 357778 - DNA, 25 bp, Artificial Sequence
  Description of Artificial Sequence: Synthetic oligonucleotide
ggtgcttccggaaccgccaggaagt

SEQ ID NO: 357779 - DNA, 23 bp, Artificial Sequence
  Description of Artificial Sequence: Synthetic oligonucleotide
tatggctgcgacgtggggcccga

SEQ ID NO: 357780 - DNA, 27 bp, Artificial Sequence
  Description of Artificial Sequence: Synthetic oligonucleotide
gtgcttccggaaccgccaggaagtgaa

SEQ ID NO: 357781 - DNA, 22 bp, Artificial Sequence
  Description of Artificial Sequence: Synthetic oligonucleotide
atggctgcgacgtggggcccga

SEQ ID NO: 357782 - DNA, 27 bp, Artificial Sequence
  Description of Artificial Sequence: Synthetic oligonucleotide
tgcttccggaaccgccaggaagtgaag

SEQ ID NO: 357783 - DNA, 21 bp, Artificial Sequence
  Description of Artificial Sequence: Synthetic oligonucleotide
tggctgcgacgtggggcccga

SEQ ID NO: 357784 - DNA, 27 bp, Artificial Sequence
  Description of Artificial Sequence: Synthetic oligonucleotide
gcttccggaaccgccaggaagtgaaga

SEQ ID NO: 357785 - DNA, 20 bp, Artificial Sequence
  Description of Artificial Sequence: Synthetic oligonucleotide
ggctgcgacgtggggcccga

SEQ ID NO: 357786 - DNA, 27 bp, Artificial Sequence
  Description of Artificial Sequence: Synthetic oligonucleotide
cttccggaaccgccaggaagtgaagac

SEQ ID NO: 357787 - DNA, 20 bp, Artificial Sequence
  Description of Artificial Sequence: Synthetic oligonucleotide
gctgcgacgtggggcccgac

SEQ ID NO: 357788 - DNA, 28 bp, Artificial Sequence
  Description of Artificial Sequence: Synthetic oligonucleotide
ttccggaaccgccaggaagtgaagactg

SEQ ID NO: 357789 - DNA, 20 bp, Artificial Sequence
  Description of Artificial Sequence: Synthetic oligonucleotide
ctgcgacgtggggcccgacg

SEQ ID NO: 357790 - DNA, 27 bp, Artificial Sequence
  Description of Artificial Sequence: Synthetic oligonucleotide
tccggaaccgccaggaagtgaagactg

SEQ ID NO: 357791 - DNA, 20 bp, Artificial Sequence
  Description of Artificial Sequence: Synthetic oligonucleotide
tgcgacgtggggcccgacgg

SEQ ID NO: 357792 - DNA, 26 bp, Artificial Sequence
  Description of Artificial Sequence: Synthetic oligonucleotide
ccggaaccgccaggaagtgaagactg

SEQ ID NO: 357793 - DNA, 20 bp, Artificial Sequence
  Description of Artificial Sequence: Synthetic oligonucleotide
gcgacgtggggcccgacggt

SEQ ID NO: 357794 - DNA, 26 bp, Artificial Sequence
  Description of Artificial Sequence: Synthetic oligonucleotide
cggaaccgccaggaagtgaagactgg

SEQ ID NO: 357795 - DNA, 20 bp, Artificial Sequence
  Description of Artificial Sequence: Synthetic oligonucleotide
cgacgtggggcccgacgggt

SEQ ID NO: 357796 - DNA, 26 bp, Artificial Sequence
  Description of Artificial Sequence: Synthetic oligonucleotide
ggaaccgccaggaagtgaagactggc

SEQ ID NO: 357797 - DNA, 20 bp, Artificial Sequence
  Description of Artificial Sequence: Synthetic oligonucleotide
gacgtggggcccgacgggct

SEQ ID NO: 357798 - DNA, 27 bp, Artificial Sequence
  Description of Artificial Sequence: Synthetic oligonucleotide
gaaccgccaggaagtgaagactggcgt

SEQ ID NO: 357799 - DNA, 20 bp, Artificial Sequence
  Description of Artificial Sequence: Synthetic oligonucleotide
acgtggggcccgacgggcgt

SEQ ID NO: 357800 - DNA, 27 bp, Artificial Sequence
  Description of Artificial Sequence: Synthetic oligonucleotide
aaccgccaggaagtgaagactggcgtg

SEQ ID NO: 357801 - DNA, 20 bp, Artificial Sequence
  Description of Artificial Sequence: Synthetic oligonucleotide
cgtggggcccgacgggcgtt

SEQ ID NO: 357802 - DNA, 26 bp, Artificial Sequence
  Description of Artificial Sequence: Synthetic oligonucleotide
accgccaggaagtgaagactggcgtg

SEQ ID NO: 357803 - DNA, 20 bp, Artificial Sequence
  Description of Artificial Sequence: Synthetic oligonucleotide
gtggggcccgacgggcgctt

SEQ ID NO: 357804 - DNA, 25 bp, Artificial Sequence
  Description of Artificial Sequence: Synthetic oligonucleotide
ccgccaggaagtgaagactggcgtg

SEQ ID NO: 357805 - DNA, 20 bp, Artificial Sequence
  Description of Artificial Sequence: Synthetic oligonucleotide
tggggcccgacgggcgcttc

SEQ ID NO: 357806 - DNA, 26 bp, Artificial Sequence
  Description of Artificial Sequence: Synthetic oligonucleotide
cgccaggaagtgaagactggcgtggt

SEQ ID NO: 357807 - DNA, 20 bp, Artificial Sequence
  Description of Artificial Sequence: Synthetic oligonucleotide
ggggcccgacgggcgcttct

SEQ ID NO: 357808 - DNA, 27 bp, Artificial Sequence
  Description of Artificial Sequence: Synthetic oligonucleotide
gccaggaagtgaagactggcgtggtgt

SEQ ID NO: 357809 - DNA, 20 bp, Artificial Sequence
  Description of Artificial Sequence: Synthetic oligonucleotide
gggcccgacgggcgcttcct

SEQ ID NO: 357810 - DNA, 27 bp, Artificial Sequence
  Description of Artificial Sequence: Synthetic oligonucleotide
ccaggaagtgaagactggcgtggtgtc

SEQ ID NO: 357811 - DNA, 20 bp, Artificial Sequence
  Description of Artificial Sequence: Synthetic oligonucleotide
ggcccgacgggcgcttcctc

SEQ ID NO: 357812 - DNA, 27 bp, Artificial Sequence
  Description of Artificial Sequence: Synthetic oligonucleotide
caggaagtgaagactggcgtggtgtcc

SEQ ID NO: 357813 - DNA, 20 bp, Artificial Sequence
  Description of Artificial Sequence: Synthetic oligonucleotide
gcccgacgggcgcttcctcc

SEQ ID NO: 357814 - DNA, 28 bp, Artificial Sequence
  Description of Artificial Sequence: Synthetic oligonucleotide
aggaagtgaagactggcgtggtgtcctc

SEQ ID NO: 357815 - DNA, 20 bp, Artificial Sequence
  Description of Artificial Sequence: Synthetic oligonucleotide
cccgacgggcgcttcctccg

SEQ ID NO: 357816 - DNA, 27 bp, Artificial Sequence
  Description of Artificial Sequence: Synthetic oligonucleotide
ggaagtgaagactggcgtggtgtcctc

SEQ ID NO: 357817 - DNA, 20 bp, Artificial Sequence
  Description of Artificial Sequence: Synthetic oligonucleotide
ccgacgggcgcttcctccgc

SEQ ID NO: 357818 - DNA, 28 bp, Artificial Sequence
  Description of Artificial Sequence: Synthetic oligonucleotide
gaagtgaagactggcgtggtgtcctcag

SEQ ID NO: 357819 - DNA, 20 bp, Artificial Sequence
  Description of Artificial Sequence: Synthetic oligonucleotide
cgacgggcgcttcctccgcg

SEQ ID NO: 357820 - DNA, 28 bp, Artificial Sequence
  Description of Artificial Sequence: Synthetic oligonucleotide
aagtgaagactggcgtggtgtcctcagg

SEQ ID NO: 357821 - DNA, 23 bp, Artificial Sequence
  Description of Artificial Sequence: Synthetic oligonucleotide
ccccgcttcatcgccgtggggta

SEQ ID NO: 357822 - DNA, 27 bp, Artificial Sequence
  Description of Artificial Sequence: Synthetic oligonucleotide
agtgaagactggcgtggtgtcctcagg

SEQ ID NO: 357823 - DNA, 23 bp, Artificial Sequence
  Description of Artificial Sequence: Synthetic oligonucleotide
cccgcttcatcgccgtggggtac

SEQ ID NO: 357824 - DNA, 26 bp, Artificial Sequence
  Description of Artificial Sequence: Synthetic oligonucleotide
gtgaagactggcgtggtgtcctcagg

SEQ ID NO: 357825 - DNA, 24 bp, Artificial Sequence
  Description of Artificial Sequence: Synthetic oligonucleotide
ccgcttcatcgccgtggggtacgt

SEQ ID NO: 357826 - DNA, 26 bp, Artificial Sequence
  Description of Artificial Sequence: Synthetic oligonucleotide
tgaagactggcgtggtgtcctcaggc

SEQ ID NO: 357827 - DNA, 24 bp, Artificial Sequence
  Description of Artificial Sequence: Synthetic oligonucleotide
cgcttcatcgccgtggggtacgtg

SEQ ID NO: 357828 - DNA, 25 bp, Artificial Sequence
  Description of Artificial Sequence: Synthetic oligonucleotide
gaagactggcgtggtgtcctcaggc

SEQ ID NO: 357829 - DNA, 25 bp, Artificial Sequence
  Description of Artificial Sequence: Synthetic oligonucleotide
gcttcatcgccgtggggtacgtgga

SEQ ID NO: 357830 - DNA, 26 bp, Artificial Sequence
  Description of Artificial Sequence: Synthetic oligonucleotide
aagactggcgtggtgtcctcaggcct

SEQ ID NO: 357831 - DNA, 25 bp, Artificial Sequence
  Description of Artificial Sequence: Synthetic oligonucleotide
cttcatcgccgtggggtacgtggac

SEQ ID NO: 357832 - DNA, 25 bp, Artificial Sequence
  Description of Artificial Sequence: Synthetic oligonucleotide
agactggcgtggtgtcctcaggcct

SEQ ID NO: 357833 - DNA, 26 bp, Artificial Sequence
  Description of Artificial Sequence: Synthetic oligonucleotide
ttcatcgccgtggggtacgtggacga

SEQ ID NO: 357834 - DNA, 24 bp, Artificial Sequence
  Description of Artificial Sequence: Synthetic oligonucleotide
gactggcgtggtgtcctcaggcct

SEQ ID NO: 357835 - DNA, 25 bp, Artificial Sequence
  Description of Artificial Sequence: Synthetic oligonucleotide
tcatcgccgtggggtacgtggacga

SEQ ID NO: 357836 - DNA, 26 bp, Artificial Sequence
  Description of Artificial Sequence: Synthetic oligonucleotide
actggcgtggtgtcctcaggcctgaa

SEQ ID NO: 357837 - DNA, 24 bp, Artificial Sequence
  Description of Artificial Sequence: Synthetic oligonucleotide
catcgccgtggggtacgtggacga

SEQ ID NO: 357838 - DNA, 25 bp, Artificial Sequence
  Description of Artificial Sequence: Synthetic oligonucleotide
ctggcgtggtgtcctcaggcctgaa

SEQ ID NO: 357839 - DNA, 25 bp, Artificial Sequence
  Description of Artificial Sequence: Synthetic oligonucleotide
atcgccgtggggtacgtggacgaca

SEQ ID NO: 357840 - DNA, 25 bp, Artificial Sequence
  Description of Artificial Sequence: Synthetic oligonucleotide
tggcgtggtgtcctcaggcctgaac

SEQ ID NO: 357841 - DNA, 24 bp, Artificial Sequence
  Description of Artificial Sequence: Synthetic oligonucleotide
tcgccgtggggtacgtggacgaca

SEQ ID NO: 357842 - DNA, 24 bp, Artificial Sequence
  Description of Artificial Sequence: Synthetic oligonucleotide
ggcgtggtgtcctcaggcctgaac

SEQ ID NO: 357843 - DNA, 23 bp, Artificial Sequence
  Description of Artificial Sequence: Synthetic oligonucleotide
cgccgtggggtacgtggacgaca

SEQ ID NO: 357844 - DNA, 25 bp, Artificial Sequence
  Description of Artificial Sequence: Synthetic oligonucleotide
gcgtggtgtcctcaggcctgaacca

SEQ ID NO: 357845 - DNA, 23 bp, Artificial Sequence
  Description of Artificial Sequence: Synthetic oligonucleotide
gccgtggggtacgtggacgacac

SEQ ID NO: 357846 - DNA, 27 bp, Artificial Sequence
  Description of Artificial Sequence: Synthetic oligonucleotide
cgtggtgtcctcaggcctgaaccagaa

SEQ ID NO: 357847 - DNA, 23 bp, Artificial Sequence
  Description of Artificial Sequence: Synthetic oligonucleotide
ccgtggggtacgtggacgacacg

SEQ ID NO: 357848 - DNA, 28 bp, Artificial Sequence
  Description of Artificial Sequence: Synthetic oligonucleotide
gtggtgtcctcaggcctgaaccagaatg

SEQ ID NO: 357849 - DNA, 24 bp, Artificial Sequence
  Description of Artificial Sequence: Synthetic oligonucleotide
cgtggggtacgtggacgacacgca

SEQ ID NO: 357850 - DNA, 28 bp, Artificial Sequence
  Description of Artificial Sequence: Synthetic oligonucleotide
tggtgtcctcaggcctgaaccagaatgg

SEQ ID NO: 357851 - DNA, 26 bp, Artificial Sequence
  Description of Artificial Sequence: Synthetic oligonucleotide
gtggggtacgtggacgacacgcagtt

SEQ ID NO: 357852 - DNA, 27 bp, Artificial Sequence
  Description of Artificial Sequence: Synthetic oligonucleotide
ggtgtcctcaggcctgaaccagaatgg

SEQ ID NO: 357853 - DNA, 26 bp, Artificial Sequence
  Description of Artificial Sequence: Synthetic oligonucleotide
tggggtacgtggacgacacgcagttc

SEQ ID NO: 357854 - DNA, 28 bp, Artificial Sequence
  Description of Artificial Sequence: Synthetic oligonucleotide
gtgtcctcaggcctgaaccagaatggtg

SEQ ID NO: 357855 - DNA, 25 bp, Artificial Sequence
  Description of Artificial Sequence: Synthetic oligonucleotide
ggggtacgtggacgacacgcagttc

SEQ ID NO: 357856 - DNA, 29 bp, Artificial Sequence
  Description of Artificial Sequence: Synthetic oligonucleotide
tgtcctcaggcctgaaccagaatggtgac

SEQ ID NO: 357857 - DNA, 26 bp, Artificial Sequence
  Description of Artificial Sequence: Synthetic oligonucleotide
gggtacgtggacgacacgcagttcgt

SEQ ID NO: 357858 - DNA, 28 bp, Artificial Sequence
  Description of Artificial Sequence: Synthetic oligonucleotide
gtcctcaggcctgaaccagaatggtgac

SEQ ID NO: 357859 - DNA, 26 bp, Artificial Sequence
  Description of Artificial Sequence: Synthetic oligonucleotide
ggtacgtggacgacacgcagttcgtg

SEQ ID NO: 357860 - DNA, 29 bp, Artificial Sequence
  Description of Artificial Sequence: Synthetic oligonucleotide
tcctcaggcctgaaccagaatggtgactg

SEQ ID NO: 357861 - DNA, 26 bp, Artificial Sequence
  Description of Artificial Sequence: Synthetic oligonucleotide
gtacgtggacgacacgcagttcgtgc

SEQ ID NO: 357862 - DNA, 28 bp, Artificial Sequence
  Description of Artificial Sequence: Synthetic oligonucleotide
cctcaggcctgaaccagaatggtgactg

SEQ ID NO: 357863 - DNA, 24 bp, Artificial Sequence
  Description of Artificial Sequence: Synthetic oligonucleotide
agaagatggagccgcgggcgcctt

SEQ ID NO: 357864 - DNA, 28 bp, Artificial Sequence
  Description of Artificial Sequence: Synthetic oligonucleotide
ctcaggcctgaaccagaatggtgactgg

SEQ ID NO: 357865 - DNA, 23 bp, Artificial Sequence
  Description of Artificial Sequence: Synthetic oligonucleotide
gaagatggagccgcgggcgcctt

SEQ ID NO: 357866 - DNA, 29 bp, Artificial Sequence
  Description of Artificial Sequence: Synthetic oligonucleotide
tcaggcctgaaccagaatggtgactggac

SEQ ID NO: 357867 - DNA, 23 bp, Artificial Sequence
  Description of Artificial Sequence: Synthetic oligonucleotide
aagatggagccgcgggcgccttg

SEQ ID NO: 357868 - DNA, 28 bp, Artificial Sequence
  Description of Artificial Sequence: Synthetic oligonucleotide
caggcctgaaccagaatggtgactggac

SEQ ID NO: 357869 - DNA, 22 bp, Artificial Sequence
  Description of Artificial Sequence: Synthetic oligonucleotide
agatggagccgcgggcgccttg

SEQ ID NO: 357870 - DNA, 28 bp, Artificial Sequence
  Description of Artificial Sequence: Synthetic oligonucleotide
aggcctgaaccagaatggtgactggacc

SEQ ID NO: 357871 - DNA, 21 bp, Artificial Sequence
  Description of Artificial Sequence: Synthetic oligonucleotide
gatggagccgcgggcgccttg

SEQ ID NO: 357872 - DNA, 27 bp, Artificial Sequence
  Description of Artificial Sequence: Synthetic oligonucleotide
ggcctgaaccagaatggtgactggacc

SEQ ID NO: 357873 - DNA, 24 bp, Artificial Sequence
  Description of Artificial Sequence: Synthetic oligonucleotide
atggagccgcgggcgccttggata

SEQ ID NO: 357874 - DNA, 29 bp, Artificial Sequence
  Description of Artificial Sequence: Synthetic oligonucleotide
gcctgaaccagaatggtgactggaccatc

SEQ ID NO: 357875 - DNA, 23 bp, Artificial Sequence
  Description of Artificial Sequence: Synthetic oligonucleotide
tggagccgcgggcgccttggata

SEQ ID NO: 357876 - DNA, 29 bp, Artificial Sequence
  Description of Artificial Sequence: Synthetic oligonucleotide
cctgaaccagaatggtgactggaccatcc

SEQ ID NO: 357877 - DNA, 22 bp, Artificial Sequence
  Description of Artificial Sequence: Synthetic oligonucleotide
ggagccgcgggcgccttggata

SEQ ID NO: 357878 - DNA, 30 bp, Artificial Sequence; identical to SEQ ID NO: 233545
  Description of Artificial Sequence: Synthetic oligonucleotide

SEQ ID NO: 357879 - DNA, 23 bp, Artificial Sequence
  Description of Artificial Sequence: Synthetic oligonucleotide
gagccgcgggcgccttggataga

SEQ ID NO: 357880 - DNA, 31 bp, Artificial Sequence; identical to SEQ ID NO: 233546
  Description of Artificial Sequence: Synthetic oligonucleotide

SEQ ID NO: 357881 - DNA, 23 bp, Artificial Sequence
  Description of Artificial Sequence: Synthetic oligonucleotide
agccgcgggcgccttggatagag

SEQ ID NO: 357882 - DNA, 30 bp, Artificial Sequence; identical to SEQ ID NO: 233547
  Description of Artificial Sequence: Synthetic oligonucleotide

SEQ ID NO: 357883 - DNA, 22 bp, Artificial Sequence
  Description of Artificial Sequence: Synthetic oligonucleotide
gccgcgggcgccttggatagag

SEQ ID NO: 357884 - DNA, 30 bp, Artificial Sequence; identical to SEQ ID NO: 233548
  Description of Artificial Sequence: Synthetic oligonucleotide

SEQ ID NO: 357885 - DNA, 23 bp, Artificial Sequence
  Description of Artificial Sequence: Synthetic oligonucleotide
ccgcgggcgccttggatagagca

SEQ ID NO: 357886 - DNA, 29 bp, Artificial Sequence
  Description of Artificial Sequence: Synthetic oligonucleotide
accagaatggtgactggaccatccagacc

SEQ ID NO: 357887 - DNA, 23 bp, Artificial Sequence
  Description of Artificial Sequence: Synthetic oligonucleotide
cgcgggcgccttggatagagcag

SEQ ID NO: 357888 - DNA, 28 bp, Artificial Sequence
  Description of Artificial Sequence: Synthetic oligonucleotide
ccagaatggtgactggaccatccagacc

SEQ ID NO: 357889 - DNA, 24 bp, Artificial Sequence
  Description of Artificial Sequence: Synthetic oligonucleotide
gcgggcgccttggatagagcagga

SEQ ID NO: 357890 - DNA, 28 bp, Artificial Sequence
  Description of Artificial Sequence: Synthetic oligonucleotide
cagaatggtgactggaccatccagaccc

SEQ ID NO: 357891 - DNA, 24 bp, Artificial Sequence
  Description of Artificial Sequence: Synthetic oligonucleotide
cgggcgccttggatagagcaggag

SEQ ID NO: 357892 - DNA, 29 bp, Artificial Sequence
  Description of Artificial Sequence: Synthetic oligonucleotide
agaatggtgactggaccatccagacccag

SEQ ID NO: 357893 - DNA, 24 bp, Artificial Sequence
  Description of Artificial Sequence: Synthetic oligonucleotide
gggcgccttggatagagcaggagg

SEQ ID NO: 357894 - DNA, 28 bp, Artificial Sequence
  Description of Artificial Sequence: Synthetic oligonucleotide
gaatggtgactggaccatccagacccag

SEQ ID NO: 357895 - DNA, 24 bp, Artificial Sequence
  Description of Artificial Sequence: Synthetic oligonucleotide
ggcgccttggatagagcaggaggg

SEQ ID NO: 357896 - DNA, 28 bp, Artificial Sequence
  Description of Artificial Sequence: Synthetic oligonucleotide
aatggtgactggaccatccagacccagg

SEQ ID NO: 357897 - DNA, 24 bp, Artificial Sequence
  Description of Artificial Sequence: Synthetic oligonucleotide
gcgccttggatagagcaggagggg

SEQ ID NO: 357898 - DNA, 27 bp, Artificial Sequence
  Description of Artificial Sequence: Synthetic oligonucleotide
atggtgactggaccatccagacccagg

SEQ ID NO: 357899 - DNA, 24 bp, Artificial Sequence
  Description of Artificial Sequence: Synthetic oligonucleotide
cgccttggatagagcaggaggggc

SEQ ID NO: 357900 - DNA, 27 bp, Artificial Sequence
  Description of Artificial Sequence: Synthetic oligonucleotide
tggtgactggaccatccagacccaggt

SEQ ID NO: 357901 - DNA, 24 bp, Artificial Sequence
  Description of Artificial Sequence: Synthetic oligonucleotide
gccttggatagagcaggaggggcc

SEQ ID NO: 357902 - DNA, 26 bp, Artificial Sequence
  Description of Artificial Sequence: Synthetic oligonucleotide
ggtgactggaccatccagacccaggt

SEQ ID NO: 357903 - DNA, 24 bp, Artificial Sequence
  Description of Artificial Sequence: Synthetic oligonucleotide
ccttggatagagcaggaggggccg

SEQ ID NO: 357904 - DNA, 27 bp, Artificial Sequence
  Description of Artificial Sequence: Synthetic oligonucleotide
gtgactggaccatccagacccaggtga

SEQ ID NO: 357905 - DNA, 25 bp, Artificial Sequence
  Description of Artificial Sequence: Synthetic oligonucleotide
cttggatagagcaggaggggccgga

SEQ ID NO: 357906 - DNA, 28 bp, Artificial Sequence
  Description of Artificial Sequence: Synthetic oligonucleotide
tgactggaccatccagacccaggtgatg

SEQ ID NO: 357907 - DNA, 27 bp, Artificial Sequence
  Description of Artificial Sequence: Synthetic oligonucleotide
ttggatagagcaggaggggccggagta

SEQ ID NO: 357908 - DNA, 27 bp, Artificial Sequence
  Description of Artificial Sequence: Synthetic oligonucleotide
gactggaccatccagacccaggtgatg

SEQ ID NO: 357909 - DNA, 26 bp, Artificial Sequence
  Description of Artificial Sequence: Synthetic oligonucleotide
agttcgtgcggttcgacagcgacgct

SEQ ID NO: 357910 - DNA, 27 bp, Artificial Sequence
  Description of Artificial Sequence: Synthetic oligonucleotide
actggaccatccagacccaggtgatgc

SEQ ID NO: 357911 - DNA, 25 bp, Artificial Sequence
  Description of Artificial Sequence: Synthetic oligonucleotide
gttcgtgcggttcgacagcgacgct

SEQ ID NO: 357912 - DNA, 27 bp, Artificial Sequence
  Description of Artificial Sequence: Synthetic oligonucleotide
ctggaccatccagacccaggtgatgca

SEQ ID NO: 357913 - DNA, 25 bp, Artificial Sequence
  Description of Artificial Sequence: Synthetic oligonucleotide
ttcgtgcggttcgacagcgacgctg

SEQ ID NO: 357914 - DNA, 27 bp, Artificial Sequence
  Description of Artificial Sequence: Synthetic oligonucleotide
tggaccatccagacccaggtgatgcag

SEQ ID NO: 357915 - DNA, 24 bp, Artificial Sequence
  Description of Artificial Sequence: Synthetic oligonucleotide
tcgtgcggttcgacagcgacgctg

SEQ ID NO: 357916 - DNA, 26 bp, Artificial Sequence
  Description of Artificial Sequence: Synthetic oligonucleotide
ggaccatccagacccaggtgatgcag

SEQ ID NO: 357917 - DNA, 23 bp, Artificial Sequence
  Description of Artificial Sequence: Synthetic oligonucleotide
cgtgcggttcgacagcgacgctg

SEQ ID NO: 357918 - DNA, 27 bp, Artificial Sequence
  Description of Artificial Sequence: Synthetic oligonucleotide
gaccatccagacccaggtgatgcagga

SEQ ID NO: 357919 - DNA, 23 bp, Artificial Sequence
  Description of Artificial Sequence: Synthetic oligonucleotide
gtgcggttcgacagcgacgctgc

SEQ ID NO: 357920 - DNA, 29 bp, Artificial Sequence
  Description of Artificial Sequence: Synthetic oligonucleotide
accatccagacccaggtgatgcaggaaac

SEQ ID NO: 357921 - DNA, 24 bp, Artificial Sequence
  Description of Artificial Sequence: Synthetic oligonucleotide
tgcggttcgacagcgacgctgcga

SEQ ID NO: 357922 - DNA, 28 bp, Artificial Sequence
  Description of Artificial Sequence: Synthetic oligonucleotide
ccatccagacccaggtgatgcaggaaac

SEQ ID NO: 357923 - DNA, 23 bp, Artificial Sequence
  Description of Artificial Sequence: Synthetic oligonucleotide
gcggttcgacagcgacgctgcga

SEQ ID NO: 357924 - DNA, 29 bp, Artificial Sequence
  Description of Artificial Sequence: Synthetic oligonucleotide
catccagacccaggtgatgcaggaaacag

SEQ ID NO: 357925 - DNA, 23 bp, Artificial Sequence
  Description of Artificial Sequence: Synthetic oligonucleotide
cggttcgacagcgacgctgcgag

SEQ ID NO: 357926 - DNA, 31 bp, Artificial Sequence; identical to SEQ ID NO: 233569
  Description of Artificial Sequence: Synthetic oligonucleotide

SEQ ID NO: 357927 - DNA, 23 bp, Artificial Sequence
  Description of Artificial Sequence: Synthetic oligonucleotide
ggttcgacagcgacgctgcgagc

SEQ ID NO: 357928 - DNA, 30 bp, Artificial Sequence; identical to SEQ ID NO: 233570
  Description of Artificial Sequence: Synthetic oligonucleotide

SEQ ID NO: 357929 - DNA, 24 bp, Artificial Sequence
  Description of Artificial Sequence: Synthetic oligonucleotide
gttcgacagcgacgctgcgagcca

SEQ ID NO: 357930 - DNA, 29 bp, Artificial Sequence
  Description of Artificial Sequence: Synthetic oligonucleotide
ccagacccaggtgatgcaggaaacagttg

SEQ ID NO: 357931 - DNA, 26 bp, Artificial Sequence
  Description of Artificial Sequence: Synthetic oligonucleotide
ttcgacagcgacgctgcgagccagaa

SEQ ID NO: 357932 - DNA, 29 bp, Artificial Sequence
  Description of Artificial Sequence: Synthetic oligonucleotide
cagacccaggtgatgcaggaaacagttgc

SEQ ID NO: 357933 - DNA, 25 bp, Artificial Sequence
  Description of Artificial Sequence: Synthetic oligonucleotide
tcgacagcgacgctgcgagccagaa

SEQ ID NO: 357934 - DNA, 30 bp, Artificial Sequence; identical to SEQ ID NO: 233573
  Description of Artificial Sequence: Synthetic oligonucleotide

SEQ ID NO: 357935 - DNA, 24 bp, Artificial Sequence
  Description of Artificial Sequence: Synthetic oligonucleotide
cgacagcgacgctgcgagccagaa

SEQ ID NO: 357936 - DNA, 29 bp, Artificial Sequence
  Description of Artificial Sequence: Synthetic oligonucleotide
gacccaggtgatgcaggaaacagttgctc

SEQ ID NO: 357937 - DNA, 26 bp, Artificial Sequence
  Description of Artificial Sequence: Synthetic oligonucleotide
gacagcgacgctgcgagccagaagat

SEQ ID NO: 357938 - DNA, 29 bp, Artificial Sequence
  Description of Artificial Sequence: Synthetic oligonucleotide
acccaggtgatgcaggaaacagttgctcg

SEQ ID NO: 357939 - DNA, 26 bp, Artificial Sequence
  Description of Artificial Sequence: Synthetic oligonucleotide
acagcgacgctgcgagccagaagatg

SEQ ID NO: 357940 - DNA, 28 bp, Artificial Sequence
  Description of Artificial Sequence: Synthetic oligonucleotide
cccaggtgatgcaggaaacagttgctcg

SEQ ID NO: 357941 - DNA, 25 bp, Artificial Sequence
  Description of Artificial Sequence: Synthetic oligonucleotide
cagcgacgctgcgagccagaagatg

SEQ ID NO: 357942 - DNA, 28 bp, Artificial Sequence
  Description of Artificial Sequence: Synthetic oligonucleotide
ccaggtgatgcaggaaacagttgctcgg

SEQ ID NO: 357943 - DNA, 26 bp, Artificial Sequence
  Description of Artificial Sequence: Synthetic oligonucleotide
agcgacgctgcgagccagaagatgga

SEQ ID NO: 357944 - DNA, 29 bp, Artificial Sequence
  Description of Artificial Sequence: Synthetic oligonucleotide
caggtgatgcaggaaacagttgctcggag

SEQ ID NO: 357945 - DNA, 25 bp, Artificial Sequence
  Description of Artificial Sequence: Synthetic oligonucleotide
gcgacgctgcgagccagaagatgga

SEQ ID NO: 357946 - DNA, 30 bp, Artificial Sequence; identical to SEQ ID NO: 233579
  Description of Artificial Sequence: Synthetic oligonucleotide

SEQ ID NO: 357947 - DNA, 25 bp, Artificial Sequence
  Description of Artificial Sequence: Synthetic oligonucleotide
cgacgctgcgagccagaagatggag

SEQ ID NO: 357948 - DNA, 29 bp, Artificial Sequence
  Description of Artificial Sequence: Synthetic oligonucleotide
ggtgatgcaggaaacagttgctcggagtg

SEQ ID NO: 357949 - DNA, 25 bp, Artificial Sequence
  Description of Artificial Sequence: Synthetic oligonucleotide
gacgctgcgagccagaagatggagc

SEQ ID NO: 357950 - DNA, 29 bp, Artificial Sequence
  Description of Artificial Sequence: Synthetic oligonucleotide
gtgatgcaggaaacagttgctcggagtgc

SEQ ID NO: 357951 - DNA, 25 bp, Artificial Sequence
  Description of Artificial Sequence: Synthetic oligonucleotide
acgctgcgagccagaagatggagcc

SEQ ID NO: 357952 - DNA, 30 bp, Artificial Sequence; identical to SEQ ID NO: 233582
  Description of Artificial Sequence: Synthetic oligonucleotide

SEQ ID NO: 357953 - DNA, 24 bp, Artificial Sequence
  Description of Artificial Sequence: Synthetic oligonucleotide
cgctgcgagccagaagatggagcc

SEQ ID NO: 357954 - DNA, 29 bp, Artificial Sequence
  Description of Artificial Sequence: Synthetic oligonucleotide
gatgcaggaaacagttgctcggagtgcag

SEQ ID NO: 357955 - DNA, 24 bp, Artificial Sequence
  Description of Artificial Sequence: Synthetic oligonucleotide
gctgcgagccagaagatggagccg

SEQ ID NO: 357956 - DNA, 30 bp, Artificial Sequence; identical to SEQ ID NO: 233584
  Description of Artificial Sequence: Synthetic oligonucleotide

SEQ ID NO: 357957 - DNA, 24 bp, Artificial Sequence
  Description of Artificial Sequence: Synthetic oligonucleotide
ctgcgagccagaagatggagccgc

SEQ ID NO: 357958 - DNA, 29 bp, Artificial Sequence
  Description of Artificial Sequence: Synthetic oligonucleotide
tgcaggaaacagttgctcggagtgcagag

SEQ ID NO: 357959 - DNA, 24 bp, Artificial Sequence
  Description of Artificial Sequence: Synthetic oligonucleotide
tgcgagccagaagatggagccgcg

SEQ ID NO: 357960 - DNA, 28 bp, Artificial Sequence
  Description of Artificial Sequence: Synthetic oligonucleotide
gcaggaaacagttgctcggagtgcagag

SEQ ID NO: 357961 - DNA, 28 bp, Artificial Sequence
  Description of Artificial Sequence: Synthetic oligonucleotide
cgggctcccactccatgaggtatttctc

SEQ ID NO: 357962 - DNA, 28 bp, Artificial Sequence
  Description of Artificial Sequence: Synthetic oligonucleotide
caggaaacagttgctcggagtgcagagg

SEQ ID NO: 357963 - DNA, 28 bp, Artificial Sequence
  Description of Artificial Sequence: Synthetic oligonucleotide
gggctcccactccatgaggtatttctcc

SEQ ID NO: 357964 - DNA, 32 bp, Artificial Sequence; identical to SEQ ID NO: 233588
  Description of Artificial Sequence: Synthetic oligonucleotide

SEQ ID NO: 357965 - DNA, 29 bp, Artificial Sequence
  Description of Artificial Sequence: Synthetic oligonucleotide
ggctcccactccatgaggtatttctccac

SEQ ID NO: 357966 - DNA, 31 bp, Artificial Sequence; identical to SEQ ID NO: 233589
  Description of Artificial Sequence: Synthetic oligonucleotide

SEQ ID NO: 357967 - DNA, 31 bp, Artificial Sequence; identical to SEQ ID NO: 1482
  Description of Artificial Sequence: Synthetic oligonucleotide

SEQ ID NO: 357968 - DNA, 32 bp, Artificial Sequence; identical to SEQ ID NO: 233590
  Description of Artificial Sequence: Synthetic oligonucleotide

SEQ ID NO: 357969 - DNA, 31 bp, Artificial Sequence; identical to SEQ ID NO: 1483
  Description of Artificial Sequence: Synthetic oligonucleotide

SEQ ID NO: 357970 - DNA, 32 bp, Artificial Sequence; identical to SEQ ID NO: 233591
  Description of Artificial Sequence: Synthetic oligonucleotide

SEQ ID NO: 357971 - DNA, 31 bp, Artificial Sequence; identical to SEQ ID NO: 1484
  Description of Artificial Sequence: Synthetic oligonucleotide

SEQ ID NO: 357972 - DNA, 31 bp, Artificial Sequence; identical to SEQ ID NO: 233592
  Description of Artificial Sequence: Synthetic oligonucleotide

SEQ ID NO: 357973 - DNA, 30 bp, Artificial Sequence; identical to SEQ ID NO: 1485
  Description of Artificial Sequence: Synthetic oligonucleotide

SEQ ID NO: 357974 - DNA, 30 bp, Artificial Sequence; identical to SEQ ID NO: 233593
  Description of Artificial Sequence: Synthetic oligonucleotide

SEQ ID NO: 357975 - DNA, 31 bp, Artificial Sequence; identical to SEQ ID NO: 1486
  Description of Artificial Sequence: Synthetic oligonucleotide

SEQ ID NO: 357976 - DNA, 29 bp, Artificial Sequence
  Description of Artificial Sequence: Synthetic oligonucleotide
cagttgctcggagtgcagaggtttagacc

SEQ ID NO: 357977 - DNA, 32 bp, Artificial Sequence; identical to SEQ ID NO: 1487
  Description of Artificial Sequence: Synthetic oligonucleotide

SEQ ID NO: 357978 - DNA, 30 bp, Artificial Sequence; identical to SEQ ID NO: 233595
  Description of Artificial Sequence: Synthetic oligonucleotide

SEQ ID NO: 357979 - DNA, 32 bp, Artificial Sequence; identical to SEQ ID NO: 1488
  Description of Artificial Sequence: Synthetic oligonucleotide

SEQ ID NO: 357980 - DNA, 29 bp, Artificial Sequence
  Description of Artificial Sequence: Synthetic oligonucleotide
gttgctcggagtgcagaggtttagacctg

SEQ ID NO: 357981 - DNA, 31 bp, Artificial Sequence; identical to SEQ ID NO: 1489
  Description of Artificial Sequence: Synthetic oligonucleotide

SEQ ID NO: 357982 - DNA, 29 bp, Artificial Sequence
  Description of Artificial Sequence: Synthetic oligonucleotide
ttgctcggagtgcagaggtttagacctgc

SEQ ID NO: 357983 - DNA, 31 bp, Artificial Sequence; identical to SEQ ID NO: 1490
  Description of Artificial Sequence: Synthetic oligonucleotide

SEQ ID NO: 357984 - DNA, 28 bp, Artificial Sequence
  Description of Artificial Sequence: Synthetic oligonucleotide
tgctcggagtgcagaggtttagacctgc

SEQ ID NO: 357985 - DNA, 30 bp, Artificial Sequence; identical to SEQ ID NO: 1491
  Description of Artificial Sequence: Synthetic oligonucleotide

SEQ ID NO: 357986 - DNA, 27 bp, Artificial Sequence
  Description of Artificial Sequence: Synthetic oligonucleotide
gctcggagtgcagaggtttagacctgc

SEQ ID NO: 357987 - DNA, 30 bp, Artificial Sequence; identical to SEQ ID NO: 1492
  Description of Artificial Sequence: Synthetic oligonucleotide

SEQ ID NO: 357988 - DNA, 27 bp, Artificial Sequence
  Description of Artificial Sequence: Synthetic oligonucleotide
ctcggagtgcagaggtttagacctgcc

SEQ ID NO: 357989 - DNA, 30 bp, Artificial Sequence; identical to SEQ ID NO: 1493
  Description of Artificial Sequence: Synthetic oligonucleotide

SEQ ID NO: 357990 - DNA, 29 bp, Artificial Sequence
  Description of Artificial Sequence: Synthetic oligonucleotide
tcggagtgcagaggtttagacctgccaac

SEQ ID NO: 357991 - DNA, 29 bp, Artificial Sequence
  Description of Artificial Sequence: Synthetic oligonucleotide
tgaggtatttctccacatccgtgtcccgg

SEQ ID NO: 357992 - DNA, 28 bp, Artificial Sequence
  Description of Artificial Sequence: Synthetic oligonucleotide
cggagtgcagaggtttagacctgccaac

SEQ ID NO: 357993 - DNA, 28 bp, Artificial Sequence
  Description of Artificial Sequence: Synthetic oligonucleotide
gaggtatttctccacatccgtgtcccgg

SEQ ID NO: 357994 - DNA, 29 bp, Artificial Sequence
  Description of Artificial Sequence: Synthetic oligonucleotide
ggagtgcagaggtttagacctgccaactg

SEQ ID NO: 357995 - DNA, 28 bp, Artificial Sequence
  Description of Artificial Sequence: Synthetic oligonucleotide
aggtatttctccacatccgtgtcccggc

SEQ ID NO: 357996 - DNA, 29 bp, Artificial Sequence
  Description of Artificial Sequence: Synthetic oligonucleotide
gagtgcagaggtttagacctgccaactgg

SEQ ID NO: 357997 - DNA, 27 bp, Artificial Sequence
  Description of Artificial Sequence: Synthetic oligonucleotide
ggtatttctccacatccgtgtcccggc

SEQ ID NO: 357998 - DNA, 30 bp, Artificial Sequence; identical to SEQ ID NO: 233605
  Description of Artificial Sequence: Synthetic oligonucleotide

SEQ ID NO: 357999 - DNA, 27 bp, Artificial Sequence
  Description of Artificial Sequence: Synthetic oligonucleotide
gtatttctccacatccgtgtcccggcc

SEQ ID NO: 358000 - DNA, 29 bp, Artificial Sequence
  Description of Artificial Sequence: Synthetic oligonucleotide
gtgcagaggtttagacctgccaactggag

SEQ ID NO: 358001 - DNA, 27 bp, Artificial Sequence
  Description of Artificial Sequence: Synthetic oligonucleotide
tatttctccacatccgtgtcccggccc

SEQ ID NO: 358002 - DNA, 29 bp, Artificial Sequence
  Description of Artificial Sequence: Synthetic oligonucleotide
tgcagaggtttagacctgccaactggagc

SEQ ID NO: 358003 - DNA, 26 bp, Artificial Sequence
  Description of Artificial Sequence: Synthetic oligonucleotide
atttctccacatccgtgtcccggccc

SEQ ID NO: 358004 - DNA, 28 bp, Artificial Sequence
  Description of Artificial Sequence: Synthetic oligonucleotide
gcagaggtttagacctgccaactggagc

SEQ ID NO: 358005 - DNA, 25 bp, Artificial Sequence
  Description of Artificial Sequence: Synthetic oligonucleotide
tttctccacatccgtgtcccggccc

SEQ ID NO: 358006 - DNA, 29 bp, Artificial Sequence
  Description of Artificial Sequence: Synthetic oligonucleotide
cagaggtttagacctgccaactggagcac

SEQ ID NO: 358007 - DNA, 24 bp, Artificial Sequence
  Description of Artificial Sequence: Synthetic oligonucleotide
ttctccacatccgtgtcccggccc

SEQ ID NO: 358008 - DNA, 29 bp, Artificial Sequence
  Description of Artificial Sequence: Synthetic oligonucleotide
agaggtttagacctgccaactggagcacc

SEQ ID NO: 358009 - DNA, 23 bp, Artificial Sequence
  Description of Artificial Sequence: Synthetic oligonucleotide
tctccacatccgtgtcccggccc

SEQ ID NO: 358010 - DNA, 28 bp, Artificial Sequence
  Description of Artificial Sequence: Synthetic oligonucleotide
gaggtttagacctgccaactggagcacc

SEQ ID NO: 358011 - DNA, 22 bp, Artificial Sequence
  Description of Artificial Sequence: Synthetic oligonucleotide
ctccacatccgtgtcccggccc

SEQ ID NO: 358012 - DNA, 28 bp, Artificial Sequence
  Description of Artificial Sequence: Synthetic oligonucleotide
aggtttagacctgccaactggagcaccg

SEQ ID NO: 358013 - DNA, 22 bp, Artificial Sequence
  Description of Artificial Sequence: Synthetic oligonucleotide
tccacatccgtgtcccggcccg

SEQ ID NO: 358014 - DNA, 27 bp, Artificial Sequence
  Description of Artificial Sequence: Synthetic oligonucleotide
ggtttagacctgccaactggagcaccg

SEQ ID NO: 358015 - DNA, 21 bp, Artificial Sequence
  Description of Artificial Sequence: Synthetic oligonucleotide
ccacatccgtgtcccggcccg

SEQ ID NO: 358016 - DNA, 29 bp, Artificial Sequence
  Description of Artificial Sequence: Synthetic oligonucleotide
gtttagacctgccaactggagcaccgaag

SEQ ID NO: 358017 - DNA, 22 bp, Artificial Sequence
  Description of Artificial Sequence: Synthetic oligonucleotide
acatccgtgtcccggcccggca

SEQ ID NO: 358018 - DNA, 29 bp, Artificial Sequence
  Description of Artificial Sequence: Synthetic oligonucleotide
tttagacctgccaactggagcaccgaagc

SEQ ID NO: 358019 - DNA, 21 bp, Artificial Sequence
  Description of Artificial Sequence: Synthetic oligonucleotide
catccgtgtcccggcccggca

SEQ ID NO: 358020 - DNA, 28 bp, Artificial Sequence
  Description of Artificial Sequence: Synthetic oligonucleotide
ttagacctgccaactggagcaccgaagc

SEQ ID NO: 358021 - DNA, 22 bp, Artificial Sequence
  Description of Artificial Sequence: Synthetic oligonucleotide
atccgtgtcccggcccggcagt

SEQ ID NO: 358022 - DNA, 27 bp, Artificial Sequence
  Description of Artificial Sequence: Synthetic oligonucleotide
tagacctgccaactggagcaccgaagc

SEQ ID NO: 358023 - DNA, 21 bp, Artificial Sequence
  Description of Artificial Sequence: Synthetic oligonucleotide
tccgtgtcccggcccggcagt

SEQ ID NO: 358024 - DNA, 26 bp, Artificial Sequence
  Description of Artificial Sequence: Synthetic oligonucleotide
agacctgccaactggagcaccgaagc

SEQ ID NO: 358025 - DNA, 20 bp, Artificial Sequence
  Description of Artificial Sequence: Synthetic oligonucleotide
ccgtgtcccggcccggcagt

SEQ ID NO: 358026 - DNA, 25 bp, Artificial Sequence
  Description of Artificial Sequence: Synthetic oligonucleotide
gacctgccaactggagcaccgaagc

SEQ ID NO: 358027 - DNA, 20 bp, Artificial Sequence
  Description of Artificial Sequence: Synthetic oligonucleotide
cgtgtcccggcccggcagtg

SEQ ID NO: 358028 - DNA, 26 bp, Artificial Sequence
  Description of Artificial Sequence: Synthetic oligonucleotide
acctgccaactggagcaccgaagcgt

SEQ ID NO: 358029 - DNA, 21 bp, Artificial Sequence
  Description of Artificial Sequence: Synthetic oligonucleotide
gtgtcccggcccggcagtgga

SEQ ID NO: 358030 - DNA, 25 bp, Artificial Sequence
  Description of Artificial Sequence: Synthetic oligonucleotide
cctgccaactggagcaccgaagcgt

SEQ ID NO: 358031 - DNA, 22 bp, Artificial Sequence
  Description of Artificial Sequence: Synthetic oligonucleotide
tgtcccggcccggcagtggaga

SEQ ID NO: 358032 - DNA, 26 bp, Artificial Sequence
  Description of Artificial Sequence: Synthetic oligonucleotide
ctgccaactggagcaccgaagcgtga

SEQ ID NO: 358033 - DNA, 21 bp, Artificial Sequence
  Description of Artificial Sequence: Synthetic oligonucleotide
gtcccggcccggcagtggaga

SEQ ID NO: 358034 - DNA, 27 bp, Artificial Sequence
  Description of Artificial Sequence: Synthetic oligonucleotide
tgccaactggagcaccgaagcgtgaca

SEQ ID NO: 358035 - DNA, 21 bp, Artificial Sequence
  Description of Artificial Sequence: Synthetic oligonucleotide
tcccggcccggcagtggagag

SEQ ID NO: 358036 - DNA, 27 bp, Artificial Sequence
  Description of Artificial Sequence: Synthetic oligonucleotide
gccaactggagcaccgaagcgtgacat

SEQ ID NO: 358037 - DNA, 20 bp, Artificial Sequence
  Description of Artificial Sequence: Synthetic oligonucleotide
cccggcccggcagtggagag

SEQ ID NO: 358038 - DNA, 27 bp, Artificial Sequence
  Description of Artificial Sequence: Synthetic oligonucleotide
ccaactggagcaccgaagcgtgacatg

SEQ ID NO: 358039 - DNA, 20 bp, Artificial Sequence
  Description of Artificial Sequence: Synthetic oligonucleotide
ccggcccggcagtggagagc

SEQ ID NO: 358040 - DNA, 27 bp, Artificial Sequence
  Description of Artificial Sequence: Synthetic oligonucleotide
caactggagcaccgaagcgtgacatgc

SEQ ID NO: 358041 - DNA, 20 bp, Artificial Sequence
  Description of Artificial Sequence: Synthetic oligonucleotide
cggcccggcagtggagagcc

SEQ ID NO: 358042 - DNA, 27 bp, Artificial Sequence
  Description of Artificial Sequence: Synthetic oligonucleotide
aactggagcaccgaagcgtgacatgcc

SEQ ID NO: 358043 - DNA, 20 bp, Artificial Sequence
  Description of Artificial Sequence: Synthetic oligonucleotide
ggcccggcagtggagagccc

SEQ ID NO: 358044 - DNA, 26 bp, Artificial Sequence
  Description of Artificial Sequence: Synthetic oligonucleotide
actggagcaccgaagcgtgacatgcc

SEQ ID NO: 358045 - DNA, 20 bp, Artificial Sequence
  Description of Artificial Sequence: Synthetic oligonucleotide
gcccggcagtggagagcccc

SEQ ID NO: 358046 - DNA, 25 bp, Artificial Sequence
  Description of Artificial Sequence: Synthetic oligonucleotide
ctggagcaccgaagcgtgacatgcc

SEQ ID NO: 358047 - DNA, 20 bp, Artificial Sequence
  Description of Artificial Sequence: Synthetic oligonucleotide
cccggcagtggagagccccg

SEQ ID NO: 358048 - DNA, 26 bp, Artificial Sequence
  Description of Artificial Sequence: Synthetic oligonucleotide
tggagcaccgaagcgtgacatgccct

SEQ ID NO: 358049 - DNA, 22 bp, Artificial Sequence
  Description of Artificial Sequence: Synthetic oligonucleotide
ccggcagtggagagccccgctt

SEQ ID NO: 358050 - DNA, 25 bp, Artificial Sequence
  Description of Artificial Sequence: Synthetic oligonucleotide
ggagcaccgaagcgtgacatgccct

SEQ ID NO: 358051 - DNA, 24 bp, Artificial Sequence
  Description of Artificial Sequence: Synthetic oligonucleotide
cggcagtggagagccccgcttcat

SEQ ID NO: 358052 - DNA, 26 bp, Artificial Sequence
  Description of Artificial Sequence: Synthetic oligonucleotide
gagcaccgaagcgtgacatgccctct

SEQ ID NO: 358053 - DNA, 24 bp, Artificial Sequence
  Description of Artificial Sequence: Synthetic oligonucleotide
ggcagtggagagccccgcttcatc

SEQ ID NO: 358054 - DNA, 27 bp, Artificial Sequence
  Description of Artificial Sequence: Synthetic oligonucleotide
agcaccgaagcgtgacatgccctctct

SEQ ID NO: 358055 - DNA, 24 bp, Artificial Sequence
  Description of Artificial Sequence: Synthetic oligonucleotide
gcagtggagagccccgcttcatcg

SEQ ID NO: 358056 - DNA, 26 bp, Artificial Sequence
  Description of Artificial Sequence: Synthetic oligonucleotide
gcaccgaagcgtgacatgccctctct

SEQ ID NO: 358057 - DNA, 25 bp, Artificial Sequence
  Description of Artificial Sequence: Synthetic oligonucleotide
cagtggagagccccgcttcatcgca

SEQ ID NO: 358058 - DNA, 27 bp, Artificial Sequence
  Description of Artificial Sequence: Synthetic oligonucleotide
caccgaagcgtgacatgccctctctca

SEQ ID NO: 358059 - DNA, 26 bp, Artificial Sequence
  Description of Artificial Sequence: Synthetic oligonucleotide
agtggagagccccgcttcatcgcagt

SEQ ID NO: 358060 - DNA, 27 bp, Artificial Sequence
  Description of Artificial Sequence: Synthetic oligonucleotide
accgaagcgtgacatgccctctctcag

SEQ ID NO: 358061 - DNA, 25 bp, Artificial Sequence
  Description of Artificial Sequence: Synthetic oligonucleotide
gtggagagccccgcttcatcgcagt

SEQ ID NO: 358062 - DNA, 27 bp, Artificial Sequence
  Description of Artificial Sequence: Synthetic oligonucleotide
ccgaagcgtgacatgccctctctcagt

SEQ ID NO: 358063 - DNA, 25 bp, Artificial Sequence
  Description of Artificial Sequence: Synthetic oligonucleotide
tggagagccccgcttcatcgcagtg

SEQ ID NO: 358064 - DNA, 27 bp, Artificial Sequence
  Description of Artificial Sequence: Synthetic oligonucleotide
cgaagcgtgacatgccctctctcagtg

SEQ ID NO: 358065 - DNA, 24 bp, Artificial Sequence
  Description of Artificial Sequence: Synthetic oligonucleotide
ggagagccccgcttcatcgcagtg

SEQ ID NO: 358066 - DNA, 27 bp, Artificial Sequence
  Description of Artificial Sequence: Synthetic oligonucleotide
gaagcgtgacatgccctctctcagtgg

SEQ ID NO: 358067 - DNA, 24 bp, Artificial Sequence
  Description of Artificial Sequence: Synthetic oligonucleotide
gagagccccgcttcatcgcagtgg

SEQ ID NO: 358068 - DNA, 30 bp, Artificial Sequence; identical to SEQ ID NO: 233640
  Description of Artificial Sequence: Synthetic oligonucleotide

SEQ ID NO: 358069 - DNA, 24 bp, Artificial Sequence
  Description of Artificial Sequence: Synthetic oligonucleotide
agagccccgcttcatcgcagtggg

SEQ ID NO: 358070 - DNA, 29 bp, Artificial Sequence
  Description of Artificial Sequence: Synthetic oligonucleotide
agcgtgacatgccctctctcagtggaatc

SEQ ID NO: 358071 - DNA, 28 bp, Artificial Sequence
  Description of Artificial Sequence: Synthetic oligonucleotide
cgaggacggttctcacaccatccagatg

SEQ ID NO: 358072 - DNA, 28 bp, Artificial Sequence
  Description of Artificial Sequence: Synthetic oligonucleotide
gcgtgacatgccctctctcagtggaatc

SEQ ID NO: 358073 - DNA, 30 bp, Artificial Sequence; identical to SEQ ID NO: 1553
  Description of Artificial Sequence: Synthetic oligonucleotide

SEQ ID NO: 358074 - DNA, 28 bp, Artificial Sequence
  Description of Artificial Sequence: Synthetic oligonucleotide
cgtgacatgccctctctcagtggaatcg

SEQ ID NO: 358075 - DNA, 33 bp, Artificial Sequence; identical to SEQ ID NO: 1554
  Description of Artificial Sequence: Synthetic oligonucleotide

SEQ ID NO: 358076 - DNA, 29 bp, Artificial Sequence
  Description of Artificial Sequence: Synthetic oligonucleotide
gtgacatgccctctctcagtggaatcgag

SEQ ID NO: 358077 - DNA, 32 bp, Artificial Sequence; identical to SEQ ID NO: 1555
  Description of Artificial Sequence: Synthetic oligonucleotide

SEQ ID NO: 358078 - DNA, 30 bp, Artificial Sequence; identical to SEQ ID NO: 233645
  Description of Artificial Sequence: Synthetic oligonucleotide

SEQ ID NO: 358079 - DNA, 32 bp, Artificial Sequence; identical to SEQ ID NO: 1556
  Description of Artificial Sequence: Synthetic oligonucleotide

SEQ ID NO: 358080 - DNA, 29 bp, Artificial Sequence
  Description of Artificial Sequence: Synthetic oligonucleotide
gacatgccctctctcagtggaatcgagag

SEQ ID NO: 358081 - DNA, 32 bp, Artificial Sequence; identical to SEQ ID NO: 1557
  Description of Artificial Sequence: Synthetic oligonucleotide

SEQ ID NO: 358082 - DNA, 29 bp, Artificial Sequence
  Description of Artificial Sequence: Synthetic oligonucleotide
acatgccctctctcagtggaatcgagagc

SEQ ID NO: 358083 - DNA, 31 bp, Artificial Sequence; identical to SEQ ID NO: 1558
  Description of Artificial Sequence: Synthetic oligonucleotide

SEQ ID NO: 358084 - DNA, 28 bp, Artificial Sequence
  Description of Artificial Sequence: Synthetic oligonucleotide
catgccctctctcagtggaatcgagagc

SEQ ID NO: 358085 - DNA, 32 bp, Artificial Sequence; identical to SEQ ID NO: 1559
  Description of Artificial Sequence: Synthetic oligonucleotide

SEQ ID NO: 358086 - DNA, 29 bp, Artificial Sequence
  Description of Artificial Sequence: Synthetic oligonucleotide
atgccctctctcagtggaatcgagagcac

SEQ ID NO: 358087 - DNA, 32 bp, Artificial Sequence; identical to SEQ ID NO: 1560
  Description of Artificial Sequence: Synthetic oligonucleotide

SEQ ID NO: 358088 - DNA, 28 bp, Artificial Sequence
  Description of Artificial Sequence: Synthetic oligonucleotide
tgccctctctcagtggaatcgagagcac

SEQ ID NO: 358089 - DNA, 32 bp, Artificial Sequence; identical to SEQ ID NO: 1561
  Description of Artificial Sequence: Synthetic oligonucleotide

SEQ ID NO: 358090 - DNA, 27 bp, Artificial Sequence
  Description of Artificial Sequence: Synthetic oligonucleotide
gccctctctcagtggaatcgagagcac

SEQ ID NO: 358091 - DNA, 31 bp, Artificial Sequence; identical to SEQ ID NO: 1562
  Description of Artificial Sequence: Synthetic oligonucleotide

SEQ ID NO: 358092 - DNA, 27 bp, Artificial Sequence
  Description of Artificial Sequence: Synthetic oligonucleotide
ccctctctcagtggaatcgagagcacg

SEQ ID NO: 358093 - DNA, 30 bp, Artificial Sequence; identical to SEQ ID NO: 1563
  Description of Artificial Sequence: Synthetic oligonucleotide

SEQ ID NO: 358094 - DNA, 27 bp, Artificial Sequence
  Description of Artificial Sequence: Synthetic oligonucleotide
cctctctcagtggaatcgagagcacgc

SEQ ID NO: 358095 - DNA, 31 bp, Artificial Sequence; identical to SEQ ID NO: 1564
  Description of Artificial Sequence: Synthetic oligonucleotide

SEQ ID NO: 358096 - DNA, 28 bp, Artificial Sequence
  Description of Artificial Sequence: Synthetic oligonucleotide
ctctctcagtggaatcgagagcacgctc

SEQ ID NO: 358097 - DNA, 30 bp, Artificial Sequence; identical to SEQ ID NO: 1565
  Description of Artificial Sequence: Synthetic oligonucleotide

SEQ ID NO: 358098 - DNA, 29 bp, Artificial Sequence
  Description of Artificial Sequence: Synthetic oligonucleotide
tctctcagtggaatcgagagcacgctctg

SEQ ID NO: 358099 - DNA, 30 bp, Artificial Sequence; identical to SEQ ID NO: 1566
  Description of Artificial Sequence: Synthetic oligonucleotide

SEQ ID NO: 358100 - DNA, 28 bp, Artificial Sequence
  Description of Artificial Sequence: Synthetic oligonucleotide
ctctcagtggaatcgagagcacgctctg

SEQ ID NO: 358101 - DNA, 29 bp, Artificial Sequence
  Description of Artificial Sequence: Synthetic oligonucleotide
caccatccagatgatgtatggctgcgacg

SEQ ID NO: 358102 - DNA, 31 bp, Artificial Sequence; identical to SEQ ID NO: 233657
  Description of Artificial Sequence: Synthetic oligonucleotide

SEQ ID NO: 358103 - DNA, 30 bp, Artificial Sequence; identical to SEQ ID NO: 1568
  Description of Artificial Sequence: Synthetic oligonucleotide

SEQ ID NO: 358104 - DNA, 30 bp, Artificial Sequence; identical to SEQ ID NO: 233658
  Description of Artificial Sequence: Synthetic oligonucleotide

SEQ ID NO: 358105 - DNA, 29 bp, Artificial Sequence
  Description of Artificial Sequence: Synthetic oligonucleotide
ccatccagatgatgtatggctgcgacgtg

SEQ ID NO: 358106 - DNA, 31 bp, Artificial Sequence; identical to SEQ ID NO: 233659
  Description of Artificial Sequence: Synthetic oligonucleotide

SEQ ID NO: 358107 - DNA, 29 bp, Artificial Sequence
  Description of Artificial Sequence: Synthetic oligonucleotide
catccagatgatgtatggctgcgacgtgg

SEQ ID NO: 358108 - DNA, 30 bp, Artificial Sequence; identical to SEQ ID NO: 233660
  Description of Artificial Sequence: Synthetic oligonucleotide

SEQ ID NO: 358109 - DNA, 29 bp, Artificial Sequence
  Description of Artificial Sequence: Synthetic oligonucleotide
atccagatgatgtatggctgcgacgtggg

SEQ ID NO: 358110 - DNA, 30 bp, Artificial Sequence; identical to SEQ ID NO: 233661
  Description of Artificial Sequence: Synthetic oligonucleotide

SEQ ID NO: 358111 - DNA, 28 bp, Artificial Sequence
  Description of Artificial Sequence: Synthetic oligonucleotide
tccagatgatgtatggctgcgacgtggg

SEQ ID NO: 358112 - DNA, 29 bp, Artificial Sequence
  Description of Artificial Sequence: Synthetic oligonucleotide
gtggaatcgagagcacgctctgaatctcc

SEQ ID NO: 358113 - DNA, 27 bp, Artificial Sequence
  Description of Artificial Sequence: Synthetic oligonucleotide
ccagatgatgtatggctgcgacgtggg

SEQ ID NO: 358114 - DNA, 30 bp, Artificial Sequence; identical to SEQ ID NO: 233663
  Description of Artificial Sequence: Synthetic oligonucleotide

SEQ ID NO: 358115 - DNA, 27 bp, Artificial Sequence
  Description of Artificial Sequence: Synthetic oligonucleotide
cagatgatgtatggctgcgacgtgggg

SEQ ID NO: 358116 - DNA, 29 bp, Artificial Sequence
  Description of Artificial Sequence: Synthetic oligonucleotide
ggaatcgagagcacgctctgaatctccac

SEQ ID NO: 358117 - DNA, 27 bp, Artificial Sequence
  Description of Artificial Sequence: Synthetic oligonucleotide
agatgatgtatggctgcgacgtggggc

SEQ ID NO: 358118 - DNA, 30 bp, Artificial Sequence; identical to SEQ ID NO: 233665
  Description of Artificial Sequence: Synthetic oligonucleotide

SEQ ID NO: 358119 - DNA, 26 bp, Artificial Sequence
  Description of Artificial Sequence: Synthetic oligonucleotide
gatgatgtatggctgcgacgtggggc

SEQ ID NO: 358120 - DNA, 31 bp, Artificial Sequence; identical to SEQ ID NO: 233666
  Description of Artificial Sequence: Synthetic oligonucleotide

SEQ ID NO: 358121 - DNA, 26 bp, Artificial Sequence
  Description of Artificial Sequence: Synthetic oligonucleotide
atgatgtatggctgcgacgtggggcc

SEQ ID NO: 358122 - DNA, 30 bp, Artificial Sequence; identical to SEQ ID NO: 233667
  Description of Artificial Sequence: Synthetic oligonucleotide

SEQ ID NO: 358123 - DNA, 25 bp, Artificial Sequence
  Description of Artificial Sequence: Synthetic oligonucleotide
tgatgtatggctgcgacgtggggcc

SEQ ID NO: 358124 - DNA, 29 bp, Artificial Sequence
  Description of Artificial Sequence: Synthetic oligonucleotide
tcgagagcacgctctgaatctccacagag

SEQ ID NO: 358125 - DNA, 24 bp, Artificial Sequence
  Description of Artificial Sequence: Synthetic oligonucleotide
gatgtatggctgcgacgtggggcc

SEQ ID NO: 358126 - DNA, 28 bp, Artificial Sequence
  Description of Artificial Sequence: Synthetic oligonucleotide
cgagagcacgctctgaatctccacagag

SEQ ID NO: 358127 - DNA, 27 bp, Artificial Sequence
  Description of Artificial Sequence: Synthetic oligonucleotide
gtgatcactggagctgtggtcgctgct

SEQ ID NO: 358128 - DNA, 28 bp, Artificial Sequence
  Description of Artificial Sequence: Synthetic oligonucleotide
gagagcacgctctgaatctccacagagc

SEQ ID NO: 358129 - DNA, 27 bp, Artificial Sequence
  Description of Artificial Sequence: Synthetic oligonucleotide
tgatcactggagctgtggtcgctgctg

SEQ ID NO: 358130 - DNA, 29 bp, Artificial Sequence
  Description of Artificial Sequence: Synthetic oligonucleotide
agagcacgctctgaatctccacagagcac

SEQ ID NO: 358131 - DNA, 27 bp, Artificial Sequence
  Description of Artificial Sequence: Synthetic oligonucleotide
gatcactggagctgtggtcgctgctgt

SEQ ID NO: 358132 - DNA, 28 bp, Artificial Sequence
  Description of Artificial Sequence: Synthetic oligonucleotide
gagcacgctctgaatctccacagagcac

SEQ ID NO: 358133 - DNA, 27 bp, Artificial Sequence
  Description of Artificial Sequence: Synthetic oligonucleotide
atcactggagctgtggtcgctgctgtg

SEQ ID NO: 358134 - DNA, 28 bp, Artificial Sequence
  Description of Artificial Sequence: Synthetic oligonucleotide
agcacgctctgaatctccacagagcacg

SEQ ID NO: 358135 - DNA, 27 bp, Artificial Sequence
  Description of Artificial Sequence: Synthetic oligonucleotide
tcactggagctgtggtcgctgctgtga

SEQ ID NO: 358136 - DNA, 27 bp, Artificial Sequence
  Description of Artificial Sequence: Synthetic oligonucleotide
gcacgctctgaatctccacagagcacg

SEQ ID NO: 358137 - DNA, 27 bp, Artificial Sequence
  Description of Artificial Sequence: Synthetic oligonucleotide
cactggagctgtggtcgctgctgtgat

SEQ ID NO: 358138 - DNA, 29 bp, Artificial Sequence
  Description of Artificial Sequence: Synthetic oligonucleotide
cacgctctgaatctccacagagcacgatg

SEQ ID NO: 358139 - DNA, 27 bp, Artificial Sequence
  Description of Artificial Sequence: Synthetic oligonucleotide
actggagctgtggtcgctgctgtgatg

SEQ ID NO: 358140 - DNA, 29 bp, Artificial Sequence
  Description of Artificial Sequence: Synthetic oligonucleotide
acgctctgaatctccacagagcacgatgc

SEQ ID NO: 358141 - DNA, 27 bp, Artificial Sequence
  Description of Artificial Sequence: Synthetic oligonucleotide
ctggagctgtggtcgctgctgtgatgt

SEQ ID NO: 358142 - DNA, 28 bp, Artificial Sequence
  Description of Artificial Sequence: Synthetic oligonucleotide
cgctctgaatctccacagagcacgatgc

SEQ ID NO: 358143 - DNA, 27 bp, Artificial Sequence
  Description of Artificial Sequence: Synthetic oligonucleotide
tggagctgtggtcgctgctgtgatgtg

SEQ ID NO: 358144 - DNA, 29 bp, Artificial Sequence
  Description of Artificial Sequence: Synthetic oligonucleotide
gctctgaatctccacagagcacgatgctg

SEQ ID NO: 358145 - DNA, 26 bp, Artificial Sequence
  Description of Artificial Sequence: Synthetic oligonucleotide
ggagctgtggtcgctgctgtgatgtg

SEQ ID NO: 358146 - DNA, 30 bp, Artificial Sequence; identical to SEQ ID NO: 233679
  Description of Artificial Sequence: Synthetic oligonucleotide

SEQ ID NO: 358147 - DNA, 27 bp, Artificial Sequence
  Description of Artificial Sequence: Synthetic oligonucleotide
gagctgtggtcgctgctgtgatgtgga

SEQ ID NO: 358148 - DNA, 31 bp, Artificial Sequence; identical to SEQ ID NO: 233680
  Description of Artificial Sequence: Synthetic oligonucleotide

SEQ ID NO: 358149 - DNA, 27 bp, Artificial Sequence
  Description of Artificial Sequence: Synthetic oligonucleotide
agctgtggtcgctgctgtgatgtggag

SEQ ID NO: 358150 - DNA, 30 bp, Artificial Sequence; identical to SEQ ID NO: 233681
  Description of Artificial Sequence: Synthetic oligonucleotide

SEQ ID NO: 358151 - DNA, 26 bp, Artificial Sequence
  Description of Artificial Sequence: Synthetic oligonucleotide
gctgtggtcgctgctgtgatgtggag

SEQ ID NO: 358152 - DNA, 30 bp, Artificial Sequence; identical to SEQ ID NO: 233682
  Description of Artificial Sequence: Synthetic oligonucleotide

SEQ ID NO: 358153 - DNA, 27 bp, Artificial Sequence
  Description of Artificial Sequence: Synthetic oligonucleotide
ctgtggtcgctgctgtgatgtggagga

SEQ ID NO: 358154 - DNA, 29 bp, Artificial Sequence
  Description of Artificial Sequence: Synthetic oligonucleotide
gaatctccacagagcacgatgctgagagg

SEQ ID NO: 358155 - DNA, 27 bp, Artificial Sequence
  Description of Artificial Sequence: Synthetic oligonucleotide
tgtggtcgctgctgtgatgtggaggag

SEQ ID NO: 358156 - DNA, 30 bp, Artificial Sequence; identical to SEQ ID NO: 233684
  Description of Artificial Sequence: Synthetic oligonucleotide

SEQ ID NO: 358157 - DNA, 26 bp, Artificial Sequence
  Description of Artificial Sequence: Synthetic oligonucleotide
gtggtcgctgctgtgatgtggaggag

SEQ ID NO: 358158 - DNA, 29 bp, Artificial Sequence
  Description of Artificial Sequence: Synthetic oligonucleotide
atctccacagagcacgatgctgagaggag

SEQ ID NO: 358159 - DNA, 27 bp, Artificial Sequence
  Description of Artificial Sequence: Synthetic oligonucleotide
tggtcgctgctgtgatgtggaggagga

SEQ ID NO: 358160 - DNA, 28 bp, Artificial Sequence
  Description of Artificial Sequence: Synthetic oligonucleotide
tctccacagagcacgatgctgagaggag

SEQ ID NO: 358161 - DNA, 27 bp, Artificial Sequence
  Description of Artificial Sequence: Synthetic oligonucleotide
ggtcgctgctgtgatgtggaggaggaa

SEQ ID NO: 358162 - DNA, 27 bp, Artificial Sequence
  Description of Artificial Sequence: Synthetic oligonucleotide
ctccacagagcacgatgctgagaggag

SEQ ID NO: 358163 - DNA, 27 bp, Artificial Sequence
  Description of Artificial Sequence: Synthetic oligonucleotide
gtcgctgctgtgatgtggaggaggaag

SEQ ID NO: 358164 - DNA, 28 bp, Artificial Sequence
  Description of Artificial Sequence: Synthetic oligonucleotide
tccacagagcacgatgctgagaggagtc

SEQ ID NO: 358165 - DNA, 28 bp, Artificial Sequence
  Description of Artificial Sequence: Synthetic oligonucleotide
tcgctgctgtgatgtggaggaggaagag

SEQ ID NO: 358166 - DNA, 27 bp, Artificial Sequence
  Description of Artificial Sequence: Synthetic oligonucleotide
ccacagagcacgatgctgagaggagtc

SEQ ID NO: 358167 - DNA, 27 bp, Artificial Sequence
  Description of Artificial Sequence: Synthetic oligonucleotide
cgctgctgtgatgtggaggaggaagag

SEQ ID NO: 358168 - DNA, 27 bp, Artificial Sequence
  Description of Artificial Sequence: Synthetic oligonucleotide
cacagagcacgatgctgagaggagtcg

SEQ ID NO: 358169 - DNA, 27 bp, Artificial Sequence
  Description of Artificial Sequence: Synthetic oligonucleotide
gctgctgtgatgtggaggaggaagagc

SEQ ID NO: 358170 - DNA, 27 bp, Artificial Sequence
  Description of Artificial Sequence: Synthetic oligonucleotide
acagagcacgatgctgagaggagtcgg

SEQ ID NO: 358171 - DNA, 28 bp, Artificial Sequence
  Description of Artificial Sequence: Synthetic oligonucleotide
ctgctgtgatgtggaggaggaagagctc

SEQ ID NO: 358172 - DNA, 26 bp, Artificial Sequence
  Description of Artificial Sequence: Synthetic oligonucleotide
cagagcacgatgctgagaggagtcgg

SEQ ID NO: 358173 - DNA, 29 bp, Artificial Sequence
  Description of Artificial Sequence: Synthetic oligonucleotide
tgctgtgatgtggaggaggaagagctcag

SEQ ID NO: 358174 - DNA, 26 bp, Artificial Sequence
  Description of Artificial Sequence: Synthetic oligonucleotide
agagcacgatgctgagaggagtcggg

SEQ ID NO: 358175 - DNA, 28 bp, Artificial Sequence
  Description of Artificial Sequence: Synthetic oligonucleotide
gctgtgatgtggaggaggaagagctcag

SEQ ID NO: 358176 - DNA, 25 bp, Artificial Sequence
  Description of Artificial Sequence: Synthetic oligonucleotide
gagcacgatgctgagaggagtcggg

SEQ ID NO: 358177 - DNA, 31 bp, Artificial Sequence; identical to SEQ ID NO: 1605
  Description of Artificial Sequence: Synthetic oligonucleotide

SEQ ID NO: 358178 - DNA, 25 bp, Artificial Sequence
  Description of Artificial Sequence: Synthetic oligonucleotide
agcacgatgctgagaggagtcgggc

SEQ ID NO: 358179 - DNA, 35 bp, Artificial Sequence; identical to SEQ ID NO: 1606
  Description of Artificial Sequence: Synthetic oligonucleotide

SEQ ID NO: 358180 - DNA, 24 bp, Artificial Sequence
  Description of Artificial Sequence: Synthetic oligonucleotide
gcacgatgctgagaggagtcgggc

SEQ ID NO: 358181 - DNA, 26 bp, Artificial Sequence
  Description of Artificial Sequence: Synthetic oligonucleotide
cagaagcagaggggtcagggcgaagt

SEQ ID NO: 358182 - DNA, 24 bp, Artificial Sequence
  Description of Artificial Sequence: Synthetic oligonucleotide
cacgatgctgagaggagtcgggcg

SEQ ID NO: 358183 - DNA, 26 bp, Artificial Sequence
  Description of Artificial Sequence: Synthetic oligonucleotide
agaagcagaggggtcagggcgaagtc

SEQ ID NO: 358184 - DNA, 27 bp, Artificial Sequence
  Description of Artificial Sequence: Synthetic oligonucleotide
acgatgctgagaggagtcgggcgcttt

SEQ ID NO: 358185 - DNA, 25 bp, Artificial Sequence
  Description of Artificial Sequence: Synthetic oligonucleotide
gaagcagaggggtcagggcgaagtc

SEQ ID NO: 358186 - DNA, 26 bp, Artificial Sequence
  Description of Artificial Sequence: Synthetic oligonucleotide
cgatgctgagaggagtcgggcgcttt

SEQ ID NO: 358187 - DNA, 25 bp, Artificial Sequence
  Description of Artificial Sequence: Synthetic oligonucleotide
aagcagaggggtcagggcgaagtcc

SEQ ID NO: 358188 - DNA, 27 bp, Artificial Sequence
  Description of Artificial Sequence: Synthetic oligonucleotide
gatgctgagaggagtcgggcgctttgt

SEQ ID NO: 358189 - DNA, 32 bp, Artificial Sequence
  Description of Artificial Sequence: Synthetic oligonucleotide
cgcagtttcttttctccctctcccaacctatg

SEQ ID NO: 358190 - DNA, 27 bp, Artificial Sequence
  Description of Artificial Sequence: Synthetic oligonucleotide
atgctgagaggagtcgggcgctttgtg

SEQ ID NO: 358191 - DNA, 34 bp, Artificial Sequence
  Description of Artificial Sequence: Synthetic oligonucleotide
gcagtttcttttctccctctcccaacctatgtag

SEQ ID NO: 358192 - DNA, 26 bp, Artificial Sequence
  Description of Artificial Sequence: Synthetic oligonucleotide
tgctgagaggagtcgggcgctttgtg

SEQ ID NO: 358193 - DNA, 34 bp, Artificial Sequence
  Description of Artificial Sequence: Synthetic oligonucleotide
cagtttcttttctccctctcccaacctatgtagg

SEQ ID NO: 358194 - DNA, 25 bp, Artificial Sequence
  Description of Artificial Sequence: Synthetic oligonucleotide
gctgagaggagtcgggcgctttgtg

SEQ ID NO: 358195 - DNA, 34 bp, Artificial Sequence
  Description of Artificial Sequence: Synthetic oligonucleotide
agtttcttttctccctctcccaacctatgtaggg

SEQ ID NO: 358196 - DNA, 26 bp, Artificial Sequence
  Description of Artificial Sequence: Synthetic oligonucleotide
ctgagaggagtcgggcgctttgtgca

SEQ ID NO: 358197 - DNA, 33 bp, Artificial Sequence
  Description of Artificial Sequence: Synthetic oligonucleotide
gtttcttttctccctctcccaacctatgtaggg

SEQ ID NO: 358198 - DNA, 26 bp, Artificial Sequence
  Description of Artificial Sequence: Synthetic oligonucleotide
tgagaggagtcgggcgctttgtgcag

SEQ ID NO: 358199 - DNA, 34 bp, Artificial Sequence
  Description of Artificial Sequence: Synthetic oligonucleotide
tttcttttctccctctcccaacctatgtagggtc

SEQ ID NO: 358200 - DNA, 25 bp, Artificial Sequence
  Description of Artificial Sequence: Synthetic oligonucleotide
gagaggagtcgggcgctttgtgcag

SEQ ID NO: 358201 - DNA, 33 bp, Artificial Sequence
  Description of Artificial Sequence: Synthetic oligonucleotide
ttcttttctccctctcccaacctatgtagggtc

SEQ ID NO: 358202 - DNA, 25 bp, Artificial Sequence
  Description of Artificial Sequence: Synthetic oligonucleotide
agaggagtcgggcgctttgtgcagg

SEQ ID NO: 358203 - DNA, 32 bp, Artificial Sequence
  Description of Artificial Sequence: Synthetic oligonucleotide
tcttttctccctctcccaacctatgtagggtc

SEQ ID NO: 358204 - DNA, 24 bp, Artificial Sequence
  Description of Artificial Sequence: Synthetic oligonucleotide
gaggagtcgggcgctttgtgcagg

SEQ ID NO: 358205 - DNA, 31 bp, Artificial Sequence
  Description of Artificial Sequence: Synthetic oligonucleotide
cttttctccctctcccaacctatgtagggtc

SEQ ID NO: 358206 - DNA, 24 bp, Artificial Sequence
  Description of Artificial Sequence: Synthetic oligonucleotide
aggagtcgggcgctttgtgcaggg

SEQ ID NO: 358207 - DNA, 31 bp, Artificial Sequence
  Description of Artificial Sequence: Synthetic oligonucleotide
ttttctccctctcccaacctatgtagggtcc

SEQ ID NO: 358208 - DNA, 23 bp, Artificial Sequence
  Description of Artificial Sequence: Synthetic oligonucleotide
ggagtcgggcgctttgtgcaggg

SEQ ID NO: 358209 - DNA, 30 bp, Artificial Sequence
  Description of Artificial Sequence: Synthetic oligonucleotide
tttctccctctcccaacctatgtagggtcc

SEQ ID NO: 358210 - DNA, 23 bp, Artificial Sequence
  Description of Artificial Sequence: Synthetic oligonucleotide
gagtcgggcgctttgtgcagggc

SEQ ID NO: 358211 - DNA, 29 bp, Artificial Sequence
  Description of Artificial Sequence: Synthetic oligonucleotide
ttctccctctcccaacctatgtagggtcc

SEQ ID NO: 358212 - DNA, 24 bp, Artificial Sequence
  Description of Artificial Sequence: Synthetic oligonucleotide
agtcgggcgctttgtgcagggcct

SEQ ID NO: 358213 - DNA, 28 bp, Artificial Sequence
  Description of Artificial Sequence: Synthetic oligonucleotide
tctccctctcccaacctatgtagggtcc

SEQ ID NO: 358214 - DNA, 23 bp, Artificial Sequence
  Description of Artificial Sequence: Synthetic oligonucleotide
gtcgggcgctttgtgcagggcct

SEQ ID NO: 358215 - DNA, 27 bp, Artificial Sequence
  Description of Artificial Sequence: Synthetic oligonucleotide
ctccctctcccaacctatgtagggtcc

SEQ ID NO: 358216 - DNA, 23 bp, Artificial Sequence
  Description of Artificial Sequence: Synthetic oligonucleotide
tcgggcgctttgtgcagggcctg

SEQ ID NO: 358217 - DNA, 29 bp, Artificial Sequence
  Description of Artificial Sequence: Synthetic oligonucleotide
tccctctcccaacctatgtagggtccttc

SEQ ID NO: 358218 - DNA, 22 bp, Artificial Sequence
  Description of Artificial Sequence: Synthetic oligonucleotide
cgggcgctttgtgcagggcctg

SEQ ID NO: 358219 - DNA, 28 bp, Artificial Sequence
  Description of Artificial Sequence: Synthetic oligonucleotide
ccctctcccaacctatgtagggtccttc

SEQ ID NO: 358220 - DNA, 23 bp, Artificial Sequence
  Description of Artificial Sequence: Synthetic oligonucleotide
gggcgctttgtgcagggcctgct

SEQ ID NO: 358221 - DNA, 30 bp, Artificial Sequence
  Description of Artificial Sequence: Synthetic oligonucleotide
cctctcccaacctatgtagggtccttcttc

SEQ ID NO: 358222 - DNA, 25 bp, Artificial Sequence
  Description of Artificial Sequence: Synthetic oligonucleotide
ggcgctttgtgcagggcctgctgtt

SEQ ID NO: 358223 - DNA, 30 bp, Artificial Sequence
  Description of Artificial Sequence: Synthetic oligonucleotide
ctctcccaacctatgtagggtccttcttcc

SEQ ID NO: 358224 - DNA, 25 bp, Artificial Sequence
  Description of Artificial Sequence: Synthetic oligonucleotide
gcgctttgtgcagggcctgctgttc

SEQ ID NO: 358225 - DNA, 31 bp, Artificial Sequence
  Description of Artificial Sequence: Synthetic oligonucleotide
tctcccaacctatgtagggtccttcttcctg

SEQ ID NO: 358226 - DNA, 27 bp, Artificial Sequence
  Description of Artificial Sequence: Synthetic oligonucleotide
cgctttgtgcagggcctgctgttcctt

SEQ ID NO: 358227 - DNA, 30 bp, Artificial Sequence
  Description of Artificial Sequence: Synthetic oligonucleotide
ctcccaacctatgtagggtccttcttcctg

SEQ ID NO: 358228 - DNA, 27 bp, Artificial Sequence
  Description of Artificial Sequence: Synthetic oligonucleotide
gctttgtgcagggcctgctgttccttg

SEQ ID NO: 358229 - DNA, 30 bp, Artificial Sequence
  Description of Artificial Sequence: Synthetic oligonucleotide
tcccaacctatgtagggtccttcttcctgg

SEQ ID NO: 358230 - DNA, 27 bp, Artificial Sequence
  Description of Artificial Sequence: Synthetic oligonucleotide
ctttgtgcagggcctgctgttccttgg

SEQ ID NO: 358231 - DNA, 29 bp, Artificial Sequence
  Description of Artificial Sequence: Synthetic oligonucleotide
cccaacctatgtagggtccttcttcctgg

SEQ ID NO: 358232 - DNA, 27 bp, Artificial Sequence
  Description of Artificial Sequence: Synthetic oligonucleotide
tttgtgcagggcctgctgttccttggc

SEQ ID NO: 358233 - DNA, 32 bp, Artificial Sequence
  Description of Artificial Sequence: Synthetic oligonucleotide
ccaacctatgtagggtccttcttcctggatac

SEQ ID NO: 358234 - DNA, 26 bp, Artificial Sequence
  Description of Artificial Sequence: Synthetic oligonucleotide
ttgtgcagggcctgctgttccttggc

SEQ ID NO: 358235 - DNA, 33 bp, Artificial Sequence
  Description of Artificial Sequence: Synthetic oligonucleotide
caacctatgtagggtccttcttcctggatactc

SEQ ID NO: 358236 - DNA, 25 bp, Artificial Sequence
  Description of Artificial Sequence: Synthetic oligonucleotide
tgtgcagggcctgctgttccttggc

SEQ ID NO: 358237 - DNA, 34 bp, Artificial Sequence
  Description of Artificial Sequence: Synthetic oligonucleotide
aacctatgtagggtccttcttcctggatactcac

SEQ ID NO: 358238 - DNA, 24 bp, Artificial Sequence
  Description of Artificial Sequence: Synthetic oligonucleotide
gtgcagggcctgctgttccttggc

SEQ ID NO: 358239 - DNA, 33 bp, Artificial Sequence
  Description of Artificial Sequence: Synthetic oligonucleotide
acctatgtagggtccttcttcctggatactcac

SEQ ID NO: 358240 - DNA, 24 bp, Artificial Sequence
  Description of Artificial Sequence: Synthetic oligonucleotide
tgcagggcctgctgttccttggcg

SEQ ID NO: 358241 - DNA, 32 bp, Artificial Sequence
  Description of Artificial Sequence: Synthetic oligonucleotide
cctatgtagggtccttcttcctggatactcac

SEQ ID NO: 358242 - DNA, 23 bp, Artificial Sequence
  Description of Artificial Sequence: Synthetic oligonucleotide
gcagggcctgctgttccttggcg

SEQ ID NO: 358243 - DNA, 32 bp, Artificial Sequence
  Description of Artificial Sequence: Synthetic oligonucleotide
ctatgtagggtccttcttcctggatactcacg

SEQ ID NO: 358244 - DNA, 23 bp, Artificial Sequence
  Description of Artificial Sequence: Synthetic oligonucleotide
cagggcctgctgttccttggcgc

SEQ ID NO: 358245 - DNA, 33 bp, Artificial Sequence
  Description of Artificial Sequence: Synthetic oligonucleotide
tatgtagggtccttcttcctggatactcacgac

SEQ ID NO: 358246 - DNA, 23 bp, Artificial Sequence
  Description of Artificial Sequence: Synthetic oligonucleotide
agggcctgctgttccttggcgcc

SEQ ID NO: 358247 - DNA, 32 bp, Artificial Sequence
  Description of Artificial Sequence: Synthetic oligonucleotide
atgtagggtccttcttcctggatactcacgac

SEQ ID NO: 358248 - DNA, 22 bp, Artificial Sequence
  Description of Artificial Sequence: Synthetic oligonucleotide
gggcctgctgttccttggcgcc

SEQ ID NO: 358249 - DNA, 31 bp, Artificial Sequence
  Description of Artificial Sequence: Synthetic oligonucleotide
tgtagggtccttcttcctggatactcacgac

SEQ ID NO: 358250 - DNA, 22 bp, Artificial Sequence
  Description of Artificial Sequence: Synthetic oligonucleotide
ggcctgctgttccttggcgccg

SEQ ID NO: 358251 - DNA, 30 bp, Artificial Sequence
  Description of Artificial Sequence: Synthetic oligonucleotide
gtagggtccttcttcctggatactcacgac

SEQ ID NO: 358252 - DNA, 22 bp, Artificial Sequence
  Description of Artificial Sequence: Synthetic oligonucleotide
gcctgctgttccttggcgccgg

SEQ ID NO: 358253 - DNA, 30 bp, Artificial Sequence
  Description of Artificial Sequence: Synthetic oligonucleotide
tagggtccttcttcctggatactcacgacg

SEQ ID NO: 358254 - DNA, 22 bp, Artificial Sequence
  Description of Artificial Sequence: Synthetic oligonucleotide
cctgctgttccttggcgccggg

SEQ ID NO: 358255 - DNA, 29 bp, Artificial Sequence
  Description of Artificial Sequence: Synthetic oligonucleotide
agggtccttcttcctggatactcacgacg

SEQ ID NO: 358256 - DNA, 23 bp, Artificial Sequence
  Description of Artificial Sequence: Synthetic oligonucleotide
ctgctgttccttggcgccgggct

SEQ ID NO: 358257 - DNA, 28 bp, Artificial Sequence
  Description of Artificial Sequence: Synthetic oligonucleotide
gggtccttcttcctggatactcacgacg

SEQ ID NO: 358258 - DNA, 25 bp, Artificial Sequence
  Description of Artificial Sequence: Synthetic oligonucleotide
tgctgttccttggcgccgggctgta

SEQ ID NO: 358259 - DNA, 28 bp, Artificial Sequence
  Description of Artificial Sequence: Synthetic oligonucleotide
ggtccttcttcctggatactcacgacgc

SEQ ID NO: 358260 - DNA, 24 bp, Artificial Sequence
  Description of Artificial Sequence: Synthetic oligonucleotide
gctgttccttggcgccgggctgta

SEQ ID NO: 358261 - DNA, 28 bp, Artificial Sequence
  Description of Artificial Sequence: Synthetic oligonucleotide
gtccttcttcctggatactcacgacgcg

SEQ ID NO: 358262 - DNA, 26 bp, Artificial Sequence
  Description of Artificial Sequence: Synthetic oligonucleotide
ctgttccttggcgccgggctgtacat

SEQ ID NO: 358263 - DNA, 28 bp, Artificial Sequence
  Description of Artificial Sequence: Synthetic oligonucleotide
tccttcttcctggatactcacgacgcgg

SEQ ID NO: 358264 - DNA, 27 bp, Artificial Sequence
  Description of Artificial Sequence: Synthetic oligonucleotide
tgttccttggcgccgggctgtacatct

SEQ ID NO: 358265 - DNA, 27 bp, Artificial Sequence
  Description of Artificial Sequence: Synthetic oligonucleotide
ccttcttcctggatactcacgacgcgg

SEQ ID NO: 358266 - DNA, 27 bp, Artificial Sequence
  Description of Artificial Sequence: Synthetic oligonucleotide
gttccttggcgccgggctgtacatcta

SEQ ID NO: 358267 - DNA, 28 bp, Artificial Sequence
  Description of Artificial Sequence: Synthetic oligonucleotide
cttcttcctggatactcacgacgcggac

SEQ ID NO: 358268 - DNA, 27 bp, Artificial Sequence
  Description of Artificial Sequence: Synthetic oligonucleotide
ttccttggcgccgggctgtacatctac

SEQ ID NO: 358269 - DNA, 28 bp, Artificial Sequence
  Description of Artificial Sequence: Synthetic oligonucleotide
ttcttcctggatactcacgacgcggacc

SEQ ID NO: 358270 - DNA, 27 bp, Artificial Sequence
  Description of Artificial Sequence: Synthetic oligonucleotide
tccttggcgccgggctgtacatctact

SEQ ID NO: 358271 - DNA, 27 bp, Artificial Sequence
  Description of Artificial Sequence: Synthetic oligonucleotide
tcttcctggatactcacgacgcggacc

SEQ ID NO: 358272 - DNA, 27 bp, Artificial Sequence
  Description of Artificial Sequence: Synthetic oligonucleotide
ccttggcgccgggctgtacatctactt

SEQ ID NO: 358273 - DNA, 26 bp, Artificial Sequence
  Description of Artificial Sequence: Synthetic oligonucleotide
cttcctggatactcacgacgcggacc

SEQ ID NO: 358274 - DNA, 27 bp, Artificial Sequence
  Description of Artificial Sequence: Synthetic oligonucleotide
cttggcgccgggctgtacatctacttg

SEQ ID NO: 358275 - DNA, 27 bp, Artificial Sequence
  Description of Artificial Sequence: Synthetic oligonucleotide
ttcctggatactcacgacgcggaccca

SEQ ID NO: 358276 - DNA, 28 bp, Artificial Sequence
  Description of Artificial Sequence: Synthetic oligonucleotide
ttggcgccgggctgtacatctacttgag

SEQ ID NO: 358277 - DNA, 26 bp, Artificial Sequence
  Description of Artificial Sequence: Synthetic oligonucleotide
aagccaatcagtgtcgtcgcggtcgc

SEQ ID NO: 358278 - DNA, 27 bp, Artificial Sequence
  Description of Artificial Sequence: Synthetic oligonucleotide
tggcgccgggctgtacatctacttgag

SEQ ID NO: 358279 - DNA, 25 bp, Artificial Sequence
  Description of Artificial Sequence: Synthetic oligonucleotide
agccaatcagtgtcgtcgcggtcgc

SEQ ID NO: 358280 - DNA, 26 bp, Artificial Sequence
  Description of Artificial Sequence: Synthetic oligonucleotide
ggcgccgggctgtacatctacttgag

SEQ ID NO: 358281 - DNA, 24 bp, Artificial Sequence
  Description of Artificial Sequence: Synthetic oligonucleotide
gccaatcagtgtcgtcgcggtcgc

SEQ ID NO: 358282 - DNA, 27 bp, Artificial Sequence
  Description of Artificial Sequence: Synthetic oligonucleotide
gcgccgggctgtacatctacttgagga

SEQ ID NO: 358283 - DNA, 24 bp, Artificial Sequence
  Description of Artificial Sequence: Synthetic oligonucleotide
ccaatcagtgtcgtcgcggtcgcg

SEQ ID NO: 358284 - DNA, 29 bp, Artificial Sequence
  Description of Artificial Sequence: Synthetic oligonucleotide
cgccgggctgtacatctacttgaggaatc

SEQ ID NO: 358285 - DNA, 26 bp, Artificial Sequence
  Description of Artificial Sequence: Synthetic oligonucleotide
caatcagtgtcgtcgcggtcgcggtt

SEQ ID NO: 358286 - DNA, 30 bp, Artificial Sequence; identical to SEQ ID NO: 233749
  Description of Artificial Sequence: Synthetic oligonucleotide

SEQ ID NO: 358287 - DNA, 27 bp, Artificial Sequence
  Description of Artificial Sequence: Synthetic oligonucleotide
aatcagtgtcgtcgcggtcgcggttct

SEQ ID NO: 358288 - DNA, 33 bp, Artificial Sequence; identical to SEQ ID NO: 233750
  Description of Artificial Sequence: Synthetic oligonucleotide

SEQ ID NO: 358289 - DNA, 27 bp, Artificial Sequence
  Description of Artificial Sequence: Synthetic oligonucleotide
atcagtgtcgtcgcggtcgcggttcta

SEQ ID NO: 358290 - DNA, 33 bp, Artificial Sequence; identical to SEQ ID NO: 233751
  Description of Artificial Sequence: Synthetic oligonucleotide

SEQ ID NO: 358291 - DNA, 27 bp, Artificial Sequence
  Description of Artificial Sequence: Synthetic oligonucleotide
tcagtgtcgtcgcggtcgcggttctaa

SEQ ID NO: 358292 - DNA, 34 bp, Artificial Sequence; identical to SEQ ID NO: 233752
  Description of Artificial Sequence: Synthetic oligonucleotide

SEQ ID NO: 358293 - DNA, 27 bp, Artificial Sequence
  Description of Artificial Sequence: Synthetic oligonucleotide
cagtgtcgtcgcggtcgcggttctaaa

SEQ ID NO: 358294 - DNA, 35 bp, Artificial Sequence; identical to SEQ ID NO: 233753
  Description of Artificial Sequence: Synthetic oligonucleotide

SEQ ID NO: 358295 - DNA, 27 bp, Artificial Sequence
  Description of Artificial Sequence: Synthetic oligonucleotide
agtgtcgtcgcggtcgcggttctaaag

SEQ ID NO: 358296 - DNA, 36 bp, Artificial Sequence; identical to SEQ ID NO: 233754
  Description of Artificial Sequence: Synthetic oligonucleotide

SEQ ID NO: 358297 - DNA, 27 bp, Artificial Sequence
  Description of Artificial Sequence: Synthetic oligonucleotide
gtgtcgtcgcggtcgcggttctaaagt

SEQ ID NO: 358298 - DNA, 37 bp, Artificial Sequence; identical to SEQ ID NO: 233755
  Description of Artificial Sequence: Synthetic oligonucleotide

SEQ ID NO: 358299 - DNA, 27 bp, Artificial Sequence
  Description of Artificial Sequence: Synthetic oligonucleotide
tgtcgtcgcggtcgcggttctaaagtc

SEQ ID NO: 358300 - DNA, 37 bp, Artificial Sequence; identical to SEQ ID NO: 233756
  Description of Artificial Sequence: Synthetic oligonucleotide

SEQ ID NO: 358301 - DNA, 26 bp, Artificial Sequence
  Description of Artificial Sequence: Synthetic oligonucleotide
gtcgtcgcggtcgcggttctaaagtc

SEQ ID NO: 358302 - DNA, 36 bp, Artificial Sequence; identical to SEQ ID NO: 233757
  Description of Artificial Sequence: Synthetic oligonucleotide

SEQ ID NO: 358303 - DNA, 26 bp, Artificial Sequence
  Description of Artificial Sequence: Synthetic oligonucleotide
tcgtcgcggtcgcggttctaaagtcc

SEQ ID NO: 358304 - DNA, 37 bp, Artificial Sequence; identical to SEQ ID NO: 233758
  Description of Artificial Sequence: Synthetic oligonucleotide

SEQ ID NO: 358305 - DNA, 25 bp, Artificial Sequence
  Description of Artificial Sequence: Synthetic oligonucleotide
cgtcgcggtcgcggttctaaagtcc

SEQ ID NO: 358306 - DNA, 36 bp, Artificial Sequence; identical to SEQ ID NO: 233759
  Description of Artificial Sequence: Synthetic oligonucleotide

SEQ ID NO: 358307 - DNA, 25 bp, Artificial Sequence
  Description of Artificial Sequence: Synthetic oligonucleotide
gtcgcggtcgcggttctaaagtccg

SEQ ID NO: 358308 - DNA, 35 bp, Artificial Sequence; identical to SEQ ID NO: 233760
  Description of Artificial Sequence: Synthetic oligonucleotide

SEQ ID NO: 358309 - DNA, 26 bp, Artificial Sequence
  Description of Artificial Sequence: Synthetic oligonucleotide
tcgcggtcgcggttctaaagtccgca

SEQ ID NO: 358310 - DNA, 37 bp, Artificial Sequence; identical to SEQ ID NO: 233761
  Description of Artificial Sequence: Synthetic oligonucleotide

SEQ ID NO: 358311 - DNA, 25 bp, Artificial Sequence
  Description of Artificial Sequence: Synthetic oligonucleotide
cgcggtcgcggttctaaagtccgca

SEQ ID NO: 358312 - DNA, 36 bp, Artificial Sequence; identical to SEQ ID NO: 233762
  Description of Artificial Sequence: Synthetic oligonucleotide

SEQ ID NO: 358313 - DNA, 25 bp, Artificial Sequence
  Description of Artificial Sequence: Synthetic oligonucleotide
gcggtcgcggttctaaagtccgcac

SEQ ID NO: 358314 - DNA, 35 bp, Artificial Sequence; identical to SEQ ID NO: 233763
  Description of Artificial Sequence: Synthetic oligonucleotide

SEQ ID NO: 358315 - DNA, 25 bp, Artificial Sequence
  Description of Artificial Sequence: Synthetic oligonucleotide
cggtcgcggttctaaagtccgcacg

SEQ ID NO: 358316 - DNA, 36 bp, Artificial Sequence; identical to SEQ ID NO: 233764
  Description of Artificial Sequence: Synthetic oligonucleotide

SEQ ID NO: 358317 - DNA, 26 bp, Artificial Sequence
  Description of Artificial Sequence: Synthetic oligonucleotide
ggtcgcggttctaaagtccgcacgca

SEQ ID NO: 358318 - DNA, 35 bp, Artificial Sequence; identical to SEQ ID NO: 233765
  Description of Artificial Sequence: Synthetic oligonucleotide

SEQ ID NO: 358319 - DNA, 26 bp, Artificial Sequence
  Description of Artificial Sequence: Synthetic oligonucleotide
gtcgcggttctaaagtccgcacgcac

SEQ ID NO: 358320 - DNA, 34 bp, Artificial Sequence; identical to SEQ ID NO: 233766
  Description of Artificial Sequence: Synthetic oligonucleotide

SEQ ID NO: 358321 - DNA, 26 bp, Artificial Sequence
  Description of Artificial Sequence: Synthetic oligonucleotide
tcgcggttctaaagtccgcacgcacc

SEQ ID NO: 358322 - DNA, 34 bp, Artificial Sequence; identical to SEQ ID NO: 233767
  Description of Artificial Sequence: Synthetic oligonucleotide

SEQ ID NO: 358323 - DNA, 25 bp, Artificial Sequence
  Description of Artificial Sequence: Synthetic oligonucleotide
cgcggttctaaagtccgcacgcacc

SEQ ID NO: 358324 - DNA, 33 bp, Artificial Sequence; identical to SEQ ID NO: 233768
  Description of Artificial Sequence: Synthetic oligonucleotide

SEQ ID NO: 358325 - DNA, 26 bp, Artificial Sequence
  Description of Artificial Sequence: Synthetic oligonucleotide
gcggttctaaagtccgcacgcaccca

SEQ ID NO: 358326 - DNA, 32 bp, Artificial Sequence; identical to SEQ ID NO: 233769
  Description of Artificial Sequence: Synthetic oligonucleotide

SEQ ID NO: 358327 - DNA, 26 bp, Artificial Sequence
  Description of Artificial Sequence: Synthetic oligonucleotide
cggttctaaagtccgcacgcacccac

SEQ ID NO: 358328 - DNA, 32 bp, Artificial Sequence; identical to SEQ ID NO: 233770
  Description of Artificial Sequence: Synthetic oligonucleotide

SEQ ID NO: 358329 - DNA, 26 bp, Artificial Sequence
  Description of Artificial Sequence: Synthetic oligonucleotide
ggttctaaagtccgcacgcacccacc

SEQ ID NO: 358330 - DNA, 31 bp, Artificial Sequence; identical to SEQ ID NO: 233771
  Description of Artificial Sequence: Synthetic oligonucleotide

SEQ ID NO: 358331 - DNA, 23 bp, Artificial Sequence
  Description of Artificial Sequence: Synthetic oligonucleotide
gtcatggcgccccgaaccctcgt

SEQ ID NO: 358332 - DNA, 33 bp, Artificial Sequence; identical to SEQ ID NO: 233772
  Description of Artificial Sequence: Synthetic oligonucleotide

SEQ ID NO: 358333 - DNA, 23 bp, Artificial Sequence
  Description of Artificial Sequence: Synthetic oligonucleotide
tcatggcgccccgaaccctcgtc

SEQ ID NO: 358334 - DNA, 34 bp, Artificial Sequence; identical to SEQ ID NO: 233773
  Description of Artificial Sequence: Synthetic oligonucleotide

SEQ ID NO: 358335 - DNA, 22 bp, Artificial Sequence
  Description of Artificial Sequence: Synthetic oligonucleotide
catggcgccccgaaccctcgtc

SEQ ID NO: 358336 - DNA, 33 bp, Artificial Sequence; identical to SEQ ID NO: 233774
  Description of Artificial Sequence: Synthetic oligonucleotide

SEQ ID NO: 358337 - DNA, 23 bp, Artificial Sequence
  Description of Artificial Sequence: Synthetic oligonucleotide
atggcgccccgaaccctcgtcct

SEQ ID NO: 358338 - DNA, 32 bp, Artificial Sequence; identical to SEQ ID NO: 233775
  Description of Artificial Sequence: Synthetic oligonucleotide

SEQ ID NO: 358339 - DNA, 22 bp, Artificial Sequence
  Description of Artificial Sequence: Synthetic oligonucleotide
tggcgccccgaaccctcgtcct

SEQ ID NO: 358340 - DNA, 31 bp, Artificial Sequence; identical to SEQ ID NO: 233776
  Description of Artificial Sequence: Synthetic oligonucleotide

SEQ ID NO: 358341 - DNA, 21 bp, Artificial Sequence
  Description of Artificial Sequence: Synthetic oligonucleotide
ggcgccccgaaccctcgtcct

SEQ ID NO: 358342 - DNA, 31 bp, Artificial Sequence; identical to SEQ ID NO: 233777
  Description of Artificial Sequence: Synthetic oligonucleotide

SEQ ID NO: 358343 - DNA, 21 bp, Artificial Sequence
  Description of Artificial Sequence: Synthetic oligonucleotide
gcgccccgaaccctcgtcctg

SEQ ID NO: 358344 - DNA, 30 bp, Artificial Sequence; identical to SEQ ID NO: 233778
  Description of Artificial Sequence: Synthetic oligonucleotide

SEQ ID NO: 358345 - DNA, 23 bp, Artificial Sequence
  Description of Artificial Sequence: Synthetic oligonucleotide
cgccccgaaccctcgtcctgcta

SEQ ID NO: 358346 - DNA, 33 bp, Artificial Sequence; identical to SEQ ID NO: 233779
  Description of Artificial Sequence: Synthetic oligonucleotide

SEQ ID NO: 358347 - DNA, 24 bp, Artificial Sequence
  Description of Artificial Sequence: Synthetic oligonucleotide
gccccgaaccctcgtcctgctact

SEQ ID NO: 358348 - DNA, 32 bp, Artificial Sequence; identical to SEQ ID NO: 233780
  Description of Artificial Sequence: Synthetic oligonucleotide

SEQ ID NO: 358349 - DNA, 25 bp, Artificial Sequence
  Description of Artificial Sequence: Synthetic oligonucleotide
ccccgaaccctcgtcctgctactct

SEQ ID NO: 358350 - DNA, 31 bp, Artificial Sequence; identical to SEQ ID NO: 233781
  Description of Artificial Sequence: Synthetic oligonucleotide

SEQ ID NO: 358351 - DNA, 25 bp, Artificial Sequence
  Description of Artificial Sequence: Synthetic oligonucleotide
cccgaaccctcgtcctgctactctc

SEQ ID NO: 358352 - DNA, 30 bp, Artificial Sequence; identical to SEQ ID NO: 233782
  Description of Artificial Sequence: Synthetic oligonucleotide

SEQ ID NO: 358353 - DNA, 25 bp, Artificial Sequence
  Description of Artificial Sequence: Synthetic oligonucleotide
ccgaaccctcgtcctgctactctcg

SEQ ID NO: 358354 - DNA, 30 bp, Artificial Sequence; identical to SEQ ID NO: 233783
  Description of Artificial Sequence: Synthetic oligonucleotide

SEQ ID NO: 358355 - DNA, 25 bp, Artificial Sequence
  Description of Artificial Sequence: Synthetic oligonucleotide
cgaaccctcgtcctgctactctcgg

SEQ ID NO: 358356 - DNA, 31 bp, Artificial Sequence; identical to SEQ ID NO: 233784
  Description of Artificial Sequence: Synthetic oligonucleotide

SEQ ID NO: 358357 - DNA, 25 bp, Artificial Sequence
  Description of Artificial Sequence: Synthetic oligonucleotide
gaaccctcgtcctgctactctcggg

SEQ ID NO: 358358 - DNA, 30 bp, Artificial Sequence; identical to SEQ ID NO: 233785
  Description of Artificial Sequence: Synthetic oligonucleotide

SEQ ID NO: 358359 - DNA, 25 bp, Artificial Sequence
  Description of Artificial Sequence: Synthetic oligonucleotide
aaccctcgtcctgctactctcgggg

SEQ ID NO: 358360 - DNA, 31 bp, Artificial Sequence; identical to SEQ ID NO: 233786
  Description of Artificial Sequence: Synthetic oligonucleotide

SEQ ID NO: 358361 - DNA, 24 bp, Artificial Sequence
  Description of Artificial Sequence: Synthetic oligonucleotide
accctcgtcctgctactctcgggg

SEQ ID NO: 358362 - DNA, 30 bp, Artificial Sequence; identical to SEQ ID NO: 233787
  Description of Artificial Sequence: Synthetic oligonucleotide

SEQ ID NO: 358363 - DNA, 23 bp, Artificial Sequence
  Description of Artificial Sequence: Synthetic oligonucleotide
ccctcgtcctgctactctcgggg

SEQ ID NO: 358364 - DNA, 30 bp, Artificial Sequence; identical to SEQ ID NO: 233788
  Description of Artificial Sequence: Synthetic oligonucleotide

SEQ ID NO: 358365 - DNA, 23 bp, Artificial Sequence
  Description of Artificial Sequence: Synthetic oligonucleotide
cctcgtcctgctactctcggggg

SEQ ID NO: 358366 - DNA, 29 bp, Artificial Sequence
  Description of Artificial Sequence: Synthetic oligonucleotide
gtggacttgagccaacaggtttcctgagc

SEQ ID NO: 358367 - DNA, 24 bp, Artificial Sequence
  Description of Artificial Sequence: Synthetic oligonucleotide
ctcgtcctgctactctcgggggct

SEQ ID NO: 358368 - DNA, 30 bp, Artificial Sequence; identical to SEQ ID NO: 233790
  Description of Artificial Sequence: Synthetic oligonucleotide

SEQ ID NO: 358369 - DNA, 25 bp, Artificial Sequence
  Description of Artificial Sequence: Synthetic oligonucleotide
tcgtcctgctactctcgggggctct

SEQ ID NO: 358370 - DNA, 29 bp, Artificial Sequence
  Description of Artificial Sequence: Synthetic oligonucleotide
ggacttgagccaacaggtttcctgagctc

SEQ ID NO: 358371 - DNA, 24 bp, Artificial Sequence
  Description of Artificial Sequence: Synthetic oligonucleotide
cgtcctgctactctcgggggctct

SEQ ID NO: 358372 - DNA, 31 bp, Artificial Sequence; identical to SEQ ID NO: 233792
  Description of Artificial Sequence: Synthetic oligonucleotide

SEQ ID NO: 358373 - DNA, 24 bp, Artificial Sequence
  Description of Artificial Sequence: Synthetic oligonucleotide
gtcctgctactctcgggggctctg

SEQ ID NO: 358374 - DNA, 30 bp, Artificial Sequence; identical to SEQ ID NO: 233793
  Description of Artificial Sequence: Synthetic oligonucleotide

SEQ ID NO: 358375 - DNA, 24 bp, Artificial Sequence
  Description of Artificial Sequence: Synthetic oligonucleotide
tcctgctactctcgggggctctgg

SEQ ID NO: 358376 - DNA, 29 bp, Artificial Sequence
  Description of Artificial Sequence: Synthetic oligonucleotide
gatcctatacaaagctcagctgctgggcg

SEQ ID NO: 358377 - DNA, 23 bp, Artificial Sequence
  Description of Artificial Sequence: Synthetic oligonucleotide
cctgctactctcgggggctctgg

SEQ ID NO: 358378 - DNA, 29 bp, Artificial Sequence
  Description of Artificial Sequence: Synthetic oligonucleotide
atcctatacaaagctcagctgctgggcgc

SEQ ID NO: 358379 - DNA, 23 bp, Artificial Sequence
  Description of Artificial Sequence: Synthetic oligonucleotide
ctgctactctcgggggctctggc

SEQ ID NO: 358380 - DNA, 28 bp, Artificial Sequence
  Description of Artificial Sequence: Synthetic oligonucleotide
tcctatacaaagctcagctgctgggcgc

SEQ ID NO: 358381 - DNA, 23 bp, Artificial Sequence
  Description of Artificial Sequence: Synthetic oligonucleotide
tgctactctcgggggctctggcc

SEQ ID NO: 358382 - DNA, 27 bp, Artificial Sequence
  Description of Artificial Sequence: Synthetic oligonucleotide
cctatacaaagctcagctgctgggcgc

SEQ ID NO: 358383 - DNA, 22 bp, Artificial Sequence
  Description of Artificial Sequence: Synthetic oligonucleotide
gctactctcgggggctctggcc

SEQ ID NO: 358384 - DNA, 27 bp, Artificial Sequence
  Description of Artificial Sequence: Synthetic oligonucleotide
ctatacaaagctcagctgctgggcgcc

SEQ ID NO: 358385 - DNA, 23 bp, Artificial Sequence
  Description of Artificial Sequence: Synthetic oligonucleotide
ctactctcgggggctctggccct

SEQ ID NO: 358386 - DNA, 27 bp, Artificial Sequence
  Description of Artificial Sequence: Synthetic oligonucleotide
tatacaaagctcagctgctgggcgccc

SEQ ID NO: 358387 - DNA, 24 bp, Artificial Sequence
  Description of Artificial Sequence: Synthetic oligonucleotide
tactctcgggggctctggccctga

SEQ ID NO: 358388 - DNA, 27 bp, Artificial Sequence
  Description of Artificial Sequence: Synthetic oligonucleotide
atacaaagctcagctgctgggcgccct

SEQ ID NO: 358389 - DNA, 23 bp, Artificial Sequence
  Description of Artificial Sequence: Synthetic oligonucleotide
actctcgggggctctggccctga

SEQ ID NO: 358390 - DNA, 26 bp, Artificial Sequence
  Description of Artificial Sequence: Synthetic oligonucleotide
tacaaagctcagctgctgggcgccct

SEQ ID NO: 358391 - DNA, 22 bp, Artificial Sequence
  Description of Artificial Sequence: Synthetic oligonucleotide
ctctcgggggctctggccctga

SEQ ID NO: 358392 - DNA, 25 bp, Artificial Sequence
  Description of Artificial Sequence: Synthetic oligonucleotide
acaaagctcagctgctgggcgccct

SEQ ID NO: 358393 - DNA, 22 bp, Artificial Sequence
  Description of Artificial Sequence: Synthetic oligonucleotide
tctcgggggctctggccctgac

SEQ ID NO: 358394 - DNA, 24 bp, Artificial Sequence
  Description of Artificial Sequence: Synthetic oligonucleotide
caaagctcagctgctgggcgccct

SEQ ID NO: 358395 - DNA, 21 bp, Artificial Sequence
  Description of Artificial Sequence: Synthetic oligonucleotide
ctcgggggctctggccctgac

SEQ ID NO: 358396 - DNA, 24 bp, Artificial Sequence
  Description of Artificial Sequence: Synthetic oligonucleotide
aaagctcagctgctgggcgccctc

SEQ ID NO: 358397 - DNA, 21 bp, Artificial Sequence
  Description of Artificial Sequence: Synthetic oligonucleotide
tcgggggctctggccctgacc

SEQ ID NO: 358398 - DNA, 23 bp, Artificial Sequence
  Description of Artificial Sequence: Synthetic oligonucleotide
aagctcagctgctgggcgccctc

SEQ ID NO: 358399 - DNA, 20 bp, Artificial Sequence
  Description of Artificial Sequence: Synthetic oligonucleotide
cgggggctctggccctgacc

SEQ ID NO: 358400 - DNA, 22 bp, Artificial Sequence
  Description of Artificial Sequence: Synthetic oligonucleotide
agctcagctgctgggcgccctc

SEQ ID NO: 358401 - DNA, 21 bp, Artificial Sequence
  Description of Artificial Sequence: Synthetic oligonucleotide
gggggctctggccctgaccca

SEQ ID NO: 358402 - DNA, 21 bp, Artificial Sequence
  Description of Artificial Sequence: Synthetic oligonucleotide
gctcagctgctgggcgccctc

SEQ ID NO: 358403 - DNA, 22 bp, Artificial Sequence
  Description of Artificial Sequence: Synthetic oligonucleotide
ggggctctggccctgacccaga

SEQ ID NO: 358404 - DNA, 21 bp, Artificial Sequence
  Description of Artificial Sequence: Synthetic oligonucleotide
ctcagctgctgggcgccctcg

SEQ ID NO: 358405 - DNA, 22 bp, Artificial Sequence
  Description of Artificial Sequence: Synthetic oligonucleotide
gggctctggccctgacccagac

SEQ ID NO: 358406 - DNA, 21 bp, Artificial Sequence
  Description of Artificial Sequence: Synthetic oligonucleotide
tcagctgctgggcgccctcgc

SEQ ID NO: 358407 - DNA, 23 bp, Artificial Sequence
  Description of Artificial Sequence: Synthetic oligonucleotide
ggctctggccctgacccagacct

SEQ ID NO: 358408 - DNA, 20 bp, Artificial Sequence
  Description of Artificial Sequence: Synthetic oligonucleotide
cagctgctgggcgccctcgc

SEQ ID NO: 358409 - DNA, 23 bp, Artificial Sequence
  Description of Artificial Sequence: Synthetic oligonucleotide
gctctggccctgacccagacctg

SEQ ID NO: 358410 - DNA, 20 bp, Artificial Sequence
  Description of Artificial Sequence: Synthetic oligonucleotide
agctgctgggcgccctcgcc

SEQ ID NO: 358411 - DNA, 23 bp, Artificial Sequence
  Description of Artificial Sequence: Synthetic oligonucleotide
ctctggccctgacccagacctgg

SEQ ID NO: 358412 - DNA, 20 bp, Artificial Sequence
  Description of Artificial Sequence: Synthetic oligonucleotide
gctgctgggcgccctcgcct

SEQ ID NO: 358413 - DNA, 23 bp, Artificial Sequence
  Description of Artificial Sequence: Synthetic oligonucleotide
tctggccctgacccagacctggg

SEQ ID NO: 358414 - DNA, 20 bp, Artificial Sequence
  Description of Artificial Sequence: Synthetic oligonucleotide
ctgctgggcgccctcgccgt

SEQ ID NO: 358415 - DNA, 23 bp, Artificial Sequence
  Description of Artificial Sequence: Synthetic oligonucleotide
tgacccagacctgggcgggctct

SEQ ID NO: 358416 - DNA, 21 bp, Artificial Sequence
  Description of Artificial Sequence: Synthetic oligonucleotide
tgctgggcgccctcgccgtga

SEQ ID NO: 358417 - DNA, 22 bp, Artificial Sequence
  Description of Artificial Sequence: Synthetic oligonucleotide
gacccagacctgggcgggctct

SEQ ID NO: 358418 - DNA, 20 bp, Artificial Sequence
  Description of Artificial Sequence: Synthetic oligonucleotide
gctgggcgccctcgccgtga

SEQ ID NO: 358419 - DNA, 23 bp, Artificial Sequence
  Description of Artificial Sequence: Synthetic oligonucleotide
acccagacctgggcgggctctca

SEQ ID NO: 358420 - DNA, 20 bp, Artificial Sequence
  Description of Artificial Sequence: Synthetic oligonucleotide
ctgggcgccctcgccgtgac

SEQ ID NO: 358421 - DNA, 22 bp, Artificial Sequence
  Description of Artificial Sequence: Synthetic oligonucleotide
cccagacctgggcgggctctca

SEQ ID NO: 358422 - DNA, 21 bp, Artificial Sequence
  Description of Artificial Sequence: Synthetic oligonucleotide
tgggcgccctcgccgtgacca

SEQ ID NO: 358423 - DNA, 23 bp, Artificial Sequence
  Description of Artificial Sequence: Synthetic oligonucleotide
ccagacctgggcgggctctcact

SEQ ID NO: 358424 - DNA, 20 bp, Artificial Sequence
  Description of Artificial Sequence: Synthetic oligonucleotide
gggcgccctcgccgtgacca

SEQ ID NO: 358425 - DNA, 23 bp, Artificial Sequence
  Description of Artificial Sequence: Synthetic oligonucleotide
cagacctgggcgggctctcactc

SEQ ID NO: 358426 - DNA, 20 bp, Artificial Sequence
  Description of Artificial Sequence: Synthetic oligonucleotide
ggcgccctcgccgtgaccac

SEQ ID NO: 358427 - DNA, 25 bp, Artificial Sequence
  Description of Artificial Sequence: Synthetic oligonucleotide
agacctgggcgggctctcactccat

SEQ ID NO: 358428 - DNA, 20 bp, Artificial Sequence
  Description of Artificial Sequence: Synthetic oligonucleotide
gcgccctcgccgtgaccacc

SEQ ID NO: 358429 - DNA, 24 bp, Artificial Sequence
  Description of Artificial Sequence: Synthetic oligonucleotide
gacctgggcgggctctcactccat

SEQ ID NO: 358430 - DNA, 21 bp, Artificial Sequence
  Description of Artificial Sequence: Synthetic oligonucleotide
cgccctcgccgtgaccaccga

SEQ ID NO: 358431 - DNA, 25 bp, Artificial Sequence
  Description of Artificial Sequence: Synthetic oligonucleotide
acctgggcgggctctcactccatga

SEQ ID NO: 358432 - DNA, 23 bp, Artificial Sequence
  Description of Artificial Sequence: Synthetic oligonucleotide
gccctcgccgtgaccaccgagat

SEQ ID NO: 358433 - DNA, 24 bp, Artificial Sequence
  Description of Artificial Sequence: Synthetic oligonucleotide
cctgggcgggctctcactccatga

SEQ ID NO: 358434 - DNA, 24 bp, Artificial Sequence
  Description of Artificial Sequence: Synthetic oligonucleotide
ccctcgccgtgaccaccgagatga

SEQ ID NO: 358435 - DNA, 24 bp, Artificial Sequence
  Description of Artificial Sequence: Synthetic oligonucleotide
ctgggcgggctctcactccatgag

SEQ ID NO: 358436 - DNA, 24 bp, Artificial Sequence
  Description of Artificial Sequence: Synthetic oligonucleotide
cctcgccgtgaccaccgagatgag

SEQ ID NO: 358437 - DNA, 27 bp, Artificial Sequence
  Description of Artificial Sequence: Synthetic oligonucleotide
tgggcgggctctcactccatgaggtat

SEQ ID NO: 358438 - DNA, 24 bp, Artificial Sequence
  Description of Artificial Sequence: Synthetic oligonucleotide
ctcgccgtgaccaccgagatgagc

SEQ ID NO: 358439 - DNA, 27 bp, Artificial Sequence
  Description of Artificial Sequence: Synthetic oligonucleotide
gggcgggctctcactccatgaggtatt

SEQ ID NO: 358440 - DNA, 24 bp, Artificial Sequence
  Description of Artificial Sequence: Synthetic oligonucleotide
tcgccgtgaccaccgagatgagcc

SEQ ID NO: 358441 - DNA, 28 bp, Artificial Sequence
  Description of Artificial Sequence: Synthetic oligonucleotide
ggcgggctctcactccatgaggtatttc

SEQ ID NO: 358442 - DNA, 23 bp, Artificial Sequence
  Description of Artificial Sequence: Synthetic oligonucleotide
cgccgtgaccaccgagatgagcc

SEQ ID NO: 358443 - DNA, 30 bp, Artificial Sequence; identical to SEQ ID NO: 3268
  Description of Artificial Sequence: Synthetic oligonucleotide

SEQ ID NO: 358444 - DNA, 23 bp, Artificial Sequence
  Description of Artificial Sequence: Synthetic oligonucleotide
gccgtgaccaccgagatgagccg

SEQ ID NO: 358445 - DNA, 31 bp, Artificial Sequence; identical to SEQ ID NO: 3269
  Description of Artificial Sequence: Synthetic oligonucleotide

SEQ ID NO: 358446 - DNA, 24 bp, Artificial Sequence
  Description of Artificial Sequence: Synthetic oligonucleotide
ccgtgaccaccgagatgagccgct

SEQ ID NO: 358447 - DNA, 33 bp, Artificial Sequence; identical to SEQ ID NO: 3270
  Description of Artificial Sequence: Synthetic oligonucleotide

SEQ ID NO: 358448 - DNA, 25 bp, Artificial Sequence
  Description of Artificial Sequence: Synthetic oligonucleotide
cgtgaccaccgagatgagccgctgt

SEQ ID NO: 358449 - DNA, 33 bp, Artificial Sequence; identical to SEQ ID NO: 3271
  Description of Artificial Sequence: Synthetic oligonucleotide

SEQ ID NO: 358450 - DNA, 25 bp, Artificial Sequence
  Description of Artificial Sequence: Synthetic oligonucleotide
gtgaccaccgagatgagccgctgtg

SEQ ID NO: 358451 - DNA, 22 bp, Artificial Sequence
  Description of Artificial Sequence: Synthetic oligonucleotide
gacagcgacgccgcgagccaga

SEQ ID NO: 358452 - DNA, 26 bp, Artificial Sequence
  Description of Artificial Sequence: Synthetic oligonucleotide
tgaccaccgagatgagccgctgtgga

SEQ ID NO: 358453 - DNA, 22 bp, Artificial Sequence
  Description of Artificial Sequence: Synthetic oligonucleotide
acagcgacgccgcgagccagag

SEQ ID NO: 358454 - DNA, 25 bp, Artificial Sequence
  Description of Artificial Sequence: Synthetic oligonucleotide
gaccaccgagatgagccgctgtgga

SEQ ID NO: 358455 - DNA, 21 bp, Artificial Sequence
  Description of Artificial Sequence: Synthetic oligonucleotide
cagcgacgccgcgagccagag

SEQ ID NO: 358456 - DNA, 25 bp, Artificial Sequence
  Description of Artificial Sequence: Synthetic oligonucleotide
accaccgagatgagccgctgtggag

SEQ ID NO: 358457 - DNA, 23 bp, Artificial Sequence
  Description of Artificial Sequence: Synthetic oligonucleotide
agcgacgccgcgagccagaggat

SEQ ID NO: 358458 - DNA, 24 bp, Artificial Sequence
  Description of Artificial Sequence: Synthetic oligonucleotide
ccaccgagatgagccgctgtggag

SEQ ID NO: 358459 - DNA, 22 bp, Artificial Sequence
  Description of Artificial Sequence: Synthetic oligonucleotide
gcgacgccgcgagccagaggat

SEQ ID NO: 358460 - DNA, 25 bp, Artificial Sequence
  Description of Artificial Sequence: Synthetic oligonucleotide
caccgagatgagccgctgtggagga

SEQ ID NO: 358461 - DNA, 22 bp, Artificial Sequence
  Description of Artificial Sequence: Synthetic oligonucleotide
cgacgccgcgagccagaggatg

SEQ ID NO: 358462 - DNA, 27 bp, Artificial Sequence
  Description of Artificial Sequence: Synthetic oligonucleotide
accgagatgagccgctgtggaggagaa

SEQ ID NO: 358463 - DNA, 23 bp, Artificial Sequence
  Description of Artificial Sequence: Synthetic oligonucleotide
gacgccgcgagccagaggatgga

SEQ ID NO: 358464 - DNA, 26 bp, Artificial Sequence
  Description of Artificial Sequence: Synthetic oligonucleotide
ccgagatgagccgctgtggaggagaa

SEQ ID NO: 358465 - DNA, 23 bp, Artificial Sequence
  Description of Artificial Sequence: Synthetic oligonucleotide
acgccgcgagccagaggatggag

SEQ ID NO: 358466 - DNA, 27 bp, Artificial Sequence
  Description of Artificial Sequence: Synthetic oligonucleotide
cgagatgagccgctgtggaggagaaga

SEQ ID NO: 358467 - DNA, 22 bp, Artificial Sequence
  Description of Artificial Sequence: Synthetic oligonucleotide
cgccgcgagccagaggatggag

SEQ ID NO: 358468 - DNA, 27 bp, Artificial Sequence
  Description of Artificial Sequence: Synthetic oligonucleotide
gagatgagccgctgtggaggagaagac

SEQ ID NO: 358469 - DNA, 22 bp, Artificial Sequence
  Description of Artificial Sequence: Synthetic oligonucleotide
gccgcgagccagaggatggagc

SEQ ID NO: 358470 - DNA, 30 bp, Artificial Sequence; identical to SEQ ID NO: 233841
  Description of Artificial Sequence: Synthetic oligonucleotide

SEQ ID NO: 358471 - DNA, 22 bp, Artificial Sequence
  Description of Artificial Sequence: Synthetic oligonucleotide
ccgcgagccagaggatggagcc

SEQ ID NO: 358472 - DNA, 29 bp, Artificial Sequence
  Description of Artificial Sequence: Synthetic oligonucleotide
gatgagccgctgtggaggagaagacattg

SEQ ID NO: 358473 - DNA, 22 bp, Artificial Sequence
  Description of Artificial Sequence: Synthetic oligonucleotide
cgcgagccagaggatggagccg

SEQ ID NO: 358474 - DNA, 30 bp, Artificial Sequence; identical to SEQ ID NO: 233843
  Description of Artificial Sequence: Synthetic oligonucleotide

SEQ ID NO: 358475 - DNA, 22 bp, Artificial Sequence
  Description of Artificial Sequence: Synthetic oligonucleotide
gcgagccagaggatggagccgc

SEQ ID NO: 358476 - DNA, 29 bp, Artificial Sequence
  Description of Artificial Sequence: Synthetic oligonucleotide
tgagccgctgtggaggagaagacattgag

SEQ ID NO: 358477 - DNA, 22 bp, Artificial Sequence
  Description of Artificial Sequence: Synthetic oligonucleotide
cgagccagaggatggagccgcg

SEQ ID NO: 358478 - DNA, 28 bp, Artificial Sequence
  Description of Artificial Sequence: Synthetic oligonucleotide
gagccgctgtggaggagaagacattgag

SEQ ID NO: 358479 - DNA, 22 bp, Artificial Sequence
  Description of Artificial Sequence: Synthetic oligonucleotide
gagccagaggatggagccgcgg

SEQ ID NO: 358480 - DNA, 28 bp, Artificial Sequence
  Description of Artificial Sequence: Synthetic oligonucleotide
agccgctgtggaggagaagacattgagg

SEQ ID NO: 358481 - DNA, 22 bp, Artificial Sequence
  Description of Artificial Sequence: Synthetic oligonucleotide
agccagaggatggagccgcggg

SEQ ID NO: 358482 - DNA, 27 bp, Artificial Sequence
  Description of Artificial Sequence: Synthetic oligonucleotide
gccgctgtggaggagaagacattgagg

SEQ ID NO: 358483 - DNA, 21 bp, Artificial Sequence
  Description of Artificial Sequence: Synthetic oligonucleotide
gccagaggatggagccgcggg

SEQ ID NO: 358484 - DNA, 27 bp, Artificial Sequence
  Description of Artificial Sequence: Synthetic oligonucleotide
ccgctgtggaggagaagacattgaggc

SEQ ID NO: 358485 - DNA, 21 bp, Artificial Sequence
  Description of Artificial Sequence: Synthetic oligonucleotide
ccagaggatggagccgcgggc

SEQ ID NO: 358486 - DNA, 28 bp, Artificial Sequence
  Description of Artificial Sequence: Synthetic oligonucleotide
cgctgtggaggagaagacattgaggctg

SEQ ID NO: 358487 - DNA, 21 bp, Artificial Sequence
  Description of Artificial Sequence: Synthetic oligonucleotide
cagaggatggagccgcgggcg

SEQ ID NO: 358488 - DNA, 29 bp, Artificial Sequence
  Description of Artificial Sequence: Synthetic oligonucleotide
gctgtggaggagaagacattgaggctgac

SEQ ID NO: 358489 - DNA, 21 bp, Artificial Sequence
  Description of Artificial Sequence: Synthetic oligonucleotide
agaggatggagccgcgggcgc

SEQ ID NO: 358490 - DNA, 29 bp, Artificial Sequence
  Description of Artificial Sequence: Synthetic oligonucleotide
ctgtggaggagaagacattgaggctgacc

SEQ ID NO: 358491 - DNA, 20 bp, Artificial Sequence
  Description of Artificial Sequence: Synthetic oligonucleotide
gaggatggagccgcgggcgc

SEQ ID NO: 358492 - DNA, 30 bp, Artificial Sequence; identical to SEQ ID NO: 233852
  Description of Artificial Sequence: Synthetic oligonucleotide

SEQ ID NO: 358493 - DNA, 20 bp, Artificial Sequence
  Description of Artificial Sequence: Synthetic oligonucleotide
aggatggagccgcgggcgcc

SEQ ID NO: 358494 - DNA, 29 bp, Artificial Sequence
  Description of Artificial Sequence: Synthetic oligonucleotide
gtggaggagaagacattgaggctgacctc

SEQ ID NO: 358495 - DNA, 20 bp, Artificial Sequence
  Description of Artificial Sequence: Synthetic oligonucleotide
ggatggagccgcgggcgcct

SEQ ID NO: 358496 - DNA, 29 bp, Artificial Sequence
  Description of Artificial Sequence: Synthetic oligonucleotide
tggaggagaagacattgaggctgacctcg

SEQ ID NO: 358497 - DNA, 24 bp, Artificial Sequence
  Description of Artificial Sequence: Synthetic oligonucleotide
gcgccgtggatagagcaggagggt

SEQ ID NO: 358498 - DNA, 28 bp, Artificial Sequence
  Description of Artificial Sequence: Synthetic oligonucleotide
ggaggagaagacattgaggctgacctcg

SEQ ID NO: 358499 - DNA, 24 bp, Artificial Sequence
  Description of Artificial Sequence: Synthetic oligonucleotide
cgccgtggatagagcaggagggtc

SEQ ID NO: 358500 - DNA, 30 bp, Artificial Sequence; identical to SEQ ID NO: 233856
  Description of Artificial Sequence: Synthetic oligonucleotide

SEQ ID NO: 358501 - DNA, 24 bp, Artificial Sequence
  Description of Artificial Sequence: Synthetic oligonucleotide
gccgtggatagagcaggagggtcc

SEQ ID NO: 358502 - DNA, 30 bp, Artificial Sequence; identical to SEQ ID NO: 233857
  Description of Artificial Sequence: Synthetic oligonucleotide

SEQ ID NO: 358503 - DNA, 24 bp, Artificial Sequence
  Description of Artificial Sequence: Synthetic oligonucleotide
ccgtggatagagcaggagggtccg

SEQ ID NO: 358504 - DNA, 29 bp, Artificial Sequence
  Description of Artificial Sequence: Synthetic oligonucleotide
ggagaagacattgaggctgacctcgttgc

SEQ ID NO: 358505 - DNA, 25 bp, Artificial Sequence
  Description of Artificial Sequence: Synthetic oligonucleotide
cgtggatagagcaggagggtccgga

SEQ ID NO: 358506 - DNA, 29 bp, Artificial Sequence
  Description of Artificial Sequence: Synthetic oligonucleotide
gagaagacattgaggctgacctcgttgcc

SEQ ID NO: 358507 - DNA, 27 bp, Artificial Sequence
  Description of Artificial Sequence: Synthetic oligonucleotide
gtggatagagcaggagggtccggagta

SEQ ID NO: 358508 - DNA, 30 bp, Artificial Sequence; identical to SEQ ID NO: 233860
  Description of Artificial Sequence: Synthetic oligonucleotide

SEQ ID NO: 358509 - DNA, 29 bp, Artificial Sequence
  Description of Artificial Sequence: Synthetic oligonucleotide
tggatagagcaggagggtccggagtattg

SEQ ID NO: 358510 - DNA, 29 bp, Artificial Sequence
  Description of Artificial Sequence: Synthetic oligonucleotide
gaagacattgaggctgacctcgttgcctc

SEQ ID NO: 358511 - DNA, 28 bp, Artificial Sequence
  Description of Artificial Sequence: Synthetic oligonucleotide
ggatagagcaggagggtccggagtattg

SEQ ID NO: 358512 - DNA, 33 bp, Artificial Sequence; identical to SEQ ID NO: 233862
  Description of Artificial Sequence: Synthetic oligonucleotide

SEQ ID NO: 358513 - DNA, 28 bp, Artificial Sequence
  Description of Artificial Sequence: Synthetic oligonucleotide
gatagagcaggagggtccggagtattgg

SEQ ID NO: 358514 - DNA, 32 bp, Artificial Sequence; identical to SEQ ID NO: 233863
  Description of Artificial Sequence: Synthetic oligonucleotide

SEQ ID NO: 358515 - DNA, 28 bp, Artificial Sequence
  Description of Artificial Sequence: Synthetic oligonucleotide
atagagcaggagggtccggagtattggg

SEQ ID NO: 358516 - DNA, 31 bp, Artificial Sequence; identical to SEQ ID NO: 233864
  Description of Artificial Sequence: Synthetic oligonucleotide

SEQ ID NO: 358517 - DNA, 27 bp, Artificial Sequence
  Description of Artificial Sequence: Synthetic oligonucleotide
tagagcaggagggtccggagtattggg

SEQ ID NO: 358518 - DNA, 31 bp, Artificial Sequence; identical to SEQ ID NO: 233865
  Description of Artificial Sequence: Synthetic oligonucleotide

SEQ ID NO: 358519 - DNA, 27 bp, Artificial Sequence
  Description of Artificial Sequence: Synthetic oligonucleotide
agagcaggagggtccggagtattggga

SEQ ID NO: 358520 - DNA, 30 bp, Artificial Sequence; identical to SEQ ID NO: 233866
  Description of Artificial Sequence: Synthetic oligonucleotide

SEQ ID NO: 358521 - DNA, 26 bp, Artificial Sequence
  Description of Artificial Sequence: Synthetic oligonucleotide
gagcaggagggtccggagtattggga

SEQ ID NO: 358522 - DNA, 31 bp, Artificial Sequence; identical to SEQ ID NO: 233867
  Description of Artificial Sequence: Synthetic oligonucleotide

SEQ ID NO: 358523 - DNA, 26 bp, Artificial Sequence
  Description of Artificial Sequence: Synthetic oligonucleotide
agcaggagggtccggagtattgggac

SEQ ID NO: 358524 - DNA, 30 bp, Artificial Sequence; identical to SEQ ID NO: 233868
  Description of Artificial Sequence: Synthetic oligonucleotide

SEQ ID NO: 358525 - DNA, 25 bp, Artificial Sequence
  Description of Artificial Sequence: Synthetic oligonucleotide
gcaggagggtccggagtattgggac

SEQ ID NO: 358526 - DNA, 29 bp, Artificial Sequence
  Description of Artificial Sequence: Synthetic oligonucleotide
tgaggctgacctcgttgcctctaatggtg

SEQ ID NO: 358527 - DNA, 25 bp, Artificial Sequence
  Description of Artificial Sequence: Synthetic oligonucleotide
caggagggtccggagtattgggacg

SEQ ID NO: 358528 - DNA, 28 bp, Artificial Sequence
  Description of Artificial Sequence: Synthetic oligonucleotide
gaggctgacctcgttgcctctaatggtg

SEQ ID NO: 358529 - DNA, 25 bp, Artificial Sequence
  Description of Artificial Sequence: Synthetic oligonucleotide
aggagggtccggagtattgggacgg

SEQ ID NO: 358530 - DNA, 32 bp, Artificial Sequence; identical to SEQ ID NO: 233871
  Description of Artificial Sequence: Synthetic oligonucleotide

SEQ ID NO: 358531 - DNA, 24 bp, Artificial Sequence
  Description of Artificial Sequence: Synthetic oligonucleotide
ggagggtccggagtattgggacgg

SEQ ID NO: 358532 - DNA, 31 bp, Artificial Sequence; identical to SEQ ID NO: 233872
  Description of Artificial Sequence: Synthetic oligonucleotide

SEQ ID NO: 358533 - DNA, 24 bp, Artificial Sequence
  Description of Artificial Sequence: Synthetic oligonucleotide
gagggtccggagtattgggacggg

SEQ ID NO: 358534 - DNA, 33 bp, Artificial Sequence; identical to SEQ ID NO: 233873
  Description of Artificial Sequence: Synthetic oligonucleotide

SEQ ID NO: 358535 - DNA, 25 bp, Artificial Sequence
  Description of Artificial Sequence: Synthetic oligonucleotide
agggtccggagtattgggacgggga

SEQ ID NO: 358536 - DNA, 35 bp, Artificial Sequence; identical to SEQ ID NO: 233874
  Description of Artificial Sequence: Synthetic oligonucleotide

SEQ ID NO: 358537 - DNA, 24 bp, Artificial Sequence
  Description of Artificial Sequence: Synthetic oligonucleotide
gggtccggagtattgggacgggga

SEQ ID NO: 358538 - DNA, 35 bp, Artificial Sequence; identical to SEQ ID NO: 233875
  Description of Artificial Sequence: Synthetic oligonucleotide

SEQ ID NO: 358539 - DNA, 25 bp, Artificial Sequence
  Description of Artificial Sequence: Synthetic oligonucleotide
ggtccggagtattgggacggggaga

SEQ ID NO: 358540 - DNA, 34 bp, Artificial Sequence; identical to SEQ ID NO: 233876
  Description of Artificial Sequence: Synthetic oligonucleotide

SEQ ID NO: 358541 - DNA, 26 bp, Artificial Sequence
  Description of Artificial Sequence: Synthetic oligonucleotide
gtccggagtattgggacggggagaca

SEQ ID NO: 358542 - DNA, 35 bp, Artificial Sequence; identical to SEQ ID NO: 233877
  Description of Artificial Sequence: Synthetic oligonucleotide

SEQ ID NO: 358543 - DNA, 26 bp, Artificial Sequence
  Description of Artificial Sequence: Synthetic oligonucleotide
tccggagtattgggacggggagacac

SEQ ID NO: 358544 - DNA, 34 bp, Artificial Sequence; identical to SEQ ID NO: 233878
  Description of Artificial Sequence: Synthetic oligonucleotide

SEQ ID NO: 358545 - DNA, 25 bp, Artificial Sequence
  Description of Artificial Sequence: Synthetic oligonucleotide
ccggagtattgggacggggagacac

SEQ ID NO: 358546 - DNA, 34 bp, Artificial Sequence; identical to SEQ ID NO: 233879
  Description of Artificial Sequence: Synthetic oligonucleotide

SEQ ID NO: 358547 - DNA, 25 bp, Artificial Sequence
  Description of Artificial Sequence: Synthetic oligonucleotide
cggagtattgggacggggagacacg

SEQ ID NO: 358548 - DNA, 37 bp, Artificial Sequence; identical to SEQ ID NO: 233880
  Description of Artificial Sequence: Synthetic oligonucleotide

SEQ ID NO: 358549 - DNA, 27 bp, Artificial Sequence
  Description of Artificial Sequence: Synthetic oligonucleotide
ggagtattgggacggggagacacggaa

SEQ ID NO: 358550 - DNA, 36 bp, Artificial Sequence; identical to SEQ ID NO: 233881
  Description of Artificial Sequence: Synthetic oligonucleotide

SEQ ID NO: 358551 - DNA, 28 bp, Artificial Sequence
  Description of Artificial Sequence: Synthetic oligonucleotide
gagtattgggacggggagacacggaaag

SEQ ID NO: 358552 - DNA, 36 bp, Artificial Sequence; identical to SEQ ID NO: 233882
  Description of Artificial Sequence: Synthetic oligonucleotide

SEQ ID NO: 358553 - DNA, 29 bp, Artificial Sequence
  Description of Artificial Sequence: Synthetic oligonucleotide
agtattgggacggggagacacggaaagtg

SEQ ID NO: 358554 - DNA, 36 bp, Artificial Sequence; identical to SEQ ID NO: 233883
  Description of Artificial Sequence: Synthetic oligonucleotide

SEQ ID NO: 358555 - DNA, 28 bp, Artificial Sequence
  Description of Artificial Sequence: Synthetic oligonucleotide
gtattgggacggggagacacggaaagtg

SEQ ID NO: 358556 - DNA, 35 bp, Artificial Sequence; identical to SEQ ID NO: 233884
  Description of Artificial Sequence: Synthetic oligonucleotide

SEQ ID NO: 358557 - DNA, 30 bp, Artificial Sequence; identical to SEQ ID NO: 3329
  Description of Artificial Sequence: Synthetic oligonucleotide

SEQ ID NO: 358558 - DNA, 34 bp, Artificial Sequence; identical to SEQ ID NO: 233885
  Description of Artificial Sequence: Synthetic oligonucleotide

SEQ ID NO: 358559 - DNA, 29 bp, Artificial Sequence
  Description of Artificial Sequence: Synthetic oligonucleotide
attgggacggggagacacggaaagtgaag

SEQ ID NO: 358560 - DNA, 35 bp, Artificial Sequence; identical to SEQ ID NO: 233886
  Description of Artificial Sequence: Synthetic oligonucleotide

SEQ ID NO: 358561 - DNA, 28 bp, Artificial Sequence
  Description of Artificial Sequence: Synthetic oligonucleotide
ttgggacggggagacacggaaagtgaag

SEQ ID NO: 358562 - DNA, 35 bp, Artificial Sequence; identical to SEQ ID NO: 233887
  Description of Artificial Sequence: Synthetic oligonucleotide

SEQ ID NO: 358563 - DNA, 27 bp, Artificial Sequence
  Description of Artificial Sequence: Synthetic oligonucleotide
tgggacggggagacacggaaagtgaag

SEQ ID NO: 358564 - DNA, 35 bp, Artificial Sequence; identical to SEQ ID NO: 233888
  Description of Artificial Sequence: Synthetic oligonucleotide

SEQ ID NO: 358565 - DNA, 26 bp, Artificial Sequence
  Description of Artificial Sequence: Synthetic oligonucleotide
gggacggggagacacggaaagtgaag

SEQ ID NO: 358566 - DNA, 34 bp, Artificial Sequence; identical to SEQ ID NO: 233889
  Description of Artificial Sequence: Synthetic oligonucleotide

SEQ ID NO: 358567 - DNA, 26 bp, Artificial Sequence
  Description of Artificial Sequence: Synthetic oligonucleotide
ggacggggagacacggaaagtgaagg

SEQ ID NO: 358568 - DNA, 35 bp, Artificial Sequence; identical to SEQ ID NO: 233890
  Description of Artificial Sequence: Synthetic oligonucleotide

SEQ ID NO: 358569 - DNA, 26 bp, Artificial Sequence
  Description of Artificial Sequence: Synthetic oligonucleotide
gacggggagacacggaaagtgaaggc

SEQ ID NO: 358570 - DNA, 34 bp, Artificial Sequence; identical to SEQ ID NO: 233891
  Description of Artificial Sequence: Synthetic oligonucleotide

SEQ ID NO: 358571 - DNA, 26 bp, Artificial Sequence
  Description of Artificial Sequence: Synthetic oligonucleotide
acggggagacacggaaagtgaaggcc

SEQ ID NO: 358572 - DNA, 33 bp, Artificial Sequence; identical to SEQ ID NO: 233892
  Description of Artificial Sequence: Synthetic oligonucleotide

SEQ ID NO: 358573 - DNA, 25 bp, Artificial Sequence
  Description of Artificial Sequence: Synthetic oligonucleotide
cggggagacacggaaagtgaaggcc

SEQ ID NO: 358574 - DNA, 32 bp, Artificial Sequence; identical to SEQ ID NO: 233893
  Description of Artificial Sequence: Synthetic oligonucleotide

SEQ ID NO: 358575 - DNA, 26 bp, Artificial Sequence
  Description of Artificial Sequence: Synthetic oligonucleotide
ggggagacacggaaagtgaaggccca

SEQ ID NO: 358576 - DNA, 31 bp, Artificial Sequence; identical to SEQ ID NO: 233894
  Description of Artificial Sequence: Synthetic oligonucleotide

SEQ ID NO: 358577 - DNA, 27 bp, Artificial Sequence
  Description of Artificial Sequence: Synthetic oligonucleotide
gggagacacggaaagtgaaggcccact

SEQ ID NO: 358578 - DNA, 32 bp, Artificial Sequence; identical to SEQ ID NO: 233895
  Description of Artificial Sequence: Synthetic oligonucleotide

SEQ ID NO: 358579 - DNA, 27 bp, Artificial Sequence
  Description of Artificial Sequence: Synthetic oligonucleotide
ggagacacggaaagtgaaggcccactc

SEQ ID NO: 358580 - DNA, 32 bp, Artificial Sequence; identical to SEQ ID NO: 233896
  Description of Artificial Sequence: Synthetic oligonucleotide

SEQ ID NO: 358581 - DNA, 28 bp, Artificial Sequence
  Description of Artificial Sequence: Synthetic oligonucleotide
gagacacggaaagtgaaggcccactcac

SEQ ID NO: 358582 - DNA, 31 bp, Artificial Sequence; identical to SEQ ID NO: 233897
  Description of Artificial Sequence: Synthetic oligonucleotide

SEQ ID NO: 358583 - DNA, 29 bp, Artificial Sequence
  Description of Artificial Sequence: Synthetic oligonucleotide
agacacggaaagtgaaggcccactcacag

SEQ ID NO: 358584 - DNA, 31 bp, Artificial Sequence; identical to SEQ ID NO: 233898
  Description of Artificial Sequence: Synthetic oligonucleotide

SEQ ID NO: 358585 - DNA, 28 bp, Artificial Sequence
  Description of Artificial Sequence: Synthetic oligonucleotide
gacacggaaagtgaaggcccactcacag

SEQ ID NO: 358586 - DNA, 30 bp, Artificial Sequence; identical to SEQ ID NO: 233899
  Description of Artificial Sequence: Synthetic oligonucleotide

SEQ ID NO: 358587 - DNA, 29 bp, Artificial Sequence
  Description of Artificial Sequence: Synthetic oligonucleotide
acacggaaagtgaaggcccactcacagac

SEQ ID NO: 358588 - DNA, 29 bp, Artificial Sequence
  Description of Artificial Sequence: Synthetic oligonucleotide
atcttgtaccaccttacggtcgctctggc

SEQ ID NO: 358589 - DNA, 28 bp, Artificial Sequence
  Description of Artificial Sequence: Synthetic oligonucleotide
cacggaaagtgaaggcccactcacagac

SEQ ID NO: 358590 - DNA, 28 bp, Artificial Sequence
  Description of Artificial Sequence: Synthetic oligonucleotide
tcttgtaccaccttacggtcgctctggc

SEQ ID NO: 358591 - DNA, 29 bp, Artificial Sequence
  Description of Artificial Sequence: Synthetic oligonucleotide
acggaaagtgaaggcccactcacagactc

SEQ ID NO: 358592 - DNA, 27 bp, Artificial Sequence
  Description of Artificial Sequence: Synthetic oligonucleotide
cttgtaccaccttacggtcgctctggc

SEQ ID NO: 358593 - DNA, 28 bp, Artificial Sequence
  Description of Artificial Sequence: Synthetic oligonucleotide
cggaaagtgaaggcccactcacagactc

SEQ ID NO: 358594 - DNA, 27 bp, Artificial Sequence
  Description of Artificial Sequence: Synthetic oligonucleotide
ttgtaccaccttacggtcgctctggcc

SEQ ID NO: 358595 - DNA, 29 bp, Artificial Sequence
  Description of Artificial Sequence: Synthetic oligonucleotide
ggaaagtgaaggcccactcacagactcac

SEQ ID NO: 358596 - DNA, 27 bp, Artificial Sequence
  Description of Artificial Sequence: Synthetic oligonucleotide
tgtaccaccttacggtcgctctggcca

SEQ ID NO: 358597 - DNA, 29 bp, Artificial Sequence
  Description of Artificial Sequence: Synthetic oligonucleotide
gaaagtgaaggcccactcacagactcacc

SEQ ID NO: 358598 - DNA, 26 bp, Artificial Sequence
  Description of Artificial Sequence: Synthetic oligonucleotide
gtaccaccttacggtcgctctggcca

SEQ ID NO: 358599 - DNA, 29 bp, Artificial Sequence
  Description of Artificial Sequence: Synthetic oligonucleotide
aaagtgaaggcccactcacagactcaccg

SEQ ID NO: 358600 - DNA, 27 bp, Artificial Sequence
  Description of Artificial Sequence: Synthetic oligonucleotide
taccaccttacggtcgctctggccact

SEQ ID NO: 358601 - DNA, 28 bp, Artificial Sequence
  Description of Artificial Sequence: Synthetic oligonucleotide
aagtgaaggcccactcacagactcaccg

SEQ ID NO: 358602 - DNA, 27 bp, Artificial Sequence
  Description of Artificial Sequence: Synthetic oligonucleotide
accaccttacggtcgctctggccacta

SEQ ID NO: 358603 - DNA, 27 bp, Artificial Sequence
  Description of Artificial Sequence: Synthetic oligonucleotide
agtgaaggcccactcacagactcaccg

SEQ ID NO: 358604 - DNA, 26 bp, Artificial Sequence
  Description of Artificial Sequence: Synthetic oligonucleotide
ccaccttacggtcgctctggccacta

SEQ ID NO: 358605 - DNA, 27 bp, Artificial Sequence
  Description of Artificial Sequence: Synthetic oligonucleotide
gtgaaggcccactcacagactcaccga

SEQ ID NO: 358606 - DNA, 27 bp, Artificial Sequence
  Description of Artificial Sequence: Synthetic oligonucleotide
caccttacggtcgctctggccactaca

SEQ ID NO: 358607 - DNA, 27 bp, Artificial Sequence
  Description of Artificial Sequence: Synthetic oligonucleotide
tgaaggcccactcacagactcaccgag

SEQ ID NO: 358608 - DNA, 27 bp, Artificial Sequence
  Description of Artificial Sequence: Synthetic oligonucleotide
accttacggtcgctctggccactacac

SEQ ID NO: 358609 - DNA, 27 bp, Artificial Sequence
  Description of Artificial Sequence: Synthetic oligonucleotide
gaaggcccactcacagactcaccgagt

SEQ ID NO: 358610 - DNA, 26 bp, Artificial Sequence
  Description of Artificial Sequence: Synthetic oligonucleotide
ccttacggtcgctctggccactacac

SEQ ID NO: 358611 - DNA, 27 bp, Artificial Sequence
  Description of Artificial Sequence: Synthetic oligonucleotide
aaggcccactcacagactcaccgagtg

SEQ ID NO: 358612 - DNA, 26 bp, Artificial Sequence
  Description of Artificial Sequence: Synthetic oligonucleotide
cttacggtcgctctggccactacacc

SEQ ID NO: 358613 - DNA, 26 bp, Artificial Sequence
  Description of Artificial Sequence: Synthetic oligonucleotide
aggcccactcacagactcaccgagtg

SEQ ID NO: 358614 - DNA, 27 bp, Artificial Sequence
  Description of Artificial Sequence: Synthetic oligonucleotide
ttacggtcgctctggccactacaccca

SEQ ID NO: 358615 - DNA, 25 bp, Artificial Sequence
  Description of Artificial Sequence: Synthetic oligonucleotide
ggcccactcacagactcaccgagtg

SEQ ID NO: 358616 - DNA, 27 bp, Artificial Sequence
  Description of Artificial Sequence: Synthetic oligonucleotide
tacggtcgctctggccactacacccat

SEQ ID NO: 358617 - DNA, 26 bp, Artificial Sequence
  Description of Artificial Sequence: Synthetic oligonucleotide
gcccactcacagactcaccgagtgga

SEQ ID NO: 358618 - DNA, 26 bp, Artificial Sequence
  Description of Artificial Sequence: Synthetic oligonucleotide
acggtcgctctggccactacacccat

SEQ ID NO: 358619 - DNA, 26 bp, Artificial Sequence
  Description of Artificial Sequence: Synthetic oligonucleotide
cccactcacagactcaccgagtggac

SEQ ID NO: 358620 - DNA, 25 bp, Artificial Sequence
  Description of Artificial Sequence: Synthetic oligonucleotide
cggtcgctctggccactacacccat

SEQ ID NO: 358621 - DNA, 27 bp, Artificial Sequence
  Description of Artificial Sequence: Synthetic oligonucleotide
ccactcacagactcaccgagtggacct

SEQ ID NO: 358622 - DNA, 27 bp, Artificial Sequence
  Description of Artificial Sequence: Synthetic oligonucleotide
ggtcgctctggccactacacccatcaa

SEQ ID NO: 358623 - DNA, 27 bp, Artificial Sequence
  Description of Artificial Sequence: Synthetic oligonucleotide
cactcacagactcaccgagtggacctg

SEQ ID NO: 358624 - DNA, 30 bp, Artificial Sequence; identical to SEQ ID NO: 233918
  Description of Artificial Sequence: Synthetic oligonucleotide

SEQ ID NO: 358625 - DNA, 27 bp, Artificial Sequence
  Description of Artificial Sequence: Synthetic oligonucleotide
actcacagactcaccgagtggacctgg

SEQ ID NO: 358626 - DNA, 32 bp, Artificial Sequence; identical to SEQ ID NO: 233919
  Description of Artificial Sequence: Synthetic oligonucleotide

SEQ ID NO: 358627 - DNA, 26 bp, Artificial Sequence
  Description of Artificial Sequence: Synthetic oligonucleotide
ctcacagactcaccgagtggacctgg

SEQ ID NO: 358628 - DNA, 31 bp, Artificial Sequence; identical to SEQ ID NO: 233920
  Description of Artificial Sequence: Synthetic oligonucleotide

SEQ ID NO: 358629 - DNA, 26 bp, Artificial Sequence
  Description of Artificial Sequence: Synthetic oligonucleotide
tcacagactcaccgagtggacctggg

SEQ ID NO: 358630 - DNA, 31 bp, Artificial Sequence; identical to SEQ ID NO: 233921
  Description of Artificial Sequence: Synthetic oligonucleotide

SEQ ID NO: 358631 - DNA, 25 bp, Artificial Sequence
  Description of Artificial Sequence: Synthetic oligonucleotide
cacagactcaccgagtggacctggg

SEQ ID NO: 358632 - DNA, 32 bp, Artificial Sequence; identical to SEQ ID NO: 233922
  Description of Artificial Sequence: Synthetic oligonucleotide

SEQ ID NO: 358633 - DNA, 26 bp, Artificial Sequence
  Description of Artificial Sequence: Synthetic oligonucleotide
acagactcaccgagtggacctgggga

SEQ ID NO: 358634 - DNA, 34 bp, Artificial Sequence; identical to SEQ ID NO: 233923
  Description of Artificial Sequence: Synthetic oligonucleotide

SEQ ID NO: 358635 - DNA, 25 bp, Artificial Sequence
  Description of Artificial Sequence: Synthetic oligonucleotide
cagactcaccgagtggacctgggga

SEQ ID NO: 358636 - DNA, 33 bp, Artificial Sequence; identical to SEQ ID NO: 233924
  Description of Artificial Sequence: Synthetic oligonucleotide

SEQ ID NO: 358637 - DNA, 25 bp, Artificial Sequence
  Description of Artificial Sequence: Synthetic oligonucleotide
agactcaccgagtggacctggggac

SEQ ID NO: 358638 - DNA, 34 bp, Artificial Sequence; identical to SEQ ID NO: 233925
  Description of Artificial Sequence: Synthetic oligonucleotide

SEQ ID NO: 358639 - DNA, 24 bp, Artificial Sequence
  Description of Artificial Sequence: Synthetic oligonucleotide
gactcaccgagtggacctggggac

SEQ ID NO: 358640 - DNA, 33 bp, Artificial Sequence; identical to SEQ ID NO: 233926
  Description of Artificial Sequence: Synthetic oligonucleotide

SEQ ID NO: 358641 - DNA, 24 bp, Artificial Sequence
  Description of Artificial Sequence: Synthetic oligonucleotide
actcaccgagtggacctggggacc

SEQ ID NO: 358642 - DNA, 33 bp, Artificial Sequence; identical to SEQ ID NO: 233927
  Description of Artificial Sequence: Synthetic oligonucleotide

SEQ ID NO: 358643 - DNA, 23 bp, Artificial Sequence
  Description of Artificial Sequence: Synthetic oligonucleotide
ctcaccgagtggacctggggacc

SEQ ID NO: 358644 - DNA, 34 bp, Artificial Sequence; identical to SEQ ID NO: 233928
  Description of Artificial Sequence: Synthetic oligonucleotide

SEQ ID NO: 358645 - DNA, 24 bp, Artificial Sequence
  Description of Artificial Sequence: Synthetic oligonucleotide
tcaccgagtggacctggggaccct

SEQ ID NO: 358646 - DNA, 36 bp, Artificial Sequence; identical to SEQ ID NO: 233929
  Description of Artificial Sequence: Synthetic oligonucleotide

SEQ ID NO: 358647 - DNA, 23 bp, Artificial Sequence
  Description of Artificial Sequence: Synthetic oligonucleotide
caccgagtggacctggggaccct

SEQ ID NO: 358648 - DNA, 38 bp, Artificial Sequence; identical to SEQ ID NO: 233930
  Description of Artificial Sequence: Synthetic oligonucleotide

SEQ ID NO: 358649 - DNA, 23 bp, Artificial Sequence
  Description of Artificial Sequence: Synthetic oligonucleotide
accgagtggacctggggaccctg

SEQ ID NO: 358650 - DNA, 37 bp, Artificial Sequence; identical to SEQ ID NO: 233931
  Description of Artificial Sequence: Synthetic oligonucleotide

SEQ ID NO: 358651 - DNA, 22 bp, Artificial Sequence
  Description of Artificial Sequence: Synthetic oligonucleotide
ccgagtggacctggggaccctg

SEQ ID NO: 358652 - DNA, 37 bp, Artificial Sequence; identical to SEQ ID NO: 233932
  Description of Artificial Sequence: Synthetic oligonucleotide

SEQ ID NO: 358653 - DNA, 22 bp, Artificial Sequence
  Description of Artificial Sequence: Synthetic oligonucleotide
cgagtggacctggggaccctgc

SEQ ID NO: 358654 - DNA, 36 bp, Artificial Sequence; identical to SEQ ID NO: 233933
  Description of Artificial Sequence: Synthetic oligonucleotide

SEQ ID NO: 358655 - DNA, 22 bp, Artificial Sequence
  Description of Artificial Sequence: Synthetic oligonucleotide
gagtggacctggggaccctgcg

SEQ ID NO: 358656 - DNA, 35 bp, Artificial Sequence; identical to SEQ ID NO: 233934
  Description of Artificial Sequence: Synthetic oligonucleotide

SEQ ID NO: 358657 - DNA, 22 bp, Artificial Sequence
  Description of Artificial Sequence: Synthetic oligonucleotide
agtggacctggggaccctgcgc

SEQ ID NO: 358658 - DNA, 36 bp, Artificial Sequence; identical to SEQ ID NO: 233935
  Description of Artificial Sequence: Synthetic oligonucleotide

SEQ ID NO: 358659 - DNA, 21 bp, Artificial Sequence
  Description of Artificial Sequence: Synthetic oligonucleotide
gtggacctggggaccctgcgc

SEQ ID NO: 358660 - DNA, 35 bp, Artificial Sequence; identical to SEQ ID NO: 233936
  Description of Artificial Sequence: Synthetic oligonucleotide

SEQ ID NO: 358661 - DNA, 21 bp, Artificial Sequence
  Description of Artificial Sequence: Synthetic oligonucleotide
tggacctggggaccctgcgcg

SEQ ID NO: 358662 - DNA, 37 bp, Artificial Sequence; identical to SEQ ID NO: 233937
  Description of Artificial Sequence: Synthetic oligonucleotide

SEQ ID NO: 358663 - DNA, 20 bp, Artificial Sequence
  Description of Artificial Sequence: Synthetic oligonucleotide
ggacctggggaccctgcgcg

SEQ ID NO: 358664 - DNA, 37 bp, Artificial Sequence; identical to SEQ ID NO: 233938
  Description of Artificial Sequence: Synthetic oligonucleotide

SEQ ID NO: 358665 - DNA, 20 bp, Artificial Sequence
  Description of Artificial Sequence: Synthetic oligonucleotide
gacctggggaccctgcgcgg

SEQ ID NO: 358666 - DNA, 38 bp, Artificial Sequence; identical to SEQ ID NO: 233939
  Description of Artificial Sequence: Synthetic oligonucleotide

SEQ ID NO: 358667 - DNA, 25 bp, Artificial Sequence
  Description of Artificial Sequence: Synthetic oligonucleotide
cgcggctactacaaccagagcgagg

SEQ ID NO: 358668 - DNA, 37 bp, Artificial Sequence; identical to SEQ ID NO: 233940
  Description of Artificial Sequence: Synthetic oligonucleotide

SEQ ID NO: 358669 - DNA, 25 bp, Artificial Sequence
  Description of Artificial Sequence: Synthetic oligonucleotide
gcggctactacaaccagagcgaggc

SEQ ID NO: 358670 - DNA, 36 bp, Artificial Sequence; identical to SEQ ID NO: 233941
  Description of Artificial Sequence: Synthetic oligonucleotide

SEQ ID NO: 358671 - DNA, 25 bp, Artificial Sequence
  Description of Artificial Sequence: Synthetic oligonucleotide
cggctactacaaccagagcgaggcc

SEQ ID NO: 358672 - DNA, 36 bp, Artificial Sequence; identical to SEQ ID NO: 233942
  Description of Artificial Sequence: Synthetic oligonucleotide

SEQ ID NO: 358673 - DNA, 25 bp, Artificial Sequence
  Description of Artificial Sequence: Synthetic oligonucleotide
ggctactacaaccagagcgaggccg

SEQ ID NO: 358674 - DNA, 35 bp, Artificial Sequence; identical to SEQ ID NO: 233943
  Description of Artificial Sequence: Synthetic oligonucleotide

SEQ ID NO: 358675 - DNA, 27 bp, Artificial Sequence
  Description of Artificial Sequence: Synthetic oligonucleotide
gctactacaaccagagcgaggccggtt

SEQ ID NO: 358676 - DNA, 34 bp, Artificial Sequence; identical to SEQ ID NO: 233944
  Description of Artificial Sequence: Synthetic oligonucleotide

SEQ ID NO: 358677 - DNA, 27 bp, Artificial Sequence
  Description of Artificial Sequence: Synthetic oligonucleotide
ctactacaaccagagcgaggccggttc

SEQ ID NO: 358678 - DNA, 33 bp, Artificial Sequence; identical to SEQ ID NO: 233945
  Description of Artificial Sequence: Synthetic oligonucleotide

SEQ ID NO: 358679 - DNA, 28 bp, Artificial Sequence
  Description of Artificial Sequence: Synthetic oligonucleotide
tactacaaccagagcgaggccggttctc

SEQ ID NO: 358680 - DNA, 32 bp, Artificial Sequence; identical to SEQ ID NO: 233946
  Description of Artificial Sequence: Synthetic oligonucleotide

SEQ ID NO: 358681 - DNA, 27 bp, Artificial Sequence
  Description of Artificial Sequence: Synthetic oligonucleotide
actacaaccagagcgaggccggttctc

SEQ ID NO: 358682 - DNA, 31 bp, Artificial Sequence; identical to SEQ ID NO: 233947
  Description of Artificial Sequence: Synthetic oligonucleotide

SEQ ID NO: 358683 - DNA, 27 bp, Artificial Sequence
  Description of Artificial Sequence: Synthetic oligonucleotide
ctacaaccagagcgaggccggttctca

SEQ ID NO: 358684 - DNA, 32 bp, Artificial Sequence; identical to SEQ ID NO: 233948
  Description of Artificial Sequence: Synthetic oligonucleotide

SEQ ID NO: 358685 - DNA, 27 bp, Artificial Sequence
  Description of Artificial Sequence: Synthetic oligonucleotide
tacaaccagagcgaggccggttctcac

SEQ ID NO: 358686 - DNA, 31 bp, Artificial Sequence; identical to SEQ ID NO: 233949
  Description of Artificial Sequence: Synthetic oligonucleotide

SEQ ID NO: 358687 - DNA, 27 bp, Artificial Sequence
  Description of Artificial Sequence: Synthetic oligonucleotide
acaaccagagcgaggccggttctcaca

SEQ ID NO: 358688 - DNA, 30 bp, Artificial Sequence; identical to SEQ ID NO: 233950
  Description of Artificial Sequence: Synthetic oligonucleotide

SEQ ID NO: 358689 - DNA, 26 bp, Artificial Sequence
  Description of Artificial Sequence: Synthetic oligonucleotide
caaccagagcgaggccggttctcaca

SEQ ID NO: 358690 - DNA, 31 bp, Artificial Sequence; identical to SEQ ID NO: 233951
  Description of Artificial Sequence: Synthetic oligonucleotide

SEQ ID NO: 358691 - DNA, 26 bp, Artificial Sequence
  Description of Artificial Sequence: Synthetic oligonucleotide
aaccagagcgaggccggttctcacac

SEQ ID NO: 358692 - DNA, 31 bp, Artificial Sequence; identical to SEQ ID NO: 233952
  Description of Artificial Sequence: Synthetic oligonucleotide

SEQ ID NO: 358693 - DNA, 25 bp, Artificial Sequence
  Description of Artificial Sequence: Synthetic oligonucleotide
accagagcgaggccggttctcacac

SEQ ID NO: 358694 - DNA, 30 bp, Artificial Sequence; identical to SEQ ID NO: 233953
  Description of Artificial Sequence: Synthetic oligonucleotide

SEQ ID NO: 358695 - DNA, 24 bp, Artificial Sequence
  Description of Artificial Sequence: Synthetic oligonucleotide
ccagagcgaggccggttctcacac

SEQ ID NO: 358696 - DNA, 32 bp, Artificial Sequence; identical to SEQ ID NO: 233954
  Description of Artificial Sequence: Synthetic oligonucleotide

SEQ ID NO: 358697 - DNA, 24 bp, Artificial Sequence
  Description of Artificial Sequence: Synthetic oligonucleotide
cagagcgaggccggttctcacacc

SEQ ID NO: 358698 - DNA, 31 bp, Artificial Sequence; identical to SEQ ID NO: 233955
  Description of Artificial Sequence: Synthetic oligonucleotide

SEQ ID NO: 358699 - DNA, 25 bp, Artificial Sequence
  Description of Artificial Sequence: Synthetic oligonucleotide
agagcgaggccggttctcacaccgt

SEQ ID NO: 358700 - DNA, 30 bp, Artificial Sequence; identical to SEQ ID NO: 233956
  Description of Artificial Sequence: Synthetic oligonucleotide

SEQ ID NO: 358701 - DNA, 24 bp, Artificial Sequence
  Description of Artificial Sequence: Synthetic oligonucleotide
gagcgaggccggttctcacaccgt

SEQ ID NO: 358702 - DNA, 30 bp, Artificial Sequence; identical to SEQ ID NO: 233957
  Description of Artificial Sequence: Synthetic oligonucleotide

SEQ ID NO: 358703 - DNA, 24 bp, Artificial Sequence
  Description of Artificial Sequence: Synthetic oligonucleotide
agcgaggccggttctcacaccgtc

SEQ ID NO: 358704 - DNA, 29 bp, Artificial Sequence
  Description of Artificial Sequence: Synthetic oligonucleotide
gcacttctacgtgtacctggagtggaagg

SEQ ID NO: 358705 - DNA, 23 bp, Artificial Sequence
  Description of Artificial Sequence: Synthetic oligonucleotide
gcgaggccggttctcacaccgtc

SEQ ID NO: 358706 - DNA, 30 bp, Artificial Sequence; identical to SEQ ID NO: 233959
  Description of Artificial Sequence: Synthetic oligonucleotide

SEQ ID NO: 358707 - DNA, 24 bp, Artificial Sequence
  Description of Artificial Sequence: Synthetic oligonucleotide
cgaggccggttctcacaccgtcca

SEQ ID NO: 358708 - DNA, 31 bp, Artificial Sequence; identical to SEQ ID NO: 233960
  Description of Artificial Sequence: Synthetic oligonucleotide

SEQ ID NO: 358709 - DNA, 25 bp, Artificial Sequence
  Description of Artificial Sequence: Synthetic oligonucleotide
gaggccggttctcacaccgtccaga

SEQ ID NO: 358710 - DNA, 30 bp, Artificial Sequence; identical to SEQ ID NO: 233961
  Description of Artificial Sequence: Synthetic oligonucleotide

SEQ ID NO: 358711 - DNA, 25 bp, Artificial Sequence
  Description of Artificial Sequence: Synthetic oligonucleotide
aggccggttctcacaccgtccagag

SEQ ID NO: 358712 - DNA, 31 bp, Artificial Sequence; identical to SEQ ID NO: 233962
  Description of Artificial Sequence: Synthetic oligonucleotide

SEQ ID NO: 358713 - DNA, 24 bp, Artificial Sequence
  Description of Artificial Sequence: Synthetic oligonucleotide
ggccggttctcacaccgtccagag

SEQ ID NO: 358714 - DNA, 30 bp, Artificial Sequence; identical to SEQ ID NO: 233963
  Description of Artificial Sequence: Synthetic oligonucleotide

SEQ ID NO: 358715 - DNA, 26 bp, Artificial Sequence
  Description of Artificial Sequence: Synthetic oligonucleotide
gccggttctcacaccgtccagaggat

SEQ ID NO: 358716 - DNA, 29 bp, Artificial Sequence
  Description of Artificial Sequence: Synthetic oligonucleotide
ctacgtgtacctggagtggaaggagacag

SEQ ID NO: 358717 - DNA, 27 bp, Artificial Sequence
  Description of Artificial Sequence: Synthetic oligonucleotide
ccggttctcacaccgtccagaggatgt

SEQ ID NO: 358718 - DNA, 30 bp, Artificial Sequence; identical to SEQ ID NO: 233965
  Description of Artificial Sequence: Synthetic oligonucleotide

SEQ ID NO: 358719 - DNA, 29 bp, Artificial Sequence
  Description of Artificial Sequence: Synthetic oligonucleotide
cggttctcacaccgtccagaggatgtatg

SEQ ID NO: 358720 - DNA, 29 bp, Artificial Sequence
  Description of Artificial Sequence: Synthetic oligonucleotide
acgtgtacctggagtggaaggagacagtc

SEQ ID NO: 358721 - DNA, 29 bp, Artificial Sequence
  Description of Artificial Sequence: Synthetic oligonucleotide
ggttctcacaccgtccagaggatgtatgg

SEQ ID NO: 358722 - DNA, 28 bp, Artificial Sequence
  Description of Artificial Sequence: Synthetic oligonucleotide
cgtgtacctggagtggaaggagacagtc

SEQ ID NO: 358723 - DNA, 29 bp, Artificial Sequence
  Description of Artificial Sequence: Synthetic oligonucleotide
gttctcacaccgtccagaggatgtatggc

SEQ ID NO: 358724 - DNA, 29 bp, Artificial Sequence
  Description of Artificial Sequence: Synthetic oligonucleotide
gtgtacctggagtggaaggagacagtctg

SEQ ID NO: 358725 - DNA, 30 bp, Artificial Sequence; identical to SEQ ID NO: 2103
  Description of Artificial Sequence: Synthetic oligonucleotide

SEQ ID NO: 358726 - DNA, 29 bp, Artificial Sequence
  Description of Artificial Sequence: Synthetic oligonucleotide
tgtacctggagtggaaggagacagtctgg

SEQ ID NO: 358727 - DNA, 29 bp, Artificial Sequence
  Description of Artificial Sequence: Synthetic oligonucleotide
tctcacaccgtccagaggatgtatggctg

SEQ ID NO: 358728 - DNA, 28 bp, Artificial Sequence
  Description of Artificial Sequence: Synthetic oligonucleotide
gtacctggagtggaaggagacagtctgg

SEQ ID NO: 358729 - DNA, 28 bp, Artificial Sequence
  Description of Artificial Sequence: Synthetic oligonucleotide
ctcacaccgtccagaggatgtatggctg

SEQ ID NO: 358730 - DNA, 28 bp, Artificial Sequence
  Description of Artificial Sequence: Synthetic oligonucleotide
tacctggagtggaaggagacagtctggc

SEQ ID NO: 358731 - DNA, 28 bp, Artificial Sequence
  Description of Artificial Sequence: Synthetic oligonucleotide
tcacaccgtccagaggatgtatggctgc

SEQ ID NO: 358732 - DNA, 27 bp, Artificial Sequence
  Description of Artificial Sequence: Synthetic oligonucleotide
acctggagtggaaggagacagtctggc

SEQ ID NO: 358733 - DNA, 27 bp, Artificial Sequence
  Description of Artificial Sequence: Synthetic oligonucleotide
cacaccgtccagaggatgtatggctgc

SEQ ID NO: 358734 - DNA, 26 bp, Artificial Sequence
  Description of Artificial Sequence: Synthetic oligonucleotide
cctggagtggaaggagacagtctggc

SEQ ID NO: 358735 - DNA, 27 bp, Artificial Sequence
  Description of Artificial Sequence: Synthetic oligonucleotide
acaccgtccagaggatgtatggctgcg

SEQ ID NO: 358736 - DNA, 26 bp, Artificial Sequence
  Description of Artificial Sequence: Synthetic oligonucleotide
ctggagtggaaggagacagtctggcg

SEQ ID NO: 358737 - DNA, 27 bp, Artificial Sequence
  Description of Artificial Sequence: Synthetic oligonucleotide
caccgtccagaggatgtatggctgcga

SEQ ID NO: 358738 - DNA, 27 bp, Artificial Sequence
  Description of Artificial Sequence: Synthetic oligonucleotide
tggagtggaaggagacagtctggcgga

SEQ ID NO: 358739 - DNA, 27 bp, Artificial Sequence
  Description of Artificial Sequence: Synthetic oligonucleotide
accgtccagaggatgtatggctgcgac

SEQ ID NO: 358740 - DNA, 27 bp, Artificial Sequence
  Description of Artificial Sequence: Synthetic oligonucleotide
ggagtggaaggagacagtctggcggat

SEQ ID NO: 358741 - DNA, 26 bp, Artificial Sequence
  Description of Artificial Sequence: Synthetic oligonucleotide
ccgtccagaggatgtatggctgcgac

SEQ ID NO: 358742 - DNA, 27 bp, Artificial Sequence
  Description of Artificial Sequence: Synthetic oligonucleotide
gagtggaaggagacagtctggcggatg

SEQ ID NO: 358743 - DNA, 27 bp, Artificial Sequence
  Description of Artificial Sequence: Synthetic oligonucleotide
cgtccagaggatgtatggctgcgacgt

SEQ ID NO: 358744 - DNA, 27 bp, Artificial Sequence
  Description of Artificial Sequence: Synthetic oligonucleotide
agtggaaggagacagtctggcggatgc

SEQ ID NO: 358745 - DNA, 27 bp, Artificial Sequence
  Description of Artificial Sequence: Synthetic oligonucleotide
gtccagaggatgtatggctgcgacgtg

SEQ ID NO: 358746 - DNA, 26 bp, Artificial Sequence
  Description of Artificial Sequence: Synthetic oligonucleotide
gtggaaggagacagtctggcggatgc

SEQ ID NO: 358747 - DNA, 27 bp, Artificial Sequence
  Description of Artificial Sequence: Synthetic oligonucleotide
tccagaggatgtatggctgcgacgtgg

SEQ ID NO: 358748 - DNA, 27 bp, Artificial Sequence
  Description of Artificial Sequence: Synthetic oligonucleotide
tggaaggagacagtctggcggatgcct

SEQ ID NO: 358749 - DNA, 26 bp, Artificial Sequence
  Description of Artificial Sequence: Synthetic oligonucleotide
ccagaggatgtatggctgcgacgtgg

SEQ ID NO: 358750 - DNA, 26 bp, Artificial Sequence
  Description of Artificial Sequence: Synthetic oligonucleotide
ggaaggagacagtctggcggatgcct

SEQ ID NO: 358751 - DNA, 26 bp, Artificial Sequence
  Description of Artificial Sequence: Synthetic oligonucleotide
cagaggatgtatggctgcgacgtggg

SEQ ID NO: 358752 - DNA, 27 bp, Artificial Sequence
  Description of Artificial Sequence: Synthetic oligonucleotide
gaaggagacagtctggcggatgcctgt

SEQ ID NO: 358753 - DNA, 27 bp, Artificial Sequence
  Description of Artificial Sequence: Synthetic oligonucleotide
agaggatgtatggctgcgacgtggggt

SEQ ID NO: 358754 - DNA, 27 bp, Artificial Sequence
  Description of Artificial Sequence: Synthetic oligonucleotide
aaggagacagtctggcggatgcctgtg

SEQ ID NO: 358755 - DNA, 26 bp, Artificial Sequence
  Description of Artificial Sequence: Synthetic oligonucleotide
gaggatgtatggctgcgacgtggggt

SEQ ID NO: 358756 - DNA, 27 bp, Artificial Sequence
  Description of Artificial Sequence: Synthetic oligonucleotide
aggagacagtctggcggatgcctgtgt

SEQ ID NO: 358757 - DNA, 26 bp, Artificial Sequence
  Description of Artificial Sequence: Synthetic oligonucleotide
aggatgtatggctgcgacgtggggtc

SEQ ID NO: 358758 - DNA, 27 bp, Artificial Sequence
  Description of Artificial Sequence: Synthetic oligonucleotide
ggagacagtctggcggatgcctgtgta

SEQ ID NO: 358759 - DNA, 25 bp, Artificial Sequence
  Description of Artificial Sequence: Synthetic oligonucleotide
ggatgtatggctgcgacgtggggtc

SEQ ID NO: 358760 - DNA, 27 bp, Artificial Sequence
  Description of Artificial Sequence: Synthetic oligonucleotide
gagacagtctggcggatgcctgtgtac

SEQ ID NO: 358761 - DNA, 25 bp, Artificial Sequence
  Description of Artificial Sequence: Synthetic oligonucleotide
gatgtatggctgcgacgtggggtcg

SEQ ID NO: 358762 - DNA, 28 bp, Artificial Sequence
  Description of Artificial Sequence: Synthetic oligonucleotide
agacagtctggcggatgcctgtgtacag

SEQ ID NO: 358763 - DNA, 26 bp, Artificial Sequence
  Description of Artificial Sequence: Synthetic oligonucleotide
atgtatggctgcgacgtggggtcgga

SEQ ID NO: 358764 - DNA, 27 bp, Artificial Sequence
  Description of Artificial Sequence: Synthetic oligonucleotide
gacagtctggcggatgcctgtgtacag

SEQ ID NO: 358765 - DNA, 25 bp, Artificial Sequence
  Description of Artificial Sequence: Synthetic oligonucleotide
tgtatggctgcgacgtggggtcgga

SEQ ID NO: 358766 - DNA, 27 bp, Artificial Sequence
  Description of Artificial Sequence: Synthetic oligonucleotide
acagtctggcggatgcctgtgtacagc

SEQ ID NO: 358767 - DNA, 24 bp, Artificial Sequence
  Description of Artificial Sequence: Synthetic oligonucleotide
gtatggctgcgacgtggggtcgga

SEQ ID NO: 358768 - DNA, 27 bp, Artificial Sequence
  Description of Artificial Sequence: Synthetic oligonucleotide
cagtctggcggatgcctgtgtacagca

SEQ ID NO: 358769 - DNA, 25 bp, Artificial Sequence
  Description of Artificial Sequence: Synthetic oligonucleotide
tatggctgcgacgtggggtcggact

SEQ ID NO: 358770 - DNA, 32 bp, Artificial Sequence; identical to SEQ ID NO: 233991
  Description of Artificial Sequence: Synthetic oligonucleotide

SEQ ID NO: 358771 - DNA, 24 bp, Artificial Sequence
  Description of Artificial Sequence: Synthetic oligonucleotide
atggctgcgacgtggggtcggact

SEQ ID NO: 358772 - DNA, 31 bp, Artificial Sequence; identical to SEQ ID NO: 233992
  Description of Artificial Sequence: Synthetic oligonucleotide

SEQ ID NO: 358773 - DNA, 23 bp, Artificial Sequence
  Description of Artificial Sequence: Synthetic oligonucleotide
tggctgcgacgtggggtcggact

SEQ ID NO: 358774 - DNA, 31 bp, Artificial Sequence; identical to SEQ ID NO: 233993
  Description of Artificial Sequence: Synthetic oligonucleotide

SEQ ID NO: 358775 - DNA, 22 bp, Artificial Sequence
  Description of Artificial Sequence: Synthetic oligonucleotide
ggctgcgacgtggggtcggact

SEQ ID NO: 358776 - DNA, 30 bp, Artificial Sequence; identical to SEQ ID NO: 233994
  Description of Artificial Sequence: Synthetic oligonucleotide

SEQ ID NO: 358777 - DNA, 22 bp, Artificial Sequence
  Description of Artificial Sequence: Synthetic oligonucleotide
gctgcgacgtggggtcggactg

SEQ ID NO: 358778 - DNA, 32 bp, Artificial Sequence; identical to SEQ ID NO: 233995
  Description of Artificial Sequence: Synthetic oligonucleotide

SEQ ID NO: 358779 - DNA, 22 bp, Artificial Sequence
  Description of Artificial Sequence: Synthetic oligonucleotide
ctgcgacgtggggtcggactgg

SEQ ID NO: 358780 - DNA, 31 bp, Artificial Sequence; identical to SEQ ID NO: 233996
  Description of Artificial Sequence: Synthetic oligonucleotide

SEQ ID NO: 358781 - DNA, 22 bp, Artificial Sequence
  Description of Artificial Sequence: Synthetic oligonucleotide
tgcgacgtggggtcggactggc

SEQ ID NO: 358782 - DNA, 37 bp, Artificial Sequence; identical to SEQ ID NO: 233997
  Description of Artificial Sequence: Synthetic oligonucleotide

SEQ ID NO: 358783 - DNA, 21 bp, Artificial Sequence
  Description of Artificial Sequence: Synthetic oligonucleotide
gcgacgtggggtcggactggc

SEQ ID NO: 358784 - DNA, 37 bp, Artificial Sequence; identical to SEQ ID NO: 233998
  Description of Artificial Sequence: Synthetic oligonucleotide

SEQ ID NO: 358785 - DNA, 21 bp, Artificial Sequence
  Description of Artificial Sequence: Synthetic oligonucleotide
cgacgtggggtcggactggcg

SEQ ID NO: 358786 - DNA, 37 bp, Artificial Sequence; identical to SEQ ID NO: 233999
  Description of Artificial Sequence: Synthetic oligonucleotide

SEQ ID NO: 358787 - DNA, 23 bp, Artificial Sequence
  Description of Artificial Sequence: Synthetic oligonucleotide
gacgtggggtcggactggcgctt

SEQ ID NO: 358788 - DNA, 37 bp, Artificial Sequence; identical to SEQ ID NO: 234000
  Description of Artificial Sequence: Synthetic oligonucleotide

SEQ ID NO: 358789 - DNA, 23 bp, Artificial Sequence
  Description of Artificial Sequence: Synthetic oligonucleotide
acgtggggtcggactggcgcttc

SEQ ID NO: 358790 - DNA, 37 bp, Artificial Sequence; identical to SEQ ID NO: 234001
  Description of Artificial Sequence: Synthetic oligonucleotide

SEQ ID NO: 358791 - DNA, 22 bp, Artificial Sequence
  Description of Artificial Sequence: Synthetic oligonucleotide
cgtggggtcggactggcgcttc

SEQ ID NO: 358792 - DNA, 36 bp, Artificial Sequence; identical to SEQ ID NO: 234002
  Description of Artificial Sequence: Synthetic oligonucleotide

SEQ ID NO: 358793 - DNA, 23 bp, Artificial Sequence
  Description of Artificial Sequence: Synthetic oligonucleotide
gtggggtcggactggcgcttcct

SEQ ID NO: 358794 - DNA, 35 bp, Artificial Sequence; identical to SEQ ID NO: 234003
  Description of Artificial Sequence: Synthetic oligonucleotide

SEQ ID NO: 358795 - DNA, 23 bp, Artificial Sequence
  Description of Artificial Sequence: Synthetic oligonucleotide
tggggtcggactggcgcttcctc

SEQ ID NO: 358796 - DNA, 40 bp, Artificial Sequence; identical to SEQ ID NO: 234004
  Description of Artificial Sequence: Synthetic oligonucleotide

SEQ ID NO: 358797 - DNA, 22 bp, Artificial Sequence
  Description of Artificial Sequence: Synthetic oligonucleotide
ggggtcggactggcgcttcctc

SEQ ID NO: 358798 - DNA, 40 bp, Artificial Sequence; identical to SEQ ID NO: 234005
  Description of Artificial Sequence: Synthetic oligonucleotide

SEQ ID NO: 358799 - DNA, 22 bp, Artificial Sequence
  Description of Artificial Sequence: Synthetic oligonucleotide
gggtcggactggcgcttcctcc

SEQ ID NO: 358800 - DNA, 41 bp, Artificial Sequence; identical to SEQ ID NO: 234006
  Description of Artificial Sequence: Synthetic oligonucleotide

SEQ ID NO: 358801 - DNA, 22 bp, Artificial Sequence
  Description of Artificial Sequence: Synthetic oligonucleotide
ggtcggactggcgcttcctccg

SEQ ID NO: 358802 - DNA, 40 bp, Artificial Sequence; identical to SEQ ID NO: 234007
  Description of Artificial Sequence: Synthetic oligonucleotide

SEQ ID NO: 358803 - DNA, 22 bp, Artificial Sequence
  Description of Artificial Sequence: Synthetic oligonucleotide
gtcggactggcgcttcctccgc

SEQ ID NO: 358804 - DNA, 41 bp, Artificial Sequence; identical to SEQ ID NO: 234008
  Description of Artificial Sequence: Synthetic oligonucleotide

SEQ ID NO: 358805 - DNA, 22 bp, Artificial Sequence
  Description of Artificial Sequence: Synthetic oligonucleotide
tcggactggcgcttcctccgcg

SEQ ID NO: 358806 - DNA, 40 bp, Artificial Sequence; identical to SEQ ID NO: 234009
  Description of Artificial Sequence: Synthetic oligonucleotide

SEQ ID NO: 358807 - DNA, 21 bp, Artificial Sequence
  Description of Artificial Sequence: Synthetic oligonucleotide
cggactggcgcttcctccgcg

SEQ ID NO: 358808 - DNA, 41 bp, Artificial Sequence; identical to SEQ ID NO: 234010
  Description of Artificial Sequence: Synthetic oligonucleotide

SEQ ID NO: 358809 - DNA, 21 bp, Artificial Sequence
  Description of Artificial Sequence: Synthetic oligonucleotide
ggactggcgcttcctccgcgg

SEQ ID NO: 358810 - DNA, 40 bp, Artificial Sequence; identical to SEQ ID NO: 234011
  Description of Artificial Sequence: Synthetic oligonucleotide

SEQ ID NO: 358811 - DNA, 23 bp, Artificial Sequence
  Description of Artificial Sequence: Synthetic oligonucleotide
gactggcgcttcctccgcgggta

SEQ ID NO: 358812 - DNA, 39 bp, Artificial Sequence; identical to SEQ ID NO: 234012
  Description of Artificial Sequence: Synthetic oligonucleotide

SEQ ID NO: 358813 - DNA, 23 bp, Artificial Sequence
  Description of Artificial Sequence: Synthetic oligonucleotide
actggcgcttcctccgcgggtac

SEQ ID NO: 358814 - DNA, 42 bp, Artificial Sequence; identical to SEQ ID NO: 234013
  Description of Artificial Sequence: Synthetic oligonucleotide

SEQ ID NO: 358815 - DNA, 22 bp, Artificial Sequence
  Description of Artificial Sequence: Synthetic oligonucleotide
ctggcgcttcctccgcgggtac

SEQ ID NO: 358816 - DNA, 41 bp, Artificial Sequence; identical to SEQ ID NO: 234014
  Description of Artificial Sequence: Synthetic oligonucleotide

SEQ ID NO: 358817 - DNA, 23 bp, Artificial Sequence
  Description of Artificial Sequence: Synthetic oligonucleotide
tggcgcttcctccgcgggtacca

SEQ ID NO: 358818 - DNA, 43 bp, Artificial Sequence; identical to SEQ ID NO: 234015
  Description of Artificial Sequence: Synthetic oligonucleotide

SEQ ID NO: 358819 - DNA, 22 bp, Artificial Sequence
  Description of Artificial Sequence: Synthetic oligonucleotide
ggcgcttcctccgcgggtacca

SEQ ID NO: 358820 - DNA, 43 bp, Artificial Sequence; identical to SEQ ID NO: 234016
  Description of Artificial Sequence: Synthetic oligonucleotide

SEQ ID NO: 358821 - DNA, 22 bp, Artificial Sequence
  Description of Artificial Sequence: Synthetic oligonucleotide
gcgcttcctccgcgggtaccac

SEQ ID NO: 358822 - DNA, 42 bp, Artificial Sequence; identical to SEQ ID NO: 234017
  Description of Artificial Sequence: Synthetic oligonucleotide

SEQ ID NO: 358823 - DNA, 23 bp, Artificial Sequence
  Description of Artificial Sequence: Synthetic oligonucleotide
cgcttcctccgcgggtaccacca

SEQ ID NO: 358824 - DNA, 41 bp, Artificial Sequence; identical to SEQ ID NO: 234018
  Description of Artificial Sequence: Synthetic oligonucleotide

SEQ ID NO: 358825 - DNA, 25 bp, Artificial Sequence
  Description of Artificial Sequence: Synthetic oligonucleotide
gcttcctccgcgggtaccaccagta

SEQ ID NO: 358826 - DNA, 40 bp, Artificial Sequence; identical to SEQ ID NO: 234019
  Description of Artificial Sequence: Synthetic oligonucleotide

SEQ ID NO: 358827 - DNA, 25 bp, Artificial Sequence
  Description of Artificial Sequence: Synthetic oligonucleotide
cttcctccgcgggtaccaccagtac

SEQ ID NO: 358828 - DNA, 39 bp, Artificial Sequence; identical to SEQ ID NO: 234020
  Description of Artificial Sequence: Synthetic oligonucleotide

SEQ ID NO: 358829 - DNA, 25 bp, Artificial Sequence
  Description of Artificial Sequence: Synthetic oligonucleotide
ttcctccgcgggtaccaccagtacg

SEQ ID NO: 358830 - DNA, 38 bp, Artificial Sequence; identical to SEQ ID NO: 234021
  Description of Artificial Sequence: Synthetic oligonucleotide

SEQ ID NO: 358831 - DNA, 24 bp, Artificial Sequence
  Description of Artificial Sequence: Synthetic oligonucleotide
tcctccgcgggtaccaccagtacg

SEQ ID NO: 358832 - DNA, 37 bp, Artificial Sequence; identical to SEQ ID NO: 234022
  Description of Artificial Sequence: Synthetic oligonucleotide

SEQ ID NO: 358833 - DNA, 23 bp, Artificial Sequence
  Description of Artificial Sequence: Synthetic oligonucleotide
cctccgcgggtaccaccagtacg

SEQ ID NO: 358834 - DNA, 37 bp, Artificial Sequence; identical to SEQ ID NO: 234023
  Description of Artificial Sequence: Synthetic oligonucleotide

SEQ ID NO: 358835 - DNA, 23 bp, Artificial Sequence
  Description of Artificial Sequence: Synthetic oligonucleotide
ctccgcgggtaccaccagtacgc

SEQ ID NO: 358836 - DNA, 38 bp, Artificial Sequence; identical to SEQ ID NO: 234024
  Description of Artificial Sequence: Synthetic oligonucleotide

SEQ ID NO: 358837 - DNA, 25 bp, Artificial Sequence
  Description of Artificial Sequence: Synthetic oligonucleotide
tccgcgggtaccaccagtacgccta

SEQ ID NO: 358838 - DNA, 37 bp, Artificial Sequence; identical to SEQ ID NO: 234025
  Description of Artificial Sequence: Synthetic oligonucleotide

SEQ ID NO: 358839 - DNA, 24 bp, Artificial Sequence
  Description of Artificial Sequence: Synthetic oligonucleotide
ccgcgggtaccaccagtacgccta

SEQ ID NO: 358840 - DNA, 36 bp, Artificial Sequence; identical to SEQ ID NO: 234026
  Description of Artificial Sequence: Synthetic oligonucleotide

SEQ ID NO: 358841 - DNA, 24 bp, Artificial Sequence
  Description of Artificial Sequence: Synthetic oligonucleotide
cgcgggtaccaccagtacgcctac

SEQ ID NO: 358842 - DNA, 37 bp, Artificial Sequence; identical to SEQ ID NO: 234027
  Description of Artificial Sequence: Synthetic oligonucleotide

SEQ ID NO: 358843 - DNA, 25 bp, Artificial Sequence
  Description of Artificial Sequence: Synthetic oligonucleotide
gcgggtaccaccagtacgcctacga

SEQ ID NO: 358844 - DNA, 36 bp, Artificial Sequence; identical to SEQ ID NO: 234028
  Description of Artificial Sequence: Synthetic oligonucleotide

SEQ ID NO: 358845 - DNA, 25 bp, Artificial Sequence
  Description of Artificial Sequence: Synthetic oligonucleotide
cgggtaccaccagtacgcctacgac

SEQ ID NO: 358846 - DNA, 35 bp, Artificial Sequence; identical to SEQ ID NO: 234029
  Description of Artificial Sequence: Synthetic oligonucleotide

SEQ ID NO: 358847 - DNA, 25 bp, Artificial Sequence
  Description of Artificial Sequence: Synthetic oligonucleotide
gggtaccaccagtacgcctacgacg

SEQ ID NO: 358848 - DNA, 34 bp, Artificial Sequence; identical to SEQ ID NO: 234030
  Description of Artificial Sequence: Synthetic oligonucleotide

SEQ ID NO: 358849 - DNA, 25 bp, Artificial Sequence
  Description of Artificial Sequence: Synthetic oligonucleotide
ggtaccaccagtacgcctacgacgg

SEQ ID NO: 358850 - DNA, 33 bp, Artificial Sequence; identical to SEQ ID NO: 234031
  Description of Artificial Sequence: Synthetic oligonucleotide

SEQ ID NO: 358851 - DNA, 27 bp, Artificial Sequence
  Description of Artificial Sequence: Synthetic oligonucleotide
gtaccaccagtacgcctacgacggcaa

SEQ ID NO: 358852 - DNA, 32 bp, Artificial Sequence; identical to SEQ ID NO: 234032
  Description of Artificial Sequence: Synthetic oligonucleotide

SEQ ID NO: 358853 - DNA, 27 bp, Artificial Sequence
  Description of Artificial Sequence: Synthetic oligonucleotide
taccaccagtacgcctacgacggcaag

SEQ ID NO: 358854 - DNA, 31 bp, Artificial Sequence; identical to SEQ ID NO: 234033
  Description of Artificial Sequence: Synthetic oligonucleotide

SEQ ID NO: 358855 - DNA, 26 bp, Artificial Sequence
  Description of Artificial Sequence: Synthetic oligonucleotide
accaccagtacgcctacgacggcaag

SEQ ID NO: 358856 - DNA, 31 bp, Artificial Sequence; identical to SEQ ID NO: 234034
  Description of Artificial Sequence: Synthetic oligonucleotide

SEQ ID NO: 358857 - DNA, 25 bp, Artificial Sequence
  Description of Artificial Sequence: Synthetic oligonucleotide
ccaccagtacgcctacgacggcaag

SEQ ID NO: 358858 - DNA, 31 bp, Artificial Sequence; identical to SEQ ID NO: 234035
  Description of Artificial Sequence: Synthetic oligonucleotide

SEQ ID NO: 358859 - DNA, 27 bp, Artificial Sequence
  Description of Artificial Sequence: Synthetic oligonucleotide
caccagtacgcctacgacggcaaggat

SEQ ID NO: 358860 - DNA, 35 bp, Artificial Sequence; identical to SEQ ID NO: 234036
  Description of Artificial Sequence: Synthetic oligonucleotide

SEQ ID NO: 358861 - DNA, 29 bp, Artificial Sequence
  Description of Artificial Sequence: Synthetic oligonucleotide
accagtacgcctacgacggcaaggattac

SEQ ID NO: 358862 - DNA, 36 bp, Artificial Sequence; identical to SEQ ID NO: 234037
  Description of Artificial Sequence: Synthetic oligonucleotide

SEQ ID NO: 358863 - DNA, 28 bp, Artificial Sequence
  Description of Artificial Sequence: Synthetic oligonucleotide
ccagtacgcctacgacggcaaggattac

SEQ ID NO: 358864 - DNA, 38 bp, Artificial Sequence; identical to SEQ ID NO: 234038
  Description of Artificial Sequence: Synthetic oligonucleotide

SEQ ID NO: 358865 - DNA, 30 bp, Artificial Sequence; identical to SEQ ID NO: 2300
  Description of Artificial Sequence: Synthetic oligonucleotide

SEQ ID NO: 358866 - DNA, 37 bp, Artificial Sequence; identical to SEQ ID NO: 234039
  Description of Artificial Sequence: Synthetic oligonucleotide

SEQ ID NO: 358867 - DNA, 30 bp, Artificial Sequence; identical to SEQ ID NO: 2301
  Description of Artificial Sequence: Synthetic oligonucleotide

SEQ ID NO: 358868 - DNA, 36 bp, Artificial Sequence; identical to SEQ ID NO: 234040
  Description of Artificial Sequence: Synthetic oligonucleotide

SEQ ID NO: 358869 - DNA, 29 bp, Artificial Sequence
  Description of Artificial Sequence: Synthetic oligonucleotide
gtacgcctacgacggcaaggattacatcg

SEQ ID NO: 358870 - DNA, 35 bp, Artificial Sequence; identical to SEQ ID NO: 234041
  Description of Artificial Sequence: Synthetic oligonucleotide

SEQ ID NO: 358871 - DNA, 29 bp, Artificial Sequence
  Description of Artificial Sequence: Synthetic oligonucleotide
tacgcctacgacggcaaggattacatcgc

SEQ ID NO: 358872 - DNA, 34 bp, Artificial Sequence; identical to SEQ ID NO: 234042
  Description of Artificial Sequence: Synthetic oligonucleotide

SEQ ID NO: 358873 - DNA, 31 bp, Artificial Sequence; identical to SEQ ID NO: 3419
  Description of Artificial Sequence: Synthetic oligonucleotide

SEQ ID NO: 358874 - DNA, 33 bp, Artificial Sequence; identical to SEQ ID NO: 234043
  Description of Artificial Sequence: Synthetic oligonucleotide

SEQ ID NO: 358875 - DNA, 30 bp, Artificial Sequence; identical to SEQ ID NO: 3420
  Description of Artificial Sequence: Synthetic oligonucleotide

SEQ ID NO: 358876 - DNA, 35 bp, Artificial Sequence; identical to SEQ ID NO: 234044
  Description of Artificial Sequence: Synthetic oligonucleotide

SEQ ID NO: 358877 - DNA, 29 bp, Artificial Sequence
  Description of Artificial Sequence: Synthetic oligonucleotide
cgacggcaaggattacatcgccctgaaag

SEQ ID NO: 358878 - DNA, 37 bp, Artificial Sequence; identical to SEQ ID NO: 234045
  Description of Artificial Sequence: Synthetic oligonucleotide

SEQ ID NO: 358879 - DNA, 30 bp, Artificial Sequence; identical to SEQ ID NO: 3422
  Description of Artificial Sequence: Synthetic oligonucleotide

SEQ ID NO: 358880 - DNA, 36 bp, Artificial Sequence; identical to SEQ ID NO: 234046
  Description of Artificial Sequence: Synthetic oligonucleotide

SEQ ID NO: 358881 - DNA, 30 bp, Artificial Sequence; identical to SEQ ID NO: 3423
  Description of Artificial Sequence: Synthetic oligonucleotide

SEQ ID NO: 358882 - DNA, 38 bp, Artificial Sequence; identical to SEQ ID NO: 234047
  Description of Artificial Sequence: Synthetic oligonucleotide

SEQ ID NO: 358883 - DNA, 29 bp, Artificial Sequence
  Description of Artificial Sequence: Synthetic oligonucleotide
cggcaaggattacatcgccctgaaagagg

SEQ ID NO: 358884 - DNA, 37 bp, Artificial Sequence; identical to SEQ ID NO: 234048
  Description of Artificial Sequence: Synthetic oligonucleotide

SEQ ID NO: 358885 - DNA, 30 bp, Artificial Sequence; identical to SEQ ID NO: 3425
  Description of Artificial Sequence: Synthetic oligonucleotide

SEQ ID NO: 358886 - DNA, 39 bp, Artificial Sequence; identical to SEQ ID NO: 234049
  Description of Artificial Sequence: Synthetic oligonucleotide

SEQ ID NO: 358887 - DNA, 30 bp, Artificial Sequence; identical to SEQ ID NO: 3426
  Description of Artificial Sequence: Synthetic oligonucleotide

SEQ ID NO: 358888 - DNA, 38 bp, Artificial Sequence; identical to SEQ ID NO: 234050
  Description of Artificial Sequence: Synthetic oligonucleotide

SEQ ID NO: 358889 - DNA, 31 bp, Artificial Sequence; identical to SEQ ID NO: 3427
  Description of Artificial Sequence: Synthetic oligonucleotide

SEQ ID NO: 358890 - DNA, 45 bp, Artificial Sequence; identical to SEQ ID NO: 234051
  Description of Artificial Sequence: Synthetic oligonucleotide

SEQ ID NO: 358891 - DNA, 31 bp, Artificial Sequence; identical to SEQ ID NO: 3428
  Description of Artificial Sequence: Synthetic oligonucleotide

SEQ ID NO: 358892 - DNA, 44 bp, Artificial Sequence; identical to SEQ ID NO: 234052
  Description of Artificial Sequence: Synthetic oligonucleotide

SEQ ID NO: 358893 - DNA, 30 bp, Artificial Sequence; identical to SEQ ID NO: 3429
  Description of Artificial Sequence: Synthetic oligonucleotide

SEQ ID NO: 358894 - DNA, 43 bp, Artificial Sequence; identical to SEQ ID NO: 234053
  Description of Artificial Sequence: Synthetic oligonucleotide

SEQ ID NO: 358895 - DNA, 29 bp, Artificial Sequence
  Description of Artificial Sequence: Synthetic oligonucleotide
ggattacatcgccctgaaagaggacctgc

SEQ ID NO: 358896 - DNA, 42 bp, Artificial Sequence; identical to SEQ ID NO: 234054
  Description of Artificial Sequence: Synthetic oligonucleotide

SEQ ID NO: 358897 - DNA, 29 bp, Artificial Sequence
  Description of Artificial Sequence: Synthetic oligonucleotide
gattacatcgccctgaaagaggacctgcg

SEQ ID NO: 358898 - DNA, 42 bp, Artificial Sequence; identical to SEQ ID NO: 234055
  Description of Artificial Sequence: Synthetic oligonucleotide

SEQ ID NO: 358899 - DNA, 29 bp, Artificial Sequence
  Description of Artificial Sequence: Synthetic oligonucleotide
attacatcgccctgaaagaggacctgcgc

SEQ ID NO: 358900 - DNA, 41 bp, Artificial Sequence; identical to SEQ ID NO: 234056
  Description of Artificial Sequence: Synthetic oligonucleotide

SEQ ID NO: 358901 - DNA, 28 bp, Artificial Sequence
  Description of Artificial Sequence: Synthetic oligonucleotide
ttacatcgccctgaaagaggacctgcgc

SEQ ID NO: 358902 - DNA, 40 bp, Artificial Sequence; identical to SEQ ID NO: 234057
  Description of Artificial Sequence: Synthetic oligonucleotide

SEQ ID NO: 358903 - DNA, 27 bp, Artificial Sequence
  Description of Artificial Sequence: Synthetic oligonucleotide
tacatcgccctgaaagaggacctgcgc

SEQ ID NO: 358904 - DNA, 40 bp, Artificial Sequence; identical to SEQ ID NO: 234058
  Description of Artificial Sequence: Synthetic oligonucleotide

SEQ ID NO: 358905 - DNA, 27 bp, Artificial Sequence
  Description of Artificial Sequence: Synthetic oligonucleotide
acatcgccctgaaagaggacctgcgct

SEQ ID NO: 358906 - DNA, 41 bp, Artificial Sequence; identical to SEQ ID NO: 234059
  Description of Artificial Sequence: Synthetic oligonucleotide

SEQ ID NO: 358907 - DNA, 26 bp, Artificial Sequence
  Description of Artificial Sequence: Synthetic oligonucleotide
catcgccctgaaagaggacctgcgct

SEQ ID NO: 358908 - DNA, 41 bp, Artificial Sequence; identical to SEQ ID NO: 234060
  Description of Artificial Sequence: Synthetic oligonucleotide

SEQ ID NO: 358909 - DNA, 27 bp, Artificial Sequence
  Description of Artificial Sequence: Synthetic oligonucleotide
atcgccctgaaagaggacctgcgctct

SEQ ID NO: 358910 - DNA, 40 bp, Artificial Sequence; identical to SEQ ID NO: 234061
  Description of Artificial Sequence: Synthetic oligonucleotide

SEQ ID NO: 358911 - DNA, 27 bp, Artificial Sequence
  Description of Artificial Sequence: Synthetic oligonucleotide
tcgccctgaaagaggacctgcgctctt

SEQ ID NO: 358912 - DNA, 42 bp, Artificial Sequence; identical to SEQ ID NO: 234062
  Description of Artificial Sequence: Synthetic oligonucleotide

SEQ ID NO: 358913 - DNA, 26 bp, Artificial Sequence
  Description of Artificial Sequence: Synthetic oligonucleotide
cgccctgaaagaggacctgcgctctt

SEQ ID NO: 358914 - DNA, 41 bp, Artificial Sequence; identical to SEQ ID NO: 234063
  Description of Artificial Sequence: Synthetic oligonucleotide

SEQ ID NO: 358915 - DNA, 26 bp, Artificial Sequence
  Description of Artificial Sequence: Synthetic oligonucleotide
gccctgaaagaggacctgcgctcttg

SEQ ID NO: 358916 - DNA, 42 bp, Artificial Sequence; identical to SEQ ID NO: 234064
  Description of Artificial Sequence: Synthetic oligonucleotide

SEQ ID NO: 358917 - DNA, 27 bp, Artificial Sequence
  Description of Artificial Sequence: Synthetic oligonucleotide
ccctgaaagaggacctgcgctcttgga

SEQ ID NO: 358918 - DNA, 44 bp, Artificial Sequence; identical to SEQ ID NO: 234065
  Description of Artificial Sequence: Synthetic oligonucleotide

SEQ ID NO: 358919 - DNA, 27 bp, Artificial Sequence
  Description of Artificial Sequence: Synthetic oligonucleotide
cctgaaagaggacctgcgctcttggac

SEQ ID NO: 358920 - DNA, 44 bp, Artificial Sequence; identical to SEQ ID NO: 234066
  Description of Artificial Sequence: Synthetic oligonucleotide

SEQ ID NO: 358921 - DNA, 27 bp, Artificial Sequence
  Description of Artificial Sequence: Synthetic oligonucleotide
ctgaaagaggacctgcgctcttggacc

SEQ ID NO: 358922 - DNA, 43 bp, Artificial Sequence; identical to SEQ ID NO: 234067
  Description of Artificial Sequence: Synthetic oligonucleotide

SEQ ID NO: 358923 - DNA, 27 bp, Artificial Sequence
  Description of Artificial Sequence: Synthetic oligonucleotide
tgaaagaggacctgcgctcttggaccg

SEQ ID NO: 358924 - DNA, 42 bp, Artificial Sequence; identical to SEQ ID NO: 234068
  Description of Artificial Sequence: Synthetic oligonucleotide

SEQ ID NO: 358925 - DNA, 26 bp, Artificial Sequence
  Description of Artificial Sequence: Synthetic oligonucleotide
gaaagaggacctgcgctcttggaccg

SEQ ID NO: 358926 - DNA, 41 bp, Artificial Sequence; identical to SEQ ID NO: 234069
  Description of Artificial Sequence: Synthetic oligonucleotide

SEQ ID NO: 358927 - DNA, 26 bp, Artificial Sequence
  Description of Artificial Sequence: Synthetic oligonucleotide
aaagaggacctgcgctcttggaccgc

SEQ ID NO: 358928 - DNA, 40 bp, Artificial Sequence; identical to SEQ ID NO: 234070
  Description of Artificial Sequence: Synthetic oligonucleotide

SEQ ID NO: 358929 - DNA, 25 bp, Artificial Sequence
  Description of Artificial Sequence: Synthetic oligonucleotide
aagaggacctgcgctcttggaccgc

SEQ ID NO: 358930 - DNA, 40 bp, Artificial Sequence; identical to SEQ ID NO: 234071
  Description of Artificial Sequence: Synthetic oligonucleotide

SEQ ID NO: 358931 - DNA, 24 bp, Artificial Sequence
  Description of Artificial Sequence: Synthetic oligonucleotide
agaggacctgcgctcttggaccgc

SEQ ID NO: 358932 - DNA, 39 bp, Artificial Sequence; identical to SEQ ID NO: 234072
  Description of Artificial Sequence: Synthetic oligonucleotide

SEQ ID NO: 358933 - DNA, 23 bp, Artificial Sequence
  Description of Artificial Sequence: Synthetic oligonucleotide
cgcggcggacatggcagctcaga

SEQ ID NO: 358934 - DNA, 39 bp, Artificial Sequence; identical to SEQ ID NO: 234073
  Description of Artificial Sequence: Synthetic oligonucleotide

SEQ ID NO: 358935 - DNA, 23 bp, Artificial Sequence
  Description of Artificial Sequence: Synthetic oligonucleotide
gcggcggacatggcagctcagac

SEQ ID NO: 358936 - DNA, 38 bp, Artificial Sequence; identical to SEQ ID NO: 234074
  Description of Artificial Sequence: Synthetic oligonucleotide

SEQ ID NO: 358937 - DNA, 24 bp, Artificial Sequence
  Description of Artificial Sequence: Synthetic oligonucleotide
cggcggacatggcagctcagacca

SEQ ID NO: 358938 - DNA, 37 bp, Artificial Sequence; identical to SEQ ID NO: 234075
  Description of Artificial Sequence: Synthetic oligonucleotide

SEQ ID NO: 358939 - DNA, 24 bp, Artificial Sequence
  Description of Artificial Sequence: Synthetic oligonucleotide
ggcggacatggcagctcagaccac

SEQ ID NO: 358940 - DNA, 38 bp, Artificial Sequence; identical to SEQ ID NO: 234076
  Description of Artificial Sequence: Synthetic oligonucleotide

SEQ ID NO: 358941 - DNA, 26 bp, Artificial Sequence
  Description of Artificial Sequence: Synthetic oligonucleotide
gcggacatggcagctcagaccaccaa

SEQ ID NO: 358942 - DNA, 37 bp, Artificial Sequence; identical to SEQ ID NO: 234077
  Description of Artificial Sequence: Synthetic oligonucleotide

SEQ ID NO: 358943 - DNA, 26 bp, Artificial Sequence
  Description of Artificial Sequence: Synthetic oligonucleotide
cggacatggcagctcagaccaccaag

SEQ ID NO: 358944 - DNA, 36 bp, Artificial Sequence; identical to SEQ ID NO: 234078
  Description of Artificial Sequence: Synthetic oligonucleotide

SEQ ID NO: 358945 - DNA, 27 bp, Artificial Sequence
  Description of Artificial Sequence: Synthetic oligonucleotide
ggacatggcagctcagaccaccaagca

SEQ ID NO: 358946 - DNA, 36 bp, Artificial Sequence; identical to SEQ ID NO: 234079
  Description of Artificial Sequence: Synthetic oligonucleotide

SEQ ID NO: 358947 - DNA, 27 bp, Artificial Sequence
  Description of Artificial Sequence: Synthetic oligonucleotide
gacatggcagctcagaccaccaagcac

SEQ ID NO: 358948 - DNA, 35 bp, Artificial Sequence; identical to SEQ ID NO: 234080
  Description of Artificial Sequence: Synthetic oligonucleotide

SEQ ID NO: 358949 - DNA, 29 bp, Artificial Sequence
  Description of Artificial Sequence: Synthetic oligonucleotide
acatggcagctcagaccaccaagcacaag

SEQ ID NO: 358950 - DNA, 34 bp, Artificial Sequence; identical to SEQ ID NO: 234081
  Description of Artificial Sequence: Synthetic oligonucleotide

SEQ ID NO: 358951 - DNA, 28 bp, Artificial Sequence
  Description of Artificial Sequence: Synthetic oligonucleotide
catggcagctcagaccaccaagcacaag

SEQ ID NO: 358952 - DNA, 36 bp, Artificial Sequence; identical to SEQ ID NO: 234082
  Description of Artificial Sequence: Synthetic oligonucleotide

SEQ ID NO: 358953 - DNA, 29 bp, Artificial Sequence
  Description of Artificial Sequence: Synthetic oligonucleotide
atggcagctcagaccaccaagcacaagtg

SEQ ID NO: 358954 - DNA, 35 bp, Artificial Sequence; identical to SEQ ID NO: 234083
  Description of Artificial Sequence: Synthetic oligonucleotide

SEQ ID NO: 358955 - DNA, 28 bp, Artificial Sequence
  Description of Artificial Sequence: Synthetic oligonucleotide
tggcagctcagaccaccaagcacaagtg

SEQ ID NO: 358956 - DNA, 34 bp, Artificial Sequence; identical to SEQ ID NO: 234084
  Description of Artificial Sequence: Synthetic oligonucleotide

SEQ ID NO: 358957 - DNA, 27 bp, Artificial Sequence
  Description of Artificial Sequence: Synthetic oligonucleotide
ggcagctcagaccaccaagcacaagtg

SEQ ID NO: 358958 - DNA, 34 bp, Artificial Sequence; identical to SEQ ID NO: 234085
  Description of Artificial Sequence: Synthetic oligonucleotide

SEQ ID NO: 358959 - DNA, 27 bp, Artificial Sequence
  Description of Artificial Sequence: Synthetic oligonucleotide
gcagctcagaccaccaagcacaagtgg

SEQ ID NO: 358960 - DNA, 33 bp, Artificial Sequence; identical to SEQ ID NO: 234086
  Description of Artificial Sequence: Synthetic oligonucleotide

SEQ ID NO: 358961 - DNA, 27 bp, Artificial Sequence
  Description of Artificial Sequence: Synthetic oligonucleotide
cagctcagaccaccaagcacaagtggg

SEQ ID NO: 358962 - DNA, 32 bp, Artificial Sequence; identical to SEQ ID NO: 234087
  Description of Artificial Sequence: Synthetic oligonucleotide

SEQ ID NO: 358963 - DNA, 28 bp, Artificial Sequence
  Description of Artificial Sequence: Synthetic oligonucleotide
agctcagaccaccaagcacaagtgggag

SEQ ID NO: 358964 - DNA, 35 bp, Artificial Sequence; identical to SEQ ID NO: 234088
  Description of Artificial Sequence: Synthetic oligonucleotide

SEQ ID NO: 358965 - DNA, 27 bp, Artificial Sequence
  Description of Artificial Sequence: Synthetic oligonucleotide
gctcagaccaccaagcacaagtgggag

SEQ ID NO: 358966 - DNA, 34 bp, Artificial Sequence; identical to SEQ ID NO: 234089
  Description of Artificial Sequence: Synthetic oligonucleotide

SEQ ID NO: 358967 - DNA, 27 bp, Artificial Sequence
  Description of Artificial Sequence: Synthetic oligonucleotide
ctcagaccaccaagcacaagtgggagg

SEQ ID NO: 358968 - DNA, 33 bp, Artificial Sequence; identical to SEQ ID NO: 234090
  Description of Artificial Sequence: Synthetic oligonucleotide

SEQ ID NO: 358969 - DNA, 27 bp, Artificial Sequence
  Description of Artificial Sequence: Synthetic oligonucleotide
tcagaccaccaagcacaagtgggaggc

SEQ ID NO: 358970 - DNA, 32 bp, Artificial Sequence; identical to SEQ ID NO: 234091
  Description of Artificial Sequence: Synthetic oligonucleotide

SEQ ID NO: 358971 - DNA, 26 bp, Artificial Sequence
  Description of Artificial Sequence: Synthetic oligonucleotide
cagaccaccaagcacaagtgggaggc

SEQ ID NO: 358972 - DNA, 31 bp, Artificial Sequence; identical to SEQ ID NO: 234092
  Description of Artificial Sequence: Synthetic oligonucleotide

SEQ ID NO: 358973 - DNA, 26 bp, Artificial Sequence
  Description of Artificial Sequence: Synthetic oligonucleotide
agaccaccaagcacaagtgggaggcg

SEQ ID NO: 358974 - DNA, 30 bp, Artificial Sequence; identical to SEQ ID NO: 234093
  Description of Artificial Sequence: Synthetic oligonucleotide

SEQ ID NO: 358975 - DNA, 25 bp, Artificial Sequence
  Description of Artificial Sequence: Synthetic oligonucleotide
gaccaccaagcacaagtgggaggcg

SEQ ID NO: 358976 - DNA, 29 bp, Artificial Sequence
  Description of Artificial Sequence: Synthetic oligonucleotide
acgctcctactctaccggtgctaccaaag

SEQ ID NO: 358977 - DNA, 25 bp, Artificial Sequence
  Description of Artificial Sequence: Synthetic oligonucleotide
accaccaagcacaagtgggaggcgg

SEQ ID NO: 358978 - DNA, 28 bp, Artificial Sequence
  Description of Artificial Sequence: Synthetic oligonucleotide
cgctcctactctaccggtgctaccaaag

SEQ ID NO: 358979 - DNA, 24 bp, Artificial Sequence
  Description of Artificial Sequence: Synthetic oligonucleotide
ccaccaagcacaagtgggaggcgg

SEQ ID NO: 358980 - DNA, 29 bp, Artificial Sequence
  Description of Artificial Sequence: Synthetic oligonucleotide
gctcctactctaccggtgctaccaaagag

SEQ ID NO: 358981 - DNA, 24 bp, Artificial Sequence
  Description of Artificial Sequence: Synthetic oligonucleotide
caccaagcacaagtgggaggcggc

SEQ ID NO: 358982 - DNA, 29 bp, Artificial Sequence
  Description of Artificial Sequence: Synthetic oligonucleotide
ctcctactctaccggtgctaccaaagagg

SEQ ID NO: 358983 - DNA, 24 bp, Artificial Sequence
  Description of Artificial Sequence: Synthetic oligonucleotide
accaagcacaagtgggaggcggcc

SEQ ID NO: 358984 - DNA, 31 bp, Artificial Sequence; identical to SEQ ID NO: 234098
  Description of Artificial Sequence: Synthetic oligonucleotide

SEQ ID NO: 358985 - DNA, 23 bp, Artificial Sequence
  Description of Artificial Sequence: Synthetic oligonucleotide
ccaagcacaagtgggaggcggcc

SEQ ID NO: 358986 - DNA, 30 bp, Artificial Sequence; identical to SEQ ID NO: 234099
  Description of Artificial Sequence: Synthetic oligonucleotide

SEQ ID NO: 358987 - DNA, 25 bp, Artificial Sequence
  Description of Artificial Sequence: Synthetic oligonucleotide
caagcacaagtgggaggcggcccat

SEQ ID NO: 358988 - DNA, 30 bp, Artificial Sequence; identical to SEQ ID NO: 234100
  Description of Artificial Sequence: Synthetic oligonucleotide

SEQ ID NO: 358989 - DNA, 26 bp, Artificial Sequence
  Description of Artificial Sequence: Synthetic oligonucleotide
aagcacaagtgggaggcggcccatgt

SEQ ID NO: 358990 - DNA, 31 bp, Artificial Sequence; identical to SEQ ID NO: 234101
  Description of Artificial Sequence: Synthetic oligonucleotide

SEQ ID NO: 358991 - DNA, 25 bp, Artificial Sequence
  Description of Artificial Sequence: Synthetic oligonucleotide
agcacaagtgggaggcggcccatgt

SEQ ID NO: 358992 - DNA, 30 bp, Artificial Sequence; identical to SEQ ID NO: 234102
  Description of Artificial Sequence: Synthetic oligonucleotide

SEQ ID NO: 358993 - DNA, 24 bp, Artificial Sequence
  Description of Artificial Sequence: Synthetic oligonucleotide
gcacaagtgggaggcggcccatgt

SEQ ID NO: 358994 - DNA, 29 bp, Artificial Sequence
  Description of Artificial Sequence: Synthetic oligonucleotide
ctctaccggtgctaccaaagaggttcctc

SEQ ID NO: 358995 - DNA, 24 bp, Artificial Sequence
  Description of Artificial Sequence: Synthetic oligonucleotide
cacaagtgggaggcggcccatgtg

SEQ ID NO: 358996 - DNA, 30 bp, Artificial Sequence; identical to SEQ ID NO: 234104
  Description of Artificial Sequence: Synthetic oligonucleotide

SEQ ID NO: 358997 - DNA, 24 bp, Artificial Sequence
  Description of Artificial Sequence: Synthetic oligonucleotide
acaagtgggaggcggcccatgtgg

SEQ ID NO: 358998 - DNA, 29 bp, Artificial Sequence
  Description of Artificial Sequence: Synthetic oligonucleotide
ctaccggtgctaccaaagaggttcctcag

SEQ ID NO: 358999 - DNA, 23 bp, Artificial Sequence
  Description of Artificial Sequence: Synthetic oligonucleotide
caagtgggaggcggcccatgtgg

SEQ ID NO: 359000 - DNA, 29 bp, Artificial Sequence
  Description of Artificial Sequence: Synthetic oligonucleotide
taccggtgctaccaaagaggttcctcagg

SEQ ID NO: 359001 - DNA, 23 bp, Artificial Sequence
  Description of Artificial Sequence: Synthetic oligonucleotide
aagtgggaggcggcccatgtggc

SEQ ID NO: 359002 - DNA, 28 bp, Artificial Sequence
  Description of Artificial Sequence: Synthetic oligonucleotide
accggtgctaccaaagaggttcctcagg

SEQ ID NO: 359003 - DNA, 22 bp, Artificial Sequence
  Description of Artificial Sequence: Synthetic oligonucleotide
agtgggaggcggcccatgtggc

SEQ ID NO: 359004 - DNA, 27 bp, Artificial Sequence
  Description of Artificial Sequence: Synthetic oligonucleotide
ccggtgctaccaaagaggttcctcagg

SEQ ID NO: 359005 - DNA, 21 bp, Artificial Sequence
  Description of Artificial Sequence: Synthetic oligonucleotide
gtgggaggcggcccatgtggc

SEQ ID NO: 359006 - DNA, 28 bp, Artificial Sequence
  Description of Artificial Sequence: Synthetic oligonucleotide
cggtgctaccaaagaggttcctcaggtc

SEQ ID NO: 359007 - DNA, 21 bp, Artificial Sequence
  Description of Artificial Sequence: Synthetic oligonucleotide
tgggaggcggcccatgtggcg

SEQ ID NO: 359008 - DNA, 29 bp, Artificial Sequence
  Description of Artificial Sequence: Synthetic oligonucleotide
ggtgctaccaaagaggttcctcaggtcac

SEQ ID NO: 359009 - DNA, 20 bp, Artificial Sequence
  Description of Artificial Sequence: Synthetic oligonucleotide
gggaggcggcccatgtggcg

SEQ ID NO: 359010 - DNA, 30 bp, Artificial Sequence; identical to SEQ ID NO: 234111
  Description of Artificial Sequence: Synthetic oligonucleotide

SEQ ID NO: 359011 - DNA, 21 bp, Artificial Sequence
  Description of Artificial Sequence: Synthetic oligonucleotide
ggaggcggcccatgtggcgga

SEQ ID NO: 359012 - DNA, 31 bp, Artificial Sequence; identical to SEQ ID NO: 234112
  Description of Artificial Sequence: Synthetic oligonucleotide

SEQ ID NO: 359013 - DNA, 21 bp, Artificial Sequence
  Description of Artificial Sequence: Synthetic oligonucleotide
gaggcggcccatgtggcggag

SEQ ID NO: 359014 - DNA, 30 bp, Artificial Sequence; identical to SEQ ID NO: 234113
  Description of Artificial Sequence: Synthetic oligonucleotide

SEQ ID NO: 359015 - DNA, 22 bp, Artificial Sequence
  Description of Artificial Sequence: Synthetic oligonucleotide
aggcggcccatgtggcggagca

SEQ ID NO: 359016 - DNA, 34 bp, Artificial Sequence; identical to SEQ ID NO: 234114
  Description of Artificial Sequence: Synthetic oligonucleotide

SEQ ID NO: 359017 - DNA, 21 bp, Artificial Sequence
  Description of Artificial Sequence: Synthetic oligonucleotide
ggcggcccatgtggcggagca

SEQ ID NO: 359018 - DNA, 34 bp, Artificial Sequence; identical to SEQ ID NO: 234115
  Description of Artificial Sequence: Synthetic oligonucleotide

SEQ ID NO: 359019 - DNA, 23 bp, Artificial Sequence
  Description of Artificial Sequence: Synthetic oligonucleotide
gcggcccatgtggcggagcagtt

SEQ ID NO: 359020 - DNA, 33 bp, Artificial Sequence; identical to SEQ ID NO: 234116
  Description of Artificial Sequence: Synthetic oligonucleotide

SEQ ID NO: 359021 - DNA, 24 bp, Artificial Sequence
  Description of Artificial Sequence: Synthetic oligonucleotide
cggcccatgtggcggagcagttga

SEQ ID NO: 359022 - DNA, 32 bp, Artificial Sequence; identical to SEQ ID NO: 234117
  Description of Artificial Sequence: Synthetic oligonucleotide

SEQ ID NO: 359023 - DNA, 25 bp, Artificial Sequence
  Description of Artificial Sequence: Synthetic oligonucleotide
ggcccatgtggcggagcagttgaga

SEQ ID NO: 359024 - DNA, 34 bp, Artificial Sequence; identical to SEQ ID NO: 234118
  Description of Artificial Sequence: Synthetic oligonucleotide

SEQ ID NO: 359025 - DNA, 25 bp, Artificial Sequence
  Description of Artificial Sequence: Synthetic oligonucleotide
gcccatgtggcggagcagttgagag

SEQ ID NO: 359026 - DNA, 35 bp, Artificial Sequence; identical to SEQ ID NO: 234119
  Description of Artificial Sequence: Synthetic oligonucleotide

SEQ ID NO: 359027 - DNA, 25 bp, Artificial Sequence
  Description of Artificial Sequence: Synthetic oligonucleotide
cccatgtggcggagcagttgagagc

SEQ ID NO: 359028 - DNA, 34 bp, Artificial Sequence; identical to SEQ ID NO: 234120
  Description of Artificial Sequence: Synthetic oligonucleotide

SEQ ID NO: 359029 - DNA, 27 bp, Artificial Sequence
  Description of Artificial Sequence: Synthetic oligonucleotide
ccatgtggcggagcagttgagagccta

SEQ ID NO: 359030 - DNA, 33 bp, Artificial Sequence; identical to SEQ ID NO: 234121
  Description of Artificial Sequence: Synthetic oligonucleotide

SEQ ID NO: 359031 - DNA, 27 bp, Artificial Sequence
  Description of Artificial Sequence: Synthetic oligonucleotide
catgtggcggagcagttgagagcctac

SEQ ID NO: 359032 - DNA, 32 bp, Artificial Sequence; identical to SEQ ID NO: 234122
  Description of Artificial Sequence: Synthetic oligonucleotide

SEQ ID NO: 359033 - DNA, 27 bp, Artificial Sequence
  Description of Artificial Sequence: Synthetic oligonucleotide
atgtggcggagcagttgagagcctacc

SEQ ID NO: 359034 - DNA, 33 bp, Artificial Sequence; identical to SEQ ID NO: 234123
  Description of Artificial Sequence: Synthetic oligonucleotide

SEQ ID NO: 359035 - DNA, 27 bp, Artificial Sequence
  Description of Artificial Sequence: Synthetic oligonucleotide
tgtggcggagcagttgagagcctacct

SEQ ID NO: 359036 - DNA, 32 bp, Artificial Sequence; identical to SEQ ID NO: 234124
  Description of Artificial Sequence: Synthetic oligonucleotide

SEQ ID NO: 359037 - DNA, 26 bp, Artificial Sequence
  Description of Artificial Sequence: Synthetic oligonucleotide
gtggcggagcagttgagagcctacct

SEQ ID NO: 359038 - DNA, 32 bp, Artificial Sequence; identical to SEQ ID NO: 234125
  Description of Artificial Sequence: Synthetic oligonucleotide

SEQ ID NO: 359039 - DNA, 26 bp, Artificial Sequence
  Description of Artificial Sequence: Synthetic oligonucleotide
tggcggagcagttgagagcctacctg

SEQ ID NO: 359040 - DNA, 32 bp, Artificial Sequence; identical to SEQ ID NO: 234126
  Description of Artificial Sequence: Synthetic oligonucleotide

SEQ ID NO: 359041 - DNA, 25 bp, Artificial Sequence
  Description of Artificial Sequence: Synthetic oligonucleotide
ggcggagcagttgagagcctacctg

SEQ ID NO: 359042 - DNA, 31 bp, Artificial Sequence; identical to SEQ ID NO: 234127
  Description of Artificial Sequence: Synthetic oligonucleotide

SEQ ID NO: 359043 - DNA, 26 bp, Artificial Sequence
  Description of Artificial Sequence: Synthetic oligonucleotide
gcggagcagttgagagcctacctgga

SEQ ID NO: 359044 - DNA, 30 bp, Artificial Sequence; identical to SEQ ID NO: 234128
  Description of Artificial Sequence: Synthetic oligonucleotide

SEQ ID NO: 359045 - DNA, 26 bp, Artificial Sequence
  Description of Artificial Sequence: Synthetic oligonucleotide
cggagcagttgagagcctacctggag

SEQ ID NO: 359046 - DNA, 30 bp, Artificial Sequence; identical to SEQ ID NO: 234129
  Description of Artificial Sequence: Synthetic oligonucleotide

SEQ ID NO: 359047 - DNA, 26 bp, Artificial Sequence
  Description of Artificial Sequence: Synthetic oligonucleotide
ggagcagttgagagcctacctggagg

SEQ ID NO: 359048 - DNA, 31 bp, Artificial Sequence; identical to SEQ ID NO: 234130
  Description of Artificial Sequence: Synthetic oligonucleotide

SEQ ID NO: 359049 - DNA, 26 bp, Artificial Sequence
  Description of Artificial Sequence: Synthetic oligonucleotide
gagcagttgagagcctacctggaggg

SEQ ID NO: 359050 - DNA, 30 bp, Artificial Sequence; identical to SEQ ID NO: 234131
  Description of Artificial Sequence: Synthetic oligonucleotide

SEQ ID NO: 359051 - DNA, 27 bp, Artificial Sequence
  Description of Artificial Sequence: Synthetic oligonucleotide
agcagttgagagcctacctggagggca

SEQ ID NO: 359052 - DNA, 31 bp, Artificial Sequence; identical to SEQ ID NO: 234132
  Description of Artificial Sequence: Synthetic oligonucleotide

SEQ ID NO: 359053 - DNA, 26 bp, Artificial Sequence
  Description of Artificial Sequence: Synthetic oligonucleotide
gcagttgagagcctacctggagggca

SEQ ID NO: 359054 - DNA, 30 bp, Artificial Sequence; identical to SEQ ID NO: 234133
  Description of Artificial Sequence: Synthetic oligonucleotide

SEQ ID NO: 359055 - DNA, 26 bp, Artificial Sequence
  Description of Artificial Sequence: Synthetic oligonucleotide
cagttgagagcctacctggagggcac

SEQ ID NO: 359056 - DNA, 31 bp, Artificial Sequence; identical to SEQ ID NO: 234134
  Description of Artificial Sequence: Synthetic oligonucleotide

SEQ ID NO: 359057 - DNA, 27 bp, Artificial Sequence
  Description of Artificial Sequence: Synthetic oligonucleotide
agttgagagcctacctggagggcacgt

SEQ ID NO: 359058 - DNA, 32 bp, Artificial Sequence; identical to SEQ ID NO: 234135
  Description of Artificial Sequence: Synthetic oligonucleotide

SEQ ID NO: 359059 - DNA, 26 bp, Artificial Sequence
  Description of Artificial Sequence: Synthetic oligonucleotide
gttgagagcctacctggagggcacgt

SEQ ID NO: 359060 - DNA, 31 bp, Artificial Sequence; identical to SEQ ID NO: 234136
  Description of Artificial Sequence: Synthetic oligonucleotide

SEQ ID NO: 359061 - DNA, 26 bp, Artificial Sequence
  Description of Artificial Sequence: Synthetic oligonucleotide
ttgagagcctacctggagggcacgtg

SEQ ID NO: 359062 - DNA, 31 bp, Artificial Sequence; identical to SEQ ID NO: 234137
  Description of Artificial Sequence: Synthetic oligonucleotide

SEQ ID NO: 359063 - DNA, 25 bp, Artificial Sequence
  Description of Artificial Sequence: Synthetic oligonucleotide
tgagagcctacctggagggcacgtg

SEQ ID NO: 359064 - DNA, 30 bp, Artificial Sequence; identical to SEQ ID NO: 234138
  Description of Artificial Sequence: Synthetic oligonucleotide

SEQ ID NO: 359065 - DNA, 24 bp, Artificial Sequence
  Description of Artificial Sequence: Synthetic oligonucleotide
gagagcctacctggagggcacgtg

SEQ ID NO: 359066 - DNA, 30 bp, Artificial Sequence; identical to SEQ ID NO: 234139
  Description of Artificial Sequence: Synthetic oligonucleotide

SEQ ID NO: 359067 - DNA, 24 bp, Artificial Sequence
  Description of Artificial Sequence: Synthetic oligonucleotide
agagcctacctggagggcacgtgc

SEQ ID NO: 359068 - DNA, 29 bp, Artificial Sequence
  Description of Artificial Sequence: Synthetic oligonucleotide
gagttttccaactctcccgtgtcactggg

SEQ ID NO: 359069 - DNA, 23 bp, Artificial Sequence
  Description of Artificial Sequence: Synthetic oligonucleotide
gagcctacctggagggcacgtgc

SEQ ID NO: 359070 - DNA, 30 bp, Artificial Sequence; identical to SEQ ID NO: 234141
  Description of Artificial Sequence: Synthetic oligonucleotide

SEQ ID NO: 359071 - DNA, 24 bp, Artificial Sequence
  Description of Artificial Sequence: Synthetic oligonucleotide
agcctacctggagggcacgtgcgt

SEQ ID NO: 359072 - DNA, 29 bp, Artificial Sequence
  Description of Artificial Sequence: Synthetic oligonucleotide
gttttccaactctcccgtgtcactgggtc

SEQ ID NO: 359073 - DNA, 23 bp, Artificial Sequence
  Description of Artificial Sequence: Synthetic oligonucleotide
gcctacctggagggcacgtgcgt

SEQ ID NO: 359074 - DNA, 30 bp, Artificial Sequence; identical to SEQ ID NO: 234143
  Description of Artificial Sequence: Synthetic oligonucleotide

SEQ ID NO: 359075 - DNA, 23 bp, Artificial Sequence
  Description of Artificial Sequence: Synthetic oligonucleotide
cctacctggagggcacgtgcgtg

SEQ ID NO: 359076 - DNA, 29 bp, Artificial Sequence
  Description of Artificial Sequence: Synthetic oligonucleotide
tttccaactctcccgtgtcactgggtctg

SEQ ID NO: 359077 - DNA, 24 bp, Artificial Sequence
  Description of Artificial Sequence: Synthetic oligonucleotide
ctacctggagggcacgtgcgtgga

SEQ ID NO: 359078 - DNA, 28 bp, Artificial Sequence
  Description of Artificial Sequence: Synthetic oligonucleotide
ttccaactctcccgtgtcactgggtctg

SEQ ID NO: 359079 - DNA, 25 bp, Artificial Sequence
  Description of Artificial Sequence: Synthetic oligonucleotide
tacctggagggcacgtgcgtggagt

SEQ ID NO: 359080 - DNA, 27 bp, Artificial Sequence
  Description of Artificial Sequence: Synthetic oligonucleotide
tccaactctcccgtgtcactgggtctg

SEQ ID NO: 359081 - DNA, 24 bp, Artificial Sequence
  Description of Artificial Sequence: Synthetic oligonucleotide
acctggagggcacgtgcgtggagt

SEQ ID NO: 359082 - DNA, 26 bp, Artificial Sequence
  Description of Artificial Sequence: Synthetic oligonucleotide
ccaactctcccgtgtcactgggtctg

SEQ ID NO: 359083 - DNA, 23 bp, Artificial Sequence
  Description of Artificial Sequence: Synthetic oligonucleotide
cctggagggcacgtgcgtggagt

SEQ ID NO: 359084 - DNA, 26 bp, Artificial Sequence
  Description of Artificial Sequence: Synthetic oligonucleotide
caactctcccgtgtcactgggtctgc

SEQ ID NO: 359085 - DNA, 23 bp, Artificial Sequence
  Description of Artificial Sequence: Synthetic oligonucleotide
ctggagggcacgtgcgtggagtg

SEQ ID NO: 359086 - DNA, 26 bp, Artificial Sequence
  Description of Artificial Sequence: Synthetic oligonucleotide
aactctcccgtgtcactgggtctgcc

SEQ ID NO: 359087 - DNA, 23 bp, Artificial Sequence
  Description of Artificial Sequence: Synthetic oligonucleotide
tggagggcacgtgcgtggagtgg

SEQ ID NO: 359088 - DNA, 25 bp, Artificial Sequence
  Description of Artificial Sequence: Synthetic oligonucleotide
actctcccgtgtcactgggtctgcc

SEQ ID NO: 359089 - DNA, 22 bp, Artificial Sequence
  Description of Artificial Sequence: Synthetic oligonucleotide
ggagggcacgtgcgtggagtgg

SEQ ID NO: 359090 - DNA, 24 bp, Artificial Sequence
  Description of Artificial Sequence: Synthetic oligonucleotide
ctctcccgtgtcactgggtctgcc

SEQ ID NO: 359091 - DNA, 23 bp, Artificial Sequence
  Description of Artificial Sequence: Synthetic oligonucleotide
gagggcacgtgcgtggagtggct

SEQ ID NO: 359092 - DNA, 26 bp, Artificial Sequence
  Description of Artificial Sequence: Synthetic oligonucleotide
tctcccgtgtcactgggtctgcccaa

SEQ ID NO: 359093 - DNA, 23 bp, Artificial Sequence
  Description of Artificial Sequence: Synthetic oligonucleotide
agggcacgtgcgtggagtggctc

SEQ ID NO: 359094 - DNA, 25 bp, Artificial Sequence
  Description of Artificial Sequence: Synthetic oligonucleotide
ctcccgtgtcactgggtctgcccaa

SEQ ID NO: 359095 - DNA, 22 bp, Artificial Sequence
  Description of Artificial Sequence: Synthetic oligonucleotide
gggcacgtgcgtggagtggctc

SEQ ID NO: 359096 - DNA, 26 bp, Artificial Sequence
  Description of Artificial Sequence: Synthetic oligonucleotide
tcccgtgtcactgggtctgcccaaca

SEQ ID NO: 359097 - DNA, 22 bp, Artificial Sequence
  Description of Artificial Sequence: Synthetic oligonucleotide
ggcacgtgcgtggagtggctcc

SEQ ID NO: 359098 - DNA, 25 bp, Artificial Sequence
  Description of Artificial Sequence: Synthetic oligonucleotide
cccgtgtcactgggtctgcccaaca

SEQ ID NO: 359099 - DNA, 22 bp, Artificial Sequence
  Description of Artificial Sequence: Synthetic oligonucleotide
gcacgtgcgtggagtggctccg

SEQ ID NO: 359100 - DNA, 25 bp, Artificial Sequence
  Description of Artificial Sequence: Synthetic oligonucleotide
ccgtgtcactgggtctgcccaacac

SEQ ID NO: 359101 - DNA, 23 bp, Artificial Sequence
  Description of Artificial Sequence: Synthetic oligonucleotide
cacgtgcgtggagtggctccgca

SEQ ID NO: 359102 - DNA, 25 bp, Artificial Sequence
  Description of Artificial Sequence: Synthetic oligonucleotide
cgtgtcactgggtctgcccaacacg

SEQ ID NO: 359103 - DNA, 26 bp, Artificial Sequence
  Description of Artificial Sequence: Synthetic oligonucleotide
acgtgcgtggagtggctccgcagata

SEQ ID NO: 359104 - DNA, 26 bp, Artificial Sequence
  Description of Artificial Sequence: Synthetic oligonucleotide
gtgtcactgggtctgcccaacacgct

SEQ ID NO: 359105 - DNA, 25 bp, Artificial Sequence
  Description of Artificial Sequence: Synthetic oligonucleotide
cgtgcgtggagtggctccgcagata

SEQ ID NO: 359106 - DNA, 27 bp, Artificial Sequence
  Description of Artificial Sequence: Synthetic oligonucleotide
tgtcactgggtctgcccaacacgctca

SEQ ID NO: 359107 - DNA, 25 bp, Artificial Sequence
  Description of Artificial Sequence: Synthetic oligonucleotide
gtgcgtggagtggctccgcagatac

SEQ ID NO: 359108 - DNA, 27 bp, Artificial Sequence
  Description of Artificial Sequence: Synthetic oligonucleotide
gtcactgggtctgcccaacacgctcat

SEQ ID NO: 359109 - DNA, 26 bp, Artificial Sequence
  Description of Artificial Sequence: Synthetic oligonucleotide
tgcgtggagtggctccgcagatacct

SEQ ID NO: 359110 - DNA, 27 bp, Artificial Sequence
  Description of Artificial Sequence: Synthetic oligonucleotide
tcactgggtctgcccaacacgctcatc

SEQ ID NO: 359111 - DNA, 25 bp, Artificial Sequence
  Description of Artificial Sequence: Synthetic oligonucleotide
gcgtggagtggctccgcagatacct

SEQ ID NO: 359112 - DNA, 27 bp, Artificial Sequence
  Description of Artificial Sequence: Synthetic oligonucleotide
cactgggtctgcccaacacgctcatct

SEQ ID NO: 359113 - DNA, 25 bp, Artificial Sequence
  Description of Artificial Sequence: Synthetic oligonucleotide
cgtggagtggctccgcagatacctg

SEQ ID NO: 359114 - DNA, 27 bp, Artificial Sequence
  Description of Artificial Sequence: Synthetic oligonucleotide
actgggtctgcccaacacgctcatctg

SEQ ID NO: 359115 - DNA, 26 bp, Artificial Sequence
  Description of Artificial Sequence: Synthetic oligonucleotide
gtggagtggctccgcagatacctgga

SEQ ID NO: 359116 - DNA, 27 bp, Artificial Sequence
  Description of Artificial Sequence: Synthetic oligonucleotide
ctgggtctgcccaacacgctcatctgt

SEQ ID NO: 359117 - DNA, 27 bp, Artificial Sequence
  Description of Artificial Sequence: Synthetic oligonucleotide
tggagtggctccgcagatacctggaga

SEQ ID NO: 359118 - DNA, 27 bp, Artificial Sequence
  Description of Artificial Sequence: Synthetic oligonucleotide
tgggtctgcccaacacgctcatctgtg

SEQ ID NO: 359119 - DNA, 27 bp, Artificial Sequence
  Description of Artificial Sequence: Synthetic oligonucleotide
ggagtggctccgcagatacctggagaa

SEQ ID NO: 359120 - DNA, 27 bp, Artificial Sequence
  Description of Artificial Sequence: Synthetic oligonucleotide
gggtctgcccaacacgctcatctgtgt

SEQ ID NO: 359121 - DNA, 27 bp, Artificial Sequence
  Description of Artificial Sequence: Synthetic oligonucleotide
gagtggctccgcagatacctggagaac

SEQ ID NO: 359122 - DNA, 28 bp, Artificial Sequence
  Description of Artificial Sequence: Synthetic oligonucleotide
ggtctgcccaacacgctcatctgtgttg

SEQ ID NO: 359123 - DNA, 27 bp, Artificial Sequence
  Description of Artificial Sequence: Synthetic oligonucleotide
agtggctccgcagatacctggagaacg

SEQ ID NO: 359124 - DNA, 29 bp, Artificial Sequence
  Description of Artificial Sequence: Synthetic oligonucleotide
gtctgcccaacacgctcatctgtgttgtg

SEQ ID NO: 359125 - DNA, 26 bp, Artificial Sequence
  Description of Artificial Sequence: Synthetic oligonucleotide
gtggctccgcagatacctggagaacg

SEQ ID NO: 359126 - DNA, 29 bp, Artificial Sequence
  Description of Artificial Sequence: Synthetic oligonucleotide
tctgcccaacacgctcatctgtgttgtgg

SEQ ID NO: 359127 - DNA, 26 bp, Artificial Sequence
  Description of Artificial Sequence: Synthetic oligonucleotide
tggctccgcagatacctggagaacgg

SEQ ID NO: 359128 - DNA, 28 bp, Artificial Sequence
  Description of Artificial Sequence: Synthetic oligonucleotide
ctgcccaacacgctcatctgtgttgtgg

SEQ ID NO: 359129 - DNA, 22 bp, Artificial Sequence
  Description of Artificial Sequence: Synthetic oligonucleotide
gagacgctgcagcgcacggacg

SEQ ID NO: 359130 - DNA, 29 bp, Artificial Sequence
  Description of Artificial Sequence: Synthetic oligonucleotide
tgcccaacacgctcatctgtgttgtggac

SEQ ID NO: 359131 - DNA, 22 bp, Artificial Sequence
  Description of Artificial Sequence: Synthetic oligonucleotide
agacgctgcagcgcacggacgc

SEQ ID NO: 359132 - DNA, 28 bp, Artificial Sequence
  Description of Artificial Sequence: Synthetic oligonucleotide
gcccaacacgctcatctgtgttgtggac

SEQ ID NO: 359133 - DNA, 21 bp, Artificial Sequence
  Description of Artificial Sequence: Synthetic oligonucleotide
gacgctgcagcgcacggacgc

SEQ ID NO: 359134 - DNA, 30 bp, Artificial Sequence; identical to SEQ ID NO: 234173
  Description of Artificial Sequence: Synthetic oligonucleotide

SEQ ID NO: 359135 - DNA, 21 bp, Artificial Sequence
  Description of Artificial Sequence: Synthetic oligonucleotide
acgctgcagcgcacggacgcc

SEQ ID NO: 359136 - DNA, 32 bp, Artificial Sequence; identical to SEQ ID NO: 234174
  Description of Artificial Sequence: Synthetic oligonucleotide

SEQ ID NO: 359137 - DNA, 20 bp, Artificial Sequence
  Description of Artificial Sequence: Synthetic oligonucleotide
cgctgcagcgcacggacgcc

SEQ ID NO: 359138 - DNA, 35 bp, Artificial Sequence; identical to SEQ ID NO: 234175
  Description of Artificial Sequence: Synthetic oligonucleotide

SEQ ID NO: 359139 - DNA, 20 bp, Artificial Sequence
  Description of Artificial Sequence: Synthetic oligonucleotide
gctgcagcgcacggacgccc

SEQ ID NO: 359140 - DNA, 35 bp, Artificial Sequence; identical to SEQ ID NO: 234176
  Description of Artificial Sequence: Synthetic oligonucleotide

SEQ ID NO: 359141 - DNA, 20 bp, Artificial Sequence
  Description of Artificial Sequence: Synthetic oligonucleotide
ctgcagcgcacggacgcccc

SEQ ID NO: 359142 - DNA, 34 bp, Artificial Sequence; identical to SEQ ID NO: 234177
  Description of Artificial Sequence: Synthetic oligonucleotide

SEQ ID NO: 359143 - DNA, 24 bp, Artificial Sequence
  Description of Artificial Sequence: Synthetic oligonucleotide
tgcagcgcacggacgcccccaaaa

SEQ ID NO: 359144 - DNA, 33 bp, Artificial Sequence; identical to SEQ ID NO: 234178
  Description of Artificial Sequence: Synthetic oligonucleotide

SEQ ID NO: 359145 - DNA, 23 bp, Artificial Sequence
  Description of Artificial Sequence: Synthetic oligonucleotide
gcagcgcacggacgcccccaaaa

SEQ ID NO: 359146 - DNA, 34 bp, Artificial Sequence; identical to SEQ ID NO: 234179
  Description of Artificial Sequence: Synthetic oligonucleotide

SEQ ID NO: 359147 - DNA, 23 bp, Artificial Sequence
  Description of Artificial Sequence: Synthetic oligonucleotide
cagcgcacggacgcccccaaaac

SEQ ID NO: 359148 - DNA, 33 bp, Artificial Sequence; identical to SEQ ID NO: 234180
  Description of Artificial Sequence: Synthetic oligonucleotide

SEQ ID NO: 359149 - DNA, 23 bp, Artificial Sequence
  Description of Artificial Sequence: Synthetic oligonucleotide
agcgcacggacgcccccaaaacg

SEQ ID NO: 359150 - DNA, 33 bp, Artificial Sequence; identical to SEQ ID NO: 234181
  Description of Artificial Sequence: Synthetic oligonucleotide

SEQ ID NO: 359151 - DNA, 22 bp, Artificial Sequence
  Description of Artificial Sequence: Synthetic oligonucleotide
gcgcacggacgcccccaaaacg

SEQ ID NO: 359152 - DNA, 34 bp, Artificial Sequence; identical to SEQ ID NO: 234182
  Description of Artificial Sequence: Synthetic oligonucleotide

SEQ ID NO: 359153 - DNA, 26 bp, Artificial Sequence
  Description of Artificial Sequence: Synthetic oligonucleotide
cgcacggacgcccccaaaacgcatat

SEQ ID NO: 359154 - DNA, 35 bp, Artificial Sequence; identical to SEQ ID NO: 234183
  Description of Artificial Sequence: Synthetic oligonucleotide

SEQ ID NO: 359155 - DNA, 27 bp, Artificial Sequence
  Description of Artificial Sequence: Synthetic oligonucleotide
gcacggacgcccccaaaacgcatatga

SEQ ID NO: 359156 - DNA, 34 bp, Artificial Sequence; identical to SEQ ID NO: 234184
  Description of Artificial Sequence: Synthetic oligonucleotide

SEQ ID NO: 359157 - DNA, 27 bp, Artificial Sequence
  Description of Artificial Sequence: Synthetic oligonucleotide
cacggacgcccccaaaacgcatatgac

SEQ ID NO: 359158 - DNA, 34 bp, Artificial Sequence; identical to SEQ ID NO: 234185
  Description of Artificial Sequence: Synthetic oligonucleotide

SEQ ID NO: 359159 - DNA, 28 bp, Artificial Sequence
  Description of Artificial Sequence: Synthetic oligonucleotide
acggacgcccccaaaacgcatatgactc

SEQ ID NO: 359160 - DNA, 33 bp, Artificial Sequence; identical to SEQ ID NO: 234186
  Description of Artificial Sequence: Synthetic oligonucleotide

SEQ ID NO: 359161 - DNA, 27 bp, Artificial Sequence
  Description of Artificial Sequence: Synthetic oligonucleotide
cggacgcccccaaaacgcatatgactc

SEQ ID NO: 359162 - DNA, 32 bp, Artificial Sequence; identical to SEQ ID NO: 234187
  Description of Artificial Sequence: Synthetic oligonucleotide

SEQ ID NO: 359163 - DNA, 28 bp, Artificial Sequence
  Description of Artificial Sequence: Synthetic oligonucleotide
ggacgcccccaaaacgcatatgactcac

SEQ ID NO: 359164 - DNA, 33 bp, Artificial Sequence; identical to SEQ ID NO: 234188
  Description of Artificial Sequence: Synthetic oligonucleotide

SEQ ID NO: 359165 - DNA, 28 bp, Artificial Sequence
  Description of Artificial Sequence: Synthetic oligonucleotide
gacgcccccaaaacgcatatgactcacc

SEQ ID NO: 359166 - DNA, 32 bp, Artificial Sequence; identical to SEQ ID NO: 234189
  Description of Artificial Sequence: Synthetic oligonucleotide

SEQ ID NO: 359167 - DNA, 29 bp, Artificial Sequence
  Description of Artificial Sequence: Synthetic oligonucleotide
acgcccccaaaacgcatatgactcaccac

SEQ ID NO: 359168 - DNA, 34 bp, Artificial Sequence; identical to SEQ ID NO: 234190
  Description of Artificial Sequence: Synthetic oligonucleotide

SEQ ID NO: 359169 - DNA, 28 bp, Artificial Sequence
  Description of Artificial Sequence: Synthetic oligonucleotide
cgcccccaaaacgcatatgactcaccac

SEQ ID NO: 359170 - DNA, 33 bp, Artificial Sequence; identical to SEQ ID NO: 234191
  Description of Artificial Sequence: Synthetic oligonucleotide

SEQ ID NO: 359171 - DNA, 28 bp, Artificial Sequence
  Description of Artificial Sequence: Synthetic oligonucleotide
gcccccaaaacgcatatgactcaccacg

SEQ ID NO: 359172 - DNA, 35 bp, Artificial Sequence; identical to SEQ ID NO: 234192
  Description of Artificial Sequence: Synthetic oligonucleotide

SEQ ID NO: 359173 - DNA, 28 bp, Artificial Sequence
  Description of Artificial Sequence: Synthetic oligonucleotide
cccccaaaacgcatatgactcaccacgc

SEQ ID NO: 359174 - DNA, 34 bp, Artificial Sequence; identical to SEQ ID NO: 234193
  Description of Artificial Sequence: Synthetic oligonucleotide

SEQ ID NO: 359175 - DNA, 29 bp, Artificial Sequence
  Description of Artificial Sequence: Synthetic oligonucleotide
ccccaaaacgcatatgactcaccacgctg

SEQ ID NO: 359176 - DNA, 33 bp, Artificial Sequence; identical to SEQ ID NO: 234194
  Description of Artificial Sequence: Synthetic oligonucleotide

SEQ ID NO: 359177 - DNA, 30 bp, Artificial Sequence; identical to SEQ ID NO: 3549
  Description of Artificial Sequence: Synthetic oligonucleotide

SEQ ID NO: 359178 - DNA, 34 bp, Artificial Sequence; identical to SEQ ID NO: 234195
  Description of Artificial Sequence: Synthetic oligonucleotide

SEQ ID NO: 359179 - DNA, 31 bp, Artificial Sequence; identical to SEQ ID NO: 3550
  Description of Artificial Sequence: Synthetic oligonucleotide

SEQ ID NO: 359180 - DNA, 33 bp, Artificial Sequence; identical to SEQ ID NO: 234196
  Description of Artificial Sequence: Synthetic oligonucleotide

SEQ ID NO: 359181 - DNA, 32 bp, Artificial Sequence; identical to SEQ ID NO: 3551
  Description of Artificial Sequence: Synthetic oligonucleotide

SEQ ID NO: 359182 - DNA, 35 bp, Artificial Sequence; identical to SEQ ID NO: 234197
  Description of Artificial Sequence: Synthetic oligonucleotide

SEQ ID NO: 359183 - DNA, 33 bp, Artificial Sequence; identical to SEQ ID NO: 3552
  Description of Artificial Sequence: Synthetic oligonucleotide

SEQ ID NO: 359184 - DNA, 35 bp, Artificial Sequence; identical to SEQ ID NO: 234198
  Description of Artificial Sequence: Synthetic oligonucleotide

SEQ ID NO: 359185 - DNA, 32 bp, Artificial Sequence; identical to SEQ ID NO: 3553
  Description of Artificial Sequence: Synthetic oligonucleotide

SEQ ID NO: 359186 - DNA, 34 bp, Artificial Sequence; identical to SEQ ID NO: 234199
  Description of Artificial Sequence: Synthetic oligonucleotide

SEQ ID NO: 359187 - DNA, 31 bp, Artificial Sequence; identical to SEQ ID NO: 3554
  Description of Artificial Sequence: Synthetic oligonucleotide

SEQ ID NO: 359188 - DNA, 34 bp, Artificial Sequence; identical to SEQ ID NO: 234200
  Description of Artificial Sequence: Synthetic oligonucleotide

SEQ ID NO: 359189 - DNA, 30 bp, Artificial Sequence; identical to SEQ ID NO: 3555
  Description of Artificial Sequence: Synthetic oligonucleotide

SEQ ID NO: 359190 - DNA, 33 bp, Artificial Sequence; identical to SEQ ID NO: 234201
  Description of Artificial Sequence: Synthetic oligonucleotide

SEQ ID NO: 359191 - DNA, 29 bp, Artificial Sequence
  Description of Artificial Sequence: Synthetic oligonucleotide
cgcatatgactcaccacgctgtctctgac

SEQ ID NO: 359192 - DNA, 32 bp, Artificial Sequence; identical to SEQ ID NO: 234202
  Description of Artificial Sequence: Synthetic oligonucleotide

SEQ ID NO: 359193 - DNA, 29 bp, Artificial Sequence
  Description of Artificial Sequence: Synthetic oligonucleotide
gcatatgactcaccacgctgtctctgacc

SEQ ID NO: 359194 - DNA, 33 bp, Artificial Sequence; identical to SEQ ID NO: 234203
  Description of Artificial Sequence: Synthetic oligonucleotide

SEQ ID NO: 359195 - DNA, 31 bp, Artificial Sequence; identical to SEQ ID NO: 3558
  Description of Artificial Sequence: Synthetic oligonucleotide

SEQ ID NO: 359196 - DNA, 32 bp, Artificial Sequence; identical to SEQ ID NO: 234204
  Description of Artificial Sequence: Synthetic oligonucleotide

SEQ ID NO: 359197 - DNA, 33 bp, Artificial Sequence; identical to SEQ ID NO: 3559
  Description of Artificial Sequence: Synthetic oligonucleotide

SEQ ID NO: 359198 - DNA, 31 bp, Artificial Sequence; identical to SEQ ID NO: 234205
  Description of Artificial Sequence: Synthetic oligonucleotide

SEQ ID NO: 359199 - DNA, 32 bp, Artificial Sequence; identical to SEQ ID NO: 3560
  Description of Artificial Sequence: Synthetic oligonucleotide

SEQ ID NO: 359200 - DNA, 32 bp, Artificial Sequence; identical to SEQ ID NO: 234206
  Description of Artificial Sequence: Synthetic oligonucleotide

SEQ ID NO: 359201 - DNA, 31 bp, Artificial Sequence; identical to SEQ ID NO: 3561
  Description of Artificial Sequence: Synthetic oligonucleotide

SEQ ID NO: 359202 - DNA, 31 bp, Artificial Sequence; identical to SEQ ID NO: 234207
  Description of Artificial Sequence: Synthetic oligonucleotide

SEQ ID NO: 359203 - DNA, 30 bp, Artificial Sequence; identical to SEQ ID NO: 3562
  Description of Artificial Sequence: Synthetic oligonucleotide

SEQ ID NO: 359204 - DNA, 30 bp, Artificial Sequence; identical to SEQ ID NO: 234208
  Description of Artificial Sequence: Synthetic oligonucleotide

SEQ ID NO: 359205 - DNA, 29 bp, Artificial Sequence
  Description of Artificial Sequence: Synthetic oligonucleotide
gactcaccacgctgtctctgaccatgaag

SEQ ID NO: 359206 - DNA, 29 bp, Artificial Sequence
  Description of Artificial Sequence: Synthetic oligonucleotide
ccacctgtggtctacatcacatcgctgag

SEQ ID NO: 359207 - DNA, 29 bp, Artificial Sequence
  Description of Artificial Sequence: Synthetic oligonucleotide
actcaccacgctgtctctgaccatgaagc

SEQ ID NO: 359208 - DNA, 29 bp, Artificial Sequence
  Description of Artificial Sequence: Synthetic oligonucleotide
cacctgtggtctacatcacatcgctgagc

SEQ ID NO: 359209 - DNA, 28 bp, Artificial Sequence
  Description of Artificial Sequence: Synthetic oligonucleotide
ctcaccacgctgtctctgaccatgaagc

SEQ ID NO: 359210 - DNA, 32 bp, Artificial Sequence; identical to SEQ ID NO: 234211
  Description of Artificial Sequence: Synthetic oligonucleotide

SEQ ID NO: 359211 - DNA, 28 bp, Artificial Sequence
  Description of Artificial Sequence: Synthetic oligonucleotide
tcaccacgctgtctctgaccatgaagcc

SEQ ID NO: 359212 - DNA, 31 bp, Artificial Sequence; identical to SEQ ID NO: 234212
  Description of Artificial Sequence: Synthetic oligonucleotide

SEQ ID NO: 359213 - DNA, 27 bp, Artificial Sequence
  Description of Artificial Sequence: Synthetic oligonucleotide
caccacgctgtctctgaccatgaagcc

SEQ ID NO: 359214 - DNA, 31 bp, Artificial Sequence; identical to SEQ ID NO: 234213
  Description of Artificial Sequence: Synthetic oligonucleotide

SEQ ID NO: 359215 - DNA, 28 bp, Artificial Sequence
  Description of Artificial Sequence: Synthetic oligonucleotide
accacgctgtctctgaccatgaagccac

SEQ ID NO: 359216 - DNA, 31 bp, Artificial Sequence; identical to SEQ ID NO: 234214
  Description of Artificial Sequence: Synthetic oligonucleotide

SEQ ID NO: 359217 - DNA, 27 bp, Artificial Sequence
  Description of Artificial Sequence: Synthetic oligonucleotide
ccacgctgtctctgaccatgaagccac

SEQ ID NO: 359218 - DNA, 30 bp, Artificial Sequence; identical to SEQ ID NO: 234215
  Description of Artificial Sequence: Synthetic oligonucleotide

SEQ ID NO: 359219 - DNA, 27 bp, Artificial Sequence
  Description of Artificial Sequence: Synthetic oligonucleotide
cacgctgtctctgaccatgaagccacc

SEQ ID NO: 359220 - DNA, 30 bp, Artificial Sequence; identical to SEQ ID NO: 234216
  Description of Artificial Sequence: Synthetic oligonucleotide

SEQ ID NO: 359221 - DNA, 27 bp, Artificial Sequence
  Description of Artificial Sequence: Synthetic oligonucleotide
acgctgtctctgaccatgaagccaccc

SEQ ID NO: 359222 - DNA, 29 bp, Artificial Sequence
  Description of Artificial Sequence: Synthetic oligonucleotide
ggtctacatcacatcgctgagcaaagggc

SEQ ID NO: 359223 - DNA, 27 bp, Artificial Sequence
  Description of Artificial Sequence: Synthetic oligonucleotide
cgctgtctctgaccatgaagccaccct

SEQ ID NO: 359224 - DNA, 30 bp, Artificial Sequence; identical to SEQ ID NO: 234218
  Description of Artificial Sequence: Synthetic oligonucleotide

SEQ ID NO: 359225 - DNA, 27 bp, Artificial Sequence
  Description of Artificial Sequence: Synthetic oligonucleotide
gctgtctctgaccatgaagccaccctg

SEQ ID NO: 359226 - DNA, 31 bp, Artificial Sequence; identical to SEQ ID NO: 234219
  Description of Artificial Sequence: Synthetic oligonucleotide

SEQ ID NO: 359227 - DNA, 28 bp, Artificial Sequence
  Description of Artificial Sequence: Synthetic oligonucleotide
ctgtctctgaccatgaagccaccctgag

SEQ ID NO: 359228 - DNA, 30 bp, Artificial Sequence; identical to SEQ ID NO: 234220
  Description of Artificial Sequence: Synthetic oligonucleotide

SEQ ID NO: 359229 - DNA, 28 bp, Artificial Sequence
  Description of Artificial Sequence: Synthetic oligonucleotide
tgtctctgaccatgaagccaccctgagg

SEQ ID NO: 359230 - DNA, 31 bp, Artificial Sequence; identical to SEQ ID NO: 234221
  Description of Artificial Sequence: Synthetic oligonucleotide

SEQ ID NO: 359231 - DNA, 27 bp, Artificial Sequence
  Description of Artificial Sequence: Synthetic oligonucleotide
gtctctgaccatgaagccaccctgagg

SEQ ID NO: 359232 - DNA, 30 bp, Artificial Sequence; identical to SEQ ID NO: 234222
  Description of Artificial Sequence: Synthetic oligonucleotide

SEQ ID NO: 359233 - DNA, 28 bp, Artificial Sequence
  Description of Artificial Sequence: Synthetic oligonucleotide
tctctgaccatgaagccaccctgaggtg

SEQ ID NO: 359234 - DNA, 29 bp, Artificial Sequence
  Description of Artificial Sequence: Synthetic oligonucleotide
catcacatcgctgagcaaagggcactcac

SEQ ID NO: 359235 - DNA, 27 bp, Artificial Sequence
  Description of Artificial Sequence: Synthetic oligonucleotide
ctctgaccatgaagccaccctgaggtg

SEQ ID NO: 359236 - DNA, 30 bp, Artificial Sequence; identical to SEQ ID NO: 234224
  Description of Artificial Sequence: Synthetic oligonucleotide

SEQ ID NO: 359237 - DNA, 27 bp, Artificial Sequence
  Description of Artificial Sequence: Synthetic oligonucleotide
tctgaccatgaagccaccctgaggtgc

SEQ ID NO: 359238 - DNA, 29 bp, Artificial Sequence
  Description of Artificial Sequence: Synthetic oligonucleotide
tcacatcgctgagcaaagggcactcactc

SEQ ID NO: 359239 - DNA, 27 bp, Artificial Sequence
  Description of Artificial Sequence: Synthetic oligonucleotide
ctgaccatgaagccaccctgaggtgct

SEQ ID NO: 359240 - DNA, 28 bp, Artificial Sequence
  Description of Artificial Sequence: Synthetic oligonucleotide
cacatcgctgagcaaagggcactcactc

SEQ ID NO: 359241 - DNA, 27 bp, Artificial Sequence
  Description of Artificial Sequence: Synthetic oligonucleotide
tgaccatgaagccaccctgaggtgctg

SEQ ID NO: 359242 - DNA, 29 bp, Artificial Sequence
  Description of Artificial Sequence: Synthetic oligonucleotide
acatcgctgagcaaagggcactcactcac

SEQ ID NO: 359243 - DNA, 26 bp, Artificial Sequence
  Description of Artificial Sequence: Synthetic oligonucleotide
gaccatgaagccaccctgaggtgctg

SEQ ID NO: 359244 - DNA, 28 bp, Artificial Sequence
  Description of Artificial Sequence: Synthetic oligonucleotide
catcgctgagcaaagggcactcactcac

SEQ ID NO: 359245 - DNA, 26 bp, Artificial Sequence
  Description of Artificial Sequence: Synthetic oligonucleotide
accatgaagccaccctgaggtgctgg

SEQ ID NO: 359246 - DNA, 29 bp, Artificial Sequence
  Description of Artificial Sequence: Synthetic oligonucleotide
atcgctgagcaaagggcactcactcacag

SEQ ID NO: 359247 - DNA, 25 bp, Artificial Sequence
  Description of Artificial Sequence: Synthetic oligonucleotide
ccatgaagccaccctgaggtgctgg

SEQ ID NO: 359248 - DNA, 28 bp, Artificial Sequence
  Description of Artificial Sequence: Synthetic oligonucleotide
tcgctgagcaaagggcactcactcacag

SEQ ID NO: 359249 - DNA, 25 bp, Artificial Sequence
  Description of Artificial Sequence: Synthetic oligonucleotide
catgaagccaccctgaggtgctggg

SEQ ID NO: 359250 - DNA, 27 bp, Artificial Sequence
  Description of Artificial Sequence: Synthetic oligonucleotide
cgctgagcaaagggcactcactcacag

SEQ ID NO: 359251 - DNA, 25 bp, Artificial Sequence
  Description of Artificial Sequence: Synthetic oligonucleotide
atgaagccaccctgaggtgctgggc

SEQ ID NO: 359252 - DNA, 29 bp, Artificial Sequence
  Description of Artificial Sequence: Synthetic oligonucleotide
gctgagcaaagggcactcactcacagaag

SEQ ID NO: 359253 - DNA, 24 bp, Artificial Sequence
  Description of Artificial Sequence: Synthetic oligonucleotide
tgaagccaccctgaggtgctgggc

SEQ ID NO: 359254 - DNA, 29 bp, Artificial Sequence
  Description of Artificial Sequence: Synthetic oligonucleotide
ctgagcaaagggcactcactcacagaagc

SEQ ID NO: 359255 - DNA, 23 bp, Artificial Sequence
  Description of Artificial Sequence: Synthetic oligonucleotide
gaagccaccctgaggtgctgggc

SEQ ID NO: 359256 - DNA, 30 bp, Artificial Sequence; identical to SEQ ID NO: 234234
  Description of Artificial Sequence: Synthetic oligonucleotide

SEQ ID NO: 359257 - DNA, 23 bp, Artificial Sequence
  Description of Artificial Sequence: Synthetic oligonucleotide
aagccaccctgaggtgctgggcc

SEQ ID NO: 359258 - DNA, 29 bp, Artificial Sequence
  Description of Artificial Sequence: Synthetic oligonucleotide
gagcaaagggcactcactcacagaagctg

SEQ ID NO: 359259 - DNA, 22 bp, Artificial Sequence
  Description of Artificial Sequence: Synthetic oligonucleotide
agccaccctgaggtgctgggcc

SEQ ID NO: 359260 - DNA, 32 bp, Artificial Sequence; identical to SEQ ID NO: 234236
  Description of Artificial Sequence: Synthetic oligonucleotide

SEQ ID NO: 359261 - DNA, 23 bp, Artificial Sequence
  Description of Artificial Sequence: Synthetic oligonucleotide
caccctgaggtgctgggccctga

SEQ ID NO: 359262 - DNA, 31 bp, Artificial Sequence; identical to SEQ ID NO: 234237
  Description of Artificial Sequence: Synthetic oligonucleotide

SEQ ID NO: 359263 - DNA, 23 bp, Artificial Sequence
  Description of Artificial Sequence: Synthetic oligonucleotide
accctgaggtgctgggccctgag

SEQ ID NO: 359264 - DNA, 32 bp, Artificial Sequence; identical to SEQ ID NO: 234238
  Description of Artificial Sequence: Synthetic oligonucleotide

SEQ ID NO: 359265 - DNA, 22 bp, Artificial Sequence
  Description of Artificial Sequence: Synthetic oligonucleotide
ccctgaggtgctgggccctgag

SEQ ID NO: 359266 - DNA, 33 bp, Artificial Sequence; identical to SEQ ID NO: 234239
  Description of Artificial Sequence: Synthetic oligonucleotide

SEQ ID NO: 359267 - DNA, 24 bp, Artificial Sequence
  Description of Artificial Sequence: Synthetic oligonucleotide
cctgaggtgctgggccctgagctt

SEQ ID NO: 359268 - DNA, 32 bp, Artificial Sequence; identical to SEQ ID NO: 234240
  Description of Artificial Sequence: Synthetic oligonucleotide

SEQ ID NO: 359269 - DNA, 26 bp, Artificial Sequence
  Description of Artificial Sequence: Synthetic oligonucleotide
ctgaggtgctgggccctgagcttcta

SEQ ID NO: 359270 - DNA, 31 bp, Artificial Sequence; identical to SEQ ID NO: 234241
  Description of Artificial Sequence: Synthetic oligonucleotide

SEQ ID NO: 359271 - DNA, 26 bp, Artificial Sequence
  Description of Artificial Sequence: Synthetic oligonucleotide
tgaggtgctgggccctgagcttctac

SEQ ID NO: 359272 - DNA, 30 bp, Artificial Sequence; identical to SEQ ID NO: 234242
  Description of Artificial Sequence: Synthetic oligonucleotide

SEQ ID NO: 359273 - DNA, 25 bp, Artificial Sequence
  Description of Artificial Sequence: Synthetic oligonucleotide
gaggtgctgggccctgagcttctac

SEQ ID NO: 359274 - DNA, 31 bp, Artificial Sequence; identical to SEQ ID NO: 234243
  Description of Artificial Sequence: Synthetic oligonucleotide

SEQ ID NO: 359275 - DNA, 25 bp, Artificial Sequence
  Description of Artificial Sequence: Synthetic oligonucleotide
aggtgctgggccctgagcttctacc

SEQ ID NO: 359276 - DNA, 31 bp, Artificial Sequence; identical to SEQ ID NO: 234244
  Description of Artificial Sequence: Synthetic oligonucleotide

SEQ ID NO: 359277 - DNA, 24 bp, Artificial Sequence
  Description of Artificial Sequence: Synthetic oligonucleotide
ggtgctgggccctgagcttctacc

SEQ ID NO: 359278 - DNA, 32 bp, Artificial Sequence; identical to SEQ ID NO: 234245
  Description of Artificial Sequence: Synthetic oligonucleotide

SEQ ID NO: 359279 - DNA, 25 bp, Artificial Sequence
  Description of Artificial Sequence: Synthetic oligonucleotide
gtgctgggccctgagcttctaccct

SEQ ID NO: 359280 - DNA, 32 bp, Artificial Sequence; identical to SEQ ID NO: 234246
  Description of Artificial Sequence: Synthetic oligonucleotide

SEQ ID NO: 359281 - DNA, 25 bp, Artificial Sequence
  Description of Artificial Sequence: Synthetic oligonucleotide
tgctgggccctgagcttctaccctg

SEQ ID NO: 359282 - DNA, 31 bp, Artificial Sequence; identical to SEQ ID NO: 234247
  Description of Artificial Sequence: Synthetic oligonucleotide

SEQ ID NO: 359283 - DNA, 24 bp, Artificial Sequence
  Description of Artificial Sequence: Synthetic oligonucleotide
gctgggccctgagcttctaccctg

SEQ ID NO: 359284 - DNA, 33 bp, Artificial Sequence; identical to SEQ ID NO: 234248
  Description of Artificial Sequence: Synthetic oligonucleotide

SEQ ID NO: 359285 - DNA, 24 bp, Artificial Sequence
  Description of Artificial Sequence: Synthetic oligonucleotide
ctgggccctgagcttctaccctgc

SEQ ID NO: 359286 - DNA, 32 bp, Artificial Sequence; identical to SEQ ID NO: 234249
  Description of Artificial Sequence: Synthetic oligonucleotide

SEQ ID NO: 359287 - DNA, 24 bp, Artificial Sequence
  Description of Artificial Sequence: Synthetic oligonucleotide
tgggccctgagcttctaccctgcg

SEQ ID NO: 359288 - DNA, 32 bp, Artificial Sequence; identical to SEQ ID NO: 234250
  Description of Artificial Sequence: Synthetic oligonucleotide

SEQ ID NO: 359289 - DNA, 23 bp, Artificial Sequence
  Description of Artificial Sequence: Synthetic oligonucleotide
gggccctgagcttctaccctgcg

SEQ ID NO: 359290 - DNA, 31 bp, Artificial Sequence; identical to SEQ ID NO: 234251
  Description of Artificial Sequence: Synthetic oligonucleotide

SEQ ID NO: 359291 - DNA, 24 bp, Artificial Sequence
  Description of Artificial Sequence: Synthetic oligonucleotide
ggccctgagcttctaccctgcgga

SEQ ID NO: 359292 - DNA, 32 bp, Artificial Sequence; identical to SEQ ID NO: 234252
  Description of Artificial Sequence: Synthetic oligonucleotide

SEQ ID NO: 359293 - DNA, 26 bp, Artificial Sequence
  Description of Artificial Sequence: Synthetic oligonucleotide
gccctgagcttctaccctgcggagat

SEQ ID NO: 359294 - DNA, 31 bp, Artificial Sequence; identical to SEQ ID NO: 234253
  Description of Artificial Sequence: Synthetic oligonucleotide

SEQ ID NO: 359295 - DNA, 27 bp, Artificial Sequence
  Description of Artificial Sequence: Synthetic oligonucleotide
ccctgagcttctaccctgcggagatca

SEQ ID NO: 359296 - DNA, 32 bp, Artificial Sequence; identical to SEQ ID NO: 234254
  Description of Artificial Sequence: Synthetic oligonucleotide

SEQ ID NO: 359297 - DNA, 27 bp, Artificial Sequence
  Description of Artificial Sequence: Synthetic oligonucleotide
cctgagcttctaccctgcggagatcac

SEQ ID NO: 359298 - DNA, 31 bp, Artificial Sequence; identical to SEQ ID NO: 234255
  Description of Artificial Sequence: Synthetic oligonucleotide

SEQ ID NO: 359299 - DNA, 28 bp, Artificial Sequence
  Description of Artificial Sequence: Synthetic oligonucleotide
ctgagcttctaccctgcggagatcacac

SEQ ID NO: 359300 - DNA, 31 bp, Artificial Sequence; identical to SEQ ID NO: 234256
  Description of Artificial Sequence: Synthetic oligonucleotide

SEQ ID NO: 359301 - DNA, 29 bp, Artificial Sequence
  Description of Artificial Sequence: Synthetic oligonucleotide
tgagcttctaccctgcggagatcacactg

SEQ ID NO: 359302 - DNA, 30 bp, Artificial Sequence; identical to SEQ ID NO: 234257
  Description of Artificial Sequence: Synthetic oligonucleotide

SEQ ID NO: 359303 - DNA, 28 bp, Artificial Sequence
  Description of Artificial Sequence: Synthetic oligonucleotide
gagcttctaccctgcggagatcacactg

SEQ ID NO: 359304 - DNA, 32 bp, Artificial Sequence; identical to SEQ ID NO: 234258
  Description of Artificial Sequence: Synthetic oligonucleotide

SEQ ID NO: 359305 - DNA, 29 bp, Artificial Sequence
  Description of Artificial Sequence: Synthetic oligonucleotide
agcttctaccctgcggagatcacactgac

SEQ ID NO: 359306 - DNA, 31 bp, Artificial Sequence; identical to SEQ ID NO: 234259
  Description of Artificial Sequence: Synthetic oligonucleotide

SEQ ID NO: 359307 - DNA, 25 bp, Artificial Sequence
  Description of Artificial Sequence: Synthetic oligonucleotide
cggctgtggtggtgccttctggaca

SEQ ID NO: 359308 - DNA, 30 bp, Artificial Sequence; identical to SEQ ID NO: 234260
  Description of Artificial Sequence: Synthetic oligonucleotide

SEQ ID NO: 359309 - DNA, 25 bp, Artificial Sequence
  Description of Artificial Sequence: Synthetic oligonucleotide
ggctgtggtggtgccttctggacag

SEQ ID NO: 359310 - DNA, 31 bp, Artificial Sequence; identical to SEQ ID NO: 234261
  Description of Artificial Sequence: Synthetic oligonucleotide

SEQ ID NO: 359311 - DNA, 26 bp, Artificial Sequence
  Description of Artificial Sequence: Synthetic oligonucleotide
gctgtggtggtgccttctggacagga

SEQ ID NO: 359312 - DNA, 32 bp, Artificial Sequence; identical to SEQ ID NO: 234262
  Description of Artificial Sequence: Synthetic oligonucleotide

SEQ ID NO: 359313 - DNA, 26 bp, Artificial Sequence
  Description of Artificial Sequence: Synthetic oligonucleotide
ctgtggtggtgccttctggacaggag

SEQ ID NO: 359314 - DNA, 31 bp, Artificial Sequence; identical to SEQ ID NO: 234263
  Description of Artificial Sequence: Synthetic oligonucleotide

SEQ ID NO: 359315 - DNA, 27 bp, Artificial Sequence
  Description of Artificial Sequence: Synthetic oligonucleotide
tgtggtggtgccttctggacaggagca

SEQ ID NO: 359316 - DNA, 33 bp, Artificial Sequence; identical to SEQ ID NO: 234264
  Description of Artificial Sequence: Synthetic oligonucleotide

SEQ ID NO: 359317 - DNA, 26 bp, Artificial Sequence
  Description of Artificial Sequence: Synthetic oligonucleotide
gtggtggtgccttctggacaggagca

SEQ ID NO: 359318 - DNA, 32 bp, Artificial Sequence; identical to SEQ ID NO: 234265
  Description of Artificial Sequence: Synthetic oligonucleotide

SEQ ID NO: 359319 - DNA, 27 bp, Artificial Sequence
  Description of Artificial Sequence: Synthetic oligonucleotide
tggtggtgccttctggacaggagcaga

SEQ ID NO: 359320 - DNA, 31 bp, Artificial Sequence; identical to SEQ ID NO: 234266
  Description of Artificial Sequence: Synthetic oligonucleotide

SEQ ID NO: 359321 - DNA, 26 bp, Artificial Sequence
  Description of Artificial Sequence: Synthetic oligonucleotide
ggtggtgccttctggacaggagcaga

SEQ ID NO: 359322 - DNA, 30 bp, Artificial Sequence; identical to SEQ ID NO: 234267
  Description of Artificial Sequence: Synthetic oligonucleotide

SEQ ID NO: 359323 - DNA, 27 bp, Artificial Sequence
  Description of Artificial Sequence: Synthetic oligonucleotide
gtggtgccttctggacaggagcagaga

SEQ ID NO: 359324 - DNA, 33 bp, Artificial Sequence; identical to SEQ ID NO: 234268
  Description of Artificial Sequence: Synthetic oligonucleotide

SEQ ID NO: 359325 - DNA, 29 bp, Artificial Sequence
  Description of Artificial Sequence: Synthetic oligonucleotide
tggtgccttctggacaggagcagagatac

SEQ ID NO: 359326 - DNA, 32 bp, Artificial Sequence; identical to SEQ ID NO: 234269
  Description of Artificial Sequence: Synthetic oligonucleotide

SEQ ID NO: 359327 - DNA, 28 bp, Artificial Sequence
  Description of Artificial Sequence: Synthetic oligonucleotide
ggtgccttctggacaggagcagagatac

SEQ ID NO: 359328 - DNA, 32 bp, Artificial Sequence; identical to SEQ ID NO: 234270
  Description of Artificial Sequence: Synthetic oligonucleotide

SEQ ID NO: 359329 - DNA, 29 bp, Artificial Sequence
  Description of Artificial Sequence: Synthetic oligonucleotide
gtgccttctggacaggagcagagatacac

SEQ ID NO: 359330 - DNA, 31 bp, Artificial Sequence; identical to SEQ ID NO: 234271
  Description of Artificial Sequence: Synthetic oligonucleotide

SEQ ID NO: 359331 - DNA, 29 bp, Artificial Sequence
  Description of Artificial Sequence: Synthetic oligonucleotide
tgccttctggacaggagcagagatacacc

SEQ ID NO: 359332 - DNA, 33 bp, Artificial Sequence; identical to SEQ ID NO: 234272
  Description of Artificial Sequence: Synthetic oligonucleotide

SEQ ID NO: 359333 - DNA, 28 bp, Artificial Sequence
  Description of Artificial Sequence: Synthetic oligonucleotide
gccttctggacaggagcagagatacacc

SEQ ID NO: 359334 - DNA, 32 bp, Artificial Sequence; identical to SEQ ID NO: 234273
  Description of Artificial Sequence: Synthetic oligonucleotide

SEQ ID NO: 359335 - DNA, 29 bp, Artificial Sequence
  Description of Artificial Sequence: Synthetic oligonucleotide
ccttctggacaggagcagagatacacctg

SEQ ID NO: 359336 - DNA, 34 bp, Artificial Sequence; identical to SEQ ID NO: 234274
  Description of Artificial Sequence: Synthetic oligonucleotide

SEQ ID NO: 359337 - DNA, 29 bp, Artificial Sequence
  Description of Artificial Sequence: Synthetic oligonucleotide
cttctggacaggagcagagatacacctgc

SEQ ID NO: 359338 - DNA, 36 bp, Artificial Sequence; identical to SEQ ID NO: 234275
  Description of Artificial Sequence: Synthetic oligonucleotide

SEQ ID NO: 359339 - DNA, 29 bp, Artificial Sequence
  Description of Artificial Sequence: Synthetic oligonucleotide
ttctggacaggagcagagatacacctgcc

SEQ ID NO: 359340 - DNA, 35 bp, Artificial Sequence; identical to SEQ ID NO: 234276
  Description of Artificial Sequence: Synthetic oligonucleotide

SEQ ID NO: 359341 - DNA, 28 bp, Artificial Sequence
  Description of Artificial Sequence: Synthetic oligonucleotide
tctggacaggagcagagatacacctgcc

SEQ ID NO: 359342 - DNA, 37 bp, Artificial Sequence; identical to SEQ ID NO: 234277
  Description of Artificial Sequence: Synthetic oligonucleotide

SEQ ID NO: 359343 - DNA, 27 bp, Artificial Sequence
  Description of Artificial Sequence: Synthetic oligonucleotide
ctggacaggagcagagatacacctgcc

SEQ ID NO: 359344 - DNA, 38 bp, Artificial Sequence; identical to SEQ ID NO: 234278
  Description of Artificial Sequence: Synthetic oligonucleotide

SEQ ID NO: 359345 - DNA, 29 bp, Artificial Sequence
  Description of Artificial Sequence: Synthetic oligonucleotide
tggacaggagcagagatacacctgccatg

SEQ ID NO: 359346 - DNA, 37 bp, Artificial Sequence; identical to SEQ ID NO: 234279
  Description of Artificial Sequence: Synthetic oligonucleotide

SEQ ID NO: 359347 - DNA, 28 bp, Artificial Sequence
  Description of Artificial Sequence: Synthetic oligonucleotide
ggacaggagcagagatacacctgccatg

SEQ ID NO: 359348 - DNA, 36 bp, Artificial Sequence; identical to SEQ ID NO: 234280
  Description of Artificial Sequence: Synthetic oligonucleotide

SEQ ID NO: 359349 - DNA, 29 bp, Artificial Sequence
  Description of Artificial Sequence: Synthetic oligonucleotide
gacaggagcagagatacacctgccatgtg

SEQ ID NO: 359350 - DNA, 39 bp, Artificial Sequence; identical to SEQ ID NO: 234281
  Description of Artificial Sequence: Synthetic oligonucleotide

SEQ ID NO: 359351 - DNA, 29 bp, Artificial Sequence
  Description of Artificial Sequence: Synthetic oligonucleotide
acaggagcagagatacacctgccatgtgc

SEQ ID NO: 359352 - DNA, 39 bp, Artificial Sequence; identical to SEQ ID NO: 234282
  Description of Artificial Sequence: Synthetic oligonucleotide

SEQ ID NO: 359353 - DNA, 28 bp, Artificial Sequence
  Description of Artificial Sequence: Synthetic oligonucleotide
caggagcagagatacacctgccatgtgc

SEQ ID NO: 359354 - DNA, 38 bp, Artificial Sequence; identical to SEQ ID NO: 234283
  Description of Artificial Sequence: Synthetic oligonucleotide

SEQ ID NO: 359355 - DNA, 31 bp, Artificial Sequence; identical to SEQ ID NO: 3638
  Description of Artificial Sequence: Synthetic oligonucleotide

SEQ ID NO: 359356 - DNA, 39 bp, Artificial Sequence; identical to SEQ ID NO: 234284
  Description of Artificial Sequence: Synthetic oligonucleotide

SEQ ID NO: 359357 - DNA, 30 bp, Artificial Sequence; identical to SEQ ID NO: 3639
  Description of Artificial Sequence: Synthetic oligonucleotide

SEQ ID NO: 359358 - DNA, 38 bp, Artificial Sequence; identical to SEQ ID NO: 234285
  Description of Artificial Sequence: Synthetic oligonucleotide

SEQ ID NO: 359359 - DNA, 29 bp, Artificial Sequence
  Description of Artificial Sequence: Synthetic oligonucleotide
acacctgccatgtgcagcatgagggtttg

SEQ ID NO: 359360 - DNA, 39 bp, Artificial Sequence; identical to SEQ ID NO: 234286
  Description of Artificial Sequence: Synthetic oligonucleotide

SEQ ID NO: 359361 - DNA, 28 bp, Artificial Sequence
  Description of Artificial Sequence: Synthetic oligonucleotide
cacctgccatgtgcagcatgagggtttg

SEQ ID NO: 359362 - DNA, 39 bp, Artificial Sequence; identical to SEQ ID NO: 234287
  Description of Artificial Sequence: Synthetic oligonucleotide

SEQ ID NO: 359363 - DNA, 28 bp, Artificial Sequence
  Description of Artificial Sequence: Synthetic oligonucleotide
acctgccatgtgcagcatgagggtttgc

SEQ ID NO: 359364 - DNA, 38 bp, Artificial Sequence; identical to SEQ ID NO: 234288
  Description of Artificial Sequence: Synthetic oligonucleotide

SEQ ID NO: 359365 - DNA, 27 bp, Artificial Sequence
  Description of Artificial Sequence: Synthetic oligonucleotide
cctgccatgtgcagcatgagggtttgc

SEQ ID NO: 359366 - DNA, 37 bp, Artificial Sequence; identical to SEQ ID NO: 234289
  Description of Artificial Sequence: Synthetic oligonucleotide

SEQ ID NO: 359367 - DNA, 27 bp, Artificial Sequence
  Description of Artificial Sequence: Synthetic oligonucleotide
ctgccatgtgcagcatgagggtttgcc

SEQ ID NO: 359368 - DNA, 39 bp, Artificial Sequence; identical to SEQ ID NO: 234290
  Description of Artificial Sequence: Synthetic oligonucleotide

SEQ ID NO: 359369 - DNA, 27 bp, Artificial Sequence
  Description of Artificial Sequence: Synthetic oligonucleotide
tgccatgtgcagcatgagggtttgccc

SEQ ID NO: 359370 - DNA, 38 bp, Artificial Sequence; identical to SEQ ID NO: 234291
  Description of Artificial Sequence: Synthetic oligonucleotide

SEQ ID NO: 359371 - DNA, 27 bp, Artificial Sequence
  Description of Artificial Sequence: Synthetic oligonucleotide
gccatgtgcagcatgagggtttgccca

SEQ ID NO: 359372 - DNA, 38 bp, Artificial Sequence; identical to SEQ ID NO: 234292
  Description of Artificial Sequence: Synthetic oligonucleotide

SEQ ID NO: 359373 - DNA, 28 bp, Artificial Sequence
  Description of Artificial Sequence: Synthetic oligonucleotide
ccatgtgcagcatgagggtttgcccaag

SEQ ID NO: 359374 - DNA, 37 bp, Artificial Sequence; identical to SEQ ID NO: 234293
  Description of Artificial Sequence: Synthetic oligonucleotide

SEQ ID NO: 359375 - DNA, 28 bp, Artificial Sequence
  Description of Artificial Sequence: Synthetic oligonucleotide
catgtgcagcatgagggtttgcccaagc

SEQ ID NO: 359376 - DNA, 38 bp, Artificial Sequence; identical to SEQ ID NO: 234294
  Description of Artificial Sequence: Synthetic oligonucleotide

SEQ ID NO: 359377 - DNA, 28 bp, Artificial Sequence
  Description of Artificial Sequence: Synthetic oligonucleotide
atgtgcagcatgagggtttgcccaagcc

SEQ ID NO: 359378 - DNA, 37 bp, Artificial Sequence; identical to SEQ ID NO: 234295
  Description of Artificial Sequence: Synthetic oligonucleotide

SEQ ID NO: 359379 - DNA, 27 bp, Artificial Sequence
  Description of Artificial Sequence: Synthetic oligonucleotide
tgtgcagcatgagggtttgcccaagcc

SEQ ID NO: 359380 - DNA, 36 bp, Artificial Sequence; identical to SEQ ID NO: 234296
  Description of Artificial Sequence: Synthetic oligonucleotide

SEQ ID NO: 359381 - DNA, 26 bp, Artificial Sequence
  Description of Artificial Sequence: Synthetic oligonucleotide
gtgcagcatgagggtttgcccaagcc

SEQ ID NO: 359382 - DNA, 36 bp, Artificial Sequence; identical to SEQ ID NO: 234297
  Description of Artificial Sequence: Synthetic oligonucleotide

SEQ ID NO: 359383 - DNA, 26 bp, Artificial Sequence
  Description of Artificial Sequence: Synthetic oligonucleotide
tgcagcatgagggtttgcccaagccc

SEQ ID NO: 359384 - DNA, 35 bp, Artificial Sequence; identical to SEQ ID NO: 234298
  Description of Artificial Sequence: Synthetic oligonucleotide

SEQ ID NO: 359385 - DNA, 25 bp, Artificial Sequence
  Description of Artificial Sequence: Synthetic oligonucleotide
gcagcatgagggtttgcccaagccc

SEQ ID NO: 359386 - DNA, 34 bp, Artificial Sequence; identical to SEQ ID NO: 234299
  Description of Artificial Sequence: Synthetic oligonucleotide

SEQ ID NO: 359387 - DNA, 26 bp, Artificial Sequence
  Description of Artificial Sequence: Synthetic oligonucleotide
cagcatgagggtttgcccaagcccct

SEQ ID NO: 359388 - DNA, 33 bp, Artificial Sequence; identical to SEQ ID NO: 234300
  Description of Artificial Sequence: Synthetic oligonucleotide

SEQ ID NO: 359389 - DNA, 27 bp, Artificial Sequence
  Description of Artificial Sequence: Synthetic oligonucleotide
agcatgagggtttgcccaagcccctca

SEQ ID NO: 359390 - DNA, 33 bp, Artificial Sequence; identical to SEQ ID NO: 234301
  Description of Artificial Sequence: Synthetic oligonucleotide

SEQ ID NO: 359391 - DNA, 26 bp, Artificial Sequence
  Description of Artificial Sequence: Synthetic oligonucleotide
gcatgagggtttgcccaagcccctca

SEQ ID NO: 359392 - DNA, 35 bp, Artificial Sequence; identical to SEQ ID NO: 234302
  Description of Artificial Sequence: Synthetic oligonucleotide

SEQ ID NO: 359393 - DNA, 26 bp, Artificial Sequence
  Description of Artificial Sequence: Synthetic oligonucleotide
catgagggtttgcccaagcccctcac

SEQ ID NO: 359394 - DNA, 34 bp, Artificial Sequence; identical to SEQ ID NO: 234303
  Description of Artificial Sequence: Synthetic oligonucleotide

SEQ ID NO: 359395 - DNA, 26 bp, Artificial Sequence
  Description of Artificial Sequence: Synthetic oligonucleotide
atgagggtttgcccaagcccctcacc

SEQ ID NO: 359396 - DNA, 33 bp, Artificial Sequence; identical to SEQ ID NO: 234304
  Description of Artificial Sequence: Synthetic oligonucleotide

SEQ ID NO: 359397 - DNA, 25 bp, Artificial Sequence
  Description of Artificial Sequence: Synthetic oligonucleotide
tgagggtttgcccaagcccctcacc

SEQ ID NO: 359398 - DNA, 34 bp, Artificial Sequence; identical to SEQ ID NO: 234305
  Description of Artificial Sequence: Synthetic oligonucleotide

SEQ ID NO: 359399 - DNA, 24 bp, Artificial Sequence
  Description of Artificial Sequence: Synthetic oligonucleotide
gagggtttgcccaagcccctcacc

SEQ ID NO: 359400 - DNA, 33 bp, Artificial Sequence; identical to SEQ ID NO: 234306
  Description of Artificial Sequence: Synthetic oligonucleotide

SEQ ID NO: 359401 - DNA, 25 bp, Artificial Sequence
  Description of Artificial Sequence: Synthetic oligonucleotide
agggtttgcccaagcccctcaccct

SEQ ID NO: 359402 - DNA, 32 bp, Artificial Sequence; identical to SEQ ID NO: 234307
  Description of Artificial Sequence: Synthetic oligonucleotide

SEQ ID NO: 359403 - DNA, 24 bp, Artificial Sequence
  Description of Artificial Sequence: Synthetic oligonucleotide
gggtttgcccaagcccctcaccct

SEQ ID NO: 359404 - DNA, 32 bp, Artificial Sequence; identical to SEQ ID NO: 234308
  Description of Artificial Sequence: Synthetic oligonucleotide

SEQ ID NO: 359405 - DNA, 25 bp, Artificial Sequence
  Description of Artificial Sequence: Synthetic oligonucleotide
ggtttgcccaagcccctcaccctga

SEQ ID NO: 359406 - DNA, 31 bp, Artificial Sequence; identical to SEQ ID NO: 234309
  Description of Artificial Sequence: Synthetic oligonucleotide

SEQ ID NO: 359407 - DNA, 27 bp, Artificial Sequence
  Description of Artificial Sequence: Synthetic oligonucleotide
gtttgcccaagcccctcaccctgagat

SEQ ID NO: 359408 - DNA, 30 bp, Artificial Sequence; identical to SEQ ID NO: 234310
  Description of Artificial Sequence: Synthetic oligonucleotide

SEQ ID NO: 359409 - DNA, 27 bp, Artificial Sequence
  Description of Artificial Sequence: Synthetic oligonucleotide
tttgcccaagcccctcaccctgagatg

SEQ ID NO: 359410 - DNA, 31 bp, Artificial Sequence; identical to SEQ ID NO: 234311
  Description of Artificial Sequence: Synthetic oligonucleotide

SEQ ID NO: 359411 - DNA, 26 bp, Artificial Sequence
  Description of Artificial Sequence: Synthetic oligonucleotide
ttgcccaagcccctcaccctgagatg

SEQ ID NO: 359412 - DNA, 30 bp, Artificial Sequence; identical to SEQ ID NO: 234312
  Description of Artificial Sequence: Synthetic oligonucleotide

SEQ ID NO: 359413 - DNA, 25 bp, Artificial Sequence
  Description of Artificial Sequence: Synthetic oligonucleotide
aagcccctcaccctgagatgggagc

SEQ ID NO: 359414 - DNA, 29 bp, Artificial Sequence
  Description of Artificial Sequence: Synthetic oligonucleotide
cagttaccacaccttcctgccttctgctc

SEQ ID NO: 359415 - DNA, 24 bp, Artificial Sequence
  Description of Artificial Sequence: Synthetic oligonucleotide
agcccctcaccctgagatgggagc

SEQ ID NO: 359416 - DNA, 31 bp, Artificial Sequence; identical to SEQ ID NO: 234314
  Description of Artificial Sequence: Synthetic oligonucleotide

SEQ ID NO: 359417 - DNA, 23 bp, Artificial Sequence
  Description of Artificial Sequence: Synthetic oligonucleotide
gcccctcaccctgagatgggagc

SEQ ID NO: 359418 - DNA, 30 bp, Artificial Sequence; identical to SEQ ID NO: 234315
  Description of Artificial Sequence: Synthetic oligonucleotide

SEQ ID NO: 359419 - DNA, 23 bp, Artificial Sequence
  Description of Artificial Sequence: Synthetic oligonucleotide
cccctcaccctgagatgggagcc

SEQ ID NO: 359420 - DNA, 31 bp, Artificial Sequence; identical to SEQ ID NO: 234316
  Description of Artificial Sequence: Synthetic oligonucleotide

SEQ ID NO: 359421 - DNA, 24 bp, Artificial Sequence
  Description of Artificial Sequence: Synthetic oligonucleotide
ccctcaccctgagatgggagccgt

SEQ ID NO: 359422 - DNA, 30 bp, Artificial Sequence; identical to SEQ ID NO: 234317
  Description of Artificial Sequence: Synthetic oligonucleotide

SEQ ID NO: 359423 - DNA, 26 bp, Artificial Sequence
  Description of Artificial Sequence: Synthetic oligonucleotide
cctcaccctgagatgggagccgtctt

SEQ ID NO: 359424 - DNA, 29 bp, Artificial Sequence
  Description of Artificial Sequence: Synthetic oligonucleotide
accacaccttcctgccttctgctcatgag

SEQ ID NO: 359425 - DNA, 26 bp, Artificial Sequence
  Description of Artificial Sequence: Synthetic oligonucleotide
ctcaccctgagatgggagccgtcttc

SEQ ID NO: 359426 - DNA, 28 bp, Artificial Sequence
  Description of Artificial Sequence: Synthetic oligonucleotide
ccacaccttcctgccttctgctcatgag

SEQ ID NO: 359427 - DNA, 26 bp, Artificial Sequence
  Description of Artificial Sequence: Synthetic oligonucleotide
tcaccctgagatgggagccgtcttcc

SEQ ID NO: 359428 - DNA, 34 bp, Artificial Sequence; identical to SEQ ID NO: 234320
  Description of Artificial Sequence: Synthetic oligonucleotide

SEQ ID NO: 359429 - DNA, 25 bp, Artificial Sequence
  Description of Artificial Sequence: Synthetic oligonucleotide
caccctgagatgggagccgtcttcc

SEQ ID NO: 359430 - DNA, 35 bp, Artificial Sequence; identical to SEQ ID NO: 234321
  Description of Artificial Sequence: Synthetic oligonucleotide

SEQ ID NO: 359431 - DNA, 26 bp, Artificial Sequence
  Description of Artificial Sequence: Synthetic oligonucleotide
accctgagatgggagccgtcttccca

SEQ ID NO: 359432 - DNA, 34 bp, Artificial Sequence; identical to SEQ ID NO: 234322
  Description of Artificial Sequence: Synthetic oligonucleotide

SEQ ID NO: 359433 - DNA, 25 bp, Artificial Sequence
  Description of Artificial Sequence: Synthetic oligonucleotide
ccctgagatgggagccgtcttccca

SEQ ID NO: 359434 - DNA, 35 bp, Artificial Sequence; identical to SEQ ID NO: 234323
  Description of Artificial Sequence: Synthetic oligonucleotide

SEQ ID NO: 359435 - DNA, 25 bp, Artificial Sequence
  Description of Artificial Sequence: Synthetic oligonucleotide
cctgagatgggagccgtcttcccag

SEQ ID NO: 359436 - DNA, 34 bp, Artificial Sequence; identical to SEQ ID NO: 234324
  Description of Artificial Sequence: Synthetic oligonucleotide

SEQ ID NO: 359437 - DNA, 25 bp, Artificial Sequence
  Description of Artificial Sequence: Synthetic oligonucleotide
ctgagatgggagccgtcttcccagc

SEQ ID NO: 359438 - DNA, 34 bp, Artificial Sequence; identical to SEQ ID NO: 234325
  Description of Artificial Sequence: Synthetic oligonucleotide

SEQ ID NO: 359439 - DNA, 25 bp, Artificial Sequence
  Description of Artificial Sequence: Synthetic oligonucleotide
tgagatgggagccgtcttcccagcc

SEQ ID NO: 359440 - DNA, 36 bp, Artificial Sequence; identical to SEQ ID NO: 234326
  Description of Artificial Sequence: Synthetic oligonucleotide

SEQ ID NO: 359441 - DNA, 24 bp, Artificial Sequence
  Description of Artificial Sequence: Synthetic oligonucleotide
gagatgggagccgtcttcccagcc

SEQ ID NO: 359442 - DNA, 35 bp, Artificial Sequence; identical to SEQ ID NO: 234327
  Description of Artificial Sequence: Synthetic oligonucleotide

SEQ ID NO: 359443 - DNA, 25 bp, Artificial Sequence
  Description of Artificial Sequence: Synthetic oligonucleotide
agatgggagccgtcttcccagccca

SEQ ID NO: 359444 - DNA, 34 bp, Artificial Sequence; identical to SEQ ID NO: 234328
  Description of Artificial Sequence: Synthetic oligonucleotide

SEQ ID NO: 359445 - DNA, 24 bp, Artificial Sequence
  Description of Artificial Sequence: Synthetic oligonucleotide
gatgggagccgtcttcccagccca

SEQ ID NO: 359446 - DNA, 34 bp, Artificial Sequence; identical to SEQ ID NO: 234329
  Description of Artificial Sequence: Synthetic oligonucleotide

SEQ ID NO: 359447 - DNA, 24 bp, Artificial Sequence
  Description of Artificial Sequence: Synthetic oligonucleotide
atgggagccgtcttcccagcccac

SEQ ID NO: 359448 - DNA, 35 bp, Artificial Sequence; identical to SEQ ID NO: 234330
  Description of Artificial Sequence: Synthetic oligonucleotide

SEQ ID NO: 359449 - DNA, 23 bp, Artificial Sequence
  Description of Artificial Sequence: Synthetic oligonucleotide
tgggagccgtcttcccagcccac

SEQ ID NO: 359450 - DNA, 34 bp, Artificial Sequence; identical to SEQ ID NO: 234331
  Description of Artificial Sequence: Synthetic oligonucleotide

SEQ ID NO: 359451 - DNA, 22 bp, Artificial Sequence
  Description of Artificial Sequence: Synthetic oligonucleotide
gggagccgtcttcccagcccac

SEQ ID NO: 359452 - DNA, 34 bp, Artificial Sequence; identical to SEQ ID NO: 234332
  Description of Artificial Sequence: Synthetic oligonucleotide

SEQ ID NO: 359453 - DNA, 24 bp, Artificial Sequence
  Description of Artificial Sequence: Synthetic oligonucleotide
ggagccgtcttcccagcccaccat

SEQ ID NO: 359454 - DNA, 35 bp, Artificial Sequence; identical to SEQ ID NO: 234333
  Description of Artificial Sequence: Synthetic oligonucleotide

SEQ ID NO: 359455 - DNA, 24 bp, Artificial Sequence
  Description of Artificial Sequence: Synthetic oligonucleotide
gagccgtcttcccagcccaccatc

SEQ ID NO: 359456 - DNA, 35 bp, Artificial Sequence; identical to SEQ ID NO: 234334
  Description of Artificial Sequence: Synthetic oligonucleotide

SEQ ID NO: 359457 - DNA, 24 bp, Artificial Sequence
  Description of Artificial Sequence: Synthetic oligonucleotide
agccgtcttcccagcccaccatcc

SEQ ID NO: 359458 - DNA, 34 bp, Artificial Sequence; identical to SEQ ID NO: 234335
  Description of Artificial Sequence: Synthetic oligonucleotide

SEQ ID NO: 359459 - DNA, 23 bp, Artificial Sequence
  Description of Artificial Sequence: Synthetic oligonucleotide
gccgtcttcccagcccaccatcc

SEQ ID NO: 359460 - DNA, 33 bp, Artificial Sequence; identical to SEQ ID NO: 234336
  Description of Artificial Sequence: Synthetic oligonucleotide

SEQ ID NO: 359461 - DNA, 23 bp, Artificial Sequence
  Description of Artificial Sequence: Synthetic oligonucleotide
ccgtcttcccagcccaccatccc

SEQ ID NO: 359462 - DNA, 34 bp, Artificial Sequence; identical to SEQ ID NO: 234337
  Description of Artificial Sequence: Synthetic oligonucleotide

SEQ ID NO: 359463 - DNA, 25 bp, Artificial Sequence
  Description of Artificial Sequence: Synthetic oligonucleotide
cgtcttcccagcccaccatccccat

SEQ ID NO: 359464 - DNA, 33 bp, Artificial Sequence; identical to SEQ ID NO: 234338
  Description of Artificial Sequence: Synthetic oligonucleotide

SEQ ID NO: 359465 - DNA, 30 bp, Artificial Sequence; identical to SEQ ID NO: 3693
  Description of Artificial Sequence: Synthetic oligonucleotide

SEQ ID NO: 359466 - DNA, 34 bp, Artificial Sequence; identical to SEQ ID NO: 234339
  Description of Artificial Sequence: Synthetic oligonucleotide

SEQ ID NO: 359467 - DNA, 29 bp, Artificial Sequence
  Description of Artificial Sequence: Synthetic oligonucleotide
gggcatcattgctggcctggttctctttg

SEQ ID NO: 359468 - DNA, 34 bp, Artificial Sequence; identical to SEQ ID NO: 234340
  Description of Artificial Sequence: Synthetic oligonucleotide

SEQ ID NO: 359469 - DNA, 29 bp, Artificial Sequence
  Description of Artificial Sequence: Synthetic oligonucleotide
ggcatcattgctggcctggttctctttgg

SEQ ID NO: 359470 - DNA, 33 bp, Artificial Sequence; identical to SEQ ID NO: 234341
  Description of Artificial Sequence: Synthetic oligonucleotide

SEQ ID NO: 359471 - DNA, 30 bp, Artificial Sequence; identical to SEQ ID NO: 3696
  Description of Artificial Sequence: Synthetic oligonucleotide

SEQ ID NO: 359472 - DNA, 33 bp, Artificial Sequence; identical to SEQ ID NO: 234342
  Description of Artificial Sequence: Synthetic oligonucleotide

SEQ ID NO: 359473 - DNA, 30 bp, Artificial Sequence; identical to SEQ ID NO: 3697
  Description of Artificial Sequence: Synthetic oligonucleotide

SEQ ID NO: 359474 - DNA, 32 bp, Artificial Sequence; identical to SEQ ID NO: 234343
  Description of Artificial Sequence: Synthetic oligonucleotide

SEQ ID NO: 359475 - DNA, 31 bp, Artificial Sequence; identical to SEQ ID NO: 3698
  Description of Artificial Sequence: Synthetic oligonucleotide

SEQ ID NO: 359476 - DNA, 31 bp, Artificial Sequence; identical to SEQ ID NO: 234344
  Description of Artificial Sequence: Synthetic oligonucleotide

SEQ ID NO: 359477 - DNA, 30 bp, Artificial Sequence; identical to SEQ ID NO: 3699
  Description of Artificial Sequence: Synthetic oligonucleotide

SEQ ID NO: 359478 - DNA, 31 bp, Artificial Sequence; identical to SEQ ID NO: 234345
  Description of Artificial Sequence: Synthetic oligonucleotide

SEQ ID NO: 359479 - DNA, 29 bp, Artificial Sequence
  Description of Artificial Sequence: Synthetic oligonucleotide
cattgctggcctggttctctttggagctg

SEQ ID NO: 359480 - DNA, 30 bp, Artificial Sequence; identical to SEQ ID NO: 234346
  Description of Artificial Sequence: Synthetic oligonucleotide

SEQ ID NO: 359481 - DNA, 30 bp, Artificial Sequence; identical to SEQ ID NO: 3701
  Description of Artificial Sequence: Synthetic oligonucleotide

SEQ ID NO: 359482 - DNA, 30 bp, Artificial Sequence; identical to SEQ ID NO: 234347
  Description of Artificial Sequence: Synthetic oligonucleotide

SEQ ID NO: 359483 - DNA, 29 bp, Artificial Sequence
  Description of Artificial Sequence: Synthetic oligonucleotide
ttgctggcctggttctctttggagctgtg

SEQ ID NO: 359484 - DNA, 29 bp, Artificial Sequence
  Description of Artificial Sequence: Synthetic oligonucleotide
tttttgactgcaacgtggagcacaggggc

SEQ ID NO: 359485 - DNA, 28 bp, Artificial Sequence
  Description of Artificial Sequence: Synthetic oligonucleotide
tgctggcctggttctctttggagctgtg

SEQ ID NO: 359486 - DNA, 28 bp, Artificial Sequence
  Description of Artificial Sequence: Synthetic oligonucleotide
ttttgactgcaacgtggagcacaggggc

SEQ ID NO: 359487 - DNA, 27 bp, Artificial Sequence
  Description of Artificial Sequence: Synthetic oligonucleotide
gctggcctggttctctttggagctgtg

SEQ ID NO: 359488 - DNA, 27 bp, Artificial Sequence
  Description of Artificial Sequence: Synthetic oligonucleotide
tttgactgcaacgtggagcacaggggc

SEQ ID NO: 359489 - DNA, 29 bp, Artificial Sequence
  Description of Artificial Sequence: Synthetic oligonucleotide
ctggcctggttctctttggagctgtgatc

SEQ ID NO: 359490 - DNA, 26 bp, Artificial Sequence
  Description of Artificial Sequence: Synthetic oligonucleotide
ttgactgcaacgtggagcacaggggc

SEQ ID NO: 359491 - DNA, 30 bp, Artificial Sequence; identical to SEQ ID NO: 3706
  Description of Artificial Sequence: Synthetic oligonucleotide

SEQ ID NO: 359492 - DNA, 25 bp, Artificial Sequence
  Description of Artificial Sequence: Synthetic oligonucleotide
tgactgcaacgtggagcacaggggc

SEQ ID NO: 359493 - DNA, 29 bp, Artificial Sequence
  Description of Artificial Sequence: Synthetic oligonucleotide
ggcctggttctctttggagctgtgatcac

SEQ ID NO: 359494 - DNA, 24 bp, Artificial Sequence
  Description of Artificial Sequence: Synthetic oligonucleotide
gactgcaacgtggagcacaggggc

SEQ ID NO: 359495 - DNA, 30 bp, Artificial Sequence; identical to SEQ ID NO: 3708
  Description of Artificial Sequence: Synthetic oligonucleotide

SEQ ID NO: 359496 - DNA, 25 bp, Artificial Sequence
  Description of Artificial Sequence: Synthetic oligonucleotide
actgcaacgtggagcacaggggcct

SEQ ID NO: 359497 - DNA, 30 bp, Artificial Sequence; identical to SEQ ID NO: 3709
  Description of Artificial Sequence: Synthetic oligonucleotide

SEQ ID NO: 359498 - DNA, 24 bp, Artificial Sequence
  Description of Artificial Sequence: Synthetic oligonucleotide
ctgcaacgtggagcacaggggcct

SEQ ID NO: 359499 - DNA, 31 bp, Artificial Sequence; identical to SEQ ID NO: 3710
  Description of Artificial Sequence: Synthetic oligonucleotide

SEQ ID NO: 359500 - DNA, 24 bp, Artificial Sequence
  Description of Artificial Sequence: Synthetic oligonucleotide
tgcaacgtggagcacaggggcctg

SEQ ID NO: 359501 - DNA, 31 bp, Artificial Sequence; identical to SEQ ID NO: 3711
  Description of Artificial Sequence: Synthetic oligonucleotide

SEQ ID NO: 359502 - DNA, 23 bp, Artificial Sequence
  Description of Artificial Sequence: Synthetic oligonucleotide
gcaacgtggagcacaggggcctg

SEQ ID NO: 359503 - DNA, 30 bp, Artificial Sequence; identical to SEQ ID NO: 3712
  Description of Artificial Sequence: Synthetic oligonucleotide

SEQ ID NO: 359504 - DNA, 24 bp, Artificial Sequence
  Description of Artificial Sequence: Synthetic oligonucleotide
caacgtggagcacaggggcctggt

SEQ ID NO: 359505 - DNA, 31 bp, Artificial Sequence; identical to SEQ ID NO: 3713
  Description of Artificial Sequence: Synthetic oligonucleotide

SEQ ID NO: 359506 - DNA, 24 bp, Artificial Sequence
  Description of Artificial Sequence: Synthetic oligonucleotide
aacgtggagcacaggggcctggtc

SEQ ID NO: 359507 - DNA, 32 bp, Artificial Sequence; identical to SEQ ID NO: 3714
  Description of Artificial Sequence: Synthetic oligonucleotide

SEQ ID NO: 359508 - DNA, 23 bp, Artificial Sequence
  Description of Artificial Sequence: Synthetic oligonucleotide
acgtggagcacaggggcctggtc

SEQ ID NO: 359509 - DNA, 31 bp, Artificial Sequence; identical to SEQ ID NO: 3715
  Description of Artificial Sequence: Synthetic oligonucleotide

SEQ ID NO: 359510 - DNA, 22 bp, Artificial Sequence
  Description of Artificial Sequence: Synthetic oligonucleotide
cgtggagcacaggggcctggtc

SEQ ID NO: 359511 - DNA, 30 bp, Artificial Sequence; identical to SEQ ID NO: 3716
  Description of Artificial Sequence: Synthetic oligonucleotide

SEQ ID NO: 359512 - DNA, 23 bp, Artificial Sequence
  Description of Artificial Sequence: Synthetic oligonucleotide
gtggagcacaggggcctggtcca

SEQ ID NO: 359513 - DNA, 30 bp, Artificial Sequence; identical to SEQ ID NO: 3717
  Description of Artificial Sequence: Synthetic oligonucleotide

SEQ ID NO: 359514 - DNA, 23 bp, Artificial Sequence
  Description of Artificial Sequence: Synthetic oligonucleotide
tggagcacaggggcctggtccag

SEQ ID NO: 359515 - DNA, 29 bp, Artificial Sequence
  Description of Artificial Sequence: Synthetic oligonucleotide
ctttggagctgtgatcactggagctgtgg

SEQ ID NO: 359516 - DNA, 22 bp, Artificial Sequence
  Description of Artificial Sequence: Synthetic oligonucleotide
ggagcacaggggcctggtccag

SEQ ID NO: 359517 - DNA, 30 bp, Artificial Sequence; identical to SEQ ID NO: 3719
  Description of Artificial Sequence: Synthetic oligonucleotide

SEQ ID NO: 359518 - DNA, 22 bp, Artificial Sequence
  Description of Artificial Sequence: Synthetic oligonucleotide
gagcacaggggcctggtccagc

SEQ ID NO: 359519 - DNA, 31 bp, Artificial Sequence; identical to SEQ ID NO: 3720
  Description of Artificial Sequence: Synthetic oligonucleotide

SEQ ID NO: 359520 - DNA, 23 bp, Artificial Sequence
  Description of Artificial Sequence: Synthetic oligonucleotide
agcacaggggcctggtccagcct

SEQ ID NO: 359521 - DNA, 33 bp, Artificial Sequence; identical to SEQ ID NO: 3721
  Description of Artificial Sequence: Synthetic oligonucleotide

SEQ ID NO: 359522 - DNA, 22 bp, Artificial Sequence
  Description of Artificial Sequence: Synthetic oligonucleotide
gcacaggggcctggtccagcct

SEQ ID NO: 359523 - DNA, 32 bp, Artificial Sequence; identical to SEQ ID NO: 3722
  Description of Artificial Sequence: Synthetic oligonucleotide

SEQ ID NO: 359524 - DNA, 24 bp, Artificial Sequence
  Description of Artificial Sequence: Synthetic oligonucleotide
cacaggggcctggtccagcctcta

SEQ ID NO: 359525 - DNA, 33 bp, Artificial Sequence; identical to SEQ ID NO: 3723
  Description of Artificial Sequence: Synthetic oligonucleotide

SEQ ID NO: 359526 - DNA, 25 bp, Artificial Sequence
  Description of Artificial Sequence: Synthetic oligonucleotide
acaggggcctggtccagcctctact

SEQ ID NO: 359527 - DNA, 34 bp, Artificial Sequence; identical to SEQ ID NO: 3724
  Description of Artificial Sequence: Synthetic oligonucleotide

SEQ ID NO: 359528 - DNA, 24 bp, Artificial Sequence
  Description of Artificial Sequence: Synthetic oligonucleotide
caggggcctggtccagcctctact

SEQ ID NO: 359529 - DNA, 33 bp, Artificial Sequence; identical to SEQ ID NO: 3725
  Description of Artificial Sequence: Synthetic oligonucleotide

SEQ ID NO: 359530 - DNA, 27 bp, Artificial Sequence
  Description of Artificial Sequence: Synthetic oligonucleotide
aggggcctggtccagcctctactgaaa

SEQ ID NO: 359531 - DNA, 32 bp, Artificial Sequence; identical to SEQ ID NO: 3726
  Description of Artificial Sequence: Synthetic oligonucleotide

SEQ ID NO: 359532 - DNA, 26 bp, Artificial Sequence
  Description of Artificial Sequence: Synthetic oligonucleotide
ggggcctggtccagcctctactgaaa

SEQ ID NO: 359533 - DNA, 33 bp, Artificial Sequence; identical to SEQ ID NO: 3727
  Description of Artificial Sequence: Synthetic oligonucleotide

SEQ ID NO: 359534 - DNA, 27 bp, Artificial Sequence
  Description of Artificial Sequence: Synthetic oligonucleotide
gggcctggtccagcctctactgaaaca

SEQ ID NO: 359535 - DNA, 32 bp, Artificial Sequence; identical to SEQ ID NO: 3728
  Description of Artificial Sequence: Synthetic oligonucleotide

SEQ ID NO: 359536 - DNA, 27 bp, Artificial Sequence
  Description of Artificial Sequence: Synthetic oligonucleotide
ggcctggtccagcctctactgaaacac

SEQ ID NO: 359537 - DNA, 32 bp, Artificial Sequence; identical to SEQ ID NO: 3729
  Description of Artificial Sequence: Synthetic oligonucleotide

SEQ ID NO: 359538 - DNA, 28 bp, Artificial Sequence
  Description of Artificial Sequence: Synthetic oligonucleotide
gcctggtccagcctctactgaaacacag

SEQ ID NO: 359539 - DNA, 32 bp, Artificial Sequence; identical to SEQ ID NO: 3730
  Description of Artificial Sequence: Synthetic oligonucleotide

SEQ ID NO: 359540 - DNA, 28 bp, Artificial Sequence
  Description of Artificial Sequence: Synthetic oligonucleotide
cctggtccagcctctactgaaacacagg

SEQ ID NO: 359541 - DNA, 31 bp, Artificial Sequence; identical to SEQ ID NO: 3731
  Description of Artificial Sequence: Synthetic oligonucleotide

SEQ ID NO: 359542 - DNA, 28 bp, Artificial Sequence
  Description of Artificial Sequence: Synthetic oligonucleotide
ctggtccagcctctactgaaacacaggg

SEQ ID NO: 359543 - DNA, 32 bp, Artificial Sequence; identical to SEQ ID NO: 3732
  Description of Artificial Sequence: Synthetic oligonucleotide

SEQ ID NO: 359544 - DNA, 29 bp, Artificial Sequence
  Description of Artificial Sequence: Synthetic oligonucleotide
tggtccagcctctactgaaacacagggag

SEQ ID NO: 359545 - DNA, 31 bp, Artificial Sequence; identical to SEQ ID NO: 3733
  Description of Artificial Sequence: Synthetic oligonucleotide

SEQ ID NO: 359546 - DNA, 28 bp, Artificial Sequence
  Description of Artificial Sequence: Synthetic oligonucleotide
ggtccagcctctactgaaacacagggag

SEQ ID NO: 359547 - DNA, 31 bp, Artificial Sequence; identical to SEQ ID NO: 3734
  Description of Artificial Sequence: Synthetic oligonucleotide

SEQ ID NO: 359548 - DNA, 28 bp, Artificial Sequence
  Description of Artificial Sequence: Synthetic oligonucleotide
gtccagcctctactgaaacacagggagc

SEQ ID NO: 359549 - DNA, 30 bp, Artificial Sequence; identical to SEQ ID NO: 3735
  Description of Artificial Sequence: Synthetic oligonucleotide

SEQ ID NO: 359550 - DNA, 28 bp, Artificial Sequence
  Description of Artificial Sequence: Synthetic oligonucleotide
tccagcctctactgaaacacagggagcc

SEQ ID NO: 359551 - DNA, 29 bp, Artificial Sequence
  Description of Artificial Sequence: Synthetic oligonucleotide
agaaaaggagggagctactctcaggctgc

SEQ ID NO: 359552 - DNA, 27 bp, Artificial Sequence
  Description of Artificial Sequence: Synthetic oligonucleotide
ccagcctctactgaaacacagggagcc

SEQ ID NO: 359553 - DNA, 28 bp, Artificial Sequence
  Description of Artificial Sequence: Synthetic oligonucleotide
gaaaaggagggagctactctcaggctgc

SEQ ID NO: 359554 - DNA, 28 bp, Artificial Sequence
  Description of Artificial Sequence: Synthetic oligonucleotide
cagcctctactgaaacacagggagcctg

SEQ ID NO: 359555 - DNA, 30 bp, Artificial Sequence; identical to SEQ ID NO: 3738
  Description of Artificial Sequence: Synthetic oligonucleotide

SEQ ID NO: 359556 - DNA, 29 bp, Artificial Sequence
  Description of Artificial Sequence: Synthetic oligonucleotide
agcctctactgaaacacagggagcctgtg

SEQ ID NO: 359557 - DNA, 29 bp, Artificial Sequence
  Description of Artificial Sequence: Synthetic oligonucleotide
aaaggagggagctactctcaggctgcaag

SEQ ID NO: 359558 - DNA, 28 bp, Artificial Sequence
  Description of Artificial Sequence: Synthetic oligonucleotide
gcctctactgaaacacagggagcctgtg

SEQ ID NO: 359559 - DNA, 28 bp, Artificial Sequence
  Description of Artificial Sequence: Synthetic oligonucleotide
aaggagggagctactctcaggctgcaag

SEQ ID NO: 359560 - DNA, 31 bp, Artificial Sequence; identical to SEQ ID NO: 234386
  Description of Artificial Sequence: Synthetic oligonucleotide

SEQ ID NO: 359561 - DNA, 27 bp, Artificial Sequence
  Description of Artificial Sequence: Synthetic oligonucleotide
aggagggagctactctcaggctgcaag

SEQ ID NO: 359562 - DNA, 31 bp, Artificial Sequence; identical to SEQ ID NO: 234387
  Description of Artificial Sequence: Synthetic oligonucleotide

SEQ ID NO: 359563 - DNA, 26 bp, Artificial Sequence
  Description of Artificial Sequence: Synthetic oligonucleotide
ggagggagctactctcaggctgcaag

SEQ ID NO: 359564 - DNA, 32 bp, Artificial Sequence; identical to SEQ ID NO: 234388
  Description of Artificial Sequence: Synthetic oligonucleotide

SEQ ID NO: 359565 - DNA, 27 bp, Artificial Sequence
  Description of Artificial Sequence: Synthetic oligonucleotide
gagggagctactctcaggctgcaagca

SEQ ID NO: 359566 - DNA, 31 bp, Artificial Sequence; identical to SEQ ID NO: 234389
  Description of Artificial Sequence: Synthetic oligonucleotide

SEQ ID NO: 359567 - DNA, 27 bp, Artificial Sequence
  Description of Artificial Sequence: Synthetic oligonucleotide
agggagctactctcaggctgcaagcag

SEQ ID NO: 359568 - DNA, 31 bp, Artificial Sequence; identical to SEQ ID NO: 234390
  Description of Artificial Sequence: Synthetic oligonucleotide

SEQ ID NO: 359569 - DNA, 27 bp, Artificial Sequence
  Description of Artificial Sequence: Synthetic oligonucleotide
gggagctactctcaggctgcaagcagt

SEQ ID NO: 359570 - DNA, 30 bp, Artificial Sequence; identical to SEQ ID NO: 234391
  Description of Artificial Sequence: Synthetic oligonucleotide

SEQ ID NO: 359571 - DNA, 27 bp, Artificial Sequence
  Description of Artificial Sequence: Synthetic oligonucleotide
ggagctactctcaggctgcaagcagtg

SEQ ID NO: 359572 - DNA, 29 bp, Artificial Sequence
  Description of Artificial Sequence: Synthetic oligonucleotide
ctgaaacacagggagcctgtgattccagg

SEQ ID NO: 359573 - DNA, 28 bp, Artificial Sequence
  Description of Artificial Sequence: Synthetic oligonucleotide
gagctactctcaggctgcaagcagtgac

SEQ ID NO: 359574 - DNA, 29 bp, Artificial Sequence
  Description of Artificial Sequence: Synthetic oligonucleotide
tgaaacacagggagcctgtgattccaggc

SEQ ID NO: 359575 - DNA, 29 bp, Artificial Sequence
  Description of Artificial Sequence: Synthetic oligonucleotide
agctactctcaggctgcaagcagtgacag

SEQ ID NO: 359576 - DNA, 28 bp, Artificial Sequence
  Description of Artificial Sequence: Synthetic oligonucleotide
gaaacacagggagcctgtgattccaggc

SEQ ID NO: 359577 - DNA, 28 bp, Artificial Sequence
  Description of Artificial Sequence: Synthetic oligonucleotide
gctactctcaggctgcaagcagtgacag

SEQ ID NO: 359578 - DNA, 28 bp, Artificial Sequence
  Description of Artificial Sequence: Synthetic oligonucleotide
aaacacagggagcctgtgattccaggcc

SEQ ID NO: 359579 - DNA, 29 bp, Artificial Sequence
  Description of Artificial Sequence: Synthetic oligonucleotide
ctactctcaggctgcaagcagtgacagtg

SEQ ID NO: 359580 - DNA, 27 bp, Artificial Sequence
  Description of Artificial Sequence: Synthetic oligonucleotide
aacacagggagcctgtgattccaggcc

SEQ ID NO: 359581 - DNA, 29 bp, Artificial Sequence
  Description of Artificial Sequence: Synthetic oligonucleotide
tactctcaggctgcaagcagtgacagtgc

SEQ ID NO: 359582 - DNA, 26 bp, Artificial Sequence
  Description of Artificial Sequence: Synthetic oligonucleotide
acacagggagcctgtgattccaggcc

SEQ ID NO: 359583 - DNA, 28 bp, Artificial Sequence
  Description of Artificial Sequence: Synthetic oligonucleotide
actctcaggctgcaagcagtgacagtgc

SEQ ID NO: 359584 - DNA, 25 bp, Artificial Sequence
  Description of Artificial Sequence: Synthetic oligonucleotide
cacagggagcctgtgattccaggcc

SEQ ID NO: 359585 - DNA, 27 bp, Artificial Sequence
  Description of Artificial Sequence: Synthetic oligonucleotide
ctctcaggctgcaagcagtgacagtgc

SEQ ID NO: 359586 - DNA, 27 bp, Artificial Sequence
  Description of Artificial Sequence: Synthetic oligonucleotide
acagggagcctgtgattccaggcccta

SEQ ID NO: 359587 - DNA, 27 bp, Artificial Sequence
  Description of Artificial Sequence: Synthetic oligonucleotide
tctcaggctgcaagcagtgacagtgcc

SEQ ID NO: 359588 - DNA, 27 bp, Artificial Sequence
  Description of Artificial Sequence: Synthetic oligonucleotide
cagggagcctgtgattccaggccctat

SEQ ID NO: 359589 - DNA, 30 bp, Artificial Sequence; identical to SEQ ID NO: 3755
  Description of Artificial Sequence: Synthetic oligonucleotide

SEQ ID NO: 359590 - DNA, 27 bp, Artificial Sequence
  Description of Artificial Sequence: Synthetic oligonucleotide
agggagcctgtgattccaggccctatg

SEQ ID NO: 359591 - DNA, 30 bp, Artificial Sequence; identical to SEQ ID NO: 3756
  Description of Artificial Sequence: Synthetic oligonucleotide

SEQ ID NO: 359592 - DNA, 27 bp, Artificial Sequence
  Description of Artificial Sequence: Synthetic oligonucleotide
gggagcctgtgattccaggccctatgt

SEQ ID NO: 359593 - DNA, 31 bp, Artificial Sequence; identical to SEQ ID NO: 3757
  Description of Artificial Sequence: Synthetic oligonucleotide

SEQ ID NO: 359594 - DNA, 27 bp, Artificial Sequence
  Description of Artificial Sequence: Synthetic oligonucleotide
ggagcctgtgattccaggccctatgtc

SEQ ID NO: 359595 - DNA, 30 bp, Artificial Sequence; identical to SEQ ID NO: 3758
  Description of Artificial Sequence: Synthetic oligonucleotide

SEQ ID NO: 359596 - DNA, 28 bp, Artificial Sequence
  Description of Artificial Sequence: Synthetic oligonucleotide
gagcctgtgattccaggccctatgtcac

SEQ ID NO: 359597 - DNA, 29 bp, Artificial Sequence
  Description of Artificial Sequence: Synthetic oligonucleotide
agtgaaggcccactcacagactcatcgag

SEQ ID NO: 359598 - DNA, 29 bp, Artificial Sequence
  Description of Artificial Sequence: Synthetic oligonucleotide
agcctgtgattccaggccctatgtcacag

SEQ ID NO: 359599 - DNA, 28 bp, Artificial Sequence
  Description of Artificial Sequence: Synthetic oligonucleotide
gtgaaggcccactcacagactcatcgag

SEQ ID NO: 359600 - DNA, 28 bp, Artificial Sequence
  Description of Artificial Sequence: Synthetic oligonucleotide
gcctgtgattccaggccctatgtcacag

SEQ ID NO: 359601 - DNA, 29 bp, Artificial Sequence
  Description of Artificial Sequence: Synthetic oligonucleotide
tgaaggcccactcacagactcatcgagtg

SEQ ID NO: 359602 - DNA, 28 bp, Artificial Sequence
  Description of Artificial Sequence: Synthetic oligonucleotide
cctgtgattccaggccctatgtcacagc

SEQ ID NO: 359603 - DNA, 28 bp, Artificial Sequence
  Description of Artificial Sequence: Synthetic oligonucleotide
gaaggcccactcacagactcatcgagtg

SEQ ID NO: 359604 - DNA, 29 bp, Artificial Sequence
  Description of Artificial Sequence: Synthetic oligonucleotide
ctgtgattccaggccctatgtcacagctc

SEQ ID NO: 359605 - DNA, 28 bp, Artificial Sequence
  Description of Artificial Sequence: Synthetic oligonucleotide
aaggcccactcacagactcatcgagtgg

SEQ ID NO: 359606 - DNA, 30 bp, Artificial Sequence; identical to SEQ ID NO: 234409
  Description of Artificial Sequence: Synthetic oligonucleotide

SEQ ID NO: 359607 - DNA, 27 bp, Artificial Sequence
  Description of Artificial Sequence: Synthetic oligonucleotide
aggcccactcacagactcatcgagtgg

SEQ ID NO: 359608 - DNA, 29 bp, Artificial Sequence
  Description of Artificial Sequence: Synthetic oligonucleotide
gtgattccaggccctatgtcacagctcac

SEQ ID NO: 359609 - DNA, 27 bp, Artificial Sequence
  Description of Artificial Sequence: Synthetic oligonucleotide
ggcccactcacagactcatcgagtgga

SEQ ID NO: 359610 - DNA, 30 bp, Artificial Sequence; identical to SEQ ID NO: 234411
  Description of Artificial Sequence: Synthetic oligonucleotide

SEQ ID NO: 359611 - DNA, 27 bp, Artificial Sequence
  Description of Artificial Sequence: Synthetic oligonucleotide
gcccactcacagactcatcgagtggac

SEQ ID NO: 359612 - DNA, 29 bp, Artificial Sequence
  Description of Artificial Sequence: Synthetic oligonucleotide
gattccaggccctatgtcacagctcacag

SEQ ID NO: 359613 - DNA, 27 bp, Artificial Sequence
  Description of Artificial Sequence: Synthetic oligonucleotide
cccactcacagactcatcgagtggacc

SEQ ID NO: 359614 - DNA, 30 bp, Artificial Sequence; identical to SEQ ID NO: 234413
  Description of Artificial Sequence: Synthetic oligonucleotide

SEQ ID NO: 359615 - DNA, 28 bp, Artificial Sequence
  Description of Artificial Sequence: Synthetic oligonucleotide
ccactcacagactcatcgagtggacctg

SEQ ID NO: 359616 - DNA, 29 bp, Artificial Sequence
  Description of Artificial Sequence: Synthetic oligonucleotide
ttccaggccctatgtcacagctcacagtg

SEQ ID NO: 359617 - DNA, 28 bp, Artificial Sequence
  Description of Artificial Sequence: Synthetic oligonucleotide
cactcacagactcatcgagtggacctgg

SEQ ID NO: 359618 - DNA, 28 bp, Artificial Sequence
  Description of Artificial Sequence: Synthetic oligonucleotide
tccaggccctatgtcacagctcacagtg

SEQ ID NO: 359619 - DNA, 28 bp, Artificial Sequence
  Description of Artificial Sequence: Synthetic oligonucleotide
actcacagactcatcgagtggacctggg

SEQ ID NO: 359620 - DNA, 27 bp, Artificial Sequence
  Description of Artificial Sequence: Synthetic oligonucleotide
ccaggccctatgtcacagctcacagtg

SEQ ID NO: 359621 - DNA, 27 bp, Artificial Sequence
  Description of Artificial Sequence: Synthetic oligonucleotide
ctcacagactcatcgagtggacctggg

SEQ ID NO: 359622 - DNA, 28 bp, Artificial Sequence
  Description of Artificial Sequence: Synthetic oligonucleotide
caggccctatgtcacagctcacagtgac

SEQ ID NO: 359623 - DNA, 27 bp, Artificial Sequence
  Description of Artificial Sequence: Synthetic oligonucleotide
tcacagactcatcgagtggacctgggg

SEQ ID NO: 359624 - DNA, 29 bp, Artificial Sequence
  Description of Artificial Sequence: Synthetic oligonucleotide
aggccctatgtcacagctcacagtgactg

SEQ ID NO: 359625 - DNA, 27 bp, Artificial Sequence
  Description of Artificial Sequence: Synthetic oligonucleotide
cacagactcatcgagtggacctgggga

SEQ ID NO: 359626 - DNA, 28 bp, Artificial Sequence
  Description of Artificial Sequence: Synthetic oligonucleotide
ggccctatgtcacagctcacagtgactg

SEQ ID NO: 359627 - DNA, 27 bp, Artificial Sequence
  Description of Artificial Sequence: Synthetic oligonucleotide
acagactcatcgagtggacctggggac

SEQ ID NO: 359628 - DNA, 29 bp, Artificial Sequence
  Description of Artificial Sequence: Synthetic oligonucleotide
gccctatgtcacagctcacagtgactgtg

SEQ ID NO: 359629 - DNA, 26 bp, Artificial Sequence
  Description of Artificial Sequence: Synthetic oligonucleotide
cagactcatcgagtggacctggggac

SEQ ID NO: 359630 - DNA, 29 bp, Artificial Sequence
  Description of Artificial Sequence: Synthetic oligonucleotide
ccctatgtcacagctcacagtgactgtgg

SEQ ID NO: 359631 - DNA, 26 bp, Artificial Sequence
  Description of Artificial Sequence: Synthetic oligonucleotide
agactcatcgagtggacctggggacc

SEQ ID NO: 359632 - DNA, 30 bp, Artificial Sequence; identical to SEQ ID NO: 234422
  Description of Artificial Sequence: Synthetic oligonucleotide

SEQ ID NO: 359633 - DNA, 25 bp, Artificial Sequence
  Description of Artificial Sequence: Synthetic oligonucleotide
gactcatcgagtggacctggggacc

SEQ ID NO: 359634 - DNA, 31 bp, Artificial Sequence; identical to SEQ ID NO: 234423
  Description of Artificial Sequence: Synthetic oligonucleotide

SEQ ID NO: 359635 - DNA, 26 bp, Artificial Sequence
  Description of Artificial Sequence: Synthetic oligonucleotide
actcatcgagtggacctggggaccct

SEQ ID NO: 359636 - DNA, 31 bp, Artificial Sequence; identical to SEQ ID NO: 234424
  Description of Artificial Sequence: Synthetic oligonucleotide

SEQ ID NO: 359637 - DNA, 25 bp, Artificial Sequence
  Description of Artificial Sequence: Synthetic oligonucleotide
ctcatcgagtggacctggggaccct

SEQ ID NO: 359638 - DNA, 30 bp, Artificial Sequence; identical to SEQ ID NO: 234425
  Description of Artificial Sequence: Synthetic oligonucleotide

SEQ ID NO: 359639 - DNA, 25 bp, Artificial Sequence
  Description of Artificial Sequence: Synthetic oligonucleotide
tcatcgagtggacctggggaccctg

SEQ ID NO: 359640 - DNA, 29 bp, Artificial Sequence
  Description of Artificial Sequence: Synthetic oligonucleotide
tgtcacagctcacagtgactgtggtgtgc

SEQ ID NO: 359641 - DNA, 24 bp, Artificial Sequence
  Description of Artificial Sequence: Synthetic oligonucleotide
catcgagtggacctggggaccctg

SEQ ID NO: 359642 - DNA, 28 bp, Artificial Sequence
  Description of Artificial Sequence: Synthetic oligonucleotide
gtcacagctcacagtgactgtggtgtgc

SEQ ID NO: 359643 - DNA, 24 bp, Artificial Sequence
  Description of Artificial Sequence: Synthetic oligonucleotide
atcgagtggacctggggaccctgc

SEQ ID NO: 359644 - DNA, 28 bp, Artificial Sequence
  Description of Artificial Sequence: Synthetic oligonucleotide
tcacagctcacagtgactgtggtgtgcg

SEQ ID NO: 359645 - DNA, 23 bp, Artificial Sequence
  Description of Artificial Sequence: Synthetic oligonucleotide
tcgagtggacctggggaccctgc

SEQ ID NO: 359646 - DNA, 27 bp, Artificial Sequence
  Description of Artificial Sequence: Synthetic oligonucleotide
cacagctcacagtgactgtggtgtgcg

SEQ ID NO: 359647 - DNA, 27 bp, Artificial Sequence
  Description of Artificial Sequence: Synthetic oligonucleotide
aaagaggacctgcgctcttggaccgca

SEQ ID NO: 359648 - DNA, 27 bp, Artificial Sequence
  Description of Artificial Sequence: Synthetic oligonucleotide
acagctcacagtgactgtggtgtgcgc

SEQ ID NO: 359649 - DNA, 26 bp, Artificial Sequence
  Description of Artificial Sequence: Synthetic oligonucleotide
aagaggacctgcgctcttggaccgca

SEQ ID NO: 359650 - DNA, 26 bp, Artificial Sequence
  Description of Artificial Sequence: Synthetic oligonucleotide
cagctcacagtgactgtggtgtgcgc

SEQ ID NO: 359651 - DNA, 25 bp, Artificial Sequence
  Description of Artificial Sequence: Synthetic oligonucleotide
agaggacctgcgctcttggaccgca

SEQ ID NO: 359652 - DNA, 26 bp, Artificial Sequence
  Description of Artificial Sequence: Synthetic oligonucleotide
agctcacagtgactgtggtgtgcgcc

SEQ ID NO: 359653 - DNA, 25 bp, Artificial Sequence
  Description of Artificial Sequence: Synthetic oligonucleotide
accgcagcggacatggcagctcaga

SEQ ID NO: 359654 - DNA, 25 bp, Artificial Sequence
  Description of Artificial Sequence: Synthetic oligonucleotide
gctcacagtgactgtggtgtgcgcc

SEQ ID NO: 359655 - DNA, 24 bp, Artificial Sequence
  Description of Artificial Sequence: Synthetic oligonucleotide
ccgcagcggacatggcagctcaga

SEQ ID NO: 359656 - DNA, 26 bp, Artificial Sequence
  Description of Artificial Sequence: Synthetic oligonucleotide
ctcacagtgactgtggtgtgcgccct

SEQ ID NO: 359657 - DNA, 24 bp, Artificial Sequence
  Description of Artificial Sequence: Synthetic oligonucleotide
cgcagcggacatggcagctcagac

SEQ ID NO: 359658 - DNA, 26 bp, Artificial Sequence
  Description of Artificial Sequence: Synthetic oligonucleotide
tcacagtgactgtggtgtgcgccctg

SEQ ID NO: 359659 - DNA, 25 bp, Artificial Sequence
  Description of Artificial Sequence: Synthetic oligonucleotide
gcagcggacatggcagctcagacca

SEQ ID NO: 359660 - DNA, 25 bp, Artificial Sequence
  Description of Artificial Sequence: Synthetic oligonucleotide
cacagtgactgtggtgtgcgccctg

SEQ ID NO: 359661 - DNA, 25 bp, Artificial Sequence
  Description of Artificial Sequence: Synthetic oligonucleotide
cagcggacatggcagctcagaccac

SEQ ID NO: 359662 - DNA, 25 bp, Artificial Sequence
  Description of Artificial Sequence: Synthetic oligonucleotide
acagtgactgtggtgtgcgccctgc

SEQ ID NO: 359663 - DNA, 27 bp, Artificial Sequence
  Description of Artificial Sequence: Synthetic oligonucleotide
agcggacatggcagctcagaccaccaa

SEQ ID NO: 359664 - DNA, 24 bp, Artificial Sequence
  Description of Artificial Sequence: Synthetic oligonucleotide
cagtgactgtggtgtgcgccctgc

SEQ ID NO: 359665 - DNA, 31 bp, Artificial Sequence; identical to SEQ ID NO: 3793
  Description of Artificial Sequence: Synthetic oligonucleotide

SEQ ID NO: 359666 - DNA, 24 bp, Artificial Sequence
  Description of Artificial Sequence: Synthetic oligonucleotide
agtgactgtggtgtgcgccctgcg

SEQ ID NO: 359667 - DNA, 32 bp, Artificial Sequence; identical to SEQ ID NO: 3794
  Description of Artificial Sequence: Synthetic oligonucleotide

SEQ ID NO: 359668 - DNA, 23 bp, Artificial Sequence
  Description of Artificial Sequence: Synthetic oligonucleotide
gtgactgtggtgtgcgccctgcg

SEQ ID NO: 359669 - DNA, 31 bp, Artificial Sequence; identical to SEQ ID NO: 3795
  Description of Artificial Sequence: Synthetic oligonucleotide

SEQ ID NO: 359670 - DNA, 25 bp, Artificial Sequence
  Description of Artificial Sequence: Synthetic oligonucleotide
tgactgtggtgtgcgccctgcggtt

SEQ ID NO: 359671 - DNA, 31 bp, Artificial Sequence; identical to SEQ ID NO: 3796
  Description of Artificial Sequence: Synthetic oligonucleotide

SEQ ID NO: 359672 - DNA, 24 bp, Artificial Sequence
  Description of Artificial Sequence: Synthetic oligonucleotide
gactgtggtgtgcgccctgcggtt

SEQ ID NO: 359673 - DNA, 32 bp, Artificial Sequence; identical to SEQ ID NO: 3797
  Description of Artificial Sequence: Synthetic oligonucleotide

SEQ ID NO: 359674 - DNA, 25 bp, Artificial Sequence
  Description of Artificial Sequence: Synthetic oligonucleotide
actgtggtgtgcgccctgcggttgt

SEQ ID NO: 359675 - DNA, 32 bp, Artificial Sequence; identical to SEQ ID NO: 3798
  Description of Artificial Sequence: Synthetic oligonucleotide

SEQ ID NO: 359676 - DNA, 24 bp, Artificial Sequence
  Description of Artificial Sequence: Synthetic oligonucleotide
ctgtggtgtgcgccctgcggttgt

SEQ ID NO: 359677 - DNA, 32 bp, Artificial Sequence; identical to SEQ ID NO: 3799
  Description of Artificial Sequence: Synthetic oligonucleotide

SEQ ID NO: 359678 - DNA, 25 bp, Artificial Sequence
  Description of Artificial Sequence: Synthetic oligonucleotide
tgtggtgtgcgccctgcggttgtct

SEQ ID NO: 359679 - DNA, 31 bp, Artificial Sequence; identical to SEQ ID NO: 3800
  Description of Artificial Sequence: Synthetic oligonucleotide

SEQ ID NO: 359680 - DNA, 24 bp, Artificial Sequence
  Description of Artificial Sequence: Synthetic oligonucleotide
gtggtgtgcgccctgcggttgtct

SEQ ID NO: 359681 - DNA, 30 bp, Artificial Sequence; identical to SEQ ID NO: 3801
  Description of Artificial Sequence: Synthetic oligonucleotide

SEQ ID NO: 359682 - DNA, 25 bp, Artificial Sequence
  Description of Artificial Sequence: Synthetic oligonucleotide
tggtgtgcgccctgcggttgtctga

SEQ ID NO: 359683 - DNA, 30 bp, Artificial Sequence; identical to SEQ ID NO: 3802
  Description of Artificial Sequence: Synthetic oligonucleotide

SEQ ID NO: 359684 - DNA, 24 bp, Artificial Sequence
  Description of Artificial Sequence: Synthetic oligonucleotide
ggtgtgcgccctgcggttgtctga

SEQ ID NO: 359685 - DNA, 31 bp, Artificial Sequence; identical to SEQ ID NO: 3803
  Description of Artificial Sequence: Synthetic oligonucleotide

SEQ ID NO: 359686 - DNA, 24 bp, Artificial Sequence
  Description of Artificial Sequence: Synthetic oligonucleotide
gtgtgcgccctgcggttgtctgag

SEQ ID NO: 359687 - DNA, 30 bp, Artificial Sequence; identical to SEQ ID NO: 3804
  Description of Artificial Sequence: Synthetic oligonucleotide

SEQ ID NO: 359688 - DNA, 24 bp, Artificial Sequence
  Description of Artificial Sequence: Synthetic oligonucleotide
tgtgcgccctgcggttgtctgagg

SEQ ID NO: 359689 - DNA, 29 bp, Artificial Sequence
  Description of Artificial Sequence: Synthetic oligonucleotide
tacatcgccctgaaagaagacctgcgctc

SEQ ID NO: 359690 - DNA, 23 bp, Artificial Sequence
  Description of Artificial Sequence: Synthetic oligonucleotide
gtgcgccctgcggttgtctgagg

SEQ ID NO: 359691 - DNA, 28 bp, Artificial Sequence
  Description of Artificial Sequence: Synthetic oligonucleotide
acatcgccctgaaagaagacctgcgctc

SEQ ID NO: 359692 - DNA, 23 bp, Artificial Sequence
  Description of Artificial Sequence: Synthetic oligonucleotide
tgcgccctgcggttgtctgaggg

SEQ ID NO: 359693 - DNA, 27 bp, Artificial Sequence
  Description of Artificial Sequence: Synthetic oligonucleotide
catcgccctgaaagaagacctgcgctc

SEQ ID NO: 359694 - DNA, 22 bp, Artificial Sequence
  Description of Artificial Sequence: Synthetic oligonucleotide
gcgccctgcggttgtctgaggg

SEQ ID NO: 359695 - DNA, 29 bp, Artificial Sequence
  Description of Artificial Sequence: Synthetic oligonucleotide
atcgccctgaaagaagacctgcgctcttg

SEQ ID NO: 359696 - DNA, 22 bp, Artificial Sequence
  Description of Artificial Sequence: Synthetic oligonucleotide
cgccctgcggttgtctgagggc

SEQ ID NO: 359697 - DNA, 28 bp, Artificial Sequence
  Description of Artificial Sequence: Synthetic oligonucleotide
tcgccctgaaagaagacctgcgctcttg

SEQ ID NO: 359698 - DNA, 23 bp, Artificial Sequence
  Description of Artificial Sequence: Synthetic oligonucleotide
gccctgcggttgtctgagggcct

SEQ ID NO: 359699 - DNA, 27 bp, Artificial Sequence
  Description of Artificial Sequence: Synthetic oligonucleotide
cgccctgaaagaagacctgcgctcttg

SEQ ID NO: 359700 - DNA, 23 bp, Artificial Sequence
  Description of Artificial Sequence: Synthetic oligonucleotide
ccctgcggttgtctgagggcctc

SEQ ID NO: 359701 - DNA, 27 bp, Artificial Sequence
  Description of Artificial Sequence: Synthetic oligonucleotide
gccctgaaagaagacctgcgctcttgg

SEQ ID NO: 359702 - DNA, 24 bp, Artificial Sequence
  Description of Artificial Sequence: Synthetic oligonucleotide
cctgcggttgtctgagggcctcgt

SEQ ID NO: 359703 - DNA, 28 bp, Artificial Sequence
  Description of Artificial Sequence: Synthetic oligonucleotide
ccctgaaagaagacctgcgctcttggac

SEQ ID NO: 359704 - DNA, 24 bp, Artificial Sequence
  Description of Artificial Sequence: Synthetic oligonucleotide
ctgcggttgtctgagggcctcgtc

SEQ ID NO: 359705 - DNA, 28 bp, Artificial Sequence
  Description of Artificial Sequence: Synthetic oligonucleotide
cctgaaagaagacctgcgctcttggacc

SEQ ID NO: 359706 - DNA, 24 bp, Artificial Sequence
  Description of Artificial Sequence: Synthetic oligonucleotide
tgcggttgtctgagggcctcgtcg

SEQ ID NO: 359707 - DNA, 28 bp, Artificial Sequence
  Description of Artificial Sequence: Synthetic oligonucleotide
ctgaaagaagacctgcgctcttggaccg

SEQ ID NO: 359708 - DNA, 23 bp, Artificial Sequence
  Description of Artificial Sequence: Synthetic oligonucleotide
gcggttgtctgagggcctcgtcg

SEQ ID NO: 359709 - DNA, 28 bp, Artificial Sequence
  Description of Artificial Sequence: Synthetic oligonucleotide
tgaaagaagacctgcgctcttggaccgc

SEQ ID NO: 359710 - DNA, 23 bp, Artificial Sequence
  Description of Artificial Sequence: Synthetic oligonucleotide
cggttgtctgagggcctcgtcgg

SEQ ID NO: 359711 - DNA, 27 bp, Artificial Sequence
  Description of Artificial Sequence: Synthetic oligonucleotide
gaaagaagacctgcgctcttggaccgc

SEQ ID NO: 359712 - DNA, 26 bp, Artificial Sequence
  Description of Artificial Sequence: Synthetic oligonucleotide
ggttgtctgagggcctcgtcggcatt

SEQ ID NO: 359713 - DNA, 27 bp, Artificial Sequence
  Description of Artificial Sequence: Synthetic oligonucleotide
aaagaagacctgcgctcttggaccgcg

SEQ ID NO: 359714 - DNA, 27 bp, Artificial Sequence
  Description of Artificial Sequence: Synthetic oligonucleotide
gttgtctgagggcctcgtcggcattgt

SEQ ID NO: 359715 - DNA, 26 bp, Artificial Sequence
  Description of Artificial Sequence: Synthetic oligonucleotide
aagaagacctgcgctcttggaccgcg

SEQ ID NO: 359716 - DNA, 27 bp, Artificial Sequence
  Description of Artificial Sequence: Synthetic oligonucleotide
ttgtctgagggcctcgtcggcattgtg

SEQ ID NO: 359717 - DNA, 25 bp, Artificial Sequence
  Description of Artificial Sequence: Synthetic oligonucleotide
agaagacctgcgctcttggaccgcg

SEQ ID NO: 359718 - DNA, 26 bp, Artificial Sequence
  Description of Artificial Sequence: Synthetic oligonucleotide
tgtctgagggcctcgtcggcattgtg

SEQ ID NO: 359719 - DNA, 24 bp, Artificial Sequence
  Description of Artificial Sequence: Synthetic oligonucleotide
gaagacctgcgctcttggaccgcg

SEQ ID NO: 359720 - DNA, 25 bp, Artificial Sequence
  Description of Artificial Sequence: Synthetic oligonucleotide
gtctgagggcctcgtcggcattgtg

SEQ ID NO: 359721 - DNA, 24 bp, Artificial Sequence
  Description of Artificial Sequence: Synthetic oligonucleotide
aagacctgcgctcttggaccgcgg

SEQ ID NO: 359722 - DNA, 26 bp, Artificial Sequence
  Description of Artificial Sequence: Synthetic oligonucleotide
tctgagggcctcgtcggcattgtgct

SEQ ID NO: 359723 - DNA, 23 bp, Artificial Sequence
  Description of Artificial Sequence: Synthetic oligonucleotide
agacctgcgctcttggaccgcgg

SEQ ID NO: 359724 - DNA, 25 bp, Artificial Sequence
  Description of Artificial Sequence: Synthetic oligonucleotide
ctgagggcctcgtcggcattgtgct

SEQ ID NO: 359725 - DNA, 24 bp, Artificial Sequence
  Description of Artificial Sequence: Synthetic oligonucleotide
cgacgtggggtcggactggcgatt

SEQ ID NO: 359726 - DNA, 25 bp, Artificial Sequence
  Description of Artificial Sequence: Synthetic oligonucleotide
tgagggcctcgtcggcattgtgctg

SEQ ID NO: 359727 - DNA, 24 bp, Artificial Sequence
  Description of Artificial Sequence: Synthetic oligonucleotide
gacgtggggtcggactggcgattc

SEQ ID NO: 359728 - DNA, 24 bp, Artificial Sequence
  Description of Artificial Sequence: Synthetic oligonucleotide
gagggcctcgtcggcattgtgctg

SEQ ID NO: 359729 - DNA, 25 bp, Artificial Sequence
  Description of Artificial Sequence: Synthetic oligonucleotide
acgtggggtcggactggcgattcct

SEQ ID NO: 359730 - DNA, 24 bp, Artificial Sequence
  Description of Artificial Sequence: Synthetic oligonucleotide
agggcctcgtcggcattgtgctgg

SEQ ID NO: 359731 - DNA, 24 bp, Artificial Sequence
  Description of Artificial Sequence: Synthetic oligonucleotide
cgtggggtcggactggcgattcct

SEQ ID NO: 359732 - DNA, 23 bp, Artificial Sequence
  Description of Artificial Sequence: Synthetic oligonucleotide
gggcctcgtcggcattgtgctgg

SEQ ID NO: 359733 - DNA, 24 bp, Artificial Sequence
  Description of Artificial Sequence: Synthetic oligonucleotide
gtggggtcggactggcgattcctc

SEQ ID NO: 359734 - DNA, 23 bp, Artificial Sequence
  Description of Artificial Sequence: Synthetic oligonucleotide
ggcctcgtcggcattgtgctggg

SEQ ID NO: 359735 - DNA, 24 bp, Artificial Sequence
  Description of Artificial Sequence: Synthetic oligonucleotide
tggggtcggactggcgattcctcc

SEQ ID NO: 359736 - DNA, 24 bp, Artificial Sequence
  Description of Artificial Sequence: Synthetic oligonucleotide
gcctcgtcggcattgtgctgggca

SEQ ID NO: 359737 - DNA, 23 bp, Artificial Sequence
  Description of Artificial Sequence: Synthetic oligonucleotide
ggggtcggactggcgattcctcc

SEQ ID NO: 359738 - DNA, 25 bp, Artificial Sequence
  Description of Artificial Sequence: Synthetic oligonucleotide
cctcgtcggcattgtgctgggcact

SEQ ID NO: 359739 - DNA, 23 bp, Artificial Sequence
  Description of Artificial Sequence: Synthetic oligonucleotide
gggtcggactggcgattcctccg

SEQ ID NO: 359740 - DNA, 26 bp, Artificial Sequence
  Description of Artificial Sequence: Synthetic oligonucleotide
ctcgtcggcattgtgctgggcactga

SEQ ID NO: 359741 - DNA, 23 bp, Artificial Sequence
  Description of Artificial Sequence: Synthetic oligonucleotide
ggtcggactggcgattcctccgc

SEQ ID NO: 359742 - DNA, 27 bp, Artificial Sequence
  Description of Artificial Sequence: Synthetic oligonucleotide
tcgtcggcattgtgctgggcactgact

SEQ ID NO: 359743 - DNA, 23 bp, Artificial Sequence
  Description of Artificial Sequence: Synthetic oligonucleotide
gtcggactggcgattcctccgcg

SEQ ID NO: 359744 - DNA, 27 bp, Artificial Sequence
  Description of Artificial Sequence: Synthetic oligonucleotide
cgtcggcattgtgctgggcactgactt

SEQ ID NO: 359745 - DNA, 23 bp, Artificial Sequence
  Description of Artificial Sequence: Synthetic oligonucleotide
tcggactggcgattcctccgcgg

SEQ ID NO: 359746 - DNA, 27 bp, Artificial Sequence
  Description of Artificial Sequence: Synthetic oligonucleotide
gtcggcattgtgctgggcactgacttc

SEQ ID NO: 359747 - DNA, 22 bp, Artificial Sequence
  Description of Artificial Sequence: Synthetic oligonucleotide
cggactggcgattcctccgcgg

SEQ ID NO: 359748 - DNA, 29 bp, Artificial Sequence
  Description of Artificial Sequence: Synthetic oligonucleotide
tcggcattgtgctgggcactgacttcatc

SEQ ID NO: 359749 - DNA, 24 bp, Artificial Sequence
  Description of Artificial Sequence: Synthetic oligonucleotide
ggactggcgattcctccgcgggta

SEQ ID NO: 359750 - DNA, 28 bp, Artificial Sequence
  Description of Artificial Sequence: Synthetic oligonucleotide
cggcattgtgctgggcactgacttcatc

SEQ ID NO: 359751 - DNA, 24 bp, Artificial Sequence
  Description of Artificial Sequence: Synthetic oligonucleotide
gactggcgattcctccgcgggtac

SEQ ID NO: 359752 - DNA, 30 bp, Artificial Sequence; identical to SEQ ID NO: 234482
  Description of Artificial Sequence: Synthetic oligonucleotide

SEQ ID NO: 359753 - DNA, 25 bp, Artificial Sequence
  Description of Artificial Sequence: Synthetic oligonucleotide
actggcgattcctccgcgggtacca

SEQ ID NO: 359754 - DNA, 30 bp, Artificial Sequence; identical to SEQ ID NO: 234483
  Description of Artificial Sequence: Synthetic oligonucleotide

SEQ ID NO: 359755 - DNA, 24 bp, Artificial Sequence
  Description of Artificial Sequence: Synthetic oligonucleotide
ctggcgattcctccgcgggtacca

SEQ ID NO: 359756 - DNA, 30 bp, Artificial Sequence; identical to SEQ ID NO: 234484
  Description of Artificial Sequence: Synthetic oligonucleotide

SEQ ID NO: 359757 - DNA, 24 bp, Artificial Sequence
  Description of Artificial Sequence: Synthetic oligonucleotide
tggcgattcctccgcgggtaccac

SEQ ID NO: 359758 - DNA, 31 bp, Artificial Sequence; identical to SEQ ID NO: 234485
  Description of Artificial Sequence: Synthetic oligonucleotide

SEQ ID NO: 359759 - DNA, 23 bp, Artificial Sequence
  Description of Artificial Sequence: Synthetic oligonucleotide
ggcgattcctccgcgggtaccac

SEQ ID NO: 359760 - DNA, 30 bp, Artificial Sequence; identical to SEQ ID NO: 234486
  Description of Artificial Sequence: Synthetic oligonucleotide

SEQ ID NO: 359761 - DNA, 24 bp, Artificial Sequence
  Description of Artificial Sequence: Synthetic oligonucleotide
gcgattcctccgcgggtaccacca

SEQ ID NO: 359762 - DNA, 29 bp, Artificial Sequence
  Description of Artificial Sequence: Synthetic oligonucleotide
tgtgctgggcactgacttcatcatgcgag

SEQ ID NO: 359763 - DNA, 26 bp, Artificial Sequence
  Description of Artificial Sequence: Synthetic oligonucleotide
cgattcctccgcgggtaccaccagta

SEQ ID NO: 359764 - DNA, 28 bp, Artificial Sequence
  Description of Artificial Sequence: Synthetic oligonucleotide
gtgctgggcactgacttcatcatgcgag

SEQ ID NO: 359765 - DNA, 26 bp, Artificial Sequence
  Description of Artificial Sequence: Synthetic oligonucleotide
gattcctccgcgggtaccaccagtac

SEQ ID NO: 359766 - DNA, 28 bp, Artificial Sequence
  Description of Artificial Sequence: Synthetic oligonucleotide
tgctgggcactgacttcatcatgcgagg

SEQ ID NO: 359767 - DNA, 26 bp, Artificial Sequence
  Description of Artificial Sequence: Synthetic oligonucleotide
attcctccgcgggtaccaccagtacg

SEQ ID NO: 359768 - DNA, 27 bp, Artificial Sequence
  Description of Artificial Sequence: Synthetic oligonucleotide
gctgggcactgacttcatcatgcgagg

SEQ ID NO: 359769 - DNA, 20 bp, Artificial Sequence
  Description of Artificial Sequence: Synthetic oligonucleotide
gtgtcccggcccggccgtgt

SEQ ID NO: 359770 - DNA, 27 bp, Artificial Sequence
  Description of Artificial Sequence: Synthetic oligonucleotide
ctgggcactgacttcatcatgcgaggc

SEQ ID NO: 359771 - DNA, 20 bp, Artificial Sequence
  Description of Artificial Sequence: Synthetic oligonucleotide
tgtcccggcccggccgtggt

SEQ ID NO: 359772 - DNA, 27 bp, Artificial Sequence
  Description of Artificial Sequence: Synthetic oligonucleotide
tgggcactgacttcatcatgcgaggcc

SEQ ID NO: 359773 - DNA, 20 bp, Artificial Sequence
  Description of Artificial Sequence: Synthetic oligonucleotide
gtcccggcccggccgtggtt

SEQ ID NO: 359774 - DNA, 27 bp, Artificial Sequence
  Description of Artificial Sequence: Synthetic oligonucleotide
gggcactgacttcatcatgcgaggcct

SEQ ID NO: 359775 - DNA, 20 bp, Artificial Sequence
  Description of Artificial Sequence: Synthetic oligonucleotide
tcccggcccggccgtgggtt

SEQ ID NO: 359776 - DNA, 27 bp, Artificial Sequence
  Description of Artificial Sequence: Synthetic oligonucleotide
ggcactgacttcatcatgcgaggcctg

SEQ ID NO: 359777 - DNA, 20 bp, Artificial Sequence
  Description of Artificial Sequence: Synthetic oligonucleotide
cccggcccggccgtgggttt

SEQ ID NO: 359778 - DNA, 27 bp, Artificial Sequence
  Description of Artificial Sequence: Synthetic oligonucleotide
gcactgacttcatcatgcgaggcctgg

SEQ ID NO: 359779 - DNA, 20 bp, Artificial Sequence
  Description of Artificial Sequence: Synthetic oligonucleotide
ccggcccggccgtggggatt

SEQ ID NO: 359780 - DNA, 27 bp, Artificial Sequence
  Description of Artificial Sequence: Synthetic oligonucleotide
cactgacttcatcatgcgaggcctggg

SEQ ID NO: 359781 - DNA, 20 bp, Artificial Sequence
  Description of Artificial Sequence: Synthetic oligonucleotide
cggcccggccgtggggagtt

SEQ ID NO: 359782 - DNA, 29 bp, Artificial Sequence
  Description of Artificial Sequence: Synthetic oligonucleotide
actgacttcatcatgcgaggcctgggttc

SEQ ID NO: 359783 - DNA, 20 bp, Artificial Sequence
  Description of Artificial Sequence: Synthetic oligonucleotide
ggcccggccgtggggagctt

SEQ ID NO: 359784 - DNA, 28 bp, Artificial Sequence
  Description of Artificial Sequence: Synthetic oligonucleotide
ctgacttcatcatgcgaggcctgggttc

SEQ ID NO: 359785 - DNA, 20 bp, Artificial Sequence
  Description of Artificial Sequence: Synthetic oligonucleotide
gcccggccgtggggagcctt

SEQ ID NO: 359786 - DNA, 29 bp, Artificial Sequence
  Description of Artificial Sequence: Synthetic oligonucleotide
tgacttcatcatgcgaggcctgggttcag

SEQ ID NO: 359787 - DNA, 20 bp, Artificial Sequence
  Description of Artificial Sequence: Synthetic oligonucleotide
cccggccgtggggagccctt

SEQ ID NO: 359788 - DNA, 28 bp, Artificial Sequence
  Description of Artificial Sequence: Synthetic oligonucleotide
gacttcatcatgcgaggcctgggttcag

SEQ ID NO: 359789 - DNA, 20 bp, Artificial Sequence
  Description of Artificial Sequence: Synthetic oligonucleotide
ccggccgtggggagcccctt

SEQ ID NO: 359790 - DNA, 30 bp, Artificial Sequence; identical to SEQ ID NO: 234501
  Description of Artificial Sequence: Synthetic oligonucleotide

SEQ ID NO: 359791 - DNA, 20 bp, Artificial Sequence
  Description of Artificial Sequence: Synthetic oligonucleotide
cggccgtggggagccccgtt

SEQ ID NO: 359792 - DNA, 29 bp, Artificial Sequence
  Description of Artificial Sequence: Synthetic oligonucleotide
cttcatcatgcgaggcctgggttcagttg

SEQ ID NO: 359793 - DNA, 20 bp, Artificial Sequence
  Description of Artificial Sequence: Synthetic oligonucleotide
ggccgtggggagccccgctt

SEQ ID NO: 359794 - DNA, 29 bp, Artificial Sequence
  Description of Artificial Sequence: Synthetic oligonucleotide
ttcatcatgcgaggcctgggttcagttgc

SEQ ID NO: 359795 - DNA, 22 bp, Artificial Sequence
  Description of Artificial Sequence: Synthetic oligonucleotide
gccgtggggagccccgcttcat

SEQ ID NO: 359796 - DNA, 28 bp, Artificial Sequence
  Description of Artificial Sequence: Synthetic oligonucleotide
tcatcatgcgaggcctgggttcagttgc

SEQ ID NO: 359797 - DNA, 22 bp, Artificial Sequence
  Description of Artificial Sequence: Synthetic oligonucleotide
ccgtggggagccccgcttcatc

SEQ ID NO: 359798 - DNA, 27 bp, Artificial Sequence
  Description of Artificial Sequence: Synthetic oligonucleotide
catcatgcgaggcctgggttcagttgc

SEQ ID NO: 359799 - DNA, 22 bp, Artificial Sequence
  Description of Artificial Sequence: Synthetic oligonucleotide
cgtggggagccccgcttcatcg

SEQ ID NO: 359800 - DNA, 28 bp, Artificial Sequence
  Description of Artificial Sequence: Synthetic oligonucleotide
atcatgcgaggcctgggttcagttgctg

SEQ ID NO: 359801 - DNA, 23 bp, Artificial Sequence
  Description of Artificial Sequence: Synthetic oligonucleotide
gtggggagccccgcttcatcgca

SEQ ID NO: 359802 - DNA, 27 bp, Artificial Sequence
  Description of Artificial Sequence: Synthetic oligonucleotide
tcatgcgaggcctgggttcagttgctg

SEQ ID NO: 359803 - DNA, 24 bp, Artificial Sequence
  Description of Artificial Sequence: Synthetic oligonucleotide
tggggagccccgcttcatcgcagt

SEQ ID NO: 359804 - DNA, 26 bp, Artificial Sequence
  Description of Artificial Sequence: Synthetic oligonucleotide
catgcgaggcctgggttcagttgctg

SEQ ID NO: 359805 - DNA, 26 bp, Artificial Sequence
  Description of Artificial Sequence: Synthetic oligonucleotide
atggggaggaccagacccaggacaca

SEQ ID NO: 359806 - DNA, 27 bp, Artificial Sequence
  Description of Artificial Sequence: Synthetic oligonucleotide
atgcgaggcctgggttcagttgctgct

SEQ ID NO: 359807 - DNA, 25 bp, Artificial Sequence
  Description of Artificial Sequence: Synthetic oligonucleotide
tggggaggaccagacccaggacaca

SEQ ID NO: 359808 - DNA, 27 bp, Artificial Sequence
  Description of Artificial Sequence: Synthetic oligonucleotide
tgcgaggcctgggttcagttgctgctt

SEQ ID NO: 359809 - DNA, 24 bp, Artificial Sequence
  Description of Artificial Sequence: Synthetic oligonucleotide
ggggaggaccagacccaggacaca

SEQ ID NO: 359810 - DNA, 26 bp, Artificial Sequence
  Description of Artificial Sequence: Synthetic oligonucleotide
gcgaggcctgggttcagttgctgctt

SEQ ID NO: 359811 - DNA, 25 bp, Artificial Sequence
  Description of Artificial Sequence: Synthetic oligonucleotide
gggaggaccagacccaggacacaga

SEQ ID NO: 359812 - DNA, 26 bp, Artificial Sequence
  Description of Artificial Sequence: Synthetic oligonucleotide
cgaggcctgggttcagttgctgcttc

SEQ ID NO: 359813 - DNA, 25 bp, Artificial Sequence
  Description of Artificial Sequence: Synthetic oligonucleotide
ggaggaccagacccaggacacagag

SEQ ID NO: 359814 - DNA, 27 bp, Artificial Sequence
  Description of Artificial Sequence: Synthetic oligonucleotide
gaggcctgggttcagttgctgcttcca

SEQ ID NO: 359815 - DNA, 26 bp, Artificial Sequence
  Description of Artificial Sequence: Synthetic oligonucleotide
gaggaccagacccaggacacagagct

SEQ ID NO: 359816 - DNA, 27 bp, Artificial Sequence
  Description of Artificial Sequence: Synthetic oligonucleotide
aggcctgggttcagttgctgcttccag

SEQ ID NO: 359817 - DNA, 26 bp, Artificial Sequence
  Description of Artificial Sequence: Synthetic oligonucleotide
aggaccagacccaggacacagagctc

SEQ ID NO: 359818 - DNA, 27 bp, Artificial Sequence
  Description of Artificial Sequence: Synthetic oligonucleotide
ggcctgggttcagttgctgcttccagt

SEQ ID NO: 359819 - DNA, 25 bp, Artificial Sequence
  Description of Artificial Sequence: Synthetic oligonucleotide
ggaccagacccaggacacagagctc

SEQ ID NO: 359820 - DNA, 27 bp, Artificial Sequence
  Description of Artificial Sequence: Synthetic oligonucleotide
gcctgggttcagttgctgcttccagtc

SEQ ID NO: 359821 - DNA, 26 bp, Artificial Sequence
  Description of Artificial Sequence: Synthetic oligonucleotide
gaccagacccaggacacagagctcgt

SEQ ID NO: 359822 - DNA, 28 bp, Artificial Sequence
  Description of Artificial Sequence: Synthetic oligonucleotide
cctgggttcagttgctgcttccagtcac

SEQ ID NO: 359823 - DNA, 26 bp, Artificial Sequence
  Description of Artificial Sequence: Synthetic oligonucleotide
accagacccaggacacagagctcgtg

SEQ ID NO: 359824 - DNA, 28 bp, Artificial Sequence
  Description of Artificial Sequence: Synthetic oligonucleotide
ctgggttcagttgctgcttccagtcacc

SEQ ID NO: 359825 - DNA, 25 bp, Artificial Sequence
  Description of Artificial Sequence: Synthetic oligonucleotide
ccagacccaggacacagagctcgtg

SEQ ID NO: 359826 - DNA, 30 bp, Artificial Sequence; identical to SEQ ID NO: 234519
  Description of Artificial Sequence: Synthetic oligonucleotide

SEQ ID NO: 359827 - DNA, 26 bp, Artificial Sequence
  Description of Artificial Sequence: Synthetic oligonucleotide
cagacccaggacacagagctcgtgga

SEQ ID NO: 359828 - DNA, 29 bp, Artificial Sequence
  Description of Artificial Sequence: Synthetic oligonucleotide
gggttcagttgctgcttccagtcaccaag

SEQ ID NO: 359829 - DNA, 27 bp, Artificial Sequence
  Description of Artificial Sequence: Synthetic oligonucleotide
agacccaggacacagagctcgtggaga

SEQ ID NO: 359830 - DNA, 29 bp, Artificial Sequence
  Description of Artificial Sequence: Synthetic oligonucleotide
ggttcagttgctgcttccagtcaccaagg

SEQ ID NO: 359831 - DNA, 26 bp, Artificial Sequence
  Description of Artificial Sequence: Synthetic oligonucleotide
gacccaggacacagagctcgtggaga

SEQ ID NO: 359832 - DNA, 29 bp, Artificial Sequence
  Description of Artificial Sequence: Synthetic oligonucleotide
gttcagttgctgcttccagtcaccaaggg

SEQ ID NO: 359833 - DNA, 26 bp, Artificial Sequence
  Description of Artificial Sequence: Synthetic oligonucleotide
acccaggacacagagctcgtggagac

SEQ ID NO: 359834 - DNA, 29 bp, Artificial Sequence
  Description of Artificial Sequence: Synthetic oligonucleotide
ttcagttgctgcttccagtcaccaagggg

SEQ ID NO: 359835 - DNA, 25 bp, Artificial Sequence
  Description of Artificial Sequence: Synthetic oligonucleotide
cccaggacacagagctcgtggagac

SEQ ID NO: 359836 - DNA, 28 bp, Artificial Sequence
  Description of Artificial Sequence: Synthetic oligonucleotide
tcagttgctgcttccagtcaccaagggg

SEQ ID NO: 359837 - DNA, 26 bp, Artificial Sequence
  Description of Artificial Sequence: Synthetic oligonucleotide
ccaggacacagagctcgtggagacca

SEQ ID NO: 359838 - DNA, 27 bp, Artificial Sequence
  Description of Artificial Sequence: Synthetic oligonucleotide
cagttgctgcttccagtcaccaagggg

SEQ ID NO: 359839 - DNA, 26 bp, Artificial Sequence
  Description of Artificial Sequence: Synthetic oligonucleotide
caggacacagagctcgtggagaccag

SEQ ID NO: 359840 - DNA, 27 bp, Artificial Sequence
  Description of Artificial Sequence: Synthetic oligonucleotide
agttgctgcttccagtcaccaaggggc

SEQ ID NO: 359841 - DNA, 26 bp, Artificial Sequence
  Description of Artificial Sequence: Synthetic oligonucleotide
aggacacagagctcgtggagaccagg

SEQ ID NO: 359842 - DNA, 26 bp, Artificial Sequence
  Description of Artificial Sequence: Synthetic oligonucleotide
gttgctgcttccagtcaccaaggggc

SEQ ID NO: 359843 - DNA, 25 bp, Artificial Sequence
  Description of Artificial Sequence: Synthetic oligonucleotide
ggacacagagctcgtggagaccagg

SEQ ID NO: 359844 - DNA, 27 bp, Artificial Sequence
  Description of Artificial Sequence: Synthetic oligonucleotide
ttgctgcttccagtcaccaaggggcct

SEQ ID NO: 359845 - DNA, 25 bp, Artificial Sequence
  Description of Artificial Sequence: Synthetic oligonucleotide
gacacagagctcgtggagaccaggc

SEQ ID NO: 359846 - DNA, 27 bp, Artificial Sequence
  Description of Artificial Sequence: Synthetic oligonucleotide
tgctgcttccagtcaccaaggggcctt

SEQ ID NO: 359847 - DNA, 26 bp, Artificial Sequence
  Description of Artificial Sequence: Synthetic oligonucleotide
acacagagctcgtggagaccaggcct

SEQ ID NO: 359848 - DNA, 26 bp, Artificial Sequence
  Description of Artificial Sequence: Synthetic oligonucleotide
gctgcttccagtcaccaaggggcctt

SEQ ID NO: 359849 - DNA, 25 bp, Artificial Sequence
  Description of Artificial Sequence: Synthetic oligonucleotide
cacagagctcgtggagaccaggcct

SEQ ID NO: 359850 - DNA, 27 bp, Artificial Sequence
  Description of Artificial Sequence: Synthetic oligonucleotide
ctgcttccagtcaccaaggggccttgt

SEQ ID NO: 359851 - DNA, 25 bp, Artificial Sequence
  Description of Artificial Sequence: Synthetic oligonucleotide
acagagctcgtggagaccaggcctg

SEQ ID NO: 359852 - DNA, 27 bp, Artificial Sequence
  Description of Artificial Sequence: Synthetic oligonucleotide
tgcttccagtcaccaaggggccttgtg

SEQ ID NO: 359853 - DNA, 24 bp, Artificial Sequence
  Description of Artificial Sequence: Synthetic oligonucleotide
cagagctcgtggagaccaggcctg

SEQ ID NO: 359854 - DNA, 27 bp, Artificial Sequence
  Description of Artificial Sequence: Synthetic oligonucleotide
gcttccagtcaccaaggggccttgtga

SEQ ID NO: 359855 - DNA, 25 bp, Artificial Sequence
  Description of Artificial Sequence: Synthetic oligonucleotide
agagctcgtggagaccaggcctgca

SEQ ID NO: 359856 - DNA, 30 bp, Artificial Sequence; identical to SEQ ID NO: 234534
  Description of Artificial Sequence: Synthetic oligonucleotide

SEQ ID NO: 359857 - DNA, 25 bp, Artificial Sequence
  Description of Artificial Sequence: Synthetic oligonucleotide
gctactacaaccagagcgaggccgg

SEQ ID NO: 359858 - DNA, 29 bp, Artificial Sequence
  Description of Artificial Sequence: Synthetic oligonucleotide
tgtcttggtagaaggcttagcggatccgc

SEQ ID NO: 359859 - DNA, 26 bp, Artificial Sequence
  Description of Artificial Sequence: Synthetic oligonucleotide
ctactacaaccagagcgaggccgggt

SEQ ID NO: 359860 - DNA, 28 bp, Artificial Sequence
  Description of Artificial Sequence: Synthetic oligonucleotide
gtcttggtagaaggcttagcggatccgc

SEQ ID NO: 359861 - DNA, 27 bp, Artificial Sequence
  Description of Artificial Sequence: Synthetic oligonucleotide
tactacaaccagagcgaggccgggtct

SEQ ID NO: 359862 - DNA, 28 bp, Artificial Sequence
  Description of Artificial Sequence: Synthetic oligonucleotide
tcttggtagaaggcttagcggatccgcg

SEQ ID NO: 359863 - DNA, 26 bp, Artificial Sequence
  Description of Artificial Sequence: Synthetic oligonucleotide
actacaaccagagcgaggccgggtct

SEQ ID NO: 359864 - DNA, 27 bp, Artificial Sequence
  Description of Artificial Sequence: Synthetic oligonucleotide
cttggtagaaggcttagcggatccgcg

SEQ ID NO: 359865 - DNA, 25 bp, Artificial Sequence
  Description of Artificial Sequence: Synthetic oligonucleotide
ctacaaccagagcgaggccgggtct

SEQ ID NO: 359866 - DNA, 27 bp, Artificial Sequence
  Description of Artificial Sequence: Synthetic oligonucleotide
ttggtagaaggcttagcggatccgcgg

SEQ ID NO: 359867 - DNA, 26 bp, Artificial Sequence
  Description of Artificial Sequence: Synthetic oligonucleotide
tacaaccagagcgaggccgggtctca

SEQ ID NO: 359868 - DNA, 27 bp, Artificial Sequence
  Description of Artificial Sequence: Synthetic oligonucleotide
tggtagaaggcttagcggatccgcgga

SEQ ID NO: 359869 - DNA, 25 bp, Artificial Sequence
  Description of Artificial Sequence: Synthetic oligonucleotide
acaaccagagcgaggccgggtctca

SEQ ID NO: 359870 - DNA, 26 bp, Artificial Sequence
  Description of Artificial Sequence: Synthetic oligonucleotide
ggtagaaggcttagcggatccgcgga

SEQ ID NO: 359871 - DNA, 24 bp, Artificial Sequence
  Description of Artificial Sequence: Synthetic oligonucleotide
caaccagagcgaggccgggtctca

SEQ ID NO: 359872 - DNA, 27 bp, Artificial Sequence
  Description of Artificial Sequence: Synthetic oligonucleotide
gtagaaggcttagcggatccgcggaga

SEQ ID NO: 359873 - DNA, 25 bp, Artificial Sequence
  Description of Artificial Sequence: Synthetic oligonucleotide
aaccagagcgaggccgggtctcaca

SEQ ID NO: 359874 - DNA, 27 bp, Artificial Sequence
  Description of Artificial Sequence: Synthetic oligonucleotide
tagaaggcttagcggatccgcggagac

SEQ ID NO: 359875 - DNA, 24 bp, Artificial Sequence
  Description of Artificial Sequence: Synthetic oligonucleotide
accagagcgaggccgggtctcaca

SEQ ID NO: 359876 - DNA, 26 bp, Artificial Sequence
  Description of Artificial Sequence: Synthetic oligonucleotide
agaaggcttagcggatccgcggagac

SEQ ID NO: 359877 - DNA, 23 bp, Artificial Sequence
  Description of Artificial Sequence: Synthetic oligonucleotide
ccagagcgaggccgggtctcaca

SEQ ID NO: 359878 - DNA, 25 bp, Artificial Sequence
  Description of Artificial Sequence: Synthetic oligonucleotide
gaaggcttagcggatccgcggagac

SEQ ID NO: 359879 - DNA, 23 bp, Artificial Sequence
  Description of Artificial Sequence: Synthetic oligonucleotide
cagagcgaggccgggtctcacac

SEQ ID NO: 359880 - DNA, 27 bp, Artificial Sequence
  Description of Artificial Sequence: Synthetic oligonucleotide
aaggcttagcggatccgcggagacctt

SEQ ID NO: 359881 - DNA, 23 bp, Artificial Sequence
  Description of Artificial Sequence: Synthetic oligonucleotide
agagcgaggccgggtctcacacc

SEQ ID NO: 359882 - DNA, 26 bp, Artificial Sequence
  Description of Artificial Sequence: Synthetic oligonucleotide
aggcttagcggatccgcggagacctt

SEQ ID NO: 359883 - DNA, 22 bp, Artificial Sequence
  Description of Artificial Sequence: Synthetic oligonucleotide
gagcgaggccgggtctcacacc

SEQ ID NO: 359884 - DNA, 25 bp, Artificial Sequence
  Description of Artificial Sequence: Synthetic oligonucleotide
ggcttagcggatccgcggagacctt

SEQ ID NO: 359885 - DNA, 23 bp, Artificial Sequence
  Description of Artificial Sequence: Synthetic oligonucleotide
agcgaggccgggtctcacaccgt

SEQ ID NO: 359886 - DNA, 25 bp, Artificial Sequence
  Description of Artificial Sequence: Synthetic oligonucleotide
gcttagcggatccgcggagaccttg

SEQ ID NO: 359887 - DNA, 22 bp, Artificial Sequence
  Description of Artificial Sequence: Synthetic oligonucleotide
gcgaggccgggtctcacaccgt

SEQ ID NO: 359888 - DNA, 25 bp, Artificial Sequence
  Description of Artificial Sequence: Synthetic oligonucleotide
cttagcggatccgcggagaccttgg

SEQ ID NO: 359889 - DNA, 22 bp, Artificial Sequence
  Description of Artificial Sequence: Synthetic oligonucleotide
cgaggccgggtctcacaccgtc

SEQ ID NO: 359890 - DNA, 25 bp, Artificial Sequence
  Description of Artificial Sequence: Synthetic oligonucleotide
ttagcggatccgcggagaccttggg

SEQ ID NO: 359891 - DNA, 23 bp, Artificial Sequence
  Description of Artificial Sequence: Synthetic oligonucleotide
gaggccgggtctcacaccgtcca

SEQ ID NO: 359892 - DNA, 24 bp, Artificial Sequence
  Description of Artificial Sequence: Synthetic oligonucleotide
tagcggatccgcggagaccttggg

SEQ ID NO: 359893 - DNA, 24 bp, Artificial Sequence
  Description of Artificial Sequence: Synthetic oligonucleotide
aggccgggtctcacaccgtccaga

SEQ ID NO: 359894 - DNA, 23 bp, Artificial Sequence
  Description of Artificial Sequence: Synthetic oligonucleotide
agcggatccgcggagaccttggg

SEQ ID NO: 359895 - DNA, 23 bp, Artificial Sequence
  Description of Artificial Sequence: Synthetic oligonucleotide
ggccgggtctcacaccgtccaga

SEQ ID NO: 359896 - DNA, 22 bp, Artificial Sequence
  Description of Artificial Sequence: Synthetic oligonucleotide
gcggatccgcggagaccttggg

SEQ ID NO: 359897 - DNA, 23 bp, Artificial Sequence
  Description of Artificial Sequence: Synthetic oligonucleotide
gccgggtctcacaccgtccagag

SEQ ID NO: 359898 - DNA, 24 bp, Artificial Sequence
  Description of Artificial Sequence: Synthetic oligonucleotide
cggatccgcggagaccttggggta

SEQ ID NO: 359899 - DNA, 25 bp, Artificial Sequence
  Description of Artificial Sequence: Synthetic oligonucleotide
ccgggtctcacaccgtccagaggat

SEQ ID NO: 359900 - DNA, 24 bp, Artificial Sequence
  Description of Artificial Sequence: Synthetic oligonucleotide
ggatccgcggagaccttggggtag

SEQ ID NO: 359901 - DNA, 27 bp, Artificial Sequence
  Description of Artificial Sequence: Synthetic oligonucleotide
cgggtctcacaccgtccagaggatgta

SEQ ID NO: 359902 - DNA, 26 bp, Artificial Sequence
  Description of Artificial Sequence: Synthetic oligonucleotide
gatccgcggagaccttggggtagcaa

SEQ ID NO: 359903 - DNA, 28 bp, Artificial Sequence
  Description of Artificial Sequence: Synthetic oligonucleotide
gggtctcacaccgtccagaggatgtatg

SEQ ID NO: 359904 - DNA, 27 bp, Artificial Sequence
  Description of Artificial Sequence: Synthetic oligonucleotide
atccgcggagaccttggggtagcaagt

SEQ ID NO: 359905 - DNA, 28 bp, Artificial Sequence
  Description of Artificial Sequence: Synthetic oligonucleotide
ggtctcacaccgtccagaggatgtatgg

SEQ ID NO: 359906 - DNA, 26 bp, Artificial Sequence
  Description of Artificial Sequence: Synthetic oligonucleotide
tccgcggagaccttggggtagcaagt

SEQ ID NO: 359907 - DNA, 28 bp, Artificial Sequence
  Description of Artificial Sequence: Synthetic oligonucleotide
gtctcacaccgtccagaggatgtatggc

SEQ ID NO: 359908 - DNA, 25 bp, Artificial Sequence
  Description of Artificial Sequence: Synthetic oligonucleotide
ccgcggagaccttggggtagcaagt

SEQ ID NO: 359909 - DNA, 25 bp, Artificial Sequence
  Description of Artificial Sequence: Synthetic oligonucleotide
gaaggagacgctgcagcgcacggat

SEQ ID NO: 359910 - DNA, 26 bp, Artificial Sequence
  Description of Artificial Sequence: Synthetic oligonucleotide
cgcggagaccttggggtagcaagtgt

SEQ ID NO: 359911 - DNA, 25 bp, Artificial Sequence
  Description of Artificial Sequence: Synthetic oligonucleotide
aaggagacgctgcagcgcacggatg

SEQ ID NO: 359912 - DNA, 27 bp, Artificial Sequence
  Description of Artificial Sequence: Synthetic oligonucleotide
gcggagaccttggggtagcaagtgtca

SEQ ID NO: 359913 - DNA, 24 bp, Artificial Sequence
  Description of Artificial Sequence: Synthetic oligonucleotide
aggagacgctgcagcgcacggatg

SEQ ID NO: 359914 - DNA, 27 bp, Artificial Sequence
  Description of Artificial Sequence: Synthetic oligonucleotide
cggagaccttggggtagcaagtgtcac

SEQ ID NO: 359915 - DNA, 23 bp, Artificial Sequence
  Description of Artificial Sequence: Synthetic oligonucleotide
ggagacgctgcagcgcacggatg

SEQ ID NO: 359916 - DNA, 27 bp, Artificial Sequence
  Description of Artificial Sequence: Synthetic oligonucleotide
ggagaccttggggtagcaagtgtcacc

SEQ ID NO: 359917 - DNA, 23 bp, Artificial Sequence
  Description of Artificial Sequence: Synthetic oligonucleotide
gagacgctgcagcgcacggatgc

SEQ ID NO: 359918 - DNA, 29 bp, Artificial Sequence
  Description of Artificial Sequence: Synthetic oligonucleotide
gagaccttggggtagcaagtgtcaccttc

SEQ ID NO: 359919 - DNA, 23 bp, Artificial Sequence
  Description of Artificial Sequence: Synthetic oligonucleotide
agacgctgcagcgcacggatgcc

SEQ ID NO: 359920 - DNA, 31 bp, Artificial Sequence; identical to SEQ ID NO: 234566
  Description of Artificial Sequence: Synthetic oligonucleotide

SEQ ID NO: 359921 - DNA, 22 bp, Artificial Sequence
  Description of Artificial Sequence: Synthetic oligonucleotide
gacgctgcagcgcacggatgcc

SEQ ID NO: 359922 - DNA, 30 bp, Artificial Sequence; identical to SEQ ID NO: 234567
  Description of Artificial Sequence: Synthetic oligonucleotide

SEQ ID NO: 359923 - DNA, 22 bp, Artificial Sequence
  Description of Artificial Sequence: Synthetic oligonucleotide
acgctgcagcgcacggatgccc

SEQ ID NO: 359924 - DNA, 30 bp, Artificial Sequence; identical to SEQ ID NO: 234568
  Description of Artificial Sequence: Synthetic oligonucleotide

SEQ ID NO: 359925 - DNA, 21 bp, Artificial Sequence
  Description of Artificial Sequence: Synthetic oligonucleotide
cgctgcagcgcacggatgccc

SEQ ID NO: 359926 - DNA, 29 bp, Artificial Sequence
  Description of Artificial Sequence: Synthetic oligonucleotide
ccttggggtagcaagtgtcaccttcatgc

SEQ ID NO: 359927 - DNA, 21 bp, Artificial Sequence
  Description of Artificial Sequence: Synthetic oligonucleotide
gctgcagcgcacggatgcccc

SEQ ID NO: 359928 - DNA, 30 bp, Artificial Sequence; identical to SEQ ID NO: 234570
  Description of Artificial Sequence: Synthetic oligonucleotide

SEQ ID NO: 359929 - DNA, 25 bp, Artificial Sequence
  Description of Artificial Sequence: Synthetic oligonucleotide
ctgcagcgcacggatgcccccaaaa

SEQ ID NO: 359930 - DNA, 30 bp, Artificial Sequence; identical to SEQ ID NO: 234571
  Description of Artificial Sequence: Synthetic oligonucleotide

SEQ ID NO: 359931 - DNA, 25 bp, Artificial Sequence
  Description of Artificial Sequence: Synthetic oligonucleotide
tgcagcgcacggatgcccccaaaac

SEQ ID NO: 359932 - DNA, 29 bp, Artificial Sequence
  Description of Artificial Sequence: Synthetic oligonucleotide
tggggtagcaagtgtcaccttcatgctgg

SEQ ID NO: 359933 - DNA, 24 bp, Artificial Sequence
  Description of Artificial Sequence: Synthetic oligonucleotide
gcagcgcacggatgcccccaaaac

SEQ ID NO: 359934 - DNA, 28 bp, Artificial Sequence
  Description of Artificial Sequence: Synthetic oligonucleotide
ggggtagcaagtgtcaccttcatgctgg

SEQ ID NO: 359935 - DNA, 24 bp, Artificial Sequence
  Description of Artificial Sequence: Synthetic oligonucleotide
cagcgcacggatgcccccaaaacg

SEQ ID NO: 359936 - DNA, 28 bp, Artificial Sequence
  Description of Artificial Sequence: Synthetic oligonucleotide
gggtagcaagtgtcaccttcatgctggc

SEQ ID NO: 359937 - DNA, 27 bp, Artificial Sequence
  Description of Artificial Sequence: Synthetic oligonucleotide
agcgcacggatgcccccaaaacgcata

SEQ ID NO: 359938 - DNA, 28 bp, Artificial Sequence
  Description of Artificial Sequence: Synthetic oligonucleotide
ggtagcaagtgtcaccttcatgctggcg

SEQ ID NO: 359939 - DNA, 27 bp, Artificial Sequence
  Description of Artificial Sequence: Synthetic oligonucleotide
gcgcacggatgcccccaaaacgcatat

SEQ ID NO: 359940 - DNA, 30 bp, Artificial Sequence; identical to SEQ ID NO: 234576
  Description of Artificial Sequence: Synthetic oligonucleotide

SEQ ID NO: 359941 - DNA, 27 bp, Artificial Sequence
  Description of Artificial Sequence: Synthetic oligonucleotide
cgcacggatgcccccaaaacgcatatg

SEQ ID NO: 359942 - DNA, 30 bp, Artificial Sequence; identical to SEQ ID NO: 234577
  Description of Artificial Sequence: Synthetic oligonucleotide

SEQ ID NO: 359943 - DNA, 28 bp, Artificial Sequence
  Description of Artificial Sequence: Synthetic oligonucleotide
gcacggatgcccccaaaacgcatatgac

SEQ ID NO: 359944 - DNA, 29 bp, Artificial Sequence
  Description of Artificial Sequence: Synthetic oligonucleotide
agcaagtgtcaccttcatgctggcgttgc

SEQ ID NO: 359945 - DNA, 29 bp, Artificial Sequence
  Description of Artificial Sequence: Synthetic oligonucleotide
cacggatgcccccaaaacgcatatgactc

SEQ ID NO: 359946 - DNA, 28 bp, Artificial Sequence
  Description of Artificial Sequence: Synthetic oligonucleotide
gcaagtgtcaccttcatgctggcgttgc

SEQ ID NO: 359947 - DNA, 30 bp, Artificial Sequence; identical to SEQ ID NO: 3934
  Description of Artificial Sequence: Synthetic oligonucleotide

SEQ ID NO: 359948 - DNA, 29 bp, Artificial Sequence
  Description of Artificial Sequence: Synthetic oligonucleotide
caagtgtcaccttcatgctggcgttgctg

SEQ ID NO: 359949 - DNA, 29 bp, Artificial Sequence
  Description of Artificial Sequence: Synthetic oligonucleotide
cggatgcccccaaaacgcatatgactcac

SEQ ID NO: 359950 - DNA, 30 bp, Artificial Sequence; identical to SEQ ID NO: 234581
  Description of Artificial Sequence: Synthetic oligonucleotide

SEQ ID NO: 359951 - DNA, 29 bp, Artificial Sequence
  Description of Artificial Sequence: Synthetic oligonucleotide
ggatgcccccaaaacgcatatgactcacc

SEQ ID NO: 359952 - DNA, 29 bp, Artificial Sequence
  Description of Artificial Sequence: Synthetic oligonucleotide
agtgtcaccttcatgctggcgttgctgag

SEQ ID NO: 359953 - DNA, 30 bp, Artificial Sequence; identical to SEQ ID NO: 3937
  Description of Artificial Sequence: Synthetic oligonucleotide

SEQ ID NO: 359954 - DNA, 28 bp, Artificial Sequence
  Description of Artificial Sequence: Synthetic oligonucleotide
gtgtcaccttcatgctggcgttgctgag

SEQ ID NO: 359955 - DNA, 30 bp, Artificial Sequence; identical to SEQ ID NO: 3938
  Description of Artificial Sequence: Synthetic oligonucleotide

SEQ ID NO: 359956 - DNA, 28 bp, Artificial Sequence
  Description of Artificial Sequence: Synthetic oligonucleotide
tgtcaccttcatgctggcgttgctgagc

SEQ ID NO: 359957 - DNA, 29 bp, Artificial Sequence
  Description of Artificial Sequence: Synthetic oligonucleotide
tgcccccaaaacgcatatgactcaccacg

SEQ ID NO: 359958 - DNA, 27 bp, Artificial Sequence
  Description of Artificial Sequence: Synthetic oligonucleotide
gtcaccttcatgctggcgttgctgagc

SEQ ID NO: 359959 - DNA, 20 bp, Artificial Sequence
  Description of Artificial Sequence: Synthetic oligonucleotide
tcccggcccggccgcggatt

SEQ ID NO: 359960 - DNA, 28 bp, Artificial Sequence
  Description of Artificial Sequence: Synthetic oligonucleotide
tcaccttcatgctggcgttgctgagctg

SEQ ID NO: 359961 - DNA, 20 bp, Artificial Sequence
  Description of Artificial Sequence: Synthetic oligonucleotide
cccggcccggccgcggattt

SEQ ID NO: 359962 - DNA, 27 bp, Artificial Sequence
  Description of Artificial Sequence: Synthetic oligonucleotide
caccttcatgctggcgttgctgagctg

SEQ ID NO: 359963 - DNA, 20 bp, Artificial Sequence
  Description of Artificial Sequence: Synthetic oligonucleotide
ccggcccggccgcggagatt

SEQ ID NO: 359964 - DNA, 27 bp, Artificial Sequence
  Description of Artificial Sequence: Synthetic oligonucleotide
accttcatgctggcgttgctgagctgc

SEQ ID NO: 359965 - DNA, 20 bp, Artificial Sequence
  Description of Artificial Sequence: Synthetic oligonucleotide
cggcccggccgcggagagtt

SEQ ID NO: 359966 - DNA, 26 bp, Artificial Sequence
  Description of Artificial Sequence: Synthetic oligonucleotide
ccttcatgctggcgttgctgagctgc

SEQ ID NO: 359967 - DNA, 20 bp, Artificial Sequence
  Description of Artificial Sequence: Synthetic oligonucleotide
ggcccggccgcggagagctt

SEQ ID NO: 359968 - DNA, 27 bp, Artificial Sequence
  Description of Artificial Sequence: Synthetic oligonucleotide
cttcatgctggcgttgctgagctgcct

SEQ ID NO: 359969 - DNA, 20 bp, Artificial Sequence
  Description of Artificial Sequence: Synthetic oligonucleotide
gcccggccgcggagagcctt

SEQ ID NO: 359970 - DNA, 28 bp, Artificial Sequence
  Description of Artificial Sequence: Synthetic oligonucleotide
ttcatgctggcgttgctgagctgcctac

SEQ ID NO: 359971 - DNA, 20 bp, Artificial Sequence
  Description of Artificial Sequence: Synthetic oligonucleotide
cccggccgcggagagccctt

SEQ ID NO: 359972 - DNA, 27 bp, Artificial Sequence
  Description of Artificial Sequence: Synthetic oligonucleotide
tcatgctggcgttgctgagctgcctac

SEQ ID NO: 359973 - DNA, 20 bp, Artificial Sequence
  Description of Artificial Sequence: Synthetic oligonucleotide
ccggccgcggagagcccctt

SEQ ID NO: 359974 - DNA, 27 bp, Artificial Sequence
  Description of Artificial Sequence: Synthetic oligonucleotide
catgctggcgttgctgagctgcctact

SEQ ID NO: 359975 - DNA, 20 bp, Artificial Sequence
  Description of Artificial Sequence: Synthetic oligonucleotide
cggccgcggagagccccgtt

SEQ ID NO: 359976 - DNA, 27 bp, Artificial Sequence
  Description of Artificial Sequence: Synthetic oligonucleotide
atgctggcgttgctgagctgcctactg

SEQ ID NO: 359977 - DNA, 20 bp, Artificial Sequence
  Description of Artificial Sequence: Synthetic oligonucleotide
ggccgcggagagccccgctt

SEQ ID NO: 359978 - DNA, 26 bp, Artificial Sequence
  Description of Artificial Sequence: Synthetic oligonucleotide
tgctggcgttgctgagctgcctactg

SEQ ID NO: 359979 - DNA, 22 bp, Artificial Sequence
  Description of Artificial Sequence: Synthetic oligonucleotide
gccgcggagagccccgcttcat

SEQ ID NO: 359980 - DNA, 25 bp, Artificial Sequence
  Description of Artificial Sequence: Synthetic oligonucleotide
gctggcgttgctgagctgcctactg

SEQ ID NO: 359981 - DNA, 22 bp, Artificial Sequence
  Description of Artificial Sequence: Synthetic oligonucleotide
ccgcggagagccccgcttcatc

SEQ ID NO: 359982 - DNA, 25 bp, Artificial Sequence
  Description of Artificial Sequence: Synthetic oligonucleotide
ctggcgttgctgagctgcctactgg

SEQ ID NO: 359983 - DNA, 22 bp, Artificial Sequence
  Description of Artificial Sequence: Synthetic oligonucleotide
cgcggagagccccgcttcatcg

SEQ ID NO: 359984 - DNA, 25 bp, Artificial Sequence
  Description of Artificial Sequence: Synthetic oligonucleotide
tggcgttgctgagctgcctactggc

SEQ ID NO: 359985 - DNA, 23 bp, Artificial Sequence
  Description of Artificial Sequence: Synthetic oligonucleotide
gcggagagccccgcttcatcgca

SEQ ID NO: 359986 - DNA, 24 bp, Artificial Sequence
  Description of Artificial Sequence: Synthetic oligonucleotide
ggcgttgctgagctgcctactggc

SEQ ID NO: 359987 - DNA, 24 bp, Artificial Sequence
  Description of Artificial Sequence: Synthetic oligonucleotide
cggagagccccgcttcatcgcagt

SEQ ID NO: 359988 - DNA, 24 bp, Artificial Sequence
  Description of Artificial Sequence: Synthetic oligonucleotide
gcgttgctgagctgcctactggcc

SEQ ID NO: 359989 - DNA, 27 bp, Artificial Sequence
  Description of Artificial Sequence: Synthetic oligonucleotide
agggtccggagtattgggacggggaaa

SEQ ID NO: 359990 - DNA, 25 bp, Artificial Sequence
  Description of Artificial Sequence: Synthetic oligonucleotide
cgttgctgagctgcctactggccga

SEQ ID NO: 359991 - DNA, 26 bp, Artificial Sequence
  Description of Artificial Sequence: Synthetic oligonucleotide
gggtccggagtattgggacggggaaa

SEQ ID NO: 359992 - DNA, 25 bp, Artificial Sequence
  Description of Artificial Sequence: Synthetic oligonucleotide
gttgctgagctgcctactggccgag

SEQ ID NO: 359993 - DNA, 27 bp, Artificial Sequence
  Description of Artificial Sequence: Synthetic oligonucleotide
ggtccggagtattgggacggggaaaca

SEQ ID NO: 359994 - DNA, 25 bp, Artificial Sequence
  Description of Artificial Sequence: Synthetic oligonucleotide
ttgctgagctgcctactggccgagg

SEQ ID NO: 359995 - DNA, 27 bp, Artificial Sequence
  Description of Artificial Sequence: Synthetic oligonucleotide
gtccggagtattgggacggggaaacac

SEQ ID NO: 359996 - DNA, 24 bp, Artificial Sequence
  Description of Artificial Sequence: Synthetic oligonucleotide
tgctgagctgcctactggccgagg

SEQ ID NO: 359997 - DNA, 27 bp, Artificial Sequence
  Description of Artificial Sequence: Synthetic oligonucleotide
tccggagtattgggacggggaaacacg

SEQ ID NO: 359998 - DNA, 23 bp, Artificial Sequence
  Description of Artificial Sequence: Synthetic oligonucleotide
gctgagctgcctactggccgagg

SEQ ID NO: 359999 - DNA, 26 bp, Artificial Sequence
  Description of Artificial Sequence: Synthetic oligonucleotide
ccggagtattgggacggggaaacacg

SEQ ID NO: 360000 - DNA, 23 bp, Artificial Sequence
  Description of Artificial Sequence: Synthetic oligonucleotide
ctgagctgcctactggccgaggg

SEQ ID NO: 360001 - DNA, 27 bp, Artificial Sequence
  Description of Artificial Sequence: Synthetic oligonucleotide
cggagtattgggacggggaaacacgga

SEQ ID NO: 360002 - DNA, 24 bp, Artificial Sequence
  Description of Artificial Sequence: Synthetic oligonucleotide
tgagctgcctactggccgagggca

SEQ ID NO: 360003 - DNA, 29 bp, Artificial Sequence
  Description of Artificial Sequence: Synthetic oligonucleotide
ggagtattgggacggggaaacacggaaag

SEQ ID NO: 360004 - DNA, 23 bp, Artificial Sequence
  Description of Artificial Sequence: Synthetic oligonucleotide
gagctgcctactggccgagggca

SEQ ID NO: 360005 - DNA, 30 bp, Artificial Sequence; identical to SEQ ID NO: 3963
  Description of Artificial Sequence: Synthetic oligonucleotide

SEQ ID NO: 360006 - DNA, 24 bp, Artificial Sequence
  Description of Artificial Sequence: Synthetic oligonucleotide
agctgcctactggccgagggcaga

SEQ ID NO: 360007 - DNA, 32 bp, Artificial Sequence; identical to SEQ ID NO: 3964
  Description of Artificial Sequence: Synthetic oligonucleotide

SEQ ID NO: 360008 - DNA, 23 bp, Artificial Sequence
  Description of Artificial Sequence: Synthetic oligonucleotide
gctgcctactggccgagggcaga

SEQ ID NO: 360009 - DNA, 31 bp, Artificial Sequence; identical to SEQ ID NO: 3965
  Description of Artificial Sequence: Synthetic oligonucleotide

SEQ ID NO: 360010 - DNA, 24 bp, Artificial Sequence
  Description of Artificial Sequence: Synthetic oligonucleotide
ctgcctactggccgagggcagaca

SEQ ID NO: 360011 - DNA, 31 bp, Artificial Sequence; identical to SEQ ID NO: 3966
  Description of Artificial Sequence: Synthetic oligonucleotide

SEQ ID NO: 360012 - DNA, 25 bp, Artificial Sequence
  Description of Artificial Sequence: Synthetic oligonucleotide
tgcctactggccgagggcagacact

SEQ ID NO: 360013 - DNA, 30 bp, Artificial Sequence; identical to SEQ ID NO: 3967
  Description of Artificial Sequence: Synthetic oligonucleotide

SEQ ID NO: 360014 - DNA, 24 bp, Artificial Sequence
  Description of Artificial Sequence: Synthetic oligonucleotide
gcctactggccgagggcagacact

SEQ ID NO: 360015 - DNA, 29 bp, Artificial Sequence
  Description of Artificial Sequence: Synthetic oligonucleotide
ttgggacggggaaacacggaaagtgaagg

SEQ ID NO: 360016 - DNA, 25 bp, Artificial Sequence
  Description of Artificial Sequence: Synthetic oligonucleotide
cctactggccgagggcagacactct

SEQ ID NO: 360017 - DNA, 28 bp, Artificial Sequence
  Description of Artificial Sequence: Synthetic oligonucleotide
tgggacggggaaacacggaaagtgaagg

SEQ ID NO: 360018 - DNA, 25 bp, Artificial Sequence
  Description of Artificial Sequence: Synthetic oligonucleotide
ctactggccgagggcagacactctc

SEQ ID NO: 360019 - DNA, 27 bp, Artificial Sequence
  Description of Artificial Sequence: Synthetic oligonucleotide
gggacggggaaacacggaaagtgaagg

SEQ ID NO: 360020 - DNA, 25 bp, Artificial Sequence
  Description of Artificial Sequence: Synthetic oligonucleotide
tactggccgagggcagacactctcc

SEQ ID NO: 360021 - DNA, 27 bp, Artificial Sequence
  Description of Artificial Sequence: Synthetic oligonucleotide
ggacggggaaacacggaaagtgaaggc

SEQ ID NO: 360022 - DNA, 24 bp, Artificial Sequence
  Description of Artificial Sequence: Synthetic oligonucleotide
actggccgagggcagacactctcc

SEQ ID NO: 360023 - DNA, 27 bp, Artificial Sequence
  Description of Artificial Sequence: Synthetic oligonucleotide
gacggggaaacacggaaagtgaaggcc

SEQ ID NO: 360024 - DNA, 23 bp, Artificial Sequence
  Description of Artificial Sequence: Synthetic oligonucleotide
ctggccgagggcagacactctcc

SEQ ID NO: 360025 - DNA, 27 bp, Artificial Sequence
  Description of Artificial Sequence: Synthetic oligonucleotide
acggggaaacacggaaagtgaaggccc

SEQ ID NO: 360026 - DNA, 23 bp, Artificial Sequence
  Description of Artificial Sequence: Synthetic oligonucleotide
tggccgagggcagacactctccc

SEQ ID NO: 360027 - DNA, 27 bp, Artificial Sequence
  Description of Artificial Sequence: Synthetic oligonucleotide
cggggaaacacggaaagtgaaggccca

SEQ ID NO: 360028 - DNA, 22 bp, Artificial Sequence
  Description of Artificial Sequence: Synthetic oligonucleotide
ggccgagggcagacactctccc

SEQ ID NO: 360029 - DNA, 27 bp, Artificial Sequence
  Description of Artificial Sequence: Synthetic oligonucleotide
ggggaaacacggaaagtgaaggcccac

SEQ ID NO: 360030 - DNA, 23 bp, Artificial Sequence
  Description of Artificial Sequence: Synthetic oligonucleotide
gccgagggcagacactctcccgt

SEQ ID NO: 360031 - DNA, 28 bp, Artificial Sequence
  Description of Artificial Sequence: Synthetic oligonucleotide
gggaaacacggaaagtgaaggcccactc

SEQ ID NO: 360032 - DNA, 23 bp, Artificial Sequence
  Description of Artificial Sequence: Synthetic oligonucleotide
ccgagggcagacactctcccgtg

SEQ ID NO: 360033 - DNA, 29 bp, Artificial Sequence
  Description of Artificial Sequence: Synthetic oligonucleotide
ggaaacacggaaagtgaaggcccactcac

SEQ ID NO: 360034 - DNA, 27 bp, Artificial Sequence
  Description of Artificial Sequence: Synthetic oligonucleotide
cgagggcagacactctcccgtggattt

SEQ ID NO: 360035 - DNA, 30 bp, Artificial Sequence; identical to SEQ ID NO: 3978
  Description of Artificial Sequence: Synthetic oligonucleotide

SEQ ID NO: 360036 - DNA, 27 bp, Artificial Sequence
  Description of Artificial Sequence: Synthetic oligonucleotide
gagggcagacactctcccgtggatttc

SEQ ID NO: 360037 - DNA, 31 bp, Artificial Sequence; identical to SEQ ID NO: 3979
  Description of Artificial Sequence: Synthetic oligonucleotide

SEQ ID NO: 360038 - DNA, 27 bp, Artificial Sequence
  Description of Artificial Sequence: Synthetic oligonucleotide
agggcagacactctcccgtggatttcg

SEQ ID NO: 360039 - DNA, 30 bp, Artificial Sequence; identical to SEQ ID NO: 3980
  Description of Artificial Sequence: Synthetic oligonucleotide

SEQ ID NO: 360040 - DNA, 27 bp, Artificial Sequence
  Description of Artificial Sequence: Synthetic oligonucleotide
gggcagacactctcccgtggatttcgt

SEQ ID NO: 360041 - DNA, 26 bp, Artificial Sequence
  Description of Artificial Sequence: Synthetic oligonucleotide
gggatggaaccttccagaagtgggcc

SEQ ID NO: 360042 - DNA, 27 bp, Artificial Sequence
  Description of Artificial Sequence: Synthetic oligonucleotide
ggcagacactctcccgtggatttcgtc

SEQ ID NO: 360043 - DNA, 26 bp, Artificial Sequence
  Description of Artificial Sequence: Synthetic oligonucleotide
ggatggaaccttccagaagtgggccg

SEQ ID NO: 360044 - DNA, 29 bp, Artificial Sequence
  Description of Artificial Sequence: Synthetic oligonucleotide
gcagacactctcccgtggatttcgtctac

SEQ ID NO: 360045 - DNA, 27 bp, Artificial Sequence
  Description of Artificial Sequence: Synthetic oligonucleotide
gatggaaccttccagaagtgggccgct

SEQ ID NO: 360046 - DNA, 29 bp, Artificial Sequence
  Description of Artificial Sequence: Synthetic oligonucleotide
cagacactctcccgtggatttcgtctacc

SEQ ID NO: 360047 - DNA, 27 bp, Artificial Sequence
  Description of Artificial Sequence: Synthetic oligonucleotide
atggaaccttccagaagtgggccgctg

SEQ ID NO: 360048 - DNA, 30 bp, Artificial Sequence; identical to SEQ ID NO: 234630
  Description of Artificial Sequence: Synthetic oligonucleotide

SEQ ID NO: 360049 - DNA, 27 bp, Artificial Sequence
  Description of Artificial Sequence: Synthetic oligonucleotide
tggaaccttccagaagtgggccgctgt

SEQ ID NO: 360050 - DNA, 29 bp, Artificial Sequence
  Description of Artificial Sequence: Synthetic oligonucleotide
gacactctcccgtggatttcgtctaccag

SEQ ID NO: 360051 - DNA, 26 bp, Artificial Sequence
  Description of Artificial Sequence: Synthetic oligonucleotide
ggaaccttccagaagtgggccgctgt

SEQ ID NO: 360052 - DNA, 34 bp, Artificial Sequence; identical to SEQ ID NO: 234632
  Description of Artificial Sequence: Synthetic oligonucleotide

SEQ ID NO: 360053 - DNA, 26 bp, Artificial Sequence
  Description of Artificial Sequence: Synthetic oligonucleotide
gaaccttccagaagtgggccgctgtg

SEQ ID NO: 360054 - DNA, 33 bp, Artificial Sequence; identical to SEQ ID NO: 234633
  Description of Artificial Sequence: Synthetic oligonucleotide

SEQ ID NO: 360055 - DNA, 27 bp, Artificial Sequence
  Description of Artificial Sequence: Synthetic oligonucleotide
aaccttccagaagtgggccgctgtggt

SEQ ID NO: 360056 - DNA, 33 bp, Artificial Sequence; identical to SEQ ID NO: 234634
  Description of Artificial Sequence: Synthetic oligonucleotide

SEQ ID NO: 360057 - DNA, 26 bp, Artificial Sequence
  Description of Artificial Sequence: Synthetic oligonucleotide
accttccagaagtgggccgctgtggt

SEQ ID NO: 360058 - DNA, 32 bp, Artificial Sequence; identical to SEQ ID NO: 234635
  Description of Artificial Sequence: Synthetic oligonucleotide

SEQ ID NO: 360059 - DNA, 25 bp, Artificial Sequence
  Description of Artificial Sequence: Synthetic oligonucleotide
ccttccagaagtgggccgctgtggt

SEQ ID NO: 360060 - DNA, 32 bp, Artificial Sequence; identical to SEQ ID NO: 234636
  Description of Artificial Sequence: Synthetic oligonucleotide

SEQ ID NO: 360061 - DNA, 25 bp, Artificial Sequence
  Description of Artificial Sequence: Synthetic oligonucleotide
cttccagaagtgggccgctgtggtg

SEQ ID NO: 360062 - DNA, 31 bp, Artificial Sequence; identical to SEQ ID NO: 234637
  Description of Artificial Sequence: Synthetic oligonucleotide

SEQ ID NO: 360063 - DNA, 26 bp, Artificial Sequence
  Description of Artificial Sequence: Synthetic oligonucleotide
ttccagaagtgggccgctgtggtggt

SEQ ID NO: 360064 - DNA, 31 bp, Artificial Sequence; identical to SEQ ID NO: 234638
  Description of Artificial Sequence: Synthetic oligonucleotide

SEQ ID NO: 360065 - DNA, 25 bp, Artificial Sequence
  Description of Artificial Sequence: Synthetic oligonucleotide
tccagaagtgggccgctgtggtggt

SEQ ID NO: 360066 - DNA, 30 bp, Artificial Sequence; identical to SEQ ID NO: 234639
  Description of Artificial Sequence: Synthetic oligonucleotide

SEQ ID NO: 360067 - DNA, 24 bp, Artificial Sequence
  Description of Artificial Sequence: Synthetic oligonucleotide
ccagaagtgggccgctgtggtggt

SEQ ID NO: 360068 - DNA, 32 bp, Artificial Sequence; identical to SEQ ID NO: 234640
  Description of Artificial Sequence: Synthetic oligonucleotide

SEQ ID NO: 360069 - DNA, 24 bp, Artificial Sequence
  Description of Artificial Sequence: Synthetic oligonucleotide
cagaagtgggccgctgtggtggtg

SEQ ID NO: 360070 - DNA, 33 bp, Artificial Sequence; identical to SEQ ID NO: 234641
  Description of Artificial Sequence: Synthetic oligonucleotide

SEQ ID NO: 360071 - DNA, 24 bp, Artificial Sequence
  Description of Artificial Sequence: Synthetic oligonucleotide
agaagtgggccgctgtggtggtgc

SEQ ID NO: 360072 - DNA, 33 bp, Artificial Sequence; identical to SEQ ID NO: 234642
  Description of Artificial Sequence: Synthetic oligonucleotide

SEQ ID NO: 360073 - DNA, 23 bp, Artificial Sequence
  Description of Artificial Sequence: Synthetic oligonucleotide
gaagtgggccgctgtggtggtgc

SEQ ID NO: 360074 - DNA, 35 bp, Artificial Sequence; identical to SEQ ID NO: 234643
  Description of Artificial Sequence: Synthetic oligonucleotide

SEQ ID NO: 360075 - DNA, 25 bp, Artificial Sequence
  Description of Artificial Sequence: Synthetic oligonucleotide
aagtgggccgctgtggtggtgcctt

SEQ ID NO: 360076 - DNA, 34 bp, Artificial Sequence; identical to SEQ ID NO: 234644
  Description of Artificial Sequence: Synthetic oligonucleotide

SEQ ID NO: 360077 - DNA, 24 bp, Artificial Sequence
  Description of Artificial Sequence: Synthetic oligonucleotide
agtgggccgctgtggtggtgcctt

SEQ ID NO: 360078 - DNA, 36 bp, Artificial Sequence; identical to SEQ ID NO: 234645
  Description of Artificial Sequence: Synthetic oligonucleotide

SEQ ID NO: 360079 - DNA, 23 bp, Artificial Sequence
  Description of Artificial Sequence: Synthetic oligonucleotide
gtgggccgctgtggtggtgcctt

SEQ ID NO: 360080 - DNA, 37 bp, Artificial Sequence; identical to SEQ ID NO: 234646
  Description of Artificial Sequence: Synthetic oligonucleotide

SEQ ID NO: 360081 - DNA, 24 bp, Artificial Sequence
  Description of Artificial Sequence: Synthetic oligonucleotide
tgggccgctgtggtggtgccttct

SEQ ID NO: 360082 - DNA, 36 bp, Artificial Sequence; identical to SEQ ID NO: 234647
  Description of Artificial Sequence: Synthetic oligonucleotide

SEQ ID NO: 360083 - DNA, 23 bp, Artificial Sequence
  Description of Artificial Sequence: Synthetic oligonucleotide
gggccgctgtggtggtgccttct

SEQ ID NO: 360084 - DNA, 35 bp, Artificial Sequence; identical to SEQ ID NO: 234648
  Description of Artificial Sequence: Synthetic oligonucleotide

SEQ ID NO: 360085 - DNA, 23 bp, Artificial Sequence
  Description of Artificial Sequence: Synthetic oligonucleotide
ggccgctgtggtggtgccttctg

SEQ ID NO: 360086 - DNA, 34 bp, Artificial Sequence; identical to SEQ ID NO: 234649
  Description of Artificial Sequence: Synthetic oligonucleotide

SEQ ID NO: 360087 - DNA, 24 bp, Artificial Sequence
  Description of Artificial Sequence: Synthetic oligonucleotide
gccgctgtggtggtgccttctgga

SEQ ID NO: 360088 - DNA, 33 bp, Artificial Sequence; identical to SEQ ID NO: 234650
  Description of Artificial Sequence: Synthetic oligonucleotide

SEQ ID NO: 360089 - DNA, 25 bp, Artificial Sequence
  Description of Artificial Sequence: Synthetic oligonucleotide
ccgctgtggtggtgccttctggaca

SEQ ID NO: 360090 - DNA, 33 bp, Artificial Sequence; identical to SEQ ID NO: 234651
  Description of Artificial Sequence: Synthetic oligonucleotide

SEQ ID NO: 360091 - DNA, 25 bp, Artificial Sequence
  Description of Artificial Sequence: Synthetic oligonucleotide
cgctgtggtggtgccttctggacag

SEQ ID NO: 360092 - DNA, 35 bp, Artificial Sequence; identical to SEQ ID NO: 234652
  Description of Artificial Sequence: Synthetic oligonucleotide

SEQ ID NO: 360093 - DNA, 24 bp, Artificial Sequence
  Description of Artificial Sequence: Synthetic oligonucleotide
aggaggggccggagtattgggacg

SEQ ID NO: 360094 - DNA, 34 bp, Artificial Sequence; identical to SEQ ID NO: 234653
  Description of Artificial Sequence: Synthetic oligonucleotide

SEQ ID NO: 360095 - DNA, 23 bp, Artificial Sequence
  Description of Artificial Sequence: Synthetic oligonucleotide
ggaggggccggagtattgggacg

SEQ ID NO: 360096 - DNA, 34 bp, Artificial Sequence; identical to SEQ ID NO: 234654
  Description of Artificial Sequence: Synthetic oligonucleotide

SEQ ID NO: 360097 - DNA, 23 bp, Artificial Sequence
  Description of Artificial Sequence: Synthetic oligonucleotide
gaggggccggagtattgggacgg

SEQ ID NO: 360098 - DNA, 33 bp, Artificial Sequence; identical to SEQ ID NO: 234655
  Description of Artificial Sequence: Synthetic oligonucleotide

SEQ ID NO: 360099 - DNA, 23 bp, Artificial Sequence
  Description of Artificial Sequence: Synthetic oligonucleotide
aggggccggagtattgggacggg

SEQ ID NO: 360100 - DNA, 32 bp, Artificial Sequence; identical to SEQ ID NO: 234656
  Description of Artificial Sequence: Synthetic oligonucleotide

SEQ ID NO: 360101 - DNA, 22 bp, Artificial Sequence
  Description of Artificial Sequence: Synthetic oligonucleotide
ggggccggagtattgggacggg

SEQ ID NO: 360102 - DNA, 32 bp, Artificial Sequence; identical to SEQ ID NO: 234657
  Description of Artificial Sequence: Synthetic oligonucleotide

SEQ ID NO: 360103 - DNA, 23 bp, Artificial Sequence
  Description of Artificial Sequence: Synthetic oligonucleotide
gggccggagtattgggacgggga

SEQ ID NO: 360104 - DNA, 32 bp, Artificial Sequence; identical to SEQ ID NO: 234658
  Description of Artificial Sequence: Synthetic oligonucleotide

SEQ ID NO: 360105 - DNA, 24 bp, Artificial Sequence
  Description of Artificial Sequence: Synthetic oligonucleotide
ggccggagtattgggacggggaga

SEQ ID NO: 360106 - DNA, 31 bp, Artificial Sequence; identical to SEQ ID NO: 234659
  Description of Artificial Sequence: Synthetic oligonucleotide

SEQ ID NO: 360107 - DNA, 25 bp, Artificial Sequence
  Description of Artificial Sequence: Synthetic oligonucleotide
gccggagtattgggacggggagaca

SEQ ID NO: 360108 - DNA, 32 bp, Artificial Sequence; identical to SEQ ID NO: 234660
  Description of Artificial Sequence: Synthetic oligonucleotide

SEQ ID NO: 360109 - DNA, 25 bp, Artificial Sequence
  Description of Artificial Sequence: Synthetic oligonucleotide
aaggagacgctgcagcgcactgacg

SEQ ID NO: 360110 - DNA, 31 bp, Artificial Sequence; identical to SEQ ID NO: 234661
  Description of Artificial Sequence: Synthetic oligonucleotide

SEQ ID NO: 360111 - DNA, 24 bp, Artificial Sequence
  Description of Artificial Sequence: Synthetic oligonucleotide
aggagacgctgcagcgcactgacg

SEQ ID NO: 360112 - DNA, 30 bp, Artificial Sequence; identical to SEQ ID NO: 234662
  Description of Artificial Sequence: Synthetic oligonucleotide

SEQ ID NO: 360113 - DNA, 23 bp, Artificial Sequence
  Description of Artificial Sequence: Synthetic oligonucleotide
ggagacgctgcagcgcactgacg

SEQ ID NO: 360114 - DNA, 29 bp, Artificial Sequence
  Description of Artificial Sequence: Synthetic oligonucleotide
tagggcatgtcctacttcaccaacgggac

SEQ ID NO: 360115 - DNA, 23 bp, Artificial Sequence
  Description of Artificial Sequence: Synthetic oligonucleotide
gagacgctgcagcgcactgacgc

SEQ ID NO: 360116 - DNA, 28 bp, Artificial Sequence
  Description of Artificial Sequence: Synthetic oligonucleotide
agggcatgtcctacttcaccaacgggac

SEQ ID NO: 360117 - DNA, 23 bp, Artificial Sequence
  Description of Artificial Sequence: Synthetic oligonucleotide
agacgctgcagcgcactgacgcc

SEQ ID NO: 360118 - DNA, 27 bp, Artificial Sequence
  Description of Artificial Sequence: Synthetic oligonucleotide
gggcatgtcctacttcaccaacgggac

SEQ ID NO: 360119 - DNA, 22 bp, Artificial Sequence
  Description of Artificial Sequence: Synthetic oligonucleotide
gacgctgcagcgcactgacgcc

SEQ ID NO: 360120 - DNA, 27 bp, Artificial Sequence
  Description of Artificial Sequence: Synthetic oligonucleotide
ggcatgtcctacttcaccaacgggacg

SEQ ID NO: 360121 - DNA, 22 bp, Artificial Sequence
  Description of Artificial Sequence: Synthetic oligonucleotide
acgctgcagcgcactgacgccc

SEQ ID NO: 360122 - DNA, 27 bp, Artificial Sequence
  Description of Artificial Sequence: Synthetic oligonucleotide
gcatgtcctacttcaccaacgggacgc

SEQ ID NO: 360123 - DNA, 21 bp, Artificial Sequence
  Description of Artificial Sequence: Synthetic oligonucleotide
cgctgcagcgcactgacgccc

SEQ ID NO: 360124 - DNA, 28 bp, Artificial Sequence
  Description of Artificial Sequence: Synthetic oligonucleotide
catgtcctacttcaccaacgggacgcag

SEQ ID NO: 360125 - DNA, 21 bp, Artificial Sequence
  Description of Artificial Sequence: Synthetic oligonucleotide
gctgcagcgcactgacgcccc

SEQ ID NO: 360126 - DNA, 28 bp, Artificial Sequence
  Description of Artificial Sequence: Synthetic oligonucleotide
atgtcctacttcaccaacgggacgcagc

SEQ ID NO: 360127 - DNA, 25 bp, Artificial Sequence
  Description of Artificial Sequence: Synthetic oligonucleotide
ctgcagcgcactgacgcccccaaaa

SEQ ID NO: 360128 - DNA, 27 bp, Artificial Sequence
  Description of Artificial Sequence: Synthetic oligonucleotide
tgtcctacttcaccaacgggacgcagc

SEQ ID NO: 360129 - DNA, 25 bp, Artificial Sequence
  Description of Artificial Sequence: Synthetic oligonucleotide
tgcagcgcactgacgcccccaaaac

SEQ ID NO: 360130 - DNA, 26 bp, Artificial Sequence
  Description of Artificial Sequence: Synthetic oligonucleotide
gtcctacttcaccaacgggacgcagc

SEQ ID NO: 360131 - DNA, 24 bp, Artificial Sequence
  Description of Artificial Sequence: Synthetic oligonucleotide
gcagcgcactgacgcccccaaaac

SEQ ID NO: 360132 - DNA, 26 bp, Artificial Sequence
  Description of Artificial Sequence: Synthetic oligonucleotide
tcctacttcaccaacgggacgcagcg

SEQ ID NO: 360133 - DNA, 24 bp, Artificial Sequence
  Description of Artificial Sequence: Synthetic oligonucleotide
cagcgcactgacgcccccaaaacg

SEQ ID NO: 360134 - DNA, 25 bp, Artificial Sequence
  Description of Artificial Sequence: Synthetic oligonucleotide
cctacttcaccaacgggacgcagcg

SEQ ID NO: 360135 - DNA, 27 bp, Artificial Sequence
  Description of Artificial Sequence: Synthetic oligonucleotide
agcgcactgacgcccccaaaacgcata

SEQ ID NO: 360136 - DNA, 25 bp, Artificial Sequence
  Description of Artificial Sequence: Synthetic oligonucleotide
ctacttcaccaacgggacgcagcgc

SEQ ID NO: 360137 - DNA, 27 bp, Artificial Sequence
  Description of Artificial Sequence: Synthetic oligonucleotide
gcgcactgacgcccccaaaacgcatat

SEQ ID NO: 360138 - DNA, 26 bp, Artificial Sequence
  Description of Artificial Sequence: Synthetic oligonucleotide
tacttcaccaacgggacgcagcgcgt

SEQ ID NO: 360139 - DNA, 27 bp, Artificial Sequence
  Description of Artificial Sequence: Synthetic oligonucleotide
cgcactgacgcccccaaaacgcatatg

SEQ ID NO: 360140 - DNA, 25 bp, Artificial Sequence
  Description of Artificial Sequence: Synthetic oligonucleotide
acttcaccaacgggacgcagcgcgt

SEQ ID NO: 360141 - DNA, 28 bp, Artificial Sequence
  Description of Artificial Sequence: Synthetic oligonucleotide
gcactgacgcccccaaaacgcatatgac

SEQ ID NO: 360142 - DNA, 24 bp, Artificial Sequence
  Description of Artificial Sequence: Synthetic oligonucleotide
cttcaccaacgggacgcagcgcgt

SEQ ID NO: 360143 - DNA, 29 bp, Artificial Sequence
  Description of Artificial Sequence: Synthetic oligonucleotide
cactgacgcccccaaaacgcatatgactc

SEQ ID NO: 360144 - DNA, 24 bp, Artificial Sequence
  Description of Artificial Sequence: Synthetic oligonucleotide
ttcaccaacgggacgcagcgcgtg

SEQ ID NO: 360145 - DNA, 30 bp, Artificial Sequence; identical to SEQ ID NO: 4058
  Description of Artificial Sequence: Synthetic oligonucleotide

SEQ ID NO: 360146 - DNA, 23 bp, Artificial Sequence
  Description of Artificial Sequence: Synthetic oligonucleotide
tcaccaacgggacgcagcgcgtg

SEQ ID NO: 360147 - DNA, 29 bp, Artificial Sequence
  Description of Artificial Sequence: Synthetic oligonucleotide
ctgacgcccccaaaacgcatatgactcac

SEQ ID NO: 360148 - DNA, 22 bp, Artificial Sequence
  Description of Artificial Sequence: Synthetic oligonucleotide
caccaacgggacgcagcgcgtg

SEQ ID NO: 360149 - DNA, 29 bp, Artificial Sequence
  Description of Artificial Sequence: Synthetic oligonucleotide
tgacgcccccaaaacgcatatgactcacc

SEQ ID NO: 360150 - DNA, 22 bp, Artificial Sequence
  Description of Artificial Sequence: Synthetic oligonucleotide
accaacgggacgcagcgcgtgc

SEQ ID NO: 360151 - DNA, 23 bp, Artificial Sequence
  Description of Artificial Sequence: Synthetic oligonucleotide
gggagccccgcttcatcgcagtc

SEQ ID NO: 360152 - DNA, 21 bp, Artificial Sequence
  Description of Artificial Sequence: Synthetic oligonucleotide
ccaacgggacgcagcgcgtgc

SEQ ID NO: 360153 - DNA, 23 bp, Artificial Sequence
  Description of Artificial Sequence: Synthetic oligonucleotide
ggagccccgcttcatcgcagtcg

SEQ ID NO: 360154 - DNA, 22 bp, Artificial Sequence
  Description of Artificial Sequence: Synthetic oligonucleotide
caacgggacgcagcgcgtgcct

SEQ ID NO: 360155 - DNA, 23 bp, Artificial Sequence
  Description of Artificial Sequence: Synthetic oligonucleotide
gagccccgcttcatcgcagtcgg

SEQ ID NO: 360156 - DNA, 24 bp, Artificial Sequence
  Description of Artificial Sequence: Synthetic oligonucleotide
aacgggacgcagcgcgtgcctctt

SEQ ID NO: 360157 - DNA, 25 bp, Artificial Sequence
  Description of Artificial Sequence: Synthetic oligonucleotide
agccccgcttcatcgcagtcggcta

SEQ ID NO: 360158 - DNA, 23 bp, Artificial Sequence
  Description of Artificial Sequence: Synthetic oligonucleotide
acgggacgcagcgcgtgcctctt

SEQ ID NO: 360159 - DNA, 24 bp, Artificial Sequence
  Description of Artificial Sequence: Synthetic oligonucleotide
gccccgcttcatcgcagtcggcta

SEQ ID NO: 360160 - DNA, 22 bp, Artificial Sequence
  Description of Artificial Sequence: Synthetic oligonucleotide
cgggacgcagcgcgtgcctctt

SEQ ID NO: 360161 - DNA, 24 bp, Artificial Sequence
  Description of Artificial Sequence: Synthetic oligonucleotide
ccccgcttcatcgcagtcggctac

SEQ ID NO: 360162 - DNA, 25 bp, Artificial Sequence
  Description of Artificial Sequence: Synthetic oligonucleotide
gggacgcagcgcgtgcctcttgtaa

SEQ ID NO: 360163 - DNA, 25 bp, Artificial Sequence
  Description of Artificial Sequence: Synthetic oligonucleotide
cccgcttcatcgcagtcggctacgt

SEQ ID NO: 360164 - DNA, 25 bp, Artificial Sequence
  Description of Artificial Sequence: Synthetic oligonucleotide
ggacgcagcgcgtgcctcttgtaac

SEQ ID NO: 360165 - DNA, 25 bp, Artificial Sequence
  Description of Artificial Sequence: Synthetic oligonucleotide
ccgcttcatcgcagtcggctacgtg

SEQ ID NO: 360166 - DNA, 26 bp, Artificial Sequence
  Description of Artificial Sequence: Synthetic oligonucleotide
gacgcagcgcgtgcctcttgtaacga

SEQ ID NO: 360167 - DNA, 26 bp, Artificial Sequence
  Description of Artificial Sequence: Synthetic oligonucleotide
cgcttcatcgcagtcggctacgtgga

SEQ ID NO: 360168 - DNA, 27 bp, Artificial Sequence
  Description of Artificial Sequence: Synthetic oligonucleotide
acgcagcgcgtgcctcttgtaacgaga

SEQ ID NO: 360169 - DNA, 26 bp, Artificial Sequence
  Description of Artificial Sequence: Synthetic oligonucleotide
gcttcatcgcagtcggctacgtggac

SEQ ID NO: 360170 - DNA, 27 bp, Artificial Sequence
  Description of Artificial Sequence: Synthetic oligonucleotide
cgcagcgcgtgcctcttgtaacgagat

SEQ ID NO: 360171 - DNA, 27 bp, Artificial Sequence
  Description of Artificial Sequence: Synthetic oligonucleotide
cttcatcgcagtcggctacgtggacga

SEQ ID NO: 360172 - DNA, 28 bp, Artificial Sequence
  Description of Artificial Sequence: Synthetic oligonucleotide
gcagcgcgtgcctcttgtaacgagatac

SEQ ID NO: 360173 - DNA, 27 bp, Artificial Sequence
  Description of Artificial Sequence: Synthetic oligonucleotide
ttcatcgcagtcggctacgtggacgac

SEQ ID NO: 360174 - DNA, 30 bp, Artificial Sequence; identical to SEQ ID NO: 234693
  Description of Artificial Sequence: Synthetic oligonucleotide

SEQ ID NO: 360175 - DNA, 27 bp, Artificial Sequence
  Description of Artificial Sequence: Synthetic oligonucleotide
tcatcgcagtcggctacgtggacgaca

SEQ ID NO: 360176 - DNA, 35 bp, Artificial Sequence; identical to SEQ ID NO: 234694
  Description of Artificial Sequence: Synthetic oligonucleotide

SEQ ID NO: 360177 - DNA, 26 bp, Artificial Sequence
  Description of Artificial Sequence: Synthetic oligonucleotide
catcgcagtcggctacgtggacgaca

SEQ ID NO: 360178 - DNA, 34 bp, Artificial Sequence; identical to SEQ ID NO: 234695
  Description of Artificial Sequence: Synthetic oligonucleotide

SEQ ID NO: 360179 - DNA, 26 bp, Artificial Sequence
  Description of Artificial Sequence: Synthetic oligonucleotide
atcgcagtcggctacgtggacgacac

SEQ ID NO: 360180 - DNA, 34 bp, Artificial Sequence; identical to SEQ ID NO: 234696
  Description of Artificial Sequence: Synthetic oligonucleotide

SEQ ID NO: 360181 - DNA, 25 bp, Artificial Sequence
  Description of Artificial Sequence: Synthetic oligonucleotide
tcgcagtcggctacgtggacgacac

SEQ ID NO: 360182 - DNA, 34 bp, Artificial Sequence; identical to SEQ ID NO: 234697
  Description of Artificial Sequence: Synthetic oligonucleotide

SEQ ID NO: 360183 - DNA, 24 bp, Artificial Sequence
  Description of Artificial Sequence: Synthetic oligonucleotide
cgcagtcggctacgtggacgacac

SEQ ID NO: 360184 - DNA, 35 bp, Artificial Sequence; identical to SEQ ID NO: 234698
  Description of Artificial Sequence: Synthetic oligonucleotide

SEQ ID NO: 360185 - DNA, 24 bp, Artificial Sequence
  Description of Artificial Sequence: Synthetic oligonucleotide
gcagtcggctacgtggacgacacg

SEQ ID NO: 360186 - DNA, 36 bp, Artificial Sequence; identical to SEQ ID NO: 234699
  Description of Artificial Sequence: Synthetic oligonucleotide

SEQ ID NO: 360187 - DNA, 25 bp, Artificial Sequence
  Description of Artificial Sequence: Synthetic oligonucleotide
cagtcggctacgtggacgacacgca

SEQ ID NO: 360188 - DNA, 36 bp, Artificial Sequence; identical to SEQ ID NO: 234700
  Description of Artificial Sequence: Synthetic oligonucleotide

SEQ ID NO: 360189 - DNA, 27 bp, Artificial Sequence
  Description of Artificial Sequence: Synthetic oligonucleotide
agtcggctacgtggacgacacgcagtt

SEQ ID NO: 360190 - DNA, 35 bp, Artificial Sequence; identical to SEQ ID NO: 234701
  Description of Artificial Sequence: Synthetic oligonucleotide

SEQ ID NO: 360191 - DNA, 26 bp, Artificial Sequence
  Description of Artificial Sequence: Synthetic oligonucleotide
gtcggctacgtggacgacacgcagtt

SEQ ID NO: 360192 - DNA, 36 bp, Artificial Sequence; identical to SEQ ID NO: 234702
  Description of Artificial Sequence: Synthetic oligonucleotide

SEQ ID NO: 360193 - DNA, 26 bp, Artificial Sequence
  Description of Artificial Sequence: Synthetic oligonucleotide
tcggctacgtggacgacacgcagttc

SEQ ID NO: 360194 - DNA, 38 bp, Artificial Sequence; identical to SEQ ID NO: 234703
  Description of Artificial Sequence: Synthetic oligonucleotide

SEQ ID NO: 360195 - DNA, 25 bp, Artificial Sequence
  Description of Artificial Sequence: Synthetic oligonucleotide
cggctacgtggacgacacgcagttc

SEQ ID NO: 360196 - DNA, 38 bp, Artificial Sequence; identical to SEQ ID NO: 234704
  Description of Artificial Sequence: Synthetic oligonucleotide

SEQ ID NO: 360197 - DNA, 28 bp, Artificial Sequence
  Description of Artificial Sequence: Synthetic oligonucleotide
cacgctgtctctgaccatgaagccactc

SEQ ID NO: 360198 - DNA, 37 bp, Artificial Sequence; identical to SEQ ID NO: 234705
  Description of Artificial Sequence: Synthetic oligonucleotide

SEQ ID NO: 360199 - DNA, 29 bp, Artificial Sequence
  Description of Artificial Sequence: Synthetic oligonucleotide
acgctgtctctgaccatgaagccactctg

SEQ ID NO: 360200 - DNA, 37 bp, Artificial Sequence; identical to SEQ ID NO: 234706
  Description of Artificial Sequence: Synthetic oligonucleotide

SEQ ID NO: 360201 - DNA, 28 bp, Artificial Sequence
  Description of Artificial Sequence: Synthetic oligonucleotide
cgctgtctctgaccatgaagccactctg

SEQ ID NO: 360202 - DNA, 36 bp, Artificial Sequence; identical to SEQ ID NO: 234707
  Description of Artificial Sequence: Synthetic oligonucleotide

SEQ ID NO: 360203 - DNA, 29 bp, Artificial Sequence
  Description of Artificial Sequence: Synthetic oligonucleotide
gctgtctctgaccatgaagccactctgag

SEQ ID NO: 360204 - DNA, 35 bp, Artificial Sequence; identical to SEQ ID NO: 234708
  Description of Artificial Sequence: Synthetic oligonucleotide

SEQ ID NO: 360205 - DNA, 29 bp, Artificial Sequence
  Description of Artificial Sequence: Synthetic oligonucleotide
ctgtctctgaccatgaagccactctgagg

SEQ ID NO: 360206 - DNA, 35 bp, Artificial Sequence; identical to SEQ ID NO: 234709
  Description of Artificial Sequence: Synthetic oligonucleotide

SEQ ID NO: 360207 - DNA, 30 bp, Artificial Sequence; identical to SEQ ID NO: 4089
  Description of Artificial Sequence: Synthetic oligonucleotide

SEQ ID NO: 360208 - DNA, 34 bp, Artificial Sequence; identical to SEQ ID NO: 234710
  Description of Artificial Sequence: Synthetic oligonucleotide

SEQ ID NO: 360209 - DNA, 29 bp, Artificial Sequence
  Description of Artificial Sequence: Synthetic oligonucleotide
gtctctgaccatgaagccactctgaggtg

SEQ ID NO: 360210 - DNA, 33 bp, Artificial Sequence; identical to SEQ ID NO: 234711
  Description of Artificial Sequence: Synthetic oligonucleotide

SEQ ID NO: 360211 - DNA, 29 bp, Artificial Sequence
  Description of Artificial Sequence: Synthetic oligonucleotide
tctctgaccatgaagccactctgaggtgc

SEQ ID NO: 360212 - DNA, 32 bp, Artificial Sequence; identical to SEQ ID NO: 234712
  Description of Artificial Sequence: Synthetic oligonucleotide

SEQ ID NO: 360213 - DNA, 28 bp, Artificial Sequence
  Description of Artificial Sequence: Synthetic oligonucleotide
ctctgaccatgaagccactctgaggtgc

SEQ ID NO: 360214 - DNA, 32 bp, Artificial Sequence; identical to SEQ ID NO: 234713
  Description of Artificial Sequence: Synthetic oligonucleotide

SEQ ID NO: 360215 - DNA, 29 bp, Artificial Sequence
  Description of Artificial Sequence: Synthetic oligonucleotide
tctgaccatgaagccactctgaggtgctg

SEQ ID NO: 360216 - DNA, 32 bp, Artificial Sequence; identical to SEQ ID NO: 234714
  Description of Artificial Sequence: Synthetic oligonucleotide

SEQ ID NO: 360217 - DNA, 28 bp, Artificial Sequence
  Description of Artificial Sequence: Synthetic oligonucleotide
ctgaccatgaagccactctgaggtgctg

SEQ ID NO: 360218 - DNA, 31 bp, Artificial Sequence; identical to SEQ ID NO: 234715
  Description of Artificial Sequence: Synthetic oligonucleotide

SEQ ID NO: 360219 - DNA, 28 bp, Artificial Sequence
  Description of Artificial Sequence: Synthetic oligonucleotide
tgaccatgaagccactctgaggtgctgg

SEQ ID NO: 360220 - DNA, 31 bp, Artificial Sequence; identical to SEQ ID NO: 234716
  Description of Artificial Sequence: Synthetic oligonucleotide

SEQ ID NO: 360221 - DNA, 27 bp, Artificial Sequence
  Description of Artificial Sequence: Synthetic oligonucleotide
gaccatgaagccactctgaggtgctgg

SEQ ID NO: 360222 - DNA, 30 bp, Artificial Sequence; identical to SEQ ID NO: 234717
  Description of Artificial Sequence: Synthetic oligonucleotide

SEQ ID NO: 360223 - DNA, 27 bp, Artificial Sequence
  Description of Artificial Sequence: Synthetic oligonucleotide
accatgaagccactctgaggtgctggg

SEQ ID NO: 360224 - DNA, 29 bp, Artificial Sequence
  Description of Artificial Sequence: Synthetic oligonucleotide
acatcaataaccgagtggagtacgcgggc

SEQ ID NO: 360225 - DNA, 26 bp, Artificial Sequence
  Description of Artificial Sequence: Synthetic oligonucleotide
ccatgaagccactctgaggtgctggg

SEQ ID NO: 360226 - DNA, 28 bp, Artificial Sequence
  Description of Artificial Sequence: Synthetic oligonucleotide
catcaataaccgagtggagtacgcgggc

SEQ ID NO: 360227 - DNA, 26 bp, Artificial Sequence
  Description of Artificial Sequence: Synthetic oligonucleotide
catgaagccactctgaggtgctgggc

SEQ ID NO: 360228 - DNA, 30 bp, Artificial Sequence; identical to SEQ ID NO: 234720
  Description of Artificial Sequence: Synthetic oligonucleotide

SEQ ID NO: 360229 - DNA, 26 bp, Artificial Sequence
  Description of Artificial Sequence: Synthetic oligonucleotide
atgaagccactctgaggtgctgggcc

SEQ ID NO: 360230 - DNA, 29 bp, Artificial Sequence
  Description of Artificial Sequence: Synthetic oligonucleotide
tcaataaccgagtggagtacgcgggcttc

SEQ ID NO: 360231 - DNA, 25 bp, Artificial Sequence
  Description of Artificial Sequence: Synthetic oligonucleotide
tgaagccactctgaggtgctgggcc

SEQ ID NO: 360232 - DNA, 28 bp, Artificial Sequence
  Description of Artificial Sequence: Synthetic oligonucleotide
caataaccgagtggagtacgcgggcttc

SEQ ID NO: 360233 - DNA, 24 bp, Artificial Sequence
  Description of Artificial Sequence: Synthetic oligonucleotide
gaagccactctgaggtgctgggcc

SEQ ID NO: 360234 - DNA, 28 bp, Artificial Sequence
  Description of Artificial Sequence: Synthetic oligonucleotide
aataaccgagtggagtacgcgggcttcg

SEQ ID NO: 360235 - DNA, 25 bp, Artificial Sequence
  Description of Artificial Sequence: Synthetic oligonucleotide
aagccactctgaggtgctgggccct

SEQ ID NO: 360236 - DNA, 27 bp, Artificial Sequence
  Description of Artificial Sequence: Synthetic oligonucleotide
ataaccgagtggagtacgcgggcttcg

SEQ ID NO: 360237 - DNA, 24 bp, Artificial Sequence
  Description of Artificial Sequence: Synthetic oligonucleotide
agccactctgaggtgctgggccct

SEQ ID NO: 360238 - DNA, 27 bp, Artificial Sequence
  Description of Artificial Sequence: Synthetic oligonucleotide
taaccgagtggagtacgcgggcttcga

SEQ ID NO: 360239 - DNA, 23 bp, Artificial Sequence
  Description of Artificial Sequence: Synthetic oligonucleotide
gccactctgaggtgctgggccct

SEQ ID NO: 360240 - DNA, 26 bp, Artificial Sequence
  Description of Artificial Sequence: Synthetic oligonucleotide
aaccgagtggagtacgcgggcttcga

SEQ ID NO: 360241 - DNA, 24 bp, Artificial Sequence
  Description of Artificial Sequence: Synthetic oligonucleotide
ccactctgaggtgctgggccctga

SEQ ID NO: 360242 - DNA, 25 bp, Artificial Sequence
  Description of Artificial Sequence: Synthetic oligonucleotide
accgagtggagtacgcgggcttcga

SEQ ID NO: 360243 - DNA, 24 bp, Artificial Sequence
  Description of Artificial Sequence: Synthetic oligonucleotide
cactctgaggtgctgggccctgag

SEQ ID NO: 360244 - DNA, 24 bp, Artificial Sequence
  Description of Artificial Sequence: Synthetic oligonucleotide
ccgagtggagtacgcgggcttcga

SEQ ID NO: 360245 - DNA, 26 bp, Artificial Sequence
  Description of Artificial Sequence: Synthetic oligonucleotide
actctgaggtgctgggccctgagctt

SEQ ID NO: 360246 - DNA, 25 bp, Artificial Sequence
  Description of Artificial Sequence: Synthetic oligonucleotide
cgagtggagtacgcgggcttcgact

SEQ ID NO: 360247 - DNA, 25 bp, Artificial Sequence
  Description of Artificial Sequence: Synthetic oligonucleotide
ctctgaggtgctgggccctgagctt

SEQ ID NO: 360248 - DNA, 25 bp, Artificial Sequence
  Description of Artificial Sequence: Synthetic oligonucleotide
gagtggagtacgcgggcttcgactg

SEQ ID NO: 360249 - DNA, 27 bp, Artificial Sequence
  Description of Artificial Sequence: Synthetic oligonucleotide
tctgaggtgctgggccctgagcttcta

SEQ ID NO: 360250 - DNA, 25 bp, Artificial Sequence
  Description of Artificial Sequence: Synthetic oligonucleotide
agtggagtacgcgggcttcgactgc

SEQ ID NO: 360251 - DNA, 21 bp, Artificial Sequence
  Description of Artificial Sequence: Synthetic oligonucleotide
gcggcccatgtggcggagcag

SEQ ID NO: 360252 - DNA, 24 bp, Artificial Sequence
  Description of Artificial Sequence: Synthetic oligonucleotide
gtggagtacgcgggcttcgactgc

SEQ ID NO: 360253 - DNA, 22 bp, Artificial Sequence
  Description of Artificial Sequence: Synthetic oligonucleotide
cggcccatgtggcggagcagct

SEQ ID NO: 360254 - DNA, 25 bp, Artificial Sequence
  Description of Artificial Sequence: Synthetic oligonucleotide
tggagtacgcgggcttcgactgcga

SEQ ID NO: 360255 - DNA, 23 bp, Artificial Sequence
  Description of Artificial Sequence: Synthetic oligonucleotide
ggcccatgtggcggagcagctga

SEQ ID NO: 360256 - DNA, 24 bp, Artificial Sequence
  Description of Artificial Sequence: Synthetic oligonucleotide
ggagtacgcgggcttcgactgcga

SEQ ID NO: 360257 - DNA, 24 bp, Artificial Sequence
  Description of Artificial Sequence: Synthetic oligonucleotide
gcccatgtggcggagcagctgaga

SEQ ID NO: 360258 - DNA, 24 bp, Artificial Sequence
  Description of Artificial Sequence: Synthetic oligonucleotide
gagtacgcgggcttcgactgcgac

SEQ ID NO: 360259 - DNA, 24 bp, Artificial Sequence
  Description of Artificial Sequence: Synthetic oligonucleotide
cccatgtggcggagcagctgagag

SEQ ID NO: 360260 - DNA, 25 bp, Artificial Sequence
  Description of Artificial Sequence: Synthetic oligonucleotide
agtacgcgggcttcgactgcgacgt

SEQ ID NO: 360261 - DNA, 24 bp, Artificial Sequence
  Description of Artificial Sequence: Synthetic oligonucleotide
ccatgtggcggagcagctgagagc

SEQ ID NO: 360262 - DNA, 24 bp, Artificial Sequence
  Description of Artificial Sequence: Synthetic oligonucleotide
gtacgcgggcttcgactgcgacgt

SEQ ID NO: 360263 - DNA, 26 bp, Artificial Sequence
  Description of Artificial Sequence: Synthetic oligonucleotide
catgtggcggagcagctgagagccta

SEQ ID NO: 360264 - DNA, 24 bp, Artificial Sequence
  Description of Artificial Sequence: Synthetic oligonucleotide
tacgcgggcttcgactgcgacgtg

SEQ ID NO: 360265 - DNA, 26 bp, Artificial Sequence
  Description of Artificial Sequence: Synthetic oligonucleotide
atgtggcggagcagctgagagcctac

SEQ ID NO: 360266 - DNA, 23 bp, Artificial Sequence
  Description of Artificial Sequence: Synthetic oligonucleotide
acgcgggcttcgactgcgacgtg

SEQ ID NO: 360267 - DNA, 25 bp, Artificial Sequence
  Description of Artificial Sequence: Synthetic oligonucleotide
tgtggcggagcagctgagagcctac

SEQ ID NO: 360268 - DNA, 22 bp, Artificial Sequence
  Description of Artificial Sequence: Synthetic oligonucleotide
cgcgggcttcgactgcgacgtg

SEQ ID NO: 360269 - DNA, 24 bp, Artificial Sequence
  Description of Artificial Sequence: Synthetic oligonucleotide
gtggcggagcagctgagagcctac

SEQ ID NO: 360270 - DNA, 22 bp, Artificial Sequence
  Description of Artificial Sequence: Synthetic oligonucleotide
gcgggcttcgactgcgacgtgc

SEQ ID NO: 360271 - DNA, 25 bp, Artificial Sequence
  Description of Artificial Sequence: Synthetic oligonucleotide
tggcggagcagctgagagcctacct

SEQ ID NO: 360272 - DNA, 22 bp, Artificial Sequence
  Description of Artificial Sequence: Synthetic oligonucleotide
cgggcttcgactgcgacgtgcg

SEQ ID NO: 360273 - DNA, 24 bp, Artificial Sequence
  Description of Artificial Sequence: Synthetic oligonucleotide
ggcggagcagctgagagcctacct

SEQ ID NO: 360274 - DNA, 22 bp, Artificial Sequence
  Description of Artificial Sequence: Synthetic oligonucleotide
gggcttcgactgcgacgtgcgg

SEQ ID NO: 360275 - DNA, 24 bp, Artificial Sequence
  Description of Artificial Sequence: Synthetic oligonucleotide
gcggagcagctgagagcctacctg

SEQ ID NO: 360276 - DNA, 23 bp, Artificial Sequence
  Description of Artificial Sequence: Synthetic oligonucleotide
ggcttcgactgcgacgtgcgggt

SEQ ID NO: 360277 - DNA, 25 bp, Artificial Sequence
  Description of Artificial Sequence: Synthetic oligonucleotide
cggagcagctgagagcctacctgga

SEQ ID NO: 360278 - DNA, 25 bp, Artificial Sequence
  Description of Artificial Sequence: Synthetic oligonucleotide
gcttcgactgcgacgtgcgggtgta

SEQ ID NO: 360279 - DNA, 25 bp, Artificial Sequence
  Description of Artificial Sequence: Synthetic oligonucleotide
ggagcagctgagagcctacctggag

SEQ ID NO: 360280 - DNA, 25 bp, Artificial Sequence
  Description of Artificial Sequence: Synthetic oligonucleotide
cttcgactgcgacgtgcgggtgtac

SEQ ID NO: 360281 - DNA, 25 bp, Artificial Sequence
  Description of Artificial Sequence: Synthetic oligonucleotide
gagcagctgagagcctacctggagg

SEQ ID NO: 360282 - DNA, 25 bp, Artificial Sequence
  Description of Artificial Sequence: Synthetic oligonucleotide
ttcgactgcgacgtgcgggtgtacc

SEQ ID NO: 360283 - DNA, 25 bp, Artificial Sequence
  Description of Artificial Sequence: Synthetic oligonucleotide
agcagctgagagcctacctggaggg

SEQ ID NO: 360284 - DNA, 24 bp, Artificial Sequence
  Description of Artificial Sequence: Synthetic oligonucleotide
tcgactgcgacgtgcgggtgtacc

SEQ ID NO: 360285 - DNA, 24 bp, Artificial Sequence
  Description of Artificial Sequence: Synthetic oligonucleotide
gcagctgagagcctacctggaggg

SEQ ID NO: 360286 - DNA, 23 bp, Artificial Sequence
  Description of Artificial Sequence: Synthetic oligonucleotide
cgactgcgacgtgcgggtgtacc

SEQ ID NO: 360287 - DNA, 25 bp, Artificial Sequence
  Description of Artificial Sequence: Synthetic oligonucleotide
cagctgagagcctacctggagggca

SEQ ID NO: 360288 - DNA, 23 bp, Artificial Sequence
  Description of Artificial Sequence: Synthetic oligonucleotide
gactgcgacgtgcgggtgtaccc

SEQ ID NO: 360289 - DNA, 25 bp, Artificial Sequence
  Description of Artificial Sequence: Synthetic oligonucleotide
agctgagagcctacctggagggcac

SEQ ID NO: 360290 - DNA, 23 bp, Artificial Sequence
  Description of Artificial Sequence: Synthetic oligonucleotide
actgcgacgtgcgggtgtacccg

SEQ ID NO: 360291 - DNA, 24 bp, Artificial Sequence
  Description of Artificial Sequence: Synthetic oligonucleotide
gctgagagcctacctggagggcac

SEQ ID NO: 360292 - DNA, 22 bp, Artificial Sequence
  Description of Artificial Sequence: Synthetic oligonucleotide
ctgcgacgtgcgggtgtacccg

SEQ ID NO: 360293 - DNA, 25 bp, Artificial Sequence
  Description of Artificial Sequence: Synthetic oligonucleotide
ctgagagcctacctggagggcacgt

SEQ ID NO: 360294 - DNA, 22 bp, Artificial Sequence
  Description of Artificial Sequence: Synthetic oligonucleotide
tgcgacgtgcgggtgtacccgg

SEQ ID NO: 360295 - DNA, 35 bp, Artificial Sequence; identical to SEQ ID NO: 4132
  Description of Artificial Sequence: Synthetic oligonucleotide

SEQ ID NO: 360296 - DNA, 21 bp, Artificial Sequence
  Description of Artificial Sequence: Synthetic oligonucleotide
gcgacgtgcgggtgtacccgg

SEQ ID NO: 360297 - DNA, 34 bp, Artificial Sequence; identical to SEQ ID NO: 4133
  Description of Artificial Sequence: Synthetic oligonucleotide

SEQ ID NO: 360298 - DNA, 21 bp, Artificial Sequence
  Description of Artificial Sequence: Synthetic oligonucleotide
cgacgtgcgggtgtacccggc

SEQ ID NO: 360299 - DNA, 34 bp, Artificial Sequence; identical to SEQ ID NO: 4134
  Description of Artificial Sequence: Synthetic oligonucleotide

SEQ ID NO: 360300 - DNA, 21 bp, Artificial Sequence
  Description of Artificial Sequence: Synthetic oligonucleotide
gacgtgcgggtgtacccggcg

SEQ ID NO: 360301 - DNA, 33 bp, Artificial Sequence; identical to SEQ ID NO: 4135
  Description of Artificial Sequence: Synthetic oligonucleotide

SEQ ID NO: 360302 - DNA, 22 bp, Artificial Sequence
  Description of Artificial Sequence: Synthetic oligonucleotide
acgtgcgggtgtacccggcggt

SEQ ID NO: 360303 - DNA, 33 bp, Artificial Sequence; identical to SEQ ID NO: 4136
  Description of Artificial Sequence: Synthetic oligonucleotide

SEQ ID NO: 360304 - DNA, 21 bp, Artificial Sequence
  Description of Artificial Sequence: Synthetic oligonucleotide
cgtgcgggtgtacccggcggt

SEQ ID NO: 360305 - DNA, 32 bp, Artificial Sequence; identical to SEQ ID NO: 4137
  Description of Artificial Sequence: Synthetic oligonucleotide

SEQ ID NO: 360306 - DNA, 22 bp, Artificial Sequence
  Description of Artificial Sequence: Synthetic oligonucleotide
gtgcgggtgtacccggcggtga

SEQ ID NO: 360307 - DNA, 32 bp, Artificial Sequence; identical to SEQ ID NO: 4138
  Description of Artificial Sequence: Synthetic oligonucleotide

SEQ ID NO: 360308 - DNA, 22 bp, Artificial Sequence
  Description of Artificial Sequence: Synthetic oligonucleotide
tgcgggtgtacccggcggtgac

SEQ ID NO: 360309 - DNA, 32 bp, Artificial Sequence; identical to SEQ ID NO: 4139
  Description of Artificial Sequence: Synthetic oligonucleotide

SEQ ID NO: 360310 - DNA, 21 bp, Artificial Sequence
  Description of Artificial Sequence: Synthetic oligonucleotide
gcgggtgtacccggcggtgac

SEQ ID NO: 360311 - DNA, 31 bp, Artificial Sequence; identical to SEQ ID NO: 4140
  Description of Artificial Sequence: Synthetic oligonucleotide

SEQ ID NO: 360312 - DNA, 21 bp, Artificial Sequence
  Description of Artificial Sequence: Synthetic oligonucleotide
cgggtgtacccggcggtgacg

SEQ ID NO: 360313 - DNA, 30 bp, Artificial Sequence; identical to SEQ ID NO: 4141
  Description of Artificial Sequence: Synthetic oligonucleotide

SEQ ID NO: 360314 - DNA, 21 bp, Artificial Sequence
  Description of Artificial Sequence: Synthetic oligonucleotide
gggtgtacccggcggtgacgg

SEQ ID NO: 360315 - DNA, 30 bp, Artificial Sequence; identical to SEQ ID NO: 4142
  Description of Artificial Sequence: Synthetic oligonucleotide

SEQ ID NO: 360316 - DNA, 21 bp, Artificial Sequence
  Description of Artificial Sequence: Synthetic oligonucleotide
ggtgtacccggcggtgacggc

SEQ ID NO: 360317 - DNA, 29 bp, Artificial Sequence
  Description of Artificial Sequence: Synthetic oligonucleotide
ggtatttcttcacatccgtgtctcggccc

SEQ ID NO: 360318 - DNA, 21 bp, Artificial Sequence
  Description of Artificial Sequence: Synthetic oligonucleotide
gtgtacccggcggtgacggcg

SEQ ID NO: 360319 - DNA, 29 bp, Artificial Sequence
  Description of Artificial Sequence: Synthetic oligonucleotide
gtatttcttcacatccgtgtctcggcccg

SEQ ID NO: 360320 - DNA, 22 bp, Artificial Sequence
  Description of Artificial Sequence: Synthetic oligonucleotide
tgtacccggcggtgacggcgca

SEQ ID NO: 360321 - DNA, 29 bp, Artificial Sequence
  Description of Artificial Sequence: Synthetic oligonucleotide
tatttcttcacatccgtgtctcggcccgg

SEQ ID NO: 360322 - DNA, 21 bp, Artificial Sequence
  Description of Artificial Sequence: Synthetic oligonucleotide
gtacccggcggtgacggcgca

SEQ ID NO: 360323 - DNA, 28 bp, Artificial Sequence
  Description of Artificial Sequence: Synthetic oligonucleotide
atttcttcacatccgtgtctcggcccgg

SEQ ID NO: 360324 - DNA, 21 bp, Artificial Sequence
  Description of Artificial Sequence: Synthetic oligonucleotide
tacccggcggtgacggcgcag

SEQ ID NO: 360325 - DNA, 27 bp, Artificial Sequence
  Description of Artificial Sequence: Synthetic oligonucleotide
tttcttcacatccgtgtctcggcccgg

SEQ ID NO: 360326 - DNA, 20 bp, Artificial Sequence
  Description of Artificial Sequence: Synthetic oligonucleotide
acccggcggtgacggcgcag

SEQ ID NO: 360327 - DNA, 26 bp, Artificial Sequence
  Description of Artificial Sequence: Synthetic oligonucleotide
ttcttcacatccgtgtctcggcccgg

SEQ ID NO: 360328 - DNA, 20 bp, Artificial Sequence
  Description of Artificial Sequence: Synthetic oligonucleotide
cccggcggtgacggcgcagt

SEQ ID NO: 360329 - DNA, 25 bp, Artificial Sequence
  Description of Artificial Sequence: Synthetic oligonucleotide
tcttcacatccgtgtctcggcccgg

SEQ ID NO: 360330 - DNA, 20 bp, Artificial Sequence
  Description of Artificial Sequence: Synthetic oligonucleotide
ccggcggtgacggcgcaggt

SEQ ID NO: 360331 - DNA, 24 bp, Artificial Sequence
  Description of Artificial Sequence: Synthetic oligonucleotide
cttcacatccgtgtctcggcccgg

SEQ ID NO: 360332 - DNA, 20 bp, Artificial Sequence
  Description of Artificial Sequence: Synthetic oligonucleotide
cggcggtgacggcgcagggt

SEQ ID NO: 360333 - DNA, 24 bp, Artificial Sequence
  Description of Artificial Sequence: Synthetic oligonucleotide
ttcacatccgtgtctcggcccggc

SEQ ID NO: 360334 - DNA, 20 bp, Artificial Sequence
  Description of Artificial Sequence: Synthetic oligonucleotide
ggcggtgacggcgcaggggt

SEQ ID NO: 360335 - DNA, 23 bp, Artificial Sequence
  Description of Artificial Sequence: Synthetic oligonucleotide
tcacatccgtgtctcggcccggc

SEQ ID NO: 360336 - DNA, 20 bp, Artificial Sequence
  Description of Artificial Sequence: Synthetic oligonucleotide
gcggtgacggcgcaggggct

SEQ ID NO: 360337 - DNA, 22 bp, Artificial Sequence
  Description of Artificial Sequence: Synthetic oligonucleotide
cacatccgtgtctcggcccggc

SEQ ID NO: 360338 - DNA, 20 bp, Artificial Sequence
  Description of Artificial Sequence: Synthetic oligonucleotide
cggtgacggcgcaggggcct

SEQ ID NO: 360339 - DNA, 22 bp, Artificial Sequence
  Description of Artificial Sequence: Synthetic oligonucleotide
acatccgtgtctcggcccggcc

SEQ ID NO: 360340 - DNA, 20 bp, Artificial Sequence
  Description of Artificial Sequence: Synthetic oligonucleotide
ggtgacggcgcaggggccgt

SEQ ID NO: 360341 - DNA, 21 bp, Artificial Sequence
  Description of Artificial Sequence: Synthetic oligonucleotide
catccgtgtctcggcccggcc

SEQ ID NO: 360342 - DNA, 20 bp, Artificial Sequence
  Description of Artificial Sequence: Synthetic oligonucleotide
gtgacggcgcaggggccgct

SEQ ID NO: 360343 - DNA, 21 bp, Artificial Sequence
  Description of Artificial Sequence: Synthetic oligonucleotide
atccgtgtctcggcccggccg

SEQ ID NO: 360344 - DNA, 20 bp, Artificial Sequence
  Description of Artificial Sequence: Synthetic oligonucleotide
tgacggcgcaggggccgcct

SEQ ID NO: 360345 - DNA, 20 bp, Artificial Sequence
  Description of Artificial Sequence: Synthetic oligonucleotide
tccgtgtctcggcccggccg

SEQ ID NO: 360346 - DNA, 20 bp, Artificial Sequence
  Description of Artificial Sequence: Synthetic oligonucleotide
gacggcgcaggggccgcctt

SEQ ID NO: 360347 - DNA, 20 bp, Artificial Sequence
  Description of Artificial Sequence: Synthetic oligonucleotide
ccgtgtctcggcccggccgt

SEQ ID NO: 360348 - DNA, 21 bp, Artificial Sequence
  Description of Artificial Sequence: Synthetic oligonucleotide
acggcgcaggggccgcctgtt

SEQ ID NO: 360349 - DNA, 20 bp, Artificial Sequence
  Description of Artificial Sequence: Synthetic oligonucleotide
cgtgtctcggcccggccgct

SEQ ID NO: 360350 - DNA, 20 bp, Artificial Sequence
  Description of Artificial Sequence: Synthetic oligonucleotide
cggcgcaggggccgcctgtt

SEQ ID NO: 360351 - DNA, 20 bp, Artificial Sequence
  Description of Artificial Sequence: Synthetic oligonucleotide
gtgtctcggcccggccgcgt

SEQ ID NO: 360352 - DNA, 20 bp, Artificial Sequence
  Description of Artificial Sequence: Synthetic oligonucleotide
ggcgcaggggccgcctgttg

SEQ ID NO: 360353 - DNA, 20 bp, Artificial Sequence
  Description of Artificial Sequence: Synthetic oligonucleotide
tgtctcggcccggccgcggt

SEQ ID NO: 360354 - DNA, 20 bp, Artificial Sequence
  Description of Artificial Sequence: Synthetic oligonucleotide
gcgcaggggccgcctgttgc

SEQ ID NO: 360355 - DNA, 20 bp, Artificial Sequence
  Description of Artificial Sequence: Synthetic oligonucleotide
gtctcggcccggccgcggtt

SEQ ID NO: 360356 - DNA, 20 bp, Artificial Sequence
  Description of Artificial Sequence: Synthetic oligonucleotide
cgcaggggccgcctgttgcc

SEQ ID NO: 360357 - DNA, 20 bp, Artificial Sequence
  Description of Artificial Sequence: Synthetic oligonucleotide
tctcggcccggccgcgggtt

SEQ ID NO: 360358 - DNA, 21 bp, Artificial Sequence
  Description of Artificial Sequence: Synthetic oligonucleotide
gcaggggccgcctgttgccga

SEQ ID NO: 360359 - DNA, 20 bp, Artificial Sequence
  Description of Artificial Sequence: Synthetic oligonucleotide
ctcggcccggccgcgggttt

SEQ ID NO: 360360 - DNA, 23 bp, Artificial Sequence
  Description of Artificial Sequence: Synthetic oligonucleotide
caggggccgcctgttgccgagta

SEQ ID NO: 360361 - DNA, 20 bp, Artificial Sequence
  Description of Artificial Sequence: Synthetic oligonucleotide
tcggcccggccgcggggatt

SEQ ID NO: 360362 - DNA, 24 bp, Artificial Sequence
  Description of Artificial Sequence: Synthetic oligonucleotide
aggggccgcctgttgccgagtact

SEQ ID NO: 360363 - DNA, 27 bp, Artificial Sequence
  Description of Artificial Sequence: Synthetic oligonucleotide
aggatgtatggctgcgacgtggggtca

SEQ ID NO: 360364 - DNA, 23 bp, Artificial Sequence
  Description of Artificial Sequence: Synthetic oligonucleotide
ggggccgcctgttgccgagtact

SEQ ID NO: 360365 - DNA, 26 bp, Artificial Sequence
  Description of Artificial Sequence: Synthetic oligonucleotide
ggatgtatggctgcgacgtggggtca

SEQ ID NO: 360366 - DNA, 23 bp, Artificial Sequence
  Description of Artificial Sequence: Synthetic oligonucleotide
gggccgcctgttgccgagtactg

SEQ ID NO: 360367 - DNA, 27 bp, Artificial Sequence
  Description of Artificial Sequence: Synthetic oligonucleotide
gatgtatggctgcgacgtggggtcaga

SEQ ID NO: 360368 - DNA, 25 bp, Artificial Sequence
  Description of Artificial Sequence: Synthetic oligonucleotide
ggccgcctgttgccgagtactggta

SEQ ID NO: 360369 - DNA, 27 bp, Artificial Sequence
  Description of Artificial Sequence: Synthetic oligonucleotide
atgtatggctgcgacgtggggtcagac

SEQ ID NO: 360370 - DNA, 26 bp, Artificial Sequence
  Description of Artificial Sequence: Synthetic oligonucleotide
gccgcctgttgccgagtactggtaca

SEQ ID NO: 360371 - DNA, 27 bp, Artificial Sequence
  Description of Artificial Sequence: Synthetic oligonucleotide
tgtatggctgcgacgtggggtcagact

SEQ ID NO: 360372 - DNA, 26 bp, Artificial Sequence
  Description of Artificial Sequence: Synthetic oligonucleotide
ccgcctgttgccgagtactggtacag

SEQ ID NO: 360373 - DNA, 26 bp, Artificial Sequence
  Description of Artificial Sequence: Synthetic oligonucleotide
gtatggctgcgacgtggggtcagact

SEQ ID NO: 360374 - DNA, 26 bp, Artificial Sequence
  Description of Artificial Sequence: Synthetic oligonucleotide
cgcctgttgccgagtactggtacagc

SEQ ID NO: 360375 - DNA, 26 bp, Artificial Sequence
  Description of Artificial Sequence: Synthetic oligonucleotide
tatggctgcgacgtggggtcagactg

SEQ ID NO: 360376 - DNA, 27 bp, Artificial Sequence
  Description of Artificial Sequence: Synthetic oligonucleotide
gcctgttgccgagtactggtacagcca

SEQ ID NO: 360377 - DNA, 25 bp, Artificial Sequence
  Description of Artificial Sequence: Synthetic oligonucleotide
atggctgcgacgtggggtcagactg

SEQ ID NO: 360378 - DNA, 27 bp, Artificial Sequence
  Description of Artificial Sequence: Synthetic oligonucleotide
cctgttgccgagtactggtacagccag

SEQ ID NO: 360379 - DNA, 24 bp, Artificial Sequence
  Description of Artificial Sequence: Synthetic oligonucleotide
tggctgcgacgtggggtcagactg

SEQ ID NO: 360380 - DNA, 29 bp, Artificial Sequence
  Description of Artificial Sequence: Synthetic oligonucleotide
ctgttgccgagtactggtacagccagatg

SEQ ID NO: 360381 - DNA, 23 bp, Artificial Sequence
  Description of Artificial Sequence: Synthetic oligonucleotide
ggctgcgacgtggggtcagactg

SEQ ID NO: 360382 - DNA, 29 bp, Artificial Sequence
  Description of Artificial Sequence: Synthetic oligonucleotide
tgttgccgagtactggtacagccagatgg

SEQ ID NO: 360383 - DNA, 23 bp, Artificial Sequence
  Description of Artificial Sequence: Synthetic oligonucleotide
gctgcgacgtggggtcagactgg

SEQ ID NO: 360384 - DNA, 28 bp, Artificial Sequence
  Description of Artificial Sequence: Synthetic oligonucleotide
gttgccgagtactggtacagccagatgg

SEQ ID NO: 360385 - DNA, 23 bp, Artificial Sequence
  Description of Artificial Sequence: Synthetic oligonucleotide
ctgcgacgtggggtcagactggc

SEQ ID NO: 360386 - DNA, 30 bp, Artificial Sequence; identical to SEQ ID NO: 234799
  Description of Artificial Sequence: Synthetic oligonucleotide

SEQ ID NO: 360387 - DNA, 23 bp, Artificial Sequence
  Description of Artificial Sequence: Synthetic oligonucleotide
tgcgacgtggggtcagactggcg

SEQ ID NO: 360388 - DNA, 29 bp, Artificial Sequence
  Description of Artificial Sequence: Synthetic oligonucleotide
tgccgagtactggtacagccagatggaag

SEQ ID NO: 360389 - DNA, 22 bp, Artificial Sequence
  Description of Artificial Sequence: Synthetic oligonucleotide
gcgacgtggggtcagactggcg

SEQ ID NO: 360390 - DNA, 28 bp, Artificial Sequence
  Description of Artificial Sequence: Synthetic oligonucleotide
gccgagtactggtacagccagatggaag

SEQ ID NO: 360391 - DNA, 24 bp, Artificial Sequence
  Description of Artificial Sequence: Synthetic oligonucleotide
cgacgtggggtcagactggcgctt

SEQ ID NO: 360392 - DNA, 29 bp, Artificial Sequence
  Description of Artificial Sequence: Synthetic oligonucleotide
ccgagtactggtacagccagatggaagtc

SEQ ID NO: 360393 - DNA, 24 bp, Artificial Sequence
  Description of Artificial Sequence: Synthetic oligonucleotide
gacgtggggtcagactggcgcttc

SEQ ID NO: 360394 - DNA, 29 bp, Artificial Sequence
  Description of Artificial Sequence: Synthetic oligonucleotide
cgagtactggtacagccagatggaagtcc

SEQ ID NO: 360395 - DNA, 25 bp, Artificial Sequence
  Description of Artificial Sequence: Synthetic oligonucleotide
acgtggggtcagactggcgcttcct

SEQ ID NO: 360396 - DNA, 30 bp, Artificial Sequence; identical to SEQ ID NO: 234804
  Description of Artificial Sequence: Synthetic oligonucleotide

SEQ ID NO: 360397 - DNA, 24 bp, Artificial Sequence
  Description of Artificial Sequence: Synthetic oligonucleotide
cgtggggtcagactggcgcttcct

SEQ ID NO: 360398 - DNA, 30 bp, Artificial Sequence; identical to SEQ ID NO: 234805
  Description of Artificial Sequence: Synthetic oligonucleotide

SEQ ID NO: 360399 - DNA, 24 bp, Artificial Sequence
  Description of Artificial Sequence: Synthetic oligonucleotide
gtggggtcagactggcgcttcctc

SEQ ID NO: 360400 - DNA, 29 bp, Artificial Sequence
  Description of Artificial Sequence: Synthetic oligonucleotide
gtactggtacagccagatggaagtcctcg

SEQ ID NO: 360401 - DNA, 24 bp, Artificial Sequence
  Description of Artificial Sequence: Synthetic oligonucleotide
tggggtcagactggcgcttcctcc

SEQ ID NO: 360402 - DNA, 30 bp, Artificial Sequence; identical to SEQ ID NO: 234807
  Description of Artificial Sequence: Synthetic oligonucleotide

SEQ ID NO: 360403 - DNA, 23 bp, Artificial Sequence
  Description of Artificial Sequence: Synthetic oligonucleotide
ggggtcagactggcgcttcctcc

SEQ ID NO: 360404 - DNA, 29 bp, Artificial Sequence
  Description of Artificial Sequence: Synthetic oligonucleotide
actggtacagccagatggaagtcctcgag

SEQ ID NO: 360405 - DNA, 23 bp, Artificial Sequence
  Description of Artificial Sequence: Synthetic oligonucleotide
gggtcagactggcgcttcctccg

SEQ ID NO: 360406 - DNA, 28 bp, Artificial Sequence
  Description of Artificial Sequence: Synthetic oligonucleotide
ctggtacagccagatggaagtcctcgag

SEQ ID NO: 360407 - DNA, 23 bp, Artificial Sequence
  Description of Artificial Sequence: Synthetic oligonucleotide
ggtcagactggcgcttcctccgc

SEQ ID NO: 360408 - DNA, 28 bp, Artificial Sequence
  Description of Artificial Sequence: Synthetic oligonucleotide
tggtacagccagatggaagtcctcgagg

SEQ ID NO: 360409 - DNA, 23 bp, Artificial Sequence
  Description of Artificial Sequence: Synthetic oligonucleotide
gtcagactggcgcttcctccgcg

SEQ ID NO: 360410 - DNA, 27 bp, Artificial Sequence
  Description of Artificial Sequence: Synthetic oligonucleotide
ggtacagccagatggaagtcctcgagg

SEQ ID NO: 360411 - DNA, 23 bp, Artificial Sequence
  Description of Artificial Sequence: Synthetic oligonucleotide
tcagactggcgcttcctccgcgg

SEQ ID NO: 360412 - DNA, 27 bp, Artificial Sequence
  Description of Artificial Sequence: Synthetic oligonucleotide
gtacagccagatggaagtcctcgaggg

SEQ ID NO: 360413 - DNA, 22 bp, Artificial Sequence
  Description of Artificial Sequence: Synthetic oligonucleotide
cagactggcgcttcctccgcgg

SEQ ID NO: 360414 - DNA, 27 bp, Artificial Sequence
  Description of Artificial Sequence: Synthetic oligonucleotide
tacagccagatggaagtcctcgagggg

SEQ ID NO: 360415 - DNA, 24 bp, Artificial Sequence
  Description of Artificial Sequence: Synthetic oligonucleotide
agactggcgcttcctccgcgggta

SEQ ID NO: 360416 - DNA, 27 bp, Artificial Sequence
  Description of Artificial Sequence: Synthetic oligonucleotide
acagccagatggaagtcctcgagggga

SEQ ID NO: 360417 - DNA, 25 bp, Artificial Sequence
  Description of Artificial Sequence: Synthetic oligonucleotide
gatgtatggctgcgacgtggggtcc

SEQ ID NO: 360418 - DNA, 26 bp, Artificial Sequence
  Description of Artificial Sequence: Synthetic oligonucleotide
cagccagatggaagtcctcgagggga

SEQ ID NO: 360419 - DNA, 26 bp, Artificial Sequence
  Description of Artificial Sequence: Synthetic oligonucleotide
atgtatggctgcgacgtggggtccga

SEQ ID NO: 360420 - DNA, 26 bp, Artificial Sequence
  Description of Artificial Sequence: Synthetic oligonucleotide
agccagatggaagtcctcgaggggac

SEQ ID NO: 360421 - DNA, 25 bp, Artificial Sequence
  Description of Artificial Sequence: Synthetic oligonucleotide
tgtatggctgcgacgtggggtccga

SEQ ID NO: 360422 - DNA, 25 bp, Artificial Sequence
  Description of Artificial Sequence: Synthetic oligonucleotide
gccagatggaagtcctcgaggggac

SEQ ID NO: 360423 - DNA, 24 bp, Artificial Sequence
  Description of Artificial Sequence: Synthetic oligonucleotide
gtatggctgcgacgtggggtccga

SEQ ID NO: 360424 - DNA, 25 bp, Artificial Sequence
  Description of Artificial Sequence: Synthetic oligonucleotide
ccagatggaagtcctcgaggggacc

SEQ ID NO: 360425 - DNA, 25 bp, Artificial Sequence
  Description of Artificial Sequence: Synthetic oligonucleotide
tatggctgcgacgtggggtccgact

SEQ ID NO: 360426 - DNA, 25 bp, Artificial Sequence
  Description of Artificial Sequence: Synthetic oligonucleotide
cagatggaagtcctcgaggggaccg

SEQ ID NO: 360427 - DNA, 24 bp, Artificial Sequence
  Description of Artificial Sequence: Synthetic oligonucleotide
atggctgcgacgtggggtccgact

SEQ ID NO: 360428 - DNA, 25 bp, Artificial Sequence
  Description of Artificial Sequence: Synthetic oligonucleotide
agatggaagtcctcgaggggaccgg

SEQ ID NO: 360429 - DNA, 23 bp, Artificial Sequence
  Description of Artificial Sequence: Synthetic oligonucleotide
tggctgcgacgtggggtccgact

SEQ ID NO: 360430 - DNA, 24 bp, Artificial Sequence
  Description of Artificial Sequence: Synthetic oligonucleotide
gatggaagtcctcgaggggaccgg

SEQ ID NO: 360431 - DNA, 22 bp, Artificial Sequence
  Description of Artificial Sequence: Synthetic oligonucleotide
ggctgcgacgtggggtccgact

SEQ ID NO: 360432 - DNA, 24 bp, Artificial Sequence
  Description of Artificial Sequence: Synthetic oligonucleotide
atggaagtcctcgaggggaccggg

SEQ ID NO: 360433 - DNA, 22 bp, Artificial Sequence
  Description of Artificial Sequence: Synthetic oligonucleotide
gctgcgacgtggggtccgactg

SEQ ID NO: 360434 - DNA, 23 bp, Artificial Sequence
  Description of Artificial Sequence: Synthetic oligonucleotide
tggaagtcctcgaggggaccggg

SEQ ID NO: 360435 - DNA, 22 bp, Artificial Sequence
  Description of Artificial Sequence: Synthetic oligonucleotide
ctgcgacgtggggtccgactgg

SEQ ID NO: 360436 - DNA, 22 bp, Artificial Sequence
  Description of Artificial Sequence: Synthetic oligonucleotide
ggaagtcctcgaggggaccggg

SEQ ID NO: 360437 - DNA, 22 bp, Artificial Sequence
  Description of Artificial Sequence: Synthetic oligonucleotide
tgcgacgtggggtccgactggc

SEQ ID NO: 360438 - DNA, 22 bp, Artificial Sequence
  Description of Artificial Sequence: Synthetic oligonucleotide
gaagtcctcgaggggaccgggg

SEQ ID NO: 360439 - DNA, 21 bp, Artificial Sequence
  Description of Artificial Sequence: Synthetic oligonucleotide
gcgacgtggggtccgactggc

SEQ ID NO: 360440 - DNA, 22 bp, Artificial Sequence
  Description of Artificial Sequence: Synthetic oligonucleotide
aagtcctcgaggggaccggggc

SEQ ID NO: 360441 - DNA, 21 bp, Artificial Sequence
  Description of Artificial Sequence: Synthetic oligonucleotide
cgacgtggggtccgactggcg

SEQ ID NO: 360442 - DNA, 21 bp, Artificial Sequence
  Description of Artificial Sequence: Synthetic oligonucleotide
agtcctcgaggggaccggggc

SEQ ID NO: 360443 - DNA, 23 bp, Artificial Sequence
  Description of Artificial Sequence: Synthetic oligonucleotide
gacgtggggtccgactggcgctt

SEQ ID NO: 360444 - DNA, 20 bp, Artificial Sequence
  Description of Artificial Sequence: Synthetic oligonucleotide
gtcctcgaggggaccggggc

SEQ ID NO: 360445 - DNA, 23 bp, Artificial Sequence
  Description of Artificial Sequence: Synthetic oligonucleotide
acgtggggtccgactggcgcttc

SEQ ID NO: 360446 - DNA, 20 bp, Artificial Sequence
  Description of Artificial Sequence: Synthetic oligonucleotide
tcctcgaggggaccggggcg

SEQ ID NO: 360447 - DNA, 22 bp, Artificial Sequence
  Description of Artificial Sequence: Synthetic oligonucleotide
cgtggggtccgactggcgcttc

SEQ ID NO: 360448 - DNA, 20 bp, Artificial Sequence
  Description of Artificial Sequence: Synthetic oligonucleotide
cctcgaggggaccggggcgt

SEQ ID NO: 360449 - DNA, 23 bp, Artificial Sequence
  Description of Artificial Sequence: Synthetic oligonucleotide
gtggggtccgactggcgcttcct

SEQ ID NO: 360450 - DNA, 20 bp, Artificial Sequence
  Description of Artificial Sequence: Synthetic oligonucleotide
ctcgaggggaccggggcgga

SEQ ID NO: 360451 - DNA, 23 bp, Artificial Sequence
  Description of Artificial Sequence: Synthetic oligonucleotide
tggggtccgactggcgcttcctc

SEQ ID NO: 360452 - DNA, 22 bp, Artificial Sequence
  Description of Artificial Sequence: Synthetic oligonucleotide
tcgaggggaccggggcggagta

SEQ ID NO: 360453 - DNA, 22 bp, Artificial Sequence
  Description of Artificial Sequence: Synthetic oligonucleotide
ggggtccgactggcgcttcctc

SEQ ID NO: 360454 - DNA, 21 bp, Artificial Sequence
  Description of Artificial Sequence: Synthetic oligonucleotide
cgaggggaccggggcggagta

SEQ ID NO: 360455 - DNA, 22 bp, Artificial Sequence
  Description of Artificial Sequence: Synthetic oligonucleotide
gggtccgactggcgcttcctcc

SEQ ID NO: 360456 - DNA, 21 bp, Artificial Sequence
  Description of Artificial Sequence: Synthetic oligonucleotide
gaggggaccggggcggagtag

SEQ ID NO: 360457 - DNA, 22 bp, Artificial Sequence
  Description of Artificial Sequence: Synthetic oligonucleotide
ggtccgactggcgcttcctccg

SEQ ID NO: 360458 - DNA, 22 bp, Artificial Sequence
  Description of Artificial Sequence: Synthetic oligonucleotide
aggggaccggggcggagtagga

SEQ ID NO: 360459 - DNA, 22 bp, Artificial Sequence
  Description of Artificial Sequence: Synthetic oligonucleotide
gtccgactggcgcttcctccgc

SEQ ID NO: 360460 - DNA, 21 bp, Artificial Sequence
  Description of Artificial Sequence: Synthetic oligonucleotide
ggggaccggggcggagtagga

SEQ ID NO: 360461 - DNA, 22 bp, Artificial Sequence
  Description of Artificial Sequence: Synthetic oligonucleotide
tccgactggcgcttcctccgcg

SEQ ID NO: 360462 - DNA, 22 bp, Artificial Sequence
  Description of Artificial Sequence: Synthetic oligonucleotide
gggaccggggcggagtaggaca

SEQ ID NO: 360463 - DNA, 21 bp, Artificial Sequence
  Description of Artificial Sequence: Synthetic oligonucleotide
ccgactggcgcttcctccgcg

SEQ ID NO: 360464 - DNA, 22 bp, Artificial Sequence
  Description of Artificial Sequence: Synthetic oligonucleotide
ggaccggggcggagtaggacac

SEQ ID NO: 360465 - DNA, 21 bp, Artificial Sequence
  Description of Artificial Sequence: Synthetic oligonucleotide
cgactggcgcttcctccgcgg

SEQ ID NO: 360466 - DNA, 22 bp, Artificial Sequence
  Description of Artificial Sequence: Synthetic oligonucleotide
gaccggggcggagtaggacacg

SEQ ID NO: 360467 - DNA, 22 bp, Artificial Sequence
  Description of Artificial Sequence: Synthetic oligonucleotide
aggatggagccgcgggcgccat

SEQ ID NO: 360468 - DNA, 23 bp, Artificial Sequence
  Description of Artificial Sequence: Synthetic oligonucleotide
accggggcggagtaggacacggt

SEQ ID NO: 360469 - DNA, 21 bp, Artificial Sequence
  Description of Artificial Sequence: Synthetic oligonucleotide
ggatggagccgcgggcgccat

SEQ ID NO: 360470 - DNA, 22 bp, Artificial Sequence
  Description of Artificial Sequence: Synthetic oligonucleotide
ccggggcggagtaggacacggt

SEQ ID NO: 360471 - DNA, 21 bp, Artificial Sequence
  Description of Artificial Sequence: Synthetic oligonucleotide
gatggagccgcgggcgccatg

SEQ ID NO: 360472 - DNA, 23 bp, Artificial Sequence
  Description of Artificial Sequence: Synthetic oligonucleotide
cggggcggagtaggacacggtct

SEQ ID NO: 360473 - DNA, 24 bp, Artificial Sequence
  Description of Artificial Sequence: Synthetic oligonucleotide
atggagccgcgggcgccatggata

SEQ ID NO: 360474 - DNA, 23 bp, Artificial Sequence
  Description of Artificial Sequence: Synthetic oligonucleotide
ggggcggagtaggacacggtctg

SEQ ID NO: 360475 - DNA, 23 bp, Artificial Sequence
  Description of Artificial Sequence: Synthetic oligonucleotide
tggagccgcgggcgccatggata

SEQ ID NO: 360476 - DNA, 24 bp, Artificial Sequence
  Description of Artificial Sequence: Synthetic oligonucleotide
gggcggagtaggacacggtctgca

SEQ ID NO: 360477 - DNA, 22 bp, Artificial Sequence
  Description of Artificial Sequence: Synthetic oligonucleotide
ggagccgcgggcgccatggata

SEQ ID NO: 360478 - DNA, 25 bp, Artificial Sequence
  Description of Artificial Sequence: Synthetic oligonucleotide
ggcggagtaggacacggtctgcaga

SEQ ID NO: 360479 - DNA, 23 bp, Artificial Sequence
  Description of Artificial Sequence: Synthetic oligonucleotide
gagccgcgggcgccatggataga

SEQ ID NO: 360480 - DNA, 26 bp, Artificial Sequence
  Description of Artificial Sequence: Synthetic oligonucleotide
gcggagtaggacacggtctgcagaca

SEQ ID NO: 360481 - DNA, 23 bp, Artificial Sequence
  Description of Artificial Sequence: Synthetic oligonucleotide
agccgcgggcgccatggatagag

SEQ ID NO: 360482 - DNA, 27 bp, Artificial Sequence
  Description of Artificial Sequence: Synthetic oligonucleotide
cggagtaggacacggtctgcagacact

SEQ ID NO: 360483 - DNA, 22 bp, Artificial Sequence
  Description of Artificial Sequence: Synthetic oligonucleotide
gccgcgggcgccatggatagag

SEQ ID NO: 360484 - DNA, 28 bp, Artificial Sequence
  Description of Artificial Sequence: Synthetic oligonucleotide
ggagtaggacacggtctgcagacactac

SEQ ID NO: 360485 - DNA, 23 bp, Artificial Sequence
  Description of Artificial Sequence: Synthetic oligonucleotide
ccgcgggcgccatggatagagca

SEQ ID NO: 360486 - DNA, 30 bp, Artificial Sequence; identical to SEQ ID NO: 234849
  Description of Artificial Sequence: Synthetic oligonucleotide

SEQ ID NO: 360487 - DNA, 23 bp, Artificial Sequence
  Description of Artificial Sequence: Synthetic oligonucleotide
cgcgggcgccatggatagagcag

SEQ ID NO: 360488 - DNA, 30 bp, Artificial Sequence; identical to SEQ ID NO: 234850
  Description of Artificial Sequence: Synthetic oligonucleotide

SEQ ID NO: 360489 - DNA, 24 bp, Artificial Sequence
  Description of Artificial Sequence: Synthetic oligonucleotide
gcgggcgccatggatagagcagga

SEQ ID NO: 360490 - DNA, 29 bp, Artificial Sequence
  Description of Artificial Sequence: Synthetic oligonucleotide
gtaggacacggtctgcagacactactacg

SEQ ID NO: 360491 - DNA, 24 bp, Artificial Sequence
  Description of Artificial Sequence: Synthetic oligonucleotide
cgggcgccatggatagagcaggag

SEQ ID NO: 360492 - DNA, 30 bp, Artificial Sequence; identical to SEQ ID NO: 234852
  Description of Artificial Sequence: Synthetic oligonucleotide

SEQ ID NO: 360493 - DNA, 24 bp, Artificial Sequence
  Description of Artificial Sequence: Synthetic oligonucleotide
gggcgccatggatagagcaggagg

SEQ ID NO: 360494 - DNA, 29 bp, Artificial Sequence
  Description of Artificial Sequence: Synthetic oligonucleotide
aggacacggtctgcagacactactacgag

SEQ ID NO: 360495 - DNA, 25 bp, Artificial Sequence
  Description of Artificial Sequence: Synthetic oligonucleotide
ggcgccatggatagagcaggagggt

SEQ ID NO: 360496 - DNA, 28 bp, Artificial Sequence
  Description of Artificial Sequence: Synthetic oligonucleotide
ggacacggtctgcagacactactacgag

SEQ ID NO: 360497 - DNA, 25 bp, Artificial Sequence
  Description of Artificial Sequence: Synthetic oligonucleotide
gcgccatggatagagcaggagggtc

SEQ ID NO: 360498 - DNA, 28 bp, Artificial Sequence
  Description of Artificial Sequence: Synthetic oligonucleotide
gacacggtctgcagacactactacgagg

SEQ ID NO: 360499 - DNA, 25 bp, Artificial Sequence
  Description of Artificial Sequence: Synthetic oligonucleotide
cgccatggatagagcaggagggtcc

SEQ ID NO: 360500 - DNA, 29 bp, Artificial Sequence
  Description of Artificial Sequence: Synthetic oligonucleotide
acacggtctgcagacactactacgaggag

SEQ ID NO: 360501 - DNA, 25 bp, Artificial Sequence
  Description of Artificial Sequence: Synthetic oligonucleotide
gccatggatagagcaggagggtccg

SEQ ID NO: 360502 - DNA, 28 bp, Artificial Sequence
  Description of Artificial Sequence: Synthetic oligonucleotide
cacggtctgcagacactactacgaggag

SEQ ID NO: 360503 - DNA, 26 bp, Artificial Sequence
  Description of Artificial Sequence: Synthetic oligonucleotide
ccatggatagagcaggagggtccgga

SEQ ID NO: 360504 - DNA, 28 bp, Artificial Sequence
  Description of Artificial Sequence: Synthetic oligonucleotide
acggtctgcagacactactacgaggagg

SEQ ID NO: 360505 - DNA, 27 bp, Artificial Sequence
  Description of Artificial Sequence: Synthetic oligonucleotide
catggatagagcaggagggtccggagt

SEQ ID NO: 360506 - DNA, 27 bp, Artificial Sequence
  Description of Artificial Sequence: Synthetic oligonucleotide
cggtctgcagacactactacgaggagg

SEQ ID NO: 360507 - DNA, 30 bp, Artificial Sequence; identical to SEQ ID NO: 4238
  Description of Artificial Sequence: Synthetic oligonucleotide

SEQ ID NO: 360508 - DNA, 27 bp, Artificial Sequence
  Description of Artificial Sequence: Synthetic oligonucleotide
ggtctgcagacactactacgaggaggg

SEQ ID NO: 360509 - DNA, 27 bp, Artificial Sequence
  Description of Artificial Sequence: Synthetic oligonucleotide
cagaccaccaagcacaagtgggaggca

SEQ ID NO: 360510 - DNA, 27 bp, Artificial Sequence
  Description of Artificial Sequence: Synthetic oligonucleotide
gtctgcagacactactacgaggagggg

SEQ ID NO: 360511 - DNA, 27 bp, Artificial Sequence
  Description of Artificial Sequence: Synthetic oligonucleotide
agaccaccaagcacaagtgggaggcag

SEQ ID NO: 360512 - DNA, 29 bp, Artificial Sequence
  Description of Artificial Sequence: Synthetic oligonucleotide
tctgcagacactactacgaggaggggtac

SEQ ID NO: 360513 - DNA, 26 bp, Artificial Sequence
  Description of Artificial Sequence: Synthetic oligonucleotide
gaccaccaagcacaagtgggaggcag

SEQ ID NO: 360514 - DNA, 28 bp, Artificial Sequence
  Description of Artificial Sequence: Synthetic oligonucleotide
ctgcagacactactacgaggaggggtac

SEQ ID NO: 360515 - DNA, 26 bp, Artificial Sequence
  Description of Artificial Sequence: Synthetic oligonucleotide
accaccaagcacaagtgggaggcagc

SEQ ID NO: 360516 - DNA, 28 bp, Artificial Sequence
  Description of Artificial Sequence: Synthetic oligonucleotide
tgcagacactactacgaggaggggtacc

SEQ ID NO: 360517 - DNA, 25 bp, Artificial Sequence
  Description of Artificial Sequence: Synthetic oligonucleotide
ccaccaagcacaagtgggaggcagc

SEQ ID NO: 360518 - DNA, 27 bp, Artificial Sequence
  Description of Artificial Sequence: Synthetic oligonucleotide
gcagacactactacgaggaggggtacc

SEQ ID NO: 360519 - DNA, 25 bp, Artificial Sequence
  Description of Artificial Sequence: Synthetic oligonucleotide
caccaagcacaagtgggaggcagcc

SEQ ID NO: 360520 - DNA, 27 bp, Artificial Sequence
  Description of Artificial Sequence: Synthetic oligonucleotide
cagacactactacgaggaggggtaccg

SEQ ID NO: 360521 - DNA, 27 bp, Artificial Sequence
  Description of Artificial Sequence: Synthetic oligonucleotide
accaagcacaagtgggaggcagcccat

SEQ ID NO: 360522 - DNA, 27 bp, Artificial Sequence
  Description of Artificial Sequence: Synthetic oligonucleotide
agacactactacgaggaggggtaccgg

SEQ ID NO: 360523 - DNA, 26 bp, Artificial Sequence
  Description of Artificial Sequence: Synthetic oligonucleotide
ccaagcacaagtgggaggcagcccat

SEQ ID NO: 360524 - DNA, 26 bp, Artificial Sequence
  Description of Artificial Sequence: Synthetic oligonucleotide
gacactactacgaggaggggtaccgg

SEQ ID NO: 360525 - DNA, 27 bp, Artificial Sequence
  Description of Artificial Sequence: Synthetic oligonucleotide
caagcacaagtgggaggcagcccatgt

SEQ ID NO: 360526 - DNA, 26 bp, Artificial Sequence
  Description of Artificial Sequence: Synthetic oligonucleotide
acactactacgaggaggggtaccggg

SEQ ID NO: 360527 - DNA, 27 bp, Artificial Sequence
  Description of Artificial Sequence: Synthetic oligonucleotide
aagcacaagtgggaggcagcccatgtg

SEQ ID NO: 360528 - DNA, 25 bp, Artificial Sequence
  Description of Artificial Sequence: Synthetic oligonucleotide
cactactacgaggaggggtaccggg

SEQ ID NO: 360529 - DNA, 26 bp, Artificial Sequence
  Description of Artificial Sequence: Synthetic oligonucleotide
agcacaagtgggaggcagcccatgtg

SEQ ID NO: 360530 - DNA, 25 bp, Artificial Sequence
  Description of Artificial Sequence: Synthetic oligonucleotide
actactacgaggaggggtaccgggg

SEQ ID NO: 360531 - DNA, 25 bp, Artificial Sequence
  Description of Artificial Sequence: Synthetic oligonucleotide
gcacaagtgggaggcagcccatgtg

SEQ ID NO: 360532 - DNA, 24 bp, Artificial Sequence
  Description of Artificial Sequence: Synthetic oligonucleotide
ctactacgaggaggggtaccgggg

SEQ ID NO: 360533 - DNA, 25 bp, Artificial Sequence
  Description of Artificial Sequence: Synthetic oligonucleotide
cacaagtgggaggcagcccatgtgg

SEQ ID NO: 360534 - DNA, 26 bp, Artificial Sequence
  Description of Artificial Sequence: Synthetic oligonucleotide
tactacgaggaggggtaccgggggat

SEQ ID NO: 360535 - DNA, 25 bp, Artificial Sequence
  Description of Artificial Sequence: Synthetic oligonucleotide
acaagtgggaggcagcccatgtggc

SEQ ID NO: 360536 - DNA, 25 bp, Artificial Sequence
  Description of Artificial Sequence: Synthetic oligonucleotide
actacgaggaggggtaccgggggat

SEQ ID NO: 360537 - DNA, 24 bp, Artificial Sequence
  Description of Artificial Sequence: Synthetic oligonucleotide
caagtgggaggcagcccatgtggc

SEQ ID NO: 360538 - DNA, 24 bp, Artificial Sequence
  Description of Artificial Sequence: Synthetic oligonucleotide
ctacgaggaggggtaccgggggat

SEQ ID NO: 360539 - DNA, 24 bp, Artificial Sequence
  Description of Artificial Sequence: Synthetic oligonucleotide
aagtgggaggcagcccatgtggcg

SEQ ID NO: 360540 - DNA, 24 bp, Artificial Sequence
  Description of Artificial Sequence: Synthetic oligonucleotide
tacgaggaggggtaccgggggatc

SEQ ID NO: 360541 - DNA, 23 bp, Artificial Sequence
  Description of Artificial Sequence: Synthetic oligonucleotide
agtgggaggcagcccatgtggcg

SEQ ID NO: 360542 - DNA, 23 bp, Artificial Sequence
  Description of Artificial Sequence: Synthetic oligonucleotide
acgaggaggggtaccgggggatc

SEQ ID NO: 360543 - DNA, 22 bp, Artificial Sequence
  Description of Artificial Sequence: Synthetic oligonucleotide
gtgggaggcagcccatgtggcg

SEQ ID NO: 360544 - DNA, 22 bp, Artificial Sequence
  Description of Artificial Sequence: Synthetic oligonucleotide
cgaggaggggtaccgggggatc

SEQ ID NO: 360545 - DNA, 23 bp, Artificial Sequence
  Description of Artificial Sequence: Synthetic oligonucleotide
tgggaggcagcccatgtggcgga

SEQ ID NO: 360546 - DNA, 23 bp, Artificial Sequence
  Description of Artificial Sequence: Synthetic oligonucleotide
gaggaggggtaccgggggatcct

SEQ ID NO: 360547 - DNA, 22 bp, Artificial Sequence
  Description of Artificial Sequence: Synthetic oligonucleotide
gggaggcagcccatgtggcgga

SEQ ID NO: 360548 - DNA, 23 bp, Artificial Sequence
  Description of Artificial Sequence: Synthetic oligonucleotide
aggaggggtaccgggggatcctg

SEQ ID NO: 360549 - DNA, 22 bp, Artificial Sequence
  Description of Artificial Sequence: Synthetic oligonucleotide
ggaggcagcccatgtggcggag

SEQ ID NO: 360550 - DNA, 22 bp, Artificial Sequence
  Description of Artificial Sequence: Synthetic oligonucleotide
ggaggggtaccgggggatcctg

SEQ ID NO: 360551 - DNA, 23 bp, Artificial Sequence
  Description of Artificial Sequence: Synthetic oligonucleotide
gaggcagcccatgtggcggagca

SEQ ID NO: 360552 - DNA, 23 bp, Artificial Sequence
  Description of Artificial Sequence: Synthetic oligonucleotide
gaggggtaccgggggatcctgga

SEQ ID NO: 360553 - DNA, 25 bp, Artificial Sequence
  Description of Artificial Sequence: Synthetic oligonucleotide
aggcagcccatgtggcggagcagtt

SEQ ID NO: 360554 - DNA, 24 bp, Artificial Sequence
  Description of Artificial Sequence: Synthetic oligonucleotide
aggggtaccgggggatcctggaga

SEQ ID NO: 360555 - DNA, 24 bp, Artificial Sequence
  Description of Artificial Sequence: Synthetic oligonucleotide
ggcagcccatgtggcggagcagtt

SEQ ID NO: 360556 - DNA, 23 bp, Artificial Sequence
  Description of Artificial Sequence: Synthetic oligonucleotide
ggggtaccgggggatcctggaga

SEQ ID NO: 360557 - DNA, 25 bp, Artificial Sequence
  Description of Artificial Sequence: Synthetic oligonucleotide
gcagcccatgtggcggagcagttga

SEQ ID NO: 360558 - DNA, 23 bp, Artificial Sequence
  Description of Artificial Sequence: Synthetic oligonucleotide
gggtaccgggggatcctggagag

SEQ ID NO: 360559 - DNA, 26 bp, Artificial Sequence
  Description of Artificial Sequence: Synthetic oligonucleotide
cagcccatgtggcggagcagttgaga

SEQ ID NO: 360560 - DNA, 24 bp, Artificial Sequence
  Description of Artificial Sequence: Synthetic oligonucleotide
ggtaccgggggatcctggagagga

SEQ ID NO: 360561 - DNA, 26 bp, Artificial Sequence
  Description of Artificial Sequence: Synthetic oligonucleotide
agcccatgtggcggagcagttgagag

SEQ ID NO: 360562 - DNA, 25 bp, Artificial Sequence
  Description of Artificial Sequence: Synthetic oligonucleotide
gtaccgggggatcctggagaggaga

SEQ ID NO: 360563 - DNA, 28 bp, Artificial Sequence
  Description of Artificial Sequence: Synthetic oligonucleotide
cagatacctggagaacgggaaggagacc

SEQ ID NO: 360564 - DNA, 26 bp, Artificial Sequence
  Description of Artificial Sequence: Synthetic oligonucleotide
taccgggggatcctggagaggagaga

SEQ ID NO: 360565 - DNA, 28 bp, Artificial Sequence
  Description of Artificial Sequence: Synthetic oligonucleotide
agatacctggagaacgggaaggagaccc

SEQ ID NO: 360566 - DNA, 25 bp, Artificial Sequence
  Description of Artificial Sequence: Synthetic oligonucleotide
accgggggatcctggagaggagaga

SEQ ID NO: 360567 - DNA, 27 bp, Artificial Sequence
  Description of Artificial Sequence: Synthetic oligonucleotide
gatacctggagaacgggaaggagaccc

SEQ ID NO: 360568 - DNA, 24 bp, Artificial Sequence
  Description of Artificial Sequence: Synthetic oligonucleotide
ccgggggatcctggagaggagaga

SEQ ID NO: 360569 - DNA, 28 bp, Artificial Sequence
  Description of Artificial Sequence: Synthetic oligonucleotide
atacctggagaacgggaaggagaccctg

SEQ ID NO: 360570 - DNA, 24 bp, Artificial Sequence
  Description of Artificial Sequence: Synthetic oligonucleotide
cgggggatcctggagaggagagag

SEQ ID NO: 360571 - DNA, 27 bp, Artificial Sequence
  Description of Artificial Sequence: Synthetic oligonucleotide
tacctggagaacgggaaggagaccctg

SEQ ID NO: 360572 - DNA, 25 bp, Artificial Sequence
  Description of Artificial Sequence: Synthetic oligonucleotide
gggggatcctggagaggagagagga

SEQ ID NO: 360573 - DNA, 26 bp, Artificial Sequence
  Description of Artificial Sequence: Synthetic oligonucleotide
acctggagaacgggaaggagaccctg

SEQ ID NO: 360574 - DNA, 25 bp, Artificial Sequence
  Description of Artificial Sequence: Synthetic oligonucleotide
ggggatcctggagaggagagaggag

SEQ ID NO: 360575 - DNA, 25 bp, Artificial Sequence
  Description of Artificial Sequence: Synthetic oligonucleotide
cctggagaacgggaaggagaccctg

SEQ ID NO: 360576 - DNA, 25 bp, Artificial Sequence
  Description of Artificial Sequence: Synthetic oligonucleotide
gggatcctggagaggagagaggagc

SEQ ID NO: 360577 - DNA, 26 bp, Artificial Sequence
  Description of Artificial Sequence: Synthetic oligonucleotide
ctggagaacgggaaggagaccctgca

SEQ ID NO: 360578 - DNA, 25 bp, Artificial Sequence
  Description of Artificial Sequence: Synthetic oligonucleotide
ggatcctggagaggagagaggagcc

SEQ ID NO: 360579 - DNA, 26 bp, Artificial Sequence
  Description of Artificial Sequence: Synthetic oligonucleotide
tggagaacgggaaggagaccctgcag

SEQ ID NO: 360580 - DNA, 26 bp, Artificial Sequence
  Description of Artificial Sequence: Synthetic oligonucleotide
gatcctggagaggagagaggagccca

SEQ ID NO: 360581 - DNA, 25 bp, Artificial Sequence
  Description of Artificial Sequence: Synthetic oligonucleotide
ggagaacgggaaggagaccctgcag

SEQ ID NO: 360582 - DNA, 26 bp, Artificial Sequence
  Description of Artificial Sequence: Synthetic oligonucleotide
atcctggagaggagagaggagcccac

SEQ ID NO: 360583 - DNA, 25 bp, Artificial Sequence
  Description of Artificial Sequence: Synthetic oligonucleotide
gagaacgggaaggagaccctgcagc

SEQ ID NO: 360584 - DNA, 25 bp, Artificial Sequence
  Description of Artificial Sequence: Synthetic oligonucleotide
tcctggagaggagagaggagcccac

SEQ ID NO: 360585 - DNA, 25 bp, Artificial Sequence
  Description of Artificial Sequence: Synthetic oligonucleotide
agaacgggaaggagaccctgcagcg

SEQ ID NO: 360586 - DNA, 24 bp, Artificial Sequence
  Description of Artificial Sequence: Synthetic oligonucleotide
cctggagaggagagaggagcccac

SEQ ID NO: 360587 - DNA, 24 bp, Artificial Sequence
  Description of Artificial Sequence: Synthetic oligonucleotide
gaacgggaaggagaccctgcagcg

SEQ ID NO: 360588 - DNA, 24 bp, Artificial Sequence
  Description of Artificial Sequence: Synthetic oligonucleotide
ctggagaggagagaggagcccacc

SEQ ID NO: 360589 - DNA, 25 bp, Artificial Sequence
  Description of Artificial Sequence: Synthetic oligonucleotide
aacgggaaggagaccctgcagcgca

SEQ ID NO: 360590 - DNA, 25 bp, Artificial Sequence
  Description of Artificial Sequence: Synthetic oligonucleotide
tggagaggagagaggagcccaccgt

SEQ ID NO: 360591 - DNA, 24 bp, Artificial Sequence
  Description of Artificial Sequence: Synthetic oligonucleotide
acgggaaggagaccctgcagcgca

SEQ ID NO: 360592 - DNA, 24 bp, Artificial Sequence
  Description of Artificial Sequence: Synthetic oligonucleotide
ggagaggagagaggagcccaccgt

SEQ ID NO: 360593 - DNA, 23 bp, Artificial Sequence
  Description of Artificial Sequence: Synthetic oligonucleotide
cgggaaggagaccctgcagcgca

SEQ ID NO: 360594 - DNA, 25 bp, Artificial Sequence
  Description of Artificial Sequence: Synthetic oligonucleotide
gagaggagagaggagcccaccgtga

SEQ ID NO: 360595 - DNA, 23 bp, Artificial Sequence
  Description of Artificial Sequence: Synthetic oligonucleotide
gggaaggagaccctgcagcgcac

SEQ ID NO: 360596 - DNA, 25 bp, Artificial Sequence
  Description of Artificial Sequence: Synthetic oligonucleotide
agaggagagaggagcccaccgtgac

SEQ ID NO: 360597 - DNA, 23 bp, Artificial Sequence
  Description of Artificial Sequence: Synthetic oligonucleotide
ggaaggagaccctgcagcgcacg

SEQ ID NO: 360598 - DNA, 24 bp, Artificial Sequence
  Description of Artificial Sequence: Synthetic oligonucleotide
gaggagagaggagcccaccgtgac

SEQ ID NO: 360599 - DNA, 23 bp, Artificial Sequence
  Description of Artificial Sequence: Synthetic oligonucleotide
gaaggagaccctgcagcgcacgg

SEQ ID NO: 360600 - DNA, 26 bp, Artificial Sequence
  Description of Artificial Sequence: Synthetic oligonucleotide
aggagagaggagcccaccgtgaccat

SEQ ID NO: 360601 - DNA, 23 bp, Artificial Sequence
  Description of Artificial Sequence: Synthetic oligonucleotide
gactggcgcttcctccgcggcta

SEQ ID NO: 360602 - DNA, 25 bp, Artificial Sequence
  Description of Artificial Sequence: Synthetic oligonucleotide
ggagagaggagcccaccgtgaccat

SEQ ID NO: 360603 - DNA, 23 bp, Artificial Sequence
  Description of Artificial Sequence: Synthetic oligonucleotide
actggcgcttcctccgcggctac

SEQ ID NO: 360604 - DNA, 26 bp, Artificial Sequence
  Description of Artificial Sequence: Synthetic oligonucleotide
gagagaggagcccaccgtgaccatca

SEQ ID NO: 360605 - DNA, 22 bp, Artificial Sequence
  Description of Artificial Sequence: Synthetic oligonucleotide
ctggcgcttcctccgcggctac

SEQ ID NO: 360606 - DNA, 26 bp, Artificial Sequence
  Description of Artificial Sequence: Synthetic oligonucleotide
agagaggagcccaccgtgaccatcac

SEQ ID NO: 360607 - DNA, 23 bp, Artificial Sequence
  Description of Artificial Sequence: Synthetic oligonucleotide
tggcgcttcctccgcggctacca

SEQ ID NO: 360608 - DNA, 25 bp, Artificial Sequence
  Description of Artificial Sequence: Synthetic oligonucleotide
gagaggagcccaccgtgaccatcac

SEQ ID NO: 360609 - DNA, 22 bp, Artificial Sequence
  Description of Artificial Sequence: Synthetic oligonucleotide
ggcgcttcctccgcggctacca

SEQ ID NO: 360610 - DNA, 25 bp, Artificial Sequence
  Description of Artificial Sequence: Synthetic oligonucleotide
agaggagcccaccgtgaccatcacc

SEQ ID NO: 360611 - DNA, 22 bp, Artificial Sequence
  Description of Artificial Sequence: Synthetic oligonucleotide
gcgcttcctccgcggctaccac

SEQ ID NO: 360612 - DNA, 24 bp, Artificial Sequence
  Description of Artificial Sequence: Synthetic oligonucleotide
gaggagcccaccgtgaccatcacc

SEQ ID NO: 360613 - DNA, 23 bp, Artificial Sequence
  Description of Artificial Sequence: Synthetic oligonucleotide
cgcttcctccgcggctaccacca

SEQ ID NO: 360614 - DNA, 24 bp, Artificial Sequence
  Description of Artificial Sequence: Synthetic oligonucleotide
aggagcccaccgtgaccatcaccc

SEQ ID NO: 360615 - DNA, 25 bp, Artificial Sequence
  Description of Artificial Sequence: Synthetic oligonucleotide
gcttcctccgcggctaccaccagta

SEQ ID NO: 360616 - DNA, 23 bp, Artificial Sequence
  Description of Artificial Sequence: Synthetic oligonucleotide
ggagcccaccgtgaccatcaccc

SEQ ID NO: 360617 - DNA, 25 bp, Artificial Sequence
  Description of Artificial Sequence: Synthetic oligonucleotide
cttcctccgcggctaccaccagtac

SEQ ID NO: 360618 - DNA, 25 bp, Artificial Sequence
  Description of Artificial Sequence: Synthetic oligonucleotide
gagcccaccgtgaccatcaccccat

SEQ ID NO: 360619 - DNA, 25 bp, Artificial Sequence
  Description of Artificial Sequence: Synthetic oligonucleotide
ttcctccgcggctaccaccagtacg

SEQ ID NO: 360620 - DNA, 25 bp, Artificial Sequence
  Description of Artificial Sequence: Synthetic oligonucleotide
agcccaccgtgaccatcaccccatc

SEQ ID NO: 360621 - DNA, 24 bp, Artificial Sequence
  Description of Artificial Sequence: Synthetic oligonucleotide
tcctccgcggctaccaccagtacg

SEQ ID NO: 360622 - DNA, 24 bp, Artificial Sequence
  Description of Artificial Sequence: Synthetic oligonucleotide
gcccaccgtgaccatcaccccatc

SEQ ID NO: 360623 - DNA, 23 bp, Artificial Sequence
  Description of Artificial Sequence: Synthetic oligonucleotide
cctccgcggctaccaccagtacg

SEQ ID NO: 360624 - DNA, 25 bp, Artificial Sequence
  Description of Artificial Sequence: Synthetic oligonucleotide
cccaccgtgaccatcaccccatcca

SEQ ID NO: 360625 - DNA, 23 bp, Artificial Sequence
  Description of Artificial Sequence: Synthetic oligonucleotide
ctccgcggctaccaccagtacgc

SEQ ID NO: 360626 - DNA, 25 bp, Artificial Sequence
  Description of Artificial Sequence: Synthetic oligonucleotide
ccaccgtgaccatcaccccatccac

SEQ ID NO: 360627 - DNA, 25 bp, Artificial Sequence
  Description of Artificial Sequence: Synthetic oligonucleotide
tccgcggctaccaccagtacgccta

SEQ ID NO: 360628 - DNA, 26 bp, Artificial Sequence
  Description of Artificial Sequence: Synthetic oligonucleotide
caccgtgaccatcaccccatccacga

SEQ ID NO: 360629 - DNA, 24 bp, Artificial Sequence
  Description of Artificial Sequence: Synthetic oligonucleotide
ccgcggctaccaccagtacgccta

SEQ ID NO: 360630 - DNA, 27 bp, Artificial Sequence
  Description of Artificial Sequence: Synthetic oligonucleotide
accgtgaccatcaccccatccacgaca

SEQ ID NO: 360631 - DNA, 24 bp, Artificial Sequence
  Description of Artificial Sequence: Synthetic oligonucleotide
cgcggctaccaccagtacgcctac

SEQ ID NO: 360632 - DNA, 26 bp, Artificial Sequence
  Description of Artificial Sequence: Synthetic oligonucleotide
ccgtgaccatcaccccatccacgaca

SEQ ID NO: 360633 - DNA, 25 bp, Artificial Sequence
  Description of Artificial Sequence: Synthetic oligonucleotide
gcggctaccaccagtacgcctacga

SEQ ID NO: 360634 - DNA, 27 bp, Artificial Sequence
  Description of Artificial Sequence: Synthetic oligonucleotide
cgtgaccatcaccccatccacgacaga

SEQ ID NO: 360635 - DNA, 25 bp, Artificial Sequence
  Description of Artificial Sequence: Synthetic oligonucleotide
cggctaccaccagtacgcctacgac

SEQ ID NO: 360636 - DNA, 27 bp, Artificial Sequence
  Description of Artificial Sequence: Synthetic oligonucleotide
gtgaccatcaccccatccacgacagag

SEQ ID NO: 360637 - DNA, 25 bp, Artificial Sequence
  Description of Artificial Sequence: Synthetic oligonucleotide
ggctaccaccagtacgcctacgacg

SEQ ID NO: 360638 - DNA, 27 bp, Artificial Sequence
  Description of Artificial Sequence: Synthetic oligonucleotide
tgaccatcaccccatccacgacagagg

SEQ ID NO: 360639 - DNA, 25 bp, Artificial Sequence
  Description of Artificial Sequence: Synthetic oligonucleotide
gctaccaccagtacgcctacgacgg

SEQ ID NO: 360640 - DNA, 26 bp, Artificial Sequence
  Description of Artificial Sequence: Synthetic oligonucleotide
gaccatcaccccatccacgacagagg

SEQ ID NO: 360641 - DNA, 27 bp, Artificial Sequence
  Description of Artificial Sequence: Synthetic oligonucleotide
ctaccaccagtacgcctacgacggcaa

SEQ ID NO: 360642 - DNA, 26 bp, Artificial Sequence
  Description of Artificial Sequence: Synthetic oligonucleotide
accatcaccccatccacgacagaggc

SEQ ID NO: 360643 - DNA, 27 bp, Artificial Sequence
  Description of Artificial Sequence: Synthetic oligonucleotide
gagtattgggacggggagacacggaag

SEQ ID NO: 360644 - DNA, 25 bp, Artificial Sequence
  Description of Artificial Sequence: Synthetic oligonucleotide
ccatcaccccatccacgacagaggc

SEQ ID NO: 360645 - DNA, 27 bp, Artificial Sequence
  Description of Artificial Sequence: Synthetic oligonucleotide
agtattgggacggggagacacggaagg

SEQ ID NO: 360646 - DNA, 25 bp, Artificial Sequence
  Description of Artificial Sequence: Synthetic oligonucleotide
catcaccccatccacgacagaggcg

SEQ ID NO: 360647 - DNA, 27 bp, Artificial Sequence
  Description of Artificial Sequence: Synthetic oligonucleotide
gtattgggacggggagacacggaaggt

SEQ ID NO: 360648 - DNA, 26 bp, Artificial Sequence
  Description of Artificial Sequence: Synthetic oligonucleotide
atcaccccatccacgacagaggcgct

SEQ ID NO: 360649 - DNA, 27 bp, Artificial Sequence
  Description of Artificial Sequence: Synthetic oligonucleotide
tattgggacggggagacacggaaggtg

SEQ ID NO: 360650 - DNA, 25 bp, Artificial Sequence
  Description of Artificial Sequence: Synthetic oligonucleotide
tcaccccatccacgacagaggcgct

SEQ ID NO: 360651 - DNA, 27 bp, Artificial Sequence
  Description of Artificial Sequence: Synthetic oligonucleotide
attgggacggggagacacggaaggtga

SEQ ID NO: 360652 - DNA, 24 bp, Artificial Sequence
  Description of Artificial Sequence: Synthetic oligonucleotide
caccccatccacgacagaggcgct

SEQ ID NO: 360653 - DNA, 27 bp, Artificial Sequence
  Description of Artificial Sequence: Synthetic oligonucleotide
ttgggacggggagacacggaaggtgaa

SEQ ID NO: 360654 - DNA, 26 bp, Artificial Sequence
  Description of Artificial Sequence: Synthetic oligonucleotide
accccatccacgacagaggcgctcaa

SEQ ID NO: 360655 - DNA, 26 bp, Artificial Sequence
  Description of Artificial Sequence: Synthetic oligonucleotide
tgggacggggagacacggaaggtgaa

SEQ ID NO: 360656 - DNA, 25 bp, Artificial Sequence
  Description of Artificial Sequence: Synthetic oligonucleotide
ccccatccacgacagaggcgctcaa

SEQ ID NO: 360657 - DNA, 25 bp, Artificial Sequence
  Description of Artificial Sequence: Synthetic oligonucleotide
gggacggggagacacggaaggtgaa

SEQ ID NO: 360658 - DNA, 25 bp, Artificial Sequence
  Description of Artificial Sequence: Synthetic oligonucleotide
cccatccacgacagaggcgctcaac

SEQ ID NO: 360659 - DNA, 25 bp, Artificial Sequence
  Description of Artificial Sequence: Synthetic oligonucleotide
ggacggggagacacggaaggtgaag

SEQ ID NO: 360660 - DNA, 26 bp, Artificial Sequence
  Description of Artificial Sequence: Synthetic oligonucleotide
ccatccacgacagaggcgctcaacca

SEQ ID NO: 360661 - DNA, 25 bp, Artificial Sequence
  Description of Artificial Sequence: Synthetic oligonucleotide
gacggggagacacggaaggtgaagg

SEQ ID NO: 360662 - DNA, 26 bp, Artificial Sequence
  Description of Artificial Sequence: Synthetic oligonucleotide
catccacgacagaggcgctcaaccac

SEQ ID NO: 360663 - DNA, 25 bp, Artificial Sequence
  Description of Artificial Sequence: Synthetic oligonucleotide
acggggagacacggaaggtgaaggc

SEQ ID NO: 360664 - DNA, 27 bp, Artificial Sequence
  Description of Artificial Sequence: Synthetic oligonucleotide
atccacgacagaggcgctcaaccacga

SEQ ID NO: 360665 - DNA, 24 bp, Artificial Sequence
  Description of Artificial Sequence: Synthetic oligonucleotide
cggggagacacggaaggtgaaggc

SEQ ID NO: 360666 - DNA, 26 bp, Artificial Sequence
  Description of Artificial Sequence: Synthetic oligonucleotide
tccacgacagaggcgctcaaccacga

SEQ ID NO: 360667 - DNA, 24 bp, Artificial Sequence
  Description of Artificial Sequence: Synthetic oligonucleotide
ggggagacacggaaggtgaaggcc

SEQ ID NO: 360668 - DNA, 25 bp, Artificial Sequence
  Description of Artificial Sequence: Synthetic oligonucleotide
ccacgacagaggcgctcaaccacga

SEQ ID NO: 360669 - DNA, 25 bp, Artificial Sequence
  Description of Artificial Sequence: Synthetic oligonucleotide
gggagacacggaaggtgaaggccca

SEQ ID NO: 360670 - DNA, 27 bp, Artificial Sequence
  Description of Artificial Sequence: Synthetic oligonucleotide
cacgacagaggcgctcaaccacgacaa

SEQ ID NO: 360671 - DNA, 26 bp, Artificial Sequence
  Description of Artificial Sequence: Synthetic oligonucleotide
ggagacacggaaggtgaaggcccact

SEQ ID NO: 360672 - DNA, 27 bp, Artificial Sequence
  Description of Artificial Sequence: Synthetic oligonucleotide
acgacagaggcgctcaaccacgacaac

SEQ ID NO: 360673 - DNA, 27 bp, Artificial Sequence
  Description of Artificial Sequence: Synthetic oligonucleotide
gagacacggaaggtgaaggcccactca

SEQ ID NO: 360674 - DNA, 26 bp, Artificial Sequence
  Description of Artificial Sequence: Synthetic oligonucleotide
cgacagaggcgctcaaccacgacaac

SEQ ID NO: 360675 - DNA, 27 bp, Artificial Sequence
  Description of Artificial Sequence: Synthetic oligonucleotide
agacacggaaggtgaaggcccactcac

SEQ ID NO: 360676 - DNA, 27 bp, Artificial Sequence
  Description of Artificial Sequence: Synthetic oligonucleotide
gacagaggcgctcaaccacgacaacct

SEQ ID NO: 360677 - DNA, 27 bp, Artificial Sequence
  Description of Artificial Sequence: Synthetic oligonucleotide
gacacggaaggtgaaggcccactcaca

SEQ ID NO: 360678 - DNA, 27 bp, Artificial Sequence
  Description of Artificial Sequence: Synthetic oligonucleotide
acagaggcgctcaaccacgacaacctg

SEQ ID NO: 360679 - DNA, 27 bp, Artificial Sequence
  Description of Artificial Sequence: Synthetic oligonucleotide
acacggaaggtgaaggcccactcacag

SEQ ID NO: 360680 - DNA, 26 bp, Artificial Sequence
  Description of Artificial Sequence: Synthetic oligonucleotide
cagaggcgctcaaccacgacaacctg

SEQ ID NO: 360681 - DNA, 27 bp, Artificial Sequence
  Description of Artificial Sequence: Synthetic oligonucleotide
cacggaaggtgaaggcccactcacaga

SEQ ID NO: 360682 - DNA, 27 bp, Artificial Sequence
  Description of Artificial Sequence: Synthetic oligonucleotide
agaggcgctcaaccacgacaacctgca

SEQ ID NO: 360683 - DNA, 27 bp, Artificial Sequence
  Description of Artificial Sequence: Synthetic oligonucleotide
acggaaggtgaaggcccactcacagac

SEQ ID NO: 360684 - DNA, 26 bp, Artificial Sequence
  Description of Artificial Sequence: Synthetic oligonucleotide
gaggcgctcaaccacgacaacctgca

SEQ ID NO: 360685 - DNA, 27 bp, Artificial Sequence
  Description of Artificial Sequence: Synthetic oligonucleotide
cggaaggtgaaggcccactcacagact

SEQ ID NO: 360686 - DNA, 26 bp, Artificial Sequence
  Description of Artificial Sequence: Synthetic oligonucleotide
aggcgctcaaccacgacaacctgcag

SEQ ID NO: 360687 - DNA, 27 bp, Artificial Sequence
  Description of Artificial Sequence: Synthetic oligonucleotide
ggaaggtgaaggcccactcacagactc

SEQ ID NO: 360688 - DNA, 25 bp, Artificial Sequence
  Description of Artificial Sequence: Synthetic oligonucleotide
ggcgctcaaccacgacaacctgcag

SEQ ID NO: 360689 - DNA, 28 bp, Artificial Sequence
  Description of Artificial Sequence: Synthetic oligonucleotide
gaaggtgaaggcccactcacagactcac

SEQ ID NO: 360690 - DNA, 26 bp, Artificial Sequence
  Description of Artificial Sequence: Synthetic oligonucleotide
gcgctcaaccacgacaacctgcaggt

SEQ ID NO: 360691 - DNA, 28 bp, Artificial Sequence
  Description of Artificial Sequence: Synthetic oligonucleotide
aaggtgaaggcccactcacagactcacc

SEQ ID NO: 360692 - DNA, 27 bp, Artificial Sequence
  Description of Artificial Sequence: Synthetic oligonucleotide
cgctcaaccacgacaacctgcaggtct

SEQ ID NO: 360693 - DNA, 27 bp, Artificial Sequence
  Description of Artificial Sequence: Synthetic oligonucleotide
aggtgaaggcccactcacagactcacc

SEQ ID NO: 360694 - DNA, 27 bp, Artificial Sequence
  Description of Artificial Sequence: Synthetic oligonucleotide
gctcaaccacgacaacctgcaggtctg

SEQ ID NO: 360695 - DNA, 26 bp, Artificial Sequence
  Description of Artificial Sequence: Synthetic oligonucleotide
ggtgaaggcccactcacagactcacc

SEQ ID NO: 360696 - DNA, 27 bp, Artificial Sequence
  Description of Artificial Sequence: Synthetic oligonucleotide
ctcaaccacgacaacctgcaggtctgc

SEQ ID NO: 360697 - DNA, 26 bp, Artificial Sequence
  Description of Artificial Sequence: Synthetic oligonucleotide
agaccaccaagcacaagtgggaggcc

SEQ ID NO: 360698 - DNA, 28 bp, Artificial Sequence
  Description of Artificial Sequence: Synthetic oligonucleotide
tcaaccacgacaacctgcaggtctgctg

SEQ ID NO: 360699 - DNA, 25 bp, Artificial Sequence
  Description of Artificial Sequence: Synthetic oligonucleotide
gaccaccaagcacaagtgggaggcc

SEQ ID NO: 360700 - DNA, 27 bp, Artificial Sequence
  Description of Artificial Sequence: Synthetic oligonucleotide
caaccacgacaacctgcaggtctgctg

SEQ ID NO: 360701 - DNA, 25 bp, Artificial Sequence
  Description of Artificial Sequence: Synthetic oligonucleotide
accaccaagcacaagtgggaggccg

SEQ ID NO: 360702 - DNA, 27 bp, Artificial Sequence
  Description of Artificial Sequence: Synthetic oligonucleotide
aaccacgacaacctgcaggtctgctgg

SEQ ID NO: 360703 - DNA, 24 bp, Artificial Sequence
  Description of Artificial Sequence: Synthetic oligonucleotide
ccaccaagcacaagtgggaggccg

SEQ ID NO: 360704 - DNA, 26 bp, Artificial Sequence
  Description of Artificial Sequence: Synthetic oligonucleotide
accacgacaacctgcaggtctgctgg

SEQ ID NO: 360705 - DNA, 24 bp, Artificial Sequence
  Description of Artificial Sequence: Synthetic oligonucleotide
caccaagcacaagtgggaggccgc

SEQ ID NO: 360706 - DNA, 25 bp, Artificial Sequence
  Description of Artificial Sequence: Synthetic oligonucleotide
ccacgacaacctgcaggtctgctgg

SEQ ID NO: 360707 - DNA, 24 bp, Artificial Sequence
  Description of Artificial Sequence: Synthetic oligonucleotide
accaagcacaagtgggaggccgcc

SEQ ID NO: 360708 - DNA, 26 bp, Artificial Sequence
  Description of Artificial Sequence: Synthetic oligonucleotide
cacgacaacctgcaggtctgctgggt

SEQ ID NO: 360709 - DNA, 23 bp, Artificial Sequence
  Description of Artificial Sequence: Synthetic oligonucleotide
ccaagcacaagtgggaggccgcc

SEQ ID NO: 360710 - DNA, 27 bp, Artificial Sequence
  Description of Artificial Sequence: Synthetic oligonucleotide
acgacaacctgcaggtctgctgggtga

SEQ ID NO: 360711 - DNA, 25 bp, Artificial Sequence
  Description of Artificial Sequence: Synthetic oligonucleotide
caagcacaagtgggaggccgcccat

SEQ ID NO: 360712 - DNA, 26 bp, Artificial Sequence
  Description of Artificial Sequence: Synthetic oligonucleotide
cgacaacctgcaggtctgctgggtga

SEQ ID NO: 360713 - DNA, 26 bp, Artificial Sequence
  Description of Artificial Sequence: Synthetic oligonucleotide
aagcacaagtgggaggccgcccatgt

SEQ ID NO: 360714 - DNA, 27 bp, Artificial Sequence
  Description of Artificial Sequence: Synthetic oligonucleotide
gacaacctgcaggtctgctgggtgaca

SEQ ID NO: 360715 - DNA, 25 bp, Artificial Sequence
  Description of Artificial Sequence: Synthetic oligonucleotide
agcacaagtgggaggccgcccatgt

SEQ ID NO: 360716 - DNA, 27 bp, Artificial Sequence
  Description of Artificial Sequence: Synthetic oligonucleotide
acaacctgcaggtctgctgggtgacag

SEQ ID NO: 360717 - DNA, 24 bp, Artificial Sequence
  Description of Artificial Sequence: Synthetic oligonucleotide
gcacaagtgggaggccgcccatgt

SEQ ID NO: 360718 - DNA, 27 bp, Artificial Sequence
  Description of Artificial Sequence: Synthetic oligonucleotide
caacctgcaggtctgctgggtgacaga

SEQ ID NO: 360719 - DNA, 24 bp, Artificial Sequence
  Description of Artificial Sequence: Synthetic oligonucleotide
cacaagtgggaggccgcccatgtg

SEQ ID NO: 360720 - DNA, 30 bp, Artificial Sequence; identical to SEQ ID NO: 234966
  Description of Artificial Sequence: Synthetic oligonucleotide

SEQ ID NO: 360721 - DNA, 24 bp, Artificial Sequence
  Description of Artificial Sequence: Synthetic oligonucleotide
acaagtgggaggccgcccatgtgg

SEQ ID NO: 360722 - DNA, 29 bp, Artificial Sequence
  Description of Artificial Sequence: Synthetic oligonucleotide
acctgcaggtctgctgggtgacagatatc

SEQ ID NO: 360723 - DNA, 23 bp, Artificial Sequence
  Description of Artificial Sequence: Synthetic oligonucleotide
caagtgggaggccgcccatgtgg

SEQ ID NO: 360724 - DNA, 28 bp, Artificial Sequence
  Description of Artificial Sequence: Synthetic oligonucleotide
cctgcaggtctgctgggtgacagatatc

SEQ ID NO: 360725 - DNA, 23 bp, Artificial Sequence
  Description of Artificial Sequence: Synthetic oligonucleotide
aagtgggaggccgcccatgtggc

SEQ ID NO: 360726 - DNA, 31 bp, Artificial Sequence; identical to SEQ ID NO: 234969
  Description of Artificial Sequence: Synthetic oligonucleotide

SEQ ID NO: 360727 - DNA, 22 bp, Artificial Sequence
  Description of Artificial Sequence: Synthetic oligonucleotide
agtgggaggccgcccatgtggc

SEQ ID NO: 360728 - DNA, 31 bp, Artificial Sequence; identical to SEQ ID NO: 234970
  Description of Artificial Sequence: Synthetic oligonucleotide

SEQ ID NO: 360729 - DNA, 21 bp, Artificial Sequence
  Description of Artificial Sequence: Synthetic oligonucleotide
gtgggaggccgcccatgtggc

SEQ ID NO: 360730 - DNA, 30 bp, Artificial Sequence; identical to SEQ ID NO: 234971
  Description of Artificial Sequence: Synthetic oligonucleotide

SEQ ID NO: 360731 - DNA, 21 bp, Artificial Sequence
  Description of Artificial Sequence: Synthetic oligonucleotide
tgggaggccgcccatgtggcg

SEQ ID NO: 360732 - DNA, 31 bp, Artificial Sequence; identical to SEQ ID NO: 234972
  Description of Artificial Sequence: Synthetic oligonucleotide

SEQ ID NO: 360733 - DNA, 20 bp, Artificial Sequence
  Description of Artificial Sequence: Synthetic oligonucleotide
gggaggccgcccatgtggcg

SEQ ID NO: 360734 - DNA, 31 bp, Artificial Sequence; identical to SEQ ID NO: 234973
  Description of Artificial Sequence: Synthetic oligonucleotide

SEQ ID NO: 360735 - DNA, 21 bp, Artificial Sequence
  Description of Artificial Sequence: Synthetic oligonucleotide
ggaggccgcccatgtggcgga

SEQ ID NO: 360736 - DNA, 30 bp, Artificial Sequence; identical to SEQ ID NO: 234974
  Description of Artificial Sequence: Synthetic oligonucleotide

SEQ ID NO: 360737 - DNA, 21 bp, Artificial Sequence
  Description of Artificial Sequence: Synthetic oligonucleotide
gaggccgcccatgtggcggag

SEQ ID NO: 360738 - DNA, 30 bp, Artificial Sequence; identical to SEQ ID NO: 234975
  Description of Artificial Sequence: Synthetic oligonucleotide

SEQ ID NO: 360739 - DNA, 22 bp, Artificial Sequence
  Description of Artificial Sequence: Synthetic oligonucleotide
aggccgcccatgtggcggagca

SEQ ID NO: 360740 - DNA, 30 bp, Artificial Sequence; identical to SEQ ID NO: 234976
  Description of Artificial Sequence: Synthetic oligonucleotide

SEQ ID NO: 360741 - DNA, 21 bp, Artificial Sequence
  Description of Artificial Sequence: Synthetic oligonucleotide
ggccgcccatgtggcggagca

SEQ ID NO: 360742 - DNA, 29 bp, Artificial Sequence
  Description of Artificial Sequence: Synthetic oligonucleotide
ctgctgggtgacagatatctatccaggcc

SEQ ID NO: 360743 - DNA, 23 bp, Artificial Sequence
  Description of Artificial Sequence: Synthetic oligonucleotide
gccgcccatgtggcggagcagtt

SEQ ID NO: 360744 - DNA, 30 bp, Artificial Sequence; identical to SEQ ID NO: 234978
  Description of Artificial Sequence: Synthetic oligonucleotide

SEQ ID NO: 360745 - DNA, 24 bp, Artificial Sequence
  Description of Artificial Sequence: Synthetic oligonucleotide
ccgcccatgtggcggagcagttga

SEQ ID NO: 360746 - DNA, 29 bp, Artificial Sequence
  Description of Artificial Sequence: Synthetic oligonucleotide
gctgggtgacagatatctatccaggccag

SEQ ID NO: 360747 - DNA, 25 bp, Artificial Sequence
  Description of Artificial Sequence: Synthetic oligonucleotide
cgcccatgtggcggagcagttgaga

SEQ ID NO: 360748 - DNA, 31 bp, Artificial Sequence; identical to SEQ ID NO: 234980
  Description of Artificial Sequence: Synthetic oligonucleotide

SEQ ID NO: 360749 - DNA, 22 bp, Artificial Sequence
  Description of Artificial Sequence: Synthetic oligonucleotide
ccgcggggagccccgcttcatt

SEQ ID NO: 360750 - DNA, 34 bp, Artificial Sequence; identical to SEQ ID NO: 234981
  Description of Artificial Sequence: Synthetic oligonucleotide

SEQ ID NO: 360751 - DNA, 22 bp, Artificial Sequence
  Description of Artificial Sequence: Synthetic oligonucleotide
cgcggggagccccgcttcattg

SEQ ID NO: 360752 - DNA, 33 bp, Artificial Sequence; identical to SEQ ID NO: 234982
  Description of Artificial Sequence: Synthetic oligonucleotide

SEQ ID NO: 360753 - DNA, 23 bp, Artificial Sequence
  Description of Artificial Sequence: Synthetic oligonucleotide
gcggggagccccgcttcattgca

SEQ ID NO: 360754 - DNA, 34 bp, Artificial Sequence; identical to SEQ ID NO: 234983
  Description of Artificial Sequence: Synthetic oligonucleotide

SEQ ID NO: 360755 - DNA, 24 bp, Artificial Sequence
  Description of Artificial Sequence: Synthetic oligonucleotide
cggggagccccgcttcattgcagt

SEQ ID NO: 360756 - DNA, 34 bp, Artificial Sequence; identical to SEQ ID NO: 234984
  Description of Artificial Sequence: Synthetic oligonucleotide

SEQ ID NO: 360757 - DNA, 24 bp, Artificial Sequence
  Description of Artificial Sequence: Synthetic oligonucleotide
ggggagccccgcttcattgcagtg

SEQ ID NO: 360758 - DNA, 35 bp, Artificial Sequence; identical to SEQ ID NO: 234985
  Description of Artificial Sequence: Synthetic oligonucleotide

SEQ ID NO: 360759 - DNA, 24 bp, Artificial Sequence
  Description of Artificial Sequence: Synthetic oligonucleotide
gggagccccgcttcattgcagtgg

SEQ ID NO: 360760 - DNA, 34 bp, Artificial Sequence; identical to SEQ ID NO: 234986
  Description of Artificial Sequence: Synthetic oligonucleotide

SEQ ID NO: 360761 - DNA, 24 bp, Artificial Sequence
  Description of Artificial Sequence: Synthetic oligonucleotide
ggagccccgcttcattgcagtggg

SEQ ID NO: 360762 - DNA, 35 bp, Artificial Sequence; identical to SEQ ID NO: 234987
  Description of Artificial Sequence: Synthetic oligonucleotide

SEQ ID NO: 360763 - DNA, 26 bp, Artificial Sequence
  Description of Artificial Sequence: Synthetic oligonucleotide
gagccccgcttcattgcagtgggcta

SEQ ID NO: 360764 - DNA, 34 bp, Artificial Sequence; identical to SEQ ID NO: 234988
  Description of Artificial Sequence: Synthetic oligonucleotide

SEQ ID NO: 360765 - DNA, 26 bp, Artificial Sequence
  Description of Artificial Sequence: Synthetic oligonucleotide
agccccgcttcattgcagtgggctac

SEQ ID NO: 360766 - DNA, 34 bp, Artificial Sequence; identical to SEQ ID NO: 234989
  Description of Artificial Sequence: Synthetic oligonucleotide

SEQ ID NO: 360767 - DNA, 25 bp, Artificial Sequence
  Description of Artificial Sequence: Synthetic oligonucleotide
gccccgcttcattgcagtgggctac

SEQ ID NO: 360768 - DNA, 33 bp, Artificial Sequence; identical to SEQ ID NO: 234990
  Description of Artificial Sequence: Synthetic oligonucleotide

SEQ ID NO: 360769 - DNA, 26 bp, Artificial Sequence
  Description of Artificial Sequence: Synthetic oligonucleotide
ccccgcttcattgcagtgggctacgt

SEQ ID NO: 360770 - DNA, 36 bp, Artificial Sequence; identical to SEQ ID NO: 234991
  Description of Artificial Sequence: Synthetic oligonucleotide

SEQ ID NO: 360771 - DNA, 26 bp, Artificial Sequence
  Description of Artificial Sequence: Synthetic oligonucleotide
cccgcttcattgcagtgggctacgtg

SEQ ID NO: 360772 - DNA, 35 bp, Artificial Sequence; identical to SEQ ID NO: 234992
  Description of Artificial Sequence: Synthetic oligonucleotide

SEQ ID NO: 360773 - DNA, 27 bp, Artificial Sequence
  Description of Artificial Sequence: Synthetic oligonucleotide
ccgcttcattgcagtgggctacgtgga

SEQ ID NO: 360774 - DNA, 34 bp, Artificial Sequence; identical to SEQ ID NO: 234993
  Description of Artificial Sequence: Synthetic oligonucleotide

SEQ ID NO: 360775 - DNA, 27 bp, Artificial Sequence
  Description of Artificial Sequence: Synthetic oligonucleotide
cgcttcattgcagtgggctacgtggac

SEQ ID NO: 360776 - DNA, 33 bp, Artificial Sequence; identical to SEQ ID NO: 234994
  Description of Artificial Sequence: Synthetic oligonucleotide

SEQ ID NO: 360777 - DNA, 27 bp, Artificial Sequence
  Description of Artificial Sequence: Synthetic oligonucleotide
gcttcattgcagtgggctacgtggacg

SEQ ID NO: 360778 - DNA, 32 bp, Artificial Sequence; identical to SEQ ID NO: 234995
  Description of Artificial Sequence: Synthetic oligonucleotide

SEQ ID NO: 360779 - DNA, 28 bp, Artificial Sequence
  Description of Artificial Sequence: Synthetic oligonucleotide
cttcattgcagtgggctacgtggacgac

SEQ ID NO: 360780 - DNA, 32 bp, Artificial Sequence; identical to SEQ ID NO: 234996
  Description of Artificial Sequence: Synthetic oligonucleotide

SEQ ID NO: 360781 - DNA, 29 bp, Artificial Sequence
  Description of Artificial Sequence: Synthetic oligonucleotide
ttcattgcagtgggctacgtggacgacac

SEQ ID NO: 360782 - DNA, 31 bp, Artificial Sequence; identical to SEQ ID NO: 234997
  Description of Artificial Sequence: Synthetic oligonucleotide

SEQ ID NO: 360783 - DNA, 28 bp, Artificial Sequence
  Description of Artificial Sequence: Synthetic oligonucleotide
tcattgcagtgggctacgtggacgacac

SEQ ID NO: 360784 - DNA, 30 bp, Artificial Sequence; identical to SEQ ID NO: 234998
  Description of Artificial Sequence: Synthetic oligonucleotide

SEQ ID NO: 360785 - DNA, 27 bp, Artificial Sequence
  Description of Artificial Sequence: Synthetic oligonucleotide
cattgcagtgggctacgtggacgacac

SEQ ID NO: 360786 - DNA, 29 bp, Artificial Sequence
  Description of Artificial Sequence: Synthetic oligonucleotide
ccaggccagatcaatgtccagtggattcg

SEQ ID NO: 360787 - DNA, 27 bp, Artificial Sequence
  Description of Artificial Sequence: Synthetic oligonucleotide
attgcagtgggctacgtggacgacacg

SEQ ID NO: 360788 - DNA, 29 bp, Artificial Sequence
  Description of Artificial Sequence: Synthetic oligonucleotide
caggccagatcaatgtccagtggattcgg

SEQ ID NO: 360789 - DNA, 26 bp, Artificial Sequence
  Description of Artificial Sequence: Synthetic oligonucleotide
ttgcagtgggctacgtggacgacacg

SEQ ID NO: 360790 - DNA, 32 bp, Artificial Sequence; identical to SEQ ID NO: 235001
  Description of Artificial Sequence: Synthetic oligonucleotide

SEQ ID NO: 360791 - DNA, 25 bp, Artificial Sequence
  Description of Artificial Sequence: Synthetic oligonucleotide
tgcagtgggctacgtggacgacacg

SEQ ID NO: 360792 - DNA, 31 bp, Artificial Sequence; identical to SEQ ID NO: 235002
  Description of Artificial Sequence: Synthetic oligonucleotide

SEQ ID NO: 360793 - DNA, 23 bp, Artificial Sequence
  Description of Artificial Sequence: Synthetic oligonucleotide
ggtcggactggcgcttcctccgt

SEQ ID NO: 360794 - DNA, 33 bp, Artificial Sequence; identical to SEQ ID NO: 235003
  Description of Artificial Sequence: Synthetic oligonucleotide

SEQ ID NO: 360795 - DNA, 23 bp, Artificial Sequence
  Description of Artificial Sequence: Synthetic oligonucleotide
gtcggactggcgcttcctccgtg

SEQ ID NO: 360796 - DNA, 34 bp, Artificial Sequence; identical to SEQ ID NO: 235004
  Description of Artificial Sequence: Synthetic oligonucleotide

SEQ ID NO: 360797 - DNA, 23 bp, Artificial Sequence
  Description of Artificial Sequence: Synthetic oligonucleotide
tcggactggcgcttcctccgtgg

SEQ ID NO: 360798 - DNA, 34 bp, Artificial Sequence; identical to SEQ ID NO: 235005
  Description of Artificial Sequence: Synthetic oligonucleotide

SEQ ID NO: 360799 - DNA, 22 bp, Artificial Sequence
  Description of Artificial Sequence: Synthetic oligonucleotide
cggactggcgcttcctccgtgg

SEQ ID NO: 360800 - DNA, 35 bp, Artificial Sequence; identical to SEQ ID NO: 235006
  Description of Artificial Sequence: Synthetic oligonucleotide

SEQ ID NO: 360801 - DNA, 24 bp, Artificial Sequence
  Description of Artificial Sequence: Synthetic oligonucleotide
ggactggcgcttcctccgtgggta

SEQ ID NO: 360802 - DNA, 34 bp, Artificial Sequence; identical to SEQ ID NO: 235007
  Description of Artificial Sequence: Synthetic oligonucleotide

SEQ ID NO: 360803 - DNA, 24 bp, Artificial Sequence
  Description of Artificial Sequence: Synthetic oligonucleotide
gactggcgcttcctccgtgggtac

SEQ ID NO: 360804 - DNA, 34 bp, Artificial Sequence; identical to SEQ ID NO: 235008
  Description of Artificial Sequence: Synthetic oligonucleotide

SEQ ID NO: 360805 - DNA, 25 bp, Artificial Sequence
  Description of Artificial Sequence: Synthetic oligonucleotide
actggcgcttcctccgtgggtacca

SEQ ID NO: 360806 - DNA, 33 bp, Artificial Sequence; identical to SEQ ID NO: 235009
  Description of Artificial Sequence: Synthetic oligonucleotide

SEQ ID NO: 360807 - DNA, 24 bp, Artificial Sequence
  Description of Artificial Sequence: Synthetic oligonucleotide
ctggcgcttcctccgtgggtacca

SEQ ID NO: 360808 - DNA, 32 bp, Artificial Sequence; identical to SEQ ID NO: 235010
  Description of Artificial Sequence: Synthetic oligonucleotide

SEQ ID NO: 360809 - DNA, 24 bp, Artificial Sequence
  Description of Artificial Sequence: Synthetic oligonucleotide
tggcgcttcctccgtgggtaccac

SEQ ID NO: 360810 - DNA, 33 bp, Artificial Sequence; identical to SEQ ID NO: 235011
  Description of Artificial Sequence: Synthetic oligonucleotide

SEQ ID NO: 360811 - DNA, 23 bp, Artificial Sequence
  Description of Artificial Sequence: Synthetic oligonucleotide
ggcgcttcctccgtgggtaccac

SEQ ID NO: 360812 - DNA, 32 bp, Artificial Sequence; identical to SEQ ID NO: 235012
  Description of Artificial Sequence: Synthetic oligonucleotide

SEQ ID NO: 360813 - DNA, 24 bp, Artificial Sequence
  Description of Artificial Sequence: Synthetic oligonucleotide
gcgcttcctccgtgggtaccacca

SEQ ID NO: 360814 - DNA, 31 bp, Artificial Sequence; identical to SEQ ID NO: 235013
  Description of Artificial Sequence: Synthetic oligonucleotide

SEQ ID NO: 360815 - DNA, 26 bp, Artificial Sequence
  Description of Artificial Sequence: Synthetic oligonucleotide
cgcttcctccgtgggtaccaccagta

SEQ ID NO: 360816 - DNA, 30 bp, Artificial Sequence; identical to SEQ ID NO: 235014
  Description of Artificial Sequence: Synthetic oligonucleotide

SEQ ID NO: 360817 - DNA, 26 bp, Artificial Sequence
  Description of Artificial Sequence: Synthetic oligonucleotide
gcttcctccgtgggtaccaccagtac

SEQ ID NO: 360818 - DNA, 31 bp, Artificial Sequence; identical to SEQ ID NO: 235015
  Description of Artificial Sequence: Synthetic oligonucleotide

SEQ ID NO: 360819 - DNA, 26 bp, Artificial Sequence
  Description of Artificial Sequence: Synthetic oligonucleotide
cttcctccgtgggtaccaccagtacg

SEQ ID NO: 360820 - DNA, 30 bp, Artificial Sequence; identical to SEQ ID NO: 235016
  Description of Artificial Sequence: Synthetic oligonucleotide

SEQ ID NO: 360821 - DNA, 26 bp, Artificial Sequence
  Description of Artificial Sequence: Synthetic oligonucleotide
ttcctccgtgggtaccaccagtacgc

SEQ ID NO: 360822 - DNA, 31 bp, Artificial Sequence; identical to SEQ ID NO: 235017
  Description of Artificial Sequence: Synthetic oligonucleotide

SEQ ID NO: 360823 - DNA, 25 bp, Artificial Sequence
  Description of Artificial Sequence: Synthetic oligonucleotide
tcctccgtgggtaccaccagtacgc

SEQ ID NO: 360824 - DNA, 31 bp, Artificial Sequence; identical to SEQ ID NO: 235018
  Description of Artificial Sequence: Synthetic oligonucleotide

SEQ ID NO: 360825 - DNA, 24 bp, Artificial Sequence
  Description of Artificial Sequence: Synthetic oligonucleotide
cctccgtgggtaccaccagtacgc

SEQ ID NO: 360826 - DNA, 30 bp, Artificial Sequence; identical to SEQ ID NO: 235019
  Description of Artificial Sequence: Synthetic oligonucleotide

SEQ ID NO: 360827 - DNA, 26 bp, Artificial Sequence
  Description of Artificial Sequence: Synthetic oligonucleotide
ctccgtgggtaccaccagtacgccta

SEQ ID NO: 360828 - DNA, 30 bp, Artificial Sequence; identical to SEQ ID NO: 235020
  Description of Artificial Sequence: Synthetic oligonucleotide

SEQ ID NO: 360829 - DNA, 26 bp, Artificial Sequence
  Description of Artificial Sequence: Synthetic oligonucleotide
tccgtgggtaccaccagtacgcctac

SEQ ID NO: 360830 - DNA, 29 bp, Artificial Sequence
  Description of Artificial Sequence: Synthetic oligonucleotide
ggattcggaatcatcaggaggacacagcc

SEQ ID NO: 360831 - DNA, 25 bp, Artificial Sequence
  Description of Artificial Sequence: Synthetic oligonucleotide
ccgtgggtaccaccagtacgcctac

SEQ ID NO: 360832 - DNA, 29 bp, Artificial Sequence
  Description of Artificial Sequence: Synthetic oligonucleotide
gattcggaatcatcaggaggacacagccg

SEQ ID NO: 360833 - DNA, 26 bp, Artificial Sequence
  Description of Artificial Sequence: Synthetic oligonucleotide
cgtgggtaccaccagtacgcctacga

SEQ ID NO: 360834 - DNA, 29 bp, Artificial Sequence
  Description of Artificial Sequence: Synthetic oligonucleotide
attcggaatcatcaggaggacacagccgg

SEQ ID NO: 360835 - DNA, 26 bp, Artificial Sequence
  Description of Artificial Sequence: Synthetic oligonucleotide
gtgggtaccaccagtacgcctacgac

SEQ ID NO: 360836 - DNA, 28 bp, Artificial Sequence
  Description of Artificial Sequence: Synthetic oligonucleotide
ttcggaatcatcaggaggacacagccgg

SEQ ID NO: 360837 - DNA, 26 bp, Artificial Sequence
  Description of Artificial Sequence: Synthetic oligonucleotide
tgggtaccaccagtacgcctacgacg

SEQ ID NO: 360838 - DNA, 27 bp, Artificial Sequence
  Description of Artificial Sequence: Synthetic oligonucleotide
tcggaatcatcaggaggacacagccgg

SEQ ID NO: 360839 - DNA, 27 bp, Artificial Sequence
  Description of Artificial Sequence: Synthetic oligonucleotide
cagaggatgtatggctgcgacgtggga

SEQ ID NO: 360840 - DNA, 26 bp, Artificial Sequence
  Description of Artificial Sequence: Synthetic oligonucleotide
cggaatcatcaggaggacacagccgg

SEQ ID NO: 360841 - DNA, 28 bp, Artificial Sequence
  Description of Artificial Sequence: Synthetic oligonucleotide
agaggatgtatggctgcgacgtgggatc

SEQ ID NO: 360842 - DNA, 26 bp, Artificial Sequence
  Description of Artificial Sequence: Synthetic oligonucleotide
ggaatcatcaggaggacacagccggc

SEQ ID NO: 360843 - DNA, 27 bp, Artificial Sequence
  Description of Artificial Sequence: Synthetic oligonucleotide
gaggatgtatggctgcgacgtgggatc

SEQ ID NO: 360844 - DNA, 27 bp, Artificial Sequence
  Description of Artificial Sequence: Synthetic oligonucleotide
gaatcatcaggaggacacagccggcct

SEQ ID NO: 360845 - DNA, 27 bp, Artificial Sequence
  Description of Artificial Sequence: Synthetic oligonucleotide
aggatgtatggctgcgacgtgggatcg

SEQ ID NO: 360846 - DNA, 28 bp, Artificial Sequence
  Description of Artificial Sequence: Synthetic oligonucleotide
aatcatcaggaggacacagccggccttg

SEQ ID NO: 360847 - DNA, 26 bp, Artificial Sequence
  Description of Artificial Sequence: Synthetic oligonucleotide
ggatgtatggctgcgacgtgggatcg

SEQ ID NO: 360848 - DNA, 27 bp, Artificial Sequence
  Description of Artificial Sequence: Synthetic oligonucleotide
atcatcaggaggacacagccggccttg

SEQ ID NO: 360849 - DNA, 27 bp, Artificial Sequence
  Description of Artificial Sequence: Synthetic oligonucleotide
gatgtatggctgcgacgtgggatcgga

SEQ ID NO: 360850 - DNA, 27 bp, Artificial Sequence
  Description of Artificial Sequence: Synthetic oligonucleotide
tcatcaggaggacacagccggccttgt

SEQ ID NO: 360851 - DNA, 27 bp, Artificial Sequence
  Description of Artificial Sequence: Synthetic oligonucleotide
atgtatggctgcgacgtgggatcggac

SEQ ID NO: 360852 - DNA, 26 bp, Artificial Sequence
  Description of Artificial Sequence: Synthetic oligonucleotide
catcaggaggacacagccggccttgt

SEQ ID NO: 360853 - DNA, 27 bp, Artificial Sequence
  Description of Artificial Sequence: Synthetic oligonucleotide
tgtatggctgcgacgtgggatcggact

SEQ ID NO: 360854 - DNA, 27 bp, Artificial Sequence
  Description of Artificial Sequence: Synthetic oligonucleotide
atcaggaggacacagccggccttgtgt

SEQ ID NO: 360855 - DNA, 26 bp, Artificial Sequence
  Description of Artificial Sequence: Synthetic oligonucleotide
gtatggctgcgacgtgggatcggact

SEQ ID NO: 360856 - DNA, 26 bp, Artificial Sequence
  Description of Artificial Sequence: Synthetic oligonucleotide
tcaggaggacacagccggccttgtgt

SEQ ID NO: 360857 - DNA, 26 bp, Artificial Sequence
  Description of Artificial Sequence: Synthetic oligonucleotide
tatggctgcgacgtgggatcggactg

SEQ ID NO: 360858 - DNA, 25 bp, Artificial Sequence
  Description of Artificial Sequence: Synthetic oligonucleotide
caggaggacacagccggccttgtgt

SEQ ID NO: 360859 - DNA, 25 bp, Artificial Sequence
  Description of Artificial Sequence: Synthetic oligonucleotide
atggctgcgacgtgggatcggactg

SEQ ID NO: 360860 - DNA, 25 bp, Artificial Sequence
  Description of Artificial Sequence: Synthetic oligonucleotide
aggaggacacagccggccttgtgtc

SEQ ID NO: 360861 - DNA, 24 bp, Artificial Sequence
  Description of Artificial Sequence: Synthetic oligonucleotide
tggctgcgacgtgggatcggactg

SEQ ID NO: 360862 - DNA, 24 bp, Artificial Sequence
  Description of Artificial Sequence: Synthetic oligonucleotide
ggaggacacagccggccttgtgtc

SEQ ID NO: 360863 - DNA, 23 bp, Artificial Sequence
  Description of Artificial Sequence: Synthetic oligonucleotide
ggctgcgacgtgggatcggactg

SEQ ID NO: 360864 - DNA, 25 bp, Artificial Sequence
  Description of Artificial Sequence: Synthetic oligonucleotide
gaggacacagccggccttgtgtcca

SEQ ID NO: 360865 - DNA, 23 bp, Artificial Sequence
  Description of Artificial Sequence: Synthetic oligonucleotide
gctgcgacgtgggatcggactgg

SEQ ID NO: 360866 - DNA, 25 bp, Artificial Sequence
  Description of Artificial Sequence: Synthetic oligonucleotide
aggacacagccggccttgtgtccag

SEQ ID NO: 360867 - DNA, 23 bp, Artificial Sequence
  Description of Artificial Sequence: Synthetic oligonucleotide
ctgcgacgtgggatcggactggc

SEQ ID NO: 360868 - DNA, 24 bp, Artificial Sequence
  Description of Artificial Sequence: Synthetic oligonucleotide
ggacacagccggccttgtgtccag

SEQ ID NO: 360869 - DNA, 23 bp, Artificial Sequence
  Description of Artificial Sequence: Synthetic oligonucleotide
tgcgacgtgggatcggactggcg

SEQ ID NO: 360870 - DNA, 24 bp, Artificial Sequence
  Description of Artificial Sequence: Synthetic oligonucleotide
gacacagccggccttgtgtccagc

SEQ ID NO: 360871 - DNA, 22 bp, Artificial Sequence
  Description of Artificial Sequence: Synthetic oligonucleotide
gcgacgtgggatcggactggcg

SEQ ID NO: 360872 - DNA, 24 bp, Artificial Sequence
  Description of Artificial Sequence: Synthetic oligonucleotide
acacagccggccttgtgtccagcc

SEQ ID NO: 360873 - DNA, 24 bp, Artificial Sequence
  Description of Artificial Sequence: Synthetic oligonucleotide
cgacgtgggatcggactggcgctt

SEQ ID NO: 360874 - DNA, 23 bp, Artificial Sequence
  Description of Artificial Sequence: Synthetic oligonucleotide
cacagccggccttgtgtccagcc

SEQ ID NO: 360875 - DNA, 24 bp, Artificial Sequence
  Description of Artificial Sequence: Synthetic oligonucleotide
gacgtgggatcggactggcgcttc

SEQ ID NO: 360876 - DNA, 23 bp, Artificial Sequence
  Description of Artificial Sequence: Synthetic oligonucleotide
acagccggccttgtgtccagccc

SEQ ID NO: 360877 - DNA, 25 bp, Artificial Sequence
  Description of Artificial Sequence: Synthetic oligonucleotide
acgtgggatcggactggcgcttcct

SEQ ID NO: 360878 - DNA, 22 bp, Artificial Sequence
  Description of Artificial Sequence: Synthetic oligonucleotide
cagccggccttgtgtccagccc

SEQ ID NO: 360879 - DNA, 24 bp, Artificial Sequence
  Description of Artificial Sequence: Synthetic oligonucleotide
cgtgggatcggactggcgcttcct

SEQ ID NO: 360880 - DNA, 22 bp, Artificial Sequence
  Description of Artificial Sequence: Synthetic oligonucleotide
agccggccttgtgtccagcccc

SEQ ID NO: 360881 - DNA, 24 bp, Artificial Sequence
  Description of Artificial Sequence: Synthetic oligonucleotide
gtgggatcggactggcgcttcctc

SEQ ID NO: 360882 - DNA, 21 bp, Artificial Sequence
  Description of Artificial Sequence: Synthetic oligonucleotide
gccggccttgtgtccagcccc

SEQ ID NO: 360883 - DNA, 24 bp, Artificial Sequence
  Description of Artificial Sequence: Synthetic oligonucleotide
tgggatcggactggcgcttcctcc

SEQ ID NO: 360884 - DNA, 27 bp, Artificial Sequence
  Description of Artificial Sequence: Synthetic oligonucleotide
ccggccttgtgtccagcccccttataa

SEQ ID NO: 360885 - DNA, 23 bp, Artificial Sequence
  Description of Artificial Sequence: Synthetic oligonucleotide
gggatcggactggcgcttcctcc

SEQ ID NO: 360886 - DNA, 27 bp, Artificial Sequence
  Description of Artificial Sequence: Synthetic oligonucleotide
cggccttgtgtccagcccccttataag

SEQ ID NO: 360887 - DNA, 23 bp, Artificial Sequence
  Description of Artificial Sequence: Synthetic oligonucleotide
ggatcggactggcgcttcctccg

SEQ ID NO: 360888 - DNA, 27 bp, Artificial Sequence
  Description of Artificial Sequence: Synthetic oligonucleotide
ggccttgtgtccagcccccttataagg

SEQ ID NO: 360889 - DNA, 23 bp, Artificial Sequence
  Description of Artificial Sequence: Synthetic oligonucleotide
gatcggactggcgcttcctccgc

SEQ ID NO: 360890 - DNA, 30 bp, Artificial Sequence; identical to SEQ ID NO: 235051
  Description of Artificial Sequence: Synthetic oligonucleotide

SEQ ID NO: 360891 - DNA, 23 bp, Artificial Sequence
  Description of Artificial Sequence: Synthetic oligonucleotide
atcggactggcgcttcctccgcg

SEQ ID NO: 360892 - DNA, 30 bp, Artificial Sequence; identical to SEQ ID NO: 235052
  Description of Artificial Sequence: Synthetic oligonucleotide

SEQ ID NO: 360893 - DNA, 22 bp, Artificial Sequence
  Description of Artificial Sequence: Synthetic oligonucleotide
gcggcggacatggcggctcaga

SEQ ID NO: 360894 - DNA, 31 bp, Artificial Sequence; identical to SEQ ID NO: 235053
  Description of Artificial Sequence: Synthetic oligonucleotide

SEQ ID NO: 360895 - DNA, 22 bp, Artificial Sequence
  Description of Artificial Sequence: Synthetic oligonucleotide
cggcggacatggcggctcagac

SEQ ID NO: 360896 - DNA, 32 bp, Artificial Sequence; identical to SEQ ID NO: 235054
  Description of Artificial Sequence: Synthetic oligonucleotide

SEQ ID NO: 360897 - DNA, 23 bp, Artificial Sequence
  Description of Artificial Sequence: Synthetic oligonucleotide
ggcggacatggcggctcagacca

SEQ ID NO: 360898 - DNA, 31 bp, Artificial Sequence; identical to SEQ ID NO: 235055
  Description of Artificial Sequence: Synthetic oligonucleotide

SEQ ID NO: 360899 - DNA, 23 bp, Artificial Sequence
  Description of Artificial Sequence: Synthetic oligonucleotide
gcggacatggcggctcagaccac

SEQ ID NO: 360900 - DNA, 30 bp, Artificial Sequence; identical to SEQ ID NO: 235056
  Description of Artificial Sequence: Synthetic oligonucleotide

SEQ ID NO: 360901 - DNA, 25 bp, Artificial Sequence
  Description of Artificial Sequence: Synthetic oligonucleotide
cggacatggcggctcagaccaccaa

SEQ ID NO: 360902 - DNA, 31 bp, Artificial Sequence; identical to SEQ ID NO: 235057
  Description of Artificial Sequence: Synthetic oligonucleotide

SEQ ID NO: 360903 - DNA, 25 bp, Artificial Sequence
  Description of Artificial Sequence: Synthetic oligonucleotide
ggacatggcggctcagaccaccaag

SEQ ID NO: 360904 - DNA, 30 bp, Artificial Sequence; identical to SEQ ID NO: 235058
  Description of Artificial Sequence: Synthetic oligonucleotide

SEQ ID NO: 360905 - DNA, 26 bp, Artificial Sequence
  Description of Artificial Sequence: Synthetic oligonucleotide
gacatggcggctcagaccaccaagca

SEQ ID NO: 360906 - DNA, 30 bp, Artificial Sequence; identical to SEQ ID NO: 235059
  Description of Artificial Sequence: Synthetic oligonucleotide

SEQ ID NO: 360907 - DNA, 27 bp, Artificial Sequence
  Description of Artificial Sequence: Synthetic oligonucleotide
acatggcggctcagaccaccaagcaca

SEQ ID NO: 360908 - DNA, 29 bp, Artificial Sequence
  Description of Artificial Sequence: Synthetic oligonucleotide
ccagcccccttataaggaatggtcactgg

SEQ ID NO: 360909 - DNA, 27 bp, Artificial Sequence
  Description of Artificial Sequence: Synthetic oligonucleotide
catggcggctcagaccaccaagcacaa

SEQ ID NO: 360910 - DNA, 30 bp, Artificial Sequence; identical to SEQ ID NO: 235061
  Description of Artificial Sequence: Synthetic oligonucleotide

SEQ ID NO: 360911 - DNA, 27 bp, Artificial Sequence
  Description of Artificial Sequence: Synthetic oligonucleotide
atggcggctcagaccaccaagcacaag

SEQ ID NO: 360912 - DNA, 33 bp, Artificial Sequence; identical to SEQ ID NO: 235062
  Description of Artificial Sequence: Synthetic oligonucleotide

SEQ ID NO: 360913 - DNA, 27 bp, Artificial Sequence
  Description of Artificial Sequence: Synthetic oligonucleotide
tggcggctcagaccaccaagcacaagt

SEQ ID NO: 360914 - DNA, 32 bp, Artificial Sequence; identical to SEQ ID NO: 235063
  Description of Artificial Sequence: Synthetic oligonucleotide

SEQ ID NO: 360915 - DNA, 26 bp, Artificial Sequence
  Description of Artificial Sequence: Synthetic oligonucleotide
ggcggctcagaccaccaagcacaagt

SEQ ID NO: 360916 - DNA, 32 bp, Artificial Sequence; identical to SEQ ID NO: 235064
  Description of Artificial Sequence: Synthetic oligonucleotide

SEQ ID NO: 360917 - DNA, 26 bp, Artificial Sequence
  Description of Artificial Sequence: Synthetic oligonucleotide
gcggctcagaccaccaagcacaagtg

SEQ ID NO: 360918 - DNA, 33 bp, Artificial Sequence; identical to SEQ ID NO: 235065
  Description of Artificial Sequence: Synthetic oligonucleotide

SEQ ID NO: 360919 - DNA, 26 bp, Artificial Sequence
  Description of Artificial Sequence: Synthetic oligonucleotide
cggctcagaccaccaagcacaagtgg

SEQ ID NO: 360920 - DNA, 35 bp, Artificial Sequence; identical to SEQ ID NO: 235066
  Description of Artificial Sequence: Synthetic oligonucleotide

SEQ ID NO: 360921 - DNA, 27 bp, Artificial Sequence
  Description of Artificial Sequence: Synthetic oligonucleotide
ggctcagaccaccaagcacaagtggga

SEQ ID NO: 360922 - DNA, 35 bp, Artificial Sequence; identical to SEQ ID NO: 235067
  Description of Artificial Sequence: Synthetic oligonucleotide

SEQ ID NO: 360923 - DNA, 31 bp, Artificial Sequence; identical to SEQ ID NO: 4483
  Description of Artificial Sequence: Synthetic oligonucleotide

SEQ ID NO: 360924 - DNA, 36 bp, Artificial Sequence; identical to SEQ ID NO: 235068
  Description of Artificial Sequence: Synthetic oligonucleotide

SEQ ID NO: 360925 - DNA, 32 bp, Artificial Sequence; identical to SEQ ID NO: 4484
  Description of Artificial Sequence: Synthetic oligonucleotide

SEQ ID NO: 360926 - DNA, 36 bp, Artificial Sequence; identical to SEQ ID NO: 235069
  Description of Artificial Sequence: Synthetic oligonucleotide

SEQ ID NO: 360927 - DNA, 32 bp, Artificial Sequence; identical to SEQ ID NO: 4485
  Description of Artificial Sequence: Synthetic oligonucleotide

SEQ ID NO: 360928 - DNA, 35 bp, Artificial Sequence; identical to SEQ ID NO: 235070
  Description of Artificial Sequence: Synthetic oligonucleotide

SEQ ID NO: 360929 - DNA, 32 bp, Artificial Sequence; identical to SEQ ID NO: 4486
  Description of Artificial Sequence: Synthetic oligonucleotide

SEQ ID NO: 360930 - DNA, 34 bp, Artificial Sequence; identical to SEQ ID NO: 235071
  Description of Artificial Sequence: Synthetic oligonucleotide

SEQ ID NO: 360931 - DNA, 31 bp, Artificial Sequence; identical to SEQ ID NO: 4487
  Description of Artificial Sequence: Synthetic oligonucleotide

SEQ ID NO: 360932 - DNA, 33 bp, Artificial Sequence; identical to SEQ ID NO: 235072
  Description of Artificial Sequence: Synthetic oligonucleotide

SEQ ID NO: 360933 - DNA, 30 bp, Artificial Sequence; identical to SEQ ID NO: 4488
  Description of Artificial Sequence: Synthetic oligonucleotide

SEQ ID NO: 360934 - DNA, 32 bp, Artificial Sequence; identical to SEQ ID NO: 235073
  Description of Artificial Sequence: Synthetic oligonucleotide

SEQ ID NO: 360935 - DNA, 30 bp, Artificial Sequence; identical to SEQ ID NO: 4489
  Description of Artificial Sequence: Synthetic oligonucleotide

SEQ ID NO: 360936 - DNA, 31 bp, Artificial Sequence; identical to SEQ ID NO: 235074
  Description of Artificial Sequence: Synthetic oligonucleotide

SEQ ID NO: 360937 - DNA, 31 bp, Artificial Sequence; identical to SEQ ID NO: 4490
  Description of Artificial Sequence: Synthetic oligonucleotide

SEQ ID NO: 360938 - DNA, 30 bp, Artificial Sequence; identical to SEQ ID NO: 235075
  Description of Artificial Sequence: Synthetic oligonucleotide

SEQ ID NO: 360939 - DNA, 30 bp, Artificial Sequence; identical to SEQ ID NO: 4491
  Description of Artificial Sequence: Synthetic oligonucleotide

SEQ ID NO: 360940 - DNA, 31 bp, Artificial Sequence; identical to SEQ ID NO: 235076
  Description of Artificial Sequence: Synthetic oligonucleotide

SEQ ID NO: 360941 - DNA, 29 bp, Artificial Sequence
  Description of Artificial Sequence: Synthetic oligonucleotide
tacatcgccctgaaagaggatctgcgctc

SEQ ID NO: 360942 - DNA, 33 bp, Artificial Sequence; identical to SEQ ID NO: 235077
  Description of Artificial Sequence: Synthetic oligonucleotide

SEQ ID NO: 360943 - DNA, 28 bp, Artificial Sequence
  Description of Artificial Sequence: Synthetic oligonucleotide
acatcgccctgaaagaggatctgcgctc

SEQ ID NO: 360944 - DNA, 32 bp, Artificial Sequence; identical to SEQ ID NO: 235078
  Description of Artificial Sequence: Synthetic oligonucleotide

SEQ ID NO: 360945 - DNA, 27 bp, Artificial Sequence
  Description of Artificial Sequence: Synthetic oligonucleotide
catcgccctgaaagaggatctgcgctc

SEQ ID NO: 360946 - DNA, 31 bp, Artificial Sequence; identical to SEQ ID NO: 235079
  Description of Artificial Sequence: Synthetic oligonucleotide

SEQ ID NO: 360947 - DNA, 29 bp, Artificial Sequence
  Description of Artificial Sequence: Synthetic oligonucleotide
atcgccctgaaagaggatctgcgctcttg

SEQ ID NO: 360948 - DNA, 30 bp, Artificial Sequence; identical to SEQ ID NO: 235080
  Description of Artificial Sequence: Synthetic oligonucleotide

SEQ ID NO: 360949 - DNA, 28 bp, Artificial Sequence
  Description of Artificial Sequence: Synthetic oligonucleotide
tcgccctgaaagaggatctgcgctcttg

SEQ ID NO: 360950 - DNA, 30 bp, Artificial Sequence; identical to SEQ ID NO: 235081
  Description of Artificial Sequence: Synthetic oligonucleotide

SEQ ID NO: 360951 - DNA, 27 bp, Artificial Sequence
  Description of Artificial Sequence: Synthetic oligonucleotide
cgccctgaaagaggatctgcgctcttg

SEQ ID NO: 360952 - DNA, 31 bp, Artificial Sequence; identical to SEQ ID NO: 235082
  Description of Artificial Sequence: Synthetic oligonucleotide

SEQ ID NO: 360953 - DNA, 27 bp, Artificial Sequence
  Description of Artificial Sequence: Synthetic oligonucleotide
gccctgaaagaggatctgcgctcttgg

SEQ ID NO: 360954 - DNA, 30 bp, Artificial Sequence; identical to SEQ ID NO: 235083
  Description of Artificial Sequence: Synthetic oligonucleotide

SEQ ID NO: 360955 - DNA, 28 bp, Artificial Sequence
  Description of Artificial Sequence: Synthetic oligonucleotide
ccctgaaagaggatctgcgctcttggac

SEQ ID NO: 360956 - DNA, 30 bp, Artificial Sequence; identical to SEQ ID NO: 235084
  Description of Artificial Sequence: Synthetic oligonucleotide

SEQ ID NO: 360957 - DNA, 28 bp, Artificial Sequence
  Description of Artificial Sequence: Synthetic oligonucleotide
cctgaaagaggatctgcgctcttggacc

SEQ ID NO: 360958 - DNA, 29 bp, Artificial Sequence
  Description of Artificial Sequence: Synthetic oligonucleotide
ctggacttaccagatcctcgtgatgctgc

SEQ ID NO: 360959 - DNA, 28 bp, Artificial Sequence
  Description of Artificial Sequence: Synthetic oligonucleotide
ctgaaagaggatctgcgctcttggaccg

SEQ ID NO: 360960 - DNA, 33 bp, Artificial Sequence; identical to SEQ ID NO: 235086
  Description of Artificial Sequence: Synthetic oligonucleotide

SEQ ID NO: 360961 - DNA, 28 bp, Artificial Sequence
  Description of Artificial Sequence: Synthetic oligonucleotide
tgaaagaggatctgcgctcttggaccgc

SEQ ID NO: 360962 - DNA, 32 bp, Artificial Sequence; identical to SEQ ID NO: 235087
  Description of Artificial Sequence: Synthetic oligonucleotide

SEQ ID NO: 360963 - DNA, 27 bp, Artificial Sequence
  Description of Artificial Sequence: Synthetic oligonucleotide
gaaagaggatctgcgctcttggaccgc

SEQ ID NO: 360964 - DNA, 33 bp, Artificial Sequence; identical to SEQ ID NO: 235088
  Description of Artificial Sequence: Synthetic oligonucleotide

SEQ ID NO: 360965 - DNA, 27 bp, Artificial Sequence
  Description of Artificial Sequence: Synthetic oligonucleotide
aaagaggatctgcgctcttggaccgcg

SEQ ID NO: 360966 - DNA, 34 bp, Artificial Sequence; identical to SEQ ID NO: 235089
  Description of Artificial Sequence: Synthetic oligonucleotide

SEQ ID NO: 360967 - DNA, 26 bp, Artificial Sequence
  Description of Artificial Sequence: Synthetic oligonucleotide
aagaggatctgcgctcttggaccgcg

SEQ ID NO: 360968 - DNA, 33 bp, Artificial Sequence; identical to SEQ ID NO: 235090
  Description of Artificial Sequence: Synthetic oligonucleotide

SEQ ID NO: 360969 - DNA, 25 bp, Artificial Sequence
  Description of Artificial Sequence: Synthetic oligonucleotide
agaggatctgcgctcttggaccgcg

SEQ ID NO: 360970 - DNA, 33 bp, Artificial Sequence; identical to SEQ ID NO: 235091
  Description of Artificial Sequence: Synthetic oligonucleotide

SEQ ID NO: 360971 - DNA, 24 bp, Artificial Sequence
  Description of Artificial Sequence: Synthetic oligonucleotide
gaggatctgcgctcttggaccgcg

SEQ ID NO: 360972 - DNA, 32 bp, Artificial Sequence; identical to SEQ ID NO: 235092
  Description of Artificial Sequence: Synthetic oligonucleotide

SEQ ID NO: 360973 - DNA, 24 bp, Artificial Sequence
  Description of Artificial Sequence: Synthetic oligonucleotide
aggatctgcgctcttggaccgcgg

SEQ ID NO: 360974 - DNA, 31 bp, Artificial Sequence; identical to SEQ ID NO: 235093
  Description of Artificial Sequence: Synthetic oligonucleotide

SEQ ID NO: 360975 - DNA, 23 bp, Artificial Sequence
  Description of Artificial Sequence: Synthetic oligonucleotide
ggatctgcgctcttggaccgcgg

SEQ ID NO: 360976 - DNA, 30 bp, Artificial Sequence; identical to SEQ ID NO: 235094
  Description of Artificial Sequence: Synthetic oligonucleotide

SEQ ID NO: 360977 - DNA, 23 bp, Artificial Sequence
  Description of Artificial Sequence: Synthetic oligonucleotide
gatctgcgctcttggaccgcggc

SEQ ID NO: 360978 - DNA, 30 bp, Artificial Sequence; identical to SEQ ID NO: 235095
  Description of Artificial Sequence: Synthetic oligonucleotide

SEQ ID NO: 360979 - DNA, 23 bp, Artificial Sequence
  Description of Artificial Sequence: Synthetic oligonucleotide
atctgcgctcttggaccgcggcg

SEQ ID NO: 360980 - DNA, 30 bp, Artificial Sequence; identical to SEQ ID NO: 235096
  Description of Artificial Sequence: Synthetic oligonucleotide

SEQ ID NO: 360981 - DNA, 22 bp, Artificial Sequence
  Description of Artificial Sequence: Synthetic oligonucleotide
tctgcgctcttggaccgcggcg

SEQ ID NO: 360982 - DNA, 29 bp, Artificial Sequence
  Description of Artificial Sequence: Synthetic oligonucleotide
gatcctcgtgatgctgcaaatgactcgcc

SEQ ID NO: 360983 - DNA, 35 bp, Artificial Sequence; identical to SEQ ID NO: 4513
  Description of Artificial Sequence: Synthetic oligonucleotide

SEQ ID NO: 360984 - DNA, 30 bp, Artificial Sequence; identical to SEQ ID NO: 235098
  Description of Artificial Sequence: Synthetic oligonucleotide

SEQ ID NO: 360985 - DNA, 36 bp, Artificial Sequence; identical to SEQ ID NO: 4514
  Description of Artificial Sequence: Synthetic oligonucleotide

SEQ ID NO: 360986 - DNA, 29 bp, Artificial Sequence
  Description of Artificial Sequence: Synthetic oligonucleotide
tcctcgtgatgctgcaaatgactcgccag

SEQ ID NO: 360987 - DNA, 36 bp, Artificial Sequence; identical to SEQ ID NO: 4515
  Description of Artificial Sequence: Synthetic oligonucleotide

SEQ ID NO: 360988 - DNA, 28 bp, Artificial Sequence
  Description of Artificial Sequence: Synthetic oligonucleotide
cctcgtgatgctgcaaatgactcgccag

SEQ ID NO: 360989 - DNA, 35 bp, Artificial Sequence; identical to SEQ ID NO: 4516
  Description of Artificial Sequence: Synthetic oligonucleotide

SEQ ID NO: 360990 - DNA, 28 bp, Artificial Sequence
  Description of Artificial Sequence: Synthetic oligonucleotide
ctcgtgatgctgcaaatgactcgccagc

SEQ ID NO: 360991 - DNA, 35 bp, Artificial Sequence; identical to SEQ ID NO: 4517
  Description of Artificial Sequence: Synthetic oligonucleotide

SEQ ID NO: 360992 - DNA, 28 bp, Artificial Sequence
  Description of Artificial Sequence: Synthetic oligonucleotide
tcgtgatgctgcaaatgactcgccagcg

SEQ ID NO: 360993 - DNA, 25 bp, Artificial Sequence
  Description of Artificial Sequence: Synthetic oligonucleotide
cggctactacaaccagagcgaggcg

SEQ ID NO: 360994 - DNA, 27 bp, Artificial Sequence
  Description of Artificial Sequence: Synthetic oligonucleotide
cgtgatgctgcaaatgactcgccagcg

SEQ ID NO: 360995 - DNA, 25 bp, Artificial Sequence
  Description of Artificial Sequence: Synthetic oligonucleotide
ggctactacaaccagagcgaggcgg

SEQ ID NO: 360996 - DNA, 28 bp, Artificial Sequence
  Description of Artificial Sequence: Synthetic oligonucleotide
gtgatgctgcaaatgactcgccagcgtg

SEQ ID NO: 360997 - DNA, 27 bp, Artificial Sequence
  Description of Artificial Sequence: Synthetic oligonucleotide
gctactacaaccagagcgaggcgggtt

SEQ ID NO: 360998 - DNA, 28 bp, Artificial Sequence
  Description of Artificial Sequence: Synthetic oligonucleotide
tgatgctgcaaatgactcgccagcgtgg

SEQ ID NO: 360999 - DNA, 27 bp, Artificial Sequence
  Description of Artificial Sequence: Synthetic oligonucleotide
ctactacaaccagagcgaggcgggttc

SEQ ID NO: 361000 - DNA, 27 bp, Artificial Sequence
  Description of Artificial Sequence: Synthetic oligonucleotide
gatgctgcaaatgactcgccagcgtgg

SEQ ID NO: 361001 - DNA, 28 bp, Artificial Sequence
  Description of Artificial Sequence: Synthetic oligonucleotide
tactacaaccagagcgaggcgggttctc

SEQ ID NO: 361002 - DNA, 28 bp, Artificial Sequence
  Description of Artificial Sequence: Synthetic oligonucleotide
atgctgcaaatgactcgccagcgtggtg

SEQ ID NO: 361003 - DNA, 27 bp, Artificial Sequence
  Description of Artificial Sequence: Synthetic oligonucleotide
actacaaccagagcgaggcgggttctc

SEQ ID NO: 361004 - DNA, 27 bp, Artificial Sequence
  Description of Artificial Sequence: Synthetic oligonucleotide
tgctgcaaatgactcgccagcgtggtg

SEQ ID NO: 361005 - DNA, 27 bp, Artificial Sequence
  Description of Artificial Sequence: Synthetic oligonucleotide
ctacaaccagagcgaggcgggttctca

SEQ ID NO: 361006 - DNA, 27 bp, Artificial Sequence
  Description of Artificial Sequence: Synthetic oligonucleotide
gctgcaaatgactcgccagcgtggtga

SEQ ID NO: 361007 - DNA, 27 bp, Artificial Sequence
  Description of Artificial Sequence: Synthetic oligonucleotide
tacaaccagagcgaggcgggttctcac

SEQ ID NO: 361008 - DNA, 28 bp, Artificial Sequence
  Description of Artificial Sequence: Synthetic oligonucleotide
ctgcaaatgactcgccagcgtggtgatg

SEQ ID NO: 361009 - DNA, 27 bp, Artificial Sequence
  Description of Artificial Sequence: Synthetic oligonucleotide
acaaccagagcgaggcgggttctcaca

SEQ ID NO: 361010 - DNA, 29 bp, Artificial Sequence
  Description of Artificial Sequence: Synthetic oligonucleotide
tgcaaatgactcgccagcgtggtgatgtc

SEQ ID NO: 361011 - DNA, 26 bp, Artificial Sequence
  Description of Artificial Sequence: Synthetic oligonucleotide
caaccagagcgaggcgggttctcaca

SEQ ID NO: 361012 - DNA, 28 bp, Artificial Sequence
  Description of Artificial Sequence: Synthetic oligonucleotide
gcaaatgactcgccagcgtggtgatgtc

SEQ ID NO: 361013 - DNA, 26 bp, Artificial Sequence
  Description of Artificial Sequence: Synthetic oligonucleotide
aaccagagcgaggcgggttctcacac

SEQ ID NO: 361014 - DNA, 30 bp, Artificial Sequence; identical to SEQ ID NO: 235113
  Description of Artificial Sequence: Synthetic oligonucleotide

SEQ ID NO: 361015 - DNA, 25 bp, Artificial Sequence
  Description of Artificial Sequence: Synthetic oligonucleotide
accagagcgaggcgggttctcacac

SEQ ID NO: 361016 - DNA, 31 bp, Artificial Sequence; identical to SEQ ID NO: 235114
  Description of Artificial Sequence: Synthetic oligonucleotide

SEQ ID NO: 361017 - DNA, 24 bp, Artificial Sequence
  Description of Artificial Sequence: Synthetic oligonucleotide
ccagagcgaggcgggttctcacac

SEQ ID NO: 361018 - DNA, 30 bp, Artificial Sequence; identical to SEQ ID NO: 235115
  Description of Artificial Sequence: Synthetic oligonucleotide

SEQ ID NO: 361019 - DNA, 24 bp, Artificial Sequence
  Description of Artificial Sequence: Synthetic oligonucleotide
cagagcgaggcgggttctcacacc

SEQ ID NO: 361020 - DNA, 29 bp, Artificial Sequence
  Description of Artificial Sequence: Synthetic oligonucleotide
atgactcgccagcgtggtgatgtctactc

SEQ ID NO: 361021 - DNA, 25 bp, Artificial Sequence
  Description of Artificial Sequence: Synthetic oligonucleotide
agagcgaggcgggttctcacaccgt

SEQ ID NO: 361022 - DNA, 28 bp, Artificial Sequence
  Description of Artificial Sequence: Synthetic oligonucleotide
tgactcgccagcgtggtgatgtctactc

SEQ ID NO: 361023 - DNA, 24 bp, Artificial Sequence
  Description of Artificial Sequence: Synthetic oligonucleotide
gagcgaggcgggttctcacaccgt

SEQ ID NO: 361024 - DNA, 27 bp, Artificial Sequence
  Description of Artificial Sequence: Synthetic oligonucleotide
gactcgccagcgtggtgatgtctactc

SEQ ID NO: 361025 - DNA, 24 bp, Artificial Sequence
  Description of Artificial Sequence: Synthetic oligonucleotide
agcgaggcgggttctcacaccgtc

SEQ ID NO: 361026 - DNA, 27 bp, Artificial Sequence
  Description of Artificial Sequence: Synthetic oligonucleotide
actcgccagcgtggtgatgtctactcc

SEQ ID NO: 361027 - DNA, 23 bp, Artificial Sequence
  Description of Artificial Sequence: Synthetic oligonucleotide
gcgaggcgggttctcacaccgtc

SEQ ID NO: 361028 - DNA, 27 bp, Artificial Sequence
  Description of Artificial Sequence: Synthetic oligonucleotide
ctcgccagcgtggtgatgtctactcct

SEQ ID NO: 361029 - DNA, 24 bp, Artificial Sequence
  Description of Artificial Sequence: Synthetic oligonucleotide
cgaggcgggttctcacaccgtcca

SEQ ID NO: 361030 - DNA, 27 bp, Artificial Sequence
  Description of Artificial Sequence: Synthetic oligonucleotide
tcgccagcgtggtgatgtctactcctg

SEQ ID NO: 361031 - DNA, 25 bp, Artificial Sequence
  Description of Artificial Sequence: Synthetic oligonucleotide
gaggcgggttctcacaccgtccaga

SEQ ID NO: 361032 - DNA, 26 bp, Artificial Sequence
  Description of Artificial Sequence: Synthetic oligonucleotide
cgccagcgtggtgatgtctactcctg

SEQ ID NO: 361033 - DNA, 25 bp, Artificial Sequence
  Description of Artificial Sequence: Synthetic oligonucleotide
aggcgggttctcacaccgtccagag

SEQ ID NO: 361034 - DNA, 26 bp, Artificial Sequence
  Description of Artificial Sequence: Synthetic oligonucleotide
gccagcgtggtgatgtctactcctgc

SEQ ID NO: 361035 - DNA, 24 bp, Artificial Sequence
  Description of Artificial Sequence: Synthetic oligonucleotide
ggcgggttctcacaccgtccagag

SEQ ID NO: 361036 - DNA, 27 bp, Artificial Sequence
  Description of Artificial Sequence: Synthetic oligonucleotide
ccagcgtggtgatgtctactcctgcca

SEQ ID NO: 361037 - DNA, 26 bp, Artificial Sequence
  Description of Artificial Sequence: Synthetic oligonucleotide
gcgggttctcacaccgtccagaggat

SEQ ID NO: 361038 - DNA, 27 bp, Artificial Sequence
  Description of Artificial Sequence: Synthetic oligonucleotide
cagcgtggtgatgtctactcctgccac

SEQ ID NO: 361039 - DNA, 27 bp, Artificial Sequence
  Description of Artificial Sequence: Synthetic oligonucleotide
cgggttctcacaccgtccagaggatgt

SEQ ID NO: 361040 - DNA, 27 bp, Artificial Sequence
  Description of Artificial Sequence: Synthetic oligonucleotide
agcgtggtgatgtctactcctgccacg

SEQ ID NO: 361041 - DNA, 29 bp, Artificial Sequence
  Description of Artificial Sequence: Synthetic oligonucleotide
gggttctcacaccgtccagaggatgtatg

SEQ ID NO: 361042 - DNA, 27 bp, Artificial Sequence
  Description of Artificial Sequence: Synthetic oligonucleotide
gcgtggtgatgtctactcctgccacga

SEQ ID NO: 361043 - DNA, 22 bp, Artificial Sequence
  Description of Artificial Sequence: Synthetic oligonucleotide
ccgcggggagccccgcttcata

SEQ ID NO: 361044 - DNA, 27 bp, Artificial Sequence
  Description of Artificial Sequence: Synthetic oligonucleotide
cgtggtgatgtctactcctgccacgag

SEQ ID NO: 361045 - DNA, 22 bp, Artificial Sequence
  Description of Artificial Sequence: Synthetic oligonucleotide
cgcggggagccccgcttcatag

SEQ ID NO: 361046 - DNA, 27 bp, Artificial Sequence
  Description of Artificial Sequence: Synthetic oligonucleotide
gtggtgatgtctactcctgccacgagg

SEQ ID NO: 361047 - DNA, 23 bp, Artificial Sequence
  Description of Artificial Sequence: Synthetic oligonucleotide
gcggggagccccgcttcatagca

SEQ ID NO: 361048 - DNA, 28 bp, Artificial Sequence
  Description of Artificial Sequence: Synthetic oligonucleotide
tggtgatgtctactcctgccacgaggag

SEQ ID NO: 361049 - DNA, 24 bp, Artificial Sequence
  Description of Artificial Sequence: Synthetic oligonucleotide
cggggagccccgcttcatagcagt

SEQ ID NO: 361050 - DNA, 27 bp, Artificial Sequence
  Description of Artificial Sequence: Synthetic oligonucleotide
ggtgatgtctactcctgccacgaggag

SEQ ID NO: 361051 - DNA, 24 bp, Artificial Sequence
  Description of Artificial Sequence: Synthetic oligonucleotide
ggggagccccgcttcatagcagtg

SEQ ID NO: 361052 - DNA, 27 bp, Artificial Sequence
  Description of Artificial Sequence: Synthetic oligonucleotide
gtgatgtctactcctgccacgaggagc

SEQ ID NO: 361053 - DNA, 24 bp, Artificial Sequence
  Description of Artificial Sequence: Synthetic oligonucleotide
gggagccccgcttcatagcagtgg

SEQ ID NO: 361054 - DNA, 28 bp, Artificial Sequence
  Description of Artificial Sequence: Synthetic oligonucleotide
tgatgtctactcctgccacgaggagcac

SEQ ID NO: 361055 - DNA, 24 bp, Artificial Sequence
  Description of Artificial Sequence: Synthetic oligonucleotide
ggagccccgcttcatagcagtggg

SEQ ID NO: 361056 - DNA, 27 bp, Artificial Sequence
  Description of Artificial Sequence: Synthetic oligonucleotide
gatgtctactcctgccacgaggagcac

SEQ ID NO: 361057 - DNA, 26 bp, Artificial Sequence
  Description of Artificial Sequence: Synthetic oligonucleotide
gagccccgcttcatagcagtgggcta

SEQ ID NO: 361058 - DNA, 27 bp, Artificial Sequence
  Description of Artificial Sequence: Synthetic oligonucleotide
atgtctactcctgccacgaggagcacc

SEQ ID NO: 361059 - DNA, 26 bp, Artificial Sequence
  Description of Artificial Sequence: Synthetic oligonucleotide
agccccgcttcatagcagtgggctac

SEQ ID NO: 361060 - DNA, 26 bp, Artificial Sequence
  Description of Artificial Sequence: Synthetic oligonucleotide
tgtctactcctgccacgaggagcacc

SEQ ID NO: 361061 - DNA, 25 bp, Artificial Sequence
  Description of Artificial Sequence: Synthetic oligonucleotide
gccccgcttcatagcagtgggctac

SEQ ID NO: 361062 - DNA, 25 bp, Artificial Sequence
  Description of Artificial Sequence: Synthetic oligonucleotide
gtctactcctgccacgaggagcacc

SEQ ID NO: 361063 - DNA, 26 bp, Artificial Sequence
  Description of Artificial Sequence: Synthetic oligonucleotide
ccccgcttcatagcagtgggctacgt

SEQ ID NO: 361064 - DNA, 25 bp, Artificial Sequence
  Description of Artificial Sequence: Synthetic oligonucleotide
tctactcctgccacgaggagcaccc

SEQ ID NO: 361065 - DNA, 26 bp, Artificial Sequence
  Description of Artificial Sequence: Synthetic oligonucleotide
cccgcttcatagcagtgggctacgtg

SEQ ID NO: 361066 - DNA, 24 bp, Artificial Sequence
  Description of Artificial Sequence: Synthetic oligonucleotide
ctactcctgccacgaggagcaccc

SEQ ID NO: 361067 - DNA, 27 bp, Artificial Sequence
  Description of Artificial Sequence: Synthetic oligonucleotide
ccgcttcatagcagtgggctacgtgga

SEQ ID NO: 361068 - DNA, 25 bp, Artificial Sequence
  Description of Artificial Sequence: Synthetic oligonucleotide
tactcctgccacgaggagcacccga

SEQ ID NO: 361069 - DNA, 27 bp, Artificial Sequence
  Description of Artificial Sequence: Synthetic oligonucleotide
cgcttcatagcagtgggctacgtggac

SEQ ID NO: 361070 - DNA, 24 bp, Artificial Sequence
  Description of Artificial Sequence: Synthetic oligonucleotide
actcctgccacgaggagcacccga

SEQ ID NO: 361071 - DNA, 27 bp, Artificial Sequence
  Description of Artificial Sequence: Synthetic oligonucleotide
gcttcatagcagtgggctacgtggacg

SEQ ID NO: 361072 - DNA, 23 bp, Artificial Sequence
  Description of Artificial Sequence: Synthetic oligonucleotide
ctcctgccacgaggagcacccga

SEQ ID NO: 361073 - DNA, 28 bp, Artificial Sequence
  Description of Artificial Sequence: Synthetic oligonucleotide
cttcatagcagtgggctacgtggacgac

SEQ ID NO: 361074 - DNA, 23 bp, Artificial Sequence
  Description of Artificial Sequence: Synthetic oligonucleotide
tcctgccacgaggagcacccgag

SEQ ID NO: 361075 - DNA, 29 bp, Artificial Sequence
  Description of Artificial Sequence: Synthetic oligonucleotide
ttcatagcagtgggctacgtggacgacac

SEQ ID NO: 361076 - DNA, 22 bp, Artificial Sequence
  Description of Artificial Sequence: Synthetic oligonucleotide
cctgccacgaggagcacccgag

SEQ ID NO: 361077 - DNA, 28 bp, Artificial Sequence
  Description of Artificial Sequence: Synthetic oligonucleotide
tcatagcagtgggctacgtggacgacac

SEQ ID NO: 361078 - DNA, 22 bp, Artificial Sequence
  Description of Artificial Sequence: Synthetic oligonucleotide
ctgccacgaggagcacccgagc

SEQ ID NO: 361079 - DNA, 27 bp, Artificial Sequence
  Description of Artificial Sequence: Synthetic oligonucleotide
catagcagtgggctacgtggacgacac

SEQ ID NO: 361080 - DNA, 23 bp, Artificial Sequence
  Description of Artificial Sequence: Synthetic oligonucleotide
tgccacgaggagcacccgagcct

SEQ ID NO: 361081 - DNA, 27 bp, Artificial Sequence
  Description of Artificial Sequence: Synthetic oligonucleotide
atagcagtgggctacgtggacgacacg

SEQ ID NO: 361082 - DNA, 22 bp, Artificial Sequence
  Description of Artificial Sequence: Synthetic oligonucleotide
gccacgaggagcacccgagcct

SEQ ID NO: 361083 - DNA, 26 bp, Artificial Sequence
  Description of Artificial Sequence: Synthetic oligonucleotide
tagcagtgggctacgtggacgacacg

SEQ ID NO: 361084 - DNA, 22 bp, Artificial Sequence
  Description of Artificial Sequence: Synthetic oligonucleotide
ccacgaggagcacccgagcctc

SEQ ID NO: 361085 - DNA, 25 bp, Artificial Sequence
  Description of Artificial Sequence: Synthetic oligonucleotide
agcagtgggctacgtggacgacacg

SEQ ID NO: 361086 - DNA, 23 bp, Artificial Sequence
  Description of Artificial Sequence: Synthetic oligonucleotide
cacgaggagcacccgagcctcca

SEQ ID NO: 361087 - DNA, 23 bp, Artificial Sequence
  Description of Artificial Sequence: Synthetic oligonucleotide
cgccgcggacatggcagctcaga

SEQ ID NO: 361088 - DNA, 24 bp, Artificial Sequence
  Description of Artificial Sequence: Synthetic oligonucleotide
acgaggagcacccgagcctccagt

SEQ ID NO: 361089 - DNA, 23 bp, Artificial Sequence
  Description of Artificial Sequence: Synthetic oligonucleotide
gccgcggacatggcagctcagac

SEQ ID NO: 361090 - DNA, 23 bp, Artificial Sequence
  Description of Artificial Sequence: Synthetic oligonucleotide
cgaggagcacccgagcctccagt

SEQ ID NO: 361091 - DNA, 24 bp, Artificial Sequence
  Description of Artificial Sequence: Synthetic oligonucleotide
ccgcggacatggcagctcagacca

SEQ ID NO: 361092 - DNA, 23 bp, Artificial Sequence
  Description of Artificial Sequence: Synthetic oligonucleotide
gaggagcacccgagcctccagtg

SEQ ID NO: 361093 - DNA, 24 bp, Artificial Sequence
  Description of Artificial Sequence: Synthetic oligonucleotide
cgcggacatggcagctcagaccac

SEQ ID NO: 361094 - DNA, 23 bp, Artificial Sequence
  Description of Artificial Sequence: Synthetic oligonucleotide
aggagcacccgagcctccagtgc

SEQ ID NO: 361095 - DNA, 27 bp, Artificial Sequence
  Description of Artificial Sequence: Synthetic oligonucleotide
gtggcggagcagttgagagcctaccta

SEQ ID NO: 361096 - DNA, 22 bp, Artificial Sequence
  Description of Artificial Sequence: Synthetic oligonucleotide
ggagcacccgagcctccagtgc

SEQ ID NO: 361097 - DNA, 27 bp, Artificial Sequence
  Description of Artificial Sequence: Synthetic oligonucleotide
tggcggagcagttgagagcctacctag

SEQ ID NO: 361098 - DNA, 22 bp, Artificial Sequence
  Description of Artificial Sequence: Synthetic oligonucleotide
gagcacccgagcctccagtgcc

SEQ ID NO: 361099 - DNA, 27 bp, Artificial Sequence
  Description of Artificial Sequence: Synthetic oligonucleotide
ggcggagcagttgagagcctacctaga

SEQ ID NO: 361100 - DNA, 22 bp, Artificial Sequence
  Description of Artificial Sequence: Synthetic oligonucleotide
agcacccgagcctccagtgccc

SEQ ID NO: 361101 - DNA, 27 bp, Artificial Sequence
  Description of Artificial Sequence: Synthetic oligonucleotide
gcggagcagttgagagcctacctagag

SEQ ID NO: 361102 - DNA, 21 bp, Artificial Sequence
  Description of Artificial Sequence: Synthetic oligonucleotide
gcacccgagcctccagtgccc

SEQ ID NO: 361103 - DNA, 27 bp, Artificial Sequence
  Description of Artificial Sequence: Synthetic oligonucleotide
cggagcagttgagagcctacctagagg

SEQ ID NO: 361104 - DNA, 23 bp, Artificial Sequence
  Description of Artificial Sequence: Synthetic oligonucleotide
cacccgagcctccagtgccccat

SEQ ID NO: 361105 - DNA, 27 bp, Artificial Sequence
  Description of Artificial Sequence: Synthetic oligonucleotide
ggagcagttgagagcctacctagaggg

SEQ ID NO: 361106 - DNA, 24 bp, Artificial Sequence
  Description of Artificial Sequence: Synthetic oligonucleotide
acccgagcctccagtgccccatct

SEQ ID NO: 361107 - DNA, 27 bp, Artificial Sequence
  Description of Artificial Sequence: Synthetic oligonucleotide
gagcagttgagagcctacctagagggc

SEQ ID NO: 361108 - DNA, 23 bp, Artificial Sequence
  Description of Artificial Sequence: Synthetic oligonucleotide
cccgagcctccagtgccccatct

SEQ ID NO: 361109 - DNA, 28 bp, Artificial Sequence
  Description of Artificial Sequence: Synthetic oligonucleotide
agcagttgagagcctacctagagggcac

SEQ ID NO: 361110 - DNA, 23 bp, Artificial Sequence
  Description of Artificial Sequence: Synthetic oligonucleotide
ccgagcctccagtgccccatctc

SEQ ID NO: 361111 - DNA, 27 bp, Artificial Sequence
  Description of Artificial Sequence: Synthetic oligonucleotide
gcagttgagagcctacctagagggcac

SEQ ID NO: 361112 - DNA, 23 bp, Artificial Sequence
  Description of Artificial Sequence: Synthetic oligonucleotide
cgagcctccagtgccccatctcc

SEQ ID NO: 361113 - DNA, 27 bp, Artificial Sequence
  Description of Artificial Sequence: Synthetic oligonucleotide
cagttgagagcctacctagagggcacg

SEQ ID NO: 361114 - DNA, 24 bp, Artificial Sequence
  Description of Artificial Sequence: Synthetic oligonucleotide
gagcctccagtgccccatctccgt

SEQ ID NO: 361115 - DNA, 28 bp, Artificial Sequence
  Description of Artificial Sequence: Synthetic oligonucleotide
agttgagagcctacctagagggcacgtg

SEQ ID NO: 361116 - DNA, 24 bp, Artificial Sequence
  Description of Artificial Sequence: Synthetic oligonucleotide
agcctccagtgccccatctccgtg

SEQ ID NO: 361117 - DNA, 27 bp, Artificial Sequence
  Description of Artificial Sequence: Synthetic oligonucleotide
gttgagagcctacctagagggcacgtg

SEQ ID NO: 361118 - DNA, 23 bp, Artificial Sequence
  Description of Artificial Sequence: Synthetic oligonucleotide
gcctccagtgccccatctccgtg

SEQ ID NO: 361119 - DNA, 27 bp, Artificial Sequence
  Description of Artificial Sequence: Synthetic oligonucleotide
ttgagagcctacctagagggcacgtgc

SEQ ID NO: 361120 - DNA, 24 bp, Artificial Sequence
  Description of Artificial Sequence: Synthetic oligonucleotide
cctccagtgccccatctccgtgga

SEQ ID NO: 361121 - DNA, 26 bp, Artificial Sequence
  Description of Artificial Sequence: Synthetic oligonucleotide
tgagagcctacctagagggcacgtgc

SEQ ID NO: 361122 - DNA, 25 bp, Artificial Sequence
  Description of Artificial Sequence: Synthetic oligonucleotide
ctccagtgccccatctccgtggagt

SEQ ID NO: 361123 - DNA, 25 bp, Artificial Sequence
  Description of Artificial Sequence: Synthetic oligonucleotide
gagagcctacctagagggcacgtgc

SEQ ID NO: 361124 - DNA, 25 bp, Artificial Sequence
  Description of Artificial Sequence: Synthetic oligonucleotide
tccagtgccccatctccgtggagtg

SEQ ID NO: 361125 - DNA, 26 bp, Artificial Sequence
  Description of Artificial Sequence: Synthetic oligonucleotide
agagcctacctagagggcacgtgcgt

SEQ ID NO: 361126 - DNA, 24 bp, Artificial Sequence
  Description of Artificial Sequence: Synthetic oligonucleotide
ccagtgccccatctccgtggagtg

SEQ ID NO: 361127 - DNA, 25 bp, Artificial Sequence
  Description of Artificial Sequence: Synthetic oligonucleotide
gagcctacctagagggcacgtgcgt

SEQ ID NO: 361128 - DNA, 24 bp, Artificial Sequence
  Description of Artificial Sequence: Synthetic oligonucleotide
cagtgccccatctccgtggagtgc

SEQ ID NO: 361129 - DNA, 25 bp, Artificial Sequence
  Description of Artificial Sequence: Synthetic oligonucleotide
agcctacctagagggcacgtgcgtg

SEQ ID NO: 361130 - DNA, 24 bp, Artificial Sequence
  Description of Artificial Sequence: Synthetic oligonucleotide
agtgccccatctccgtggagtgcc

SEQ ID NO: 361131 - DNA, 24 bp, Artificial Sequence
  Description of Artificial Sequence: Synthetic oligonucleotide
gcctacctagagggcacgtgcgtg

SEQ ID NO: 361132 - DNA, 23 bp, Artificial Sequence
  Description of Artificial Sequence: Synthetic oligonucleotide
gtgccccatctccgtggagtgcc

SEQ ID NO: 361133 - DNA, 25 bp, Artificial Sequence
  Description of Artificial Sequence: Synthetic oligonucleotide
cctacctagagggcacgtgcgtgga

SEQ ID NO: 361134 - DNA, 23 bp, Artificial Sequence
  Description of Artificial Sequence: Synthetic oligonucleotide
tgccccatctccgtggagtgccg

SEQ ID NO: 361135 - DNA, 26 bp, Artificial Sequence
  Description of Artificial Sequence: Synthetic oligonucleotide
ctacctagagggcacgtgcgtggagt

SEQ ID NO: 361136 - DNA, 22 bp, Artificial Sequence
  Description of Artificial Sequence: Synthetic oligonucleotide
gccccatctccgtggagtgccg

SEQ ID NO: 361137 - DNA, 26 bp, Artificial Sequence
  Description of Artificial Sequence: Synthetic oligonucleotide
tacctagagggcacgtgcgtggagtg

SEQ ID NO: 361138 - DNA, 22 bp, Artificial Sequence
  Description of Artificial Sequence: Synthetic oligonucleotide
ccccatctccgtggagtgccgg

SEQ ID NO: 361139 - DNA, 25 bp, Artificial Sequence
  Description of Artificial Sequence: Synthetic oligonucleotide
acctagagggcacgtgcgtggagtg

SEQ ID NO: 361140 - DNA, 22 bp, Artificial Sequence
  Description of Artificial Sequence: Synthetic oligonucleotide
cccatctccgtggagtgccggg

SEQ ID NO: 361141 - DNA, 24 bp, Artificial Sequence
  Description of Artificial Sequence: Synthetic oligonucleotide
cctagagggcacgtgcgtggagtg

SEQ ID NO: 361142 - DNA, 23 bp, Artificial Sequence
  Description of Artificial Sequence: Synthetic oligonucleotide
ccatctccgtggagtgccgggct

SEQ ID NO: 361143 - DNA, 24 bp, Artificial Sequence
  Description of Artificial Sequence: Synthetic oligonucleotide
ctagagggcacgtgcgtggagtgg

SEQ ID NO: 361144 - DNA, 24 bp, Artificial Sequence
  Description of Artificial Sequence: Synthetic oligonucleotide
catctccgtggagtgccgggctca

SEQ ID NO: 361145 - DNA, 25 bp, Artificial Sequence
  Description of Artificial Sequence: Synthetic oligonucleotide
tagagggcacgtgcgtggagtggct

SEQ ID NO: 361146 - DNA, 25 bp, Artificial Sequence
  Description of Artificial Sequence: Synthetic oligonucleotide
atctccgtggagtgccgggctcaga

SEQ ID NO: 361147 - DNA, 24 bp, Artificial Sequence
  Description of Artificial Sequence: Synthetic oligonucleotide
agagggcacgtgcgtggagtggct

SEQ ID NO: 361148 - DNA, 24 bp, Artificial Sequence
  Description of Artificial Sequence: Synthetic oligonucleotide
tctccgtggagtgccgggctcaga

SEQ ID NO: 361149 - DNA, 35 bp, Artificial Sequence; identical to SEQ ID NO: 4599
  Description of Artificial Sequence: Synthetic oligonucleotide

SEQ ID NO: 361150 - DNA, 23 bp, Artificial Sequence
  Description of Artificial Sequence: Synthetic oligonucleotide
ctccgtggagtgccgggctcaga

SEQ ID NO: 361151 - DNA, 36 bp, Artificial Sequence; identical to SEQ ID NO: 4600
  Description of Artificial Sequence: Synthetic oligonucleotide

SEQ ID NO: 361152 - DNA, 24 bp, Artificial Sequence
  Description of Artificial Sequence: Synthetic oligonucleotide
tccgtggagtgccgggctcagact

SEQ ID NO: 361153 - DNA, 36 bp, Artificial Sequence; identical to SEQ ID NO: 4601
  Description of Artificial Sequence: Synthetic oligonucleotide

SEQ ID NO: 361154 - DNA, 23 bp, Artificial Sequence
  Description of Artificial Sequence: Synthetic oligonucleotide
ccgtggagtgccgggctcagact

SEQ ID NO: 361155 - DNA, 35 bp, Artificial Sequence; identical to SEQ ID NO: 4602
  Description of Artificial Sequence: Synthetic oligonucleotide

SEQ ID NO: 361156 - DNA, 26 bp, Artificial Sequence
  Description of Artificial Sequence: Synthetic oligonucleotide
cgtggagtgccgggctcagactgaat

SEQ ID NO: 361157 - DNA, 35 bp, Artificial Sequence; identical to SEQ ID NO: 4603
  Description of Artificial Sequence: Synthetic oligonucleotide

SEQ ID NO: 361158 - DNA, 27 bp, Artificial Sequence
  Description of Artificial Sequence: Synthetic oligonucleotide
gtggagtgccgggctcagactgaatct

SEQ ID NO: 361159 - DNA, 23 bp, Artificial Sequence
  Description of Artificial Sequence: Synthetic oligonucleotide
cgagccagaggatggagccgcga

SEQ ID NO: 361160 - DNA, 27 bp, Artificial Sequence
  Description of Artificial Sequence: Synthetic oligonucleotide
tggagtgccgggctcagactgaatctg

SEQ ID NO: 361161 - DNA, 23 bp, Artificial Sequence
  Description of Artificial Sequence: Synthetic oligonucleotide
gagccagaggatggagccgcgag

SEQ ID NO: 361162 - DNA, 26 bp, Artificial Sequence
  Description of Artificial Sequence: Synthetic oligonucleotide
ggagtgccgggctcagactgaatctg

SEQ ID NO: 361163 - DNA, 23 bp, Artificial Sequence
  Description of Artificial Sequence: Synthetic oligonucleotide
agccagaggatggagccgcgagc

SEQ ID NO: 361164 - DNA, 26 bp, Artificial Sequence
  Description of Artificial Sequence: Synthetic oligonucleotide
gagtgccgggctcagactgaatctgg

SEQ ID NO: 361165 - DNA, 22 bp, Artificial Sequence
  Description of Artificial Sequence: Synthetic oligonucleotide
gccagaggatggagccgcgagc

SEQ ID NO: 361166 - DNA, 26 bp, Artificial Sequence
  Description of Artificial Sequence: Synthetic oligonucleotide
agtgccgggctcagactgaatctggc

SEQ ID NO: 361167 - DNA, 22 bp, Artificial Sequence
  Description of Artificial Sequence: Synthetic oligonucleotide
ccagaggatggagccgcgagcg

SEQ ID NO: 361168 - DNA, 25 bp, Artificial Sequence
  Description of Artificial Sequence: Synthetic oligonucleotide
gtgccgggctcagactgaatctggc

SEQ ID NO: 361169 - DNA, 22 bp, Artificial Sequence
  Description of Artificial Sequence: Synthetic oligonucleotide
cagaggatggagccgcgagcgc

SEQ ID NO: 361170 - DNA, 26 bp, Artificial Sequence
  Description of Artificial Sequence: Synthetic oligonucleotide
tgccgggctcagactgaatctggcca

SEQ ID NO: 361171 - DNA, 22 bp, Artificial Sequence
  Description of Artificial Sequence: Synthetic oligonucleotide
agaggatggagccgcgagcgcc

SEQ ID NO: 361172 - DNA, 25 bp, Artificial Sequence
  Description of Artificial Sequence: Synthetic oligonucleotide
gccgggctcagactgaatctggcca

SEQ ID NO: 361173 - DNA, 21 bp, Artificial Sequence
  Description of Artificial Sequence: Synthetic oligonucleotide
gaggatggagccgcgagcgcc

SEQ ID NO: 361174 - DNA, 26 bp, Artificial Sequence
  Description of Artificial Sequence: Synthetic oligonucleotide
ccgggctcagactgaatctggccaga

SEQ ID NO: 361175 - DNA, 22 bp, Artificial Sequence
  Description of Artificial Sequence: Synthetic oligonucleotide
aggatggagccgcgagcgccgt

SEQ ID NO: 361176 - DNA, 26 bp, Artificial Sequence
  Description of Artificial Sequence: Synthetic oligonucleotide
cgggctcagactgaatctggccagag

SEQ ID NO: 361177 - DNA, 21 bp, Artificial Sequence
  Description of Artificial Sequence: Synthetic oligonucleotide
ggatggagccgcgagcgccgt

SEQ ID NO: 361178 - DNA, 27 bp, Artificial Sequence
  Description of Artificial Sequence: Synthetic oligonucleotide
gggctcagactgaatctggccagagca

SEQ ID NO: 361179 - DNA, 21 bp, Artificial Sequence
  Description of Artificial Sequence: Synthetic oligonucleotide
gatggagccgcgagcgccgtg

SEQ ID NO: 361180 - DNA, 28 bp, Artificial Sequence
  Description of Artificial Sequence: Synthetic oligonucleotide
ggctcagactgaatctggccagagcaac

SEQ ID NO: 361181 - DNA, 24 bp, Artificial Sequence
  Description of Artificial Sequence: Synthetic oligonucleotide
atggagccgcgagcgccgtggata

SEQ ID NO: 361182 - DNA, 30 bp, Artificial Sequence; identical to SEQ ID NO: 235197
  Description of Artificial Sequence: Synthetic oligonucleotide

SEQ ID NO: 361183 - DNA, 23 bp, Artificial Sequence
  Description of Artificial Sequence: Synthetic oligonucleotide
tggagccgcgagcgccgtggata

SEQ ID NO: 361184 - DNA, 30 bp, Artificial Sequence; identical to SEQ ID NO: 235198
  Description of Artificial Sequence: Synthetic oligonucleotide

SEQ ID NO: 361185 - DNA, 22 bp, Artificial Sequence
  Description of Artificial Sequence: Synthetic oligonucleotide
ggagccgcgagcgccgtggata

SEQ ID NO: 361186 - DNA, 31 bp, Artificial Sequence; identical to SEQ ID NO: 235199
  Description of Artificial Sequence: Synthetic oligonucleotide

SEQ ID NO: 361187 - DNA, 23 bp, Artificial Sequence
  Description of Artificial Sequence: Synthetic oligonucleotide
gagccgcgagcgccgtggataga

SEQ ID NO: 361188 - DNA, 30 bp, Artificial Sequence; identical to SEQ ID NO: 235200
  Description of Artificial Sequence: Synthetic oligonucleotide

SEQ ID NO: 361189 - DNA, 23 bp, Artificial Sequence
  Description of Artificial Sequence: Synthetic oligonucleotide
agccgcgagcgccgtggatagag

SEQ ID NO: 361190 - DNA, 31 bp, Artificial Sequence; identical to SEQ ID NO: 235201
  Description of Artificial Sequence: Synthetic oligonucleotide

SEQ ID NO: 361191 - DNA, 22 bp, Artificial Sequence
  Description of Artificial Sequence: Synthetic oligonucleotide
gccgcgagcgccgtggatagag

SEQ ID NO: 361192 - DNA, 30 bp, Artificial Sequence; identical to SEQ ID NO: 235202
  Description of Artificial Sequence: Synthetic oligonucleotide

SEQ ID NO: 361193 - DNA, 23 bp, Artificial Sequence
  Description of Artificial Sequence: Synthetic oligonucleotide
ccgcgagcgccgtggatagagca

SEQ ID NO: 361194 - DNA, 31 bp, Artificial Sequence; identical to SEQ ID NO: 235203
  Description of Artificial Sequence: Synthetic oligonucleotide

SEQ ID NO: 361195 - DNA, 23 bp, Artificial Sequence
  Description of Artificial Sequence: Synthetic oligonucleotide
cgcgagcgccgtggatagagcag

SEQ ID NO: 361196 - DNA, 30 bp, Artificial Sequence; identical to SEQ ID NO: 235204
  Description of Artificial Sequence: Synthetic oligonucleotide

SEQ ID NO: 361197 - DNA, 24 bp, Artificial Sequence
  Description of Artificial Sequence: Synthetic oligonucleotide
gcgagcgccgtggatagagcagga

SEQ ID NO: 361198 - DNA, 30 bp, Artificial Sequence; identical to SEQ ID NO: 235205
  Description of Artificial Sequence: Synthetic oligonucleotide

SEQ ID NO: 361199 - DNA, 24 bp, Artificial Sequence
  Description of Artificial Sequence: Synthetic oligonucleotide
cgagcgccgtggatagagcaggag

SEQ ID NO: 361200 - DNA, 29 bp, Artificial Sequence
  Description of Artificial Sequence: Synthetic oligonucleotide
gaatctggccagagcaacatgctgagtcg

SEQ ID NO: 361201 - DNA, 24 bp, Artificial Sequence
  Description of Artificial Sequence: Synthetic oligonucleotide
gagcgccgtggatagagcaggagg

SEQ ID NO: 361202 - DNA, 29 bp, Artificial Sequence
  Description of Artificial Sequence: Synthetic oligonucleotide
aatctggccagagcaacatgctgagtcgc

SEQ ID NO: 361203 - DNA, 25 bp, Artificial Sequence
  Description of Artificial Sequence: Synthetic oligonucleotide
agcgccgtggatagagcaggagggt

SEQ ID NO: 361204 - DNA, 28 bp, Artificial Sequence
  Description of Artificial Sequence: Synthetic oligonucleotide
atctggccagagcaacatgctgagtcgc

SEQ ID NO: 361205 - DNA, 27 bp, Artificial Sequence
  Description of Artificial Sequence: Synthetic oligonucleotide
gtgggctacgtggacgacacgcagttt

SEQ ID NO: 361206 - DNA, 27 bp, Artificial Sequence
  Description of Artificial Sequence: Synthetic oligonucleotide
tctggccagagcaacatgctgagtcgc

SEQ ID NO: 361207 - DNA, 27 bp, Artificial Sequence
  Description of Artificial Sequence: Synthetic oligonucleotide
tgggctacgtggacgacacgcagtttg

SEQ ID NO: 361208 - DNA, 26 bp, Artificial Sequence
  Description of Artificial Sequence: Synthetic oligonucleotide
ctggccagagcaacatgctgagtcgc

SEQ ID NO: 361209 - DNA, 27 bp, Artificial Sequence
  Description of Artificial Sequence: Synthetic oligonucleotide
gggctacgtggacgacacgcagtttgt

SEQ ID NO: 361210 - DNA, 27 bp, Artificial Sequence
  Description of Artificial Sequence: Synthetic oligonucleotide
tggccagagcaacatgctgagtcgcgt

SEQ ID NO: 361211 - DNA, 27 bp, Artificial Sequence
  Description of Artificial Sequence: Synthetic oligonucleotide
ggctacgtggacgacacgcagtttgtg

SEQ ID NO: 361212 - DNA, 27 bp, Artificial Sequence
  Description of Artificial Sequence: Synthetic oligonucleotide
ggccagagcaacatgctgagtcgcgtt

SEQ ID NO: 361213 - DNA, 27 bp, Artificial Sequence
  Description of Artificial Sequence: Synthetic oligonucleotide
gctacgtggacgacacgcagtttgtgc

SEQ ID NO: 361214 - DNA, 27 bp, Artificial Sequence
  Description of Artificial Sequence: Synthetic oligonucleotide
gccagagcaacatgctgagtcgcgttg

SEQ ID NO: 361215 - DNA, 27 bp, Artificial Sequence
  Description of Artificial Sequence: Synthetic oligonucleotide
ctacgtggacgacacgcagtttgtgcg

SEQ ID NO: 361216 - DNA, 27 bp, Artificial Sequence
  Description of Artificial Sequence: Synthetic oligonucleotide
ccagagcaacatgctgagtcgcgttgg

SEQ ID NO: 361217 - DNA, 27 bp, Artificial Sequence
  Description of Artificial Sequence: Synthetic oligonucleotide
tacgtggacgacacgcagtttgtgcgg

SEQ ID NO: 361218 - DNA, 28 bp, Artificial Sequence
  Description of Artificial Sequence: Synthetic oligonucleotide
cagagcaacatgctgagtcgcgttggag

SEQ ID NO: 361219 - DNA, 27 bp, Artificial Sequence
  Description of Artificial Sequence: Synthetic oligonucleotide
acgtggacgacacgcagtttgtgcggt

SEQ ID NO: 361220 - DNA, 28 bp, Artificial Sequence
  Description of Artificial Sequence: Synthetic oligonucleotide
agagcaacatgctgagtcgcgttggagc

SEQ ID NO: 361221 - DNA, 27 bp, Artificial Sequence
  Description of Artificial Sequence: Synthetic oligonucleotide
cgtggacgacacgcagtttgtgcggtt

SEQ ID NO: 361222 - DNA, 27 bp, Artificial Sequence
  Description of Artificial Sequence: Synthetic oligonucleotide
gagcaacatgctgagtcgcgttggagc

SEQ ID NO: 361223 - DNA, 27 bp, Artificial Sequence
  Description of Artificial Sequence: Synthetic oligonucleotide
gtggacgacacgcagtttgtgcggttc

SEQ ID NO: 361224 - DNA, 27 bp, Artificial Sequence
  Description of Artificial Sequence: Synthetic oligonucleotide
agcaacatgctgagtcgcgttggagcc

SEQ ID NO: 361225 - DNA, 27 bp, Artificial Sequence
  Description of Artificial Sequence: Synthetic oligonucleotide
tggacgacacgcagtttgtgcggttcg

SEQ ID NO: 361226 - DNA, 27 bp, Artificial Sequence
  Description of Artificial Sequence: Synthetic oligonucleotide
gcaacatgctgagtcgcgttggagcct

SEQ ID NO: 361227 - DNA, 27 bp, Artificial Sequence
  Description of Artificial Sequence: Synthetic oligonucleotide
ggacgacacgcagtttgtgcggttcga

SEQ ID NO: 361228 - DNA, 28 bp, Artificial Sequence
  Description of Artificial Sequence: Synthetic oligonucleotide
caacatgctgagtcgcgttggagccttc

SEQ ID NO: 361229 - DNA, 27 bp, Artificial Sequence
  Description of Artificial Sequence: Synthetic oligonucleotide
gacgacacgcagtttgtgcggttcgac

SEQ ID NO: 361230 - DNA, 28 bp, Artificial Sequence
  Description of Artificial Sequence: Synthetic oligonucleotide
aacatgctgagtcgcgttggagccttcg

SEQ ID NO: 361231 - DNA, 28 bp, Artificial Sequence
  Description of Artificial Sequence: Synthetic oligonucleotide
acgacacgcagtttgtgcggttcgacag

SEQ ID NO: 361232 - DNA, 27 bp, Artificial Sequence
  Description of Artificial Sequence: Synthetic oligonucleotide
acatgctgagtcgcgttggagccttcg

SEQ ID NO: 361233 - DNA, 27 bp, Artificial Sequence
  Description of Artificial Sequence: Synthetic oligonucleotide
cgacacgcagtttgtgcggttcgacag

SEQ ID NO: 361234 - DNA, 27 bp, Artificial Sequence
  Description of Artificial Sequence: Synthetic oligonucleotide
catgctgagtcgcgttggagccttcgt

SEQ ID NO: 361235 - DNA, 27 bp, Artificial Sequence
  Description of Artificial Sequence: Synthetic oligonucleotide
gacacgcagtttgtgcggttcgacagc

SEQ ID NO: 361236 - DNA, 27 bp, Artificial Sequence
  Description of Artificial Sequence: Synthetic oligonucleotide
atgctgagtcgcgttggagccttcgtg

SEQ ID NO: 361237 - DNA, 27 bp, Artificial Sequence
  Description of Artificial Sequence: Synthetic oligonucleotide
acacgcagtttgtgcggttcgacagcg

SEQ ID NO: 361238 - DNA, 26 bp, Artificial Sequence
  Description of Artificial Sequence: Synthetic oligonucleotide
tgctgagtcgcgttggagccttcgtg

SEQ ID NO: 361239 - DNA, 27 bp, Artificial Sequence
  Description of Artificial Sequence: Synthetic oligonucleotide
cacgcagtttgtgcggttcgacagcga

SEQ ID NO: 361240 - DNA, 25 bp, Artificial Sequence
  Description of Artificial Sequence: Synthetic oligonucleotide
gctgagtcgcgttggagccttcgtg

SEQ ID NO: 361241 - DNA, 27 bp, Artificial Sequence
  Description of Artificial Sequence: Synthetic oligonucleotide
acgcagtttgtgcggttcgacagcgac

SEQ ID NO: 361242 - DNA, 26 bp, Artificial Sequence
  Description of Artificial Sequence: Synthetic oligonucleotide
ctgagtcgcgttggagccttcgtgct

SEQ ID NO: 361243 - DNA, 26 bp, Artificial Sequence
  Description of Artificial Sequence: Synthetic oligonucleotide
cgcagtttgtgcggttcgacagcgac

SEQ ID NO: 361244 - DNA, 26 bp, Artificial Sequence
  Description of Artificial Sequence: Synthetic oligonucleotide
tgagtcgcgttggagccttcgtgctc

SEQ ID NO: 361245 - DNA, 26 bp, Artificial Sequence
  Description of Artificial Sequence: Synthetic oligonucleotide
gcagtttgtgcggttcgacagcgacg

SEQ ID NO: 361246 - DNA, 25 bp, Artificial Sequence
  Description of Artificial Sequence: Synthetic oligonucleotide
gagtcgcgttggagccttcgtgctc

SEQ ID NO: 361247 - DNA, 26 bp, Artificial Sequence
  Description of Artificial Sequence: Synthetic oligonucleotide
cagtttgtgcggttcgacagcgacgc

SEQ ID NO: 361248 - DNA, 25 bp, Artificial Sequence
  Description of Artificial Sequence: Synthetic oligonucleotide
agtcgcgttggagccttcgtgctcg

SEQ ID NO: 361249 - DNA, 26 bp, Artificial Sequence
  Description of Artificial Sequence: Synthetic oligonucleotide
agtttgtgcggttcgacagcgacgcc

SEQ ID NO: 361250 - DNA, 24 bp, Artificial Sequence
  Description of Artificial Sequence: Synthetic oligonucleotide
gtcgcgttggagccttcgtgctcg

SEQ ID NO: 361251 - DNA, 25 bp, Artificial Sequence
  Description of Artificial Sequence: Synthetic oligonucleotide
gtttgtgcggttcgacagcgacgcc

SEQ ID NO: 361252 - DNA, 24 bp, Artificial Sequence
  Description of Artificial Sequence: Synthetic oligonucleotide
tcgcgttggagccttcgtgctcgg

SEQ ID NO: 361253 - DNA, 25 bp, Artificial Sequence
  Description of Artificial Sequence: Synthetic oligonucleotide
tttgtgcggttcgacagcgacgccg

SEQ ID NO: 361254 - DNA, 23 bp, Artificial Sequence
  Description of Artificial Sequence: Synthetic oligonucleotide
cgcgttggagccttcgtgctcgg

SEQ ID NO: 361255 - DNA, 24 bp, Artificial Sequence
  Description of Artificial Sequence: Synthetic oligonucleotide
ttgtgcggttcgacagcgacgccg

SEQ ID NO: 361256 - DNA, 23 bp, Artificial Sequence
  Description of Artificial Sequence: Synthetic oligonucleotide
gcgttggagccttcgtgctcggg

SEQ ID NO: 361257 - DNA, 23 bp, Artificial Sequence
  Description of Artificial Sequence: Synthetic oligonucleotide
tgtgcggttcgacagcgacgccg

SEQ ID NO: 361258 - DNA, 24 bp, Artificial Sequence
  Description of Artificial Sequence: Synthetic oligonucleotide
cgttggagccttcgtgctcgggct

SEQ ID NO: 361259 - DNA, 25 bp, Artificial Sequence
  Description of Artificial Sequence: Synthetic oligonucleotide
agcctacctggagggcacgtgcgta

SEQ ID NO: 361260 - DNA, 26 bp, Artificial Sequence
  Description of Artificial Sequence: Synthetic oligonucleotide
gttggagccttcgtgctcgggctgat

SEQ ID NO: 361261 - DNA, 24 bp, Artificial Sequence
  Description of Artificial Sequence: Synthetic oligonucleotide
gcctacctggagggcacgtgcgta

SEQ ID NO: 361262 - DNA, 27 bp, Artificial Sequence
  Description of Artificial Sequence: Synthetic oligonucleotide
ttggagccttcgtgctcgggctgatca

SEQ ID NO: 361263 - DNA, 25 bp, Artificial Sequence
  Description of Artificial Sequence: Synthetic oligonucleotide
cctacctggagggcacgtgcgtaga

SEQ ID NO: 361264 - DNA, 27 bp, Artificial Sequence
  Description of Artificial Sequence: Synthetic oligonucleotide
tggagccttcgtgctcgggctgatcat

SEQ ID NO: 361265 - DNA, 26 bp, Artificial Sequence
  Description of Artificial Sequence: Synthetic oligonucleotide
ctacctggagggcacgtgcgtagagt

SEQ ID NO: 361266 - DNA, 26 bp, Artificial Sequence
  Description of Artificial Sequence: Synthetic oligonucleotide
ggagccttcgtgctcgggctgatcat

SEQ ID NO: 361267 - DNA, 26 bp, Artificial Sequence
  Description of Artificial Sequence: Synthetic oligonucleotide
tacctggagggcacgtgcgtagagtg

SEQ ID NO: 361268 - DNA, 26 bp, Artificial Sequence
  Description of Artificial Sequence: Synthetic oligonucleotide
gagccttcgtgctcgggctgatcatc

SEQ ID NO: 361269 - DNA, 25 bp, Artificial Sequence
  Description of Artificial Sequence: Synthetic oligonucleotide
acctggagggcacgtgcgtagagtg

SEQ ID NO: 361270 - DNA, 27 bp, Artificial Sequence
  Description of Artificial Sequence: Synthetic oligonucleotide
agccttcgtgctcgggctgatcatcct

SEQ ID NO: 361271 - DNA, 24 bp, Artificial Sequence
  Description of Artificial Sequence: Synthetic oligonucleotide
cctggagggcacgtgcgtagagtg

SEQ ID NO: 361272 - DNA, 27 bp, Artificial Sequence
  Description of Artificial Sequence: Synthetic oligonucleotide
gccttcgtgctcgggctgatcatcctt

SEQ ID NO: 361273 - DNA, 24 bp, Artificial Sequence
  Description of Artificial Sequence: Synthetic oligonucleotide
ctggagggcacgtgcgtagagtgg

SEQ ID NO: 361274 - DNA, 27 bp, Artificial Sequence
  Description of Artificial Sequence: Synthetic oligonucleotide
ccttcgtgctcgggctgatcatccttg

SEQ ID NO: 361275 - DNA, 25 bp, Artificial Sequence
  Description of Artificial Sequence: Synthetic oligonucleotide
tggagggcacgtgcgtagagtggct

SEQ ID NO: 361276 - DNA, 27 bp, Artificial Sequence
  Description of Artificial Sequence: Synthetic oligonucleotide
cttcgtgctcgggctgatcatccttgg

SEQ ID NO: 361277 - DNA, 24 bp, Artificial Sequence
  Description of Artificial Sequence: Synthetic oligonucleotide
ggagggcacgtgcgtagagtggct

SEQ ID NO: 361278 - DNA, 27 bp, Artificial Sequence
  Description of Artificial Sequence: Synthetic oligonucleotide
ttcgtgctcgggctgatcatccttggg

SEQ ID NO: 361279 - DNA, 24 bp, Artificial Sequence
  Description of Artificial Sequence: Synthetic oligonucleotide
gagggcacgtgcgtagagtggctc

SEQ ID NO: 361280 - DNA, 26 bp, Artificial Sequence
  Description of Artificial Sequence: Synthetic oligonucleotide
tcgtgctcgggctgatcatccttggg

SEQ ID NO: 361281 - DNA, 24 bp, Artificial Sequence
  Description of Artificial Sequence: Synthetic oligonucleotide
agggcacgtgcgtagagtggctcc

SEQ ID NO: 361282 - DNA, 25 bp, Artificial Sequence
  Description of Artificial Sequence: Synthetic oligonucleotide
cgtgctcgggctgatcatccttggg

SEQ ID NO: 361283 - DNA, 23 bp, Artificial Sequence
  Description of Artificial Sequence: Synthetic oligonucleotide
gggcacgtgcgtagagtggctcc

SEQ ID NO: 361284 - DNA, 26 bp, Artificial Sequence
  Description of Artificial Sequence: Synthetic oligonucleotide
gtgctcgggctgatcatccttgggca

SEQ ID NO: 361285 - DNA, 23 bp, Artificial Sequence
  Description of Artificial Sequence: Synthetic oligonucleotide
ggcacgtgcgtagagtggctccg

SEQ ID NO: 361286 - DNA, 26 bp, Artificial Sequence
  Description of Artificial Sequence: Synthetic oligonucleotide
tgctcgggctgatcatccttgggcag

SEQ ID NO: 361287 - DNA, 24 bp, Artificial Sequence
  Description of Artificial Sequence: Synthetic oligonucleotide
gcacgtgcgtagagtggctccgca

SEQ ID NO: 361288 - DNA, 25 bp, Artificial Sequence
  Description of Artificial Sequence: Synthetic oligonucleotide
gctcgggctgatcatccttgggcag

SEQ ID NO: 361289 - DNA, 27 bp, Artificial Sequence
  Description of Artificial Sequence: Synthetic oligonucleotide
cacgtgcgtagagtggctccgcagata

SEQ ID NO: 361290 - DNA, 25 bp, Artificial Sequence
  Description of Artificial Sequence: Synthetic oligonucleotide
ctcgggctgatcatccttgggcagg

SEQ ID NO: 361291 - DNA, 27 bp, Artificial Sequence
  Description of Artificial Sequence: Synthetic oligonucleotide
acgtgcgtagagtggctccgcagatac

SEQ ID NO: 361292 - DNA, 25 bp, Artificial Sequence
  Description of Artificial Sequence: Synthetic oligonucleotide
tcgggctgatcatccttgggcaggg

SEQ ID NO: 361293 - DNA, 26 bp, Artificial Sequence
  Description of Artificial Sequence: Synthetic oligonucleotide
cgtgcgtagagtggctccgcagatac

SEQ ID NO: 361294 - DNA, 24 bp, Artificial Sequence
  Description of Artificial Sequence: Synthetic oligonucleotide
cgggctgatcatccttgggcaggg

SEQ ID NO: 361295 - DNA, 27 bp, Artificial Sequence
  Description of Artificial Sequence: Synthetic oligonucleotide
gtgcgtagagtggctccgcagatacct

SEQ ID NO: 361296 - DNA, 24 bp, Artificial Sequence
  Description of Artificial Sequence: Synthetic oligonucleotide
gggctgatcatccttgggcagggc

SEQ ID NO: 361297 - DNA, 27 bp, Artificial Sequence
  Description of Artificial Sequence: Synthetic oligonucleotide
tgcgtagagtggctccgcagatacctg

SEQ ID NO: 361298 - DNA, 27 bp, Artificial Sequence
  Description of Artificial Sequence: Synthetic oligonucleotide
ggctgatcatccttgggcagggcctta

SEQ ID NO: 361299 - DNA, 26 bp, Artificial Sequence
  Description of Artificial Sequence: Synthetic oligonucleotide
gcgtagagtggctccgcagatacctg

SEQ ID NO: 361300 - DNA, 28 bp, Artificial Sequence
  Description of Artificial Sequence: Synthetic oligonucleotide
gctgatcatccttgggcagggccttaag

SEQ ID NO: 361301 - DNA, 27 bp, Artificial Sequence
  Description of Artificial Sequence: Synthetic oligonucleotide
cgtagagtggctccgcagatacctgga

SEQ ID NO: 361302 - DNA, 30 bp, Artificial Sequence; identical to SEQ ID NO: 235257
  Description of Artificial Sequence: Synthetic oligonucleotide

SEQ ID NO: 361303 - DNA, 27 bp, Artificial Sequence
  Description of Artificial Sequence: Synthetic oligonucleotide
gtagagtggctccgcagatacctggag

SEQ ID NO: 361304 - DNA, 30 bp, Artificial Sequence; identical to SEQ ID NO: 235258
  Description of Artificial Sequence: Synthetic oligonucleotide

SEQ ID NO: 361305 - DNA, 29 bp, Artificial Sequence
  Description of Artificial Sequence: Synthetic oligonucleotide
tagagtggctccgcagatacctggagaac

SEQ ID NO: 361306 - DNA, 29 bp, Artificial Sequence
  Description of Artificial Sequence: Synthetic oligonucleotide
gatcatccttgggcagggccttaagatcc

SEQ ID NO: 361307 - DNA, 28 bp, Artificial Sequence
  Description of Artificial Sequence: Synthetic oligonucleotide
agagtggctccgcagatacctggagaac

SEQ ID NO: 361308 - DNA, 29 bp, Artificial Sequence
  Description of Artificial Sequence: Synthetic oligonucleotide
atcatccttgggcagggccttaagatccg

SEQ ID NO: 361309 - DNA, 28 bp, Artificial Sequence
  Description of Artificial Sequence: Synthetic oligonucleotide
ctccgcagatacctggagaacgggaaag

SEQ ID NO: 361310 - DNA, 28 bp, Artificial Sequence
  Description of Artificial Sequence: Synthetic oligonucleotide
tcatccttgggcagggccttaagatccg

SEQ ID NO: 361311 - DNA, 29 bp, Artificial Sequence
  Description of Artificial Sequence: Synthetic oligonucleotide
tccgcagatacctggagaacgggaaagag

SEQ ID NO: 361312 - DNA, 27 bp, Artificial Sequence
  Description of Artificial Sequence: Synthetic oligonucleotide
catccttgggcagggccttaagatccg

SEQ ID NO: 361313 - DNA, 28 bp, Artificial Sequence
  Description of Artificial Sequence: Synthetic oligonucleotide
ccgcagatacctggagaacgggaaagag

SEQ ID NO: 361314 - DNA, 28 bp, Artificial Sequence
  Description of Artificial Sequence: Synthetic oligonucleotide
atccttgggcagggccttaagatccgtc

SEQ ID NO: 361315 - DNA, 29 bp, Artificial Sequence
  Description of Artificial Sequence: Synthetic oligonucleotide
cgcagatacctggagaacgggaaagagac

SEQ ID NO: 361316 - DNA, 27 bp, Artificial Sequence
  Description of Artificial Sequence: Synthetic oligonucleotide
tccttgggcagggccttaagatccgtc

SEQ ID NO: 361317 - DNA, 29 bp, Artificial Sequence
  Description of Artificial Sequence: Synthetic oligonucleotide
gcagatacctggagaacgggaaagagacg

SEQ ID NO: 361318 - DNA, 27 bp, Artificial Sequence
  Description of Artificial Sequence: Synthetic oligonucleotide
ccttgggcagggccttaagatccgtca

SEQ ID NO: 361319 - DNA, 29 bp, Artificial Sequence
  Description of Artificial Sequence: Synthetic oligonucleotide
cagatacctggagaacgggaaagagacgc

SEQ ID NO: 361320 - DNA, 29 bp, Artificial Sequence
  Description of Artificial Sequence: Synthetic oligonucleotide
cttgggcagggccttaagatccgtcaatg

SEQ ID NO: 361321 - DNA, 30 bp, Artificial Sequence; identical to SEQ ID NO: 4712
  Description of Artificial Sequence: Synthetic oligonucleotide

SEQ ID NO: 361322 - DNA, 29 bp, Artificial Sequence
  Description of Artificial Sequence: Synthetic oligonucleotide
ttgggcagggccttaagatccgtcaatgg

SEQ ID NO: 361323 - DNA, 29 bp, Artificial Sequence
  Description of Artificial Sequence: Synthetic oligonucleotide
gatacctggagaacgggaaagagacgctg

SEQ ID NO: 361324 - DNA, 28 bp, Artificial Sequence
  Description of Artificial Sequence: Synthetic oligonucleotide
tgggcagggccttaagatccgtcaatgg

SEQ ID NO: 361325 - DNA, 29 bp, Artificial Sequence
  Description of Artificial Sequence: Synthetic oligonucleotide
atacctggagaacgggaaagagacgctgc

SEQ ID NO: 361326 - DNA, 27 bp, Artificial Sequence
  Description of Artificial Sequence: Synthetic oligonucleotide
gggcagggccttaagatccgtcaatgg

SEQ ID NO: 361327 - DNA, 28 bp, Artificial Sequence
  Description of Artificial Sequence: Synthetic oligonucleotide
tacctggagaacgggaaagagacgctgc

SEQ ID NO: 361328 - DNA, 28 bp, Artificial Sequence
  Description of Artificial Sequence: Synthetic oligonucleotide
ggcagggccttaagatccgtcaatggag

SEQ ID NO: 361329 - DNA, 27 bp, Artificial Sequence
  Description of Artificial Sequence: Synthetic oligonucleotide
acctggagaacgggaaagagacgctgc

SEQ ID NO: 361330 - DNA, 29 bp, Artificial Sequence
  Description of Artificial Sequence: Synthetic oligonucleotide
gcagggccttaagatccgtcaatggagtc

SEQ ID NO: 361331 - DNA, 27 bp, Artificial Sequence
  Description of Artificial Sequence: Synthetic oligonucleotide
cctggagaacgggaaagagacgctgca

SEQ ID NO: 361332 - DNA, 30 bp, Artificial Sequence; identical to SEQ ID NO: 235272
  Description of Artificial Sequence: Synthetic oligonucleotide

SEQ ID NO: 361333 - DNA, 27 bp, Artificial Sequence
  Description of Artificial Sequence: Synthetic oligonucleotide
ctggagaacgggaaagagacgctgcag

SEQ ID NO: 361334 - DNA, 33 bp, Artificial Sequence; identical to SEQ ID NO: 235273
  Description of Artificial Sequence: Synthetic oligonucleotide

SEQ ID NO: 361335 - DNA, 27 bp, Artificial Sequence
  Description of Artificial Sequence: Synthetic oligonucleotide
tggagaacgggaaagagacgctgcagc

SEQ ID NO: 361336 - DNA, 32 bp, Artificial Sequence; identical to SEQ ID NO: 235274
  Description of Artificial Sequence: Synthetic oligonucleotide

SEQ ID NO: 361337 - DNA, 26 bp, Artificial Sequence
  Description of Artificial Sequence: Synthetic oligonucleotide
ggagaacgggaaagagacgctgcagc

SEQ ID NO: 361338 - DNA, 32 bp, Artificial Sequence; identical to SEQ ID NO: 235275
  Description of Artificial Sequence: Synthetic oligonucleotide

SEQ ID NO: 361339 - DNA, 26 bp, Artificial Sequence
  Description of Artificial Sequence: Synthetic oligonucleotide
gagaacgggaaagagacgctgcagcg

SEQ ID NO: 361340 - DNA, 32 bp, Artificial Sequence; identical to SEQ ID NO: 235276
  Description of Artificial Sequence: Synthetic oligonucleotide

SEQ ID NO: 361341 - DNA, 27 bp, Artificial Sequence
  Description of Artificial Sequence: Synthetic oligonucleotide
agaacgggaaagagacgctgcagcgca

SEQ ID NO: 361342 - DNA, 32 bp, Artificial Sequence; identical to SEQ ID NO: 235277
  Description of Artificial Sequence: Synthetic oligonucleotide

SEQ ID NO: 361343 - DNA, 26 bp, Artificial Sequence
  Description of Artificial Sequence: Synthetic oligonucleotide
gaacgggaaagagacgctgcagcgca

SEQ ID NO: 361344 - DNA, 34 bp, Artificial Sequence; identical to SEQ ID NO: 235278
  Description of Artificial Sequence: Synthetic oligonucleotide

SEQ ID NO: 361345 - DNA, 26 bp, Artificial Sequence
  Description of Artificial Sequence: Synthetic oligonucleotide
aacgggaaagagacgctgcagcgcac

SEQ ID NO: 361346 - DNA, 35 bp, Artificial Sequence; identical to SEQ ID NO: 235279
  Description of Artificial Sequence: Synthetic oligonucleotide

SEQ ID NO: 361347 - DNA, 25 bp, Artificial Sequence
  Description of Artificial Sequence: Synthetic oligonucleotide
acgggaaagagacgctgcagcgcac

SEQ ID NO: 361348 - DNA, 34 bp, Artificial Sequence; identical to SEQ ID NO: 235280
  Description of Artificial Sequence: Synthetic oligonucleotide

SEQ ID NO: 361349 - DNA, 24 bp, Artificial Sequence
  Description of Artificial Sequence: Synthetic oligonucleotide
cgggaaagagacgctgcagcgcac

SEQ ID NO: 361350 - DNA, 33 bp, Artificial Sequence; identical to SEQ ID NO: 235281
  Description of Artificial Sequence: Synthetic oligonucleotide

SEQ ID NO: 361351 - DNA, 24 bp, Artificial Sequence
  Description of Artificial Sequence: Synthetic oligonucleotide
gggaaagagacgctgcagcgcacg

SEQ ID NO: 361352 - DNA, 32 bp, Artificial Sequence; identical to SEQ ID NO: 235282
  Description of Artificial Sequence: Synthetic oligonucleotide

SEQ ID NO: 361353 - DNA, 25 bp, Artificial Sequence
  Description of Artificial Sequence: Synthetic oligonucleotide
ggaaagagacgctgcagcgcacgga

SEQ ID NO: 361354 - DNA, 31 bp, Artificial Sequence; identical to SEQ ID NO: 235283
  Description of Artificial Sequence: Synthetic oligonucleotide

SEQ ID NO: 361355 - DNA, 25 bp, Artificial Sequence
  Description of Artificial Sequence: Synthetic oligonucleotide
gaaagagacgctgcagcgcacggac

SEQ ID NO: 361356 - DNA, 31 bp, Artificial Sequence; identical to SEQ ID NO: 235284
  Description of Artificial Sequence: Synthetic oligonucleotide

SEQ ID NO: 361357 - DNA, 25 bp, Artificial Sequence
  Description of Artificial Sequence: Synthetic oligonucleotide
aaagagacgctgcagcgcacggacg

SEQ ID NO: 361358 - DNA, 30 bp, Artificial Sequence; identical to SEQ ID NO: 235285
  Description of Artificial Sequence: Synthetic oligonucleotide

SEQ ID NO: 361359 - DNA, 24 bp, Artificial Sequence
  Description of Artificial Sequence: Synthetic oligonucleotide
aagagacgctgcagcgcacggacg

SEQ ID NO: 361360 - DNA, 29 bp, Artificial Sequence
  Description of Artificial Sequence: Synthetic oligonucleotide
ccgtcaatggagtcagatagggcttctcc

SEQ ID NO: 361361 - DNA, 23 bp, Artificial Sequence
  Description of Artificial Sequence: Synthetic oligonucleotide
agagacgctgcagcgcacggacg

SEQ ID NO: 361362 - DNA, 30 bp, Artificial Sequence; identical to SEQ ID NO: 235287
  Description of Artificial Sequence: Synthetic oligonucleotide

SEQ ID NO: 361363 - DNA, 31 bp, Artificial Sequence; identical to SEQ ID NO: 4733
  Description of Artificial Sequence: Synthetic oligonucleotide

SEQ ID NO: 361364 - DNA, 31 bp, Artificial Sequence; identical to SEQ ID NO: 235288
  Description of Artificial Sequence: Synthetic oligonucleotide

SEQ ID NO: 361365 - DNA, 30 bp, Artificial Sequence; identical to SEQ ID NO: 4734
  Description of Artificial Sequence: Synthetic oligonucleotide

SEQ ID NO: 361366 - DNA, 34 bp, Artificial Sequence; identical to SEQ ID NO: 235289
  Description of Artificial Sequence: Synthetic oligonucleotide

SEQ ID NO: 361367 - DNA, 30 bp, Artificial Sequence; identical to SEQ ID NO: 4735
  Description of Artificial Sequence: Synthetic oligonucleotide

SEQ ID NO: 361368 - DNA, 33 bp, Artificial Sequence; identical to SEQ ID NO: 235290
  Description of Artificial Sequence: Synthetic oligonucleotide

SEQ ID NO: 361369 - DNA, 30 bp, Artificial Sequence; identical to SEQ ID NO: 4736
  Description of Artificial Sequence: Synthetic oligonucleotide

SEQ ID NO: 361370 - DNA, 32 bp, Artificial Sequence; identical to SEQ ID NO: 235291
  Description of Artificial Sequence: Synthetic oligonucleotide

SEQ ID NO: 361371 - DNA, 32 bp, Artificial Sequence; identical to SEQ ID NO: 4737
  Description of Artificial Sequence: Synthetic oligonucleotide

SEQ ID NO: 361372 - DNA, 32 bp, Artificial Sequence; identical to SEQ ID NO: 235292
  Description of Artificial Sequence: Synthetic oligonucleotide

SEQ ID NO: 361373 - DNA, 31 bp, Artificial Sequence; identical to SEQ ID NO: 4738
  Description of Artificial Sequence: Synthetic oligonucleotide

SEQ ID NO: 361374 - DNA, 33 bp, Artificial Sequence; identical to SEQ ID NO: 235293
  Description of Artificial Sequence: Synthetic oligonucleotide

SEQ ID NO: 361375 - DNA, 30 bp, Artificial Sequence; identical to SEQ ID NO: 4739
  Description of Artificial Sequence: Synthetic oligonucleotide

SEQ ID NO: 361376 - DNA, 34 bp, Artificial Sequence; identical to SEQ ID NO: 235294
  Description of Artificial Sequence: Synthetic oligonucleotide

SEQ ID NO: 361377 - DNA, 31 bp, Artificial Sequence; identical to SEQ ID NO: 4740
  Description of Artificial Sequence: Synthetic oligonucleotide

SEQ ID NO: 361378 - DNA, 36 bp, Artificial Sequence; identical to SEQ ID NO: 235295
  Description of Artificial Sequence: Synthetic oligonucleotide

SEQ ID NO: 361379 - DNA, 30 bp, Artificial Sequence; identical to SEQ ID NO: 4741
  Description of Artificial Sequence: Synthetic oligonucleotide

SEQ ID NO: 361380 - DNA, 38 bp, Artificial Sequence; identical to SEQ ID NO: 235296
  Description of Artificial Sequence: Synthetic oligonucleotide

SEQ ID NO: 361381 - DNA, 30 bp, Artificial Sequence; identical to SEQ ID NO: 4742
  Description of Artificial Sequence: Synthetic oligonucleotide

SEQ ID NO: 361382 - DNA, 39 bp, Artificial Sequence; identical to SEQ ID NO: 235297
  Description of Artificial Sequence: Synthetic oligonucleotide

SEQ ID NO: 361383 - DNA, 31 bp, Artificial Sequence; identical to SEQ ID NO: 4743
  Description of Artificial Sequence: Synthetic oligonucleotide

SEQ ID NO: 361384 - DNA, 38 bp, Artificial Sequence; identical to SEQ ID NO: 235298
  Description of Artificial Sequence: Synthetic oligonucleotide

SEQ ID NO: 361385 - DNA, 30 bp, Artificial Sequence; identical to SEQ ID NO: 4744
  Description of Artificial Sequence: Synthetic oligonucleotide

SEQ ID NO: 361386 - DNA, 39 bp, Artificial Sequence; identical to SEQ ID NO: 235299
  Description of Artificial Sequence: Synthetic oligonucleotide

SEQ ID NO: 361387 - DNA, 30 bp, Artificial Sequence; identical to SEQ ID NO: 4745
  Description of Artificial Sequence: Synthetic oligonucleotide

SEQ ID NO: 361388 - DNA, 38 bp, Artificial Sequence; identical to SEQ ID NO: 235300
  Description of Artificial Sequence: Synthetic oligonucleotide

SEQ ID NO: 361389 - DNA, 29 bp, Artificial Sequence
  Description of Artificial Sequence: Synthetic oligonucleotide
ggagcagagatacacttgccatgtgcagc

SEQ ID NO: 361390 - DNA, 37 bp, Artificial Sequence; identical to SEQ ID NO: 235301
  Description of Artificial Sequence: Synthetic oligonucleotide

SEQ ID NO: 361391 - DNA, 31 bp, Artificial Sequence; identical to SEQ ID NO: 4747
  Description of Artificial Sequence: Synthetic oligonucleotide

SEQ ID NO: 361392 - DNA, 37 bp, Artificial Sequence; identical to SEQ ID NO: 235302
  Description of Artificial Sequence: Synthetic oligonucleotide

SEQ ID NO: 361393 - DNA, 32 bp, Artificial Sequence; identical to SEQ ID NO: 4748
  Description of Artificial Sequence: Synthetic oligonucleotide

SEQ ID NO: 361394 - DNA, 36 bp, Artificial Sequence; identical to SEQ ID NO: 235303
  Description of Artificial Sequence: Synthetic oligonucleotide

SEQ ID NO: 361395 - DNA, 31 bp, Artificial Sequence; identical to SEQ ID NO: 4749
  Description of Artificial Sequence: Synthetic oligonucleotide

SEQ ID NO: 361396 - DNA, 36 bp, Artificial Sequence; identical to SEQ ID NO: 235304
  Description of Artificial Sequence: Synthetic oligonucleotide

SEQ ID NO: 361397 - DNA, 31 bp, Artificial Sequence; identical to SEQ ID NO: 4750
  Description of Artificial Sequence: Synthetic oligonucleotide

SEQ ID NO: 361398 - DNA, 35 bp, Artificial Sequence; identical to SEQ ID NO: 235305
  Description of Artificial Sequence: Synthetic oligonucleotide

SEQ ID NO: 361399 - DNA, 31 bp, Artificial Sequence; identical to SEQ ID NO: 4751
  Description of Artificial Sequence: Synthetic oligonucleotide

SEQ ID NO: 361400 - DNA, 35 bp, Artificial Sequence; identical to SEQ ID NO: 235306
  Description of Artificial Sequence: Synthetic oligonucleotide

SEQ ID NO: 361401 - DNA, 30 bp, Artificial Sequence; identical to SEQ ID NO: 4752
  Description of Artificial Sequence: Synthetic oligonucleotide

SEQ ID NO: 361402 - DNA, 34 bp, Artificial Sequence; identical to SEQ ID NO: 235307
  Description of Artificial Sequence: Synthetic oligonucleotide

SEQ ID NO: 361403 - DNA, 33 bp, Artificial Sequence; identical to SEQ ID NO: 4753
  Description of Artificial Sequence: Synthetic oligonucleotide

SEQ ID NO: 361404 - DNA, 33 bp, Artificial Sequence; identical to SEQ ID NO: 235308
  Description of Artificial Sequence: Synthetic oligonucleotide

SEQ ID NO: 361405 - DNA, 32 bp, Artificial Sequence; identical to SEQ ID NO: 4754
  Description of Artificial Sequence: Synthetic oligonucleotide

SEQ ID NO: 361406 - DNA, 32 bp, Artificial Sequence; identical to SEQ ID NO: 235309
  Description of Artificial Sequence: Synthetic oligonucleotide

SEQ ID NO: 361407 - DNA, 32 bp, Artificial Sequence; identical to SEQ ID NO: 4755
  Description of Artificial Sequence: Synthetic oligonucleotide

SEQ ID NO: 361408 - DNA, 33 bp, Artificial Sequence; identical to SEQ ID NO: 235310
  Description of Artificial Sequence: Synthetic oligonucleotide

SEQ ID NO: 361409 - DNA, 31 bp, Artificial Sequence; identical to SEQ ID NO: 4756
  Description of Artificial Sequence: Synthetic oligonucleotide

SEQ ID NO: 361410 - DNA, 32 bp, Artificial Sequence; identical to SEQ ID NO: 235311
  Description of Artificial Sequence: Synthetic oligonucleotide

SEQ ID NO: 361411 - DNA, 30 bp, Artificial Sequence; identical to SEQ ID NO: 4757
  Description of Artificial Sequence: Synthetic oligonucleotide

SEQ ID NO: 361412 - DNA, 31 bp, Artificial Sequence; identical to SEQ ID NO: 235312
  Description of Artificial Sequence: Synthetic oligonucleotide

SEQ ID NO: 361413 - DNA, 29 bp, Artificial Sequence
  Description of Artificial Sequence: Synthetic oligonucleotide
cacttgccatgtgcagcatgagggtttgc

SEQ ID NO: 361414 - DNA, 32 bp, Artificial Sequence; identical to SEQ ID NO: 235313
  Description of Artificial Sequence: Synthetic oligonucleotide

SEQ ID NO: 361415 - DNA, 29 bp, Artificial Sequence
  Description of Artificial Sequence: Synthetic oligonucleotide
acttgccatgtgcagcatgagggtttgcc

SEQ ID NO: 361416 - DNA, 32 bp, Artificial Sequence; identical to SEQ ID NO: 235314
  Description of Artificial Sequence: Synthetic oligonucleotide

SEQ ID NO: 361417 - DNA, 28 bp, Artificial Sequence
  Description of Artificial Sequence: Synthetic oligonucleotide
cttgccatgtgcagcatgagggtttgcc

SEQ ID NO: 361418 - DNA, 31 bp, Artificial Sequence; identical to SEQ ID NO: 235315
  Description of Artificial Sequence: Synthetic oligonucleotide

SEQ ID NO: 361419 - DNA, 28 bp, Artificial Sequence
  Description of Artificial Sequence: Synthetic oligonucleotide
ttgccatgtgcagcatgagggtttgccc

SEQ ID NO: 361420 - DNA, 30 bp, Artificial Sequence; identical to SEQ ID NO: 235316
  Description of Artificial Sequence: Synthetic oligonucleotide

SEQ ID NO: 361421 - DNA, 27 bp, Artificial Sequence
  Description of Artificial Sequence: Synthetic oligonucleotide
gcccactcacagactcaccgagtggat

SEQ ID NO: 361422 - DNA, 29 bp, Artificial Sequence
  Description of Artificial Sequence: Synthetic oligonucleotide
tgagagctgtgttcttgagaggcctctcc

SEQ ID NO: 361423 - DNA, 27 bp, Artificial Sequence
  Description of Artificial Sequence: Synthetic oligonucleotide
cccactcacagactcaccgagtggatc

SEQ ID NO: 361424 - DNA, 28 bp, Artificial Sequence
  Description of Artificial Sequence: Synthetic oligonucleotide
gagagctgtgttcttgagaggcctctcc

SEQ ID NO: 361425 - DNA, 28 bp, Artificial Sequence
  Description of Artificial Sequence: Synthetic oligonucleotide
ccactcacagactcaccgagtggatctg

SEQ ID NO: 361426 - DNA, 30 bp, Artificial Sequence; identical to SEQ ID NO: 235319
  Description of Artificial Sequence: Synthetic oligonucleotide

SEQ ID NO: 361427 - DNA, 28 bp, Artificial Sequence
  Description of Artificial Sequence: Synthetic oligonucleotide
cactcacagactcaccgagtggatctgg

SEQ ID NO: 361428 - DNA, 29 bp, Artificial Sequence
  Description of Artificial Sequence: Synthetic oligonucleotide
gagctgtgttcttgagaggcctctccttc

SEQ ID NO: 361429 - DNA, 28 bp, Artificial Sequence
  Description of Artificial Sequence: Synthetic oligonucleotide
actcacagactcaccgagtggatctggg

SEQ ID NO: 361430 - DNA, 29 bp, Artificial Sequence
  Description of Artificial Sequence: Synthetic oligonucleotide
agctgtgttcttgagaggcctctccttcg

SEQ ID NO: 361431 - DNA, 27 bp, Artificial Sequence
  Description of Artificial Sequence: Synthetic oligonucleotide
ctcacagactcaccgagtggatctggg

SEQ ID NO: 361432 - DNA, 28 bp, Artificial Sequence
  Description of Artificial Sequence: Synthetic oligonucleotide
gctgtgttcttgagaggcctctccttcg

SEQ ID NO: 361433 - DNA, 27 bp, Artificial Sequence
  Description of Artificial Sequence: Synthetic oligonucleotide
tcacagactcaccgagtggatctgggg

SEQ ID NO: 361434 - DNA, 28 bp, Artificial Sequence
  Description of Artificial Sequence: Synthetic oligonucleotide
ctgtgttcttgagaggcctctccttcgc

SEQ ID NO: 361435 - DNA, 27 bp, Artificial Sequence
  Description of Artificial Sequence: Synthetic oligonucleotide
cacagactcaccgagtggatctgggga

SEQ ID NO: 361436 - DNA, 31 bp, Artificial Sequence; identical to SEQ ID NO: 235324
  Description of Artificial Sequence: Synthetic oligonucleotide

SEQ ID NO: 361437 - DNA, 27 bp, Artificial Sequence
  Description of Artificial Sequence: Synthetic oligonucleotide
acagactcaccgagtggatctggggac

SEQ ID NO: 361438 - DNA, 30 bp, Artificial Sequence; identical to SEQ ID NO: 235325
  Description of Artificial Sequence: Synthetic oligonucleotide

SEQ ID NO: 361439 - DNA, 26 bp, Artificial Sequence
  Description of Artificial Sequence: Synthetic oligonucleotide
cagactcaccgagtggatctggggac

SEQ ID NO: 361440 - DNA, 30 bp, Artificial Sequence; identical to SEQ ID NO: 235326
  Description of Artificial Sequence: Synthetic oligonucleotide

SEQ ID NO: 361441 - DNA, 26 bp, Artificial Sequence
  Description of Artificial Sequence: Synthetic oligonucleotide
agactcaccgagtggatctggggacc

SEQ ID NO: 361442 - DNA, 29 bp, Artificial Sequence
  Description of Artificial Sequence: Synthetic oligonucleotide
gttcttgagaggcctctccttcgctttcc

SEQ ID NO: 361443 - DNA, 25 bp, Artificial Sequence
  Description of Artificial Sequence: Synthetic oligonucleotide
gactcaccgagtggatctggggacc

SEQ ID NO: 361444 - DNA, 30 bp, Artificial Sequence; identical to SEQ ID NO: 235328
  Description of Artificial Sequence: Synthetic oligonucleotide

SEQ ID NO: 361445 - DNA, 26 bp, Artificial Sequence
  Description of Artificial Sequence: Synthetic oligonucleotide
actcaccgagtggatctggggaccct

SEQ ID NO: 361446 - DNA, 29 bp, Artificial Sequence
  Description of Artificial Sequence: Synthetic oligonucleotide
tcttgagaggcctctccttcgctttcctg

SEQ ID NO: 361447 - DNA, 25 bp, Artificial Sequence
  Description of Artificial Sequence: Synthetic oligonucleotide
ctcaccgagtggatctggggaccct

SEQ ID NO: 361448 - DNA, 28 bp, Artificial Sequence
  Description of Artificial Sequence: Synthetic oligonucleotide
cttgagaggcctctccttcgctttcctg

SEQ ID NO: 361449 - DNA, 25 bp, Artificial Sequence
  Description of Artificial Sequence: Synthetic oligonucleotide
tcaccgagtggatctggggaccctg

SEQ ID NO: 361450 - DNA, 28 bp, Artificial Sequence
  Description of Artificial Sequence: Synthetic oligonucleotide
ttgagaggcctctccttcgctttcctgg

SEQ ID NO: 361451 - DNA, 24 bp, Artificial Sequence
  Description of Artificial Sequence: Synthetic oligonucleotide
caccgagtggatctggggaccctg

SEQ ID NO: 361452 - DNA, 27 bp, Artificial Sequence
  Description of Artificial Sequence: Synthetic oligonucleotide
tgagaggcctctccttcgctttcctgg

SEQ ID NO: 361453 - DNA, 24 bp, Artificial Sequence
  Description of Artificial Sequence: Synthetic oligonucleotide
accgagtggatctggggaccctgc

SEQ ID NO: 361454 - DNA, 27 bp, Artificial Sequence
  Description of Artificial Sequence: Synthetic oligonucleotide
gagaggcctctccttcgctttcctggt

SEQ ID NO: 361455 - DNA, 23 bp, Artificial Sequence
  Description of Artificial Sequence: Synthetic oligonucleotide
ccgagtggatctggggaccctgc

SEQ ID NO: 361456 - DNA, 27 bp, Artificial Sequence
  Description of Artificial Sequence: Synthetic oligonucleotide
agaggcctctccttcgctttcctggtg

SEQ ID NO: 361457 - DNA, 23 bp, Artificial Sequence
  Description of Artificial Sequence: Synthetic oligonucleotide
cgagtggatctggggaccctgcg

SEQ ID NO: 361458 - DNA, 27 bp, Artificial Sequence
  Description of Artificial Sequence: Synthetic oligonucleotide
gaggcctctccttcgctttcctggtga

SEQ ID NO: 361459 - DNA, 23 bp, Artificial Sequence
  Description of Artificial Sequence: Synthetic oligonucleotide
gagtggatctggggaccctgcgc

SEQ ID NO: 361460 - DNA, 27 bp, Artificial Sequence
  Description of Artificial Sequence: Synthetic oligonucleotide
aggcctctccttcgctttcctggtgag

SEQ ID NO: 361461 - DNA, 23 bp, Artificial Sequence
  Description of Artificial Sequence: Synthetic oligonucleotide
agtggatctggggaccctgcgcg

SEQ ID NO: 361462 - DNA, 27 bp, Artificial Sequence
  Description of Artificial Sequence: Synthetic oligonucleotide
ggcctctccttcgctttcctggtgagt

SEQ ID NO: 361463 - DNA, 22 bp, Artificial Sequence
  Description of Artificial Sequence: Synthetic oligonucleotide
gtggatctggggaccctgcgcg

SEQ ID NO: 361464 - DNA, 27 bp, Artificial Sequence
  Description of Artificial Sequence: Synthetic oligonucleotide
gcctctccttcgctttcctggtgagtc

SEQ ID NO: 361465 - DNA, 22 bp, Artificial Sequence
  Description of Artificial Sequence: Synthetic oligonucleotide
tggatctggggaccctgcgcgg

SEQ ID NO: 361466 - DNA, 28 bp, Artificial Sequence
  Description of Artificial Sequence: Synthetic oligonucleotide
cctctccttcgctttcctggtgagtctc

SEQ ID NO: 361467 - DNA, 21 bp, Artificial Sequence
  Description of Artificial Sequence: Synthetic oligonucleotide
ggatctggggaccctgcgcgg

SEQ ID NO: 361468 - DNA, 28 bp, Artificial Sequence
  Description of Artificial Sequence: Synthetic oligonucleotide
ctctccttcgctttcctggtgagtctcc

SEQ ID NO: 361469 - DNA, 23 bp, Artificial Sequence
  Description of Artificial Sequence: Synthetic oligonucleotide
gatctggggaccctgcgcggcta

SEQ ID NO: 361470 - DNA, 28 bp, Artificial Sequence
  Description of Artificial Sequence: Synthetic oligonucleotide
tctccttcgctttcctggtgagtctccc

SEQ ID NO: 361471 - DNA, 27 bp, Artificial Sequence
  Description of Artificial Sequence: Synthetic oligonucleotide
ctgaggtgctgggccctgagcttctat

SEQ ID NO: 361472 - DNA, 27 bp, Artificial Sequence
  Description of Artificial Sequence: Synthetic oligonucleotide
ctccttcgctttcctggtgagtctccc

SEQ ID NO: 361473 - DNA, 27 bp, Artificial Sequence
  Description of Artificial Sequence: Synthetic oligonucleotide
tgaggtgctgggccctgagcttctatc

SEQ ID NO: 361474 - DNA, 28 bp, Artificial Sequence
  Description of Artificial Sequence: Synthetic oligonucleotide
tccttcgctttcctggtgagtctcccag

SEQ ID NO: 361475 - DNA, 26 bp, Artificial Sequence
  Description of Artificial Sequence: Synthetic oligonucleotide
gaggtgctgggccctgagcttctatc

SEQ ID NO: 361476 - DNA, 27 bp, Artificial Sequence
  Description of Artificial Sequence: Synthetic oligonucleotide
ccttcgctttcctggtgagtctcccag

SEQ ID NO: 361477 - DNA, 27 bp, Artificial Sequence
  Description of Artificial Sequence: Synthetic oligonucleotide
aggtgctgggccctgagcttctatcct

SEQ ID NO: 361478 - DNA, 27 bp, Artificial Sequence
  Description of Artificial Sequence: Synthetic oligonucleotide
cttcgctttcctggtgagtctcccagg

SEQ ID NO: 361479 - DNA, 26 bp, Artificial Sequence
  Description of Artificial Sequence: Synthetic oligonucleotide
ggtgctgggccctgagcttctatcct

SEQ ID NO: 361480 - DNA, 28 bp, Artificial Sequence
  Description of Artificial Sequence: Synthetic oligonucleotide
ttcgctttcctggtgagtctcccaggag

SEQ ID NO: 361481 - DNA, 26 bp, Artificial Sequence
  Description of Artificial Sequence: Synthetic oligonucleotide
gtgctgggccctgagcttctatcctg

SEQ ID NO: 361482 - DNA, 27 bp, Artificial Sequence
  Description of Artificial Sequence: Synthetic oligonucleotide
tcgctttcctggtgagtctcccaggag

SEQ ID NO: 361483 - DNA, 26 bp, Artificial Sequence
  Description of Artificial Sequence: Synthetic oligonucleotide
tgctgggccctgagcttctatcctgc

SEQ ID NO: 361484 - DNA, 26 bp, Artificial Sequence
  Description of Artificial Sequence: Synthetic oligonucleotide
cgctttcctggtgagtctcccaggag

SEQ ID NO: 361485 - DNA, 25 bp, Artificial Sequence
  Description of Artificial Sequence: Synthetic oligonucleotide
gctgggccctgagcttctatcctgc

SEQ ID NO: 361486 - DNA, 27 bp, Artificial Sequence
  Description of Artificial Sequence: Synthetic oligonucleotide
gctttcctggtgagtctcccaggagct

SEQ ID NO: 361487 - DNA, 25 bp, Artificial Sequence
  Description of Artificial Sequence: Synthetic oligonucleotide
ctgggccctgagcttctatcctgcg

SEQ ID NO: 361488 - DNA, 27 bp, Artificial Sequence
  Description of Artificial Sequence: Synthetic oligonucleotide
ctttcctggtgagtctcccaggagctg

SEQ ID NO: 361489 - DNA, 26 bp, Artificial Sequence
  Description of Artificial Sequence: Synthetic oligonucleotide
tgggccctgagcttctatcctgcgga

SEQ ID NO: 361490 - DNA, 27 bp, Artificial Sequence
  Description of Artificial Sequence: Synthetic oligonucleotide
tttcctggtgagtctcccaggagctgg

SEQ ID NO: 361491 - DNA, 25 bp, Artificial Sequence
  Description of Artificial Sequence: Synthetic oligonucleotide
gggccctgagcttctatcctgcgga

SEQ ID NO: 361492 - DNA, 26 bp, Artificial Sequence
  Description of Artificial Sequence: Synthetic oligonucleotide
ttcctggtgagtctcccaggagctgg

SEQ ID NO: 361493 - DNA, 27 bp, Artificial Sequence
  Description of Artificial Sequence: Synthetic oligonucleotide
ggccctgagcttctatcctgcggagat

SEQ ID NO: 361494 - DNA, 25 bp, Artificial Sequence
  Description of Artificial Sequence: Synthetic oligonucleotide
tcctggtgagtctcccaggagctgg

SEQ ID NO: 361495 - DNA, 27 bp, Artificial Sequence
  Description of Artificial Sequence: Synthetic oligonucleotide
gccctgagcttctatcctgcggagatc

SEQ ID NO: 361496 - DNA, 24 bp, Artificial Sequence
  Description of Artificial Sequence: Synthetic oligonucleotide
cctggtgagtctcccaggagctgg

SEQ ID NO: 361497 - DNA, 28 bp, Artificial Sequence
  Description of Artificial Sequence: Synthetic oligonucleotide
ccctgagcttctatcctgcggagatcac

SEQ ID NO: 361498 - DNA, 24 bp, Artificial Sequence
  Description of Artificial Sequence: Synthetic oligonucleotide
ctggtgagtctcccaggagctggc

SEQ ID NO: 361499 - DNA, 29 bp, Artificial Sequence
  Description of Artificial Sequence: Synthetic oligonucleotide
cctgagcttctatcctgcggagatcacac

SEQ ID NO: 361500 - DNA, 24 bp, Artificial Sequence
  Description of Artificial Sequence: Synthetic oligonucleotide
tggtgagtctcccaggagctggcg

SEQ ID NO: 361501 - DNA, 30 bp, Artificial Sequence; identical to SEQ ID NO: 4802
  Description of Artificial Sequence: Synthetic oligonucleotide

SEQ ID NO: 361502 - DNA, 23 bp, Artificial Sequence
  Description of Artificial Sequence: Synthetic oligonucleotide
ggtgagtctcccaggagctggcg

SEQ ID NO: 361503 - DNA, 31 bp, Artificial Sequence; identical to SEQ ID NO: 4803
  Description of Artificial Sequence: Synthetic oligonucleotide

SEQ ID NO: 361504 - DNA, 23 bp, Artificial Sequence
  Description of Artificial Sequence: Synthetic oligonucleotide
gtgagtctcccaggagctggcgc

SEQ ID NO: 361505 - DNA, 30 bp, Artificial Sequence; identical to SEQ ID NO: 4804
  Description of Artificial Sequence: Synthetic oligonucleotide

SEQ ID NO: 361506 - DNA, 25 bp, Artificial Sequence
  Description of Artificial Sequence: Synthetic oligonucleotide
tgagtctcccaggagctggcgccat

SEQ ID NO: 361507 - DNA, 30 bp, Artificial Sequence; identical to SEQ ID NO: 4805
  Description of Artificial Sequence: Synthetic oligonucleotide

SEQ ID NO: 361508 - DNA, 24 bp, Artificial Sequence
  Description of Artificial Sequence: Synthetic oligonucleotide
gagtctcccaggagctggcgccat

SEQ ID NO: 361509 - DNA, 29 bp, Artificial Sequence
  Description of Artificial Sequence: Synthetic oligonucleotide
gcttctatcctgcggagatcacactgacc

SEQ ID NO: 361510 - DNA, 26 bp, Artificial Sequence
  Description of Artificial Sequence: Synthetic oligonucleotide
agtctcccaggagctggcgccatcaa

SEQ ID NO: 361511 - DNA, 30 bp, Artificial Sequence; identical to SEQ ID NO: 4807
  Description of Artificial Sequence: Synthetic oligonucleotide

SEQ ID NO: 361512 - DNA, 25 bp, Artificial Sequence
  Description of Artificial Sequence: Synthetic oligonucleotide
gtctcccaggagctggcgccatcaa

SEQ ID NO: 361513 - DNA, 30 bp, Artificial Sequence; identical to SEQ ID NO: 4808
  Description of Artificial Sequence: Synthetic oligonucleotide

SEQ ID NO: 361514 - DNA, 25 bp, Artificial Sequence
  Description of Artificial Sequence: Synthetic oligonucleotide
tctcccaggagctggcgccatcaag

SEQ ID NO: 361515 - DNA, 29 bp, Artificial Sequence
  Description of Artificial Sequence: Synthetic oligonucleotide
tctatcctgcggagatcacactgacctgg

SEQ ID NO: 361516 - DNA, 24 bp, Artificial Sequence
  Description of Artificial Sequence: Synthetic oligonucleotide
ctcccaggagctggcgccatcaag

SEQ ID NO: 361517 - DNA, 28 bp, Artificial Sequence
  Description of Artificial Sequence: Synthetic oligonucleotide
ctatcctgcggagatcacactgacctgg

SEQ ID NO: 361518 - DNA, 24 bp, Artificial Sequence
  Description of Artificial Sequence: Synthetic oligonucleotide
tcccaggagctggcgccatcaagc

SEQ ID NO: 361519 - DNA, 28 bp, Artificial Sequence
  Description of Artificial Sequence: Synthetic oligonucleotide
tatcctgcggagatcacactgacctggc

SEQ ID NO: 361520 - DNA, 23 bp, Artificial Sequence
  Description of Artificial Sequence: Synthetic oligonucleotide
cccaggagctggcgccatcaagc

SEQ ID NO: 361521 - DNA, 27 bp, Artificial Sequence
  Description of Artificial Sequence: Synthetic oligonucleotide
atcctgcggagatcacactgacctggc

SEQ ID NO: 361522 - DNA, 23 bp, Artificial Sequence
  Description of Artificial Sequence: Synthetic oligonucleotide
ccaggagctggcgccatcaagcc

SEQ ID NO: 361523 - DNA, 27 bp, Artificial Sequence
  Description of Artificial Sequence: Synthetic oligonucleotide
tcctgcggagatcacactgacctggca

SEQ ID NO: 361524 - DNA, 23 bp, Artificial Sequence
  Description of Artificial Sequence: Synthetic oligonucleotide
caggagctggcgccatcaagccg

SEQ ID NO: 361525 - DNA, 27 bp, Artificial Sequence
  Description of Artificial Sequence: Synthetic oligonucleotide
gagcaggagggtccggagtattgggat

SEQ ID NO: 361526 - DNA, 24 bp, Artificial Sequence
  Description of Artificial Sequence: Synthetic oligonucleotide
aggagctggcgccatcaagccgga

SEQ ID NO: 361527 - DNA, 27 bp, Artificial Sequence
  Description of Artificial Sequence: Synthetic oligonucleotide
agcaggagggtccggagtattgggatg

SEQ ID NO: 361528 - DNA, 23 bp, Artificial Sequence
  Description of Artificial Sequence: Synthetic oligonucleotide
ggagctggcgccatcaagccgga

SEQ ID NO: 361529 - DNA, 26 bp, Artificial Sequence
  Description of Artificial Sequence: Synthetic oligonucleotide
gcaggagggtccggagtattgggatg

SEQ ID NO: 361530 - DNA, 23 bp, Artificial Sequence
  Description of Artificial Sequence: Synthetic oligonucleotide
gagctggcgccatcaagccggac

SEQ ID NO: 361531 - DNA, 26 bp, Artificial Sequence
  Description of Artificial Sequence: Synthetic oligonucleotide
caggagggtccggagtattgggatgg

SEQ ID NO: 361532 - DNA, 25 bp, Artificial Sequence
  Description of Artificial Sequence: Synthetic oligonucleotide
agctggcgccatcaagccggaccat

SEQ ID NO: 361533 - DNA, 26 bp, Artificial Sequence
  Description of Artificial Sequence: Synthetic oligonucleotide
aggagggtccggagtattgggatggg

SEQ ID NO: 361534 - DNA, 24 bp, Artificial Sequence
  Description of Artificial Sequence: Synthetic oligonucleotide
gctggcgccatcaagccggaccat

SEQ ID NO: 361535 - DNA, 25 bp, Artificial Sequence
  Description of Artificial Sequence: Synthetic oligonucleotide
ggagggtccggagtattgggatggg

SEQ ID NO: 361536 - DNA, 25 bp, Artificial Sequence
  Description of Artificial Sequence: Synthetic oligonucleotide
ctggcgccatcaagccggaccatga

SEQ ID NO: 361537 - DNA, 26 bp, Artificial Sequence
  Description of Artificial Sequence: Synthetic oligonucleotide
gagggtccggagtattgggatgggga

SEQ ID NO: 361538 - DNA, 26 bp, Artificial Sequence
  Description of Artificial Sequence: Synthetic oligonucleotide
tggcgccatcaagccggaccatgagt

SEQ ID NO: 361539 - DNA, 27 bp, Artificial Sequence
  Description of Artificial Sequence: Synthetic oligonucleotide
agggtccggagtattgggatggggaga

SEQ ID NO: 361540 - DNA, 25 bp, Artificial Sequence
  Description of Artificial Sequence: Synthetic oligonucleotide
ggcgccatcaagccggaccatgagt

SEQ ID NO: 361541 - DNA, 26 bp, Artificial Sequence
  Description of Artificial Sequence: Synthetic oligonucleotide
gggtccggagtattgggatggggaga

SEQ ID NO: 361542 - DNA, 27 bp, Artificial Sequence
  Description of Artificial Sequence: Synthetic oligonucleotide
gcgccatcaagccggaccatgagtcaa

SEQ ID NO: 361543 - DNA, 27 bp, Artificial Sequence
  Description of Artificial Sequence: Synthetic oligonucleotide
ggtccggagtattgggatggggagaca

SEQ ID NO: 361544 - DNA, 27 bp, Artificial Sequence
  Description of Artificial Sequence: Synthetic oligonucleotide
cgccatcaagccggaccatgagtcaac

SEQ ID NO: 361545 - DNA, 27 bp, Artificial Sequence
  Description of Artificial Sequence: Synthetic oligonucleotide
gtccggagtattgggatggggagacac

SEQ ID NO: 361546 - DNA, 31 bp, Artificial Sequence; identical to SEQ ID NO: 235379
  Description of Artificial Sequence: Synthetic oligonucleotide

SEQ ID NO: 361547 - DNA, 27 bp, Artificial Sequence
  Description of Artificial Sequence: Synthetic oligonucleotide
tccggagtattgggatggggagacacg

SEQ ID NO: 361548 - DNA, 31 bp, Artificial Sequence; identical to SEQ ID NO: 235380
  Description of Artificial Sequence: Synthetic oligonucleotide

SEQ ID NO: 361549 - DNA, 26 bp, Artificial Sequence
  Description of Artificial Sequence: Synthetic oligonucleotide
ccggagtattgggatggggagacacg

SEQ ID NO: 361550 - DNA, 31 bp, Artificial Sequence; identical to SEQ ID NO: 235381
  Description of Artificial Sequence: Synthetic oligonucleotide

SEQ ID NO: 361551 - DNA, 27 bp, Artificial Sequence
  Description of Artificial Sequence: Synthetic oligonucleotide
cggagtattgggatggggagacacgga

SEQ ID NO: 361552 - DNA, 31 bp, Artificial Sequence; identical to SEQ ID NO: 235382
  Description of Artificial Sequence: Synthetic oligonucleotide

SEQ ID NO: 361553 - DNA, 29 bp, Artificial Sequence
  Description of Artificial Sequence: Synthetic oligonucleotide
ggagtattgggatggggagacacggaaag

SEQ ID NO: 361554 - DNA, 30 bp, Artificial Sequence; identical to SEQ ID NO: 235383
  Description of Artificial Sequence: Synthetic oligonucleotide

SEQ ID NO: 361555 - DNA, 30 bp, Artificial Sequence
  Description of Artificial Sequence: Synthetic oligonucleotide
gagtattgggatggggagacacggaaagtg

SEQ ID NO: 361556 - DNA, 29 bp, Artificial Sequence
  Description of Artificial Sequence: Synthetic oligonucleotide
caagccggaccatgagtcaacttaagccg

SEQ ID NO: 361557 - DNA, 32 bp, Artificial Sequence
  Description of Artificial Sequence: Synthetic oligonucleotide
agtattgggatggggagacacggaaagtgaag

SEQ ID NO: 361558 - DNA, 29 bp, Artificial Sequence
  Description of Artificial Sequence: Synthetic oligonucleotide
aagccggaccatgagtcaacttaagccgc

SEQ ID NO: 361559 - DNA, 31 bp, Artificial Sequence
  Description of Artificial Sequence: Synthetic oligonucleotide
gtattgggatggggagacacggaaagtgaag

SEQ ID NO: 361560 - DNA, 28 bp, Artificial Sequence
  Description of Artificial Sequence: Synthetic oligonucleotide
agccggaccatgagtcaacttaagccgc

SEQ ID NO: 361561 - DNA, 31 bp, Artificial Sequence
  Description of Artificial Sequence: Synthetic oligonucleotide
tattgggatggggagacacggaaagtgaagg

SEQ ID NO: 361562 - DNA, 27 bp, Artificial Sequence
  Description of Artificial Sequence: Synthetic oligonucleotide
gccggaccatgagtcaacttaagccgc

SEQ ID NO: 361563 - DNA, 30 bp, Artificial Sequence
  Description of Artificial Sequence: Synthetic oligonucleotide
attgggatggggagacacggaaagtgaagg

SEQ ID NO: 361564 - DNA, 27 bp, Artificial Sequence
  Description of Artificial Sequence: Synthetic oligonucleotide
ccggaccatgagtcaacttaagccgcg

SEQ ID NO: 361565 - DNA, 29 bp, Artificial Sequence
  Description of Artificial Sequence: Synthetic oligonucleotide
ttgggatggggagacacggaaagtgaagg

SEQ ID NO: 361566 - DNA, 30 bp, Artificial Sequence; identical to SEQ ID NO: 235389
  Description of Artificial Sequence: Synthetic oligonucleotide

SEQ ID NO: 361567 - DNA, 28 bp, Artificial Sequence
  Description of Artificial Sequence: Synthetic oligonucleotide
tgggatggggagacacggaaagtgaagg

SEQ ID NO: 361568 - DNA, 32 bp, Artificial Sequence; identical to SEQ ID NO: 235390
  Description of Artificial Sequence: Synthetic oligonucleotide

SEQ ID NO: 361569 - DNA, 27 bp, Artificial Sequence
  Description of Artificial Sequence: Synthetic oligonucleotide
gggatggggagacacggaaagtgaagg

SEQ ID NO: 361570 - DNA, 33 bp, Artificial Sequence; identical to SEQ ID NO: 235391
  Description of Artificial Sequence: Synthetic oligonucleotide

SEQ ID NO: 361571 - DNA, 27 bp, Artificial Sequence
  Description of Artificial Sequence: Synthetic oligonucleotide
ggatggggagacacggaaagtgaaggc

SEQ ID NO: 361572 - DNA, 34 bp, Artificial Sequence; identical to SEQ ID NO: 235392
  Description of Artificial Sequence: Synthetic oligonucleotide

SEQ ID NO: 361573 - DNA, 27 bp, Artificial Sequence
  Description of Artificial Sequence: Synthetic oligonucleotide
gatggggagacacggaaagtgaaggcc

SEQ ID NO: 361574 - DNA, 33 bp, Artificial Sequence; identical to SEQ ID NO: 235393
  Description of Artificial Sequence: Synthetic oligonucleotide

SEQ ID NO: 361575 - DNA, 27 bp, Artificial Sequence
  Description of Artificial Sequence: Synthetic oligonucleotide
atggggagacacggaaagtgaaggccc

SEQ ID NO: 361576 - DNA, 33 bp, Artificial Sequence; identical to SEQ ID NO: 235394
  Description of Artificial Sequence: Synthetic oligonucleotide

SEQ ID NO: 361577 - DNA, 27 bp, Artificial Sequence
  Description of Artificial Sequence: Synthetic oligonucleotide
tggggagacacggaaagtgaaggccca

SEQ ID NO: 361578 - DNA, 33 bp, Artificial Sequence; identical to SEQ ID NO: 235395
  Description of Artificial Sequence: Synthetic oligonucleotide

SEQ ID NO: 361579 - DNA, 22 bp, Artificial Sequence
  Description of Artificial Sequence: Synthetic oligonucleotide
cgcgagccagaggatggagccc

SEQ ID NO: 361580 - DNA, 32 bp, Artificial Sequence; identical to SEQ ID NO: 235396
  Description of Artificial Sequence: Synthetic oligonucleotide

SEQ ID NO: 361581 - DNA, 22 bp, Artificial Sequence
  Description of Artificial Sequence: Synthetic oligonucleotide
gcgagccagaggatggagcccc

SEQ ID NO: 361582 - DNA, 31 bp, Artificial Sequence; identical to SEQ ID NO: 235397
  Description of Artificial Sequence: Synthetic oligonucleotide

SEQ ID NO: 361583 - DNA, 22 bp, Artificial Sequence
  Description of Artificial Sequence: Synthetic oligonucleotide
cgagccagaggatggagccccg

SEQ ID NO: 361584 - DNA, 34 bp, Artificial Sequence; identical to SEQ ID NO: 235398
  Description of Artificial Sequence: Synthetic oligonucleotide

SEQ ID NO: 361585 - DNA, 22 bp, Artificial Sequence
  Description of Artificial Sequence: Synthetic oligonucleotide
gagccagaggatggagccccgg

SEQ ID NO: 361586 - DNA, 33 bp, Artificial Sequence; identical to SEQ ID NO: 235399
  Description of Artificial Sequence: Synthetic oligonucleotide

SEQ ID NO: 361587 - DNA, 22 bp, Artificial Sequence
  Description of Artificial Sequence: Synthetic oligonucleotide
agccagaggatggagccccggg

SEQ ID NO: 361588 - DNA, 34 bp, Artificial Sequence; identical to SEQ ID NO: 235400
  Description of Artificial Sequence: Synthetic oligonucleotide

SEQ ID NO: 361589 - DNA, 21 bp, Artificial Sequence
  Description of Artificial Sequence: Synthetic oligonucleotide
gccagaggatggagccccggg

SEQ ID NO: 361590 - DNA, 33 bp, Artificial Sequence; identical to SEQ ID NO: 235401
  Description of Artificial Sequence: Synthetic oligonucleotide

SEQ ID NO: 361591 - DNA, 21 bp, Artificial Sequence
  Description of Artificial Sequence: Synthetic oligonucleotide
ccagaggatggagccccgggc

SEQ ID NO: 361592 - DNA, 33 bp, Artificial Sequence; identical to SEQ ID NO: 235402
  Description of Artificial Sequence: Synthetic oligonucleotide

SEQ ID NO: 361593 - DNA, 21 bp, Artificial Sequence
  Description of Artificial Sequence: Synthetic oligonucleotide
cagaggatggagccccgggcg

SEQ ID NO: 361594 - DNA, 32 bp, Artificial Sequence; identical to SEQ ID NO: 235403
  Description of Artificial Sequence: Synthetic oligonucleotide

SEQ ID NO: 361595 - DNA, 21 bp, Artificial Sequence
  Description of Artificial Sequence: Synthetic oligonucleotide
agaggatggagccccgggcgc

SEQ ID NO: 361596 - DNA, 31 bp, Artificial Sequence; identical to SEQ ID NO: 235404
  Description of Artificial Sequence: Synthetic oligonucleotide

SEQ ID NO: 361597 - DNA, 20 bp, Artificial Sequence
  Description of Artificial Sequence: Synthetic oligonucleotide
gaggatggagccccgggcgc

SEQ ID NO: 361598 - DNA, 33 bp, Artificial Sequence; identical to SEQ ID NO: 235405
  Description of Artificial Sequence: Synthetic oligonucleotide

SEQ ID NO: 361599 - DNA, 20 bp, Artificial Sequence
  Description of Artificial Sequence: Synthetic oligonucleotide
aggatggagccccgggcgcc

SEQ ID NO: 361600 - DNA, 32 bp, Artificial Sequence; identical to SEQ ID NO: 235406
  Description of Artificial Sequence: Synthetic oligonucleotide

SEQ ID NO: 361601 - DNA, 20 bp, Artificial Sequence
  Description of Artificial Sequence: Synthetic oligonucleotide
ggatggagccccgggcgcct

SEQ ID NO: 361602 - DNA, 31 bp, Artificial Sequence; identical to SEQ ID NO: 235407
  Description of Artificial Sequence: Synthetic oligonucleotide

SEQ ID NO: 361603 - DNA, 20 bp, Artificial Sequence
  Description of Artificial Sequence: Synthetic oligonucleotide
gatggagccccgggcgccgt

SEQ ID NO: 361604 - DNA, 30 bp, Artificial Sequence; identical to SEQ ID NO: 235408
  Description of Artificial Sequence: Synthetic oligonucleotide

SEQ ID NO: 361605 - DNA, 20 bp, Artificial Sequence
  Description of Artificial Sequence: Synthetic oligonucleotide
atggagccccgggcgccgtg

SEQ ID NO: 361606 - DNA, 29 bp, Artificial Sequence
  Description of Artificial Sequence: Synthetic oligonucleotide
gccgcgtttctacagacgcttagaccaac

SEQ ID NO: 361607 - DNA, 20 bp, Artificial Sequence
  Description of Artificial Sequence: Synthetic oligonucleotide
tggagccccgggcgccgtgt

SEQ ID NO: 361608 - DNA, 30 bp, Artificial Sequence; identical to SEQ ID NO: 235410
  Description of Artificial Sequence: Synthetic oligonucleotide

SEQ ID NO: 361609 - DNA, 20 bp, Artificial Sequence
  Description of Artificial Sequence: Synthetic oligonucleotide
ggagccccgggcgccgtgtt

SEQ ID NO: 361610 - DNA, 30 bp, Artificial Sequence; identical to SEQ ID NO: 235411
  Description of Artificial Sequence: Synthetic oligonucleotide

SEQ ID NO: 361611 - DNA, 21 bp, Artificial Sequence
  Description of Artificial Sequence: Synthetic oligonucleotide
gagccccgggcgccgtggata

SEQ ID NO: 361612 - DNA, 30 bp, Artificial Sequence; identical to SEQ ID NO: 235412
  Description of Artificial Sequence: Synthetic oligonucleotide

SEQ ID NO: 361613 - DNA, 22 bp, Artificial Sequence
  Description of Artificial Sequence: Synthetic oligonucleotide
agccccgggcgccgtggataga

SEQ ID NO: 361614 - DNA, 30 bp, Artificial Sequence; identical to SEQ ID NO: 235413
  Description of Artificial Sequence: Synthetic oligonucleotide

SEQ ID NO: 361615 - DNA, 21 bp, Artificial Sequence
  Description of Artificial Sequence: Synthetic oligonucleotide
gccccgggcgccgtggataga

SEQ ID NO: 361616 - DNA, 31 bp, Artificial Sequence; identical to SEQ ID NO: 235414
  Description of Artificial Sequence: Synthetic oligonucleotide

SEQ ID NO: 361617 - DNA, 21 bp, Artificial Sequence
  Description of Artificial Sequence: Synthetic oligonucleotide
ccccgggcgccgtggatagag

SEQ ID NO: 361618 - DNA, 36 bp, Artificial Sequence; identical to SEQ ID NO: 235415
  Description of Artificial Sequence: Synthetic oligonucleotide

SEQ ID NO: 361619 - DNA, 22 bp, Artificial Sequence
  Description of Artificial Sequence: Synthetic oligonucleotide
cccgggcgccgtggatagagca

SEQ ID NO: 361620 - DNA, 35 bp, Artificial Sequence; identical to SEQ ID NO: 235416
  Description of Artificial Sequence: Synthetic oligonucleotide

SEQ ID NO: 361621 - DNA, 22 bp, Artificial Sequence
  Description of Artificial Sequence: Synthetic oligonucleotide
ccgggcgccgtggatagagcag

SEQ ID NO: 361622 - DNA, 34 bp, Artificial Sequence; identical to SEQ ID NO: 235417
  Description of Artificial Sequence: Synthetic oligonucleotide

SEQ ID NO: 361623 - DNA, 23 bp, Artificial Sequence
  Description of Artificial Sequence: Synthetic oligonucleotide
ggaaggagacgctgcagcgcacc

SEQ ID NO: 361624 - DNA, 33 bp, Artificial Sequence; identical to SEQ ID NO: 235418
  Description of Artificial Sequence: Synthetic oligonucleotide

SEQ ID NO: 361625 - DNA, 23 bp, Artificial Sequence
  Description of Artificial Sequence: Synthetic oligonucleotide
gaaggagacgctgcagcgcaccg

SEQ ID NO: 361626 - DNA, 36 bp, Artificial Sequence; identical to SEQ ID NO: 235419
  Description of Artificial Sequence: Synthetic oligonucleotide

SEQ ID NO: 361627 - DNA, 28 bp, Artificial Sequence
  Description of Artificial Sequence: Synthetic oligonucleotide
acggaaagtgaaggcccactcacagacc

SEQ ID NO: 361628 - DNA, 35 bp, Artificial Sequence; identical to SEQ ID NO: 235420
  Description of Artificial Sequence: Synthetic oligonucleotide

SEQ ID NO: 361629 - DNA, 27 bp, Artificial Sequence
  Description of Artificial Sequence: Synthetic oligonucleotide
cggaaagtgaaggcccactcacagacc

SEQ ID NO: 361630 - DNA, 34 bp, Artificial Sequence; identical to SEQ ID NO: 235421
  Description of Artificial Sequence: Synthetic oligonucleotide

SEQ ID NO: 361631 - DNA, 27 bp, Artificial Sequence
  Description of Artificial Sequence: Synthetic oligonucleotide
ggaaagtgaaggcccactcacagaccc

SEQ ID NO: 361632 - DNA, 39 bp, Artificial Sequence; identical to SEQ ID NO: 235422
  Description of Artificial Sequence: Synthetic oligonucleotide

SEQ ID NO: 361633 - DNA, 28 bp, Artificial Sequence
  Description of Artificial Sequence: Synthetic oligonucleotide
gaaagtgaaggcccactcacagacccac

SEQ ID NO: 361634 - DNA, 38 bp, Artificial Sequence; identical to SEQ ID NO: 235423
  Description of Artificial Sequence: Synthetic oligonucleotide

SEQ ID NO: 361635 - DNA, 28 bp, Artificial Sequence
  Description of Artificial Sequence: Synthetic oligonucleotide
aaagtgaaggcccactcacagacccacc

SEQ ID NO: 361636 - DNA, 40 bp, Artificial Sequence; identical to SEQ ID NO: 235424
  Description of Artificial Sequence: Synthetic oligonucleotide

SEQ ID NO: 361637 - DNA, 27 bp, Artificial Sequence
  Description of Artificial Sequence: Synthetic oligonucleotide
aagtgaaggcccactcacagacccacc

SEQ ID NO: 361638 - DNA, 39 bp, Artificial Sequence; identical to SEQ ID NO: 235425
  Description of Artificial Sequence: Synthetic oligonucleotide

SEQ ID NO: 361639 - DNA, 26 bp, Artificial Sequence
  Description of Artificial Sequence: Synthetic oligonucleotide
agtgaaggcccactcacagacccacc

SEQ ID NO: 361640 - DNA, 41 bp, Artificial Sequence; identical to SEQ ID NO: 235426
  Description of Artificial Sequence: Synthetic oligonucleotide

SEQ ID NO: 361641 - DNA, 25 bp, Artificial Sequence
  Description of Artificial Sequence: Synthetic oligonucleotide
gtgaaggcccactcacagacccacc

SEQ ID NO: 361642 - DNA, 43 bp, Artificial Sequence; identical to SEQ ID NO: 235427
  Description of Artificial Sequence: Synthetic oligonucleotide

SEQ ID NO: 361643 - DNA, 26 bp, Artificial Sequence
  Description of Artificial Sequence: Synthetic oligonucleotide
tgaaggcccactcacagacccaccga

SEQ ID NO: 361644 - DNA, 44 bp, Artificial Sequence; identical to SEQ ID NO: 235428
  Description of Artificial Sequence: Synthetic oligonucleotide

SEQ ID NO: 361645 - DNA, 25 bp, Artificial Sequence
  Description of Artificial Sequence: Synthetic oligonucleotide
gaaggcccactcacagacccaccga

SEQ ID NO: 361646 - DNA, 43 bp, Artificial Sequence; identical to SEQ ID NO: 235429
  Description of Artificial Sequence: Synthetic oligonucleotide

SEQ ID NO: 361647 - DNA, 26 bp, Artificial Sequence
  Description of Artificial Sequence: Synthetic oligonucleotide
aaggcccactcacagacccaccgagt

SEQ ID NO: 361648 - DNA, 42 bp, Artificial Sequence; identical to SEQ ID NO: 235430
  Description of Artificial Sequence: Synthetic oligonucleotide

SEQ ID NO: 361649 - DNA, 25 bp, Artificial Sequence
  Description of Artificial Sequence: Synthetic oligonucleotide
aggcccactcacagacccaccgagt

SEQ ID NO: 361650 - DNA, 41 bp, Artificial Sequence; identical to SEQ ID NO: 235431
  Description of Artificial Sequence: Synthetic oligonucleotide

SEQ ID NO: 361651 - DNA, 24 bp, Artificial Sequence
  Description of Artificial Sequence: Synthetic oligonucleotide
ggcccactcacagacccaccgagt

SEQ ID NO: 361652 - DNA, 43 bp, Artificial Sequence; identical to SEQ ID NO: 235432
  Description of Artificial Sequence: Synthetic oligonucleotide

SEQ ID NO: 361653 - DNA, 24 bp, Artificial Sequence
  Description of Artificial Sequence: Synthetic oligonucleotide
gcccactcacagacccaccgagtg

SEQ ID NO: 361654 - DNA, 42 bp, Artificial Sequence; identical to SEQ ID NO: 235433
  Description of Artificial Sequence: Synthetic oligonucleotide

SEQ ID NO: 361655 - DNA, 25 bp, Artificial Sequence
  Description of Artificial Sequence: Synthetic oligonucleotide
cccactcacagacccaccgagtgga

SEQ ID NO: 361656 - DNA, 44 bp, Artificial Sequence; identical to SEQ ID NO: 235434
  Description of Artificial Sequence: Synthetic oligonucleotide

SEQ ID NO: 361657 - DNA, 25 bp, Artificial Sequence
  Description of Artificial Sequence: Synthetic oligonucleotide
ccactcacagacccaccgagtggac

SEQ ID NO: 361658 - DNA, 47 bp, Artificial Sequence; identical to SEQ ID NO: 235435
  Description of Artificial Sequence: Synthetic oligonucleotide

SEQ ID NO: 361659 - DNA, 26 bp, Artificial Sequence
  Description of Artificial Sequence: Synthetic oligonucleotide
cactcacagacccaccgagtggacct

SEQ ID NO: 361660 - DNA, 46 bp, Artificial Sequence; identical to SEQ ID NO: 235436
  Description of Artificial Sequence: Synthetic oligonucleotide

SEQ ID NO: 361661 - DNA, 26 bp, Artificial Sequence
  Description of Artificial Sequence: Synthetic oligonucleotide
actcacagacccaccgagtggacctg

SEQ ID NO: 361662 - DNA, 45 bp, Artificial Sequence; identical to SEQ ID NO: 235437
  Description of Artificial Sequence: Synthetic oligonucleotide

SEQ ID NO: 361663 - DNA, 25 bp, Artificial Sequence
  Description of Artificial Sequence: Synthetic oligonucleotide
ctcacagacccaccgagtggacctg

SEQ ID NO: 361664 - DNA, 46 bp, Artificial Sequence; identical to SEQ ID NO: 235438
  Description of Artificial Sequence: Synthetic oligonucleotide

SEQ ID NO: 361665 - DNA, 25 bp, Artificial Sequence
  Description of Artificial Sequence: Synthetic oligonucleotide
tcacagacccaccgagtggacctgg

SEQ ID NO: 361666 - DNA, 45 bp, Artificial Sequence; identical to SEQ ID NO: 235439
  Description of Artificial Sequence: Synthetic oligonucleotide

SEQ ID NO: 361667 - DNA, 24 bp, Artificial Sequence
  Description of Artificial Sequence: Synthetic oligonucleotide
cacagacccaccgagtggacctgg

SEQ ID NO: 361668 - DNA, 45 bp, Artificial Sequence; identical to SEQ ID NO: 235440
  Description of Artificial Sequence: Synthetic oligonucleotide

SEQ ID NO: 361669 - DNA, 24 bp, Artificial Sequence
  Description of Artificial Sequence: Synthetic oligonucleotide
acagacccaccgagtggacctggg

SEQ ID NO: 361670 - DNA, 47 bp, Artificial Sequence; identical to SEQ ID NO: 235441
  Description of Artificial Sequence: Synthetic oligonucleotide

SEQ ID NO: 361671 - DNA, 23 bp, Artificial Sequence
  Description of Artificial Sequence: Synthetic oligonucleotide
cagacccaccgagtggacctggg

SEQ ID NO: 361672 - DNA, 48 bp, Artificial Sequence; identical to SEQ ID NO: 235442
  Description of Artificial Sequence: Synthetic oligonucleotide

SEQ ID NO: 361673 - DNA, 24 bp, Artificial Sequence
  Description of Artificial Sequence: Synthetic oligonucleotide
agacccaccgagtggacctgggga

SEQ ID NO: 361674 - DNA, 48 bp, Artificial Sequence; identical to SEQ ID NO: 235443
  Description of Artificial Sequence: Synthetic oligonucleotide

SEQ ID NO: 361675 - DNA, 23 bp, Artificial Sequence
  Description of Artificial Sequence: Synthetic oligonucleotide
gacccaccgagtggacctgggga

SEQ ID NO: 361676 - DNA, 47 bp, Artificial Sequence; identical to SEQ ID NO: 235444
  Description of Artificial Sequence: Synthetic oligonucleotide

SEQ ID NO: 361677 - DNA, 23 bp, Artificial Sequence
  Description of Artificial Sequence: Synthetic oligonucleotide
acccaccgagtggacctggggac

SEQ ID NO: 361678 - DNA, 48 bp, Artificial Sequence; identical to SEQ ID NO: 235445
  Description of Artificial Sequence: Synthetic oligonucleotide

SEQ ID NO: 361679 - DNA, 22 bp, Artificial Sequence
  Description of Artificial Sequence: Synthetic oligonucleotide
cccaccgagtggacctggggac

SEQ ID NO: 361680 - DNA, 47 bp, Artificial Sequence; identical to SEQ ID NO: 235446
  Description of Artificial Sequence: Synthetic oligonucleotide

SEQ ID NO: 361681 - DNA, 22 bp, Artificial Sequence
  Description of Artificial Sequence: Synthetic oligonucleotide
ccaccgagtggacctggggacc

SEQ ID NO: 361682 - DNA, 46 bp, Artificial Sequence; identical to SEQ ID NO: 235447
  Description of Artificial Sequence: Synthetic oligonucleotide

SEQ ID NO: 361683 - DNA, 31 bp, Artificial Sequence; identical to SEQ ID NO: 14727
  Description of Artificial Sequence: Synthetic oligonucleotide

SEQ ID NO: 361684 - DNA, 45 bp, Artificial Sequence; identical to SEQ ID NO: 235448
  Description of Artificial Sequence: Synthetic oligonucleotide

SEQ ID NO: 361685 - DNA, 31 bp, Artificial Sequence; identical to SEQ ID NO: 14728
  Description of Artificial Sequence: Synthetic oligonucleotide

SEQ ID NO: 361686 - DNA, 44 bp, Artificial Sequence; identical to SEQ ID NO: 235449
  Description of Artificial Sequence: Synthetic oligonucleotide

SEQ ID NO: 361687 - DNA, 30 bp, Artificial Sequence; identical to SEQ ID NO: 14729
  Description of Artificial Sequence: Synthetic oligonucleotide

SEQ ID NO: 361688 - DNA, 43 bp, Artificial Sequence; identical to SEQ ID NO: 235450
  Description of Artificial Sequence: Synthetic oligonucleotide

SEQ ID NO: 361689 - DNA, 30 bp, Artificial Sequence; identical to SEQ ID NO: 14730
  Description of Artificial Sequence: Synthetic oligonucleotide

SEQ ID NO: 361690 - DNA, 45 bp, Artificial Sequence; identical to SEQ ID NO: 235451
  Description of Artificial Sequence: Synthetic oligonucleotide

SEQ ID NO: 361691 - DNA, 29 bp, Artificial Sequence
  Description of Artificial Sequence: Synthetic oligonucleotide
acgcctacgacggcaaggattacatagcc

SEQ ID NO: 361692 - DNA, 44 bp, Artificial Sequence; identical to SEQ ID NO: 235452
  Description of Artificial Sequence: Synthetic oligonucleotide

SEQ ID NO: 361693 - DNA, 28 bp, Artificial Sequence
  Description of Artificial Sequence: Synthetic oligonucleotide
cgcctacgacggcaaggattacatagcc

SEQ ID NO: 361694 - DNA, 43 bp, Artificial Sequence; identical to SEQ ID NO: 235453
  Description of Artificial Sequence: Synthetic oligonucleotide

SEQ ID NO: 361695 - DNA, 28 bp, Artificial Sequence
  Description of Artificial Sequence: Synthetic oligonucleotide
gcctacgacggcaaggattacatagccc

SEQ ID NO: 361696 - DNA, 42 bp, Artificial Sequence; identical to SEQ ID NO: 235454
  Description of Artificial Sequence: Synthetic oligonucleotide

SEQ ID NO: 361697 - DNA, 29 bp, Artificial Sequence
  Description of Artificial Sequence: Synthetic oligonucleotide
cctacgacggcaaggattacatagccctg

SEQ ID NO: 361698 - DNA, 44 bp, Artificial Sequence; identical to SEQ ID NO: 235455
  Description of Artificial Sequence: Synthetic oligonucleotide

SEQ ID NO: 361699 - DNA, 32 bp, Artificial Sequence; identical to SEQ ID NO: 14735
  Description of Artificial Sequence: Synthetic oligonucleotide

SEQ ID NO: 361700 - DNA, 43 bp, Artificial Sequence; identical to SEQ ID NO: 235456
  Description of Artificial Sequence: Synthetic oligonucleotide

SEQ ID NO: 361701 - DNA, 33 bp, Artificial Sequence; identical to SEQ ID NO: 14736
  Description of Artificial Sequence: Synthetic oligonucleotide

SEQ ID NO: 361702 - DNA, 42 bp, Artificial Sequence; identical to SEQ ID NO: 235457
  Description of Artificial Sequence: Synthetic oligonucleotide

SEQ ID NO: 361703 - DNA, 32 bp, Artificial Sequence; identical to SEQ ID NO: 14737
  Description of Artificial Sequence: Synthetic oligonucleotide

SEQ ID NO: 361704 - DNA, 41 bp, Artificial Sequence; identical to SEQ ID NO: 235458
  Description of Artificial Sequence: Synthetic oligonucleotide

SEQ ID NO: 361705 - DNA, 31 bp, Artificial Sequence; identical to SEQ ID NO: 14738
  Description of Artificial Sequence: Synthetic oligonucleotide

SEQ ID NO: 361706 - DNA, 40 bp, Artificial Sequence; identical to SEQ ID NO: 235459
  Description of Artificial Sequence: Synthetic oligonucleotide

SEQ ID NO: 361707 - DNA, 31 bp, Artificial Sequence; identical to SEQ ID NO: 14739
  Description of Artificial Sequence: Synthetic oligonucleotide

SEQ ID NO: 361708 - DNA, 39 bp, Artificial Sequence; identical to SEQ ID NO: 235460
  Description of Artificial Sequence: Synthetic oligonucleotide

SEQ ID NO: 361709 - DNA, 32 bp, Artificial Sequence; identical to SEQ ID NO: 14740
  Description of Artificial Sequence: Synthetic oligonucleotide

SEQ ID NO: 361710 - DNA, 39 bp, Artificial Sequence; identical to SEQ ID NO: 235461
  Description of Artificial Sequence: Synthetic oligonucleotide

SEQ ID NO: 361711 - DNA, 31 bp, Artificial Sequence; identical to SEQ ID NO: 14741
  Description of Artificial Sequence: Synthetic oligonucleotide

SEQ ID NO: 361712 - DNA, 38 bp, Artificial Sequence; identical to SEQ ID NO: 235462
  Description of Artificial Sequence: Synthetic oligonucleotide

SEQ ID NO: 361713 - DNA, 31 bp, Artificial Sequence; identical to SEQ ID NO: 14742
  Description of Artificial Sequence: Synthetic oligonucleotide

SEQ ID NO: 361714 - DNA, 37 bp, Artificial Sequence; identical to SEQ ID NO: 235463
  Description of Artificial Sequence: Synthetic oligonucleotide

SEQ ID NO: 361715 - DNA, 32 bp, Artificial Sequence; identical to SEQ ID NO: 14743
  Description of Artificial Sequence: Synthetic oligonucleotide

SEQ ID NO: 361716 - DNA, 38 bp, Artificial Sequence; identical to SEQ ID NO: 235464
  Description of Artificial Sequence: Synthetic oligonucleotide

SEQ ID NO: 361717 - DNA, 32 bp, Artificial Sequence; identical to SEQ ID NO: 14744
  Description of Artificial Sequence: Synthetic oligonucleotide

SEQ ID NO: 361718 - DNA, 37 bp, Artificial Sequence; identical to SEQ ID NO: 235465
  Description of Artificial Sequence: Synthetic oligonucleotide

SEQ ID NO: 361719 - DNA, 32 bp, Artificial Sequence; identical to SEQ ID NO: 14745
  Description of Artificial Sequence: Synthetic oligonucleotide

SEQ ID NO: 361720 - DNA, 36 bp, Artificial Sequence; identical to SEQ ID NO: 235466
  Description of Artificial Sequence: Synthetic oligonucleotide

SEQ ID NO: 361721 - DNA, 31 bp, Artificial Sequence; identical to SEQ ID NO: 14746
  Description of Artificial Sequence: Synthetic oligonucleotide

SEQ ID NO: 361722 - DNA, 37 bp, Artificial Sequence; identical to SEQ ID NO: 235467
  Description of Artificial Sequence: Synthetic oligonucleotide

SEQ ID NO: 361723 - DNA, 30 bp, Artificial Sequence; identical to SEQ ID NO: 14747
  Description of Artificial Sequence: Synthetic oligonucleotide

SEQ ID NO: 361724 - DNA, 36 bp, Artificial Sequence; identical to SEQ ID NO: 235468
  Description of Artificial Sequence: Synthetic oligonucleotide

SEQ ID NO: 361725 - DNA, 30 bp, Artificial Sequence; identical to SEQ ID NO: 14748
  Description of Artificial Sequence: Synthetic oligonucleotide

SEQ ID NO: 361726 - DNA, 35 bp, Artificial Sequence; identical to SEQ ID NO: 235469
  Description of Artificial Sequence: Synthetic oligonucleotide

SEQ ID NO: 361727 - DNA, 31 bp, Artificial Sequence; identical to SEQ ID NO: 14749
  Description of Artificial Sequence: Synthetic oligonucleotide

SEQ ID NO: 361728 - DNA, 35 bp, Artificial Sequence; identical to SEQ ID NO: 235470
  Description of Artificial Sequence: Synthetic oligonucleotide

SEQ ID NO: 361729 - DNA, 30 bp, Artificial Sequence; identical to SEQ ID NO: 14750
  Description of Artificial Sequence: Synthetic oligonucleotide

SEQ ID NO: 361730 - DNA, 34 bp, Artificial Sequence; identical to SEQ ID NO: 235471
  Description of Artificial Sequence: Synthetic oligonucleotide

SEQ ID NO: 361731 - DNA, 29 bp, Artificial Sequence
  Description of Artificial Sequence: Synthetic oligonucleotide
tacatagccctgaaagaggacctgcgctc

SEQ ID NO: 361732 - DNA, 34 bp, Artificial Sequence; identical to SEQ ID NO: 235472
  Description of Artificial Sequence: Synthetic oligonucleotide

SEQ ID NO: 361733 - DNA, 28 bp, Artificial Sequence
  Description of Artificial Sequence: Synthetic oligonucleotide
acatagccctgaaagaggacctgcgctc

SEQ ID NO: 361734 - DNA, 33 bp, Artificial Sequence; identical to SEQ ID NO: 235473
  Description of Artificial Sequence: Synthetic oligonucleotide

SEQ ID NO: 361735 - DNA, 27 bp, Artificial Sequence
  Description of Artificial Sequence: Synthetic oligonucleotide
catagccctgaaagaggacctgcgctc

SEQ ID NO: 361736 - DNA, 32 bp, Artificial Sequence; identical to SEQ ID NO: 235474
  Description of Artificial Sequence: Synthetic oligonucleotide

SEQ ID NO: 361737 - DNA, 29 bp, Artificial Sequence
  Description of Artificial Sequence: Synthetic oligonucleotide
atagccctgaaagaggacctgcgctcttg

SEQ ID NO: 361738 - DNA, 33 bp, Artificial Sequence; identical to SEQ ID NO: 235475
  Description of Artificial Sequence: Synthetic oligonucleotide

SEQ ID NO: 361739 - DNA, 28 bp, Artificial Sequence
  Description of Artificial Sequence: Synthetic oligonucleotide
tagccctgaaagaggacctgcgctcttg

SEQ ID NO: 361740 - DNA, 32 bp, Artificial Sequence; identical to SEQ ID NO: 235476
  Description of Artificial Sequence: Synthetic oligonucleotide

SEQ ID NO: 361741 - DNA, 27 bp, Artificial Sequence
  Description of Artificial Sequence: Synthetic oligonucleotide
agccctgaaagaggacctgcgctcttg

SEQ ID NO: 361742 - DNA, 31 bp, Artificial Sequence; identical to SEQ ID NO: 235477
  Description of Artificial Sequence: Synthetic oligonucleotide

SEQ ID NO: 361743 - DNA, 22 bp, Artificial Sequence
  Description of Artificial Sequence: Synthetic oligonucleotide
gccgcggggagccccgtttcat

SEQ ID NO: 361744 - DNA, 32 bp, Artificial Sequence; identical to SEQ ID NO: 235478
  Description of Artificial Sequence: Synthetic oligonucleotide

SEQ ID NO: 361745 - DNA, 22 bp, Artificial Sequence
  Description of Artificial Sequence: Synthetic oligonucleotide
ccgcggggagccccgtttcatc

SEQ ID NO: 361746 - DNA, 31 bp, Artificial Sequence; identical to SEQ ID NO: 235479
  Description of Artificial Sequence: Synthetic oligonucleotide

SEQ ID NO: 361747 - DNA, 22 bp, Artificial Sequence
  Description of Artificial Sequence: Synthetic oligonucleotide
cgcggggagccccgtttcatcg

SEQ ID NO: 361748 - DNA, 30 bp, Artificial Sequence; identical to SEQ ID NO: 235480
  Description of Artificial Sequence: Synthetic oligonucleotide

SEQ ID NO: 361749 - DNA, 23 bp, Artificial Sequence
  Description of Artificial Sequence: Synthetic oligonucleotide
gcggggagccccgtttcatcgca

SEQ ID NO: 361750 - DNA, 29 bp, Artificial Sequence
  Description of Artificial Sequence: Synthetic oligonucleotide
gtggatcaggacaagaacgagaccgtcag

SEQ ID NO: 361751 - DNA, 24 bp, Artificial Sequence
  Description of Artificial Sequence: Synthetic oligonucleotide
cggggagccccgtttcatcgcagt

SEQ ID NO: 361752 - DNA, 29 bp, Artificial Sequence
  Description of Artificial Sequence: Synthetic oligonucleotide
tggatcaggacaagaacgagaccgtcagg

SEQ ID NO: 361753 - DNA, 24 bp, Artificial Sequence
  Description of Artificial Sequence: Synthetic oligonucleotide
ggggagccccgtttcatcgcagtg

SEQ ID NO: 361754 - DNA, 28 bp, Artificial Sequence
  Description of Artificial Sequence: Synthetic oligonucleotide
ggatcaggacaagaacgagaccgtcagg

SEQ ID NO: 361755 - DNA, 24 bp, Artificial Sequence
  Description of Artificial Sequence: Synthetic oligonucleotide
gggagccccgtttcatcgcagtgg

SEQ ID NO: 361756 - DNA, 28 bp, Artificial Sequence
  Description of Artificial Sequence: Synthetic oligonucleotide
gatcaggacaagaacgagaccgtcaggc

SEQ ID NO: 361757 - DNA, 24 bp, Artificial Sequence
  Description of Artificial Sequence: Synthetic oligonucleotide
ggagccccgtttcatcgcagtggg

SEQ ID NO: 361758 - DNA, 30 bp, Artificial Sequence; identical to SEQ ID NO: 235485
  Description of Artificial Sequence: Synthetic oligonucleotide

SEQ ID NO: 361759 - DNA, 26 bp, Artificial Sequence
  Description of Artificial Sequence: Synthetic oligonucleotide
gagccccgtttcatcgcagtgggcta

SEQ ID NO: 361760 - DNA, 29 bp, Artificial Sequence
  Description of Artificial Sequence: Synthetic oligonucleotide
tcaggacaagaacgagaccgtcaggcatc

SEQ ID NO: 361761 - DNA, 26 bp, Artificial Sequence
  Description of Artificial Sequence: Synthetic oligonucleotide
agccccgtttcatcgcagtgggctac

SEQ ID NO: 361762 - DNA, 28 bp, Artificial Sequence
  Description of Artificial Sequence: Synthetic oligonucleotide
caggacaagaacgagaccgtcaggcatc

SEQ ID NO: 361763 - DNA, 25 bp, Artificial Sequence
  Description of Artificial Sequence: Synthetic oligonucleotide
gccccgtttcatcgcagtgggctac

SEQ ID NO: 361764 - DNA, 29 bp, Artificial Sequence
  Description of Artificial Sequence: Synthetic oligonucleotide
aggacaagaacgagaccgtcaggcatctg

SEQ ID NO: 361765 - DNA, 26 bp, Artificial Sequence
  Description of Artificial Sequence: Synthetic oligonucleotide
ccccgtttcatcgcagtgggctacgt

SEQ ID NO: 361766 - DNA, 28 bp, Artificial Sequence
  Description of Artificial Sequence: Synthetic oligonucleotide
ggacaagaacgagaccgtcaggcatctg

SEQ ID NO: 361767 - DNA, 26 bp, Artificial Sequence
  Description of Artificial Sequence: Synthetic oligonucleotide
cccgtttcatcgcagtgggctacgtg

SEQ ID NO: 361768 - DNA, 28 bp, Artificial Sequence
  Description of Artificial Sequence: Synthetic oligonucleotide
gacaagaacgagaccgtcaggcatctgg

SEQ ID NO: 361769 - DNA, 27 bp, Artificial Sequence
  Description of Artificial Sequence: Synthetic oligonucleotide
ccgtttcatcgcagtgggctacgtgga

SEQ ID NO: 361770 - DNA, 29 bp, Artificial Sequence
  Description of Artificial Sequence: Synthetic oligonucleotide
acaagaacgagaccgtcaggcatctggtg

SEQ ID NO: 361771 - DNA, 27 bp, Artificial Sequence
  Description of Artificial Sequence: Synthetic oligonucleotide
cgtttcatcgcagtgggctacgtggac

SEQ ID NO: 361772 - DNA, 28 bp, Artificial Sequence
  Description of Artificial Sequence: Synthetic oligonucleotide
caagaacgagaccgtcaggcatctggtg

SEQ ID NO: 361773 - DNA, 27 bp, Artificial Sequence
  Description of Artificial Sequence: Synthetic oligonucleotide
gtttcatcgcagtgggctacgtggacg

SEQ ID NO: 361774 - DNA, 28 bp, Artificial Sequence
  Description of Artificial Sequence: Synthetic oligonucleotide
aagaacgagaccgtcaggcatctggtgg

SEQ ID NO: 361775 - DNA, 28 bp, Artificial Sequence
  Description of Artificial Sequence: Synthetic oligonucleotide
tttcatcgcagtgggctacgtggacgac

SEQ ID NO: 361776 - DNA, 27 bp, Artificial Sequence
  Description of Artificial Sequence: Synthetic oligonucleotide
agaacgagaccgtcaggcatctggtgg

SEQ ID NO: 361777 - DNA, 23 bp, Artificial Sequence
  Description of Artificial Sequence: Synthetic oligonucleotide
agggcacgtgcgtggagtggctg

SEQ ID NO: 361778 - DNA, 27 bp, Artificial Sequence
  Description of Artificial Sequence: Synthetic oligonucleotide
gaacgagaccgtcaggcatctggtgga

SEQ ID NO: 361779 - DNA, 22 bp, Artificial Sequence
  Description of Artificial Sequence: Synthetic oligonucleotide
gggcacgtgcgtggagtggctg

SEQ ID NO: 361780 - DNA, 27 bp, Artificial Sequence
  Description of Artificial Sequence: Synthetic oligonucleotide
aacgagaccgtcaggcatctggtggag

SEQ ID NO: 361781 - DNA, 22 bp, Artificial Sequence
  Description of Artificial Sequence: Synthetic oligonucleotide
ggcacgtgcgtggagtggctgc

SEQ ID NO: 361782 - DNA, 27 bp, Artificial Sequence
  Description of Artificial Sequence: Synthetic oligonucleotide
acgagaccgtcaggcatctggtggagt

SEQ ID NO: 361783 - DNA, 22 bp, Artificial Sequence
  Description of Artificial Sequence: Synthetic oligonucleotide
gcacgtgcgtggagtggctgcg

SEQ ID NO: 361784 - DNA, 27 bp, Artificial Sequence
  Description of Artificial Sequence: Synthetic oligonucleotide
cgagaccgtcaggcatctggtggagtt

SEQ ID NO: 361785 - DNA, 23 bp, Artificial Sequence
  Description of Artificial Sequence: Synthetic oligonucleotide
cacgtgcgtggagtggctgcgca

SEQ ID NO: 361786 - DNA, 28 bp, Artificial Sequence
  Description of Artificial Sequence: Synthetic oligonucleotide
gagaccgtcaggcatctggtggagtttg

SEQ ID NO: 361787 - DNA, 26 bp, Artificial Sequence
  Description of Artificial Sequence: Synthetic oligonucleotide
acgtgcgtggagtggctgcgcagata

SEQ ID NO: 361788 - DNA, 28 bp, Artificial Sequence
  Description of Artificial Sequence: Synthetic oligonucleotide
agaccgtcaggcatctggtggagtttgg

SEQ ID NO: 361789 - DNA, 25 bp, Artificial Sequence
  Description of Artificial Sequence: Synthetic oligonucleotide
cgtgcgtggagtggctgcgcagata

SEQ ID NO: 361790 - DNA, 27 bp, Artificial Sequence
  Description of Artificial Sequence: Synthetic oligonucleotide
gaccgtcaggcatctggtggagtttgg

SEQ ID NO: 361791 - DNA, 25 bp, Artificial Sequence
  Description of Artificial Sequence: Synthetic oligonucleotide
gtgcgtggagtggctgcgcagatac

SEQ ID NO: 361792 - DNA, 27 bp, Artificial Sequence
  Description of Artificial Sequence: Synthetic oligonucleotide
accgtcaggcatctggtggagtttggg

SEQ ID NO: 361793 - DNA, 26 bp, Artificial Sequence
  Description of Artificial Sequence: Synthetic oligonucleotide
tgcgtggagtggctgcgcagatacct

SEQ ID NO: 361794 - DNA, 26 bp, Artificial Sequence
  Description of Artificial Sequence: Synthetic oligonucleotide
ccgtcaggcatctggtggagtttggg

SEQ ID NO: 361795 - DNA, 25 bp, Artificial Sequence
  Description of Artificial Sequence: Synthetic oligonucleotide
gcgtggagtggctgcgcagatacct

SEQ ID NO: 361796 - DNA, 27 bp, Artificial Sequence
  Description of Artificial Sequence: Synthetic oligonucleotide
cgtcaggcatctggtggagtttgggca

SEQ ID NO: 361797 - DNA, 25 bp, Artificial Sequence
  Description of Artificial Sequence: Synthetic oligonucleotide
cgtggagtggctgcgcagatacctg

SEQ ID NO: 361798 - DNA, 28 bp, Artificial Sequence
  Description of Artificial Sequence: Synthetic oligonucleotide
gtcaggcatctggtggagtttgggcaag

SEQ ID NO: 361799 - DNA, 26 bp, Artificial Sequence
  Description of Artificial Sequence: Synthetic oligonucleotide
gtggagtggctgcgcagatacctgga

SEQ ID NO: 361800 - DNA, 28 bp, Artificial Sequence
  Description of Artificial Sequence: Synthetic oligonucleotide
tcaggcatctggtggagtttgggcaagc

SEQ ID NO: 361801 - DNA, 27 bp, Artificial Sequence
  Description of Artificial Sequence: Synthetic oligonucleotide
tggagtggctgcgcagatacctggaga

SEQ ID NO: 361802 - DNA, 27 bp, Artificial Sequence
  Description of Artificial Sequence: Synthetic oligonucleotide
caggcatctggtggagtttgggcaagc

SEQ ID NO: 361803 - DNA, 27 bp, Artificial Sequence
  Description of Artificial Sequence: Synthetic oligonucleotide
ggagtggctgcgcagatacctggagaa

SEQ ID NO: 361804 - DNA, 27 bp, Artificial Sequence
  Description of Artificial Sequence: Synthetic oligonucleotide
aggcatctggtggagtttgggcaagcc

SEQ ID NO: 361805 - DNA, 27 bp, Artificial Sequence
  Description of Artificial Sequence: Synthetic oligonucleotide
gagtggctgcgcagatacctggagaac

SEQ ID NO: 361806 - DNA, 27 bp, Artificial Sequence
  Description of Artificial Sequence: Synthetic oligonucleotide
ggcatctggtggagtttgggcaagcct

SEQ ID NO: 361807 - DNA, 27 bp, Artificial Sequence
  Description of Artificial Sequence: Synthetic oligonucleotide
agtggctgcgcagatacctggagaacg

SEQ ID NO: 361808 - DNA, 30 bp, Artificial Sequence; identical to SEQ ID NO: 235510
  Description of Artificial Sequence: Synthetic oligonucleotide

SEQ ID NO: 361809 - DNA, 26 bp, Artificial Sequence
  Description of Artificial Sequence: Synthetic oligonucleotide
gtggctgcgcagatacctggagaacg

SEQ ID NO: 361810 - DNA, 30 bp, Artificial Sequence; identical to SEQ ID NO: 235511
  Description of Artificial Sequence: Synthetic oligonucleotide

SEQ ID NO: 361811 - DNA, 26 bp, Artificial Sequence
  Description of Artificial Sequence: Synthetic oligonucleotide
tggctgcgcagatacctggagaacgg

SEQ ID NO: 361812 - DNA, 33 bp, Artificial Sequence; identical to SEQ ID NO: 235512
  Description of Artificial Sequence: Synthetic oligonucleotide

SEQ ID NO: 361813 - DNA, 25 bp, Artificial Sequence
  Description of Artificial Sequence: Synthetic oligonucleotide
ggctgcgcagatacctggagaacgg

SEQ ID NO: 361814 - DNA, 32 bp, Artificial Sequence; identical to SEQ ID NO: 235513
  Description of Artificial Sequence: Synthetic oligonucleotide

SEQ ID NO: 361815 - DNA, 27 bp, Artificial Sequence
  Description of Artificial Sequence: Synthetic oligonucleotide
gctgcgcagatacctggagaacgggaa

SEQ ID NO: 361816 - DNA, 31 bp, Artificial Sequence; identical to SEQ ID NO: 235514
  Description of Artificial Sequence: Synthetic oligonucleotide

SEQ ID NO: 361817 - DNA, 27 bp, Artificial Sequence
  Description of Artificial Sequence: Synthetic oligonucleotide
ctgcgcagatacctggagaacgggaag

SEQ ID NO: 361818 - DNA, 32 bp, Artificial Sequence; identical to SEQ ID NO: 235515
  Description of Artificial Sequence: Synthetic oligonucleotide

SEQ ID NO: 361819 - DNA, 27 bp, Artificial Sequence
  Description of Artificial Sequence: Synthetic oligonucleotide
tgcgcagatacctggagaacgggaagg

SEQ ID NO: 361820 - DNA, 31 bp, Artificial Sequence; identical to SEQ ID NO: 235516
  Description of Artificial Sequence: Synthetic oligonucleotide

SEQ ID NO: 361821 - DNA, 27 bp, Artificial Sequence
  Description of Artificial Sequence: Synthetic oligonucleotide
gcgcagatacctggagaacgggaagga

SEQ ID NO: 361822 - DNA, 31 bp, Artificial Sequence; identical to SEQ ID NO: 235517
  Description of Artificial Sequence: Synthetic oligonucleotide

SEQ ID NO: 361823 - DNA, 27 bp, Artificial Sequence
  Description of Artificial Sequence: Synthetic oligonucleotide
ggcggacatggcagctcagaccacaaa

SEQ ID NO: 361824 - DNA, 31 bp, Artificial Sequence; identical to SEQ ID NO: 235518
  Description of Artificial Sequence: Synthetic oligonucleotide

SEQ ID NO: 361825 - DNA, 27 bp, Artificial Sequence
  Description of Artificial Sequence: Synthetic oligonucleotide
gcggacatggcagctcagaccacaaag

SEQ ID NO: 361826 - DNA, 30 bp, Artificial Sequence; identical to SEQ ID NO: 235519
  Description of Artificial Sequence: Synthetic oligonucleotide

SEQ ID NO: 361827 - DNA, 27 bp, Artificial Sequence
  Description of Artificial Sequence: Synthetic oligonucleotide
cggacatggcagctcagaccacaaagc

SEQ ID NO: 361828 - DNA, 31 bp, Artificial Sequence; identical to SEQ ID NO: 235520
  Description of Artificial Sequence: Synthetic oligonucleotide

SEQ ID NO: 361829 - DNA, 28 bp, Artificial Sequence
  Description of Artificial Sequence: Synthetic oligonucleotide
ggacatggcagctcagaccacaaagcac

SEQ ID NO: 361830 - DNA, 32 bp, Artificial Sequence; identical to SEQ ID NO: 235521
  Description of Artificial Sequence: Synthetic oligonucleotide

SEQ ID NO: 361831 - DNA, 30 bp, Artificial Sequence
  Description of Artificial Sequence: Synthetic oligonucleotide
gacatggcagctcagaccacaaagcacaag

SEQ ID NO: 361832 - DNA, 31 bp, Artificial Sequence; identical to SEQ ID NO: 235522
  Description of Artificial Sequence: Synthetic oligonucleotide

SEQ ID NO: 361833 - DNA, 31 bp, Artificial Sequence
  Description of Artificial Sequence: Synthetic oligonucleotide
acatggcagctcagaccacaaagcacaagtg

SEQ ID NO: 361834 - DNA, 31 bp, Artificial Sequence; identical to SEQ ID NO: 235523
  Description of Artificial Sequence: Synthetic oligonucleotide

SEQ ID NO: 361835 - DNA, 30 bp, Artificial Sequence
  Description of Artificial Sequence: Synthetic oligonucleotide
catggcagctcagaccacaaagcacaagtg

SEQ ID NO: 361836 - DNA, 30 bp, Artificial Sequence; identical to SEQ ID NO: 235524
  Description of Artificial Sequence: Synthetic oligonucleotide

SEQ ID NO: 361837 - DNA, 30 bp, Artificial Sequence
  Description of Artificial Sequence: Synthetic oligonucleotide
atggcagctcagaccacaaagcacaagtgg

SEQ ID NO: 361838 - DNA, 29 bp, Artificial Sequence
  Description of Artificial Sequence: Synthetic oligonucleotide
tgggcaagcctttacctttgagggtcagg

SEQ ID NO: 361839 - DNA, 29 bp, Artificial Sequence
  Description of Artificial Sequence: Synthetic oligonucleotide
tggcagctcagaccacaaagcacaagtgg

SEQ ID NO: 361840 - DNA, 28 bp, Artificial Sequence
  Description of Artificial Sequence: Synthetic oligonucleotide
gggcaagcctttacctttgagggtcagg

SEQ ID NO: 361841 - DNA, 28 bp, Artificial Sequence
  Description of Artificial Sequence: Synthetic oligonucleotide
ggcagctcagaccacaaagcacaagtgg

SEQ ID NO: 361842 - DNA, 28 bp, Artificial Sequence
  Description of Artificial Sequence: Synthetic oligonucleotide
ggcaagcctttacctttgagggtcaggg

SEQ ID NO: 361843 - DNA, 28 bp, Artificial Sequence
  Description of Artificial Sequence: Synthetic oligonucleotide
gcagctcagaccacaaagcacaagtggg

SEQ ID NO: 361844 - DNA, 28 bp, Artificial Sequence
  Description of Artificial Sequence: Synthetic oligonucleotide
gcaagcctttacctttgagggtcagggc

SEQ ID NO: 361845 - DNA, 29 bp, Artificial Sequence
  Description of Artificial Sequence: Synthetic oligonucleotide
cagctcagaccacaaagcacaagtgggag

SEQ ID NO: 361846 - DNA, 28 bp, Artificial Sequence
  Description of Artificial Sequence: Synthetic oligonucleotide
caagcctttacctttgagggtcagggcg

SEQ ID NO: 361847 - DNA, 29 bp, Artificial Sequence
  Description of Artificial Sequence: Synthetic oligonucleotide
agctcagaccacaaagcacaagtgggagg

SEQ ID NO: 361848 - DNA, 28 bp, Artificial Sequence
  Description of Artificial Sequence: Synthetic oligonucleotide
aagcctttacctttgagggtcagggcgg

SEQ ID NO: 361849 - DNA, 28 bp, Artificial Sequence
  Description of Artificial Sequence: Synthetic oligonucleotide
gctcagaccacaaagcacaagtgggagg

SEQ ID NO: 361850 - DNA, 27 bp, Artificial Sequence
  Description of Artificial Sequence: Synthetic oligonucleotide
agcctttacctttgagggtcagggcgg

SEQ ID NO: 361851 - DNA, 28 bp, Artificial Sequence
  Description of Artificial Sequence: Synthetic oligonucleotide
ctcagaccacaaagcacaagtgggaggc

SEQ ID NO: 361852 - DNA, 26 bp, Artificial Sequence
  Description of Artificial Sequence: Synthetic oligonucleotide
gcctttacctttgagggtcagggcgg

SEQ ID NO: 361853 - DNA, 28 bp, Artificial Sequence
  Description of Artificial Sequence: Synthetic oligonucleotide
tcagaccacaaagcacaagtgggaggcg

SEQ ID NO: 361854 - DNA, 26 bp, Artificial Sequence
  Description of Artificial Sequence: Synthetic oligonucleotide
cctttacctttgagggtcagggcggc

SEQ ID NO: 361855 - DNA, 27 bp, Artificial Sequence
  Description of Artificial Sequence: Synthetic oligonucleotide
cagaccacaaagcacaagtgggaggcg

SEQ ID NO: 361856 - DNA, 27 bp, Artificial Sequence
  Description of Artificial Sequence: Synthetic oligonucleotide
ctttacctttgagggtcagggcggcct

SEQ ID NO: 361857 - DNA, 27 bp, Artificial Sequence
  Description of Artificial Sequence: Synthetic oligonucleotide
agaccacaaagcacaagtgggaggcgg

SEQ ID NO: 361858 - DNA, 27 bp, Artificial Sequence
  Description of Artificial Sequence: Synthetic oligonucleotide
tttacctttgagggtcagggcggcctg

SEQ ID NO: 361859 - DNA, 26 bp, Artificial Sequence
  Description of Artificial Sequence: Synthetic oligonucleotide
gaccacaaagcacaagtgggaggcgg

SEQ ID NO: 361860 - DNA, 26 bp, Artificial Sequence
  Description of Artificial Sequence: Synthetic oligonucleotide
ttacctttgagggtcagggcggcctg

SEQ ID NO: 361861 - DNA, 26 bp, Artificial Sequence
  Description of Artificial Sequence: Synthetic oligonucleotide
accacaaagcacaagtgggaggcggc

SEQ ID NO: 361862 - DNA, 25 bp, Artificial Sequence
  Description of Artificial Sequence: Synthetic oligonucleotide
tacctttgagggtcagggcggcctg

SEQ ID NO: 361863 - DNA, 25 bp, Artificial Sequence
  Description of Artificial Sequence: Synthetic oligonucleotide
ccacaaagcacaagtgggaggcggc

SEQ ID NO: 361864 - DNA, 24 bp, Artificial Sequence
  Description of Artificial Sequence: Synthetic oligonucleotide
acctttgagggtcagggcggcctg

SEQ ID NO: 361865 - DNA, 25 bp, Artificial Sequence
  Description of Artificial Sequence: Synthetic oligonucleotide
cacaaagcacaagtgggaggcggcc

SEQ ID NO: 361866 - DNA, 23 bp, Artificial Sequence
  Description of Artificial Sequence: Synthetic oligonucleotide
cctttgagggtcagggcggcctg

SEQ ID NO: 361867 - DNA, 27 bp, Artificial Sequence
  Description of Artificial Sequence: Synthetic oligonucleotide
acaaagcacaagtgggaggcggcccat

SEQ ID NO: 361868 - DNA, 23 bp, Artificial Sequence
  Description of Artificial Sequence: Synthetic oligonucleotide
ctttgagggtcagggcggcctgg

SEQ ID NO: 361869 - DNA, 26 bp, Artificial Sequence
  Description of Artificial Sequence: Synthetic oligonucleotide
caaagcacaagtgggaggcggcccat

SEQ ID NO: 361870 - DNA, 26 bp, Artificial Sequence
  Description of Artificial Sequence: Synthetic oligonucleotide
tttgagggtcagggcggcctggctaa

SEQ ID NO: 361871 - DNA, 27 bp, Artificial Sequence
  Description of Artificial Sequence: Synthetic oligonucleotide
aaagcacaagtgggaggcggcccatgt

SEQ ID NO: 361872 - DNA, 25 bp, Artificial Sequence
  Description of Artificial Sequence: Synthetic oligonucleotide
ttgagggtcagggcggcctggctaa

SEQ ID NO: 361873 - DNA, 27 bp, Artificial Sequence
  Description of Artificial Sequence: Synthetic oligonucleotide
cggagtattgggacggggagacacgaa

SEQ ID NO: 361874 - DNA, 24 bp, Artificial Sequence
  Description of Artificial Sequence: Synthetic oligonucleotide
tgagggtcagggcggcctggctaa

SEQ ID NO: 361875 - DNA, 29 bp, Artificial Sequence
  Description of Artificial Sequence: Synthetic oligonucleotide
ggagtattgggacggggagacacgaaaag

SEQ ID NO: 361876 - DNA, 23 bp, Artificial Sequence
  Description of Artificial Sequence: Synthetic oligonucleotide
gagggtcagggcggcctggctaa

SEQ ID NO: 361877 - DNA, 30 bp, Artificial Sequence
  Description of Artificial Sequence: Synthetic oligonucleotide
gagtattgggacggggagacacgaaaagtg

SEQ ID NO: 361878 - DNA, 26 bp, Artificial Sequence
  Description of Artificial Sequence: Synthetic oligonucleotide
agggtcagggcggcctggctaacttt

SEQ ID NO: 361879 - DNA, 32 bp, Artificial Sequence
  Description of Artificial Sequence: Synthetic oligonucleotide
agtattgggacggggagacacgaaaagtgaag

SEQ ID NO: 361880 - DNA, 25 bp, Artificial Sequence
  Description of Artificial Sequence: Synthetic oligonucleotide
gggtcagggcggcctggctaacttt

SEQ ID NO: 361881 - DNA, 31 bp, Artificial Sequence
  Description of Artificial Sequence: Synthetic oligonucleotide
gtattgggacggggagacacgaaaagtgaag

SEQ ID NO: 361882 - DNA, 25 bp, Artificial Sequence
  Description of Artificial Sequence: Synthetic oligonucleotide
ggtcagggcggcctggctaactttg

SEQ ID NO: 361883 - DNA, 31 bp, Artificial Sequence
  Description of Artificial Sequence: Synthetic oligonucleotide
tattgggacggggagacacgaaaagtgaagg

SEQ ID NO: 361884 - DNA, 27 bp, Artificial Sequence
  Description of Artificial Sequence: Synthetic oligonucleotide
gtcagggcggcctggctaactttgcta

SEQ ID NO: 361885 - DNA, 30 bp, Artificial Sequence
  Description of Artificial Sequence: Synthetic oligonucleotide
attgggacggggagacacgaaaagtgaagg

SEQ ID NO: 361886 - DNA, 31 bp, Artificial Sequence; identical to SEQ ID NO: 235549
  Description of Artificial Sequence: Synthetic oligonucleotide

SEQ ID NO: 361887 - DNA, 29 bp, Artificial Sequence
  Description of Artificial Sequence: Synthetic oligonucleotide
ttgggacggggagacacgaaaagtgaagg

SEQ ID NO: 361888 - DNA, 30 bp, Artificial Sequence; identical to SEQ ID NO: 235550
  Description of Artificial Sequence: Synthetic oligonucleotide

SEQ ID NO: 361889 - DNA, 28 bp, Artificial Sequence
  Description of Artificial Sequence: Synthetic oligonucleotide
tgggacggggagacacgaaaagtgaagg

SEQ ID NO: 361890 - DNA, 32 bp, Artificial Sequence; identical to SEQ ID NO: 235551
  Description of Artificial Sequence: Synthetic oligonucleotide

SEQ ID NO: 361891 - DNA, 27 bp, Artificial Sequence
  Description of Artificial Sequence: Synthetic oligonucleotide
gggacggggagacacgaaaagtgaagg

SEQ ID NO: 361892 - DNA, 31 bp, Artificial Sequence; identical to SEQ ID NO: 235552
  Description of Artificial Sequence: Synthetic oligonucleotide

SEQ ID NO: 361893 - DNA, 27 bp, Artificial Sequence
  Description of Artificial Sequence: Synthetic oligonucleotide
ggacggggagacacgaaaagtgaaggc

SEQ ID NO: 361894 - DNA, 33 bp, Artificial Sequence; identical to SEQ ID NO: 235553
  Description of Artificial Sequence: Synthetic oligonucleotide

SEQ ID NO: 361895 - DNA, 27 bp, Artificial Sequence
  Description of Artificial Sequence: Synthetic oligonucleotide
gacggggagacacgaaaagtgaaggcc

SEQ ID NO: 361896 - DNA, 35 bp, Artificial Sequence; identical to SEQ ID NO: 235554
  Description of Artificial Sequence: Synthetic oligonucleotide

SEQ ID NO: 361897 - DNA, 27 bp, Artificial Sequence
  Description of Artificial Sequence: Synthetic oligonucleotide
acggggagacacgaaaagtgaaggccc

SEQ ID NO: 361898 - DNA, 37 bp, Artificial Sequence; identical to SEQ ID NO: 235555
  Description of Artificial Sequence: Synthetic oligonucleotide

SEQ ID NO: 361899 - DNA, 27 bp, Artificial Sequence
  Description of Artificial Sequence: Synthetic oligonucleotide
cggggagacacgaaaagtgaaggccca

SEQ ID NO: 361900 - DNA, 41 bp, Artificial Sequence; identical to SEQ ID NO: 235556
  Description of Artificial Sequence: Synthetic oligonucleotide

SEQ ID NO: 361901 - DNA, 27 bp, Artificial Sequence
  Description of Artificial Sequence: Synthetic oligonucleotide
ggggagacacgaaaagtgaaggcccac

SEQ ID NO: 361902 - DNA, 41 bp, Artificial Sequence; identical to SEQ ID NO: 235557
  Description of Artificial Sequence: Synthetic oligonucleotide

SEQ ID NO: 361903 - DNA, 28 bp, Artificial Sequence
  Description of Artificial Sequence: Synthetic oligonucleotide
gggagacacgaaaagtgaaggcccactc

SEQ ID NO: 361904 - DNA, 43 bp, Artificial Sequence; identical to SEQ ID NO: 235558
  Description of Artificial Sequence: Synthetic oligonucleotide

SEQ ID NO: 361905 - DNA, 29 bp, Artificial Sequence
  Description of Artificial Sequence: Synthetic oligonucleotide
ggagacacgaaaagtgaaggcccactcac

SEQ ID NO: 361906 - DNA, 45 bp, Artificial Sequence; identical to SEQ ID NO: 235559
  Description of Artificial Sequence: Synthetic oligonucleotide

SEQ ID NO: 361907 - DNA, 30 bp, Artificial Sequence
  Description of Artificial Sequence: Synthetic oligonucleotide
gagacacgaaaagtgaaggcccactcacag

SEQ ID NO: 361908 - DNA, 45 bp, Artificial Sequence; identical to SEQ ID NO: 235560
  Description of Artificial Sequence: Synthetic oligonucleotide

SEQ ID NO: 361909 - DNA, 31 bp, Artificial Sequence
  Description of Artificial Sequence: Synthetic oligonucleotide
agacacgaaaagtgaaggcccactcacagac

SEQ ID NO: 361910 - DNA, 44 bp, Artificial Sequence; identical to SEQ ID NO: 235561
  Description of Artificial Sequence: Synthetic oligonucleotide

SEQ ID NO: 361911 - DNA, 30 bp, Artificial Sequence
  Description of Artificial Sequence: Synthetic oligonucleotide
gacacgaaaagtgaaggcccactcacagac

SEQ ID NO: 361912 - DNA, 45 bp, Artificial Sequence; identical to SEQ ID NO: 235562
  Description of Artificial Sequence: Synthetic oligonucleotide

SEQ ID NO: 361913 - DNA, 31 bp, Artificial Sequence
  Description of Artificial Sequence: Synthetic oligonucleotide
acacgaaaagtgaaggcccactcacagactc

SEQ ID NO: 361914 - DNA, 45 bp, Artificial Sequence; identical to SEQ ID NO: 235563
  Description of Artificial Sequence: Synthetic oligonucleotide

SEQ ID NO: 361915 - DNA, 30 bp, Artificial Sequence
  Description of Artificial Sequence: Synthetic oligonucleotide
cacgaaaagtgaaggcccactcacagactc

SEQ ID NO: 361916 - DNA, 45 bp, Artificial Sequence; identical to SEQ ID NO: 235564
  Description of Artificial Sequence: Synthetic oligonucleotide

SEQ ID NO: 361917 - DNA, 31 bp, Artificial Sequence
  Description of Artificial Sequence: Synthetic oligonucleotide
acgaaaagtgaaggcccactcacagactcac

SEQ ID NO: 361918 - DNA, 44 bp, Artificial Sequence; identical to SEQ ID NO: 235565
  Description of Artificial Sequence: Synthetic oligonucleotide

SEQ ID NO: 361919 - DNA, 30 bp, Artificial Sequence
  Description of Artificial Sequence: Synthetic oligonucleotide
cgaaaagtgaaggcccactcacagactcac

SEQ ID NO: 361920 - DNA, 43 bp, Artificial Sequence; identical to SEQ ID NO: 235566
  Description of Artificial Sequence: Synthetic oligonucleotide

SEQ ID NO: 361921 - DNA, 30 bp, Artificial Sequence
  Description of Artificial Sequence: Synthetic oligonucleotide
gaaaagtgaaggcccactcacagactcacc

SEQ ID NO: 361922 - DNA, 42 bp, Artificial Sequence; identical to SEQ ID NO: 235567
  Description of Artificial Sequence: Synthetic oligonucleotide

SEQ ID NO: 361923 - DNA, 30 bp, Artificial Sequence
  Description of Artificial Sequence: Synthetic oligonucleotide
aaaagtgaaggcccactcacagactcaccg

SEQ ID NO: 361924 - DNA, 44 bp, Artificial Sequence; identical to SEQ ID NO: 235568
  Description of Artificial Sequence: Synthetic oligonucleotide

SEQ ID NO: 361925 - DNA, 27 bp, Artificial Sequence
  Description of Artificial Sequence: Synthetic oligonucleotide
aaccagagcgaggccggttctcacaca

SEQ ID NO: 361926 - DNA, 43 bp, Artificial Sequence; identical to SEQ ID NO: 235569
  Description of Artificial Sequence: Synthetic oligonucleotide

SEQ ID NO: 361927 - DNA, 26 bp, Artificial Sequence
  Description of Artificial Sequence: Synthetic oligonucleotide
accagagcgaggccggttctcacaca

SEQ ID NO: 361928 - DNA, 42 bp, Artificial Sequence; identical to SEQ ID NO: 235570
  Description of Artificial Sequence: Synthetic oligonucleotide

SEQ ID NO: 361929 - DNA, 25 bp, Artificial Sequence
  Description of Artificial Sequence: Synthetic oligonucleotide
ccagagcgaggccggttctcacaca

SEQ ID NO: 361930 - DNA, 41 bp, Artificial Sequence; identical to SEQ ID NO: 235571
  Description of Artificial Sequence: Synthetic oligonucleotide

SEQ ID NO: 361931 - DNA, 26 bp, Artificial Sequence
  Description of Artificial Sequence: Synthetic oligonucleotide
cagagcgaggccggttctcacacagt

SEQ ID NO: 361932 - DNA, 41 bp, Artificial Sequence; identical to SEQ ID NO: 235572
  Description of Artificial Sequence: Synthetic oligonucleotide

SEQ ID NO: 361933 - DNA, 26 bp, Artificial Sequence
  Description of Artificial Sequence: Synthetic oligonucleotide
agagcgaggccggttctcacacagtc

SEQ ID NO: 361934 - DNA, 43 bp, Artificial Sequence; identical to SEQ ID NO: 235573
  Description of Artificial Sequence: Synthetic oligonucleotide

SEQ ID NO: 361935 - DNA, 25 bp, Artificial Sequence
  Description of Artificial Sequence: Synthetic oligonucleotide
gagcgaggccggttctcacacagtc

SEQ ID NO: 361936 - DNA, 42 bp, Artificial Sequence; identical to SEQ ID NO: 235574
  Description of Artificial Sequence: Synthetic oligonucleotide

SEQ ID NO: 361937 - DNA, 26 bp, Artificial Sequence
  Description of Artificial Sequence: Synthetic oligonucleotide
agcgaggccggttctcacacagtcca

SEQ ID NO: 361938 - DNA, 41 bp, Artificial Sequence; identical to SEQ ID NO: 235575
  Description of Artificial Sequence: Synthetic oligonucleotide

SEQ ID NO: 361939 - DNA, 25 bp, Artificial Sequence
  Description of Artificial Sequence: Synthetic oligonucleotide
gcgaggccggttctcacacagtcca

SEQ ID NO: 361940 - DNA, 40 bp, Artificial Sequence; identical to SEQ ID NO: 235576
  Description of Artificial Sequence: Synthetic oligonucleotide
